United States Patent 11,459,587 (MATERIALS AND METHODS FOR TREATMENT OF PAIN RELATED DISORDERS) - sequence listing, part 4

SEQ ID NO: 39968 - DNA, 20 bp, Artificial Sequence
  Description of Artificial Sequence: Synthetic oligonucleotide
  Target: SCN9A; (+) strand; PAM type: NRG; PAM sequence: GGG
gtaaccaaaagagagcaatg

SEQ ID NO: 39969 - DNA, 20 bp, Artificial Sequence
  Description of Artificial Sequence: Synthetic oligonucleotide
  Target: SCN9A; (+) strand; PAM type: NRG; PAM sequence: CAG
aagagagcaatggggctata

SEQ ID NO: 39970 - DNA, 20 bp, Artificial Sequence
  Description of Artificial Sequence: Synthetic oligonucleotide
  Target: SCN9A; (+) strand; PAM type: NRG; PAM sequence: CAG
ggggctatacagtcgtcctt

SEQ ID NO: 39971 - DNA, 20 bp, Artificial Sequence
  Description of Artificial Sequence: Synthetic oligonucleotide
  Target: SCN9A; (+) strand; PAM type: NRG; PAM sequence: CAG
cagtcgtccttcagtatcta

SEQ ID NO: 39972 - DNA, 20 bp, Artificial Sequence
  Description of Artificial Sequence: Synthetic oligonucleotide
  Target: SCN9A; (+) strand; PAM type: NRG; PAM sequence: AGG
agtcgtccttcagtatctac

SEQ ID NO: 39973 - DNA, 20 bp, Artificial Sequence
  Description of Artificial Sequence: Synthetic oligonucleotide
  Target: SCN9A; (+) strand; PAM type: NRG; PAM sequence: GGG
gtcgtccttcagtatctaca

SEQ ID NO: 39974 - DNA, 20 bp, Artificial Sequence
  Description of Artificial Sequence: Synthetic oligonucleotide
  Target: SCN9A; (+) strand; PAM type: NRG; PAM sequence: TGG
cttcagtatctacagggtca

SEQ ID NO: 39975 - DNA, 20 bp, Artificial Sequence
  Description of Artificial Sequence: Synthetic oligonucleotide
  Target: SCN9A; (+) strand; PAM type: NRG; PAM sequence: CAG
tatctacagggtcatggttt

SEQ ID NO: 39976 - DNA, 20 bp, Artificial Sequence
  Description of Artificial Sequence: Synthetic oligonucleotide
  Target: SCN9A; (+) strand; PAM type: NRG; PAM sequence: AAG
ggtcatggtttcagaacccc

SEQ ID NO: 39977 - DNA, 20 bp, Artificial Sequence
  Description of Artificial Sequence: Synthetic oligonucleotide
  Target: SCN9A; (+) strand; PAM type: NRG; PAM sequence: AGG
gtcatggtttcagaacccca

SEQ ID NO: 39978 - DNA, 20 bp, Artificial Sequence
  Description of Artificial Sequence: Synthetic oligonucleotide
  Target: SCN9A; (+) strand; PAM type: NRG; PAM sequence: GGG
tcatggtttcagaaccccaa

SEQ ID NO: 39979 - DNA, 20 bp, Artificial Sequence
  Description of Artificial Sequence: Synthetic oligonucleotide
  Target: SCN9A; (+) strand; PAM type: NRG; PAM sequence: GAG
ccccaagggataccaaaatt

SEQ ID NO: 39980 - DNA, 20 bp, Artificial Sequence
  Description of Artificial Sequence: Synthetic oligonucleotide
  Target: SCN9A; (+) strand; PAM type: NRG; PAM sequence: AGG
cccaagggataccaaaattg

SEQ ID NO: 39981 - DNA, 20 bp, Artificial Sequence
  Description of Artificial Sequence: Synthetic oligonucleotide
  Target: SCN9A; (+) strand; PAM type: NRG; PAM sequence: AAG
taccaaaattgaggatgctt

SEQ ID NO: 39982 - DNA, 20 bp, Artificial Sequence
  Description of Artificial Sequence: Synthetic oligonucleotide
  Target: SCN9A; (+) strand; PAM type: NRG; PAM sequence: CAG
ttgaggatgcttaagtccca

SEQ ID NO: 39983 - DNA, 20 bp, Artificial Sequence
  Description of Artificial Sequence: Synthetic oligonucleotide
  Target: SCN9A; (+) strand; PAM type: NRG; PAM sequence: CAG
ggatgcttaagtcccacagt

SEQ ID NO: 39984 - DNA, 20 bp, Artificial Sequence
  Description of Artificial Sequence: Synthetic oligonucleotide
  Target: SCN9A; (+) strand; PAM type: NRG; PAM sequence: CAG
aagtcccacagtcagtcttg

SEQ ID NO: 39985 - DNA, 20 bp, Artificial Sequence
  Description of Artificial Sequence: Synthetic oligonucleotide
  Target: SCN9A; (+) strand; PAM type: NRG; PAM sequence: AGG
agtcccacagtcagtcttgc

SEQ ID NO: 39986 - DNA, 20 bp, Artificial Sequence
  Description of Artificial Sequence: Synthetic oligonucleotide
  Target: SCN9A; (+) strand; PAM type: NRG; PAM sequence: TGG
agtcagtcttgcaggacctg

SEQ ID NO: 39987 - DNA, 20 bp, Artificial Sequence
  Description of Artificial Sequence: Synthetic oligonucleotide
  Target: SCN9A; (+) strand; PAM type: NRG; PAM sequence: TGG
aatttgaccctctgtatctg

SEQ ID NO: 39988 - DNA, 20 bp, Artificial Sequence
  Description of Artificial Sequence: Synthetic oligonucleotide
  Target: SCN9A; (+) strand; PAM type: NRG; PAM sequence: CAG
gatttcacattccatgaata

SEQ ID NO: 39989 - DNA, 20 bp, Artificial Sequence
  Description of Artificial Sequence: Synthetic oligonucleotide
  Target: SCN9A; (+) strand; PAM type: NRG; PAM sequence: CAG
atgaatacagtgttttcaat

SEQ ID NO: 39990 - DNA, 20 bp, Artificial Sequence
  Description of Artificial Sequence: Synthetic oligonucleotide
  Target: SCN9A; (+) strand; PAM type: NRG; PAM sequence: TGG
acagtgttttcaatcagcat

SEQ ID NO: 39991 - DNA, 20 bp, Artificial Sequence
  Description of Artificial Sequence: Synthetic oligonucleotide
  Target: SCN9A; (+) strand; PAM type: NRG; PAM sequence: CAG
atcagcattggctgaatcta

SEQ ID NO: 39992 - DNA, 20 bp, Artificial Sequence
  Description of Artificial Sequence: Synthetic oligonucleotide
  Target: SCN9A; (+) strand; PAM type: NRG; PAM sequence: CAG
atctacagatgtaaaaccca

SEQ ID NO: 39993 - DNA, 20 bp, Artificial Sequence
  Description of Artificial Sequence: Synthetic oligonucleotide
  Target: SCN9A; (+) strand; PAM type: NRG; PAM sequence: CAG
agatgtaaaacccacagaca

SEQ ID NO: 39994 - DNA, 20 bp, Artificial Sequence
  Description of Artificial Sequence: Synthetic oligonucleotide
  Target: SCN9A; (+) strand; PAM type: NRG; PAM sequence: GAG
atgtaaaacccacagacaca

SEQ ID NO: 39995 - DNA, 20 bp, Artificial Sequence
  Description of Artificial Sequence: Synthetic oligonucleotide
  Target: SCN9A; (+) strand; PAM type: NRG; PAM sequence: AGG
tgtaaaacccacagacacag

SEQ ID NO: 39996 - DNA, 20 bp, Artificial Sequence
  Description of Artificial Sequence: Synthetic oligonucleotide
  Target: SCN9A; (+) strand; PAM type: NRG; PAM sequence: CAG
aggacaccctgtaattatat

SEQ ID NO: 39997 - DNA, 20 bp, Artificial Sequence
  Description of Artificial Sequence: Synthetic oligonucleotide
  Target: SCN9A; (+) strand; PAM type: NRG; PAM sequence: TAG
tgtaattatatcagccaaaa

SEQ ID NO: 39998 - DNA, 20 bp, Artificial Sequence
  Description of Artificial Sequence: Synthetic oligonucleotide
  Target: SCN9A; (+) strand; PAM type: NRG; PAM sequence: AAG
tttaaataaaaaactgtcac

SEQ ID NO: 39999 - DNA, 20 bp, Artificial Sequence
  Description of Artificial Sequence: Synthetic oligonucleotide
  Target: SCN9A; (+) strand; PAM type: NRG; PAM sequence: GAG
taaataaaaaactgtcacaa

SEQ ID NO: 40000 - DNA, 20 bp, Artificial Sequence
  Description of Artificial Sequence: Synthetic oligonucleotide
  Target: SCN9A; (+) strand; PAM type: NRG; PAM sequence: AAG
aaaaactgtcacaagagaca

SEQ ID NO: 40001 - DNA, 20 bp, Artificial Sequence
  Description of Artificial Sequence: Synthetic oligonucleotide
  Target: SCN9A; (+) strand; PAM type: NRG; PAM sequence: TAG
aactgtcacaagagacaaag

SEQ ID NO: 40002 - DNA, 20 bp, Artificial Sequence
  Description of Artificial Sequence: Synthetic oligonucleotide
  Target: SCN9A; (+) strand; PAM type: NRG; PAM sequence: AGG
actgtcacaagagacaaagt

SEQ ID NO: 40003 - DNA, 20 bp, Artificial Sequence
  Description of Artificial Sequence: Synthetic oligonucleotide
  Target: SCN9A; (+) strand; PAM type: NRG; PAM sequence: AAG
gacaaagtaggtcataaaat

SEQ ID NO: 40004 - DNA, 20 bp, Artificial Sequence
  Description of Artificial Sequence: Synthetic oligonucleotide
  Target: SCN9A; (+) strand; PAM type: NRG; PAM sequence: AAG
taggtcataaaataagataa

SEQ ID NO: 40005 - DNA, 20 bp, Artificial Sequence
  Description of Artificial Sequence: Synthetic oligonucleotide
  Target: SCN9A; (+) strand; PAM type: NRG; PAM sequence: GAG
ggtcataaaataagataaaa

SEQ ID NO: 40006 - DNA, 20 bp, Artificial Sequence
  Description of Artificial Sequence: Synthetic oligonucleotide
  Target: SCN9A; (+) strand; PAM type: NRG; PAM sequence: AAG
gataaaagagttaattcatc

SEQ ID NO: 40007 - DNA, 20 bp, Artificial Sequence
  Description of Artificial Sequence: Synthetic oligonucleotide
  Target: SCN9A; (+) strand; PAM type: NRG; PAM sequence: AAG
aaaagagttaattcatcaag

SEQ ID NO: 40008 - DNA, 20 bp, Artificial Sequence
  Description of Artificial Sequence: Synthetic oligonucleotide
  Target: SCN9A; (+) strand; PAM type: NRG; PAM sequence: AAG
tatatgtgaatccatcatca

SEQ ID NO: 40009 - DNA, 20 bp, Artificial Sequence
  Description of Artificial Sequence: Synthetic oligonucleotide
  Target: SCN9A; (+) strand; PAM type: NRG; PAM sequence: AAG
tcaaagcatgtaaatacgta

SEQ ID NO: 40010 - DNA, 20 bp, Artificial Sequence
  Description of Artificial Sequence: Synthetic oligonucleotide
  Target: SCN9A; (+) strand; PAM type: NRG; PAM sequence: CAG
atacgtaaagcaatcattga

SEQ ID NO: 40011 - DNA, 20 bp, Artificial Sequence
  Description of Artificial Sequence: Synthetic oligonucleotide
  Target: SCN9A; (+) strand; PAM type: NRG; PAM sequence: AAG
agcaatcattgacagatctg

SEQ ID NO: 40012 - DNA, 20 bp, Artificial Sequence
  Description of Artificial Sequence: Synthetic oligonucleotide
  Target: SCN9A; (+) strand; PAM type: NRG; PAM sequence: AGG
gcaatcattgacagatctga

SEQ ID NO: 40013 - DNA, 20 bp, Artificial Sequence
  Description of Artificial Sequence: Synthetic oligonucleotide
  Target: SCN9A; (+) strand; PAM type: NRG; PAM sequence: GGG
caatcattgacagatctgaa

SEQ ID NO: 40014 - DNA, 20 bp, Artificial Sequence
  Description of Artificial Sequence: Synthetic oligonucleotide
  Target: SCN9A; (+) strand; PAM type: NRG; PAM sequence: CAG
gatctgaagggataaacatg

SEQ ID NO: 40015 - DNA, 20 bp, Artificial Sequence
  Description of Artificial Sequence: Synthetic oligonucleotide
  Target: SCN9A; (+) strand; PAM type: NRG; PAM sequence: CAG
aacatgcagcaacaccataa

SEQ ID NO: 40016 - DNA, 20 bp, Artificial Sequence
  Description of Artificial Sequence: Synthetic oligonucleotide
  Target: SCN9A; (+) strand; PAM type: NRG; PAM sequence: TAG
atgcagcaacaccataacag

SEQ ID NO: 40017 - DNA, 20 bp, Artificial Sequence
  Description of Artificial Sequence: Synthetic oligonucleotide
  Target: SCN9A; (+) strand; PAM type: NRG; PAM sequence: AGG
tgcagcaacaccataacagt

SEQ ID NO: 40018 - DNA, 20 bp, Artificial Sequence
  Description of Artificial Sequence: Synthetic oligonucleotide
  Target: SCN9A; (+) strand; PAM type: NRG; PAM sequence: CAG
acccgacttgcaataatgaa

SEQ ID NO: 40019 - DNA, 20 bp, Artificial Sequence
  Description of Artificial Sequence: Synthetic oligonucleotide
  Target: SCN9A; (+) strand; PAM type: NRG; PAM sequence: CAG
acttgcaataatgaacagaa

SEQ ID NO: 40020 - DNA, 20 bp, Artificial Sequence
  Description of Artificial Sequence: Synthetic oligonucleotide
  Target: SCN9A; (+) strand; PAM type: NRG; PAM sequence: CAG
gcaataatgaacagaacagc

SEQ ID NO: 40021 - DNA, 20 bp, Artificial Sequence
  Description of Artificial Sequence: Synthetic oligonucleotide
  Target: SCN9A; (+) strand; PAM type: NRG; PAM sequence: TGG
atgaacagaacagccagata

SEQ ID NO: 40022 - DNA, 20 bp, Artificial Sequence
  Description of Artificial Sequence: Synthetic oligonucleotide
  Target: SCN9A; (+) strand; PAM type: NRG; PAM sequence: TGG
tggaatctataaacaaactg

SEQ ID NO: 40023 - DNA, 20 bp, Artificial Sequence
  Description of Artificial Sequence: Synthetic oligonucleotide
  Target: SCN9A; (+) strand; PAM type: NRG; PAM sequence: TAG
tgtggatttgaacaacgcta

SEQ ID NO: 40024 - DNA, 20 bp, Artificial Sequence
  Description of Artificial Sequence: Synthetic oligonucleotide
  Target: SCN9A; (+) strand; PAM type: NRG; PAM sequence: TGG
gaacaacgctatagaccaaa

SEQ ID NO: 40025 - DNA, 20 bp, Artificial Sequence
  Description of Artificial Sequence: Synthetic oligonucleotide
  Target: SCN9A; (+) strand; PAM type: NRG; PAM sequence: CAG
ccaaatggatcacaaacaca

SEQ ID NO: 40026 - DNA, 20 bp, Artificial Sequence
  Description of Artificial Sequence: Synthetic oligonucleotide
  Target: SCN9A; (+) strand; PAM type: NRG; PAM sequence: CAG
acacagaatatgctacccaa

SEQ ID NO: 40027 - DNA, 20 bp, Artificial Sequence
  Description of Artificial Sequence: Synthetic oligonucleotide
  Target: SCN9A; (+) strand; PAM type: NRG; PAM sequence: AAG
tcttaatataccatcttttc

SEQ ID NO: 40028 - DNA, 20 bp, Artificial Sequence
  Description of Artificial Sequence: Synthetic oligonucleotide
  Target: SCN9A; (+) strand; PAM type: NRG; PAM sequence: CAG
accatcttttcaagtgcgca

SEQ ID NO: 40029 - DNA, 20 bp, Artificial Sequence
  Description of Artificial Sequence: Synthetic oligonucleotide
  Target: SCN9A; (+) strand; PAM type: NRG; PAM sequence: CAG
aagtgcgcacagaatattct

SEQ ID NO: 40030 - DNA, 20 bp, Artificial Sequence
  Description of Artificial Sequence: Synthetic oligonucleotide
  Target: SCN9A; (+) strand; PAM type: NRG; PAM sequence: AGG
agtgcgcacagaatattctc

SEQ ID NO: 40031 - DNA, 20 bp, Artificial Sequence
  Description of Artificial Sequence: Synthetic oligonucleotide
  Target: SCN9A; (+) strand; PAM type: NRG; PAM sequence: TAG
cgcacagaatattctcagga

SEQ ID NO: 40032 - DNA, 20 bp, Artificial Sequence
  Description of Artificial Sequence: Synthetic oligonucleotide
  Target: SCN9A; (+) strand; PAM type: NRG; PAM sequence: CAG
tctcaggatagatcacatat

SEQ ID NO: 40033 - DNA, 20 bp, Artificial Sequence
  Description of Artificial Sequence: Synthetic oligonucleotide
  Target: SCN9A; (+) strand; PAM type: NRG; PAM sequence: AGG
ctcaggatagatcacatatc

SEQ ID NO: 40034 - DNA, 20 bp, Artificial Sequence
  Description of Artificial Sequence: Synthetic oligonucleotide
  Target: SCN9A; (+) strand; PAM type: NRG; PAM sequence: AAG
agatcacatatcaggtcatg

SEQ ID NO: 40035 - DNA, 20 bp, Artificial Sequence
  Description of Artificial Sequence: Synthetic oligonucleotide
  Target: SCN9A; (+) strand; PAM type: NRG; PAM sequence: AAG
agtttgttttgacaactgtt

SEQ ID NO: 40036 - DNA, 20 bp, Artificial Sequence
  Description of Artificial Sequence: Synthetic oligonucleotide
  Target: SCN9A; (+) strand; PAM type: NRG; PAM sequence: AAG
ttgttttgacaactgttaag

SEQ ID NO: 40037 - DNA, 20 bp, Artificial Sequence
  Description of Artificial Sequence: Synthetic oligonucleotide
  Target: SCN9A; (+) strand; PAM type: NRG; PAM sequence: CAG
ttaagaagttgaaatcatac

SEQ ID NO: 40038 - DNA, 20 bp, Artificial Sequence
  Description of Artificial Sequence: Synthetic oligonucleotide
  Target: SCN9A; (+) strand; PAM type: NRG; PAM sequence: TGG
gatatcttttatgaccacaa

SEQ ID NO: 40039 - DNA, 20 bp, Artificial Sequence
  Description of Artificial Sequence: Synthetic oligonucleotide
  Target: SCN9A; (+) strand; PAM type: NRG; PAM sequence: AAG
atcttttatgaccacaatgg

SEQ ID NO: 40040 - DNA, 20 bp, Artificial Sequence
  Description of Artificial Sequence: Synthetic oligonucleotide
  Target: SCN9A; (+) strand; PAM type: NRG; PAM sequence: AGG
tcttttatgaccacaatgga

SEQ ID NO: 40041 - DNA, 20 bp, Artificial Sequence
  Description of Artificial Sequence: Synthetic oligonucleotide
  Target: SCN9A; (+) strand; PAM type: NRG; PAM sequence: TGG
tgaccacaatggaaggaaac

SEQ ID NO: 40042 - DNA, 20 bp, Artificial Sequence
  Description of Artificial Sequence: Synthetic oligonucleotide
  Target: SCN9A; (+) strand; PAM type: NRG; PAM sequence: AAG
ccacaatggaaggaaactgg

SEQ ID NO: 40043 - DNA, 20 bp, Artificial Sequence
  Description of Artificial Sequence: Synthetic oligonucleotide
  Target: SCN9A; (+) strand; PAM type: NRG; PAM sequence: CAG
aatggaaggaaactggaagt

SEQ ID NO: 40044 - DNA, 20 bp, Artificial Sequence
  Description of Artificial Sequence: Synthetic oligonucleotide
  Target: SCN9A; (+) strand; PAM type: NRG; PAM sequence: TAG
aggaaactggaagtcagtaa

SEQ ID NO: 40045 - DNA, 20 bp, Artificial Sequence
  Description of Artificial Sequence: Synthetic oligonucleotide
  Target: SCN9A; (+) strand; PAM type: NRG; PAM sequence: AAG
aaactggaagtcagtaatag

SEQ ID NO: 40046 - DNA, 20 bp, Artificial Sequence
  Description of Artificial Sequence: Synthetic oligonucleotide
  Target: SCN9A; (+) strand; PAM type: NRG; PAM sequence: AGG
aactggaagtcagtaataga

SEQ ID NO: 40047 - DNA, 20 bp, Artificial Sequence
  Description of Artificial Sequence: Synthetic oligonucleotide
  Target: SCN9A; (+) strand; PAM type: NRG; PAM sequence: TGG
ctgaaaaattcacaaatatg

SEQ ID NO: 40048 - DNA, 20 bp, Artificial Sequence
  Description of Artificial Sequence: Synthetic oligonucleotide
  Target: SCN9A; (+) strand; PAM type: NRG; PAM sequence: AAG
taaacaacactctcttgaaa

SEQ ID NO: 40049 - DNA, 20 bp, Artificial Sequence
  Description of Artificial Sequence: Synthetic oligonucleotide
  Target: SCN9A; (+) strand; PAM type: NRG; PAM sequence: TGG
acactctcttgaaaaagcaa

SEQ ID NO: 40050 - DNA, 20 bp, Artificial Sequence
  Description of Artificial Sequence: Synthetic oligonucleotide
  Target: SCN9A; (+) strand; PAM type: NRG; PAM sequence: GGG
cactctcttgaaaaagcaat

SEQ ID NO: 40051 - DNA, 20 bp, Artificial Sequence
  Description of Artificial Sequence: Synthetic oligonucleotide
  Target: SCN9A; (+) strand; PAM type: NRG; PAM sequence: AAG
cttgaaaaagcaatgggtca

SEQ ID NO: 40052 - DNA, 20 bp, Artificial Sequence
  Description of Artificial Sequence: Synthetic oligonucleotide
  Target: SCN9A; (+) strand; PAM type: NRG; PAM sequence: TAG
ggtcaaagaaaaaaaatcaa

SEQ ID NO: 40053 - DNA, 20 bp, Artificial Sequence
  Description of Artificial Sequence: Synthetic oligonucleotide
  Target: SCN9A; (+) strand; PAM type: NRG; PAM sequence: AGG
gtcaaagaaaaaaaatcaat

SEQ ID NO: 40054 - DNA, 20 bp, Artificial Sequence
  Description of Artificial Sequence: Synthetic oligonucleotide
  Target: SCN9A; (+) strand; PAM type: NRG; PAM sequence: AAG
aaatcaataggaaaatttaa

SEQ ID NO: 40055 - DNA, 20 bp, Artificial Sequence
  Description of Artificial Sequence: Synthetic oligonucleotide
  Target: SCN9A; (+) strand; PAM type: NRG; PAM sequence: AAG
cttgaaacaaacaaaaatga

SEQ ID NO: 40056 - DNA, 20 bp, Artificial Sequence
  Description of Artificial Sequence: Synthetic oligonucleotide
  Target: SCN9A; (+) strand; PAM type: NRG; PAM sequence: GAG
gcacaatttccaaaatttat

SEQ ID NO: 40057 - DNA, 20 bp, Artificial Sequence
  Description of Artificial Sequence: Synthetic oligonucleotide
  Target: SCN9A; (+) strand; PAM type: NRG; PAM sequence: CAG
tttccaaaatttatgagatg

SEQ ID NO: 40058 - DNA, 20 bp, Artificial Sequence
  Description of Artificial Sequence: Synthetic oligonucleotide
  Target: SCN9A; (+) strand; PAM type: NRG; PAM sequence: AAG
aaatttatgagatgcagcaa

SEQ ID NO: 40059 - DNA, 20 bp, Artificial Sequence
  Description of Artificial Sequence: Synthetic oligonucleotide
  Target: SCN9A; (+) strand; PAM type: NRG; PAM sequence: CAG
tttatgagatgcagcaaaag

SEQ ID NO: 40060 - DNA, 20 bp, Artificial Sequence
  Description of Artificial Sequence: Synthetic oligonucleotide
  Target: SCN9A; (+) strand; PAM type: NRG; PAM sequence: AAG
tgcagcaaaagcagtaataa

SEQ ID NO: 40061 - DNA, 20 bp, Artificial Sequence
  Description of Artificial Sequence: Synthetic oligonucleotide
  Target: SCN9A; (+) strand; PAM type: NRG; PAM sequence: GAG
taataaaagcaaatcttatt

SEQ ID NO: 40062 - DNA, 20 bp, Artificial Sequence
  Description of Artificial Sequence: Synthetic oligonucleotide
  Target: SCN9A; (+) strand; PAM type: NRG; PAM sequence: AAG
atacatgtctacattataaa

SEQ ID NO: 40063 - DNA, 20 bp, Artificial Sequence
  Description of Artificial Sequence: Synthetic oligonucleotide
  Target: SCN9A; (+) strand; PAM type: NRG; PAM sequence: TAG
aatatctcatataaacaata

SEQ ID NO: 40064 - DNA, 20 bp, Artificial Sequence
  Description of Artificial Sequence: Synthetic oligonucleotide
  Target: SCN9A; (+) strand; PAM type: NRG; PAM sequence: TAG
acaatatagatttacatgtc

SEQ ID NO: 40065 - DNA, 20 bp, Artificial Sequence
  Description of Artificial Sequence: Synthetic oligonucleotide
  Target: SCN9A; (+) strand; PAM type: NRG; PAM sequence: AGG
caatatagatttacatgtct

SEQ ID NO: 40066 - DNA, 20 bp, Artificial Sequence
  Description of Artificial Sequence: Synthetic oligonucleotide
  Target: SCN9A; (+) strand; PAM type: NRG; PAM sequence: TAG
agatttacatgtctaggaac

SEQ ID NO: 40067 - DNA, 20 bp, Artificial Sequence
  Description of Artificial Sequence: Synthetic oligonucleotide
  Target: SCN9A; (+) strand; PAM type: NRG; PAM sequence: AAG
acatgtctaggaactagaaa

SEQ ID NO: 40068 - DNA, 20 bp, Artificial Sequence
  Description of Artificial Sequence: Synthetic oligonucleotide
  Target: SCN9A; (+) strand; PAM type: NRG; PAM sequence: AAG
aactagaaaaagaacaaact

SEQ ID NO: 40069 - DNA, 20 bp, Artificial Sequence
  Description of Artificial Sequence: Synthetic oligonucleotide
  Target: SCN9A; (+) strand; PAM type: NRG; PAM sequence: CAG
gaacaaactaagcccaacat

SEQ ID NO: 40070 - DNA, 20 bp, Artificial Sequence
  Description of Artificial Sequence: Synthetic oligonucleotide
  Target: SCN9A; (+) strand; PAM type: NRG; PAM sequence: AAG
actaagcccaacatcagcaa

SEQ ID NO: 40071 - DNA, 20 bp, Artificial Sequence
  Description of Artificial Sequence: Synthetic oligonucleotide
  Target: SCN9A; (+) strand; PAM type: NRG; PAM sequence: AGG
ctaagcccaacatcagcaaa

SEQ ID NO: 40072 - DNA, 20 bp, Artificial Sequence
  Description of Artificial Sequence: Synthetic oligonucleotide
  Target: SCN9A; (+) strand; PAM type: NRG; PAM sequence: AAG
agcccaacatcagcaaaagg

SEQ ID NO: 40073 - DNA, 20 bp, Artificial Sequence
  Description of Artificial Sequence: Synthetic oligonucleotide
  Target: SCN9A; (+) strand; PAM type: NRG; PAM sequence: AGG
gcccaacatcagcaaaagga

SEQ ID NO: 40074 - DNA, 20 bp, Artificial Sequence
  Description of Artificial Sequence: Synthetic oligonucleotide
  Target: SCN9A; (+) strand; PAM type: NRG; PAM sequence: AAG
agcaaaaggaaggaaataat

SEQ ID NO: 40075 - DNA, 20 bp, Artificial Sequence
  Description of Artificial Sequence: Synthetic oligonucleotide
  Target: SCN9A; (+) strand; PAM type: NRG; PAM sequence: TAG
aggaaggaaataataagtat

SEQ ID NO: 40076 - DNA, 20 bp, Artificial Sequence
  Description of Artificial Sequence: Synthetic oligonucleotide
  Target: SCN9A; (+) strand; PAM type: NRG; PAM sequence: GAG
gaaggaaataataagtatta

SEQ ID NO: 40077 - DNA, 20 bp, Artificial Sequence
  Description of Artificial Sequence: Synthetic oligonucleotide
  Target: SCN9A; (+) strand; PAM type: NRG; PAM sequence: AAG
aaataataagtattagagct

SEQ ID NO: 40078 - DNA, 20 bp, Artificial Sequence
  Description of Artificial Sequence: Synthetic oligonucleotide
  Target: SCN9A; (+) strand; PAM type: NRG; PAM sequence: AAG
aataagtattagagctaagt

SEQ ID NO: 40079 - DNA, 20 bp, Artificial Sequence
  Description of Artificial Sequence: Synthetic oligonucleotide
  Target: SCN9A; (+) strand; PAM type: NRG; PAM sequence: TAG
ttagagctaagtaagtgaaa

SEQ ID NO: 40080 - DNA, 20 bp, Artificial Sequence
  Description of Artificial Sequence: Synthetic oligonucleotide
  Target: SCN9A; (+) strand; PAM type: NRG; PAM sequence: GAG
agagctaagtaagtgaaata

SEQ ID NO: 40081 - DNA, 20 bp, Artificial Sequence
  Description of Artificial Sequence: Synthetic oligonucleotide
  Target: SCN9A; (+) strand; PAM type: NRG; PAM sequence: AAG
aagtgaaatagagaataaaa

SEQ ID NO: 40082 - DNA, 20 bp, Artificial Sequence
  Description of Artificial Sequence: Synthetic oligonucleotide
  Target: SCN9A; (+) strand; PAM type: NRG; PAM sequence: TAG
aatagagaataaaaaagcaa

SEQ ID NO: 40083 - DNA, 20 bp, Artificial Sequence
  Description of Artificial Sequence: Synthetic oligonucleotide
  Target: SCN9A; (+) strand; PAM type: NRG; PAM sequence: AAG
gaataaaaaagcaatagaaa

SEQ ID NO: 40084 - DNA, 20 bp, Artificial Sequence
  Description of Artificial Sequence: Synthetic oligonucleotide
  Target: SCN9A; (+) strand; PAM type: NRG; PAM sequence: AAG
tagaaaaagtcaacaaaact

SEQ ID NO: 40085 - DNA, 20 bp, Artificial Sequence
  Description of Artificial Sequence: Synthetic oligonucleotide
  Target: SCN9A; (+) strand; PAM type: NRG; PAM sequence: TGG
aagtcaacaaaactaagaat

SEQ ID NO: 40086 - DNA, 20 bp, Artificial Sequence
  Description of Artificial Sequence: Synthetic oligonucleotide
  Target: SCN9A; (+) strand; PAM type: NRG; PAM sequence: AAG
ctaagaattggttttttcga

SEQ ID NO: 40087 - DNA, 20 bp, Artificial Sequence
  Description of Artificial Sequence: Synthetic oligonucleotide
  Target: SCN9A; (+) strand; PAM type: NRG; PAM sequence: TAG
ggttttttcgaaagataaaa

SEQ ID NO: 40088 - DNA, 20 bp, Artificial Sequence
  Description of Artificial Sequence: Synthetic oligonucleotide
  Target: SCN9A; (+) strand; PAM type: NRG; PAM sequence: TAG
agataaaatagacaaatcct

SEQ ID NO: 40089 - DNA, 20 bp, Artificial Sequence
  Description of Artificial Sequence: Synthetic oligonucleotide
  Target: SCN9A; (+) strand; PAM type: NRG; PAM sequence: AAG
aaaatagacaaatccttagc

SEQ ID NO: 40090 - DNA, 20 bp, Artificial Sequence
  Description of Artificial Sequence: Synthetic oligonucleotide
  Target: SCN9A; (+) strand; PAM type: NRG; PAM sequence: AAG
aatccttagcaagcataact

SEQ ID NO: 40091 - DNA, 20 bp, Artificial Sequence
  Description of Artificial Sequence: Synthetic oligonucleotide
  Target: SCN9A; (+) strand; PAM type: NRG; PAM sequence: AAG
agcaagcataactaagaaaa

SEQ ID NO: 40092 - DNA, 20 bp, Artificial Sequence
  Description of Artificial Sequence: Synthetic oligonucleotide
  Target: SCN9A; (+) strand; PAM type: NRG; PAM sequence: TAG
agcataactaagaaaaaaga

SEQ ID NO: 40093 - DNA, 20 bp, Artificial Sequence
  Description of Artificial Sequence: Synthetic oligonucleotide
  Target: SCN9A; (+) strand; PAM type: NRG; PAM sequence: GAG
cataactaagaaaaaagata

SEQ ID NO: 40094 - DNA, 20 bp, Artificial Sequence
  Description of Artificial Sequence: Synthetic oligonucleotide
  Target: SCN9A; (+) strand; PAM type: NRG; PAM sequence: AGG
ataactaagaaaaaagatag

SEQ ID NO: 40095 - DNA, 20 bp, Artificial Sequence
  Description of Artificial Sequence: Synthetic oligonucleotide
  Target: SCN9A; (+) strand; PAM type: NRG; PAM sequence: CAG
aggactcaaatatgtaaaac

SEQ ID NO: 40096 - DNA, 20 bp, Artificial Sequence
  Description of Artificial Sequence: Synthetic oligonucleotide
  Target: SCN9A; (+) strand; PAM type: NRG; PAM sequence: AAG
atatgtaaaaccagaaatga

SEQ ID NO: 40097 - DNA, 20 bp, Artificial Sequence
  Description of Artificial Sequence: Synthetic oligonucleotide
  Target: SCN9A; (+) strand; PAM type: NRG; PAM sequence: GAG
atgtaaaaccagaaatgaaa

SEQ ID NO: 40098 - DNA, 20 bp, Artificial Sequence
  Description of Artificial Sequence: Synthetic oligonucleotide
  Target: SCN9A; (+) strand; PAM type: NRG; PAM sequence: AGG
tgtaaaaccagaaatgaaag

SEQ ID NO: 40099 - DNA, 20 bp, Artificial Sequence
  Description of Artificial Sequence: Synthetic oligonucleotide
  Target: SCN9A; (+) strand; PAM type: NRG; PAM sequence: GAG
taaaaccagaaatgaaagag

SEQ ID NO: 40100 - DNA, 20 bp, Artificial Sequence
  Description of Artificial Sequence: Synthetic oligonucleotide
  Target: SCN9A; (+) strand; PAM type: NRG; PAM sequence: TGG
agaatttacaactgatttta

SEQ ID NO: 40101 - DNA, 20 bp, Artificial Sequence
  Description of Artificial Sequence: Synthetic oligonucleotide
  Target: SCN9A; (+) strand; PAM type: NRG; PAM sequence: GGG
gaatttacaactgattttat

SEQ ID NO: 40102 - DNA, 20 bp, Artificial Sequence
  Description of Artificial Sequence: Synthetic oligonucleotide
  Target: SCN9A; (+) strand; PAM type: NRG; PAM sequence: AAG
acaactgattttatgggaat

SEQ ID NO: 40103 - DNA, 20 bp, Artificial Sequence
  Description of Artificial Sequence: Synthetic oligonucleotide
  Target: SCN9A; (+) strand; PAM type: NRG; PAM sequence: AAG
actgattttatgggaataag

SEQ ID NO: 40104 - DNA, 20 bp, Artificial Sequence
  Description of Artificial Sequence: Synthetic oligonucleotide
  Target: SCN9A; (+) strand; PAM type: NRG; PAM sequence: AGG
ctgattttatgggaataaga

SEQ ID NO: 40105 - DNA, 20 bp, Artificial Sequence
  Description of Artificial Sequence: Synthetic oligonucleotide
  Target: SCN9A; (+) strand; PAM type: NRG; PAM sequence: AAG
tatgggaataagaaggatca

SEQ ID NO: 40106 - DNA, 20 bp, Artificial Sequence
  Description of Artificial Sequence: Synthetic oligonucleotide
  Target: SCN9A; (+) strand; PAM type: NRG; PAM sequence: GAG
tgggaataagaaggatcaaa

SEQ ID NO: 40107 - DNA, 20 bp, Artificial Sequence
  Description of Artificial Sequence: Synthetic oligonucleotide
  Target: SCN9A; (+) strand; PAM type: NRG; PAM sequence: TGG
acaattatacaccaacaaat

SEQ ID NO: 40108 - DNA, 20 bp, Artificial Sequence
  Description of Artificial Sequence: Synthetic oligonucleotide
  Target: SCN9A; (+) strand; PAM type: NRG; PAM sequence: TAG
caccaacaaattggataact

SEQ ID NO: 40109 - DNA, 20 bp, Artificial Sequence
  Description of Artificial Sequence: Synthetic oligonucleotide
  Target: SCN9A; (+) strand; PAM type: NRG; PAM sequence: AAG
caacaaattggataacttag

SEQ ID NO: 40110 - DNA, 20 bp, Artificial Sequence
  Description of Artificial Sequence: Synthetic oligonucleotide
  Target: SCN9A; (+) strand; PAM type: NRG; PAM sequence: AGG
aacaaattggataacttaga

SEQ ID NO: 40111 - DNA, 20 bp, Artificial Sequence
  Description of Artificial Sequence: Synthetic oligonucleotide
  Target: SCN9A; (+) strand; PAM type: NRG; PAM sequence: TAG
attggataacttagaaggaa

SEQ ID NO: 40112 - DNA, 20 bp, Artificial Sequence
  Description of Artificial Sequence: Synthetic oligonucleotide
  Target: SCN9A; (+) strand; PAM type: NRG; PAM sequence: AGG
ttggataacttagaaggaat

SEQ ID NO: 40113 - DNA, 20 bp, Artificial Sequence
  Description of Artificial Sequence: Synthetic oligonucleotide
  Target: SCN9A; (+) strand; PAM type: NRG; PAM sequence: AAG
ccaaaaatatacaacctacc

SEQ ID NO: 40114 - DNA, 20 bp, Artificial Sequence
  Description of Artificial Sequence: Synthetic oligonucleotide
  Target: SCN9A; (+) strand; PAM type: NRG; PAM sequence: GAG
acctaccaagactgaatcat

SEQ ID NO: 40115 - DNA, 20 bp, Artificial Sequence
  Description of Artificial Sequence: Synthetic oligonucleotide
  Target: SCN9A; (+) strand; PAM type: NRG; PAM sequence: AGG
cctaccaagactgaatcatg

SEQ ID NO: 40116 - DNA, 20 bp, Artificial Sequence
  Description of Artificial Sequence: Synthetic oligonucleotide
  Target: SCN9A; (+) strand; PAM type: NRG; PAM sequence: TAG
aagactgaatcatgaggaaa

SEQ ID NO: 40117 - DNA, 20 bp, Artificial Sequence
  Description of Artificial Sequence: Synthetic oligonucleotide
  Target: SCN9A; (+) strand; PAM type: NRG; PAM sequence: TAG
gaggaaatagaataactgaa

SEQ ID NO: 40118 - DNA, 20 bp, Artificial Sequence
  Description of Artificial Sequence: Synthetic oligonucleotide
  Target: SCN9A; (+) strand; PAM type: NRG; PAM sequence: TAG
aataataataatgataatga

SEQ ID NO: 40119 - DNA, 20 bp, Artificial Sequence
  Description of Artificial Sequence: Synthetic oligonucleotide
  Target: SCN9A; (+) strand; PAM type: NRG; PAM sequence: AAG
aatgatagtaactcccaaaa

SEQ ID NO: 40120 - DNA, 20 bp, Artificial Sequence
  Description of Artificial Sequence: Synthetic oligonucleotide
  Target: SCN9A; (+) strand; PAM type: NRG; PAM sequence: CAG
actcccaaaaaagaaatgta

SEQ ID NO: 40121 - DNA, 20 bp, Artificial Sequence
  Description of Artificial Sequence: Synthetic oligonucleotide
  Target: SCN9A; (+) strand; PAM type: NRG; PAM sequence: AGG
ctcccaaaaaagaaatgtac

SEQ ID NO: 40122 - DNA, 20 bp, Artificial Sequence
  Description of Artificial Sequence: Synthetic oligonucleotide
  Target: SCN9A; (+) strand; PAM type: NRG; PAM sequence: CAG
aaaaaagaaatgtacaggac

SEQ ID NO: 40123 - DNA, 20 bp, Artificial Sequence
  Description of Artificial Sequence: Synthetic oligonucleotide
  Target: SCN9A; (+) strand; PAM type: NRG; PAM sequence: CGG
aagaaatgtacaggaccaga

SEQ ID NO: 40124 - DNA, 20 bp, Artificial Sequence
  Description of Artificial Sequence: Synthetic oligonucleotide
  Target: SCN9A; (+) strand; PAM type: NRG; PAM sequence: TGG
acaggaccagacggcttctc

SEQ ID NO: 40125 - DNA, 20 bp, Artificial Sequence
  Description of Artificial Sequence: Synthetic oligonucleotide
  Target: SCN9A; (+) strand; PAM type: NRG; PAM sequence: GAG
aggaccagacggcttctctg

SEQ ID NO: 40126 - DNA, 20 bp, Artificial Sequence
  Description of Artificial Sequence: Synthetic oligonucleotide
  Target: SCN9A; (+) strand; PAM type: NRG; PAM sequence: AAG
accagacggcttctctggag

SEQ ID NO: 40127 - DNA, 20 bp, Artificial Sequence
  Description of Artificial Sequence: Synthetic oligonucleotide
  Target: SCN9A; (+) strand; PAM type: NRG; PAM sequence: AAG
gaagtccaaccaaacattta

SEQ ID NO: 40128 - DNA, 20 bp, Artificial Sequence
  Description of Artificial Sequence: Synthetic oligonucleotide
  Target: SCN9A; (+) strand; PAM type: NRG; PAM sequence: AAG
gtccaaccaaacatttaaag

SEQ ID NO: 40129 - DNA, 20 bp, Artificial Sequence
  Description of Artificial Sequence: Synthetic oligonucleotide
  Target: SCN9A; (+) strand; PAM type: NRG; PAM sequence: AAG
caaactctcttaaaactttg

SEQ ID NO: 40130 - DNA, 20 bp, Artificial Sequence
  Description of Artificial Sequence: Synthetic oligonucleotide
  Target: SCN9A; (+) strand; PAM type: NRG; PAM sequence: GAG
aactctcttaaaactttgaa

SEQ ID NO: 40131 - DNA, 20 bp, Artificial Sequence
  Description of Artificial Sequence: Synthetic oligonucleotide
  Target: SCN9A; (+) strand; PAM type: NRG; PAM sequence: AGG
actctcttaaaactttgaag

SEQ ID NO: 40132 - DNA, 20 bp, Artificial Sequence
  Description of Artificial Sequence: Synthetic oligonucleotide
  Target: SCN9A; (+) strand; PAM type: NRG; PAM sequence: AAG
tcttaaaactttgaagagga

SEQ ID NO: 40133 - DNA, 20 bp, Artificial Sequence
  Description of Artificial Sequence: Synthetic oligonucleotide
  Target: SCN9A; (+) strand; PAM type: NRG; PAM sequence: AAG
aagaggaaagaacacttcga

SEQ ID NO: 40134 - DNA, 20 bp, Artificial Sequence
  Description of Artificial Sequence: Synthetic oligonucleotide
  Target: SCN9A; (+) strand; PAM type: NRG; PAM sequence: TGG
acacttcgaaagtcatttta

SEQ ID NO: 40135 - DNA, 20 bp, Artificial Sequence
  Description of Artificial Sequence: Synthetic oligonucleotide
  Target: SCN9A; (+) strand; PAM type: NRG; PAM sequence: GGG
cacttcgaaagtcattttat

SEQ ID NO: 40136 - DNA, 20 bp, Artificial Sequence
  Description of Artificial Sequence: Synthetic oligonucleotide
  Target: SCN9A; (+) strand; PAM type: NRG; PAM sequence: GGG
acttcgaaagtcattttatg

SEQ ID NO: 40137 - DNA, 20 bp, Artificial Sequence
  Description of Artificial Sequence: Synthetic oligonucleotide
  Target: SCN9A; (+) strand; PAM type: NRG; PAM sequence: CAG
cgaaagtcattttatggggc

SEQ ID NO: 40138 - DNA, 20 bp, Artificial Sequence
  Description of Artificial Sequence: Synthetic oligonucleotide
  Target: SCN9A; (+) strand; PAM type: NRG; PAM sequence: AAG
ccagaattattctcatatca

SEQ ID NO: 40139 - DNA, 20 bp, Artificial Sequence
  Description of Artificial Sequence: Synthetic oligonucleotide
  Target: SCN9A; (+) strand; PAM type: NRG; PAM sequence: CAG
aattattctcatatcaaagc

SEQ ID NO: 40140 - DNA, 20 bp, Artificial Sequence
  Description of Artificial Sequence: Synthetic oligonucleotide
  Target: SCN9A; (+) strand; PAM type: NRG; PAM sequence: AAG
tctcatatcaaagccagaca

SEQ ID NO: 40141 - DNA, 20 bp, Artificial Sequence
  Description of Artificial Sequence: Synthetic oligonucleotide
  Target: SCN9A; (+) strand; PAM type: NRG; PAM sequence: AAG
aagccagacaaagacactgt

SEQ ID NO: 40142 - DNA, 20 bp, Artificial Sequence
  Description of Artificial Sequence: Synthetic oligonucleotide
  Target: SCN9A; (+) strand; PAM type: NRG; PAM sequence: AAG
agacaaagacactgtaagaa

SEQ ID NO: 40143 - DNA, 20 bp, Artificial Sequence
  Description of Artificial Sequence: Synthetic oligonucleotide
  Target: SCN9A; (+) strand; PAM type: NRG; PAM sequence: CAG
actgtaagaaaagaaaatta

SEQ ID NO: 40144 - DNA, 20 bp, Artificial Sequence
  Description of Artificial Sequence: Synthetic oligonucleotide
  Target: SCN9A; (+) strand; PAM type: NRG; PAM sequence: AAG
aaagaaaattacagcttttg

SEQ ID NO: 40145 - DNA, 20 bp, Artificial Sequence
  Description of Artificial Sequence: Synthetic oligonucleotide
  Target: SCN9A; (+) strand; PAM type: NRG; PAM sequence: AGG
aagaaaattacagcttttga

SEQ ID NO: 40146 - DNA, 20 bp, Artificial Sequence
  Description of Artificial Sequence: Synthetic oligonucleotide
  Target: SCN9A; (+) strand; PAM type: NRG; PAM sequence: AAG
aaaattacagcttttgaagg

SEQ ID NO: 40147 - DNA, 20 bp, Artificial Sequence
  Description of Artificial Sequence: Synthetic oligonucleotide
  Target: SCN9A; (+) strand; PAM type: NRG; PAM sequence: CAG
gcttttgaaggaagtgactt

SEQ ID NO: 40148 - DNA, 20 bp, Artificial Sequence
  Description of Artificial Sequence: Synthetic oligonucleotide
  Target: SCN9A; (+) strand; PAM type: NRG; PAM sequence: TGG
aagtgacttcagcaacattg

SEQ ID NO: 40149 - DNA, 20 bp, Artificial Sequence
  Description of Artificial Sequence: Synthetic oligonucleotide
  Target: SCN9A; (+) strand; PAM type: NRG; PAM sequence: TAG
acttcagcaacattgtggaa

SEQ ID NO: 40150 - DNA, 20 bp, Artificial Sequence
  Description of Artificial Sequence: Synthetic oligonucleotide
  Target: SCN9A; (+) strand; PAM type: NRG; PAM sequence: AGG
cttcagcaacattgtggaat

SEQ ID NO: 40151 - DNA, 20 bp, Artificial Sequence
  Description of Artificial Sequence: Synthetic oligonucleotide
  Target: SCN9A; (+) strand; PAM type: NRG; PAM sequence: GAG
tcagcaacattgtggaatag

SEQ ID NO: 40152 - DNA, 20 bp, Artificial Sequence
  Description of Artificial Sequence: Synthetic oligonucleotide
  Target: SCN9A; (+) strand; PAM type: NRG; PAM sequence: AGG
cagcaacattgtggaatagg

SEQ ID NO: 40153 - DNA, 20 bp, Artificial Sequence
  Description of Artificial Sequence: Synthetic oligonucleotide
  Target: SCN9A; (+) strand; PAM type: NRG; PAM sequence: TGG
tatgactattttttctctca

SEQ ID NO: 40154 - DNA, 20 bp, Artificial Sequence
  Description of Artificial Sequence: Synthetic oligonucleotide
  Target: SCN9A; (+) strand; PAM type: NRG; PAM sequence: AAG
ttttctctcatggacgtacc

SEQ ID NO: 40155 - DNA, 20 bp, Artificial Sequence
  Description of Artificial Sequence: Synthetic oligonucleotide
  Target: SCN9A; (+) strand; PAM type: NRG; PAM sequence: TGG
agtaaacatctacatacaca

SEQ ID NO: 40156 - DNA, 20 bp, Artificial Sequence
  Description of Artificial Sequence: Synthetic oligonucleotide
  Target: SCN9A; (+) strand; PAM type: NRG; PAM sequence: CAG
acatctacatacacatggat

SEQ ID NO: 40157 - DNA, 20 bp, Artificial Sequence
  Description of Artificial Sequence: Synthetic oligonucleotide
  Target: SCN9A; (+) strand; PAM type: NRG; PAM sequence: CAG
acacatggatcagttctctc

SEQ ID NO: 40158 - DNA, 20 bp, Artificial Sequence
  Description of Artificial Sequence: Synthetic oligonucleotide
  Target: SCN9A; (+) strand; PAM type: NRG; PAM sequence: GAG
acatggatcagttctctcca

SEQ ID NO: 40159 - DNA, 20 bp, Artificial Sequence
  Description of Artificial Sequence: Synthetic oligonucleotide
  Target: SCN9A; (+) strand; PAM type: NRG; PAM sequence: CAG
cagttctctccagagaaacc

SEQ ID NO: 40160 - DNA, 20 bp, Artificial Sequence
  Description of Artificial Sequence: Synthetic oligonucleotide
  Target: SCN9A; (+) strand; PAM type: NRG; PAM sequence: CAG
ctccagagaaacccagaatc

SEQ ID NO: 40161 - DNA, 20 bp, Artificial Sequence
  Description of Artificial Sequence: Synthetic oligonucleotide
  Target: SCN9A; (+) strand; PAM type: NRG; PAM sequence: TAG
cagagaaacccagaatccag

SEQ ID NO: 40162 - DNA, 20 bp, Artificial Sequence
  Description of Artificial Sequence: Synthetic oligonucleotide
  Target: SCN9A; (+) strand; PAM type: NRG; PAM sequence: CAG
gtagaaaaactcatgcacac

SEQ ID NO: 40163 - DNA, 20 bp, Artificial Sequence
  Description of Artificial Sequence: Synthetic oligonucleotide
  Target: SCN9A; (+) strand; PAM type: NRG; PAM sequence: GAG
agaaaaactcatgcacacca

SEQ ID NO: 40164 - DNA, 20 bp, Artificial Sequence
  Description of Artificial Sequence: Synthetic oligonucleotide
  Target: SCN9A; (+) strand; PAM type: NRG; PAM sequence: AGG
gaaaaactcatgcacaccag

SEQ ID NO: 40165 - DNA, 20 bp, Artificial Sequence
  Description of Artificial Sequence: Synthetic oligonucleotide
  Target: SCN9A; (+) strand; PAM type: NRG; PAM sequence: CAG
aactcatgcacaccagagga

SEQ ID NO: 40166 - DNA, 20 bp, Artificial Sequence
  Description of Artificial Sequence: Synthetic oligonucleotide
  Target: SCN9A; (+) strand; PAM type: NRG; PAM sequence: TGG
agaaaatacccatatcaaaa

SEQ ID NO: 40167 - DNA, 20 bp, Artificial Sequence
  Description of Artificial Sequence: Synthetic oligonucleotide
  Target: SCN9A; (+) strand; PAM type: NRG; PAM sequence: GGG
gaaaatacccatatcaaaat

SEQ ID NO: 40168 - DNA, 20 bp, Artificial Sequence
  Description of Artificial Sequence: Synthetic oligonucleotide
  Target: SCN9A; (+) strand; PAM type: NRG; PAM sequence: TAG
aatacccatatcaaaatggg

SEQ ID NO: 40169 - DNA, 20 bp, Artificial Sequence
  Description of Artificial Sequence: Synthetic oligonucleotide
  Target: SCN9A; (+) strand; PAM type: NRG; PAM sequence: AAG
catatcaaaatgggtagaaa

SEQ ID NO: 40170 - DNA, 20 bp, Artificial Sequence
  Description of Artificial Sequence: Synthetic oligonucleotide
  Target: SCN9A; (+) strand; PAM type: NRG; PAM sequence: TGG
atcaaaatgggtagaaaaag

SEQ ID NO: 40171 - DNA, 20 bp, Artificial Sequence
  Description of Artificial Sequence: Synthetic oligonucleotide
  Target: SCN9A; (+) strand; PAM type: NRG; PAM sequence: AAG
aaatgggtagaaaaagtgga

SEQ ID NO: 40172 - DNA, 20 bp, Artificial Sequence
  Description of Artificial Sequence: Synthetic oligonucleotide
  Target: SCN9A; (+) strand; PAM type: NRG; PAM sequence: GAG
tcatgcactaaccccaccct

SEQ ID NO: 40173 - DNA, 20 bp, Artificial Sequence
  Description of Artificial Sequence: Synthetic oligonucleotide
  Target: SCN9A; (+) strand; PAM type: NRG; PAM sequence: CAG
cactaaccccaccctgagca

SEQ ID NO: 40174 - DNA, 20 bp, Artificial Sequence
  Description of Artificial Sequence: Synthetic oligonucleotide
  Target: SCN9A; (+) strand; PAM type: NRG; PAM sequence: TGG
tgagcacagtgccttacatt

SEQ ID NO: 40175 - DNA, 20 bp, Artificial Sequence
  Description of Artificial Sequence: Synthetic oligonucleotide
  Target: SCN9A; (+) strand; PAM type: NRG; PAM sequence: GGG
gagcacagtgccttacattt

SEQ ID NO: 40176 - DNA, 20 bp, Artificial Sequence
  Description of Artificial Sequence: Synthetic oligonucleotide
  Target: SCN9A; (+) strand; PAM type: NRG; PAM sequence: AAG
cacagtgccttacatttggg

SEQ ID NO: 40177 - DNA, 20 bp, Artificial Sequence
  Description of Artificial Sequence: Synthetic oligonucleotide
  Target: SCN9A; (+) strand; PAM type: NRG; PAM sequence: CAG
tgggaagaaaaccaaatttg

SEQ ID NO: 40178 - DNA, 20 bp, Artificial Sequence
  Description of Artificial Sequence: Synthetic oligonucleotide
  Target: SCN9A; (+) strand; PAM type: NRG; PAM sequence: AAG
caaatttgcagctacttccc

SEQ ID NO: 40179 - DNA, 20 bp, Artificial Sequence
  Description of Artificial Sequence: Synthetic oligonucleotide
  Target: SCN9A; (+) strand; PAM type: NRG; PAM sequence: AGG
aaatttgcagctacttccca

SEQ ID NO: 40180 - DNA, 20 bp, Artificial Sequence
  Description of Artificial Sequence: Synthetic oligonucleotide
  Target: SCN9A; (+) strand; PAM type: NRG; PAM sequence: GGG
aatttgcagctacttcccaa

SEQ ID NO: 40181 - DNA, 20 bp, Artificial Sequence
  Description of Artificial Sequence: Synthetic oligonucleotide
  Target: SCN9A; (+) strand; PAM type: NRG; PAM sequence: GAG
gcagctacttcccaagggtt

SEQ ID NO: 40182 - DNA, 20 bp, Artificial Sequence
  Description of Artificial Sequence: Synthetic oligonucleotide
  Target: SCN9A; (+) strand; PAM type: NRG; PAM sequence: TAG
tcccaagggttgagaaacta

SEQ ID NO: 40183 - DNA, 20 bp, Artificial Sequence
  Description of Artificial Sequence: Synthetic oligonucleotide
  Target: SCN9A; (+) strand; PAM type: NRG; PAM sequence: TAG
gagaaactatagcacacata

SEQ ID NO: 40184 - DNA, 20 bp, Artificial Sequence
  Description of Artificial Sequence: Synthetic oligonucleotide
  Target: SCN9A; (+) strand; PAM type: NRG; PAM sequence: AAG
acccaacttttttttaattt

SEQ ID NO: 40185 - DNA, 20 bp, Artificial Sequence
  Description of Artificial Sequence: Synthetic oligonucleotide
  Target: SCN9A; (+) strand; PAM type: NRG; PAM sequence: AGG
cccaacttttttttaattta

SEQ ID NO: 40186 - DNA, 20 bp, Artificial Sequence
  Description of Artificial Sequence: Synthetic oligonucleotide
  Target: SCN9A; (+) strand; PAM type: NRG; PAM sequence: TAG
taaggaaatgtatttatttc

SEQ ID NO: 40187 - DNA, 20 bp, Artificial Sequence
  Description of Artificial Sequence: Synthetic oligonucleotide
  Target: SCN9A; (+) strand; PAM type: NRG; PAM sequence: TAG
tttctagaaaatgctttttc

SEQ ID NO: 40188 - DNA, 20 bp, Artificial Sequence
  Description of Artificial Sequence: Synthetic oligonucleotide
  Target: SCN9A; (+) strand; PAM type: NRG; PAM sequence: GAG
tctagaaaatgctttttcta

SEQ ID NO: 40189 - DNA, 20 bp, Artificial Sequence
  Description of Artificial Sequence: Synthetic oligonucleotide
  Target: SCN9A; (+) strand; PAM type: NRG; PAM sequence: AAG
aatgctttttctagagtgta

SEQ ID NO: 40190 - DNA, 20 bp, Artificial Sequence
  Description of Artificial Sequence: Synthetic oligonucleotide
  Target: SCN9A; (+) strand; PAM type: NRG; PAM sequence: GAG
tgctttttctagagtgtaaa

SEQ ID NO: 40191 - DNA, 20 bp, Artificial Sequence
  Description of Artificial Sequence: Synthetic oligonucleotide
  Target: SCN9A; (+) strand; PAM type: NRG; PAM sequence: GAG
ctttttctagagtgtaaaga

SEQ ID NO: 40192 - DNA, 20 bp, Artificial Sequence
  Description of Artificial Sequence: Synthetic oligonucleotide
  Target: SCN9A; (+) strand; PAM type: NRG; PAM sequence: AAG
tttctagagtgtaaagagag

SEQ ID NO: 40193 - DNA, 20 bp, Artificial Sequence
  Description of Artificial Sequence: Synthetic oligonucleotide
  Target: SCN9A; (+) strand; PAM type: NRG; PAM sequence: GAG
tctagagtgtaaagagagaa

SEQ ID NO: 40194 - DNA, 20 bp, Artificial Sequence
  Description of Artificial Sequence: Synthetic oligonucleotide
  Target: SCN9A; (+) strand; PAM type: NRG; PAM sequence: TGG
aatcatcttcataattgcct

SEQ ID NO: 40195 - DNA, 20 bp, Artificial Sequence
  Description of Artificial Sequence: Synthetic oligonucleotide
  Target: SCN9A; (+) strand; PAM type: NRG; PAM sequence: TAG
tgccttggttttccattttg

SEQ ID NO: 40196 - DNA, 20 bp, Artificial Sequence
  Description of Artificial Sequence: Synthetic oligonucleotide
  Target: SCN9A; (+) strand; PAM type: NRG; PAM sequence: TAG
tttgtagaacccaactttta

SEQ ID NO: 40197 - DNA, 20 bp, Artificial Sequence
  Description of Artificial Sequence: Synthetic oligonucleotide
  Target: SCN9A; (+) strand; PAM type: NRG; PAM sequence: AGG
ttgtagaacccaacttttat

SEQ ID NO: 40198 - DNA, 20 bp, Artificial Sequence
  Description of Artificial Sequence: Synthetic oligonucleotide
  Target: SCN9A; (+) strand; PAM type: NRG; PAM sequence: CAG
aacttttataggccctgaca

SEQ ID NO: 40199 - DNA, 20 bp, Artificial Sequence
  Description of Artificial Sequence: Synthetic oligonucleotide
  Target: SCN9A; (+) strand; PAM type: NRG; PAM sequence: GAG
cttttataggccctgacaca

SEQ ID NO: 40200 - DNA, 20 bp, Artificial Sequence
  Description of Artificial Sequence: Synthetic oligonucleotide
  Target: SCN9A; (+) strand; PAM type: NRG; PAM sequence: TGG
ataggccctgacacagagct

SEQ ID NO: 40201 - DNA, 20 bp, Artificial Sequence
  Description of Artificial Sequence: Synthetic oligonucleotide
  Target: SCN9A; (+) strand; PAM type: NRG; PAM sequence: TAG
ctgacacagagcttggcttt

SEQ ID NO: 40202 - DNA, 20 bp, Artificial Sequence
  Description of Artificial Sequence: Synthetic oligonucleotide
  Target: SCN9A; (+) strand; PAM type: NRG; PAM sequence: GAG
gcttttagatcaccatgctt

SEQ ID NO: 40203 - DNA, 20 bp, Artificial Sequence
  Description of Artificial Sequence: Synthetic oligonucleotide
  Target: SCN9A; (+) strand; PAM type: NRG; PAM sequence: AGG
cttttagatcaccatgcttg

SEQ ID NO: 40204 - DNA, 20 bp, Artificial Sequence
  Description of Artificial Sequence: Synthetic oligonucleotide
  Target: SCN9A; (+) strand; PAM type: NRG; PAM sequence: TGG
agatcaccatgcttgaggaa

SEQ ID NO: 40205 - DNA, 20 bp, Artificial Sequence
  Description of Artificial Sequence: Synthetic oligonucleotide
  Target: SCN9A; (+) strand; PAM type: NRG; PAM sequence: CAG
tcaccatgcttgaggaatgg

SEQ ID NO: 40206 - DNA, 20 bp, Artificial Sequence
  Description of Artificial Sequence: Synthetic oligonucleotide
  Target: SCN9A; (+) strand; PAM type: NRG; PAM sequence: GAG
accatgcttgaggaatggca

SEQ ID NO: 40207 - DNA, 20 bp, Artificial Sequence
  Description of Artificial Sequence: Synthetic oligonucleotide
  Target: SCN9A; (+) strand; PAM type: NRG; PAM sequence: AAG
gcttgaggaatggcagagat

SEQ ID NO: 40208 - DNA, 20 bp, Artificial Sequence
  Description of Artificial Sequence: Synthetic oligonucleotide
  Target: SCN9A; (+) strand; PAM type: NRG; PAM sequence: TGG
gaatggcagagataagccat

SEQ ID NO: 40209 - DNA, 20 bp, Artificial Sequence
  Description of Artificial Sequence: Synthetic oligonucleotide
  Target: SCN9A; (+) strand; PAM type: NRG; PAM sequence: GAG
atggcagagataagccattg

SEQ ID NO: 40210 - DNA, 20 bp, Artificial Sequence
  Description of Artificial Sequence: Synthetic oligonucleotide
  Target: SCN9A; (+) strand; PAM type: NRG; PAM sequence: AAG
agccattggagttttctctc

SEQ ID NO: 40211 - DNA, 20 bp, Artificial Sequence
  Description of Artificial Sequence: Synthetic oligonucleotide
  Target: SCN9A; (+) strand; PAM type: NRG; PAM sequence: TGG
ctctcaagtacaaaaaacga

SEQ ID NO: 40212 - DNA, 20 bp, Artificial Sequence
  Description of Artificial Sequence: Synthetic oligonucleotide
  Target: SCN9A; (+) strand; PAM type: NRG; PAM sequence: GGG
tctcaagtacaaaaaacgat

SEQ ID NO: 40213 - DNA, 20 bp, Artificial Sequence
  Description of Artificial Sequence: Synthetic oligonucleotide
  Target: SCN9A; (+) strand; PAM type: NRG; PAM sequence: GGG
ctcaagtacaaaaaacgatg

SEQ ID NO: 40214 - DNA, 20 bp, Artificial Sequence
  Description of Artificial Sequence: Synthetic oligonucleotide
  Target: SCN9A; (+) strand; PAM type: NRG; PAM sequence: GGG
tcaagtacaaaaaacgatgg

SEQ ID NO: 40215 - DNA, 20 bp, Artificial Sequence
  Description of Artificial Sequence: Synthetic oligonucleotide
  Target: SCN9A; (+) strand; PAM type: NRG; PAM sequence: GGG
caagtacaaaaaacgatggg

SEQ ID NO: 40216 - DNA, 20 bp, Artificial Sequence
  Description of Artificial Sequence: Synthetic oligonucleotide
  Target: SCN9A; (+) strand; PAM type: NRG; PAM sequence: GAG
tggggggttttgaactgcct

SEQ ID NO: 40217 - DNA, 20 bp, Artificial Sequence
  Description of Artificial Sequence: Synthetic oligonucleotide
  Target: SCN9A; (+) strand; PAM type: NRG; PAM sequence: CAG
ttgaactgcctgagcactct

SEQ ID NO: 40218 - DNA, 20 bp, Artificial Sequence
  Description of Artificial Sequence: Synthetic oligonucleotide
  Target: SCN9A; (+) strand; PAM type: NRG; PAM sequence: AAG
aactgcctgagcactctcag

SEQ ID NO: 40219 - DNA, 20 bp, Artificial Sequence
  Description of Artificial Sequence: Synthetic oligonucleotide
  Target: SCN9A; (+) strand; PAM type: NRG; PAM sequence: TGG
ctctcagaagctttaattcc

SEQ ID NO: 40220 - DNA, 20 bp, Artificial Sequence
  Description of Artificial Sequence: Synthetic oligonucleotide
  Target: SCN9A; (+) strand; PAM type: NRG; PAM sequence: GGG
tctcagaagctttaattcct

SEQ ID NO: 40221 - DNA, 20 bp, Artificial Sequence
  Description of Artificial Sequence: Synthetic oligonucleotide
  Target: SCN9A; (+) strand; PAM type: NRG; PAM sequence: CAG
gaagctttaattcctgggat

SEQ ID NO: 40222 - DNA, 20 bp, Artificial Sequence
  Description of Artificial Sequence: Synthetic oligonucleotide
  Target: SCN9A; (+) strand; PAM type: NRG; PAM sequence: TGG
accatcttccaacttcccca

SEQ ID NO: 40223 - DNA, 20 bp, Artificial Sequence
  Description of Artificial Sequence: Synthetic oligonucleotide
  Target: SCN9A; (+) strand; PAM type: NRG; PAM sequence: TAG
aacttccccatggaaaccat

SEQ ID NO: 40224 - DNA, 20 bp, Artificial Sequence
  Description of Artificial Sequence: Synthetic oligonucleotide
  Target: SCN9A; (+) strand; PAM type: NRG; PAM sequence: AGG
acttccccatggaaaccatt

SEQ ID NO: 40225 - DNA, 20 bp, Artificial Sequence
  Description of Artificial Sequence: Synthetic oligonucleotide
  Target: SCN9A; (+) strand; PAM type: NRG; PAM sequence: CAG
ccattaggctacacgttttc

SEQ ID NO: 40226 - DNA, 20 bp, Artificial Sequence
  Description of Artificial Sequence: Synthetic oligonucleotide
  Target: SCN9A; (+) strand; PAM type: NRG; PAM sequence: TGG
cgttttccagccgctccctg

SEQ ID NO: 40227 - DNA, 20 bp, Artificial Sequence
  Description of Artificial Sequence: Synthetic oligonucleotide
  Target: SCN9A; (+) strand; PAM type: NRG; PAM sequence: TGG
ccagccgctccctgtggttc

SEQ ID NO: 40228 - DNA, 20 bp, Artificial Sequence
  Description of Artificial Sequence: Synthetic oligonucleotide
  Target: SCN9A; (+) strand; PAM type: NRG; PAM sequence: CAG
cctgtggttctggcctcttc

SEQ ID NO: 40229 - DNA, 20 bp, Artificial Sequence
  Description of Artificial Sequence: Synthetic oligonucleotide
  Target: SCN9A; (+) strand; PAM type: NRG; PAM sequence: TGG
ttctggcctcttccagtact

SEQ ID NO: 40230 - DNA, 20 bp, Artificial Sequence
  Description of Artificial Sequence: Synthetic oligonucleotide
  Target: SCN9A; (+) strand; PAM type: NRG; PAM sequence: TAG
ccagtacttggaaatctaca

SEQ ID NO: 40231 - DNA, 20 bp, Artificial Sequence
  Description of Artificial Sequence: Synthetic oligonucleotide
  Target: SCN9A; (+) strand; PAM type: NRG; PAM sequence: AAG
ggaaatctacatagcaaatg

SEQ ID NO: 40232 - DNA, 20 bp, Artificial Sequence
  Description of Artificial Sequence: Synthetic oligonucleotide
  Target: SCN9A; (+) strand; PAM type: NRG; PAM sequence: CAG
aatgaagaataaaccttctt

SEQ ID NO: 40233 - DNA, 20 bp, Artificial Sequence
  Description of Artificial Sequence: Synthetic oligonucleotide
  Target: SCN9A; (+) strand; PAM type: NRG; PAM sequence: AAG
aaaccttcttcagcctaaac

SEQ ID NO: 40234 - DNA, 20 bp, Artificial Sequence
  Description of Artificial Sequence: Synthetic oligonucleotide
  Target: SCN9A; (+) strand; PAM type: NRG; PAM sequence: GAG
accttcttcagcctaaacaa

SEQ ID NO: 40235 - DNA, 20 bp, Artificial Sequence
  Description of Artificial Sequence: Synthetic oligonucleotide
  Target: SCN9A; (+) strand; PAM type: NRG; PAM sequence: AGG
ccttcttcagcctaaacaag

SEQ ID NO: 40236 - DNA, 20 bp, Artificial Sequence
  Description of Artificial Sequence: Synthetic oligonucleotide
  Target: SCN9A; (+) strand; PAM type: NRG; PAM sequence: TGG
attccccacgccttcttccc

SEQ ID NO: 40237 - DNA, 20 bp, Artificial Sequence
  Description of Artificial Sequence: Synthetic oligonucleotide
  Target: SCN9A; (+) strand; PAM type: NRG; PAM sequence: CAG
ccttcttccctggcttcctc

SEQ ID NO: 40238 - DNA, 20 bp, Artificial Sequence
  Description of Artificial Sequence: Synthetic oligonucleotide
  Target: SCN9A; (+) strand; PAM type: NRG; PAM sequence: GAG
ttcttccctggcttcctcca

SEQ ID NO: 40239 - DNA, 20 bp, Artificial Sequence
  Description of Artificial Sequence: Synthetic oligonucleotide
  Target: SCN9A; (+) strand; PAM type: NRG; PAM sequence: GAG
tttttttttttttttttttt

SEQ ID NO: 40240 - DNA, 20 bp, Artificial Sequence
  Description of Artificial Sequence: Synthetic oligonucleotide
  Target: SCN9A; (+) strand; PAM type: NRG; PAM sequence: TGG
ttttttttttttttttgaga

SEQ ID NO: 40241 - DNA, 20 bp, Artificial Sequence
  Description of Artificial Sequence: Synthetic oligonucleotide
  Target: SCN9A; (+) strand; PAM type: NRG; PAM sequence: GAG
ttttttttttttttgagatg

SEQ ID NO: 40242 - DNA, 20 bp, Artificial Sequence
  Description of Artificial Sequence: Synthetic oligonucleotide
  Target: SCN9A; (+) strand; PAM type: NRG; PAM sequence: CAG
cgctgtctcgctctgtcgcc

SEQ ID NO: 40243 - DNA, 20 bp, Artificial Sequence
  Description of Artificial Sequence: Synthetic oligonucleotide
  Target: SCN9A; (+) strand; PAM type: NRG; PAM sequence: AGG
gctgtctcgctctgtcgccc

SEQ ID NO: 40244 - DNA, 20 bp, Artificial Sequence
  Description of Artificial Sequence: Synthetic oligonucleotide
  Target: SCN9A; (+) strand; PAM type: NRG; PAM sequence: TGG
tctcgctctgtcgcccaggc

SEQ ID NO: 40245 - DNA, 20 bp, Artificial Sequence
  Description of Artificial Sequence: Synthetic oligonucleotide
  Target: SCN9A; (+) strand; PAM type: NRG; PAM sequence: GAG
tcgctctgtcgcccaggctg

SEQ ID NO: 40246 - DNA, 20 bp, Artificial Sequence
  Description of Artificial Sequence: Synthetic oligonucleotide
  Target: SCN9A; (+) strand; PAM type: NRG; PAM sequence: CAG
ctgtcgcccaggctggagtg

SEQ ID NO: 40247 - DNA, 20 bp, Artificial Sequence
  Description of Artificial Sequence: Synthetic oligonucleotide
  Target: SCN9A; (+) strand; PAM type: NRG; PAM sequence: TGG
tcgcccaggctggagtgcag

SEQ ID NO: 40248 - DNA, 20 bp, Artificial Sequence
  Description of Artificial Sequence: Synthetic oligonucleotide
  Target: SCN9A; (+) strand; PAM type: NRG; PAM sequence: CGG
ggagtgcagtggcgcaatct

SEQ ID NO: 40249 - DNA, 20 bp, Artificial Sequence
  Description of Artificial Sequence: Synthetic oligonucleotide
  Target: SCN9A; (+) strand; PAM type: NRG; PAM sequence: AAG
gcgcaatctcggctcactgc

SEQ ID NO: 40250 - DNA, 20 bp, Artificial Sequence
  Description of Artificial Sequence: Synthetic oligonucleotide
  Target: SCN9A; (+) strand; PAM type: NRG; PAM sequence: CGG
tcactgcaagctccgcctcc

SEQ ID NO: 40251 - DNA, 20 bp, Artificial Sequence
  Description of Artificial Sequence: Synthetic oligonucleotide
  Target: SCN9A; (+) strand; PAM type: NRG; PAM sequence: GGG
cactgcaagctccgcctccc

SEQ ID NO: 40252 - DNA, 20 bp, Artificial Sequence
  Description of Artificial Sequence: Synthetic oligonucleotide
  Target: SCN9A; (+) strand; PAM type: NRG; PAM sequence: CAG
ttcatgccattctcctgcct

SEQ ID NO: 40253 - DNA, 20 bp, Artificial Sequence
  Description of Artificial Sequence: Synthetic oligonucleotide
  Target: SCN9A; (+) strand; PAM type: NRG; PAM sequence: GAG
ttctcctgcctcagcctccc

SEQ ID NO: 40254 - DNA, 20 bp, Artificial Sequence
  Description of Artificial Sequence: Synthetic oligonucleotide
  Target: SCN9A; (+) strand; PAM type: NRG; PAM sequence: TAG
tcctgcctcagcctcccgag

SEQ ID NO: 40255 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctcccgagtagc

SEQ ID NO: 40256 - DNA, 20 bp, Artificial Sequence
  Description of Artificial Sequence: Synthetic oligonucleotide
  Target: SCN9A; (+) strand; PAM type: NRG; PAM sequence: GGG
cctcagcctcccgagtagct

SEQ ID NO: 40257 - DNA, 20 bp, Artificial Sequence
  Description of Artificial Sequence: Synthetic oligonucleotide
  Target: SCN9A; (+) strand; PAM type: NRG; PAM sequence: CAG
ctcccgagtagctgggacta

SEQ ID NO: 40258 - DNA, 20 bp, Artificial Sequence
  Description of Artificial Sequence: Synthetic oligonucleotide
  Target: SCN9A; (+) strand; PAM type: NRG; PAM sequence: AGG
tcccgagtagctgggactac

SEQ ID NO: 40259 - DNA, 20 bp, Artificial Sequence
  Description of Artificial Sequence: Synthetic oligonucleotide
  Target: SCN9A; (+) strand; PAM type: NRG; PAM sequence: CGG
caggcgcccgctaccacgcc

SEQ ID NO: 40260 - DNA, 20 bp, Artificial Sequence
  Description of Artificial Sequence: Synthetic oligonucleotide
  Target: SCN9A; (+) strand; PAM type: NRG; PAM sequence: TAG
cggctaattttttgtatttt

SEQ ID NO: 40261 - DNA, 20 bp, Artificial Sequence
  Description of Artificial Sequence: Synthetic oligonucleotide
  Target: SCN9A; (+) strand; PAM type: NRG; PAM sequence: TAG
ctaattttttgtatttttag

SEQ ID NO: 40262 - DNA, 20 bp, Artificial Sequence
  Description of Artificial Sequence: Synthetic oligonucleotide
  Target: SCN9A; (+) strand; PAM type: NRG; PAM sequence: GAG
aattttttgtatttttagta

SEQ ID NO: 40263 - DNA, 20 bp, Artificial Sequence
  Description of Artificial Sequence: Synthetic oligonucleotide
  Target: SCN9A; (+) strand; PAM type: NRG; PAM sequence: CGG
ttttgtatttttagtagaga

SEQ ID NO: 40264 - DNA, 20 bp, Artificial Sequence
  Description of Artificial Sequence: Synthetic oligonucleotide
  Target: SCN9A; (+) strand; PAM type: NRG; PAM sequence: GGG
tttgtatttttagtagagac

SEQ ID NO: 40265 - DNA, 20 bp, Artificial Sequence
  Description of Artificial Sequence: Synthetic oligonucleotide
  Target: SCN9A; (+) strand; PAM type: NRG; PAM sequence: GGG
ttgtatttttagtagagacg

SEQ ID NO: 40266 - DNA, 20 bp, Artificial Sequence
  Description of Artificial Sequence: Synthetic oligonucleotide
  Target: SCN9A; (+) strand; PAM type: NRG; PAM sequence: TAG
gagacggggtttcaccgtgt

SEQ ID NO: 40267 - DNA, 20 bp, Artificial Sequence
  Description of Artificial Sequence: Synthetic oligonucleotide
  Target: SCN9A; (+) strand; PAM type: NRG; PAM sequence: CAG
cggggtttcaccgtgttagc

SEQ ID NO: 40268 - DNA, 20 bp, Artificial Sequence
  Description of Artificial Sequence: Synthetic oligonucleotide
  Target: SCN9A; (+) strand; PAM type: NRG; PAM sequence: AGG
ggggtttcaccgtgttagcc

SEQ ID NO: 40269 - DNA, 20 bp, Artificial Sequence
  Description of Artificial Sequence: Synthetic oligonucleotide
  Target: SCN9A; (+) strand; PAM type: NRG; PAM sequence: TGG
tttcaccgtgttagccagga

SEQ ID NO: 40270 - DNA, 20 bp, Artificial Sequence
  Description of Artificial Sequence: Synthetic oligonucleotide
  Target: SCN9A; (+) strand; PAM type: NRG; PAM sequence: CGG
acctcgtgatccgcccgcct

SEQ ID NO: 40271 - DNA, 20 bp, Artificial Sequence
  Description of Artificial Sequence: Synthetic oligonucleotide
  Target: SCN9A; (+) strand; PAM type: NRG; PAM sequence: AAG
ccgcccgcctcggcctccca

SEQ ID NO: 40272 - DNA, 20 bp, Artificial Sequence
  Description of Artificial Sequence: Synthetic oligonucleotide
  Target: SCN9A; (+) strand; PAM type: NRG; PAM sequence: TGG
gcctcggcctcccaaagtgc

SEQ ID NO: 40273 - DNA, 20 bp, Artificial Sequence
  Description of Artificial Sequence: Synthetic oligonucleotide
  Target: SCN9A; (+) strand; PAM type: NRG; PAM sequence: GGG
cctcggcctcccaaagtgct

SEQ ID NO: 40274 - DNA, 20 bp, Artificial Sequence
  Description of Artificial Sequence: Synthetic oligonucleotide
  Target: SCN9A; (+) strand; PAM type: NRG; PAM sequence: CAG
ctcccaaagtgctgggatta

SEQ ID NO: 40275 - DNA, 20 bp, Artificial Sequence
  Description of Artificial Sequence: Synthetic oligonucleotide
  Target: SCN9A; (+) strand; PAM type: NRG; PAM sequence: AGG
tcccaaagtgctgggattac

SEQ ID NO: 40276 - DNA, 20 bp, Artificial Sequence
  Description of Artificial Sequence: Synthetic oligonucleotide
  Target: SCN9A; (+) strand; PAM type: NRG; PAM sequence: GAG
agtgctgggattacaggcgt

SEQ ID NO: 40277 - DNA, 20 bp, Artificial Sequence
  Description of Artificial Sequence: Synthetic oligonucleotide
  Target: SCN9A; (+) strand; PAM type: NRG; PAM sequence: CGG
caggcgtgagccaccgcgcc

SEQ ID NO: 40278 - DNA, 20 bp, Artificial Sequence
  Description of Artificial Sequence: Synthetic oligonucleotide
  Target: SCN9A; (+) strand; PAM type: NRG; PAM sequence: AAG
ggccacaatctttcttttaa

SEQ ID NO: 40279 - DNA, 20 bp, Artificial Sequence
  Description of Artificial Sequence: Synthetic oligonucleotide
  Target: SCN9A; (+) strand; PAM type: NRG; PAM sequence: TGG
aatctttcttttaaaagatg

SEQ ID NO: 40280 - DNA, 20 bp, Artificial Sequence
  Description of Artificial Sequence: Synthetic oligonucleotide
  Target: SCN9A; (+) strand; PAM type: NRG; PAM sequence: AAG
ctttcttttaaaagatgtgg

SEQ ID NO: 40281 - DNA, 20 bp, Artificial Sequence
  Description of Artificial Sequence: Synthetic oligonucleotide
  Target: SCN9A; (+) strand; PAM type: NRG; PAM sequence: AGG
tttcttttaaaagatgtgga

SEQ ID NO: 40282 - DNA, 20 bp, Artificial Sequence
  Description of Artificial Sequence: Synthetic oligonucleotide
  Target: SCN9A; (+) strand; PAM type: NRG; PAM sequence: AAG
tgtggaaggtctctaccacc

SEQ ID NO: 40283 - DNA, 20 bp, Artificial Sequence
  Description of Artificial Sequence: Synthetic oligonucleotide
  Target: SCN9A; (+) strand; PAM type: NRG; PAM sequence: CAG
aaggtctctaccaccaagaa

SEQ ID NO: 40284 - DNA, 20 bp, Artificial Sequence
  Description of Artificial Sequence: Synthetic oligonucleotide
  Target: SCN9A; (+) strand; PAM type: NRG; PAM sequence: AGG
aggtctctaccaccaagaac

SEQ ID NO: 40285 - DNA, 20 bp, Artificial Sequence
  Description of Artificial Sequence: Synthetic oligonucleotide
  Target: SCN9A; (+) strand; PAM type: NRG; PAM sequence: AAG
tctctaccaccaagaacagg

SEQ ID NO: 40286 - DNA, 20 bp, Artificial Sequence
  Description of Artificial Sequence: Synthetic oligonucleotide
  Target: SCN9A; (+) strand; PAM type: NRG; PAM sequence: AGG
ctctaccaccaagaacagga

SEQ ID NO: 40287 - DNA, 20 bp, Artificial Sequence
  Description of Artificial Sequence: Synthetic oligonucleotide
  Target: SCN9A; (+) strand; PAM type: NRG; PAM sequence: TGG
taccaccaagaacaggaagg

SEQ ID NO: 40288 - DNA, 20 bp, Artificial Sequence
  Description of Artificial Sequence: Synthetic oligonucleotide
  Target: SCN9A; (+) strand; PAM type: NRG; PAM sequence: TGG
caggaaggtggcttcttccc

SEQ ID NO: 40289 - DNA, 20 bp, Artificial Sequence
  Description of Artificial Sequence: Synthetic oligonucleotide
  Target: SCN9A; (+) strand; PAM type: NRG; PAM sequence: CAG
tgctcctgacataatttatg

SEQ ID NO: 40290 - DNA, 20 bp, Artificial Sequence
  Description of Artificial Sequence: Synthetic oligonucleotide
  Target: SCN9A; (+) strand; PAM type: NRG; PAM sequence: TAG
taatttatgcagtttcttat

SEQ ID NO: 40291 - DNA, 20 bp, Artificial Sequence
  Description of Artificial Sequence: Synthetic oligonucleotide
  Target: SCN9A; (+) strand; PAM type: NRG; PAM sequence: GAG
atttatgcagtttcttatta

SEQ ID NO: 40292 - DNA, 20 bp, Artificial Sequence
  Description of Artificial Sequence: Synthetic oligonucleotide
  Target: SCN9A; (+) strand; PAM type: NRG; PAM sequence: AGG
tttatgcagtttcttattag

SEQ ID NO: 40293 - DNA, 20 bp, Artificial Sequence
  Description of Artificial Sequence: Synthetic oligonucleotide
  Target: SCN9A; (+) strand; PAM type: NRG; PAM sequence: AAG
atgcagtttcttattagagg

SEQ ID NO: 40294 - DNA, 20 bp, Artificial Sequence
  Description of Artificial Sequence: Synthetic oligonucleotide
  Target: SCN9A; (+) strand; PAM type: NRG; PAM sequence: AGG
tgcagtttcttattagagga

SEQ ID NO: 40295 - DNA, 20 bp, Artificial Sequence
  Description of Artificial Sequence: Synthetic oligonucleotide
  Target: SCN9A; (+) strand; PAM type: NRG; PAM sequence: TAG
tgaactacactttaatccaa

SEQ ID NO: 40296 - DNA, 20 bp, Artificial Sequence
  Description of Artificial Sequence: Synthetic oligonucleotide
  Target: SCN9A; (+) strand; PAM type: NRG; PAM sequence: CAG
ctttaatccaatagatctaa

SEQ ID NO: 40297 - DNA, 20 bp, Artificial Sequence
  Description of Artificial Sequence: Synthetic oligonucleotide
  Target: SCN9A; (+) strand; PAM type: NRG; PAM sequence: TAG
atagatctaacagatattta

SEQ ID NO: 40298 - DNA, 20 bp, Artificial Sequence
  Description of Artificial Sequence: Synthetic oligonucleotide
  Target: SCN9A; (+) strand; PAM type: NRG; PAM sequence: CAG
tctaacagatatttatagaa

SEQ ID NO: 40299 - DNA, 20 bp, Artificial Sequence
  Description of Artificial Sequence: Synthetic oligonucleotide
  Target: SCN9A; (+) strand; PAM type: NRG; PAM sequence: CAG
ttatagaacagttcatccaa

SEQ ID NO: 40300 - DNA, 20 bp, Artificial Sequence
  Description of Artificial Sequence: Synthetic oligonucleotide
  Target: SCN9A; (+) strand; PAM type: NRG; PAM sequence: CAG
aaatcacatgaaacactctc

SEQ ID NO: 40301 - DNA, 20 bp, Artificial Sequence
  Description of Artificial Sequence: Synthetic oligonucleotide
  Target: SCN9A; (+) strand; PAM type: NRG; PAM sequence: AGG
aatcacatgaaacactctcc

SEQ ID NO: 40302 - DNA, 20 bp, Artificial Sequence
  Description of Artificial Sequence: Synthetic oligonucleotide
  Target: SCN9A; (+) strand; PAM type: NRG; PAM sequence: TAG
acatgaaacactctccagga

SEQ ID NO: 40303 - DNA, 20 bp, Artificial Sequence
  Description of Artificial Sequence: Synthetic oligonucleotide
  Target: SCN9A; (+) strand; PAM type: NRG; PAM sequence: TAG
ctccaggatagatcacatgt

SEQ ID NO: 40304 - DNA, 20 bp, Artificial Sequence
  Description of Artificial Sequence: Synthetic oligonucleotide
  Target: SCN9A; (+) strand; PAM type: NRG; PAM sequence: AGG
tccaggatagatcacatgtt

SEQ ID NO: 40305 - DNA, 20 bp, Artificial Sequence
  Description of Artificial Sequence: Synthetic oligonucleotide
  Target: SCN9A; (+) strand; PAM type: NRG; PAM sequence: AAG
cacatgttaggccaccaaac

SEQ ID NO: 40306 - DNA, 20 bp, Artificial Sequence
  Description of Artificial Sequence: Synthetic oligonucleotide
  Target: SCN9A; (+) strand; PAM type: NRG; PAM sequence: AAG
aaacaagttttaacaaattt

SEQ ID NO: 40307 - DNA, 20 bp, Artificial Sequence
  Description of Artificial Sequence: Synthetic oligonucleotide
  Target: SCN9A; (+) strand; PAM type: NRG; PAM sequence: AAG
caagttttaacaaatttaag

SEQ ID NO: 40308 - DNA, 20 bp, Artificial Sequence
  Description of Artificial Sequence: Synthetic oligonucleotide
  Target: SCN9A; (+) strand; PAM type: NRG; PAM sequence: GAG
aagaagattaaaatcatatc

SEQ ID NO: 40309 - DNA, 20 bp, Artificial Sequence
  Description of Artificial Sequence: Synthetic oligonucleotide
  Target: SCN9A; (+) strand; PAM type: NRG; PAM sequence: TAG
tgttcatgatgacatgaaac

SEQ ID NO: 40310 - DNA, 20 bp, Artificial Sequence
  Description of Artificial Sequence: Synthetic oligonucleotide
  Target: SCN9A; (+) strand; PAM type: NRG; PAM sequence: AAG
tcatgatgacatgaaactag

SEQ ID NO: 40311 - DNA, 20 bp, Artificial Sequence
  Description of Artificial Sequence: Synthetic oligonucleotide
  Target: SCN9A; (+) strand; PAM type: NRG; PAM sequence: AAG
acatgaaactagaagtcaat

SEQ ID NO: 40312 - DNA, 20 bp, Artificial Sequence
  Description of Artificial Sequence: Synthetic oligonucleotide
  Target: SCN9A; (+) strand; PAM type: NRG; PAM sequence: TGG
ttgaacaactcataattacg

SEQ ID NO: 40313 - DNA, 20 bp, Artificial Sequence
  Description of Artificial Sequence: Synthetic oligonucleotide
  Target: SCN9A; (+) strand; PAM type: NRG; PAM sequence: CAG
ttaaacaacatgctcctgaa

SEQ ID NO: 40314 - DNA, 20 bp, Artificial Sequence
  Description of Artificial Sequence: Synthetic oligonucleotide
  Target: SCN9A; (+) strand; PAM type: NRG; PAM sequence: AGG
taaacaacatgctcctgaac

SEQ ID NO: 40315 - DNA, 20 bp, Artificial Sequence
  Description of Artificial Sequence: Synthetic oligonucleotide
  Target: SCN9A; (+) strand; PAM type: NRG; PAM sequence: TGG
acatgctcctgaacaggcaa

SEQ ID NO: 40316 - DNA, 20 bp, Artificial Sequence
  Description of Artificial Sequence: Synthetic oligonucleotide
  Target: SCN9A; (+) strand; PAM type: NRG; PAM sequence: GGG
catgctcctgaacaggcaat

SEQ ID NO: 40317 - DNA, 20 bp, Artificial Sequence
  Description of Artificial Sequence: Synthetic oligonucleotide
  Target: SCN9A; (+) strand; PAM type: NRG; PAM sequence: AAG
cctgaacaggcaatgggtca

SEQ ID NO: 40318 - DNA, 20 bp, Artificial Sequence
  Description of Artificial Sequence: Synthetic oligonucleotide
  Target: SCN9A; (+) strand; PAM type: NRG; PAM sequence: AAG
gaacaggcaatgggtcaaag

SEQ ID NO: 40319 - DNA, 20 bp, Artificial Sequence
  Description of Artificial Sequence: Synthetic oligonucleotide
  Target: SCN9A; (+) strand; PAM type: NRG; PAM sequence: CGG
gggtcaaagaagaaattata

SEQ ID NO: 40320 - DNA, 20 bp, Artificial Sequence
  Description of Artificial Sequence: Synthetic oligonucleotide
  Target: SCN9A; (+) strand; PAM type: NRG; PAM sequence: CAG
gaagaaattatacggaaaaa

SEQ ID NO: 40321 - DNA, 20 bp, Artificial Sequence
  Description of Artificial Sequence: Synthetic oligonucleotide
  Target: SCN9A; (+) strand; PAM type: NRG; PAM sequence: TGG
cggaaaaacagaaaatattt

SEQ ID NO: 40322 - DNA, 20 bp, Artificial Sequence
  Description of Artificial Sequence: Synthetic oligonucleotide
  Target: SCN9A; (+) strand; PAM type: NRG; PAM sequence: GGG
ggaaaaacagaaaatatttt

SEQ ID NO: 40323 - DNA, 20 bp, Artificial Sequence
  Description of Artificial Sequence: Synthetic oligonucleotide
  Target: SCN9A; (+) strand; PAM type: NRG; PAM sequence: TGG
tattttgggatcaatgacaa

SEQ ID NO: 40324 - DNA, 20 bp, Artificial Sequence
  Description of Artificial Sequence: Synthetic oligonucleotide
  Target: SCN9A; (+) strand; PAM type: NRG; PAM sequence: AAG
atcaatgacaatggaaacac

SEQ ID NO: 40325 - DNA, 20 bp, Artificial Sequence
  Description of Artificial Sequence: Synthetic oligonucleotide
  Target: SCN9A; (+) strand; PAM type: NRG; PAM sequence: TAG
tggaaacacaagataacaaa

SEQ ID NO: 40326 - DNA, 20 bp, Artificial Sequence
  Description of Artificial Sequence: Synthetic oligonucleotide
  Target: SCN9A; (+) strand; PAM type: NRG; PAM sequence: TGG
acacaagataacaaatagta

SEQ ID NO: 40327 - DNA, 20 bp, Artificial Sequence
  Description of Artificial Sequence: Synthetic oligonucleotide
  Target: SCN9A; (+) strand; PAM type: NRG; PAM sequence: TAG
ataacaaatagtatggaatg

SEQ ID NO: 40328 - DNA, 20 bp, Artificial Sequence
  Description of Artificial Sequence: Synthetic oligonucleotide
  Target: SCN9A; (+) strand; PAM type: NRG; PAM sequence: AAG
aatagtatggaatgtagaaa

SEQ ID NO: 40329 - DNA, 20 bp, Artificial Sequence
  Description of Artificial Sequence: Synthetic oligonucleotide
  Target: SCN9A; (+) strand; PAM type: NRG; PAM sequence: AAG
agtatggaatgtagaaaaag

SEQ ID NO: 40330 - DNA, 20 bp, Artificial Sequence
  Description of Artificial Sequence: Synthetic oligonucleotide
  Target: SCN9A; (+) strand; PAM type: NRG; PAM sequence: GAG
aatgtagaaaaagaagccct

SEQ ID NO: 40331 - DNA, 20 bp, Artificial Sequence
  Description of Artificial Sequence: Synthetic oligonucleotide
  Target: SCN9A; (+) strand; PAM type: NRG; PAM sequence: GAG
tgtagaaaaagaagccctga

SEQ ID NO: 40332 - DNA, 20 bp, Artificial Sequence
  Description of Artificial Sequence: Synthetic oligonucleotide
  Target: SCN9A; (+) strand; PAM type: NRG; PAM sequence: TAG
agccctgagagaaaaattta

SEQ ID NO: 40333 - DNA, 20 bp, Artificial Sequence
  Description of Artificial Sequence: Synthetic oligonucleotide
  Target: SCN9A; (+) strand; PAM type: NRG; PAM sequence: AAG
agtaataaatgcctacatta

SEQ ID NO: 40334 - DNA, 20 bp, Artificial Sequence
  Description of Artificial Sequence: Synthetic oligonucleotide
  Target: SCN9A; (+) strand; PAM type: NRG; PAM sequence: AAG
ataaatgcctacattaaaga

SEQ ID NO: 40335 - DNA, 20 bp, Artificial Sequence
  Description of Artificial Sequence: Synthetic oligonucleotide
  Target: SCN9A; (+) strand; PAM type: NRG; PAM sequence: AAG
aatgcctacattaaagaaag

SEQ ID NO: 40336 - DNA, 20 bp, Artificial Sequence
  Description of Artificial Sequence: Synthetic oligonucleotide
  Target: SCN9A; (+) strand; PAM type: NRG; PAM sequence: AGG
atgcctacattaaagaaaga

SEQ ID NO: 40337 - DNA, 20 bp, Artificial Sequence
  Description of Artificial Sequence: Synthetic oligonucleotide
  Target: SCN9A; (+) strand; PAM type: NRG; PAM sequence: TAG
aacaacctaatattacatct

SEQ ID NO: 40338 - DNA, 20 bp, Artificial Sequence
  Description of Artificial Sequence: Synthetic oligonucleotide
  Target: SCN9A; (+) strand; PAM type: NRG; PAM sequence: GAG
caacctaatattacatctta

SEQ ID NO: 40339 - DNA, 20 bp, Artificial Sequence
  Description of Artificial Sequence: Synthetic oligonucleotide
  Target: SCN9A; (+) strand; PAM type: NRG; PAM sequence: TAG
taatattacatcttagagat

SEQ ID NO: 40340 - DNA, 20 bp, Artificial Sequence
  Description of Artificial Sequence: Synthetic oligonucleotide
  Target: SCN9A; (+) strand; PAM type: NRG; PAM sequence: AAG
tacatcttagagattagaaa

SEQ ID NO: 40341 - DNA, 20 bp, Artificial Sequence
  Description of Artificial Sequence: Synthetic oligonucleotide
  Target: SCN9A; (+) strand; PAM type: NRG; PAM sequence: AAG
atcttagagattagaaaaag

SEQ ID NO: 40342 - DNA, 20 bp, Artificial Sequence
  Description of Artificial Sequence: Synthetic oligonucleotide
  Target: SCN9A; (+) strand; PAM type: NRG; PAM sequence: CAG
agagattagaaaaagaagaa

SEQ ID NO: 40343 - DNA, 20 bp, Artificial Sequence
  Description of Artificial Sequence: Synthetic oligonucleotide
  Target: SCN9A; (+) strand; PAM type: NRG; PAM sequence: CAG
cagaatatccccaaactttg

SEQ ID NO: 40344 - DNA, 20 bp, Artificial Sequence
  Description of Artificial Sequence: Synthetic oligonucleotide
  Target: SCN9A; (+) strand; PAM type: NRG; PAM sequence: AAG
aatatccccaaactttgcag

SEQ ID NO: 40345 - DNA, 20 bp, Artificial Sequence
  Description of Artificial Sequence: Synthetic oligonucleotide
  Target: SCN9A; (+) strand; PAM type: NRG; PAM sequence: AGG
atatccccaaactttgcaga

SEQ ID NO: 40346 - DNA, 20 bp, Artificial Sequence
  Description of Artificial Sequence: Synthetic oligonucleotide
  Target: SCN9A; (+) strand; PAM type: NRG; PAM sequence: AAG
tccccaaactttgcagaagg

SEQ ID NO: 40347 - DNA, 20 bp, Artificial Sequence
  Description of Artificial Sequence: Synthetic oligonucleotide
  Target: SCN9A; (+) strand; PAM type: NRG; PAM sequence: AAG
gcagaaggaagaaaataaca

SEQ ID NO: 40348 - DNA, 20 bp, Artificial Sequence
  Description of Artificial Sequence: Synthetic oligonucleotide
  Target: SCN9A; (+) strand; PAM type: NRG; PAM sequence: TAG
gaaaataacaaagataatga

SEQ ID NO: 40349 - DNA, 20 bp, Artificial Sequence
  Description of Artificial Sequence: Synthetic oligonucleotide
  Target: SCN9A; (+) strand; PAM type: NRG; PAM sequence: AAG
gataatgatagaaataaaca

SEQ ID NO: 40350 - DNA, 20 bp, Artificial Sequence
  Description of Artificial Sequence: Synthetic oligonucleotide
  Target: SCN9A; (+) strand; PAM type: NRG; PAM sequence: AAG
taaacaaagcaaatactaaa

SEQ ID NO: 40351 - DNA, 20 bp, Artificial Sequence
  Description of Artificial Sequence: Synthetic oligonucleotide
  Target: SCN9A; (+) strand; PAM type: NRG; PAM sequence: AAG
taaaaagttgtttttttgaa

SEQ ID NO: 40352 - DNA, 20 bp, Artificial Sequence
  Description of Artificial Sequence: Synthetic oligonucleotide
  Target: SCN9A; (+) strand; PAM type: NRG; PAM sequence: TAG
aaaatcgaaaaacctttaac

SEQ ID NO: 40353 - DNA, 20 bp, Artificial Sequence
  Description of Artificial Sequence: Synthetic oligonucleotide
  Target: SCN9A; (+) strand; PAM type: NRG; PAM sequence: AAG
aacctttaactagactaacc

SEQ ID NO: 40354 - DNA, 20 bp, Artificial Sequence
  Description of Artificial Sequence: Synthetic oligonucleotide
  Target: SCN9A; (+) strand; PAM type: NRG; PAM sequence: AGG
acctttaactagactaacca

SEQ ID NO: 40355 - DNA, 20 bp, Artificial Sequence
  Description of Artificial Sequence: Synthetic oligonucleotide
  Target: SCN9A; (+) strand; PAM type: NRG; PAM sequence: GGG
cctttaactagactaaccaa

SEQ ID NO: 40356 - DNA, 20 bp, Artificial Sequence
  Description of Artificial Sequence: Synthetic oligonucleotide
  Target: SCN9A; (+) strand; PAM type: NRG; PAM sequence: AAG
ctagactaaccaagggaaaa

SEQ ID NO: 40357 - DNA, 20 bp, Artificial Sequence
  Description of Artificial Sequence: Synthetic oligonucleotide
  Target: SCN9A; (+) strand; PAM type: NRG; PAM sequence: AAG
tcaaacaatatctgaaatga

SEQ ID NO: 40358 - DNA, 20 bp, Artificial Sequence
  Description of Artificial Sequence: Synthetic oligonucleotide
  Target: SCN9A; (+) strand; PAM type: NRG; PAM sequence: AAG
aacaatatctgaaatgaaag

SEQ ID NO: 40359 - DNA, 20 bp, Artificial Sequence
  Description of Artificial Sequence: Synthetic oligonucleotide
  Target: SCN9A; (+) strand; PAM type: NRG; PAM sequence: AGG
acaatatctgaaatgaaaga

SEQ ID NO: 40360 - DNA, 20 bp, Artificial Sequence
  Description of Artificial Sequence: Synthetic oligonucleotide
  Target: SCN9A; (+) strand; PAM type: NRG; PAM sequence: GGG
caatatctgaaatgaaagaa

SEQ ID NO: 40361 - DNA, 20 bp, Artificial Sequence
  Description of Artificial Sequence: Synthetic oligonucleotide
  Target: SCN9A; (+) strand; PAM type: NRG; PAM sequence: GAG
atatctgaaatgaaagaagg

SEQ ID NO: 40362 - DNA, 20 bp, Artificial Sequence
  Description of Artificial Sequence: Synthetic oligonucleotide
  Target: SCN9A; (+) strand; PAM type: NRG; PAM sequence: AAG
cactgataacacataaatac

SEQ ID NO: 40363 - DNA, 20 bp, Artificial Sequence
  Description of Artificial Sequence: Synthetic oligonucleotide
  Target: SCN9A; (+) strand; PAM type: NRG; PAM sequence: AGG
actgataacacataaataca

SEQ ID NO: 40364 - DNA, 20 bp, Artificial Sequence
  Description of Artificial Sequence: Synthetic oligonucleotide
  Target: SCN9A; (+) strand; PAM type: NRG; PAM sequence: TAG
caccatcaaattgaataacc

SEQ ID NO: 40365 - DNA, 20 bp, Artificial Sequence
  Description of Artificial Sequence: Synthetic oligonucleotide
  Target: SCN9A; (+) strand; PAM type: NRG; PAM sequence: AAG
catcaaattgaataacctag

SEQ ID NO: 40366 - DNA, 20 bp, Artificial Sequence
  Description of Artificial Sequence: Synthetic oligonucleotide
  Target: SCN9A; (+) strand; PAM type: NRG; PAM sequence: AGG
atcaaattgaataacctaga

SEQ ID NO: 40367 - DNA, 20 bp, Artificial Sequence
  Description of Artificial Sequence: Synthetic oligonucleotide
  Target: SCN9A; (+) strand; PAM type: NRG; PAM sequence: TAG
agaaggaatgaactaatctt

SEQ ID NO: 40368 - DNA, 20 bp, Artificial Sequence
  Description of Artificial Sequence: Synthetic oligonucleotide
  Target: SCN9A; (+) strand; PAM type: NRG; PAM sequence: AAG
ttagaaacatgcaacctacc

SEQ ID NO: 40369 - DNA, 20 bp, Artificial Sequence
  Description of Artificial Sequence: Synthetic oligonucleotide
  Target: SCN9A; (+) strand; PAM type: NRG; PAM sequence: AAG
caacctaccaagactaaatc

SEQ ID NO: 40370 - DNA, 20 bp, Artificial Sequence
  Description of Artificial Sequence: Synthetic oligonucleotide
  Target: SCN9A; (+) strand; PAM type: NRG; PAM sequence: TGG
acatctgaacaaaccaatac

SEQ ID NO: 40371 - DNA, 20 bp, Artificial Sequence
  Description of Artificial Sequence: Synthetic oligonucleotide
  Target: SCN9A; (+) strand; PAM type: NRG; PAM sequence: AAG
gaacaaaccaatactggata

SEQ ID NO: 40372 - DNA, 20 bp, Artificial Sequence
  Description of Artificial Sequence: Synthetic oligonucleotide
  Target: SCN9A; (+) strand; PAM type: NRG; PAM sequence: TAG
ccaatactggataaagaaaa

SEQ ID NO: 40373 - DNA, 20 bp, Artificial Sequence
  Description of Artificial Sequence: Synthetic oligonucleotide
  Target: SCN9A; (+) strand; PAM type: NRG; PAM sequence: CAG
actggataaagaaaatagat

SEQ ID NO: 40374 - DNA, 20 bp, Artificial Sequence
  Description of Artificial Sequence: Synthetic oligonucleotide
  Target: SCN9A; (+) strand; PAM type: NRG; PAM sequence: AAG
aaatagatcagtaataaatt

SEQ ID NO: 40375 - DNA, 20 bp, Artificial Sequence
  Description of Artificial Sequence: Synthetic oligonucleotide
  Target: SCN9A; (+) strand; PAM type: NRG; PAM sequence: AAG
tcctaaccaaaaaaaaaaaa

SEQ ID NO: 40376 - DNA, 20 bp, Artificial Sequence
  Description of Artificial Sequence: Synthetic oligonucleotide
  Target: SCN9A; (+) strand; PAM type: NRG; PAM sequence: AGG
cctaaccaaaaaaaaaaaaa

SEQ ID NO: 40377 - DNA, 20 bp, Artificial Sequence
  Description of Artificial Sequence: Synthetic oligonucleotide
  Target: SCN9A; (+) strand; PAM type: NRG; PAM sequence: AAG
ccaaaaaaaaaaaaaaggaa

SEQ ID NO: 40378 - DNA, 20 bp, Artificial Sequence
  Description of Artificial Sequence: Synthetic oligonucleotide
  Target: SCN9A; (+) strand; PAM type: NRG; PAM sequence: AGG
caaaaaaaaaaaaaaggaaa

SEQ ID NO: 40379 - DNA, 20 bp, Artificial Sequence
  Description of Artificial Sequence: Synthetic oligonucleotide
  Target: SCN9A; (+) strand; PAM type: NRG; PAM sequence: TGG
aaaaaaaaggaaaaggtcac

SEQ ID NO: 40380 - DNA, 20 bp, Artificial Sequence
  Description of Artificial Sequence: Synthetic oligonucleotide
  Target: SCN9A; (+) strand; PAM type: NRG; PAM sequence: AAG
tcactggtgaattctattta

SEQ ID NO: 40381 - DNA, 20 bp, Artificial Sequence
  Description of Artificial Sequence: Synthetic oligonucleotide
  Target: SCN9A; (+) strand; PAM type: NRG; PAM sequence: AAG
ctggtgaattctatttaaag

SEQ ID NO: 40382 - DNA, 20 bp, Artificial Sequence
  Description of Artificial Sequence: Synthetic oligonucleotide
  Target: SCN9A; (+) strand; PAM type: NRG; PAM sequence: AAG
aattcttccaaaaaattgaa

SEQ ID NO: 40383 - DNA, 20 bp, Artificial Sequence
  Description of Artificial Sequence: Synthetic oligonucleotide
  Target: SCN9A; (+) strand; PAM type: NRG; PAM sequence: AGG
attcttccaaaaaattgaaa

SEQ ID NO: 40384 - DNA, 20 bp, Artificial Sequence
  Description of Artificial Sequence: Synthetic oligonucleotide
  Target: SCN9A; (+) strand; PAM type: NRG; PAM sequence: GAG
tcttccaaaaaattgaaaag

SEQ ID NO: 40385 - DNA, 20 bp, Artificial Sequence
  Description of Artificial Sequence: Synthetic oligonucleotide
  Target: SCN9A; (+) strand; PAM type: NRG; PAM sequence: AGG
cttccaaaaaattgaaaagg

SEQ ID NO: 40386 - DNA, 20 bp, Artificial Sequence
  Description of Artificial Sequence: Synthetic oligonucleotide
  Target: SCN9A; (+) strand; PAM type: NRG; PAM sequence: GAG
ggaggtcaaattcattttat

SEQ ID NO: 40387 - DNA, 20 bp, Artificial Sequence
  Description of Artificial Sequence: Synthetic oligonucleotide
  Target: SCN9A; (+) strand; PAM type: NRG; PAM sequence: AGG
gaggtcaaattcattttatg

SEQ ID NO: 40388 - DNA, 20 bp, Artificial Sequence
  Description of Artificial Sequence: Synthetic oligonucleotide
  Target: SCN9A; (+) strand; PAM type: NRG; PAM sequence: CAG
tcaaattcattttatgaggc

SEQ ID NO: 40389 - DNA, 20 bp, Artificial Sequence
  Description of Artificial Sequence: Synthetic oligonucleotide
  Target: SCN9A; (+) strand; PAM type: NRG; PAM sequence: AAG
tatactgatatgaaaaccct

SEQ ID NO: 40390 - DNA, 20 bp, Artificial Sequence
  Description of Artificial Sequence: Synthetic oligonucleotide
  Target: SCN9A; (+) strand; PAM type: NRG; PAM sequence: GAG
tactgatatgaaaaccctaa

SEQ ID NO: 40391 - DNA, 20 bp, Artificial Sequence
  Description of Artificial Sequence: Synthetic oligonucleotide
  Target: SCN9A; (+) strand; PAM type: NRG; PAM sequence: CAG
aaaccctaagagtatgctac

SEQ ID NO: 40392 - DNA, 20 bp, Artificial Sequence
  Description of Artificial Sequence: Synthetic oligonucleotide
  Target: SCN9A; (+) strand; PAM type: NRG; PAM sequence: AAG
ctaagagtatgctaccagaa

SEQ ID NO: 40393 - DNA, 20 bp, Artificial Sequence
  Description of Artificial Sequence: Synthetic oligonucleotide
  Target: SCN9A; (+) strand; PAM type: NRG; PAM sequence: CAG
gctaccagaaaagaaaactg

SEQ ID NO: 40394 - DNA, 20 bp, Artificial Sequence
  Description of Artificial Sequence: Synthetic oligonucleotide
  Target: SCN9A; (+) strand; PAM type: NRG; PAM sequence: AGG
ctaccagaaaagaaaactgc

SEQ ID NO: 40395 - DNA, 20 bp, Artificial Sequence
  Description of Artificial Sequence: Synthetic oligonucleotide
  Target: SCN9A; (+) strand; PAM type: NRG; PAM sequence: TAG
gccaatattcttgatgaaca

SEQ ID NO: 40396 - DNA, 20 bp, Artificial Sequence
  Description of Artificial Sequence: Synthetic oligonucleotide
  Target: SCN9A; (+) strand; PAM type: NRG; PAM sequence: TAG
aaaaattcacaacaatatat

SEQ ID NO: 40397 - DNA, 20 bp, Artificial Sequence
  Description of Artificial Sequence: Synthetic oligonucleotide
  Target: SCN9A; (+) strand; PAM type: NRG; PAM sequence: TAG
tattagcaaactgaattccc

SEQ ID NO: 40398 - DNA, 20 bp, Artificial Sequence
  Description of Artificial Sequence: Synthetic oligonucleotide
  Target: SCN9A; (+) strand; PAM type: NRG; PAM sequence: TGG
catcattcaccatgattact

SEQ ID NO: 40399 - DNA, 20 bp, Artificial Sequence
  Description of Artificial Sequence: Synthetic oligonucleotide
  Target: SCN9A; (+) strand; PAM type: NRG; PAM sequence: GGG
atcattcaccatgattactt

SEQ ID NO: 40400 - DNA, 20 bp, Artificial Sequence
  Description of Artificial Sequence: Synthetic oligonucleotide
  Target: SCN9A; (+) strand; PAM type: NRG; PAM sequence: GAG
tgattacttgggatttatct

SEQ ID NO: 40401 - DNA, 20 bp, Artificial Sequence
  Description of Artificial Sequence: Synthetic oligonucleotide
  Target: SCN9A; (+) strand; PAM type: NRG; PAM sequence: AGG
gattacttgggatttatctg

SEQ ID NO: 40402 - DNA, 20 bp, Artificial Sequence
  Description of Artificial Sequence: Synthetic oligonucleotide
  Target: SCN9A; (+) strand; PAM type: NRG; PAM sequence: GGG
attacttgggatttatctga

SEQ ID NO: 40403 - DNA, 20 bp, Artificial Sequence
  Description of Artificial Sequence: Synthetic oligonucleotide
  Target: SCN9A; (+) strand; PAM type: NRG; PAM sequence: TGG
ttatctgagggatgcaaaaa

SEQ ID NO: 40404 - DNA, 20 bp, Artificial Sequence
  Description of Artificial Sequence: Synthetic oligonucleotide
  Target: SCN9A; (+) strand; PAM type: NRG; PAM sequence: AAG
atatgctacattaacaaaat

SEQ ID NO: 40405 - DNA, 20 bp, Artificial Sequence
  Description of Artificial Sequence: Synthetic oligonucleotide
  Target: SCN9A; (+) strand; PAM type: NRG; PAM sequence: TAG
aaatcatatgatcatcttac

SEQ ID NO: 40406 - DNA, 20 bp, Artificial Sequence
  Description of Artificial Sequence: Synthetic oligonucleotide
  Target: SCN9A; (+) strand; PAM type: NRG; PAM sequence: CAG
tatgatcatcttactagatg

SEQ ID NO: 40407 - DNA, 20 bp, Artificial Sequence
  Description of Artificial Sequence: Synthetic oligonucleotide
  Target: SCN9A; (+) strand; PAM type: NRG; PAM sequence: AAG
catcttactagatgcagaca

SEQ ID NO: 40408 - DNA, 20 bp, Artificial Sequence
  Description of Artificial Sequence: Synthetic oligonucleotide
  Target: SCN9A; (+) strand; PAM type: NRG; PAM sequence: CAG
acaaagcatttgataaaatc

SEQ ID NO: 40409 - DNA, 20 bp, Artificial Sequence
  Description of Artificial Sequence: Synthetic oligonucleotide
  Target: SCN9A; (+) strand; PAM type: NRG; PAM sequence: AAG
ttcataataaaatctcaaca

SEQ ID NO: 40410 - DNA, 20 bp, Artificial Sequence
  Description of Artificial Sequence: Synthetic oligonucleotide
  Target: SCN9A; (+) strand; PAM type: NRG; PAM sequence: CAG
ataataaaatctcaacaaag

SEQ ID NO: 40411 - DNA, 20 bp, Artificial Sequence
  Description of Artificial Sequence: Synthetic oligonucleotide
  Target: SCN9A; (+) strand; PAM type: NRG; PAM sequence: TGG
aaatctcaacaaagcagata

SEQ ID NO: 40412 - DNA, 20 bp, Artificial Sequence
  Description of Artificial Sequence: Synthetic oligonucleotide
  Target: SCN9A; (+) strand; PAM type: NRG; PAM sequence: AAG
tctcaacaaagcagatatgg

SEQ ID NO: 40413 - DNA, 20 bp, Artificial Sequence
  Description of Artificial Sequence: Synthetic oligonucleotide
  Target: SCN9A; (+) strand; PAM type: NRG; PAM sequence: AGG
ctcaacaaagcagatatgga

SEQ ID NO: 40414 - DNA, 20 bp, Artificial Sequence
  Description of Artificial Sequence: Synthetic oligonucleotide
  Target: SCN9A; (+) strand; PAM type: NRG; PAM sequence: AAG
gaatgtaccttaacaaaata

SEQ ID NO: 40415 - DNA, 20 bp, Artificial Sequence
  Description of Artificial Sequence: Synthetic oligonucleotide
  Target: SCN9A; (+) strand; PAM type: NRG; PAM sequence: AAG
aaaataaagccatatatgac

SEQ ID NO: 40416 - DNA, 20 bp, Artificial Sequence
  Description of Artificial Sequence: Synthetic oligonucleotide
  Target: SCN9A; (+) strand; PAM type: NRG; PAM sequence: CGG
agccatatatgacaagccca

SEQ ID NO: 40417 - DNA, 20 bp, Artificial Sequence
  Description of Artificial Sequence: Synthetic oligonucleotide
  Target: SCN9A; (+) strand; PAM type: NRG; PAM sequence: AAG
aacattatgcaaaaactgaa

SEQ ID NO: 40418 - DNA, 20 bp, Artificial Sequence
  Description of Artificial Sequence: Synthetic oligonucleotide
  Target: SCN9A; (+) strand; PAM type: NRG; PAM sequence: TGG
ttatgcaaaaactgaaaagt

SEQ ID NO: 40419 - DNA, 20 bp, Artificial Sequence
  Description of Artificial Sequence: Synthetic oligonucleotide
  Target: SCN9A; (+) strand; PAM type: NRG; PAM sequence: GGG
tatgcaaaaactgaaaagtt

SEQ ID NO: 40420 - DNA, 20 bp, Artificial Sequence
  Description of Artificial Sequence: Synthetic oligonucleotide
  Target: SCN9A; (+) strand; PAM type: NRG; PAM sequence: GAG
tgcaaaaactgaaaagttgg

SEQ ID NO: 40421 - DNA, 20 bp, Artificial Sequence
  Description of Artificial Sequence: Synthetic oligonucleotide
  Target: SCN9A; (+) strand; PAM type: NRG; PAM sequence: AAG
aagttgggagcttttcttct

SEQ ID NO: 40422 - DNA, 20 bp, Artificial Sequence
  Description of Artificial Sequence: Synthetic oligonucleotide
  Target: SCN9A; (+) strand; PAM type: NRG; PAM sequence: CAG
gggagcttttcttctaagat

SEQ ID NO: 40423 - DNA, 20 bp, Artificial Sequence
  Description of Artificial Sequence: Synthetic oligonucleotide
  Target: SCN9A; (+) strand; PAM type: NRG; PAM sequence: AGG
ggagcttttcttctaagatc

SEQ ID NO: 40424 - DNA, 20 bp, Artificial Sequence
  Description of Artificial Sequence: Synthetic oligonucleotide
  Target: SCN9A; (+) strand; PAM type: NRG; PAM sequence: AAG
tttcttctaagatcaggaac

SEQ ID NO: 40425 - DNA, 20 bp, Artificial Sequence
  Description of Artificial Sequence: Synthetic oligonucleotide
  Target: SCN9A; (+) strand; PAM type: NRG; PAM sequence: AAG
tctaagatcaggaacaagac

SEQ ID NO: 40426 - DNA, 20 bp, Artificial Sequence
  Description of Artificial Sequence: Synthetic oligonucleotide
  Target: SCN9A; (+) strand; PAM type: NRG; PAM sequence: AGG
ctaagatcaggaacaagaca

SEQ ID NO: 40427 - DNA, 20 bp, Artificial Sequence
  Description of Artificial Sequence: Synthetic oligonucleotide
  Target: SCN9A; (+) strand; PAM type: NRG; PAM sequence: TAG
attaccacttctttttgaca

SEQ ID NO: 40428 - DNA, 20 bp, Artificial Sequence
  Description of Artificial Sequence: Synthetic oligonucleotide
  Target: SCN9A; (+) strand; PAM type: NRG; PAM sequence: TAG
acttctttttgacatagtac

SEQ ID NO: 40429 - DNA, 20 bp, Artificial Sequence
  Description of Artificial Sequence: Synthetic oligonucleotide
  Target: SCN9A; (+) strand; PAM type: NRG; PAM sequence: TAG
agtactagaaatcccatcca

SEQ ID NO: 40430 - DNA, 20 bp, Artificial Sequence
  Description of Artificial Sequence: Synthetic oligonucleotide
  Target: SCN9A; (+) strand; PAM type: NRG; PAM sequence: TAG
gaaatcccatccatagcaat

SEQ ID NO: 40431 - DNA, 20 bp, Artificial Sequence
  Description of Artificial Sequence: Synthetic oligonucleotide
  Target: SCN9A; (+) strand; PAM type: NRG; PAM sequence: AGG
aaatcccatccatagcaatt

SEQ ID NO: 40432 - DNA, 20 bp, Artificial Sequence
  Description of Artificial Sequence: Synthetic oligonucleotide
  Target: SCN9A; (+) strand; PAM type: NRG; PAM sequence: CAG
tcccatccatagcaattagg

SEQ ID NO: 40433 - DNA, 20 bp, Artificial Sequence
  Description of Artificial Sequence: Synthetic oligonucleotide
  Target: SCN9A; (+) strand; PAM type: NRG; PAM sequence: AGG
cccatccatagcaattaggc

SEQ ID NO: 40434 - DNA, 20 bp, Artificial Sequence
  Description of Artificial Sequence: Synthetic oligonucleotide
  Target: SCN9A; (+) strand; PAM type: NRG; PAM sequence: AAG
catagcaattaggcaggaaa

SEQ ID NO: 40435 - DNA, 20 bp, Artificial Sequence
  Description of Artificial Sequence: Synthetic oligonucleotide
  Target: SCN9A; (+) strand; PAM type: NRG; PAM sequence: AAG
gaaataaaatacatccatgt

SEQ ID NO: 40436 - DNA, 20 bp, Artificial Sequence
  Description of Artificial Sequence: Synthetic oligonucleotide
  Target: SCN9A; (+) strand; PAM type: NRG; PAM sequence: AAG
taaaatacatccatgtaaga

SEQ ID NO: 40437 - DNA, 20 bp, Artificial Sequence
  Description of Artificial Sequence: Synthetic oligonucleotide
  Target: SCN9A; (+) strand; PAM type: NRG; PAM sequence: AAG
atacatccatgtaagaaagc

SEQ ID NO: 40438 - DNA, 20 bp, Artificial Sequence
  Description of Artificial Sequence: Synthetic oligonucleotide
  Target: SCN9A; (+) strand; PAM type: NRG; PAM sequence: TAG
aatgacatgatctttatatg

SEQ ID NO: 40439 - DNA, 20 bp, Artificial Sequence
  Description of Artificial Sequence: Synthetic oligonucleotide
  Target: SCN9A; (+) strand; PAM type: NRG; PAM sequence: GAG
aaaaccctgaacactctact

SEQ ID NO: 40440 - DNA, 20 bp, Artificial Sequence
  Description of Artificial Sequence: Synthetic oligonucleotide
  Target: SCN9A; (+) strand; PAM type: NRG; PAM sequence: CAG
ttaaaactgatacataaatt

SEQ ID NO: 40441 - DNA, 20 bp, Artificial Sequence
  Description of Artificial Sequence: Synthetic oligonucleotide
  Target: SCN9A; (+) strand; PAM type: NRG; PAM sequence: AAG
actgatacataaattcagta

SEQ ID NO: 40442 - DNA, 20 bp, Artificial Sequence
  Description of Artificial Sequence: Synthetic oligonucleotide
  Target: SCN9A; (+) strand; PAM type: NRG; PAM sequence: CAG
acataaattcagtaaagttg

SEQ ID NO: 40443 - DNA, 20 bp, Artificial Sequence
  Description of Artificial Sequence: Synthetic oligonucleotide
  Target: SCN9A; (+) strand; PAM type: NRG; PAM sequence: TAG
tgcagtttgcaaaatcaaca

SEQ ID NO: 40444 - DNA, 20 bp, Artificial Sequence
  Description of Artificial Sequence: Synthetic oligonucleotide
  Target: SCN9A; (+) strand; PAM type: NRG; PAM sequence: CAG
caaaatcaacatagaaaaat

SEQ ID NO: 40445 - DNA, 20 bp, Artificial Sequence
  Description of Artificial Sequence: Synthetic oligonucleotide
  Target: SCN9A; (+) strand; PAM type: NRG; PAM sequence: TAG
aatcaacatagaaaaatcag

SEQ ID NO: 40446 - DNA, 20 bp, Artificial Sequence
  Description of Artificial Sequence: Synthetic oligonucleotide
  Target: SCN9A; (+) strand; PAM type: NRG; PAM sequence: GAG
catttctatacattaacaat

SEQ ID NO: 40447 - DNA, 20 bp, Artificial Sequence
  Description of Artificial Sequence: Synthetic oligonucleotide
  Target: SCN9A; (+) strand; PAM type: NRG; PAM sequence: AGG
atttctatacattaacaatg

SEQ ID NO: 40448 - DNA, 20 bp, Artificial Sequence
  Description of Artificial Sequence: Synthetic oligonucleotide
  Target: SCN9A; (+) strand; PAM type: NRG; PAM sequence: AAG
taacaatgaggtatccaaca

SEQ ID NO: 40449 - DNA, 20 bp, Artificial Sequence
  Description of Artificial Sequence: Synthetic oligonucleotide
  Target: SCN9A; (+) strand; PAM type: NRG; PAM sequence: AAG
aggtatccaacaaagaaatt

SEQ ID NO: 40450 - DNA, 20 bp, Artificial Sequence
  Description of Artificial Sequence: Synthetic oligonucleotide
  Target: SCN9A; (+) strand; PAM type: NRG; PAM sequence: CAG
gaaattaatcctatttaaaa

SEQ ID NO: 40451 - DNA, 20 bp, Artificial Sequence
  Description of Artificial Sequence: Synthetic oligonucleotide
  Target: SCN9A; (+) strand; PAM type: NRG; PAM sequence: AAG
taaataaataaaatactttg

SEQ ID NO: 40452 - DNA, 20 bp, Artificial Sequence
  Description of Artificial Sequence: Synthetic oligonucleotide
  Target: SCN9A; (+) strand; PAM type: NRG; PAM sequence: CAG
tactttgaagtaaatttaac

SEQ ID NO: 40453 - DNA, 20 bp, Artificial Sequence
  Description of Artificial Sequence: Synthetic oligonucleotide
  Target: SCN9A; (+) strand; PAM type: NRG; PAM sequence: AGG
actttgaagtaaatttaacc

SEQ ID NO: 40454 - DNA, 20 bp, Artificial Sequence
  Description of Artificial Sequence: Synthetic oligonucleotide
  Target: SCN9A; (+) strand; PAM type: NRG; PAM sequence: AAG
tgaagtaaatttaaccagga

SEQ ID NO: 40455 - DNA, 20 bp, Artificial Sequence
  Description of Artificial Sequence: Synthetic oligonucleotide
  Target: SCN9A; (+) strand; PAM type: NRG; PAM sequence: AAG
aaatttaaccaggaaagttg

SEQ ID NO: 40456 - DNA, 20 bp, Artificial Sequence
  Description of Artificial Sequence: Synthetic oligonucleotide
  Target: SCN9A; (+) strand; PAM type: NRG; PAM sequence: AAG
atctgtacactgaaaactat

SEQ ID NO: 40457 - DNA, 20 bp, Artificial Sequence
  Description of Artificial Sequence: Synthetic oligonucleotide
  Target: SCN9A; (+) strand; PAM type: NRG; PAM sequence: GAG
taagttgatttaaaaaaact

SEQ ID NO: 40458 - DNA, 20 bp, Artificial Sequence
  Description of Artificial Sequence: Synthetic oligonucleotide
  Target: SCN9A; (+) strand; PAM type: NRG; PAM sequence: AGG
aagttgatttaaaaaaactg

SEQ ID NO: 40459 - DNA, 20 bp, Artificial Sequence
  Description of Artificial Sequence: Synthetic oligonucleotide
  Target: SCN9A; (+) strand; PAM type: NRG; PAM sequence: AAG
ttgatttaaaaaaactgagg

SEQ ID NO: 40460 - DNA, 20 bp, Artificial Sequence
  Description of Artificial Sequence: Synthetic oligonucleotide
  Target: SCN9A; (+) strand; PAM type: NRG; PAM sequence: TGG
tatatttcatgttcatgtgt

SEQ ID NO: 40461 - DNA, 20 bp, Artificial Sequence
  Description of Artificial Sequence: Synthetic oligonucleotide
  Target: SCN9A; (+) strand; PAM type: NRG; PAM sequence: AAG
atttcatgttcatgtgttgg

SEQ ID NO: 40462 - DNA, 20 bp, Artificial Sequence
  Description of Artificial Sequence: Synthetic oligonucleotide
  Target: SCN9A; (+) strand; PAM type: NRG; PAM sequence: CAG
atactacccaaaataatcta

SEQ ID NO: 40463 - DNA, 20 bp, Artificial Sequence
  Description of Artificial Sequence: Synthetic oligonucleotide
  Target: SCN9A; (+) strand; PAM type: NRG; PAM sequence: CAG
ccctatcaaaattctaatgt

SEQ ID NO: 40464 - DNA, 20 bp, Artificial Sequence
  Description of Artificial Sequence: Synthetic oligonucleotide
  Target: SCN9A; (+) strand; PAM type: NRG; PAM sequence: CAG
aattctaatgtcagttttca

SEQ ID NO: 40465 - DNA, 20 bp, Artificial Sequence
  Description of Artificial Sequence: Synthetic oligonucleotide
  Target: SCN9A; (+) strand; PAM type: NRG; PAM sequence: TAG
aatgtcagttttcacagaaa

SEQ ID NO: 40466 - DNA, 20 bp, Artificial Sequence
  Description of Artificial Sequence: Synthetic oligonucleotide
  Target: SCN9A; (+) strand; PAM type: NRG; PAM sequence: AAG
aacatttgaataaaataaaa

SEQ ID NO: 40467 - DNA, 20 bp, Artificial Sequence
  Description of Artificial Sequence: Synthetic oligonucleotide
  Target: SCN9A; (+) strand; PAM type: NRG; PAM sequence: TGG
aaaataaaaaagatgctaaa

SEQ ID NO: 40468 - DNA, 20 bp, Artificial Sequence
  Description of Artificial Sequence: Synthetic oligonucleotide
  Target: SCN9A; (+) strand; PAM type: NRG; PAM sequence: AAG
aaaaagatgctaaatggcca

SEQ ID NO: 40469 - DNA, 20 bp, Artificial Sequence
  Description of Artificial Sequence: Synthetic oligonucleotide
  Target: SCN9A; (+) strand; PAM type: NRG; PAM sequence: GAG
ctaaatggccaaagcaatct

SEQ ID NO: 40470 - DNA, 20 bp, Artificial Sequence
  Description of Artificial Sequence: Synthetic oligonucleotide
  Target: SCN9A; (+) strand; PAM type: NRG; PAM sequence: AAG
gccaaagcaatctgagcaaa

SEQ ID NO: 40471 - DNA, 20 bp, Artificial Sequence
  Description of Artificial Sequence: Synthetic oligonucleotide
  Target: SCN9A; (+) strand; PAM type: NRG; PAM sequence: AAG
caatctgagcaaaaagaaca

SEQ ID NO: 40472 - DNA, 20 bp, Artificial Sequence
  Description of Artificial Sequence: Synthetic oligonucleotide
  Target: SCN9A; (+) strand; PAM type: NRG; PAM sequence: TAG
ctgagcaaaaagaacaaagc

SEQ ID NO: 40473 - DNA, 20 bp, Artificial Sequence
  Description of Artificial Sequence: Synthetic oligonucleotide
  Target: SCN9A; (+) strand; PAM type: NRG; PAM sequence: GAG
gagcaaaaagaacaaagcta

SEQ ID NO: 40474 - DNA, 20 bp, Artificial Sequence
  Description of Artificial Sequence: Synthetic oligonucleotide
  Target: SCN9A; (+) strand; PAM type: NRG; PAM sequence: AGG
agcaaaaagaacaaagctag

SEQ ID NO: 40475 - DNA, 20 bp, Artificial Sequence
  Description of Artificial Sequence: Synthetic oligonucleotide
  Target: SCN9A; (+) strand; PAM type: NRG; PAM sequence: AAG
ctctgtcatttcaaaatata

SEQ ID NO: 40476 - DNA, 20 bp, Artificial Sequence
  Description of Artificial Sequence: Synthetic oligonucleotide
  Target: SCN9A; (+) strand; PAM type: NRG; PAM sequence: TGG
aaaatataaagctatgctat

SEQ ID NO: 40477 - DNA, 20 bp, Artificial Sequence
  Description of Artificial Sequence: Synthetic oligonucleotide
  Target: SCN9A; (+) strand; PAM type: NRG; PAM sequence: CAG
ctatgctattggcataaaca

SEQ ID NO: 40478 - DNA, 20 bp, Artificial Sequence
  Description of Artificial Sequence: Synthetic oligonucleotide
  Target: SCN9A; (+) strand; PAM type: NRG; PAM sequence: TGG
tggcataaacacagatatat

SEQ ID NO: 40479 - DNA, 20 bp, Artificial Sequence
  Description of Artificial Sequence: Synthetic oligonucleotide
  Target: SCN9A; (+) strand; PAM type: NRG; PAM sequence: TGG
aacacagatatattggctaa

SEQ ID NO: 40480 - DNA, 20 bp, Artificial Sequence
  Description of Artificial Sequence: Synthetic oligonucleotide
  Target: SCN9A; (+) strand; PAM type: NRG; PAM sequence: AAG
agatatattggctaatggaa

SEQ ID NO: 40481 - DNA, 20 bp, Artificial Sequence
  Description of Artificial Sequence: Synthetic oligonucleotide
  Target: SCN9A; (+) strand; PAM type: NRG; PAM sequence: AGG
gatatattggctaatggaaa

SEQ ID NO: 40482 - DNA, 20 bp, Artificial Sequence
  Description of Artificial Sequence: Synthetic oligonucleotide
  Target: SCN9A; (+) strand; PAM type: NRG; PAM sequence: AAG
ggctaatggaaaaggataaa

SEQ ID NO: 40483 - DNA, 20 bp, Artificial Sequence
  Description of Artificial Sequence: Synthetic oligonucleotide
  Target: SCN9A; (+) strand; PAM type: NRG; PAM sequence: CAG
atggaaaaggataaaaagcc

SEQ ID NO: 40484 - DNA, 20 bp, Artificial Sequence
  Description of Artificial Sequence: Synthetic oligonucleotide
  Target: SCN9A; (+) strand; PAM type: NRG; PAM sequence: TAG
gaaataaacccaattattta

SEQ ID NO: 40485 - DNA, 20 bp, Artificial Sequence
  Description of Artificial Sequence: Synthetic oligonucleotide
  Target: SCN9A; (+) strand; PAM type: NRG; PAM sequence: CAG
atttatagtcaattgatttt

SEQ ID NO: 40486 - DNA, 20 bp, Artificial Sequence
  Description of Artificial Sequence: Synthetic oligonucleotide
  Target: SCN9A; (+) strand; PAM type: NRG; PAM sequence: AAG
tagtcaattgattttcagca

SEQ ID NO: 40487 - DNA, 20 bp, Artificial Sequence
  Description of Artificial Sequence: Synthetic oligonucleotide
  Target: SCN9A; (+) strand; PAM type: NRG; PAM sequence: AGG
agtcaattgattttcagcaa

SEQ ID NO: 40488 - DNA, 20 bp, Artificial Sequence
  Description of Artificial Sequence: Synthetic oligonucleotide
  Target: SCN9A; (+) strand; PAM type: NRG; PAM sequence: AAG
tgattttcagcaaaggtgca

SEQ ID NO: 40489 - DNA, 20 bp, Artificial Sequence
  Description of Artificial Sequence: Synthetic oligonucleotide
  Target: SCN9A; (+) strand; PAM type: NRG; PAM sequence: TGG
aaggtgcaaagaataaacaa

SEQ ID NO: 40490 - DNA, 20 bp, Artificial Sequence
  Description of Artificial Sequence: Synthetic oligonucleotide
  Target: SCN9A; (+) strand; PAM type: NRG; PAM sequence: GGG
aggtgcaaagaataaacaat

SEQ ID NO: 40491 - DNA, 20 bp, Artificial Sequence
  Description of Artificial Sequence: Synthetic oligonucleotide
  Target: SCN9A; (+) strand; PAM type: NRG; PAM sequence: GGG
ggtgcaaagaataaacaatg

SEQ ID NO: 40492 - DNA, 20 bp, Artificial Sequence
  Description of Artificial Sequence: Synthetic oligonucleotide
  Target: SCN9A; (+) strand; PAM type: NRG; PAM sequence: GGG
gtgcaaagaataaacaatgg

SEQ ID NO: 40493 - DNA, 20 bp, Artificial Sequence
  Description of Artificial Sequence: Synthetic oligonucleotide
  Target: SCN9A; (+) strand; PAM type: NRG; PAM sequence: AAG
aaagaataaacaatggggga

SEQ ID NO: 40494 - DNA, 20 bp, Artificial Sequence
  Description of Artificial Sequence: Synthetic oligonucleotide
  Target: SCN9A; (+) strand; PAM type: NRG; PAM sequence: AGG
aagaataaacaatgggggaa

SEQ ID NO: 40495 - DNA, 20 bp, Artificial Sequence
  Description of Artificial Sequence: Synthetic oligonucleotide
  Target: SCN9A; (+) strand; PAM type: NRG; PAM sequence: TGG
aggacgatctcttcaataaa

SEQ ID NO: 40496 - DNA, 20 bp, Artificial Sequence
  Description of Artificial Sequence: Synthetic oligonucleotide
  Target: SCN9A; (+) strand; PAM type: NRG; PAM sequence: TGG
atctcttcaataaatggtgt

SEQ ID NO: 40497 - DNA, 20 bp, Artificial Sequence
  Description of Artificial Sequence: Synthetic oligonucleotide
  Target: SCN9A; (+) strand; PAM type: NRG; PAM sequence: GGG
tctcttcaataaatggtgtt

SEQ ID NO: 40498 - DNA, 20 bp, Artificial Sequence
  Description of Artificial Sequence: Synthetic oligonucleotide
  Target: SCN9A; (+) strand; PAM type: NRG; PAM sequence: AAG
actgaatattccttatgcaa

SEQ ID NO: 40499 - DNA, 20 bp, Artificial Sequence
  Description of Artificial Sequence: Synthetic oligonucleotide
  Target: SCN9A; (+) strand; PAM type: NRG; PAM sequence: TGG
cttatgcaaaagaatgaaat

SEQ ID NO: 40500 - DNA, 20 bp, Artificial Sequence
  Description of Artificial Sequence: Synthetic oligonucleotide
  Target: SCN9A; (+) strand; PAM type: NRG; PAM sequence: GGG
ttatgcaaaagaatgaaatt

SEQ ID NO: 40501 - DNA, 20 bp, Artificial Sequence
  Description of Artificial Sequence: Synthetic oligonucleotide
  Target: SCN9A; (+) strand; PAM type: NRG; PAM sequence: AAG
atatgtttataaaaccaaac

SEQ ID NO: 40502 - DNA, 20 bp, Artificial Sequence
  Description of Artificial Sequence: Synthetic oligonucleotide
  Target: SCN9A; (+) strand; PAM type: NRG; PAM sequence: AAG
ttataaaaccaaacaagtaa

SEQ ID NO: 40503 - DNA, 20 bp, Artificial Sequence
  Description of Artificial Sequence: Synthetic oligonucleotide
  Target: SCN9A; (+) strand; PAM type: NRG; PAM sequence: AAG
caagtaaaagacttaaatat

SEQ ID NO: 40504 - DNA, 20 bp, Artificial Sequence
  Description of Artificial Sequence: Synthetic oligonucleotide
  Target: SCN9A; (+) strand; PAM type: NRG; PAM sequence: AAG
atataagaaatgaaactata

SEQ ID NO: 40505 - DNA, 20 bp, Artificial Sequence
  Description of Artificial Sequence: Synthetic oligonucleotide
  Target: SCN9A; (+) strand; PAM type: NRG; PAM sequence: TAG
aaatgaaactataaagctac

SEQ ID NO: 40506 - DNA, 20 bp, Artificial Sequence
  Description of Artificial Sequence: Synthetic oligonucleotide
  Target: SCN9A; (+) strand; PAM type: NRG; PAM sequence: AAG
tgaaactataaagctactag

SEQ ID NO: 40507 - DNA, 20 bp, Artificial Sequence
  Description of Artificial Sequence: Synthetic oligonucleotide
  Target: SCN9A; (+) strand; PAM type: NRG; PAM sequence: AAG
gctactagaagaaaacataa

SEQ ID NO: 40508 - DNA, 20 bp, Artificial Sequence
  Description of Artificial Sequence: Synthetic oligonucleotide
  Target: SCN9A; (+) strand; PAM type: NRG; PAM sequence: AAG
tagaagaaaacataaaagaa

SEQ ID NO: 40509 - DNA, 20 bp, Artificial Sequence
  Description of Artificial Sequence: Synthetic oligonucleotide
  Target: SCN9A; (+) strand; PAM type: NRG; PAM sequence: TGG
aaagctgtatgacatttatc

SEQ ID NO: 40510 - DNA, 20 bp, Artificial Sequence
  Description of Artificial Sequence: Synthetic oligonucleotide
  Target: SCN9A; (+) strand; PAM type: NRG; PAM sequence: GGG
aagctgtatgacatttatct

SEQ ID NO: 40511 - DNA, 20 bp, Artificial Sequence
  Description of Artificial Sequence: Synthetic oligonucleotide
  Target: SCN9A; (+) strand; PAM type: NRG; PAM sequence: AAG
tgtatgacatttatctgggc

SEQ ID NO: 40512 - DNA, 20 bp, Artificial Sequence
  Description of Artificial Sequence: Synthetic oligonucleotide
  Target: SCN9A; (+) strand; PAM type: NRG; PAM sequence: AGG
gtatgacatttatctgggca

SEQ ID NO: 40513 - DNA, 20 bp, Artificial Sequence
  Description of Artificial Sequence: Synthetic oligonucleotide
  Target: SCN9A; (+) strand; PAM type: NRG; PAM sequence: TGG
ttatctgggcaaggatttct

SEQ ID NO: 40514 - DNA, 20 bp, Artificial Sequence
  Description of Artificial Sequence: Synthetic oligonucleotide
  Target: SCN9A; (+) strand; PAM type: NRG; PAM sequence: TAG
ctgggcaaggatttcttggc

SEQ ID NO: 40515 - DNA, 20 bp, Artificial Sequence
  Description of Artificial Sequence: Synthetic oligonucleotide
  Target: SCN9A; (+) strand; PAM type: NRG; PAM sequence: AGG
tgggcaaggatttcttggct

SEQ ID NO: 40516 - DNA, 20 bp, Artificial Sequence
  Description of Artificial Sequence: Synthetic oligonucleotide
  Target: SCN9A; (+) strand; PAM type: NRG; PAM sequence: AAG
tttcttggctaggactctaa

SEQ ID NO: 40517 - DNA, 20 bp, Artificial Sequence
  Description of Artificial Sequence: Synthetic oligonucleotide
  Target: SCN9A; (+) strand; PAM type: NRG; PAM sequence: CAG
tggctaggactctaaaagca

SEQ ID NO: 40518 - DNA, 20 bp, Artificial Sequence
  Description of Artificial Sequence: Synthetic oligonucleotide
  Target: SCN9A; (+) strand; PAM type: NRG; PAM sequence: AGG
ggctaggactctaaaagcac

SEQ ID NO: 40519 - DNA, 20 bp, Artificial Sequence
  Description of Artificial Sequence: Synthetic oligonucleotide
  Target: SCN9A; (+) strand; PAM type: NRG; PAM sequence: AAG
tctaaaagcacaggtaacaa

SEQ ID NO: 40520 - DNA, 20 bp, Artificial Sequence
  Description of Artificial Sequence: Synthetic oligonucleotide
  Target: SCN9A; (+) strand; PAM type: NRG; PAM sequence: AAG
cacaggtaacaaaagacaat

SEQ ID NO: 40521 - DNA, 20 bp, Artificial Sequence
  Description of Artificial Sequence: Synthetic oligonucleotide
  Target: SCN9A; (+) strand; PAM type: NRG; PAM sequence: GAG
caggtaacaaaagacaataa

SEQ ID NO: 40522 - DNA, 20 bp, Artificial Sequence
  Description of Artificial Sequence: Synthetic oligonucleotide
  Target: SCN9A; (+) strand; PAM type: NRG; PAM sequence: AAG
aacaaaagacaataagagac

SEQ ID NO: 40523 - DNA, 20 bp, Artificial Sequence
  Description of Artificial Sequence: Synthetic oligonucleotide
  Target: SCN9A; (+) strand; PAM type: NRG; PAM sequence: TGG
aaagacaataagagacaagt

SEQ ID NO: 40524 - DNA, 20 bp, Artificial Sequence
  Description of Artificial Sequence: Synthetic oligonucleotide
  Target: SCN9A; (+) strand; PAM type: NRG; PAM sequence: TAG
caataagagacaagttggat

SEQ ID NO: 40525 - DNA, 20 bp, Artificial Sequence
  Description of Artificial Sequence: Synthetic oligonucleotide
  Target: SCN9A; (+) strand; PAM type: NRG; PAM sequence: CAG
caaactaaaaatgttcttta

SEQ ID NO: 40526 - DNA, 20 bp, Artificial Sequence
  Description of Artificial Sequence: Synthetic oligonucleotide
  Target: SCN9A; (+) strand; PAM type: NRG; PAM sequence: AAG
aatgttctttacagcaaacg

SEQ ID NO: 40527 - DNA, 20 bp, Artificial Sequence
  Description of Artificial Sequence: Synthetic oligonucleotide
  Target: SCN9A; (+) strand; PAM type: NRG; PAM sequence: CAG
tacagcaaacgaagcaataa

SEQ ID NO: 40528 - DNA, 20 bp, Artificial Sequence
  Description of Artificial Sequence: Synthetic oligonucleotide
  Target: SCN9A; (+) strand; PAM type: NRG; PAM sequence: GAG
cagcaaacgaagcaataaca

SEQ ID NO: 40529 - DNA, 20 bp, Artificial Sequence
  Description of Artificial Sequence: Synthetic oligonucleotide
  Target: SCN9A; (+) strand; PAM type: NRG; PAM sequence: TGG
caaacgaagcaataacagag

SEQ ID NO: 40530 - DNA, 20 bp, Artificial Sequence
  Description of Artificial Sequence: Synthetic oligonucleotide
  Target: SCN9A; (+) strand; PAM type: NRG; PAM sequence: GAG
aacgaagcaataacagagtg

SEQ ID NO: 40531 - DNA, 20 bp, Artificial Sequence
  Description of Artificial Sequence: Synthetic oligonucleotide
  Target: SCN9A; (+) strand; PAM type: NRG; PAM sequence: GAG
cgaagcaataacagagtgga

SEQ ID NO: 40532 - DNA, 20 bp, Artificial Sequence
  Description of Artificial Sequence: Synthetic oligonucleotide
  Target: SCN9A; (+) strand; PAM type: NRG; PAM sequence: GAG
aagcaataacagagtggaga

SEQ ID NO: 40533 - DNA, 20 bp, Artificial Sequence
  Description of Artificial Sequence: Synthetic oligonucleotide
  Target: SCN9A; (+) strand; PAM type: NRG; PAM sequence: GAG
gcaataacagagtggagaga

SEQ ID NO: 40534 - DNA, 20 bp, Artificial Sequence
  Description of Artificial Sequence: Synthetic oligonucleotide
  Target: SCN9A; (+) strand; PAM type: NRG; PAM sequence: TGG
cagagtggagagagagatca

SEQ ID NO: 40535 - DNA, 20 bp, Artificial Sequence
  Description of Artificial Sequence: Synthetic oligonucleotide
  Target: SCN9A; (+) strand; PAM type: NRG; PAM sequence: AAG
tgcaaaccatacatctgata

SEQ ID NO: 40536 - DNA, 20 bp, Artificial Sequence
  Description of Artificial Sequence: Synthetic oligonucleotide
  Target: SCN9A; (+) strand; PAM type: NRG; PAM sequence: AGG
gcaaaccatacatctgataa

SEQ ID NO: 40537 - DNA, 20 bp, Artificial Sequence
  Description of Artificial Sequence: Synthetic oligonucleotide
  Target: SCN9A; (+) strand; PAM type: NRG; PAM sequence: GGG
caaaccatacatctgataaa

SEQ ID NO: 40538 - DNA, 20 bp, Artificial Sequence
  Description of Artificial Sequence: Synthetic oligonucleotide
  Target: SCN9A; (+) strand; PAM type: NRG; PAM sequence: AAG
tatccaacattatacataaa

SEQ ID NO: 40539 - DNA, 20 bp, Artificial Sequence
  Description of Artificial Sequence: Synthetic oligonucleotide
  Target: SCN9A; (+) strand; PAM type: NRG; PAM sequence: AAG
acattatacataaaaagctc

SEQ ID NO: 40540 - DNA, 20 bp, Artificial Sequence
  Description of Artificial Sequence: Synthetic oligonucleotide
  Target: SCN9A; (+) strand; PAM type: NRG; PAM sequence: TAG
agctcaagcaactcaacacc

SEQ ID NO: 40541 - DNA, 20 bp, Artificial Sequence
  Description of Artificial Sequence: Synthetic oligonucleotide
  Target: SCN9A; (+) strand; PAM type: NRG; PAM sequence: TAG
gaaaatcaataaaccaattg

SEQ ID NO: 40542 - DNA, 20 bp, Artificial Sequence
  Description of Artificial Sequence: Synthetic oligonucleotide
  Target: SCN9A; (+) strand; PAM type: NRG; PAM sequence: TGG
tcaataaaccaattgtagaa

SEQ ID NO: 40543 - DNA, 20 bp, Artificial Sequence
  Description of Artificial Sequence: Synthetic oligonucleotide
  Target: SCN9A; (+) strand; PAM type: NRG; PAM sequence: GGG
caataaaccaattgtagaat

SEQ ID NO: 40544 - DNA, 20 bp, Artificial Sequence
  Description of Artificial Sequence: Synthetic oligonucleotide
  Target: SCN9A; (+) strand; PAM type: NRG; PAM sequence: CAG
gaatgggcaaataatctgaa

SEQ ID NO: 40545 - DNA, 20 bp, Artificial Sequence
  Description of Artificial Sequence: Synthetic oligonucleotide
  Target: SCN9A; (+) strand; PAM type: NRG; PAM sequence: AAG
tctgaacagacatttctcaa

SEQ ID NO: 40546 - DNA, 20 bp, Artificial Sequence
  Description of Artificial Sequence: Synthetic oligonucleotide
  Target: SCN9A; (+) strand; PAM type: NRG; PAM sequence: AAG
gaacagacatttctcaaaag

SEQ ID NO: 40547 - DNA, 20 bp, Artificial Sequence
  Description of Artificial Sequence: Synthetic oligonucleotide
  Target: SCN9A; (+) strand; PAM type: NRG; PAM sequence: GAG
acagacatttctcaaaagaa

SEQ ID NO: 40548 - DNA, 20 bp, Artificial Sequence
  Description of Artificial Sequence: Synthetic oligonucleotide
  Target: SCN9A; (+) strand; PAM type: NRG; PAM sequence: TGG
ctcaaaagaagagatatgaa

SEQ ID NO: 40549 - DNA, 20 bp, Artificial Sequence
  Description of Artificial Sequence: Synthetic oligonucleotide
  Target: SCN9A; (+) strand; PAM type: NRG; PAM sequence: TAG
gaagagatatgaatggccaa

SEQ ID NO: 40550 - DNA, 20 bp, Artificial Sequence
  Description of Artificial Sequence: Synthetic oligonucleotide
  Target: SCN9A; (+) strand; PAM type: NRG; PAM sequence: CAG
tgctcaacatctctaatcat

SEQ ID NO: 40551 - DNA, 20 bp, Artificial Sequence
  Description of Artificial Sequence: Synthetic oligonucleotide
  Target: SCN9A; (+) strand; PAM type: NRG; PAM sequence: TAG
aaatattacctcacacctcc

SEQ ID NO: 40552 - DNA, 20 bp, Artificial Sequence
  Description of Artificial Sequence: Synthetic oligonucleotide
  Target: SCN9A; (+) strand; PAM type: NRG; PAM sequence: TGG
ttacctcacacctcctagaa

SEQ ID NO: 40553 - DNA, 20 bp, Artificial Sequence
  Description of Artificial Sequence: Synthetic oligonucleotide
  Target: SCN9A; (+) strand; PAM type: NRG; PAM sequence: AAG
ctagaatggctgttatcaaa

SEQ ID NO: 40554 - DNA, 20 bp, Artificial Sequence
  Description of Artificial Sequence: Synthetic oligonucleotide
  Target: SCN9A; (+) strand; PAM type: NRG; PAM sequence: AAG
tcaaaaagatgaatgataac

SEQ ID NO: 40555 - DNA, 20 bp, Artificial Sequence
  Description of Artificial Sequence: Synthetic oligonucleotide
  Target: SCN9A; (+) strand; PAM type: NRG; PAM sequence: GAG
gaatgataacaagtgttgat

SEQ ID NO: 40556 - DNA, 20 bp, Artificial Sequence
  Description of Artificial Sequence: Synthetic oligonucleotide
  Target: SCN9A; (+) strand; PAM type: NRG; PAM sequence: AGG
aatgataacaagtgttgatg

SEQ ID NO: 40557 - DNA, 20 bp, Artificial Sequence
  Description of Artificial Sequence: Synthetic oligonucleotide
  Target: SCN9A; (+) strand; PAM type: NRG; PAM sequence: TGG
aacaagtgttgatgaggatg

SEQ ID NO: 40558 - DNA, 20 bp, Artificial Sequence
  Description of Artificial Sequence: Synthetic oligonucleotide
  Target: SCN9A; (+) strand; PAM type: NRG; PAM sequence: GAG
caagtgttgatgaggatgtg

SEQ ID NO: 40559 - DNA, 20 bp, Artificial Sequence
  Description of Artificial Sequence: Synthetic oligonucleotide
  Target: SCN9A; (+) strand; PAM type: NRG; PAM sequence: TAG
ttgatgaggatgtggagaaa

SEQ ID NO: 40560 - DNA, 20 bp, Artificial Sequence
  Description of Artificial Sequence: Synthetic oligonucleotide
  Target: SCN9A; (+) strand; PAM type: NRG; PAM sequence: AGG
tgatgaggatgtggagaaat

SEQ ID NO: 40561 - DNA, 20 bp, Artificial Sequence
  Description of Artificial Sequence: Synthetic oligonucleotide
  Target: SCN9A; (+) strand; PAM type: NRG; PAM sequence: TAG
taggaacccttatacattgt

SEQ ID NO: 40562 - DNA, 20 bp, Artificial Sequence
  Description of Artificial Sequence: Synthetic oligonucleotide
  Target: SCN9A; (+) strand; PAM type: NRG; PAM sequence: TAG
ttgttagtgaaaatgtaaat

SEQ ID NO: 40563 - DNA, 20 bp, Artificial Sequence
  Description of Artificial Sequence: Synthetic oligonucleotide
  Target: SCN9A; (+) strand; PAM type: NRG; PAM sequence: CAG
agtgaaaatgtaaattagta

SEQ ID NO: 40564 - DNA, 20 bp, Artificial Sequence
  Description of Artificial Sequence: Synthetic oligonucleotide
  Target: SCN9A; (+) strand; PAM type: NRG; PAM sequence: GAG
gtaaattagtacagctgttt

SEQ ID NO: 40565 - DNA, 20 bp, Artificial Sequence
  Description of Artificial Sequence: Synthetic oligonucleotide
  Target: SCN9A; (+) strand; PAM type: NRG; PAM sequence: TAG
gtacagctgtttgagaaaaa

SEQ ID NO: 40566 - DNA, 20 bp, Artificial Sequence
  Description of Artificial Sequence: Synthetic oligonucleotide
  Target: SCN9A; (+) strand; PAM type: NRG; PAM sequence: TGG
gctgtttgagaaaaatagca

SEQ ID NO: 40567 - DNA, 20 bp, Artificial Sequence
  Description of Artificial Sequence: Synthetic oligonucleotide
  Target: SCN9A; (+) strand; PAM type: NRG; PAM sequence: AAG
gtttgagaaaaatagcatgg

SEQ ID NO: 40568 - DNA, 20 bp, Artificial Sequence
  Description of Artificial Sequence: Synthetic oligonucleotide
  Target: SCN9A; (+) strand; PAM type: NRG; PAM sequence: CAG
aatacaattaccatataatt

SEQ ID NO: 40569 - DNA, 20 bp, Artificial Sequence
  Description of Artificial Sequence: Synthetic oligonucleotide
  Target: SCN9A; (+) strand; PAM type: NRG; PAM sequence: TAG
taattcagcaattccacttc

SEQ ID NO: 40570 - DNA, 20 bp, Artificial Sequence
  Description of Artificial Sequence: Synthetic oligonucleotide
  Target: SCN9A; (+) strand; PAM type: NRG; PAM sequence: AGG
aattcagcaattccacttct

SEQ ID NO: 40571 - DNA, 20 bp, Artificial Sequence
  Description of Artificial Sequence: Synthetic oligonucleotide
  Target: SCN9A; (+) strand; PAM type: NRG; PAM sequence: TAG
caattccacttctaggtata

SEQ ID NO: 40572 - DNA, 20 bp, Artificial Sequence
  Description of Artificial Sequence: Synthetic oligonucleotide
  Target: SCN9A; (+) strand; PAM type: NRG; PAM sequence: TGG
ttccacttctaggtatatag

SEQ ID NO: 40573 - DNA, 20 bp, Artificial Sequence
  Description of Artificial Sequence: Synthetic oligonucleotide
  Target: SCN9A; (+) strand; PAM type: NRG; PAM sequence: TAG
tggtatatatttaattcctt

SEQ ID NO: 40574 - DNA, 20 bp, Artificial Sequence
  Description of Artificial Sequence: Synthetic oligonucleotide
  Target: SCN9A; (+) strand; PAM type: NRG; PAM sequence: GAG
gtatatatttaattccttta

SEQ ID NO: 40575 - DNA, 20 bp, Artificial Sequence
  Description of Artificial Sequence: Synthetic oligonucleotide
  Target: SCN9A; (+) strand; PAM type: NRG; PAM sequence: AGG
tatatatttaattcctttag

SEQ ID NO: 40576 - DNA, 20 bp, Artificial Sequence
  Description of Artificial Sequence: Synthetic oligonucleotide
  Target: SCN9A; (+) strand; PAM type: NRG; PAM sequence: AAG
gaattaaaatcgttctgtca

SEQ ID NO: 40577 - DNA, 20 bp, Artificial Sequence
  Description of Artificial Sequence: Synthetic oligonucleotide
  Target: SCN9A; (+) strand; PAM type: NRG; PAM sequence: AGG
aattaaaatcgttctgtcaa

SEQ ID NO: 40578 - DNA, 20 bp, Artificial Sequence
  Description of Artificial Sequence: Synthetic oligonucleotide
  Target: SCN9A; (+) strand; PAM type: NRG; PAM sequence: CAG
ctgcactcccatgttcattt

SEQ ID NO: 40579 - DNA, 20 bp, Artificial Sequence
  Description of Artificial Sequence: Synthetic oligonucleotide
  Target: SCN9A; (+) strand; PAM type: NRG; PAM sequence: AAG
ttcatttcagcattatttac

SEQ ID NO: 40580 - DNA, 20 bp, Artificial Sequence
  Description of Artificial Sequence: Synthetic oligonucleotide
  Target: SCN9A; (+) strand; PAM type: NRG; PAM sequence: AAG
cagcattatttacaagaacc

SEQ ID NO: 40581 - DNA, 20 bp, Artificial Sequence
  Description of Artificial Sequence: Synthetic oligonucleotide
  Target: SCN9A; (+) strand; PAM type: NRG; PAM sequence: TAG
ttacaagaaccaagacatat

SEQ ID NO: 40582 - DNA, 20 bp, Artificial Sequence
  Description of Artificial Sequence: Synthetic oligonucleotide
  Target: SCN9A; (+) strand; PAM type: NRG; PAM sequence: AGG
tacaagaaccaagacatatt

SEQ ID NO: 40583 - DNA, 20 bp, Artificial Sequence
  Description of Artificial Sequence: Synthetic oligonucleotide
  Target: SCN9A; (+) strand; PAM type: NRG; PAM sequence: TGG
agaaccaagacatattaggt

SEQ ID NO: 40584 - DNA, 20 bp, Artificial Sequence
  Description of Artificial Sequence: Synthetic oligonucleotide
  Target: SCN9A; (+) strand; PAM type: NRG; PAM sequence: CAG
ggttggtgcaaatgtaattg

SEQ ID NO: 40585 - DNA, 20 bp, Artificial Sequence
  Description of Artificial Sequence: Synthetic oligonucleotide
  Target: SCN9A; (+) strand; PAM type: NRG; PAM sequence: AAG
attacttttgctgcaattaa

SEQ ID NO: 40586 - DNA, 20 bp, Artificial Sequence
  Description of Artificial Sequence: Synthetic oligonucleotide
  Target: SCN9A; (+) strand; PAM type: NRG; PAM sequence: TGG
tttgctgcaattaaaagtaa

SEQ ID NO: 40587 - DNA, 20 bp, Artificial Sequence
  Description of Artificial Sequence: Synthetic oligonucleotide
  Target: SCN9A; (+) strand; PAM type: NRG; PAM sequence: CAG
atgcaacctgtacccatcaa

SEQ ID NO: 40588 - DNA, 20 bp, Artificial Sequence
  Description of Artificial Sequence: Synthetic oligonucleotide
  Target: SCN9A; (+) strand; PAM type: NRG; PAM sequence: AGG
tgcaacctgtacccatcaac

SEQ ID NO: 40589 - DNA, 20 bp, Artificial Sequence
  Description of Artificial Sequence: Synthetic oligonucleotide
  Target: SCN9A; (+) strand; PAM type: NRG; PAM sequence: AAG
catcaacaggtgaatgaata

SEQ ID NO: 40590 - DNA, 20 bp, Artificial Sequence
  Description of Artificial Sequence: Synthetic oligonucleotide
  Target: SCN9A; (+) strand; PAM type: NRG; PAM sequence: TAG
aatgaataaagaaaatgtga

SEQ ID NO: 40591 - DNA, 20 bp, Artificial Sequence
  Description of Artificial Sequence: Synthetic oligonucleotide
  Target: SCN9A; (+) strand; PAM type: NRG; PAM sequence: AGG
atgaataaagaaaatgtgat

SEQ ID NO: 40592 - DNA, 20 bp, Artificial Sequence
  Description of Artificial Sequence: Synthetic oligonucleotide
  Target: SCN9A; (+) strand; PAM type: NRG; PAM sequence: CAG
gaaaatgtgataggtatgca

SEQ ID NO: 40593 - DNA, 20 bp, Artificial Sequence
  Description of Artificial Sequence: Synthetic oligonucleotide
  Target: SCN9A; (+) strand; PAM type: NRG; PAM sequence: AAG
actactatacaaaactttaa

SEQ ID NO: 40594 - DNA, 20 bp, Artificial Sequence
  Description of Artificial Sequence: Synthetic oligonucleotide
  Target: SCN9A; (+) strand; PAM type: NRG; PAM sequence: AAG
tcccaacatgaatgaaacta

SEQ ID NO: 40595 - DNA, 20 bp, Artificial Sequence
  Description of Artificial Sequence: Synthetic oligonucleotide
  Target: SCN9A; (+) strand; PAM type: NRG; PAM sequence: AGG
cccaacatgaatgaaactaa

SEQ ID NO: 40596 - DNA, 20 bp, Artificial Sequence
  Description of Artificial Sequence: Synthetic oligonucleotide
  Target: SCN9A; (+) strand; PAM type: NRG; PAM sequence: AAG
aaactaaaggacgttatgct

SEQ ID NO: 40597 - DNA, 20 bp, Artificial Sequence
  Description of Artificial Sequence: Synthetic oligonucleotide
  Target: SCN9A; (+) strand; PAM type: NRG; PAM sequence: TAG
gacgttatgctaagcaaaat

SEQ ID NO: 40598 - DNA, 20 bp, Artificial Sequence
  Description of Artificial Sequence: Synthetic oligonucleotide
  Target: SCN9A; (+) strand; PAM type: NRG; PAM sequence: CAG
ttatgctaagcaaaattagc

SEQ ID NO: 40599 - DNA, 20 bp, Artificial Sequence
  Description of Artificial Sequence: Synthetic oligonucleotide
  Target: SCN9A; (+) strand; PAM type: NRG; PAM sequence: AGG
tatgctaagcaaaattagcc

SEQ ID NO: 40600 - DNA, 20 bp, Artificial Sequence
  Description of Artificial Sequence: Synthetic oligonucleotide
  Target: SCN9A; (+) strand; PAM type: NRG; PAM sequence: CAG
taagcaaaattagccaggta

SEQ ID NO: 40601 - DNA, 20 bp, Artificial Sequence
  Description of Artificial Sequence: Synthetic oligonucleotide
  Target: SCN9A; (+) strand; PAM type: NRG; PAM sequence: AAG
caaaattagccaggtacaga

SEQ ID NO: 40602 - DNA, 20 bp, Artificial Sequence
  Description of Artificial Sequence: Synthetic oligonucleotide
  Target: SCN9A; (+) strand; PAM type: NRG; PAM sequence: TGG
gatctcacttacatgtaaaa

SEQ ID NO: 40603 - DNA, 20 bp, Artificial Sequence
  Description of Artificial Sequence: Synthetic oligonucleotide
  Target: SCN9A; (+) strand; PAM type: NRG; PAM sequence: GGG
atctcacttacatgtaaaat

SEQ ID NO: 40604 - DNA, 20 bp, Artificial Sequence
  Description of Artificial Sequence: Synthetic oligonucleotide
  Target: SCN9A; (+) strand; PAM type: NRG; PAM sequence: GGG
tctcacttacatgtaaaatg

SEQ ID NO: 40605 - DNA, 20 bp, Artificial Sequence
  Description of Artificial Sequence: Synthetic oligonucleotide
  Target: SCN9A; (+) strand; PAM type: NRG; PAM sequence: TGG
cacttacatgtaaaatgggg

SEQ ID NO: 40606 - DNA, 20 bp, Artificial Sequence
  Description of Artificial Sequence: Synthetic oligonucleotide
  Target: SCN9A; (+) strand; PAM type: NRG; PAM sequence: GGG
acttacatgtaaaatggggt

SEQ ID NO: 40607 - DNA, 20 bp, Artificial Sequence
  Description of Artificial Sequence: Synthetic oligonucleotide
  Target: SCN9A; (+) strand; PAM type: NRG; PAM sequence: GGG
cttacatgtaaaatggggtg

SEQ ID NO: 40608 - DNA, 20 bp, Artificial Sequence
  Description of Artificial Sequence: Synthetic oligonucleotide
  Target: SCN9A; (+) strand; PAM type: NRG; PAM sequence: GGG
ttacatgtaaaatggggtgg

SEQ ID NO: 40609 - DNA, 20 bp, Artificial Sequence
  Description of Artificial Sequence: Synthetic oligonucleotide
  Target: SCN9A; (+) strand; PAM type: NRG; PAM sequence: GGG
tacatgtaaaatggggtggg

SEQ ID NO: 40610 - DNA, 20 bp, Artificial Sequence
  Description of Artificial Sequence: Synthetic oligonucleotide
  Target: SCN9A; (+) strand; PAM type: NRG; PAM sequence: GAG
catgtaaaatggggtggggg

SEQ ID NO: 40611 - DNA, 20 bp, Artificial Sequence
  Description of Artificial Sequence: Synthetic oligonucleotide
  Target: SCN9A; (+) strand; PAM type: NRG; PAM sequence: AGG
atgtaaaatggggtgggggg

SEQ ID NO: 40612 - DNA, 20 bp, Artificial Sequence
  Description of Artificial Sequence: Synthetic oligonucleotide
  Target: SCN9A; (+) strand; PAM type: NRG; PAM sequence: GGG
tgtaaaatggggtgggggga

SEQ ID NO: 40613 - DNA, 20 bp, Artificial Sequence
  Description of Artificial Sequence: Synthetic oligonucleotide
  Target: SCN9A; (+) strand; PAM type: NRG; PAM sequence: GGG
gtaaaatggggtggggggag

SEQ ID NO: 40614 - DNA, 20 bp, Artificial Sequence
  Description of Artificial Sequence: Synthetic oligonucleotide
  Target: SCN9A; (+) strand; PAM type: NRG; PAM sequence: GGG
taaaatggggtggggggagg

SEQ ID NO: 40615 - DNA, 20 bp, Artificial Sequence
  Description of Artificial Sequence: Synthetic oligonucleotide
  Target: SCN9A; (+) strand; PAM type: NRG; PAM sequence: GGG
aaaatggggtggggggaggg

SEQ ID NO: 40616 - DNA, 20 bp, Artificial Sequence
  Description of Artificial Sequence: Synthetic oligonucleotide
  Target: SCN9A; (+) strand; PAM type: NRG; PAM sequence: GAG
aatggggtggggggaggggg

SEQ ID NO: 40617 - DNA, 20 bp, Artificial Sequence
  Description of Artificial Sequence: Synthetic oligonucleotide
  Target: SCN9A; (+) strand; PAM type: NRG; PAM sequence: AGG
atggggtggggggagggggg

SEQ ID NO: 40618 - DNA, 20 bp, Artificial Sequence
  Description of Artificial Sequence: Synthetic oligonucleotide
  Target: SCN9A; (+) strand; PAM type: NRG; PAM sequence: GGG
tggggtggggggagggggga

SEQ ID NO: 40619 - DNA, 20 bp, Artificial Sequence
  Description of Artificial Sequence: Synthetic oligonucleotide
  Target: SCN9A; (+) strand; PAM type: NRG; PAM sequence: TAG
gtggggggaggggggaggga

SEQ ID NO: 40620 - DNA, 20 bp, Artificial Sequence
  Description of Artificial Sequence: Synthetic oligonucleotide
  Target: SCN9A; (+) strand; PAM type: NRG; PAM sequence: TAG
ggaggggggagggatagcat

SEQ ID NO: 40621 - DNA, 20 bp, Artificial Sequence
  Description of Artificial Sequence: Synthetic oligonucleotide
  Target: SCN9A; (+) strand; PAM type: NRG; PAM sequence: AGG
gaggggggagggatagcatt

SEQ ID NO: 40622 - DNA, 20 bp, Artificial Sequence
  Description of Artificial Sequence: Synthetic oligonucleotide
  Target: SCN9A; (+) strand; PAM type: NRG; PAM sequence: GAG
ggggggagggatagcattag

SEQ ID NO: 40623 - DNA, 20 bp, Artificial Sequence
  Description of Artificial Sequence: Synthetic oligonucleotide
  Target: SCN9A; (+) strand; PAM type: NRG; PAM sequence: GAG
atatacctaatgtaaatgac

SEQ ID NO: 40624 - DNA, 20 bp, Artificial Sequence
  Description of Artificial Sequence: Synthetic oligonucleotide
  Target: SCN9A; (+) strand; PAM type: NRG; PAM sequence: TGG
taatgtaaatgacgagttaa

SEQ ID NO: 40625 - DNA, 20 bp, Artificial Sequence
  Description of Artificial Sequence: Synthetic oligonucleotide
  Target: SCN9A; (+) strand; PAM type: NRG; PAM sequence: GGG
aatgtaaatgacgagttaat

SEQ ID NO: 40626 - DNA, 20 bp, Artificial Sequence
  Description of Artificial Sequence: Synthetic oligonucleotide
  Target: SCN9A; (+) strand; PAM type: NRG; PAM sequence: TGG
atgggtgccgcacaccaaca

SEQ ID NO: 40627 - DNA, 20 bp, Artificial Sequence
  Description of Artificial Sequence: Synthetic oligonucleotide
  Target: SCN9A; (+) strand; PAM type: NRG; PAM sequence: TAG
cacgttgtgcacatgtaccc

SEQ ID NO: 40628 - DNA, 20 bp, Artificial Sequence
  Description of Artificial Sequence: Synthetic oligonucleotide
  Target: SCN9A; (+) strand; PAM type: NRG; PAM sequence: AAG
cacatgtaccctagaactta

SEQ ID NO: 40629 - DNA, 20 bp, Artificial Sequence
  Description of Artificial Sequence: Synthetic oligonucleotide
  Target: SCN9A; (+) strand; PAM type: NRG; PAM sequence: AAG
taaataaataaaaaataaaa

SEQ ID NO: 40630 - DNA, 20 bp, Artificial Sequence
  Description of Artificial Sequence: Synthetic oligonucleotide
  Target: SCN9A; (+) strand; PAM type: NRG; PAM sequence: GAG
taaataaaaaataaaaaagt

SEQ ID NO: 40631 - DNA, 20 bp, Artificial Sequence
  Description of Artificial Sequence: Synthetic oligonucleotide
  Target: SCN9A; (+) strand; PAM type: NRG; PAM sequence: AAG
ataaaaaataaaaaagtgag

SEQ ID NO: 40632 - DNA, 20 bp, Artificial Sequence
  Description of Artificial Sequence: Synthetic oligonucleotide
  Target: SCN9A; (+) strand; PAM type: NRG; PAM sequence: CAG
aaagtgagaagtcaacatta

SEQ ID NO: 40633 - DNA, 20 bp, Artificial Sequence
  Description of Artificial Sequence: Synthetic oligonucleotide
  Target: SCN9A; (+) strand; PAM type: NRG; PAM sequence: CAG
agaagtcaacattacagaaa

SEQ ID NO: 40634 - DNA, 20 bp, Artificial Sequence
  Description of Artificial Sequence: Synthetic oligonucleotide
  Target: SCN9A; (+) strand; PAM type: NRG; PAM sequence: AAG
cattacagaaacagcatata

SEQ ID NO: 40635 - DNA, 20 bp, Artificial Sequence
  Description of Artificial Sequence: Synthetic oligonucleotide
  Target: SCN9A; (+) strand; PAM type: NRG; PAM sequence: AGG
attacagaaacagcatataa

SEQ ID NO: 40636 - DNA, 20 bp, Artificial Sequence
  Description of Artificial Sequence: Synthetic oligonucleotide
  Target: SCN9A; (+) strand; PAM type: NRG; PAM sequence: TGG
acagaaacagcatataaagg

SEQ ID NO: 40637 - DNA, 20 bp, Artificial Sequence
  Description of Artificial Sequence: Synthetic oligonucleotide
  Target: SCN9A; (+) strand; PAM type: NRG; PAM sequence: TAG
gcatataaaggtggttgcca

SEQ ID NO: 40638 - DNA, 20 bp, Artificial Sequence
  Description of Artificial Sequence: Synthetic oligonucleotide
  Target: SCN9A; (+) strand; PAM type: NRG; PAM sequence: AGG
catataaaggtggttgccat

SEQ ID NO: 40639 - DNA, 20 bp, Artificial Sequence
  Description of Artificial Sequence: Synthetic oligonucleotide
  Target: SCN9A; (+) strand; PAM type: NRG; PAM sequence: TGG
aaaggtggttgccataggac

SEQ ID NO: 40640 - DNA, 20 bp, Artificial Sequence
  Description of Artificial Sequence: Synthetic oligonucleotide
  Target: SCN9A; (+) strand; PAM type: NRG; PAM sequence: GGG
aaggtggttgccataggact

SEQ ID NO: 40641 - DNA, 20 bp, Artificial Sequence
  Description of Artificial Sequence: Synthetic oligonucleotide
  Target: SCN9A; (+) strand; PAM type: NRG; PAM sequence: GGG
aggtggttgccataggactg

SEQ ID NO: 40642 - DNA, 20 bp, Artificial Sequence
  Description of Artificial Sequence: Synthetic oligonucleotide
  Target: SCN9A; (+) strand; PAM type: NRG; PAM sequence: GGG
ggtggttgccataggactgg

SEQ ID NO: 40643 - DNA, 20 bp, Artificial Sequence
  Description of Artificial Sequence: Synthetic oligonucleotide
  Target: SCN9A; (+) strand; PAM type: NRG; PAM sequence: AAG
ggttgccataggactggggg

SEQ ID NO: 40644 - DNA, 20 bp, Artificial Sequence
  Description of Artificial Sequence: Synthetic oligonucleotide
  Target: SCN9A; (+) strand; PAM type: NRG; PAM sequence: TGG
aggactgggggaagacgatg

SEQ ID NO: 40645 - DNA, 20 bp, Artificial Sequence
  Description of Artificial Sequence: Synthetic oligonucleotide
  Target: SCN9A; (+) strand; PAM type: NRG; PAM sequence: GAG
gactgggggaagacgatgtg

SEQ ID NO: 40646 - DNA, 20 bp, Artificial Sequence
  Description of Artificial Sequence: Synthetic oligonucleotide
  Target: SCN9A; (+) strand; PAM type: NRG; PAM sequence: AAG
gggggaagacgatgtggaga

SEQ ID NO: 40647 - DNA, 20 bp, Artificial Sequence
  Description of Artificial Sequence: Synthetic oligonucleotide
  Target: SCN9A; (+) strand; PAM type: NRG; PAM sequence: AAG
gaaagtataaatcttgatca

SEQ ID NO: 40648 - DNA, 20 bp, Artificial Sequence
  Description of Artificial Sequence: Synthetic oligonucleotide
  Target: SCN9A; (+) strand; PAM type: NRG; PAM sequence: AGG
aaagtataaatcttgatcaa

SEQ ID NO: 40649 - DNA, 20 bp, Artificial Sequence
  Description of Artificial Sequence: Synthetic oligonucleotide
  Target: SCN9A; (+) strand; PAM type: NRG; PAM sequence: TAG
aaggatgtacatttttcatt

SEQ ID NO: 40650 - DNA, 20 bp, Artificial Sequence
  Description of Artificial Sequence: Synthetic oligonucleotide
  Target: SCN9A; (+) strand; PAM type: NRG; PAM sequence: GAG
ggatgtacatttttcattta

SEQ ID NO: 40651 - DNA, 20 bp, Artificial Sequence
  Description of Artificial Sequence: Synthetic oligonucleotide
  Target: SCN9A; (+) strand; PAM type: NRG; PAM sequence: TAG
tgtacatttttcatttagag

SEQ ID NO: 40652 - DNA, 20 bp, Artificial Sequence
  Description of Artificial Sequence: Synthetic oligonucleotide
  Target: SCN9A; (+) strand; PAM type: NRG; PAM sequence: GAG
tacatttttcatttagagta

SEQ ID NO: 40653 - DNA, 20 bp, Artificial Sequence
  Description of Artificial Sequence: Synthetic oligonucleotide
  Target: SCN9A; (+) strand; PAM type: NRG; PAM sequence: AGG
acatttttcatttagagtag

SEQ ID NO: 40654 - DNA, 20 bp, Artificial Sequence
  Description of Artificial Sequence: Synthetic oligonucleotide
  Target: SCN9A; (+) strand; PAM type: NRG; PAM sequence: AAG
agagtagaggaataaatctt

SEQ ID NO: 40655 - DNA, 20 bp, Artificial Sequence
  Description of Artificial Sequence: Synthetic oligonucleotide
  Target: SCN9A; (+) strand; PAM type: NRG; PAM sequence: TGG
tagaggaataaatcttaaga

SEQ ID NO: 40656 - DNA, 20 bp, Artificial Sequence
  Description of Artificial Sequence: Synthetic oligonucleotide
  Target: SCN9A; (+) strand; PAM type: NRG; PAM sequence: AAG
ataaatcttaagatggatta

SEQ ID NO: 40657 - DNA, 20 bp, Artificial Sequence
  Description of Artificial Sequence: Synthetic oligonucleotide
  Target: SCN9A; (+) strand; PAM type: NRG; PAM sequence: TGG
atctaaaactataaaaaccc

SEQ ID NO: 40658 - DNA, 20 bp, Artificial Sequence
  Description of Artificial Sequence: Synthetic oligonucleotide
  Target: SCN9A; (+) strand; PAM type: NRG; PAM sequence: AAG
taaaactataaaaaccctgg

SEQ ID NO: 40659 - DNA, 20 bp, Artificial Sequence
  Description of Artificial Sequence: Synthetic oligonucleotide
  Target: SCN9A; (+) strand; PAM type: NRG; PAM sequence: CAG
actataaaaaccctggaaga

SEQ ID NO: 40660 - DNA, 20 bp, Artificial Sequence
  Description of Artificial Sequence: Synthetic oligonucleotide
  Target: SCN9A; (+) strand; PAM type: NRG; PAM sequence: TAG
aaaaaccctggaagacagcc

SEQ ID NO: 40661 - DNA, 20 bp, Artificial Sequence
  Description of Artificial Sequence: Synthetic oligonucleotide
  Target: SCN9A; (+) strand; PAM type: NRG; PAM sequence: AGG
aaaaccctggaagacagcct

SEQ ID NO: 40662 - DNA, 20 bp, Artificial Sequence
  Description of Artificial Sequence: Synthetic oligonucleotide
  Target: SCN9A; (+) strand; PAM type: NRG; PAM sequence: CAG
acagcctaggcaataccatt

SEQ ID NO: 40663 - DNA, 20 bp, Artificial Sequence
  Description of Artificial Sequence: Synthetic oligonucleotide
  Target: SCN9A; (+) strand; PAM type: NRG; PAM sequence: AGG
cagcctaggcaataccattc

SEQ ID NO: 40664 - DNA, 20 bp, Artificial Sequence
  Description of Artificial Sequence: Synthetic oligonucleotide
  Target: SCN9A; (+) strand; PAM type: NRG; PAM sequence: TAG
aggcaataccattcaggaca

SEQ ID NO: 40665 - DNA, 20 bp, Artificial Sequence
  Description of Artificial Sequence: Synthetic oligonucleotide
  Target: SCN9A; (+) strand; PAM type: NRG; PAM sequence: AGG
ggcaataccattcaggacat

SEQ ID NO: 40666 - DNA, 20 bp, Artificial Sequence
  Description of Artificial Sequence: Synthetic oligonucleotide
  Target: SCN9A; (+) strand; PAM type: NRG; PAM sequence: TGG
taccattcaggacataggca

SEQ ID NO: 40667 - DNA, 20 bp, Artificial Sequence
  Description of Artificial Sequence: Synthetic oligonucleotide
  Target: SCN9A; (+) strand; PAM type: NRG; PAM sequence: GGG
accattcaggacataggcat

SEQ ID NO: 40668 - DNA, 20 bp, Artificial Sequence
  Description of Artificial Sequence: Synthetic oligonucleotide
  Target: SCN9A; (+) strand; PAM type: NRG; PAM sequence: AAG
tcaggacataggcatgggca

SEQ ID NO: 40669 - DNA, 20 bp, Artificial Sequence
  Description of Artificial Sequence: Synthetic oligonucleotide
  Target: SCN9A; (+) strand; PAM type: NRG; PAM sequence: AAG
tgggcaaagatttcatgatg

SEQ ID NO: 40670 - DNA, 20 bp, Artificial Sequence
  Description of Artificial Sequence: Synthetic oligonucleotide
  Target: SCN9A; (+) strand; PAM type: NRG; PAM sequence: AAG
tttcatgatgaagacaccaa

SEQ ID NO: 40671 - DNA, 20 bp, Artificial Sequence
  Description of Artificial Sequence: Synthetic oligonucleotide
  Target: SCN9A; (+) strand; PAM type: NRG; PAM sequence: TGG
caaaaacaaaaattaacaaa

SEQ ID NO: 40672 - DNA, 20 bp, Artificial Sequence
  Description of Artificial Sequence: Synthetic oligonucleotide
  Target: SCN9A; (+) strand; PAM type: NRG; PAM sequence: GGG
aaaaacaaaaattaacaaat

SEQ ID NO: 40673 - DNA, 20 bp, Artificial Sequence
  Description of Artificial Sequence: Synthetic oligonucleotide
  Target: SCN9A; (+) strand; PAM type: NRG; PAM sequence: AAG
aatgggatctaattaaacta

SEQ ID NO: 40674 - DNA, 20 bp, Artificial Sequence
  Description of Artificial Sequence: Synthetic oligonucleotide
  Target: SCN9A; (+) strand; PAM type: NRG; PAM sequence: GAG
tgggatctaattaaactaaa

SEQ ID NO: 40675 - DNA, 20 bp, Artificial Sequence
  Description of Artificial Sequence: Synthetic oligonucleotide
  Target: SCN9A; (+) strand; PAM type: NRG; PAM sequence: CAG
taaactaaagagcttctgca

SEQ ID NO: 40676 - DNA, 20 bp, Artificial Sequence
  Description of Artificial Sequence: Synthetic oligonucleotide
  Target: SCN9A; (+) strand; PAM type: NRG; PAM sequence: AAG
aaagagcttctgcacagcaa

SEQ ID NO: 40677 - DNA, 20 bp, Artificial Sequence
  Description of Artificial Sequence: Synthetic oligonucleotide
  Target: SCN9A; (+) strand; PAM type: NRG; PAM sequence: CAG
acagcaaaagaaactatcaa

SEQ ID NO: 40678 - DNA, 20 bp, Artificial Sequence
  Description of Artificial Sequence: Synthetic oligonucleotide
  Target: SCN9A; (+) strand; PAM type: NRG; PAM sequence: GAG
agcaaaagaaactatcaaca

SEQ ID NO: 40679 - DNA, 20 bp, Artificial Sequence
  Description of Artificial Sequence: Synthetic oligonucleotide
  Target: SCN9A; (+) strand; PAM type: NRG; PAM sequence: AAG
aaagaaactatcaacagagt

SEQ ID NO: 40680 - DNA, 20 bp, Artificial Sequence
  Description of Artificial Sequence: Synthetic oligonucleotide
  Target: SCN9A; (+) strand; PAM type: NRG; PAM sequence: CAG
gaaactatcaacagagtaag

SEQ ID NO: 40681 - DNA, 20 bp, Artificial Sequence
  Description of Artificial Sequence: Synthetic oligonucleotide
  Target: SCN9A; (+) strand; PAM type: NRG; PAM sequence: CAG
ctatcaacagagtaagcaga

SEQ ID NO: 40682 - DNA, 20 bp, Artificial Sequence
  Description of Artificial Sequence: Synthetic oligonucleotide
  Target: SCN9A; (+) strand; PAM type: NRG; PAM sequence: CAG
cagagtaagcagacagtcta

SEQ ID NO: 40683 - DNA, 20 bp, Artificial Sequence
  Description of Artificial Sequence: Synthetic oligonucleotide
  Target: SCN9A; (+) strand; PAM type: NRG; PAM sequence: TGG
taagcagacagtctacagaa

SEQ ID NO: 40684 - DNA, 20 bp, Artificial Sequence
  Description of Artificial Sequence: Synthetic oligonucleotide
  Target: SCN9A; (+) strand; PAM type: NRG; PAM sequence: GGG
aagcagacagtctacagaat

SEQ ID NO: 40685 - DNA, 20 bp, Artificial Sequence
  Description of Artificial Sequence: Synthetic oligonucleotide
  Target: SCN9A; (+) strand; PAM type: NRG; PAM sequence: GAG
gcagacagtctacagaatgg

SEQ ID NO: 40686 - DNA, 20 bp, Artificial Sequence
  Description of Artificial Sequence: Synthetic oligonucleotide
  Target: SCN9A; (+) strand; PAM type: NRG; PAM sequence: CAG
agaatgggagaaaatttttg

SEQ ID NO: 40687 - DNA, 20 bp, Artificial Sequence
  Description of Artificial Sequence: Synthetic oligonucleotide
  Target: SCN9A; (+) strand; PAM type: NRG; PAM sequence: AAG
tgcagactatgcatctgaca

SEQ ID NO: 40688 - DNA, 20 bp, Artificial Sequence
  Description of Artificial Sequence: Synthetic oligonucleotide
  Target: SCN9A; (+) strand; PAM type: NRG; PAM sequence: AGG
gcagactatgcatctgacaa

SEQ ID NO: 40689 - DNA, 20 bp, Artificial Sequence
  Description of Artificial Sequence: Synthetic oligonucleotide
  Target: SCN9A; (+) strand; PAM type: NRG; PAM sequence: CAG
tctgacaaaggtctaatatc

SEQ ID NO: 40690 - DNA, 20 bp, Artificial Sequence
  Description of Artificial Sequence: Synthetic oligonucleotide
  Target: SCN9A; (+) strand; PAM type: NRG; PAM sequence: AAG
gtctaatatccagaatctat

SEQ ID NO: 40691 - DNA, 20 bp, Artificial Sequence
  Description of Artificial Sequence: Synthetic oligonucleotide
  Target: SCN9A; (+) strand; PAM type: NRG; PAM sequence: AGG
tctaatatccagaatctata

SEQ ID NO: 40692 - DNA, 20 bp, Artificial Sequence
  Description of Artificial Sequence: Synthetic oligonucleotide
  Target: SCN9A; (+) strand; PAM type: NRG; PAM sequence: GAG
aatctataaggaacttaaat

SEQ ID NO: 40693 - DNA, 20 bp, Artificial Sequence
  Description of Artificial Sequence: Synthetic oligonucleotide
  Target: SCN9A; (+) strand; PAM type: NRG; PAM sequence: AAG
aggaacttaaatgagtttac

SEQ ID NO: 40694 - DNA, 20 bp, Artificial Sequence
  Description of Artificial Sequence: Synthetic oligonucleotide
  Target: SCN9A; (+) strand; PAM type: NRG; PAM sequence: AAG
aaataaacaaccccattaaa

SEQ ID NO: 40695 - DNA, 20 bp, Artificial Sequence
  Description of Artificial Sequence: Synthetic oligonucleotide
  Target: SCN9A; (+) strand; PAM type: NRG; PAM sequence: TGG
taaacaaccccattaaaaag

SEQ ID NO: 40696 - DNA, 20 bp, Artificial Sequence
  Description of Artificial Sequence: Synthetic oligonucleotide
  Target: SCN9A; (+) strand; PAM type: NRG; PAM sequence: GGG
aaacaaccccattaaaaagt

SEQ ID NO: 40697 - DNA, 20 bp, Artificial Sequence
  Description of Artificial Sequence: Synthetic oligonucleotide
  Target: SCN9A; (+) strand; PAM type: NRG; PAM sequence: AAG
accccattaaaaagtgggca

SEQ ID NO: 40698 - DNA, 20 bp, Artificial Sequence
  Description of Artificial Sequence: Synthetic oligonucleotide
  Target: SCN9A; (+) strand; PAM type: NRG; PAM sequence: AGG
ccccattaaaaagtgggcaa

SEQ ID NO: 40699 - DNA, 20 bp, Artificial Sequence
  Description of Artificial Sequence: Synthetic oligonucleotide
  Target: SCN9A; (+) strand; PAM type: NRG; PAM sequence: CAG
aagtgggcaaaggatatgaa

SEQ ID NO: 40700 - DNA, 20 bp, Artificial Sequence
  Description of Artificial Sequence: Synthetic oligonucleotide
  Target: SCN9A; (+) strand; PAM type: NRG; PAM sequence: AAG
tatgaacagacacttctgaa

SEQ ID NO: 40701 - DNA, 20 bp, Artificial Sequence
  Description of Artificial Sequence: Synthetic oligonucleotide
  Target: SCN9A; (+) strand; PAM type: NRG; PAM sequence: AAG
gaacagacacttctgaaaag

SEQ ID NO: 40702 - DNA, 20 bp, Artificial Sequence
  Description of Artificial Sequence: Synthetic oligonucleotide
  Target: SCN9A; (+) strand; PAM type: NRG; PAM sequence: AAG
aagacacacatgcaacaaac

SEQ ID NO: 40703 - DNA, 20 bp, Artificial Sequence
  Description of Artificial Sequence: Synthetic oligonucleotide
  Target: SCN9A; (+) strand; PAM type: NRG; PAM sequence: AAG
acaaacaagcatatgaaaaa

SEQ ID NO: 40704 - DNA, 20 bp, Artificial Sequence
  Description of Artificial Sequence: Synthetic oligonucleotide
  Target: SCN9A; (+) strand; PAM type: NRG; PAM sequence: TAG
agctcaatgtcactgaccat

SEQ ID NO: 40705 - DNA, 20 bp, Artificial Sequence
  Description of Artificial Sequence: Synthetic oligonucleotide
  Target: SCN9A; (+) strand; PAM type: NRG; PAM sequence: GAG
ctcaatgtcactgaccatta

SEQ ID NO: 40706 - DNA, 20 bp, Artificial Sequence
  Description of Artificial Sequence: Synthetic oligonucleotide
  Target: SCN9A; (+) strand; PAM type: NRG; PAM sequence: GAG
atgcaaatcaaaaccacaat

SEQ ID NO: 40707 - DNA, 20 bp, Artificial Sequence
  Description of Artificial Sequence: Synthetic oligonucleotide
  Target: SCN9A; (+) strand; PAM type: NRG; PAM sequence: CAG
aatgagataccatctcacac

SEQ ID NO: 40708 - DNA, 20 bp, Artificial Sequence
  Description of Artificial Sequence: Synthetic oligonucleotide
  Target: SCN9A; (+) strand; PAM type: NRG; PAM sequence: CAG
agataccatctcacaccagt

SEQ ID NO: 40709 - DNA, 20 bp, Artificial Sequence
  Description of Artificial Sequence: Synthetic oligonucleotide
  Target: SCN9A; (+) strand; PAM type: NRG; PAM sequence: TGG
ccatctcacaccagtcagaa

SEQ ID NO: 40710 - DNA, 20 bp, Artificial Sequence
  Description of Artificial Sequence: Synthetic oligonucleotide
  Target: SCN9A; (+) strand; PAM type: NRG; PAM sequence: AAG
tcagaatggctattatgaaa

SEQ ID NO: 40711 - DNA, 20 bp, Artificial Sequence
  Description of Artificial Sequence: Synthetic oligonucleotide
  Target: SCN9A; (+) strand; PAM type: NRG; PAM sequence: CAG
atgaaaaagtcaaaaaataa

SEQ ID NO: 40712 - DNA, 20 bp, Artificial Sequence
  Description of Artificial Sequence: Synthetic oligonucleotide
  Target: SCN9A; (+) strand; PAM type: NRG; PAM sequence: TGG
agtcaaaaaataacagatgc

SEQ ID NO: 40713 - DNA, 20 bp, Artificial Sequence
  Description of Artificial Sequence: Synthetic oligonucleotide
  Target: SCN9A; (+) strand; PAM type: NRG; PAM sequence: GAG
aaaaaataacagatgctggc

SEQ ID NO: 40714 - DNA, 20 bp, Artificial Sequence
  Description of Artificial Sequence: Synthetic oligonucleotide
  Target: SCN9A; (+) strand; PAM type: NRG; PAM sequence: AGG
aaaaataacagatgctggcg

SEQ ID NO: 40715 - DNA, 20 bp, Artificial Sequence
  Description of Artificial Sequence: Synthetic oligonucleotide
  Target: SCN9A; (+) strand; PAM type: NRG; PAM sequence: GGG
aaaataacagatgctggcga

SEQ ID NO: 40716 - DNA, 20 bp, Artificial Sequence
  Description of Artificial Sequence: Synthetic oligonucleotide
  Target: SCN9A; (+) strand; PAM type: NRG; PAM sequence: TGG
aacagatgctggcgagggtg

SEQ ID NO: 40717 - DNA, 20 bp, Artificial Sequence
  Description of Artificial Sequence: Synthetic oligonucleotide
  Target: SCN9A; (+) strand; PAM type: NRG; PAM sequence: GAG
cagatgctggcgagggtgtg

SEQ ID NO: 40718 - DNA, 20 bp, Artificial Sequence
  Description of Artificial Sequence: Synthetic oligonucleotide
  Target: SCN9A; (+) strand; PAM type: NRG; PAM sequence: AAG
ggcgagggtgtggagaaaaa

SEQ ID NO: 40719 - DNA, 20 bp, Artificial Sequence
  Description of Artificial Sequence: Synthetic oligonucleotide
  Target: SCN9A; (+) strand; PAM type: NRG; PAM sequence: TGG
gaatgcctacacactgttga

SEQ ID NO: 40720 - DNA, 20 bp, Artificial Sequence
  Description of Artificial Sequence: Synthetic oligonucleotide
  Target: SCN9A; (+) strand; PAM type: NRG; PAM sequence: GGG
aatgcctacacactgttgat

SEQ ID NO: 40721 - DNA, 20 bp, Artificial Sequence
  Description of Artificial Sequence: Synthetic oligonucleotide
  Target: SCN9A; (+) strand; PAM type: NRG; PAM sequence: GAG
tgcctacacactgttgatgg

SEQ ID NO: 40722 - DNA, 20 bp, Artificial Sequence
  Description of Artificial Sequence: Synthetic oligonucleotide
  Target: SCN9A; (+) strand; PAM type: NRG; PAM sequence: TGG
gtaaattaattcaaccataa

SEQ ID NO: 40723 - DNA, 20 bp, Artificial Sequence
  Description of Artificial Sequence: Synthetic oligonucleotide
  Target: SCN9A; (+) strand; PAM type: NRG; PAM sequence: AAG
aattaattcaaccataatgg

SEQ ID NO: 40724 - DNA, 20 bp, Artificial Sequence
  Description of Artificial Sequence: Synthetic oligonucleotide
  Target: SCN9A; (+) strand; PAM type: NRG; PAM sequence: TGG
aaccataatggaagactgtg

SEQ ID NO: 40725 - DNA, 20 bp, Artificial Sequence
  Description of Artificial Sequence: Synthetic oligonucleotide
  Target: SCN9A; (+) strand; PAM type: NRG; PAM sequence: AAG
gactgtgtggcaattcctca

SEQ ID NO: 40726 - DNA, 20 bp, Artificial Sequence
  Description of Artificial Sequence: Synthetic oligonucleotide
  Target: SCN9A; (+) strand; PAM type: NRG; PAM sequence: AAG
ggcaattcctcaaagaccta

SEQ ID NO: 40727 - DNA, 20 bp, Artificial Sequence
  Description of Artificial Sequence: Synthetic oligonucleotide
  Target: SCN9A; (+) strand; PAM type: NRG; PAM sequence: CAG
attcctcaaagacctaaaga

SEQ ID NO: 40728 - DNA, 20 bp, Artificial Sequence
  Description of Artificial Sequence: Synthetic oligonucleotide
  Target: SCN9A; (+) strand; PAM type: NRG; PAM sequence: CAG
gacagaaatgccattcaacc

SEQ ID NO: 40729 - DNA, 20 bp, Artificial Sequence
  Description of Artificial Sequence: Synthetic oligonucleotide
  Target: SCN9A; (+) strand; PAM type: NRG; PAM sequence: TGG
caacccagcaatcccattac

SEQ ID NO: 40730 - DNA, 20 bp, Artificial Sequence
  Description of Artificial Sequence: Synthetic oligonucleotide
  Target: SCN9A; (+) strand; PAM type: NRG; PAM sequence: GGG
aacccagcaatcccattact

SEQ ID NO: 40731 - DNA, 20 bp, Artificial Sequence
  Description of Artificial Sequence: Synthetic oligonucleotide
  Target: SCN9A; (+) strand; PAM type: NRG; PAM sequence: AAG
cattactgggtatataccta

SEQ ID NO: 40732 - DNA, 20 bp, Artificial Sequence
  Description of Artificial Sequence: Synthetic oligonucleotide
  Target: SCN9A; (+) strand; PAM type: NRG; PAM sequence: AGG
attactgggtatatacctaa

SEQ ID NO: 40733 - DNA, 20 bp, Artificial Sequence
  Description of Artificial Sequence: Synthetic oligonucleotide
  Target: SCN9A; (+) strand; PAM type: NRG; PAM sequence: GGG
ttactgggtatatacctaaa

SEQ ID NO: 40734 - DNA, 20 bp, Artificial Sequence
  Description of Artificial Sequence: Synthetic oligonucleotide
  Target: SCN9A; (+) strand; PAM type: NRG; PAM sequence: AAG
aaatacatttttctattata

SEQ ID NO: 40735 - DNA, 20 bp, Artificial Sequence
  Description of Artificial Sequence: Synthetic oligonucleotide
  Target: SCN9A; (+) strand; PAM type: NRG; PAM sequence: TGG
acatgcacacatatgtttat

SEQ ID NO: 40736 - DNA, 20 bp, Artificial Sequence
  Description of Artificial Sequence: Synthetic oligonucleotide
  Target: SCN9A; (+) strand; PAM type: NRG; PAM sequence: GAG
atgcacacatatgtttattg

SEQ ID NO: 40737 - DNA, 20 bp, Artificial Sequence
  Description of Artificial Sequence: Synthetic oligonucleotide
  Target: SCN9A; (+) strand; PAM type: NRG; PAM sequence: TGG
tattggagcactattcacaa

SEQ ID NO: 40738 - DNA, 20 bp, Artificial Sequence
  Description of Artificial Sequence: Synthetic oligonucleotide
  Target: SCN9A; (+) strand; PAM type: NRG; PAM sequence: AAG
gagcactattcacaatggca

SEQ ID NO: 40739 - DNA, 20 bp, Artificial Sequence
  Description of Artificial Sequence: Synthetic oligonucleotide
  Target: SCN9A; (+) strand; PAM type: NRG; PAM sequence: TAG
tattcacaatggcaaagaca

SEQ ID NO: 40740 - DNA, 20 bp, Artificial Sequence
  Description of Artificial Sequence: Synthetic oligonucleotide
  Target: SCN9A; (+) strand; PAM type: NRG; PAM sequence: CAG
gaatcaactcaaatgaccat

SEQ ID NO: 40741 - DNA, 20 bp, Artificial Sequence
  Description of Artificial Sequence: Synthetic oligonucleotide
  Target: SCN9A; (+) strand; PAM type: NRG; PAM sequence: TAG
actcaaatgaccatcagtga

SEQ ID NO: 40742 - DNA, 20 bp, Artificial Sequence
  Description of Artificial Sequence: Synthetic oligonucleotide
  Target: SCN9A; (+) strand; PAM type: NRG; PAM sequence: TGG
aatgaccatcagtgatagac

SEQ ID NO: 40743 - DNA, 20 bp, Artificial Sequence
  Description of Artificial Sequence: Synthetic oligonucleotide
  Target: SCN9A; (+) strand; PAM type: NRG; PAM sequence: AAG
catcagtgatagactggata

SEQ ID NO: 40744 - DNA, 20 bp, Artificial Sequence
  Description of Artificial Sequence: Synthetic oligonucleotide
  Target: SCN9A; (+) strand; PAM type: NRG; PAM sequence: TGG
tagactggataaagataatg

SEQ ID NO: 40745 - DNA, 20 bp, Artificial Sequence
  Description of Artificial Sequence: Synthetic oligonucleotide
  Target: SCN9A; (+) strand; PAM type: NRG; PAM sequence: CAG
atataccatataatactatg

SEQ ID NO: 40746 - DNA, 20 bp, Artificial Sequence
  Description of Artificial Sequence: Synthetic oligonucleotide
  Target: SCN9A; (+) strand; PAM type: NRG; PAM sequence: GAG
gcagccattcaaaaaaaaac

SEQ ID NO: 40747 - DNA, 20 bp, Artificial Sequence
  Description of Artificial Sequence: Synthetic oligonucleotide
  Target: SCN9A; (+) strand; PAM type: NRG; PAM sequence: CAG
aaacgagatcatatcctttg

SEQ ID NO: 40748 - DNA, 20 bp, Artificial Sequence
  Description of Artificial Sequence: Synthetic oligonucleotide
  Target: SCN9A; (+) strand; PAM type: NRG; PAM sequence: AGG
aacgagatcatatcctttgc

SEQ ID NO: 40749 - DNA, 20 bp, Artificial Sequence
  Description of Artificial Sequence: Synthetic oligonucleotide
  Target: SCN9A; (+) strand; PAM type: NRG; PAM sequence: GGG
acgagatcatatcctttgca

SEQ ID NO: 40750 - DNA, 20 bp, Artificial Sequence
  Description of Artificial Sequence: Synthetic oligonucleotide
  Target: SCN9A; (+) strand; PAM type: NRG; PAM sequence: TGG
atcctttgcagggacatgaa

SEQ ID NO: 40751 - DNA, 20 bp, Artificial Sequence
  Description of Artificial Sequence: Synthetic oligonucleotide
  Target: SCN9A; (+) strand; PAM type: NRG; PAM sequence: GAG
cctttgcagggacatgaatg

SEQ ID NO: 40752 - DNA, 20 bp, Artificial Sequence
  Description of Artificial Sequence: Synthetic oligonucleotide
  Target: SCN9A; (+) strand; PAM type: NRG; PAM sequence: TGG
tgcagggacatgaatggagc

SEQ ID NO: 40753 - DNA, 20 bp, Artificial Sequence
  Description of Artificial Sequence: Synthetic oligonucleotide
  Target: SCN9A; (+) strand; PAM type: NRG; PAM sequence: GAG
cagggacatgaatggagctg

SEQ ID NO: 40754 - DNA, 20 bp, Artificial Sequence
  Description of Artificial Sequence: Synthetic oligonucleotide
  Target: SCN9A; (+) strand; PAM type: NRG; PAM sequence: AGG
agggacatgaatggagctgg

SEQ ID NO: 40755 - DNA, 20 bp, Artificial Sequence
  Description of Artificial Sequence: Synthetic oligonucleotide
  Target: SCN9A; (+) strand; PAM type: NRG; PAM sequence: TAG
gagctggaggccattttcat

SEQ ID NO: 40756 - DNA, 20 bp, Artificial Sequence
  Description of Artificial Sequence: Synthetic oligonucleotide
  Target: SCN9A; (+) strand; PAM type: NRG; PAM sequence: AAG
gccattttcattagtaaact

SEQ ID NO: 40757 - DNA, 20 bp, Artificial Sequence
  Description of Artificial Sequence: Synthetic oligonucleotide
  Target: SCN9A; (+) strand; PAM type: NRG; PAM sequence: AGG
ccattttcattagtaaacta

SEQ ID NO: 40758 - DNA, 20 bp, Artificial Sequence
  Description of Artificial Sequence: Synthetic oligonucleotide
  Target: SCN9A; (+) strand; PAM type: NRG; PAM sequence: CAG
ttttcattagtaaactaagg

SEQ ID NO: 40759 - DNA, 20 bp, Artificial Sequence
  Description of Artificial Sequence: Synthetic oligonucleotide
  Target: SCN9A; (+) strand; PAM type: NRG; PAM sequence: AGG
tttcattagtaaactaaggc

SEQ ID NO: 40760 - DNA, 20 bp, Artificial Sequence
  Description of Artificial Sequence: Synthetic oligonucleotide
  Target: SCN9A; (+) strand; PAM type: NRG; PAM sequence: CAG
ttagtaaactaaggcaggaa

SEQ ID NO: 40761 - DNA, 20 bp, Artificial Sequence
  Description of Artificial Sequence: Synthetic oligonucleotide
  Target: SCN9A; (+) strand; PAM type: NRG; PAM sequence: AAG
taccacatgttctcacttat

SEQ ID NO: 40762 - DNA, 20 bp, Artificial Sequence
  Description of Artificial Sequence: Synthetic oligonucleotide
  Target: SCN9A; (+) strand; PAM type: NRG; PAM sequence: TGG
cacatgttctcacttataag

SEQ ID NO: 40763 - DNA, 20 bp, Artificial Sequence
  Description of Artificial Sequence: Synthetic oligonucleotide
  Target: SCN9A; (+) strand; PAM type: NRG; PAM sequence: GGG
acatgttctcacttataagt

SEQ ID NO: 40764 - DNA, 20 bp, Artificial Sequence
  Description of Artificial Sequence: Synthetic oligonucleotide
  Target: SCN9A; (+) strand; PAM type: NRG; PAM sequence: GAG
atgttctcacttataagtgg

SEQ ID NO: 40765 - DNA, 20 bp, Artificial Sequence
  Description of Artificial Sequence: Synthetic oligonucleotide
  Target: SCN9A; (+) strand; PAM type: NRG; PAM sequence: GAG
ataagtgggagctaaatgat

SEQ ID NO: 40766 - DNA, 20 bp, Artificial Sequence
  Description of Artificial Sequence: Synthetic oligonucleotide
  Target: SCN9A; (+) strand; PAM type: NRG; PAM sequence: TGG
agctaaatgatgagaacaca

SEQ ID NO: 40767 - DNA, 20 bp, Artificial Sequence
  Description of Artificial Sequence: Synthetic oligonucleotide
  Target: SCN9A; (+) strand; PAM type: NRG; PAM sequence: AAG
tgagaacacatggacacata

SEQ ID NO: 40768 - DNA, 20 bp, Artificial Sequence
  Description of Artificial Sequence: Synthetic oligonucleotide
  Target: SCN9A; (+) strand; PAM type: NRG; PAM sequence: AGG
gagaacacatggacacataa

SEQ ID NO: 40769 - DNA, 20 bp, Artificial Sequence
  Description of Artificial Sequence: Synthetic oligonucleotide
  Target: SCN9A; (+) strand; PAM type: NRG; PAM sequence: GGG
agaacacatggacacataaa

SEQ ID NO: 40770 - DNA, 20 bp, Artificial Sequence
  Description of Artificial Sequence: Synthetic oligonucleotide
  Target: SCN9A; (+) strand; PAM type: NRG; PAM sequence: TGG
taaagggtaacaacacacac

SEQ ID NO: 40771 - DNA, 20 bp, Artificial Sequence
  Description of Artificial Sequence: Synthetic oligonucleotide
  Target: SCN9A; (+) strand; PAM type: NRG; PAM sequence: GGG
aaagggtaacaacacacact

SEQ ID NO: 40772 - DNA, 20 bp, Artificial Sequence
  Description of Artificial Sequence: Synthetic oligonucleotide
  Target: SCN9A; (+) strand; PAM type: NRG; PAM sequence: GGG
aagggtaacaacacacactg

SEQ ID NO: 40773 - DNA, 20 bp, Artificial Sequence
  Description of Artificial Sequence: Synthetic oligonucleotide
  Target: SCN9A; (+) strand; PAM type: NRG; PAM sequence: TGG
acaacacacactggggccta

SEQ ID NO: 40774 - DNA, 20 bp, Artificial Sequence
  Description of Artificial Sequence: Synthetic oligonucleotide
  Target: SCN9A; (+) strand; PAM type: NRG; PAM sequence: GGG
caacacacactggggcctat

SEQ ID NO: 40775 - DNA, 20 bp, Artificial Sequence
  Description of Artificial Sequence: Synthetic oligonucleotide
  Target: SCN9A; (+) strand; PAM type: NRG; PAM sequence: GAG
acacacactggggcctatgg

SEQ ID NO: 40776 - DNA, 20 bp, Artificial Sequence
  Description of Artificial Sequence: Synthetic oligonucleotide
  Target: SCN9A; (+) strand; PAM type: NRG; PAM sequence: AGG
cacacactggggcctatggg

SEQ ID NO: 40777 - DNA, 20 bp, Artificial Sequence
  Description of Artificial Sequence: Synthetic oligonucleotide
  Target: SCN9A; (+) strand; PAM type: NRG; PAM sequence: GGG
acacactggggcctatggga

SEQ ID NO: 40778 - DNA, 20 bp, Artificial Sequence
  Description of Artificial Sequence: Synthetic oligonucleotide
  Target: SCN9A; (+) strand; PAM type: NRG; PAM sequence: AAG
ctggggcctatgggagggtg

SEQ ID NO: 40779 - DNA, 20 bp, Artificial Sequence
  Description of Artificial Sequence: Synthetic oligonucleotide
  Target: SCN9A; (+) strand; PAM type: NRG; PAM sequence: AGG
tggggcctatgggagggtga

SEQ ID NO: 40780 - DNA, 20 bp, Artificial Sequence
  Description of Artificial Sequence: Synthetic oligonucleotide
  Target: SCN9A; (+) strand; PAM type: NRG; PAM sequence: GGG
ggggcctatgggagggtgaa

SEQ ID NO: 40781 - DNA, 20 bp, Artificial Sequence
  Description of Artificial Sequence: Synthetic oligonucleotide
  Target: SCN9A; (+) strand; PAM type: NRG; PAM sequence: TGG
gcctatgggagggtgaaggg

SEQ ID NO: 40782 - DNA, 20 bp, Artificial Sequence
  Description of Artificial Sequence: Synthetic oligonucleotide
  Target: SCN9A; (+) strand; PAM type: NRG; PAM sequence: GGG
cctatgggagggtgaagggt

SEQ ID NO: 40783 - DNA, 20 bp, Artificial Sequence
  Description of Artificial Sequence: Synthetic oligonucleotide
  Target: SCN9A; (+) strand; PAM type: NRG; PAM sequence: GAG
tatgggagggtgaagggtgg

SEQ ID NO: 40784 - DNA, 20 bp, Artificial Sequence
  Description of Artificial Sequence: Synthetic oligonucleotide
  Target: SCN9A; (+) strand; PAM type: NRG; PAM sequence: AGG
atgggagggtgaagggtggg

SEQ ID NO: 40785 - DNA, 20 bp, Artificial Sequence
  Description of Artificial Sequence: Synthetic oligonucleotide
  Target: SCN9A; (+) strand; PAM type: NRG; PAM sequence: AAG
ggagggtgaagggtgggagg

SEQ ID NO: 40786 - DNA, 20 bp, Artificial Sequence
  Description of Artificial Sequence: Synthetic oligonucleotide
  Target: SCN9A; (+) strand; PAM type: NRG; PAM sequence: AGG
gagggtgaagggtgggagga

SEQ ID NO: 40787 - DNA, 20 bp, Artificial Sequence
  Description of Artificial Sequence: Synthetic oligonucleotide
  Target: SCN9A; (+) strand; PAM type: NRG; PAM sequence: GAG
gggtgaagggtgggaggaag

SEQ ID NO: 40788 - DNA, 20 bp, Artificial Sequence
  Description of Artificial Sequence: Synthetic oligonucleotide
  Target: SCN9A; (+) strand; PAM type: NRG; PAM sequence: GAG
gtgaagggtgggaggaagga

SEQ ID NO: 40789 - DNA, 20 bp, Artificial Sequence
  Description of Artificial Sequence: Synthetic oligonucleotide
  Target: SCN9A; (+) strand; PAM type: NRG; PAM sequence: AGG
tgaagggtgggaggaaggag

SEQ ID NO: 40790 - DNA, 20 bp, Artificial Sequence
  Description of Artificial Sequence: Synthetic oligonucleotide
  Target: SCN9A; (+) strand; PAM type: NRG; PAM sequence: GGG
gaagggtgggaggaaggaga

SEQ ID NO: 40791 - DNA, 20 bp, Artificial Sequence
  Description of Artificial Sequence: Synthetic oligonucleotide
  Target: SCN9A; (+) strand; PAM type: NRG; PAM sequence: CAG
ggtgggaggaaggagagggt

SEQ ID NO: 40792 - DNA, 20 bp, Artificial Sequence
  Description of Artificial Sequence: Synthetic oligonucleotide
  Target: SCN9A; (+) strand; PAM type: NRG; PAM sequence: AGG
gtgggaggaaggagagggtc

SEQ ID NO: 40793 - DNA, 20 bp, Artificial Sequence
  Description of Artificial Sequence: Synthetic oligonucleotide
  Target: SCN9A; (+) strand; PAM type: NRG; PAM sequence: TGG
gaaaaataaccaatgcatac

SEQ ID NO: 40794 - DNA, 20 bp, Artificial Sequence
  Description of Artificial Sequence: Synthetic oligonucleotide
  Target: SCN9A; (+) strand; PAM type: NRG; PAM sequence: GGG
aaaaataaccaatgcatact

SEQ ID NO: 40795 - DNA, 20 bp, Artificial Sequence
  Description of Artificial Sequence: Synthetic oligonucleotide
  Target: SCN9A; (+) strand; PAM type: NRG; PAM sequence: CAG
gcatactgggattaatacct

SEQ ID NO: 40796 - DNA, 20 bp, Artificial Sequence
  Description of Artificial Sequence: Synthetic oligonucleotide
  Target: SCN9A; (+) strand; PAM type: NRG; PAM sequence: AGG
catactgggattaatacctc

SEQ ID NO: 40797 - DNA, 20 bp, Artificial Sequence
  Description of Artificial Sequence: Synthetic oligonucleotide
  Target: SCN9A; (+) strand; PAM type: NRG; PAM sequence: GGG
atactgggattaatacctca

SEQ ID NO: 40798 - DNA, 20 bp, Artificial Sequence
  Description of Artificial Sequence: Synthetic oligonucleotide
  Target: SCN9A; (+) strand; PAM type: NRG; PAM sequence: AAG
gacatgtttacctatgtaac

SEQ ID NO: 40799 - DNA, 20 bp, Artificial Sequence
  Description of Artificial Sequence: Synthetic oligonucleotide
  Target: SCN9A; (+) strand; PAM type: NRG; PAM sequence: AAG
tacccctgaacttaaaataa

SEQ ID NO: 40800 - DNA, 20 bp, Artificial Sequence
  Description of Artificial Sequence: Synthetic oligonucleotide
  Target: SCN9A; (+) strand; PAM type: NRG; PAM sequence: AAG
acttaaaataaaagtcaaaa

SEQ ID NO: 40801 - DNA, 20 bp, Artificial Sequence
  Description of Artificial Sequence: Synthetic oligonucleotide
  Target: SCN9A; (+) strand; PAM type: NRG; PAM sequence: TAG
aagtcaaaaaagtcacacaa

SEQ ID NO: 40802 - DNA, 20 bp, Artificial Sequence
  Description of Artificial Sequence: Synthetic oligonucleotide
  Target: SCN9A; (+) strand; PAM type: NRG; PAM sequence: AGG
agtcaaaaaagtcacacaat

SEQ ID NO: 40803 - DNA, 20 bp, Artificial Sequence
  Description of Artificial Sequence: Synthetic oligonucleotide
  Target: SCN9A; (+) strand; PAM type: NRG; PAM sequence: AAG
gtatatttcaaaattgctaa

SEQ ID NO: 40804 - DNA, 20 bp, Artificial Sequence
  Description of Artificial Sequence: Synthetic oligonucleotide
  Target: SCN9A; (+) strand; PAM type: NRG; PAM sequence: TAG
tttcaaaattgctaaaagaa

SEQ ID NO: 40805 - DNA, 20 bp, Artificial Sequence
  Description of Artificial Sequence: Synthetic oligonucleotide
  Target: SCN9A; (+) strand; PAM type: NRG; PAM sequence: AAG
tcttaccacaaaaaaatgat

SEQ ID NO: 40806 - DNA, 20 bp, Artificial Sequence
  Description of Artificial Sequence: Synthetic oligonucleotide
  Target: SCN9A; (+) strand; PAM type: NRG; PAM sequence: TGG
taccacaaaaaaatgataag

SEQ ID NO: 40807 - DNA, 20 bp, Artificial Sequence
  Description of Artificial Sequence: Synthetic oligonucleotide
  Target: SCN9A; (+) strand; PAM type: NRG; PAM sequence: GGG
accacaaaaaaatgataagt

SEQ ID NO: 40808 - DNA, 20 bp, Artificial Sequence
  Description of Artificial Sequence: Synthetic oligonucleotide
  Target: SCN9A; (+) strand; PAM type: NRG; PAM sequence: AAG
aaaaaaatgataagtgggtg

SEQ ID NO: 40809 - DNA, 20 bp, Artificial Sequence
  Description of Artificial Sequence: Synthetic oligonucleotide
  Target: SCN9A; (+) strand; PAM type: NRG; PAM sequence: TGG
atgataagtgggtgaagtga

SEQ ID NO: 40810 - DNA, 20 bp, Artificial Sequence
  Description of Artificial Sequence: Synthetic oligonucleotide
  Target: SCN9A; (+) strand; PAM type: NRG; PAM sequence: TAG
gaagtgatggttatgttaat

SEQ ID NO: 40811 - DNA, 20 bp, Artificial Sequence
  Description of Artificial Sequence: Synthetic oligonucleotide
  Target: SCN9A; (+) strand; PAM type: NRG; PAM sequence: TAG
aaatttctacaatgtttatg

SEQ ID NO: 40812 - DNA, 20 bp, Artificial Sequence
  Description of Artificial Sequence: Synthetic oligonucleotide
  Target: SCN9A; (+) strand; PAM type: NRG; PAM sequence: AAG
ttgttttgtaccccataaat

SEQ ID NO: 40813 - DNA, 20 bp, Artificial Sequence
  Description of Artificial Sequence: Synthetic oligonucleotide
  Target: SCN9A; (+) strand; PAM type: NRG; PAM sequence: CAG
aaaatgaacaaatatttaaa

SEQ ID NO: 40814 - DNA, 20 bp, Artificial Sequence
  Description of Artificial Sequence: Synthetic oligonucleotide
  Target: SCN9A; (+) strand; PAM type: NRG; PAM sequence: CAG
aaacagaaaaaaacatacta

SEQ ID NO: 40815 - DNA, 20 bp, Artificial Sequence
  Description of Artificial Sequence: Synthetic oligonucleotide
  Target: SCN9A; (+) strand; PAM type: NRG; PAM sequence: AAG
aaaaaaacatactacagaac

SEQ ID NO: 40816 - DNA, 20 bp, Artificial Sequence
  Description of Artificial Sequence: Synthetic oligonucleotide
  Target: SCN9A; (+) strand; PAM type: NRG; PAM sequence: TAG
aacaagatccctgatgaaca

SEQ ID NO: 40817 - DNA, 20 bp, Artificial Sequence
  Description of Artificial Sequence: Synthetic oligonucleotide
  Target: SCN9A; (+) strand; PAM type: NRG; PAM sequence: TAG
aaataacttcatcaaaatat

SEQ ID NO: 40818 - DNA, 20 bp, Artificial Sequence
  Description of Artificial Sequence: Synthetic oligonucleotide
  Target: SCN9A; (+) strand; PAM type: NRG; PAM sequence: CAG
tattagcaaactgaatgcaa

SEQ ID NO: 40819 - DNA, 20 bp, Artificial Sequence
  Description of Artificial Sequence: Synthetic oligonucleotide
  Target: SCN9A; (+) strand; PAM type: NRG; PAM sequence: AAG
aatgatcatgtactacgacc

SEQ ID NO: 40820 - DNA, 20 bp, Artificial Sequence
  Description of Artificial Sequence: Synthetic oligonucleotide
  Target: SCN9A; (+) strand; PAM type: NRG; PAM sequence: TGG
gatcatgtactacgaccaag

SEQ ID NO: 40821 - DNA, 20 bp, Artificial Sequence
  Description of Artificial Sequence: Synthetic oligonucleotide
  Target: SCN9A; (+) strand; PAM type: NRG; PAM sequence: GGG
atcatgtactacgaccaagt

SEQ ID NO: 40822 - DNA, 20 bp, Artificial Sequence
  Description of Artificial Sequence: Synthetic oligonucleotide
  Target: SCN9A; (+) strand; PAM type: NRG; PAM sequence: GAG
catgtactacgaccaagtgg

SEQ ID NO: 40823 - DNA, 20 bp, Artificial Sequence
  Description of Artificial Sequence: Synthetic oligonucleotide
  Target: SCN9A; (+) strand; PAM type: NRG; PAM sequence: TAG
gaccaagtgggagttgtccc

SEQ ID NO: 40824 - DNA, 20 bp, Artificial Sequence
  Description of Artificial Sequence: Synthetic oligonucleotide
  Target: SCN9A; (+) strand; PAM type: NRG; PAM sequence: AGG
accaagtgggagttgtccct

SEQ ID NO: 40825 - DNA, 20 bp, Artificial Sequence
  Description of Artificial Sequence: Synthetic oligonucleotide
  Target: SCN9A; (+) strand; PAM type: NRG; PAM sequence: AAG
gggagttgtccctaggatgc

SEQ ID NO: 40826 - DNA, 20 bp, Artificial Sequence
  Description of Artificial Sequence: Synthetic oligonucleotide
  Target: SCN9A; (+) strand; PAM type: NRG; PAM sequence: AGG
ggagttgtccctaggatgca

SEQ ID NO: 40827 - DNA, 20 bp, Artificial Sequence
  Description of Artificial Sequence: Synthetic oligonucleotide
  Target: SCN9A; (+) strand; PAM type: NRG; PAM sequence: TGG
ttgtccctaggatgcaagga

SEQ ID NO: 40828 - DNA, 20 bp, Artificial Sequence
  Description of Artificial Sequence: Synthetic oligonucleotide
  Target: SCN9A; (+) strand; PAM type: NRG; PAM sequence: CAG
caaggatggttcaacatatg

SEQ ID NO: 40829 - DNA, 20 bp, Artificial Sequence
  Description of Artificial Sequence: Synthetic oligonucleotide
  Target: SCN9A; (+) strand; PAM type: NRG; PAM sequence: GAG
tgtgatacaccacatgatct

SEQ ID NO: 40830 - DNA, 20 bp, Artificial Sequence
  Description of Artificial Sequence: Synthetic oligonucleotide
  Target: SCN9A; (+) strand; PAM type: NRG; PAM sequence: AAG
gatacaccacatgatctgag

SEQ ID NO: 40831 - DNA, 20 bp, Artificial Sequence
  Description of Artificial Sequence: Synthetic oligonucleotide
  Target: SCN9A; (+) strand; PAM type: NRG; PAM sequence: AGG
atacaccacatgatctgaga

SEQ ID NO: 40832 - DNA, 20 bp, Artificial Sequence
  Description of Artificial Sequence: Synthetic oligonucleotide
  Target: SCN9A; (+) strand; PAM type: NRG; PAM sequence: CAG
gataaaaatcacatgatcat

SEQ ID NO: 40833 - DNA, 20 bp, Artificial Sequence
  Description of Artificial Sequence: Synthetic oligonucleotide
  Target: SCN9A; (+) strand; PAM type: NRG; PAM sequence: AAG
aaaaatcacatgatcatcag

SEQ ID NO: 40834 - DNA, 20 bp, Artificial Sequence
  Description of Artificial Sequence: Synthetic oligonucleotide
  Target: SCN9A; (+) strand; PAM type: NRG; PAM sequence: GAG
aaatcacatgatcatcagaa

SEQ ID NO: 40835 - DNA, 20 bp, Artificial Sequence
  Description of Artificial Sequence: Synthetic oligonucleotide
  Target: SCN9A; (+) strand; PAM type: NRG; PAM sequence: CAG
catgatcatcagaagagatt

SEQ ID NO: 40836 - DNA, 20 bp, Artificial Sequence
  Description of Artificial Sequence: Synthetic oligonucleotide
  Target: SCN9A; (+) strand; PAM type: NRG; PAM sequence: AAG
gatcatcagaagagattcag

SEQ ID NO: 40837 - DNA, 20 bp, Artificial Sequence
  Description of Artificial Sequence: Synthetic oligonucleotide
  Target: SCN9A; (+) strand; PAM type: NRG; PAM sequence: AAG
catcagaagagattcagaag

SEQ ID NO: 40838 - DNA, 20 bp, Artificial Sequence
  Description of Artificial Sequence: Synthetic oligonucleotide
  Target: SCN9A; (+) strand; PAM type: NRG; PAM sequence: TGG
caaatttcaacaacctttca

SEQ ID NO: 40839 - DNA, 20 bp, Artificial Sequence
  Description of Artificial Sequence: Synthetic oligonucleotide
  Target: SCN9A; (+) strand; PAM type: NRG; PAM sequence: AAG
ttcatggtaaaaactaaaaa

SEQ ID NO: 40840 - DNA, 20 bp, Artificial Sequence
  Description of Artificial Sequence: Synthetic oligonucleotide
  Target: SCN9A; (+) strand; PAM type: NRG; PAM sequence: AAG
aaactaaaaaaagaaaacaa

SEQ ID NO: 40841 - DNA, 20 bp, Artificial Sequence
  Description of Artificial Sequence: Synthetic oligonucleotide
  Target: SCN9A; (+) strand; PAM type: NRG; PAM sequence: TAG
taaaaaaagaaaacaaaagc

SEQ ID NO: 40842 - DNA, 20 bp, Artificial Sequence
  Description of Artificial Sequence: Synthetic oligonucleotide
  Target: SCN9A; (+) strand; PAM type: NRG; PAM sequence: AGG
aaaaaaagaaaacaaaagct

SEQ ID NO: 40843 - DNA, 20 bp, Artificial Sequence
  Description of Artificial Sequence: Synthetic oligonucleotide
  Target: SCN9A; (+) strand; PAM type: NRG; PAM sequence: TAG
aagaaaacaaaagctaggta

SEQ ID NO: 40844 - DNA, 20 bp, Artificial Sequence
  Description of Artificial Sequence: Synthetic oligonucleotide
  Target: SCN9A; (+) strand; PAM type: NRG; PAM sequence: AAG
aaaacaaaagctaggtatag

SEQ ID NO: 40845 - DNA, 20 bp, Artificial Sequence
  Description of Artificial Sequence: Synthetic oligonucleotide
  Target: SCN9A; (+) strand; PAM type: NRG; PAM sequence: AAG
atagaagttgctataacttg

SEQ ID NO: 40846 - DNA, 20 bp, Artificial Sequence
  Description of Artificial Sequence: Synthetic oligonucleotide
  Target: SCN9A; (+) strand; PAM type: NRG; PAM sequence: AGG
tagaagttgctataacttga

SEQ ID NO: 40847 - DNA, 20 bp, Artificial Sequence
  Description of Artificial Sequence: Synthetic oligonucleotide
  Target: SCN9A; (+) strand; PAM type: NRG; PAM sequence: AAG
ttgaaggtttgtcccctcca

SEQ ID NO: 40848 - DNA, 20 bp, Artificial Sequence
  Description of Artificial Sequence: Synthetic oligonucleotide
  Target: SCN9A; (+) strand; PAM type: NRG; PAM sequence: CAG
caatttaattgcaattgtga

SEQ ID NO: 40849 - DNA, 20 bp, Artificial Sequence
  Description of Artificial Sequence: Synthetic oligonucleotide
  Target: SCN9A; (+) strand; PAM type: NRG; PAM sequence: TGG
aattgcaattgtgacagaat

SEQ ID NO: 40850 - DNA, 20 bp, Artificial Sequence
  Description of Artificial Sequence: Synthetic oligonucleotide
  Target: SCN9A; (+) strand; PAM type: NRG; PAM sequence: GGG
attgcaattgtgacagaatt

SEQ ID NO: 40851 - DNA, 20 bp, Artificial Sequence
  Description of Artificial Sequence: Synthetic oligonucleotide
  Target: SCN9A; (+) strand; PAM type: NRG; PAM sequence: GAG
tgcaattgtgacagaattgg

SEQ ID NO: 40852 - DNA, 20 bp, Artificial Sequence
  Description of Artificial Sequence: Synthetic oligonucleotide
  Target: SCN9A; (+) strand; PAM type: NRG; PAM sequence: AGG
gcaattgtgacagaattggg

SEQ ID NO: 40853 - DNA, 20 bp, Artificial Sequence
  Description of Artificial Sequence: Synthetic oligonucleotide
  Target: SCN9A; (+) strand; PAM type: NRG; PAM sequence: GAG
ttgtgacagaattgggaggt

SEQ ID NO: 40854 - DNA, 20 bp, Artificial Sequence
  Description of Artificial Sequence: Synthetic oligonucleotide
  Target: SCN9A; (+) strand; PAM type: NRG; PAM sequence: AAG
aattgggaggtgagaccttt

SEQ ID NO: 40855 - DNA, 20 bp, Artificial Sequence
  Description of Artificial Sequence: Synthetic oligonucleotide
  Target: SCN9A; (+) strand; PAM type: NRG; PAM sequence: GAG
ttgggaggtgagacctttaa

SEQ ID NO: 40856 - DNA, 20 bp, Artificial Sequence
  Description of Artificial Sequence: Synthetic oligonucleotide
  Target: SCN9A; (+) strand; PAM type: NRG; PAM sequence: AGG
tgggaggtgagacctttaag

SEQ ID NO: 40857 - DNA, 20 bp, Artificial Sequence
  Description of Artificial Sequence: Synthetic oligonucleotide
  Target: SCN9A; (+) strand; PAM type: NRG; PAM sequence: AAG
gagacctttaagaggtgttt

SEQ ID NO: 40858 - DNA, 20 bp, Artificial Sequence
  Description of Artificial Sequence: Synthetic oligonucleotide
  Target: SCN9A; (+) strand; PAM type: NRG; PAM sequence: GAG
ttaagaggtgtttaagttat

SEQ ID NO: 40859 - DNA, 20 bp, Artificial Sequence
  Description of Artificial Sequence: Synthetic oligonucleotide
  Target: SCN9A; (+) strand; PAM type: NRG; PAM sequence: CAG
atgcattaatgctgttatct

SEQ ID NO: 40860 - DNA, 20 bp, Artificial Sequence
  Description of Artificial Sequence: Synthetic oligonucleotide
  Target: SCN9A; (+) strand; PAM type: NRG; PAM sequence: AGG
tgcattaatgctgttatctc

SEQ ID NO: 40861 - DNA, 20 bp, Artificial Sequence
  Description of Artificial Sequence: Synthetic oligonucleotide
  Target: SCN9A; (+) strand; PAM type: NRG; PAM sequence: GAG
aatgctgttatctcaggatt

SEQ ID NO: 40862 - DNA, 20 bp, Artificial Sequence
  Description of Artificial Sequence: Synthetic oligonucleotide
  Target: SCN9A; (+) strand; PAM type: NRG; PAM sequence: CAG
aggattgagttcattataaa

SEQ ID NO: 40863 - DNA, 20 bp, Artificial Sequence
  Description of Artificial Sequence: Synthetic oligonucleotide
  Target: SCN9A; (+) strand; PAM type: NRG; PAM sequence: AGG
ggattgagttcattataaac

SEQ ID NO: 40864 - DNA, 20 bp, Artificial Sequence
  Description of Artificial Sequence: Synthetic oligonucleotide
  Target: SCN9A; (+) strand; PAM type: NRG; PAM sequence: CAG
ttgagttcattataaacagg

SEQ ID NO: 40865 - DNA, 20 bp, Artificial Sequence
  Description of Artificial Sequence: Synthetic oligonucleotide
  Target: SCN9A; (+) strand; PAM type: NRG; PAM sequence: AGG
tgagttcattataaacaggc

SEQ ID NO: 40866 - DNA, 20 bp, Artificial Sequence
  Description of Artificial Sequence: Synthetic oligonucleotide
  Target: SCN9A; (+) strand; PAM type: NRG; PAM sequence: CAG
tatcataacatgatacctta

SEQ ID NO: 40867 - DNA, 20 bp, Artificial Sequence
  Description of Artificial Sequence: Synthetic oligonucleotide
  Target: SCN9A; (+) strand; PAM type: NRG; PAM sequence: AAG
catgttatgacacaacaaat

SEQ ID NO: 40868 - DNA, 20 bp, Artificial Sequence
  Description of Artificial Sequence: Synthetic oligonucleotide
  Target: SCN9A; (+) strand; PAM type: NRG; PAM sequence: CAG
cacaacaaataagacctcac

SEQ ID NO: 40869 - DNA, 20 bp, Artificial Sequence
  Description of Artificial Sequence: Synthetic oligonucleotide
  Target: SCN9A; (+) strand; PAM type: NRG; PAM sequence: CAG
acaaataagacctcaccaga

SEQ ID NO: 40870 - DNA, 20 bp, Artificial Sequence
  Description of Artificial Sequence: Synthetic oligonucleotide
  Target: SCN9A; (+) strand; PAM type: NRG; PAM sequence: CAG
gacctcaccagacagcccct

SEQ ID NO: 40871 - DNA, 20 bp, Artificial Sequence
  Description of Artificial Sequence: Synthetic oligonucleotide
  Target: SCN9A; (+) strand; PAM type: NRG; PAM sequence: CAG
gtcatgaactttccatcctc

SEQ ID NO: 40872 - DNA, 20 bp, Artificial Sequence
  Description of Artificial Sequence: Synthetic oligonucleotide
  Target: SCN9A; (+) strand; PAM type: NRG; PAM sequence: AAG
ctccagtactgtgatcccat

SEQ ID NO: 40873 - DNA, 20 bp, Artificial Sequence
  Description of Artificial Sequence: Synthetic oligonucleotide
  Target: SCN9A; (+) strand; PAM type: NRG; PAM sequence: AGG
tccagtactgtgatcccata

SEQ ID NO: 40874 - DNA, 20 bp, Artificial Sequence
  Description of Artificial Sequence: Synthetic oligonucleotide
  Target: SCN9A; (+) strand; PAM type: NRG; PAM sequence: CAG
tatgttcattataaattacc

SEQ ID NO: 40875 - DNA, 20 bp, Artificial Sequence
  Description of Artificial Sequence: Synthetic oligonucleotide
  Target: SCN9A; (+) strand; PAM type: NRG; PAM sequence: TGG
attataaattacccagtctg

SEQ ID NO: 40876 - DNA, 20 bp, Artificial Sequence
  Description of Artificial Sequence: Synthetic oligonucleotide
  Target: SCN9A; (+) strand; PAM type: NRG; PAM sequence: TAG
cagtctgtggtattctgtta

SEQ ID NO: 40877 - DNA, 20 bp, Artificial Sequence
  Description of Artificial Sequence: Synthetic oligonucleotide
  Target: SCN9A; (+) strand; PAM type: NRG; PAM sequence: TAG
tctgtggtattctgttatag

SEQ ID NO: 40878 - DNA, 20 bp, Artificial Sequence
  Description of Artificial Sequence: Synthetic oligonucleotide
  Target: SCN9A; (+) strand; PAM type: NRG; PAM sequence: TGG
ttctgttatagtagcacaaa

SEQ ID NO: 40879 - DNA, 20 bp, Artificial Sequence
  Description of Artificial Sequence: Synthetic oligonucleotide
  Target: SCN9A; (+) strand; PAM type: NRG; PAM sequence: GAG
ttatagtagcacaaatggat

SEQ ID NO: 40880 - DNA, 20 bp, Artificial Sequence
  Description of Artificial Sequence: Synthetic oligonucleotide
  Target: SCN9A; (+) strand; PAM type: NRG; PAM sequence: CAG
gtagcacaaatggatgagaa

SEQ ID NO: 40881 - DNA, 20 bp, Artificial Sequence
  Description of Artificial Sequence: Synthetic oligonucleotide
  Target: SCN9A; (+) strand; PAM type: NRG; PAM sequence: GAG
agcacaaatggatgagaaca

SEQ ID NO: 40882 - DNA, 20 bp, Artificial Sequence
  Description of Artificial Sequence: Synthetic oligonucleotide
  Target: SCN9A; (+) strand; PAM type: NRG; PAM sequence: AGG
gcacaaatggatgagaacag

SEQ ID NO: 40883 - DNA, 20 bp, Artificial Sequence
  Description of Artificial Sequence: Synthetic oligonucleotide
  Target: SCN9A; (+) strand; PAM type: NRG; PAM sequence: AAG
aaatatacttcatgataaca

SEQ ID NO: 40884 - DNA, 20 bp, Artificial Sequence
  Description of Artificial Sequence: Synthetic oligonucleotide
  Target: SCN9A; (+) strand; PAM type: NRG; PAM sequence: CAG
aagactacttgaaaatccca

SEQ ID NO: 40885 - DNA, 20 bp, Artificial Sequence
  Description of Artificial Sequence: Synthetic oligonucleotide
  Target: SCN9A; (+) strand; PAM type: NRG; PAM sequence: TGG
acagctaacatcgtattcaa

SEQ ID NO: 40886 - DNA, 20 bp, Artificial Sequence
  Description of Artificial Sequence: Synthetic oligonucleotide
  Target: SCN9A; (+) strand; PAM type: NRG; PAM sequence: AAG
aaactgaaaaactttcctgt

SEQ ID NO: 40887 - DNA, 20 bp, Artificial Sequence
  Description of Artificial Sequence: Synthetic oligonucleotide
  Target: SCN9A; (+) strand; PAM type: NRG; PAM sequence: CAG
gaaaaactttcctgtaagat

SEQ ID NO: 40888 - DNA, 20 bp, Artificial Sequence
  Description of Artificial Sequence: Synthetic oligonucleotide
  Target: SCN9A; (+) strand; PAM type: NRG; PAM sequence: AGG
aaaaactttcctgtaagatc

SEQ ID NO: 40889 - DNA, 20 bp, Artificial Sequence
  Description of Artificial Sequence: Synthetic oligonucleotide
  Target: SCN9A; (+) strand; PAM type: NRG; PAM sequence: AAG
tttcctgtaagatcaggaat

SEQ ID NO: 40890 - DNA, 20 bp, Artificial Sequence
  Description of Artificial Sequence: Synthetic oligonucleotide
  Target: SCN9A; (+) strand; PAM type: NRG; PAM sequence: TGG
gatcaggaataagacaaata

SEQ ID NO: 40891 - DNA, 20 bp, Artificial Sequence
  Description of Artificial Sequence: Synthetic oligonucleotide
  Target: SCN9A; (+) strand; PAM type: NRG; PAM sequence: CAG
cttgccacttgtatttaaca

SEQ ID NO: 40892 - DNA, 20 bp, Artificial Sequence
  Description of Artificial Sequence: Synthetic oligonucleotide
  Target: SCN9A; (+) strand; PAM type: NRG; PAM sequence: TAG
acttgtatttaacacagcac

SEQ ID NO: 40893 - DNA, 20 bp, Artificial Sequence
  Description of Artificial Sequence: Synthetic oligonucleotide
  Target: SCN9A; (+) strand; PAM type: NRG; PAM sequence: AAG
tgtatttaacacagcactag

SEQ ID NO: 40894 - DNA, 20 bp, Artificial Sequence
  Description of Artificial Sequence: Synthetic oligonucleotide
  Target: SCN9A; (+) strand; PAM type: NRG; PAM sequence: TAG
taacacagcactagaagtcc

SEQ ID NO: 40895 - DNA, 20 bp, Artificial Sequence
  Description of Artificial Sequence: Synthetic oligonucleotide
  Target: SCN9A; (+) strand; PAM type: NRG; PAM sequence: CAG
acagcactagaagtcctagc

SEQ ID NO: 40896 - DNA, 20 bp, Artificial Sequence
  Description of Artificial Sequence: Synthetic oligonucleotide
  Target: SCN9A; (+) strand; PAM type: NRG; PAM sequence: GAG
agcactagaagtcctagcca

SEQ ID NO: 40897 - DNA, 20 bp, Artificial Sequence
  Description of Artificial Sequence: Synthetic oligonucleotide
  Target: SCN9A; (+) strand; PAM type: NRG; PAM sequence: TAG
gaagtcctagccagagaaat

SEQ ID NO: 40898 - DNA, 20 bp, Artificial Sequence
  Description of Artificial Sequence: Synthetic oligonucleotide
  Target: SCN9A; (+) strand; PAM type: NRG; PAM sequence: AGG
aagtcctagccagagaaatt

SEQ ID NO: 40899 - DNA, 20 bp, Artificial Sequence
  Description of Artificial Sequence: Synthetic oligonucleotide
  Target: SCN9A; (+) strand; PAM type: NRG; PAM sequence: AAG
cctagccagagaaattaggc

SEQ ID NO: 40900 - DNA, 20 bp, Artificial Sequence
  Description of Artificial Sequence: Synthetic oligonucleotide
  Target: SCN9A; (+) strand; PAM type: NRG; PAM sequence: AAG
agaaattaggcaagaaaaac

SEQ ID NO: 40901 - DNA, 20 bp, Artificial Sequence
  Description of Artificial Sequence: Synthetic oligonucleotide
  Target: SCN9A; (+) strand; PAM type: NRG; PAM sequence: AAG
taggcaagaaaaacaagtaa

SEQ ID NO: 40902 - DNA, 20 bp, Artificial Sequence
  Description of Artificial Sequence: Synthetic oligonucleotide
  Target: SCN9A; (+) strand; PAM type: NRG; PAM sequence: AAG
taaaagacatcccaatctga

SEQ ID NO: 40903 - DNA, 20 bp, Artificial Sequence
  Description of Artificial Sequence: Synthetic oligonucleotide
  Target: SCN9A; (+) strand; PAM type: NRG; PAM sequence: AAG
catcccaatctgaaagaaaa

SEQ ID NO: 40904 - DNA, 20 bp, Artificial Sequence
  Description of Artificial Sequence: Synthetic oligonucleotide
  Target: SCN9A; (+) strand; PAM type: NRG; PAM sequence: CAG
ctgaaagaaaaaagtgttta

SEQ ID NO: 40905 - DNA, 20 bp, Artificial Sequence
  Description of Artificial Sequence: Synthetic oligonucleotide
  Target: SCN9A; (+) strand; PAM type: NRG; PAM sequence: TGG
acagatgacattattttata

SEQ ID NO: 40906 - DNA, 20 bp, Artificial Sequence
  Description of Artificial Sequence: Synthetic oligonucleotide
  Target: SCN9A; (+) strand; PAM type: NRG; PAM sequence: GAG
agatgacattattttatatg

SEQ ID NO: 40907 - DNA, 20 bp, Artificial Sequence
  Description of Artificial Sequence: Synthetic oligonucleotide
  Target: SCN9A; (+) strand; PAM type: NRG; PAM sequence: GAG
atgacattattttatatgga

SEQ ID NO: 40908 - DNA, 20 bp, Artificial Sequence
  Description of Artificial Sequence: Synthetic oligonucleotide
  Target: SCN9A; (+) strand; PAM type: NRG; PAM sequence: AAG
tttatatggagagtacccta

SEQ ID NO: 40909 - DNA, 20 bp, Artificial Sequence
  Description of Artificial Sequence: Synthetic oligonucleotide
  Target: SCN9A; (+) strand; PAM type: NRG; PAM sequence: CAG
accctaaagactccacacat

SEQ ID NO: 40910 - DNA, 20 bp, Artificial Sequence
  Description of Artificial Sequence: Synthetic oligonucleotide
  Target: SCN9A; (+) strand; PAM type: NRG; PAM sequence: AGG
ccctaaagactccacacatc

SEQ ID NO: 40911 - DNA, 20 bp, Artificial Sequence
  Description of Artificial Sequence: Synthetic oligonucleotide
  Target: SCN9A; (+) strand; PAM type: NRG; PAM sequence: TAG
cacacatcaggaaaatctgt

SEQ ID NO: 40912 - DNA, 20 bp, Artificial Sequence
  Description of Artificial Sequence: Synthetic oligonucleotide
  Target: SCN9A; (+) strand; PAM type: NRG; PAM sequence: TAG
gaactaataaacaaatttac

SEQ ID NO: 40913 - DNA, 20 bp, Artificial Sequence
  Description of Artificial Sequence: Synthetic oligonucleotide
  Target: SCN9A; (+) strand; PAM type: NRG; PAM sequence: AAG
aacaaatttactagatgttg

SEQ ID NO: 40914 - DNA, 20 bp, Artificial Sequence
  Description of Artificial Sequence: Synthetic oligonucleotide
  Target: SCN9A; (+) strand; PAM type: NRG; PAM sequence: AGG
acaaatttactagatgttga

SEQ ID NO: 40915 - DNA, 20 bp, Artificial Sequence
  Description of Artificial Sequence: Synthetic oligonucleotide
  Target: SCN9A; (+) strand; PAM type: NRG; PAM sequence: AAG
cactaacaataaacaatctg

SEQ ID NO: 40916 - DNA, 20 bp, Artificial Sequence
  Description of Artificial Sequence: Synthetic oligonucleotide
  Target: SCN9A; (+) strand; PAM type: NRG; PAM sequence: GAG
ctaacaataaacaatctgaa

SEQ ID NO: 40917 - DNA, 20 bp, Artificial Sequence
  Description of Artificial Sequence: Synthetic oligonucleotide
  Target: SCN9A; (+) strand; PAM type: NRG; PAM sequence: TAG
aaacaatctgaagagaaaat

SEQ ID NO: 40918 - DNA, 20 bp, Artificial Sequence
  Description of Artificial Sequence: Synthetic oligonucleotide
  Target: SCN9A; (+) strand; PAM type: NRG; PAM sequence: AGG
aacaatctgaagagaaaatt

SEQ ID NO: 40919 - DNA, 20 bp, Artificial Sequence
  Description of Artificial Sequence: Synthetic oligonucleotide
  Target: SCN9A; (+) strand; PAM type: NRG; PAM sequence: AAG
atctgaagagaaaattagga

SEQ ID NO: 40920 - DNA, 20 bp, Artificial Sequence
  Description of Artificial Sequence: Synthetic oligonucleotide
  Target: SCN9A; (+) strand; PAM type: NRG; PAM sequence: AAG
cccatttatgataacatcaa

SEQ ID NO: 40921 - DNA, 20 bp, Artificial Sequence
  Description of Artificial Sequence: Synthetic oligonucleotide
  Target: SCN9A; (+) strand; PAM type: NRG; PAM sequence: TAG
atcaaaagaaataaaatact

SEQ ID NO: 40922 - DNA, 20 bp, Artificial Sequence
  Description of Artificial Sequence: Synthetic oligonucleotide
  Target: SCN9A; (+) strand; PAM type: NRG; PAM sequence: AGG
tcaaaagaaataaaatactt

SEQ ID NO: 40923 - DNA, 20 bp, Artificial Sequence
  Description of Artificial Sequence: Synthetic oligonucleotide
  Target: SCN9A; (+) strand; PAM type: NRG; PAM sequence: AAG
tacttaggatatgcttaacc

SEQ ID NO: 40924 - DNA, 20 bp, Artificial Sequence
  Description of Artificial Sequence: Synthetic oligonucleotide
  Target: SCN9A; (+) strand; PAM type: NRG; PAM sequence: AGG
acttaggatatgcttaacca

SEQ ID NO: 40925 - DNA, 20 bp, Artificial Sequence
  Description of Artificial Sequence: Synthetic oligonucleotide
  Target: SCN9A; (+) strand; PAM type: NRG; PAM sequence: AAG
aaaactacaaaatgttcatg

SEQ ID NO: 40926 - DNA, 20 bp, Artificial Sequence
  Description of Artificial Sequence: Synthetic oligonucleotide
  Target: SCN9A; (+) strand; PAM type: NRG; PAM sequence: AGG
aaactacaaaatgttcatga

SEQ ID NO: 40927 - DNA, 20 bp, Artificial Sequence
  Description of Artificial Sequence: Synthetic oligonucleotide
  Target: SCN9A; (+) strand; PAM type: NRG; PAM sequence: AAG
aatgttcatgaaggaaatta

SEQ ID NO: 40928 - DNA, 20 bp, Artificial Sequence
  Description of Artificial Sequence: Synthetic oligonucleotide
  Target: SCN9A; (+) strand; PAM type: NRG; PAM sequence: AAG
gttcatgaaggaaattaaag

SEQ ID NO: 40929 - DNA, 20 bp, Artificial Sequence
  Description of Artificial Sequence: Synthetic oligonucleotide
  Target: SCN9A; (+) strand; PAM type: NRG; PAM sequence: TGG
ttaaagaagacacaaataaa

SEQ ID NO: 40930 - DNA, 20 bp, Artificial Sequence
  Description of Artificial Sequence: Synthetic oligonucleotide
  Target: SCN9A; (+) strand; PAM type: NRG; PAM sequence: AAG
agaagacacaaataaatgga

SEQ ID NO: 40931 - DNA, 20 bp, Artificial Sequence
  Description of Artificial Sequence: Synthetic oligonucleotide
  Target: SCN9A; (+) strand; PAM type: NRG; PAM sequence: CAG
cacaaataaatggaaagacc

SEQ ID NO: 40932 - DNA, 20 bp, Artificial Sequence
  Description of Artificial Sequence: Synthetic oligonucleotide
  Target: SCN9A; (+) strand; PAM type: NRG; PAM sequence: AAG
taaaatgcccatactaccct

SEQ ID NO: 40933 - DNA, 20 bp, Artificial Sequence
  Description of Artificial Sequence: Synthetic oligonucleotide
  Target: SCN9A; (+) strand; PAM type: NRG; PAM sequence: CAG
agtgatctgtgaattcaata

SEQ ID NO: 40934 - DNA, 20 bp, Artificial Sequence
  Description of Artificial Sequence: Synthetic oligonucleotide
  Target: SCN9A; (+) strand; PAM type: NRG; PAM sequence: TAG
agtacatatcaaaatcccaa

SEQ ID NO: 40935 - DNA, 20 bp, Artificial Sequence
  Description of Artificial Sequence: Synthetic oligonucleotide
  Target: SCN9A; (+) strand; PAM type: NRG; PAM sequence: AAG
attatttactaaaataaaaa

SEQ ID NO: 40936 - DNA, 20 bp, Artificial Sequence
  Description of Artificial Sequence: Synthetic oligonucleotide
  Target: SCN9A; (+) strand; PAM type: NRG; PAM sequence: TGG
aaaagatcctaaaattcata

SEQ ID NO: 40937 - DNA, 20 bp, Artificial Sequence
  Description of Artificial Sequence: Synthetic oligonucleotide
  Target: SCN9A; (+) strand; PAM type: NRG; PAM sequence: AAG
aaattcatatggaaccacaa

SEQ ID NO: 40938 - DNA, 20 bp, Artificial Sequence
  Description of Artificial Sequence: Synthetic oligonucleotide
  Target: SCN9A; (+) strand; PAM type: NRG; PAM sequence: TAG
gaaccacaaaagactctgaa

SEQ ID NO: 40939 - DNA, 20 bp, Artificial Sequence
  Description of Artificial Sequence: Synthetic oligonucleotide
  Target: SCN9A; (+) strand; PAM type: NRG; PAM sequence: AAG
caaaagactctgaatagcca

SEQ ID NO: 40940 - DNA, 20 bp, Artificial Sequence
  Description of Artificial Sequence: Synthetic oligonucleotide
  Target: SCN9A; (+) strand; PAM type: NRG; PAM sequence: AAG
tgaatagccaaagcaatctt

SEQ ID NO: 40941 - DNA, 20 bp, Artificial Sequence
  Description of Artificial Sequence: Synthetic oligonucleotide
  Target: SCN9A; (+) strand; PAM type: NRG; PAM sequence: AAG
ccaaagcaatcttaagaaaa

SEQ ID NO: 40942 - DNA, 20 bp, Artificial Sequence
  Description of Artificial Sequence: Synthetic oligonucleotide
  Target: SCN9A; (+) strand; PAM type: NRG; PAM sequence: TGG
cttaagaaaaaagaacaaaa

SEQ ID NO: 40943 - DNA, 20 bp, Artificial Sequence
  Description of Artificial Sequence: Synthetic oligonucleotide
  Target: SCN9A; (+) strand; PAM type: NRG; PAM sequence: AAG
aagaaaaaagaacaaaatgg

SEQ ID NO: 40944 - DNA, 20 bp, Artificial Sequence
  Description of Artificial Sequence: Synthetic oligonucleotide
  Target: SCN9A; (+) strand; PAM type: NRG; PAM sequence: GAG
ttcttatttatttatttatt

SEQ ID NO: 40945 - DNA, 20 bp, Artificial Sequence
  Description of Artificial Sequence: Synthetic oligonucleotide
  Target: SCN9A; (+) strand; PAM type: NRG; PAM sequence: GAG
cttatttatttatttattga

SEQ ID NO: 40946 - DNA, 20 bp, Artificial Sequence
  Description of Artificial Sequence: Synthetic oligonucleotide
  Target: SCN9A; (+) strand; PAM type: NRG; PAM sequence: GAG
tatttatttatttattgaga

SEQ ID NO: 40947 - DNA, 20 bp, Artificial Sequence
  Description of Artificial Sequence: Synthetic oligonucleotide
  Target: SCN9A; (+) strand; PAM type: NRG; PAM sequence: AAG
ttatttatttattgagagag

SEQ ID NO: 40948 - DNA, 20 bp, Artificial Sequence
  Description of Artificial Sequence: Synthetic oligonucleotide
  Target: SCN9A; (+) strand; PAM type: NRG; PAM sequence: CAG
gaagatctcaccctgttgcc

SEQ ID NO: 40949 - DNA, 20 bp, Artificial Sequence
  Description of Artificial Sequence: Synthetic oligonucleotide
  Target: SCN9A; (+) strand; PAM type: NRG; PAM sequence: AGG
aagatctcaccctgttgccc

SEQ ID NO: 40950 - DNA, 20 bp, Artificial Sequence
  Description of Artificial Sequence: Synthetic oligonucleotide
  Target: SCN9A; (+) strand; PAM type: NRG; PAM sequence: CAG
tctcaccctgttgcccaggc

SEQ ID NO: 40951 - DNA, 20 bp, Artificial Sequence
  Description of Artificial Sequence: Synthetic oligonucleotide
  Target: SCN9A; (+) strand; PAM type: NRG; PAM sequence: GAG
tcaccctgttgcccaggcca

SEQ ID NO: 40952 - DNA, 20 bp, Artificial Sequence
  Description of Artificial Sequence: Synthetic oligonucleotide
  Target: SCN9A; (+) strand; PAM type: NRG; PAM sequence: CAG
ctgttgcccaggccagagtg

SEQ ID NO: 40953 - DNA, 20 bp, Artificial Sequence
  Description of Artificial Sequence: Synthetic oligonucleotide
  Target: SCN9A; (+) strand; PAM type: NRG; PAM sequence: TGG
ttgcccaggccagagtgcag

SEQ ID NO: 40954 - DNA, 20 bp, Artificial Sequence
  Description of Artificial Sequence: Synthetic oligonucleotide
  Target: SCN9A; (+) strand; PAM type: NRG; PAM sequence: TAG
agagtgcagtggcatgatca

SEQ ID NO: 40955 - DNA, 20 bp, Artificial Sequence
  Description of Artificial Sequence: Synthetic oligonucleotide
  Target: SCN9A; (+) strand; PAM type: NRG; PAM sequence: CAG
ggcatgatcatagctcactg

SEQ ID NO: 40956 - DNA, 20 bp, Artificial Sequence
  Description of Artificial Sequence: Synthetic oligonucleotide
  Target: SCN9A; (+) strand; PAM type: NRG; PAM sequence: TGG
tcactgcagcctcatactct

SEQ ID NO: 40957 - DNA, 20 bp, Artificial Sequence
  Description of Artificial Sequence: Synthetic oligonucleotide
  Target: SCN9A; (+) strand; PAM type: NRG; PAM sequence: GGG
cactgcagcctcatactctt

SEQ ID NO: 40958 - DNA, 20 bp, Artificial Sequence
  Description of Artificial Sequence: Synthetic oligonucleotide
  Target: SCN9A; (+) strand; PAM type: NRG; PAM sequence: CAG
agcctcatactcttgggctt

SEQ ID NO: 40959 - DNA, 20 bp, Artificial Sequence
  Description of Artificial Sequence: Synthetic oligonucleotide
  Target: SCN9A; (+) strand; PAM type: NRG; PAM sequence: CAG
cttcagtgatcctcccacct

SEQ ID NO: 40960 - DNA, 20 bp, Artificial Sequence
  Description of Artificial Sequence: Synthetic oligonucleotide
  Target: SCN9A; (+) strand; PAM type: NRG; PAM sequence: AGG
ttcagtgatcctcccacctc

SEQ ID NO: 40961 - DNA, 20 bp, Artificial Sequence
  Description of Artificial Sequence: Synthetic oligonucleotide
  Target: SCN9A; (+) strand; PAM type: NRG; PAM sequence: AAG
tcctcccacctcaggctcct

SEQ ID NO: 40962 - DNA, 20 bp, Artificial Sequence
  Description of Artificial Sequence: Synthetic oligonucleotide
  Target: SCN9A; (+) strand; PAM type: NRG; PAM sequence: TAG
tcccacctcaggctcctaag

SEQ ID NO: 40963 - DNA, 20 bp, Artificial Sequence
  Description of Artificial Sequence: Synthetic oligonucleotide
  Target: SCN9A; (+) strand; PAM type: NRG; PAM sequence: TAG
acctcaggctcctaagtagc

SEQ ID NO: 40964 - DNA, 20 bp, Artificial Sequence
  Description of Artificial Sequence: Synthetic oligonucleotide
  Target: SCN9A; (+) strand; PAM type: NRG; PAM sequence: AGG
cctcaggctcctaagtagct

SEQ ID NO: 40965 - DNA, 20 bp, Artificial Sequence
  Description of Artificial Sequence: Synthetic oligonucleotide
  Target: SCN9A; (+) strand; PAM type: NRG; PAM sequence: TAG
ctcctaagtagctaggacta

SEQ ID NO: 40966 - DNA, 20 bp, Artificial Sequence
  Description of Artificial Sequence: Synthetic oligonucleotide
  Target: SCN9A; (+) strand; PAM type: NRG; PAM sequence: AGG
tcctaagtagctaggactat

SEQ ID NO: 40967 - DNA, 20 bp, Artificial Sequence
  Description of Artificial Sequence: Synthetic oligonucleotide
  Target: SCN9A; (+) strand; PAM type: NRG; PAM sequence: TGG
taggtgtgtgccatcatgct

SEQ ID NO: 40968 - DNA, 20 bp, Artificial Sequence
  Description of Artificial Sequence: Synthetic oligonucleotide
  Target: SCN9A; (+) strand; PAM type: NRG; PAM sequence: AAG
acttttcaaatatcttcgta

SEQ ID NO: 40969 - DNA, 20 bp, Artificial Sequence
  Description of Artificial Sequence: Synthetic oligonucleotide
  Target: SCN9A; (+) strand; PAM type: NRG; PAM sequence: AAG
tttcaaatatcttcgtaaag

SEQ ID NO: 40970 - DNA, 20 bp, Artificial Sequence
  Description of Artificial Sequence: Synthetic oligonucleotide
  Target: SCN9A; (+) strand; PAM type: NRG; PAM sequence: AGG
ttcaaatatcttcgtaaaga

SEQ ID NO: 40971 - DNA, 20 bp, Artificial Sequence
  Description of Artificial Sequence: Synthetic oligonucleotide
  Target: SCN9A; (+) strand; PAM type: NRG; PAM sequence: GAG
caaatatcttcgtaaagaag

SEQ ID NO: 40972 - DNA, 20 bp, Artificial Sequence
  Description of Artificial Sequence: Synthetic oligonucleotide
  Target: SCN9A; (+) strand; PAM type: NRG; PAM sequence: CAG
aagaaggagtctatcttgcc

SEQ ID NO: 40973 - DNA, 20 bp, Artificial Sequence
  Description of Artificial Sequence: Synthetic oligonucleotide
  Target: SCN9A; (+) strand; PAM type: NRG; PAM sequence: AGG
agaaggagtctatcttgccc

SEQ ID NO: 40974 - DNA, 20 bp, Artificial Sequence
  Description of Artificial Sequence: Synthetic oligonucleotide
  Target: SCN9A; (+) strand; PAM type: NRG; PAM sequence: TGG
ggagtctatcttgcccaggc

SEQ ID NO: 40975 - DNA, 20 bp, Artificial Sequence
  Description of Artificial Sequence: Synthetic oligonucleotide
  Target: SCN9A; (+) strand; PAM type: NRG; PAM sequence: TGG
ccaggctggtctcaaactct

SEQ ID NO: 40976 - DNA, 20 bp, Artificial Sequence
  Description of Artificial Sequence: Synthetic oligonucleotide
  Target: SCN9A; (+) strand; PAM type: NRG; PAM sequence: AAG
ggtctcaaactcttggccac

SEQ ID NO: 40977 - DNA, 20 bp, Artificial Sequence
  Description of Artificial Sequence: Synthetic oligonucleotide
  Target: SCN9A; (+) strand; PAM type: NRG; PAM sequence: CAG
cttggccacaagtgatcctc

SEQ ID NO: 40978 - DNA, 20 bp, Artificial Sequence
  Description of Artificial Sequence: Synthetic oligonucleotide
  Target: SCN9A; (+) strand; PAM type: NRG; PAM sequence: TAG
cacaagtgatcctccagcct

SEQ ID NO: 40979 - DNA, 20 bp, Artificial Sequence
  Description of Artificial Sequence: Synthetic oligonucleotide
  Target: SCN9A; (+) strand; PAM type: NRG; PAM sequence: GAG
tcctccagccttagcctccc

SEQ ID NO: 40980 - DNA, 20 bp, Artificial Sequence
  Description of Artificial Sequence: Synthetic oligonucleotide
  Target: SCN9A; (+) strand; PAM type: NRG; PAM sequence: TGG
gccttagcctcccgagttgc

SEQ ID NO: 40981 - DNA, 20 bp, Artificial Sequence
  Description of Artificial Sequence: Synthetic oligonucleotide
  Target: SCN9A; (+) strand; PAM type: NRG; PAM sequence: GGG
ccttagcctcccgagttgct

SEQ ID NO: 40982 - DNA, 20 bp, Artificial Sequence
  Description of Artificial Sequence: Synthetic oligonucleotide
  Target: SCN9A; (+) strand; PAM type: NRG; PAM sequence: AAG
tcccgagttgctgggattat

SEQ ID NO: 40983 - DNA, 20 bp, Artificial Sequence
  Description of Artificial Sequence: Synthetic oligonucleotide
  Target: SCN9A; (+) strand; PAM type: NRG; PAM sequence: GAG
gttgctgggattataagcat

SEQ ID NO: 40984 - DNA, 20 bp, Artificial Sequence
  Description of Artificial Sequence: Synthetic oligonucleotide
  Target: SCN9A; (+) strand; PAM type: NRG; PAM sequence: CAG
taagcatgagccattgcacc

SEQ ID NO: 40985 - DNA, 20 bp, Artificial Sequence
  Description of Artificial Sequence: Synthetic oligonucleotide
  Target: SCN9A; (+) strand; PAM type: NRG; PAM sequence: CAG
gccattgcacccagtcccca

SEQ ID NO: 40986 - DNA, 20 bp, Artificial Sequence
  Description of Artificial Sequence: Synthetic oligonucleotide
  Target: SCN9A; (+) strand; PAM type: NRG; PAM sequence: AGG
ccattgcacccagtccccac

SEQ ID NO: 40987 - DNA, 20 bp, Artificial Sequence
  Description of Artificial Sequence: Synthetic oligonucleotide
  Target: SCN9A; (+) strand; PAM type: NRG; PAM sequence: AAG
tcatttcaaaatgtataaca

SEQ ID NO: 40988 - DNA, 20 bp, Artificial Sequence
  Description of Artificial Sequence: Synthetic oligonucleotide
  Target: SCN9A; (+) strand; PAM type: NRG; PAM sequence: TAG
caaagctacaacaattaaaa

SEQ ID NO: 40989 - DNA, 20 bp, Artificial Sequence
  Description of Artificial Sequence: Synthetic oligonucleotide
  Target: SCN9A; (+) strand; PAM type: NRG; PAM sequence: TGG
ctacaacaattaaaatagta

SEQ ID NO: 40990 - DNA, 20 bp, Artificial Sequence
  Description of Artificial Sequence: Synthetic oligonucleotide
  Target: SCN9A; (+) strand; PAM type: NRG; PAM sequence: TGG
caattaaaatagtatggtcc

SEQ ID NO: 40991 - DNA, 20 bp, Artificial Sequence
  Description of Artificial Sequence: Synthetic oligonucleotide
  Target: SCN9A; (+) strand; PAM type: NRG; PAM sequence: TAG
cctggcataaaacaaatata

SEQ ID NO: 40992 - DNA, 20 bp, Artificial Sequence
  Description of Artificial Sequence: Synthetic oligonucleotide
  Target: SCN9A; (+) strand; PAM type: NRG; PAM sequence: AGG
ctggcataaaacaaatatat

SEQ ID NO: 40993 - DNA, 20 bp, Artificial Sequence
  Description of Artificial Sequence: Synthetic oligonucleotide
  Target: SCN9A; (+) strand; PAM type: NRG; PAM sequence: CAG
aaatatataggccaatgaaa

SEQ ID NO: 40994 - DNA, 20 bp, Artificial Sequence
  Description of Artificial Sequence: Synthetic oligonucleotide
  Target: SCN9A; (+) strand; PAM type: NRG; PAM sequence: AGG
aatatataggccaatgaaac

SEQ ID NO: 40995 - DNA, 20 bp, Artificial Sequence
  Description of Artificial Sequence: Synthetic oligonucleotide
  Target: SCN9A; (+) strand; PAM type: NRG; PAM sequence: TAG
tataggccaatgaaacagga

SEQ ID NO: 40996 - DNA, 20 bp, Artificial Sequence
  Description of Artificial Sequence: Synthetic oligonucleotide
  Target: SCN9A; (+) strand; PAM type: NRG; PAM sequence: GAG
taggccaatgaaacaggata

SEQ ID NO: 40997 - DNA, 20 bp, Artificial Sequence
  Description of Artificial Sequence: Synthetic oligonucleotide
  Target: SCN9A; (+) strand; PAM type: NRG; PAM sequence: GAG
ggccaatgaaacaggataga

SEQ ID NO: 40998 - DNA, 20 bp, Artificial Sequence
  Description of Artificial Sequence: Synthetic oligonucleotide
  Target: SCN9A; (+) strand; PAM type: NRG; PAM sequence: CAG
atgaaacaggatagagagcc

SEQ ID NO: 40999 - DNA, 20 bp, Artificial Sequence
  Description of Artificial Sequence: Synthetic oligonucleotide
  Target: SCN9A; (+) strand; PAM type: NRG; PAM sequence: TAG
gaaataaacccatgcataaa

SEQ ID NO: 41000 - DNA, 20 bp, Artificial Sequence
  Description of Artificial Sequence: Synthetic oligonucleotide
  Target: SCN9A; (+) strand; PAM type: NRG; PAM sequence: CAG
aatagttaactcatattcaa

SEQ ID NO: 41001 - DNA, 20 bp, Artificial Sequence
  Description of Artificial Sequence: Synthetic oligonucleotide
  Target: SCN9A; (+) strand; PAM type: NRG; PAM sequence: AGG
atagttaactcatattcaac

SEQ ID NO: 41002 - DNA, 20 bp, Artificial Sequence
  Description of Artificial Sequence: Synthetic oligonucleotide
  Target: SCN9A; (+) strand; PAM type: NRG; PAM sequence: GGG
tagttaactcatattcaaca

SEQ ID NO: 41003 - DNA, 20 bp, Artificial Sequence
  Description of Artificial Sequence: Synthetic oligonucleotide
  Target: SCN9A; (+) strand; PAM type: NRG; PAM sequence: GGG
agttaactcatattcaacag

SEQ ID NO: 41004 - DNA, 20 bp, Artificial Sequence
  Description of Artificial Sequence: Synthetic oligonucleotide
  Target: SCN9A; (+) strand; PAM type: NRG; PAM sequence: AAG
tcatattcaacaggggtgcc

SEQ ID NO: 41005 - DNA, 20 bp, Artificial Sequence
  Description of Artificial Sequence: Synthetic oligonucleotide
  Target: SCN9A; (+) strand; PAM type: NRG; PAM sequence: TAG
ggggtgccaagaatacacaa

SEQ ID NO: 41006 - DNA, 20 bp, Artificial Sequence
  Description of Artificial Sequence: Synthetic oligonucleotide
  Target: SCN9A; (+) strand; PAM type: NRG; PAM sequence: AAG
gccaagaatacacaatagaa

SEQ ID NO: 41007 - DNA, 20 bp, Artificial Sequence
  Description of Artificial Sequence: Synthetic oligonucleotide
  Target: SCN9A; (+) strand; PAM type: NRG; PAM sequence: GAG
caagaatacacaatagaaaa

SEQ ID NO: 41008 - DNA, 20 bp, Artificial Sequence
  Description of Artificial Sequence: Synthetic oligonucleotide
  Target: SCN9A; (+) strand; PAM type: NRG; PAM sequence: AGG
aagaatacacaatagaaaag

SEQ ID NO: 41009 - DNA, 20 bp, Artificial Sequence
  Description of Artificial Sequence: Synthetic oligonucleotide
  Target: SCN9A; (+) strand; PAM type: NRG; PAM sequence: TGG
ggccactcaacaaataatgt

SEQ ID NO: 41010 - DNA, 20 bp, Artificial Sequence
  Description of Artificial Sequence: Synthetic oligonucleotide
  Target: SCN9A; (+) strand; PAM type: NRG; PAM sequence: GGG
gccactcaacaaataatgtt

SEQ ID NO: 41011 - DNA, 20 bp, Artificial Sequence
  Description of Artificial Sequence: Synthetic oligonucleotide
  Target: SCN9A; (+) strand; PAM type: NRG; PAM sequence: TGG
acaaataatgttgggaaaac

SEQ ID NO: 41012 - DNA, 20 bp, Artificial Sequence
  Description of Artificial Sequence: Synthetic oligonucleotide
  Target: SCN9A; (+) strand; PAM type: NRG; PAM sequence: TAG
acacaaaaataaactcaaaa

SEQ ID NO: 41013 - DNA, 20 bp, Artificial Sequence
  Description of Artificial Sequence: Synthetic oligonucleotide
  Target: SCN9A; (+) strand; PAM type: NRG; PAM sequence: AAG
tagattaaacatttaaacct

SEQ ID NO: 41014 - DNA, 20 bp, Artificial Sequence
  Description of Artificial Sequence: Synthetic oligonucleotide
  Target: SCN9A; (+) strand; PAM type: NRG; PAM sequence: TAG
cctgaaaactgtaaaacttg

SEQ ID NO: 41015 - DNA, 20 bp, Artificial Sequence
  Description of Artificial Sequence: Synthetic oligonucleotide
  Target: SCN9A; (+) strand; PAM type: NRG; PAM sequence: AAG
gaaaactgtaaaacttgtag

SEQ ID NO: 41016 - DNA, 20 bp, Artificial Sequence
  Description of Artificial Sequence: Synthetic oligonucleotide
  Target: SCN9A; (+) strand; PAM type: NRG; PAM sequence: TAG
aaaacttgtagaagaaaaca

SEQ ID NO: 41017 - DNA, 20 bp, Artificial Sequence
  Description of Artificial Sequence: Synthetic oligonucleotide
  Target: SCN9A; (+) strand; PAM type: NRG; PAM sequence: CAG
acttgtagaagaaaacatag

SEQ ID NO: 41018 - DNA, 20 bp, Artificial Sequence
  Description of Artificial Sequence: Synthetic oligonucleotide
  Target: SCN9A; (+) strand; PAM type: NRG; PAM sequence: AGG
cttgtagaagaaaacatagc

SEQ ID NO: 41019 - DNA, 20 bp, Artificial Sequence
  Description of Artificial Sequence: Synthetic oligonucleotide
  Target: SCN9A; (+) strand; PAM type: NRG; PAM sequence: AAG
tagaagaaaacatagcagga

SEQ ID NO: 41020 - DNA, 20 bp, Artificial Sequence
  Description of Artificial Sequence: Synthetic oligonucleotide
  Target: SCN9A; (+) strand; PAM type: NRG; PAM sequence: TGG
tgttcttgacaatgatttct

SEQ ID NO: 41021 - DNA, 20 bp, Artificial Sequence
  Description of Artificial Sequence: Synthetic oligonucleotide
  Target: SCN9A; (+) strand; PAM type: NRG; PAM sequence: AAG
aatgactccaaaattcaaac

SEQ ID NO: 41022 - DNA, 20 bp, Artificial Sequence
  Description of Artificial Sequence: Synthetic oligonucleotide
  Target: SCN9A; (+) strand; PAM type: NRG; PAM sequence: GAG
tgactccaaaattcaaacaa

SEQ ID NO: 41023 - DNA, 20 bp, Artificial Sequence
  Description of Artificial Sequence: Synthetic oligonucleotide
  Target: SCN9A; (+) strand; PAM type: NRG; PAM sequence: TAG
aattcaaacaagagcaaaaa

SEQ ID NO: 41024 - DNA, 20 bp, Artificial Sequence
  Description of Artificial Sequence: Synthetic oligonucleotide
  Target: SCN9A; (+) strand; PAM type: NRG; PAM sequence: GAG
aagagcaaaaatagacaatt

SEQ ID NO: 41025 - DNA, 20 bp, Artificial Sequence
  Description of Artificial Sequence: Synthetic oligonucleotide
  Target: SCN9A; (+) strand; PAM type: NRG; PAM sequence: AAG
tgagaccatatcaaactaaa

SEQ ID NO: 41026 - DNA, 20 bp, Artificial Sequence
  Description of Artificial Sequence: Synthetic oligonucleotide
  Target: SCN9A; (+) strand; PAM type: NRG; PAM sequence: TGG
catatcaaactaaaaagctt

SEQ ID NO: 41027 - DNA, 20 bp, Artificial Sequence
  Description of Artificial Sequence: Synthetic oligonucleotide
  Target: SCN9A; (+) strand; PAM type: NRG; PAM sequence: GGG
atatcaaactaaaaagcttt

SEQ ID NO: 41028 - DNA, 20 bp, Artificial Sequence
  Description of Artificial Sequence: Synthetic oligonucleotide
  Target: SCN9A; (+) strand; PAM type: NRG; PAM sequence: AAG
ctaaaaagctttgggaaaaa

SEQ ID NO: 41029 - DNA, 20 bp, Artificial Sequence
  Description of Artificial Sequence: Synthetic oligonucleotide
  Target: SCN9A; (+) strand; PAM type: NRG; PAM sequence: AGG
taaaaagctttgggaaaaaa

SEQ ID NO: 41030 - DNA, 20 bp, Artificial Sequence
  Description of Artificial Sequence: Synthetic oligonucleotide
  Target: SCN9A; (+) strand; PAM type: NRG; PAM sequence: AAG
aaagctttgggaaaaaaagg

SEQ ID NO: 41031 - DNA, 20 bp, Artificial Sequence
  Description of Artificial Sequence: Synthetic oligonucleotide
  Target: SCN9A; (+) strand; PAM type: NRG; PAM sequence: AAG
gggaaaaaaaggaagcattc

SEQ ID NO: 41032 - DNA, 20 bp, Artificial Sequence
  Description of Artificial Sequence: Synthetic oligonucleotide
  Target: SCN9A; (+) strand; PAM type: NRG; PAM sequence: GAG
gaaaaaaaggaagcattcaa

SEQ ID NO: 41033 - DNA, 20 bp, Artificial Sequence
  Description of Artificial Sequence: Synthetic oligonucleotide
  Target: SCN9A; (+) strand; PAM type: NRG; PAM sequence: AGG
aaaaaaaggaagcattcaag

SEQ ID NO: 41034 - DNA, 20 bp, Artificial Sequence
  Description of Artificial Sequence: Synthetic oligonucleotide
  Target: SCN9A; (+) strand; PAM type: NRG; PAM sequence: GGG
aaaaaaggaagcattcaaga

SEQ ID NO: 41035 - DNA, 20 bp, Artificial Sequence
  Description of Artificial Sequence: Synthetic oligonucleotide
  Target: SCN9A; (+) strand; PAM type: NRG; PAM sequence: AAG
aagcattcaagagggtgaaa

SEQ ID NO: 41036 - DNA, 20 bp, Artificial Sequence
  Description of Artificial Sequence: Synthetic oligonucleotide
  Target: SCN9A; (+) strand; PAM type: NRG; PAM sequence: TAG
gagggtgaaaaagcaaccta

SEQ ID NO: 41037 - DNA, 20 bp, Artificial Sequence
  Description of Artificial Sequence: Synthetic oligonucleotide
  Target: SCN9A; (+) strand; PAM type: NRG; PAM sequence: TGG
tgaaaaagcaacctatagaa

SEQ ID NO: 41038 - DNA, 20 bp, Artificial Sequence
  Description of Artificial Sequence: Synthetic oligonucleotide
  Target: SCN9A; (+) strand; PAM type: NRG; PAM sequence: GGG
gaaaaagcaacctatagaat

SEQ ID NO: 41039 - DNA, 20 bp, Artificial Sequence
  Description of Artificial Sequence: Synthetic oligonucleotide
  Target: SCN9A; (+) strand; PAM type: NRG; PAM sequence: GAG
aaaagcaacctatagaatgg

SEQ ID NO: 41040 - DNA, 20 bp, Artificial Sequence
  Description of Artificial Sequence: Synthetic oligonucleotide
  Target: SCN9A; (+) strand; PAM type: NRG; PAM sequence: TGG
ccaactatatatctaataaa

SEQ ID NO: 41041 - DNA, 20 bp, Artificial Sequence
  Description of Artificial Sequence: Synthetic oligonucleotide
  Target: SCN9A; (+) strand; PAM type: NRG; PAM sequence: TAG
tggttaatatccaaaatata

SEQ ID NO: 41042 - DNA, 20 bp, Artificial Sequence
  Description of Artificial Sequence: Synthetic oligonucleotide
  Target: SCN9A; (+) strand; PAM type: NRG; PAM sequence: AGG
ggttaatatccaaaatatat

SEQ ID NO: 41043 - DNA, 20 bp, Artificial Sequence
  Description of Artificial Sequence: Synthetic oligonucleotide
  Target: SCN9A; (+) strand; PAM type: NRG; PAM sequence: GGG
gttaatatccaaaatatata

SEQ ID NO: 41044 - DNA, 20 bp, Artificial Sequence
  Description of Artificial Sequence: Synthetic oligonucleotide
  Target: SCN9A; (+) strand; PAM type: NRG; PAM sequence: AAG
atagggaactcctgcaactt

SEQ ID NO: 41045 - DNA, 20 bp, Artificial Sequence
  Description of Artificial Sequence: Synthetic oligonucleotide
  Target: SCN9A; (+) strand; PAM type: NRG; PAM sequence: AAG
gggaactcctgcaacttaag

SEQ ID NO: 41046 - DNA, 20 bp, Artificial Sequence
  Description of Artificial Sequence: Synthetic oligonucleotide
  Target: SCN9A; (+) strand; PAM type: NRG; PAM sequence: AGG
ggaactcctgcaacttaaga

SEQ ID NO: 41047 - DNA, 20 bp, Artificial Sequence
  Description of Artificial Sequence: Synthetic oligonucleotide
  Target: SCN9A; (+) strand; PAM type: NRG; PAM sequence: AAG
atgaccaacatgtatattaa

SEQ ID NO: 41048 - DNA, 20 bp, Artificial Sequence
  Description of Artificial Sequence: Synthetic oligonucleotide
  Target: SCN9A; (+) strand; PAM type: NRG; PAM sequence: CAG
catgtatattaaaagatgct

SEQ ID NO: 41049 - DNA, 20 bp, Artificial Sequence
  Description of Artificial Sequence: Synthetic oligonucleotide
  Target: SCN9A; (+) strand; PAM type: NRG; PAM sequence: CAG
tgctcagtatcactaatcat

SEQ ID NO: 41050 - DNA, 20 bp, Artificial Sequence
  Description of Artificial Sequence: Synthetic oligonucleotide
  Target: SCN9A; (+) strand; PAM type: NRG; PAM sequence: GAG
attcaaataaaaactgtaat

SEQ ID NO: 41051 - DNA, 20 bp, Artificial Sequence
  Description of Artificial Sequence: Synthetic oligonucleotide
  Target: SCN9A; (+) strand; PAM type: NRG; PAM sequence: AGG
ttcaaataaaaactgtaatg

SEQ ID NO: 41052 - DNA, 20 bp, Artificial Sequence
  Description of Artificial Sequence: Synthetic oligonucleotide
  Target: SCN9A; (+) strand; PAM type: NRG; PAM sequence: GGG
tcaaataaaaactgtaatga

SEQ ID NO: 41053 - DNA, 20 bp, Artificial Sequence
  Description of Artificial Sequence: Synthetic oligonucleotide
  Target: SCN9A; (+) strand; PAM type: NRG; PAM sequence: CAG
ataaaaactgtaatgagggc

SEQ ID NO: 41054 - DNA, 20 bp, Artificial Sequence
  Description of Artificial Sequence: Synthetic oligonucleotide
  Target: SCN9A; (+) strand; PAM type: NRG; PAM sequence: AGG
taaaaactgtaatgagggcc

SEQ ID NO: 41055 - DNA, 20 bp, Artificial Sequence
  Description of Artificial Sequence: Synthetic oligonucleotide
  Target: SCN9A; (+) strand; PAM type: NRG; PAM sequence: CAG
actgtaatgagggccaggtg

SEQ ID NO: 41056 - DNA, 20 bp, Artificial Sequence
  Description of Artificial Sequence: Synthetic oligonucleotide
  Target: SCN9A; (+) strand; PAM type: NRG; PAM sequence: TGG
gtaatgagggccaggtgcag

SEQ ID NO: 41057 - DNA, 20 bp, Artificial Sequence
  Description of Artificial Sequence: Synthetic oligonucleotide
  Target: SCN9A; (+) strand; PAM type: NRG; PAM sequence: CAG
gtggctcatgcctgttatcc

SEQ ID NO: 41058 - DNA, 20 bp, Artificial Sequence
  Description of Artificial Sequence: Synthetic oligonucleotide
  Target: SCN9A; (+) strand; PAM type: NRG; PAM sequence: TGG
tgcctgttatcccagcactt

SEQ ID NO: 41059 - DNA, 20 bp, Artificial Sequence
  Description of Artificial Sequence: Synthetic oligonucleotide
  Target: SCN9A; (+) strand; PAM type: NRG; PAM sequence: GGG
gcctgttatcccagcacttt

SEQ ID NO: 41060 - DNA, 20 bp, Artificial Sequence
  Description of Artificial Sequence: Synthetic oligonucleotide
  Target: SCN9A; (+) strand; PAM type: NRG; PAM sequence: GAG
ctgttatcccagcactttgg

SEQ ID NO: 41061 - DNA, 20 bp, Artificial Sequence
  Description of Artificial Sequence: Synthetic oligonucleotide
  Target: SCN9A; (+) strand; PAM type: NRG; PAM sequence: AGG
tgttatcccagcactttggg

SEQ ID NO: 41062 - DNA, 20 bp, Artificial Sequence
  Description of Artificial Sequence: Synthetic oligonucleotide
  Target: SCN9A; (+) strand; PAM type: NRG; PAM sequence: AAG
tcccagcactttgggaggcc

SEQ ID NO: 41063 - DNA, 20 bp, Artificial Sequence
  Description of Artificial Sequence: Synthetic oligonucleotide
  Target: SCN9A; (+) strand; PAM type: NRG; PAM sequence: AGG
cccagcactttgggaggcca

SEQ ID NO: 41064 - DNA, 20 bp, Artificial Sequence
  Description of Artificial Sequence: Synthetic oligonucleotide
  Target: SCN9A; (+) strand; PAM type: NRG; PAM sequence: TGG
agcactttgggaggccaagg

SEQ ID NO: 41065 - DNA, 20 bp, Artificial Sequence
  Description of Artificial Sequence: Synthetic oligonucleotide
  Target: SCN9A; (+) strand; PAM type: NRG; PAM sequence: GGG
gcactttgggaggccaaggt

SEQ ID NO: 41066 - DNA, 20 bp, Artificial Sequence
  Description of Artificial Sequence: Synthetic oligonucleotide
  Target: SCN9A; (+) strand; PAM type: NRG; PAM sequence: TGG
ctttgggaggccaaggtggg

SEQ ID NO: 41067 - DNA, 20 bp, Artificial Sequence
  Description of Artificial Sequence: Synthetic oligonucleotide
  Target: SCN9A; (+) strand; PAM type: NRG; PAM sequence: GAG
ggccaaggtgggtggatcat

SEQ ID NO: 41068 - DNA, 20 bp, Artificial Sequence
  Description of Artificial Sequence: Synthetic oligonucleotide
  Target: SCN9A; (+) strand; PAM type: NRG; PAM sequence: AGG
gccaaggtgggtggatcatg

SEQ ID NO: 41069 - DNA, 20 bp, Artificial Sequence
  Description of Artificial Sequence: Synthetic oligonucleotide
  Target: SCN9A; (+) strand; PAM type: NRG; PAM sequence: CAG
aggtgggtggatcatgaggt

SEQ ID NO: 41070 - DNA, 20 bp, Artificial Sequence
  Description of Artificial Sequence: Synthetic oligonucleotide
  Target: SCN9A; (+) strand; PAM type: NRG; PAM sequence: AGG
ggtgggtggatcatgaggtc

SEQ ID NO: 41071 - DNA, 20 bp, Artificial Sequence
  Description of Artificial Sequence: Synthetic oligonucleotide
  Target: SCN9A; (+) strand; PAM type: NRG; PAM sequence: GAG
tgggtggatcatgaggtcag

SEQ ID NO: 41072 - DNA, 20 bp, Artificial Sequence
  Description of Artificial Sequence: Synthetic oligonucleotide
  Target: SCN9A; (+) strand; PAM type: NRG; PAM sequence: AAG
gatcatgaggtcaggagatc

SEQ ID NO: 41073 - DNA, 20 bp, Artificial Sequence
  Description of Artificial Sequence: Synthetic oligonucleotide
  Target: SCN9A; (+) strand; PAM type: NRG; PAM sequence: TGG
tcaggagatcaagaccatcc

SEQ ID NO: 41074 - DNA, 20 bp, Artificial Sequence
  Description of Artificial Sequence: Synthetic oligonucleotide
  Target: SCN9A; (+) strand; PAM type: NRG; PAM sequence: TGG
caagaccatcctggccaaaa

SEQ ID NO: 41075 - DNA, 20 bp, Artificial Sequence
  Description of Artificial Sequence: Synthetic oligonucleotide
  Target: SCN9A; (+) strand; PAM type: NRG; PAM sequence: TAG
tctactgaaaatacaaaaat

SEQ ID NO: 41076 - DNA, 20 bp, Artificial Sequence
  Description of Artificial Sequence: Synthetic oligonucleotide
  Target: SCN9A; (+) strand; PAM type: NRG; PAM sequence: TGG
ctgaaaatacaaaaattagc

SEQ ID NO: 41077 - DNA, 20 bp, Artificial Sequence
  Description of Artificial Sequence: Synthetic oligonucleotide
  Target: SCN9A; (+) strand; PAM type: NRG; PAM sequence: GGG
tgaaaatacaaaaattagct

SEQ ID NO: 41078 - DNA, 20 bp, Artificial Sequence
  Description of Artificial Sequence: Synthetic oligonucleotide
  Target: SCN9A; (+) strand; PAM type: NRG; PAM sequence: TGG
atacaaaaattagctgggca

SEQ ID NO: 41079 - DNA, 20 bp, Artificial Sequence
  Description of Artificial Sequence: Synthetic oligonucleotide
  Target: SCN9A; (+) strand; PAM type: NRG; PAM sequence: TGG
caaaaattagctgggcatgg

SEQ ID NO: 41080 - DNA, 20 bp, Artificial Sequence
  Description of Artificial Sequence: Synthetic oligonucleotide
  Target: SCN9A; (+) strand; PAM type: NRG; PAM sequence: CAG
gtggcacatgcctgtaatcc

SEQ ID NO: 41081 - DNA, 20 bp, Artificial Sequence
  Description of Artificial Sequence: Synthetic oligonucleotide
  Target: SCN9A; (+) strand; PAM type: NRG; PAM sequence: TGG
tgcctgtaatcccagctact

SEQ ID NO: 41082 - DNA, 20 bp, Artificial Sequence
  Description of Artificial Sequence: Synthetic oligonucleotide
  Target: SCN9A; (+) strand; PAM type: NRG; PAM sequence: GGG
gcctgtaatcccagctactt

SEQ ID NO: 41083 - DNA, 20 bp, Artificial Sequence
  Description of Artificial Sequence: Synthetic oligonucleotide
  Target: SCN9A; (+) strand; PAM type: NRG; PAM sequence: AAG
tgtaatcccagctacttggg

SEQ ID NO: 41084 - DNA, 20 bp, Artificial Sequence
  Description of Artificial Sequence: Synthetic oligonucleotide
  Target: SCN9A; (+) strand; PAM type: NRG; PAM sequence: GAG
tcccagctacttgggaagct

SEQ ID NO: 41085 - DNA, 20 bp, Artificial Sequence
  Description of Artificial Sequence: Synthetic oligonucleotide
  Target: SCN9A; (+) strand; PAM type: NRG; PAM sequence: AGG
cccagctacttgggaagctg

SEQ ID NO: 41086 - DNA, 20 bp, Artificial Sequence
  Description of Artificial Sequence: Synthetic oligonucleotide
  Target: SCN9A; (+) strand; PAM type: NRG; PAM sequence: CAG
agctacttgggaagctgagg

SEQ ID NO: 41087 - DNA, 20 bp, Artificial Sequence
  Description of Artificial Sequence: Synthetic oligonucleotide
  Target: SCN9A; (+) strand; PAM type: NRG; PAM sequence: AGG
gctacttgggaagctgaggc

SEQ ID NO: 41088 - DNA, 20 bp, Artificial Sequence
  Description of Artificial Sequence: Synthetic oligonucleotide
  Target: SCN9A; (+) strand; PAM type: NRG; PAM sequence: GAG
tacttgggaagctgaggcag

SEQ ID NO: 41089 - DNA, 20 bp, Artificial Sequence
  Description of Artificial Sequence: Synthetic oligonucleotide
  Target: SCN9A; (+) strand; PAM type: NRG; PAM sequence: CAG
ggcaggagaatcacttgaac

SEQ ID NO: 41090 - DNA, 20 bp, Artificial Sequence
  Description of Artificial Sequence: Synthetic oligonucleotide
  Target: SCN9A; (+) strand; PAM type: NRG; PAM sequence: AGG
gcaggagaatcacttgaacc

SEQ ID NO: 41091 - DNA, 20 bp, Artificial Sequence
  Description of Artificial Sequence: Synthetic oligonucleotide
  Target: SCN9A; (+) strand; PAM type: NRG; PAM sequence: GGG
caggagaatcacttgaacca

SEQ ID NO: 41092 - DNA, 20 bp, Artificial Sequence
  Description of Artificial Sequence: Synthetic oligonucleotide
  Target: SCN9A; (+) strand; PAM type: NRG; PAM sequence: GAG
ggagaatcacttgaaccagg

SEQ ID NO: 41093 - DNA, 20 bp, Artificial Sequence
  Description of Artificial Sequence: Synthetic oligonucleotide
  Target: SCN9A; (+) strand; PAM type: NRG; PAM sequence: CGG
aatcacttgaaccagggagt

SEQ ID NO: 41094 - DNA, 20 bp, Artificial Sequence
  Description of Artificial Sequence: Synthetic oligonucleotide
  Target: SCN9A; (+) strand; PAM type: NRG; PAM sequence: GAG
tcacttgaaccagggagtcg

SEQ ID NO: 41095 - DNA, 20 bp, Artificial Sequence
  Description of Artificial Sequence: Synthetic oligonucleotide
  Target: SCN9A; (+) strand; PAM type: NRG; PAM sequence: AGG
cacttgaaccagggagtcgg

SEQ ID NO: 41096 - DNA, 20 bp, Artificial Sequence
  Description of Artificial Sequence: Synthetic oligonucleotide
  Target: SCN9A; (+) strand; PAM type: NRG; PAM sequence: CAG
aaccagggagtcggaggttg

SEQ ID NO: 41097 - DNA, 20 bp, Artificial Sequence
  Description of Artificial Sequence: Synthetic oligonucleotide
  Target: SCN9A; (+) strand; PAM type: NRG; PAM sequence: GAG
agggagtcggaggttgcagt

SEQ ID NO: 41098 - DNA, 20 bp, Artificial Sequence
  Description of Artificial Sequence: Synthetic oligonucleotide
  Target: SCN9A; (+) strand; PAM type: NRG; PAM sequence: GAG
gtcggaggttgcagtgagct

SEQ ID NO: 41099 - DNA, 20 bp, Artificial Sequence
  Description of Artificial Sequence: Synthetic oligonucleotide
  Target: SCN9A; (+) strand; PAM type: NRG; PAM sequence: CAG
gagatcgcgccactgcactc

SEQ ID NO: 41100 - DNA, 20 bp, Artificial Sequence
  Description of Artificial Sequence: Synthetic oligonucleotide
  Target: SCN9A; (+) strand; PAM type: NRG; PAM sequence: TGG
cgcgccactgcactccagcc

SEQ ID NO: 41101 - DNA, 20 bp, Artificial Sequence
  Description of Artificial Sequence: Synthetic oligonucleotide
  Target: SCN9A; (+) strand; PAM type: NRG; PAM sequence: CAG
actgcactccagcctggtga

SEQ ID NO: 41102 - DNA, 20 bp, Artificial Sequence
  Description of Artificial Sequence: Synthetic oligonucleotide
  Target: SCN9A; (+) strand; PAM type: NRG; PAM sequence: GAG
tgcactccagcctggtgaca

SEQ ID NO: 41103 - DNA, 20 bp, Artificial Sequence
  Description of Artificial Sequence: Synthetic oligonucleotide
  Target: SCN9A; (+) strand; PAM type: NRG; PAM sequence: GAG
ctccagcctggtgacagagt

SEQ ID NO: 41104 - DNA, 20 bp, Artificial Sequence
  Description of Artificial Sequence: Synthetic oligonucleotide
  Target: SCN9A; (+) strand; PAM type: NRG; PAM sequence: CAG
ttcaaaaacaaacaaacaaa

SEQ ID NO: 41105 - DNA, 20 bp, Artificial Sequence
  Description of Artificial Sequence: Synthetic oligonucleotide
  Target: SCN9A; (+) strand; PAM type: NRG; PAM sequence: AAG
acaaacaaacaaacagcaac

SEQ ID NO: 41106 - DNA, 20 bp, Artificial Sequence
  Description of Artificial Sequence: Synthetic oligonucleotide
  Target: SCN9A; (+) strand; PAM type: NRG; PAM sequence: AGG
caaacaaacaaacagcaaca

SEQ ID NO: 41107 - DNA, 20 bp, Artificial Sequence
  Description of Artificial Sequence: Synthetic oligonucleotide
  Target: SCN9A; (+) strand; PAM type: NRG; PAM sequence: CGG
caaacaaacagcaacaaggc

SEQ ID NO: 41108 - DNA, 20 bp, Artificial Sequence
  Description of Artificial Sequence: Synthetic oligonucleotide
  Target: SCN9A; (+) strand; PAM type: NRG; PAM sequence: GGG
aaacaaacagcaacaaggcc

SEQ ID NO: 41109 - DNA, 20 bp, Artificial Sequence
  Description of Artificial Sequence: Synthetic oligonucleotide
  Target: SCN9A; (+) strand; PAM type: NRG; PAM sequence: TGG
aacagcaacaaggccgggcg

SEQ ID NO: 41110 - DNA, 20 bp, Artificial Sequence
  Description of Artificial Sequence: Synthetic oligonucleotide
  Target: SCN9A; (+) strand; PAM type: NRG; PAM sequence: TGG
agcaacaaggccgggcgtgg

SEQ ID NO: 41111 - DNA, 20 bp, Artificial Sequence
  Description of Artificial Sequence: Synthetic oligonucleotide
  Target: SCN9A; (+) strand; PAM type: NRG; PAM sequence: CAG
gtggctcacgcctgtaatcc

SEQ ID NO: 41112 - DNA, 20 bp, Artificial Sequence
  Description of Artificial Sequence: Synthetic oligonucleotide
  Target: SCN9A; (+) strand; PAM type: NRG; PAM sequence: TGG
cgcctgtaatcccagcactt

SEQ ID NO: 41113 - DNA, 20 bp, Artificial Sequence
  Description of Artificial Sequence: Synthetic oligonucleotide
  Target: SCN9A; (+) strand; PAM type: NRG; PAM sequence: GGG
gcctgtaatcccagcacttt

SEQ ID NO: 41114 - DNA, 20 bp, Artificial Sequence
  Description of Artificial Sequence: Synthetic oligonucleotide
  Target: SCN9A; (+) strand; PAM type: NRG; PAM sequence: GAG
ctgtaatcccagcactttgg

SEQ ID NO: 41115 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccagcactttggg

SEQ ID NO: 41116 - DNA, 20 bp, Artificial Sequence
  Description of Artificial Sequence: Synthetic oligonucleotide
  Target: SCN9A; (+) strand; PAM type: NRG; PAM sequence: GAG
tcccagcactttgggaggcc

SEQ ID NO: 41117 - DNA, 20 bp, Artificial Sequence
  Description of Artificial Sequence: Synthetic oligonucleotide
  Target: SCN9A; (+) strand; PAM type: NRG; PAM sequence: CGG
agcactttgggaggccgaga

SEQ ID NO: 41118 - DNA, 20 bp, Artificial Sequence
  Description of Artificial Sequence: Synthetic oligonucleotide
  Target: SCN9A; (+) strand; PAM type: NRG; PAM sequence: GGG
gcactttgggaggccgagac

SEQ ID NO: 41119 - DNA, 20 bp, Artificial Sequence
  Description of Artificial Sequence: Synthetic oligonucleotide
  Target: SCN9A; (+) strand; PAM type: NRG; PAM sequence: CGG
ctttgggaggccgagacggg

SEQ ID NO: 41120 - DNA, 20 bp, Artificial Sequence
  Description of Artificial Sequence: Synthetic oligonucleotide
  Target: SCN9A; (+) strand; PAM type: NRG; PAM sequence: GAG
ggccgagacgggcggatcac

SEQ ID NO: 41121 - DNA, 20 bp, Artificial Sequence
  Description of Artificial Sequence: Synthetic oligonucleotide
  Target: SCN9A; (+) strand; PAM type: NRG; PAM sequence: AGG
gccgagacgggcggatcacg

SEQ ID NO: 41122 - DNA, 20 bp, Artificial Sequence
  Description of Artificial Sequence: Synthetic oligonucleotide
  Target: SCN9A; (+) strand; PAM type: NRG; PAM sequence: CAG
agacgggcggatcacgaggt

SEQ ID NO: 41123 - DNA, 20 bp, Artificial Sequence
  Description of Artificial Sequence: Synthetic oligonucleotide
  Target: SCN9A; (+) strand; PAM type: NRG; PAM sequence: AGG
gacgggcggatcacgaggtc

SEQ ID NO: 41124 - DNA, 20 bp, Artificial Sequence
  Description of Artificial Sequence: Synthetic oligonucleotide
  Target: SCN9A; (+) strand; PAM type: NRG; PAM sequence: GAG
cgggcggatcacgaggtcag

SEQ ID NO: 41125 - DNA, 20 bp, Artificial Sequence
  Description of Artificial Sequence: Synthetic oligonucleotide
  Target: SCN9A; (+) strand; PAM type: NRG; PAM sequence: GAG
gatcacgaggtcaggagatc

SEQ ID NO: 41126 - DNA, 20 bp, Artificial Sequence
  Description of Artificial Sequence: Synthetic oligonucleotide
  Target: SCN9A; (+) strand; PAM type: NRG; PAM sequence: TGG
tcaggagatcgagaccatcc

SEQ ID NO: 41127 - DNA, 20 bp, Artificial Sequence
  Description of Artificial Sequence: Synthetic oligonucleotide
  Target: SCN9A; (+) strand; PAM type: NRG; PAM sequence: CAG
atcgagaccatcctggctaa

SEQ ID NO: 41128 - DNA, 20 bp, Artificial Sequence
  Description of Artificial Sequence: Synthetic oligonucleotide
  Target: SCN9A; (+) strand; PAM type: NRG; PAM sequence: AGG
tcgagaccatcctggctaac

SEQ ID NO: 41129 - DNA, 20 bp, Artificial Sequence
  Description of Artificial Sequence: Synthetic oligonucleotide
  Target: SCN9A; (+) strand; PAM type: NRG; PAM sequence: GGG
cgagaccatcctggctaaca

SEQ ID NO: 41130 - DNA, 20 bp, Artificial Sequence
  Description of Artificial Sequence: Synthetic oligonucleotide
  Target: SCN9A; (+) strand; PAM type: NRG; PAM sequence: TAG
tctactaaaaatacaaaaat

SEQ ID NO: 41131 - DNA, 20 bp, Artificial Sequence
  Description of Artificial Sequence: Synthetic oligonucleotide
  Target: SCN9A; (+) strand; PAM type: NRG; PAM sequence: CGG
ctaaaaatacaaaaattagc

SEQ ID NO: 41132 - DNA, 20 bp, Artificial Sequence
  Description of Artificial Sequence: Synthetic oligonucleotide
  Target: SCN9A; (+) strand; PAM type: NRG; PAM sequence: GGG
taaaaatacaaaaattagcc

SEQ ID NO: 41133 - DNA, 20 bp, Artificial Sequence
  Description of Artificial Sequence: Synthetic oligonucleotide
  Target: SCN9A; (+) strand; PAM type: NRG; PAM sequence: TGG
atacaaaaattagccgggca

SEQ ID NO: 41134 - DNA, 20 bp, Artificial Sequence
  Description of Artificial Sequence: Synthetic oligonucleotide
  Target: SCN9A; (+) strand; PAM type: NRG; PAM sequence: TGG
caaaaattagccgggcatgg

SEQ ID NO: 41135 - DNA, 20 bp, Artificial Sequence
  Description of Artificial Sequence: Synthetic oligonucleotide
  Target: SCN9A; (+) strand; PAM type: NRG; PAM sequence: TAG
ggcatggtggcgcacgcctg

SEQ ID NO: 41136 - DNA, 20 bp, Artificial Sequence
  Description of Artificial Sequence: Synthetic oligonucleotide
  Target: SCN9A; (+) strand; PAM type: NRG; PAM sequence: CAG
gtggcgcacgcctgtagtcc

SEQ ID NO: 41137 - DNA, 20 bp, Artificial Sequence
  Description of Artificial Sequence: Synthetic oligonucleotide
  Target: SCN9A; (+) strand; PAM type: NRG; PAM sequence: CGG
cgcctgtagtcccagctaca

SEQ ID NO: 41138 - DNA, 20 bp, Artificial Sequence
  Description of Artificial Sequence: Synthetic oligonucleotide
  Target: SCN9A; (+) strand; PAM type: NRG; PAM sequence: GGG
gcctgtagtcccagctacac

SEQ ID NO: 41139 - DNA, 20 bp, Artificial Sequence
  Description of Artificial Sequence: Synthetic oligonucleotide
  Target: SCN9A; (+) strand; PAM type: NRG; PAM sequence: GAG
ctgtagtcccagctacacgg

SEQ ID NO: 41140 - DNA, 20 bp, Artificial Sequence
  Description of Artificial Sequence: Synthetic oligonucleotide
  Target: SCN9A; (+) strand; PAM type: NRG; PAM sequence: AGG
tgtagtcccagctacacggg

SEQ ID NO: 41141 - DNA, 20 bp, Artificial Sequence
  Description of Artificial Sequence: Synthetic oligonucleotide
  Target: SCN9A; (+) strand; PAM type: NRG; PAM sequence: GAG
tcccagctacacgggaggct

SEQ ID NO: 41142 - DNA, 20 bp, Artificial Sequence
  Description of Artificial Sequence: Synthetic oligonucleotide
  Target: SCN9A; (+) strand; PAM type: NRG; PAM sequence: AGG
cccagctacacgggaggctg

SEQ ID NO: 41143 - DNA, 20 bp, Artificial Sequence
  Description of Artificial Sequence: Synthetic oligonucleotide
  Target: SCN9A; (+) strand; PAM type: NRG; PAM sequence: CAG
agctacacgggaggctgagg

SEQ ID NO: 41144 - DNA, 20 bp, Artificial Sequence
  Description of Artificial Sequence: Synthetic oligonucleotide
  Target: SCN9A; (+) strand; PAM type: NRG; PAM sequence: AGG
gctacacgggaggctgaggc

SEQ ID NO: 41145 - DNA, 20 bp, Artificial Sequence
  Description of Artificial Sequence: Synthetic oligonucleotide
  Target: SCN9A; (+) strand; PAM type: NRG; PAM sequence: GAG
tacacgggaggctgaggcag

SEQ ID NO: 41146 - DNA, 20 bp, Artificial Sequence
  Description of Artificial Sequence: Synthetic oligonucleotide
  Target: SCN9A; (+) strand; PAM type: NRG; PAM sequence: TGG
gggaggctgaggcaggagaa

SEQ ID NO: 41147 - DNA, 20 bp, Artificial Sequence
  Description of Artificial Sequence: Synthetic oligonucleotide
  Target: SCN9A; (+) strand; PAM type: NRG; PAM sequence: CGG
gcaggagaatggcgtgaacc

SEQ ID NO: 41148 - DNA, 20 bp, Artificial Sequence
  Description of Artificial Sequence: Synthetic oligonucleotide
  Target: SCN9A; (+) strand; PAM type: NRG; PAM sequence: GGG
caggagaatggcgtgaaccc

SEQ ID NO: 41149 - DNA, 20 bp, Artificial Sequence
  Description of Artificial Sequence: Synthetic oligonucleotide
  Target: SCN9A; (+) strand; PAM type: NRG; PAM sequence: GAG
ggagaatggcgtgaacccgg

SEQ ID NO: 41150 - DNA, 20 bp, Artificial Sequence
  Description of Artificial Sequence: Synthetic oligonucleotide
  Target: SCN9A; (+) strand; PAM type: NRG; PAM sequence: AGG
gagaatggcgtgaacccggg

SEQ ID NO: 41151 - DNA, 20 bp, Artificial Sequence
  Description of Artificial Sequence: Synthetic oligonucleotide
  Target: SCN9A; (+) strand; PAM type: NRG; PAM sequence: CGG
aatggcgtgaacccgggagg

SEQ ID NO: 41152 - DNA, 20 bp, Artificial Sequence
  Description of Artificial Sequence: Synthetic oligonucleotide
  Target: SCN9A; (+) strand; PAM type: NRG; PAM sequence: GAG
tggcgtgaacccgggaggcg

SEQ ID NO: 41153 - DNA, 20 bp, Artificial Sequence
  Description of Artificial Sequence: Synthetic oligonucleotide
  Target: SCN9A; (+) strand; PAM type: NRG; PAM sequence: CAG
aacccgggaggcggagcttg

SEQ ID NO: 41154 - DNA, 20 bp, Artificial Sequence
  Description of Artificial Sequence: Synthetic oligonucleotide
  Target: SCN9A; (+) strand; PAM type: NRG; PAM sequence: GAG
cgggaggcggagcttgcagt

SEQ ID NO: 41155 - DNA, 20 bp, Artificial Sequence
  Description of Artificial Sequence: Synthetic oligonucleotide
  Target: SCN9A; (+) strand; PAM type: NRG; PAM sequence: GAG
ggcggagcttgcagtgagtc

SEQ ID NO: 41156 - DNA, 20 bp, Artificial Sequence
  Description of Artificial Sequence: Synthetic oligonucleotide
  Target: SCN9A; (+) strand; PAM type: NRG; PAM sequence: CAG
gagatcgcgccactgcactc

SEQ ID NO: 41157 - DNA, 20 bp, Artificial Sequence
  Description of Artificial Sequence: Synthetic oligonucleotide
  Target: SCN9A; (+) strand; PAM type: NRG; PAM sequence: TGG
cgcgccactgcactccagcc

SEQ ID NO: 41158 - DNA, 20 bp, Artificial Sequence
  Description of Artificial Sequence: Synthetic oligonucleotide
  Target: SCN9A; (+) strand; PAM type: NRG; PAM sequence: GGG
gcgccactgcactccagcct

SEQ ID NO: 41159 - DNA, 20 bp, Artificial Sequence
  Description of Artificial Sequence: Synthetic oligonucleotide
  Target: SCN9A; (+) strand; PAM type: NRG; PAM sequence: CAG
ctgcactccagcctgggcga

SEQ ID NO: 41160 - DNA, 20 bp, Artificial Sequence
  Description of Artificial Sequence: Synthetic oligonucleotide
  Target: SCN9A; (+) strand; PAM type: NRG; PAM sequence: GAG
gcactccagcctgggcgaca

SEQ ID NO: 41161 - DNA, 20 bp, Artificial Sequence
  Description of Artificial Sequence: Synthetic oligonucleotide
  Target: SCN9A; (+) strand; PAM type: NRG; PAM sequence: CAG
aaaaaaaaaaaaaaaaaaaa

SEQ ID NO: 41162 - DNA, 20 bp, Artificial Sequence
  Description of Artificial Sequence: Synthetic oligonucleotide
  Target: SCN9A; (+) strand; PAM type: NRG; PAM sequence: AAG
aacagcaacaaaaaaccgta

SEQ ID NO: 41163 - DNA, 20 bp, Artificial Sequence
  Description of Artificial Sequence: Synthetic oligonucleotide
  Target: SCN9A; (+) strand; PAM type: NRG; PAM sequence: GAG
cagcaacaaaaaaccgtaaa

SEQ ID NO: 41164 - DNA, 20 bp, Artificial Sequence
  Description of Artificial Sequence: Synthetic oligonucleotide
  Target: SCN9A; (+) strand; PAM type: NRG; PAM sequence: TAG
agatatcatttcatacctgc

SEQ ID NO: 41165 - DNA, 20 bp, Artificial Sequence
  Description of Artificial Sequence: Synthetic oligonucleotide
  Target: SCN9A; (+) strand; PAM type: NRG; PAM sequence: AGG
gatatcatttcatacctgct

SEQ ID NO: 41166 - DNA, 20 bp, Artificial Sequence
  Description of Artificial Sequence: Synthetic oligonucleotide
  Target: SCN9A; (+) strand; PAM type: NRG; PAM sequence: TGG
tcatttcatacctgctagga

SEQ ID NO: 41167 - DNA, 20 bp, Artificial Sequence
  Description of Artificial Sequence: Synthetic oligonucleotide
  Target: SCN9A; (+) strand; PAM type: NRG; PAM sequence: AAG
acaaaaaccacccaaatcaa

SEQ ID NO: 41168 - DNA, 20 bp, Artificial Sequence
  Description of Artificial Sequence: Synthetic oligonucleotide
  Target: SCN9A; (+) strand; PAM type: NRG; PAM sequence: TAG
ccacccaaatcaaaagataa

SEQ ID NO: 41169 - DNA, 20 bp, Artificial Sequence
  Description of Artificial Sequence: Synthetic oligonucleotide
  Target: SCN9A; (+) strand; PAM type: NRG; PAM sequence: AGG
cacccaaatcaaaagataat

SEQ ID NO: 41170 - DNA, 20 bp, Artificial Sequence
  Description of Artificial Sequence: Synthetic oligonucleotide
  Target: SCN9A; (+) strand; PAM type: NRG; PAM sequence: TGG
aatcaaaagataataggtgt

SEQ ID NO: 41171 - DNA, 20 bp, Artificial Sequence
  Description of Artificial Sequence: Synthetic oligonucleotide
  Target: SCN9A; (+) strand; PAM type: NRG; PAM sequence: AAG
aaaagataataggtgttggc

SEQ ID NO: 41172 - DNA, 20 bp, Artificial Sequence
  Description of Artificial Sequence: Synthetic oligonucleotide
  Target: SCN9A; (+) strand; PAM type: NRG; PAM sequence: AGG
aaagataataggtgttggca

SEQ ID NO: 41173 - DNA, 20 bp, Artificial Sequence
  Description of Artificial Sequence: Synthetic oligonucleotide
  Target: SCN9A; (+) strand; PAM type: NRG; PAM sequence: TGG
aataggtgttggcaaggata

SEQ ID NO: 41174 - DNA, 20 bp, Artificial Sequence
  Description of Artificial Sequence: Synthetic oligonucleotide
  Target: SCN9A; (+) strand; PAM type: NRG; PAM sequence: GAG
taggtgttggcaaggatatg

SEQ ID NO: 41175 - DNA, 20 bp, Artificial Sequence
  Description of Artificial Sequence: Synthetic oligonucleotide
  Target: SCN9A; (+) strand; PAM type: NRG; PAM sequence: TAG
tggcaaggatatggagaaat

SEQ ID NO: 41176 - DNA, 20 bp, Artificial Sequence
  Description of Artificial Sequence: Synthetic oligonucleotide
  Target: SCN9A; (+) strand; PAM type: NRG; PAM sequence: TGG
ttagaacctttgtacattgt

SEQ ID NO: 41177 - DNA, 20 bp, Artificial Sequence
  Description of Artificial Sequence: Synthetic oligonucleotide
  Target: SCN9A; (+) strand; PAM type: NRG; PAM sequence: TAG
tgttggaatgtaaaatgatg

SEQ ID NO: 41178 - DNA, 20 bp, Artificial Sequence
  Description of Artificial Sequence: Synthetic oligonucleotide
  Target: SCN9A; (+) strand; PAM type: NRG; PAM sequence: TAG
gtaaaatgatgtagctgcca

SEQ ID NO: 41179 - DNA, 20 bp, Artificial Sequence
  Description of Artificial Sequence: Synthetic oligonucleotide
  Target: SCN9A; (+) strand; PAM type: NRG; PAM sequence: CAG
gatgtagctgccatagaaaa

SEQ ID NO: 41180 - DNA, 20 bp, Artificial Sequence
  Description of Artificial Sequence: Synthetic oligonucleotide
  Target: SCN9A; (+) strand; PAM type: NRG; PAM sequence: AAG
tgccatagaaaacagtatga

SEQ ID NO: 41181 - DNA, 20 bp, Artificial Sequence
  Description of Artificial Sequence: Synthetic oligonucleotide
  Target: SCN9A; (+) strand; PAM type: NRG; PAM sequence: TAG
aatataactaccatttgatc

SEQ ID NO: 41182 - DNA, 20 bp, Artificial Sequence
  Description of Artificial Sequence: Synthetic oligonucleotide
  Target: SCN9A; (+) strand; PAM type: NRG; PAM sequence: GAG
gatctagcaatgccacatct

SEQ ID NO: 41183 - DNA, 20 bp, Artificial Sequence
  Description of Artificial Sequence: Synthetic oligonucleotide
  Target: SCN9A; (+) strand; PAM type: NRG; PAM sequence: CAG
atattttaaaaatttgaact

SEQ ID NO: 41184 - DNA, 20 bp, Artificial Sequence
  Description of Artificial Sequence: Synthetic oligonucleotide
  Target: SCN9A; (+) strand; PAM type: NRG; PAM sequence: AGG
tattttaaaaatttgaactc

SEQ ID NO: 41185 - DNA, 20 bp, Artificial Sequence
  Description of Artificial Sequence: Synthetic oligonucleotide
  Target: SCN9A; (+) strand; PAM type: NRG; PAM sequence: CAG
aaaatttgaactcaggatct

SEQ ID NO: 41186 - DNA, 20 bp, Artificial Sequence
  Description of Artificial Sequence: Synthetic oligonucleotide
  Target: SCN9A; (+) strand; PAM type: NRG; PAM sequence: GAG
aatttgaactcaggatctca

SEQ ID NO: 41187 - DNA, 20 bp, Artificial Sequence
  Description of Artificial Sequence: Synthetic oligonucleotide
  Target: SCN9A; (+) strand; PAM type: NRG; PAM sequence: CAG
ccttacttccatgttcactt

SEQ ID NO: 41188 - DNA, 20 bp, Artificial Sequence
  Description of Artificial Sequence: Synthetic oligonucleotide
  Target: SCN9A; (+) strand; PAM type: NRG; PAM sequence: TGG
aaatgtctattgatgaatga

SEQ ID NO: 41189 - DNA, 20 bp, Artificial Sequence
  Description of Artificial Sequence: Synthetic oligonucleotide
  Target: SCN9A; (+) strand; PAM type: NRG; PAM sequence: GGG
aatgtctattgatgaatgat

SEQ ID NO: 41190 - DNA, 20 bp, Artificial Sequence
  Description of Artificial Sequence: Synthetic oligonucleotide
  Target: SCN9A; (+) strand; PAM type: NRG; PAM sequence: TAG
tctattgatgaatgatggga

SEQ ID NO: 41191 - DNA, 20 bp, Artificial Sequence
  Description of Artificial Sequence: Synthetic oligonucleotide
  Target: SCN9A; (+) strand; PAM type: NRG; PAM sequence: TGG
gaatgatgggatagaaaatg

SEQ ID NO: 41192 - DNA, 20 bp, Artificial Sequence
  Description of Artificial Sequence: Synthetic oligonucleotide
  Target: SCN9A; (+) strand; PAM type: NRG; PAM sequence: CAG
acacacaaacacacactatt

SEQ ID NO: 41193 - DNA, 20 bp, Artificial Sequence
  Description of Artificial Sequence: Synthetic oligonucleotide
  Target: SCN9A; (+) strand; PAM type: NRG; PAM sequence: AAG
acacactattcagccttata

SEQ ID NO: 41194 - DNA, 20 bp, Artificial Sequence
  Description of Artificial Sequence: Synthetic oligonucleotide
  Target: SCN9A; (+) strand; PAM type: NRG; PAM sequence: AAG
cactattcagccttataaag

SEQ ID NO: 41195 - DNA, 20 bp, Artificial Sequence
  Description of Artificial Sequence: Synthetic oligonucleotide
  Target: SCN9A; (+) strand; PAM type: NRG; PAM sequence: AGG
actattcagccttataaaga

SEQ ID NO: 41196 - DNA, 20 bp, Artificial Sequence
  Description of Artificial Sequence: Synthetic oligonucleotide
  Target: SCN9A; (+) strand; PAM type: NRG; PAM sequence: CAG
gaaggaaatcctgccatatg

SEQ ID NO: 41197 - DNA, 20 bp, Artificial Sequence
  Description of Artificial Sequence: Synthetic oligonucleotide
  Target: SCN9A; (+) strand; PAM type: NRG; PAM sequence: TGG
tgcagcaacttgaatgaacc

SEQ ID NO: 41198 - DNA, 20 bp, Artificial Sequence
  Description of Artificial Sequence: Synthetic oligonucleotide
  Target: SCN9A; (+) strand; PAM type: NRG; PAM sequence: GAG
aacctggataaatttatgct

SEQ ID NO: 41199 - DNA, 20 bp, Artificial Sequence
  Description of Artificial Sequence: Synthetic oligonucleotide
  Target: SCN9A; (+) strand; PAM type: NRG; PAM sequence: AAG
ggataaatttatgctgagtg

SEQ ID NO: 41200 - DNA, 20 bp, Artificial Sequence
  Description of Artificial Sequence: Synthetic oligonucleotide
  Target: SCN9A; (+) strand; PAM type: NRG; PAM sequence: CAG
atttatgctgagtgaagtaa

SEQ ID NO: 41201 - DNA, 20 bp, Artificial Sequence
  Description of Artificial Sequence: Synthetic oligonucleotide
  Target: SCN9A; (+) strand; PAM type: NRG; PAM sequence: CGG
aatattgcataattccactt

SEQ ID NO: 41202 - DNA, 20 bp, Artificial Sequence
  Description of Artificial Sequence: Synthetic oligonucleotide
  Target: SCN9A; (+) strand; PAM type: NRG; PAM sequence: AAG
tgcataattccacttcggtg

SEQ ID NO: 41203 - DNA, 20 bp, Artificial Sequence
  Description of Artificial Sequence: Synthetic oligonucleotide
  Target: SCN9A; (+) strand; PAM type: NRG; PAM sequence: TGG
cttcggtgaagtaactaaaa

SEQ ID NO: 41204 - DNA, 20 bp, Artificial Sequence
  Description of Artificial Sequence: Synthetic oligonucleotide
  Target: SCN9A; (+) strand; PAM type: NRG; PAM sequence: TGG
aactaaaatggtcaaactca

SEQ ID NO: 41205 - DNA, 20 bp, Artificial Sequence
  Description of Artificial Sequence: Synthetic oligonucleotide
  Target: SCN9A; (+) strand; PAM type: NRG; PAM sequence: CAG
aatggtcaaactcatggaaa

SEQ ID NO: 41206 - DNA, 20 bp, Artificial Sequence
  Description of Artificial Sequence: Synthetic oligonucleotide
  Target: SCN9A; (+) strand; PAM type: NRG; PAM sequence: GAG
tggtcaaactcatggaaaca

SEQ ID NO: 41207 - DNA, 20 bp, Artificial Sequence
  Description of Artificial Sequence: Synthetic oligonucleotide
  Target: SCN9A; (+) strand; PAM type: NRG; PAM sequence: GAG
gtcaaactcatggaaacaga

SEQ ID NO: 41208 - DNA, 20 bp, Artificial Sequence
  Description of Artificial Sequence: Synthetic oligonucleotide
  Target: SCN9A; (+) strand; PAM type: NRG; PAM sequence: AAG
aaactcatggaaacagagag

SEQ ID NO: 41209 - DNA, 20 bp, Artificial Sequence
  Description of Artificial Sequence: Synthetic oligonucleotide
  Target: SCN9A; (+) strand; PAM type: NRG; PAM sequence: TGG
catggaaacagagagaagaa

SEQ ID NO: 41210 - DNA, 20 bp, Artificial Sequence
  Description of Artificial Sequence: Synthetic oligonucleotide
  Target: SCN9A; (+) strand; PAM type: NRG; PAM sequence: CAG
gagagaagaatggtgattgc

SEQ ID NO: 41211 - DNA, 20 bp, Artificial Sequence
  Description of Artificial Sequence: Synthetic oligonucleotide
  Target: SCN9A; (+) strand; PAM type: NRG; PAM sequence: AGG
agagaagaatggtgattgcc

SEQ ID NO: 41212 - DNA, 20 bp, Artificial Sequence
  Description of Artificial Sequence: Synthetic oligonucleotide
  Target: SCN9A; (+) strand; PAM type: NRG; PAM sequence: GGG
gagaagaatggtgattgcca

SEQ ID NO: 41213 - DNA, 20 bp, Artificial Sequence
  Description of Artificial Sequence: Synthetic oligonucleotide
  Target: SCN9A; (+) strand; PAM type: NRG; PAM sequence: AAG
tggtgattgccagggcatga

SEQ ID NO: 41214 - DNA, 20 bp, Artificial Sequence
  Description of Artificial Sequence: Synthetic oligonucleotide
  Target: SCN9A; (+) strand; PAM type: NRG; PAM sequence: AGG
ggtgattgccagggcatgaa

SEQ ID NO: 41215 - DNA, 20 bp, Artificial Sequence
  Description of Artificial Sequence: Synthetic oligonucleotide
  Target: SCN9A; (+) strand; PAM type: NRG; PAM sequence: TGG
attgccagggcatgaaagga

SEQ ID NO: 41216 - DNA, 20 bp, Artificial Sequence
  Description of Artificial Sequence: Synthetic oligonucleotide
  Target: SCN9A; (+) strand; PAM type: NRG; PAM sequence: GGG
ttgccagggcatgaaaggat

SEQ ID NO: 41217 - DNA, 20 bp, Artificial Sequence
  Description of Artificial Sequence: Synthetic oligonucleotide
  Target: SCN9A; (+) strand; PAM type: NRG; PAM sequence: GAG
gccagggcatgaaaggatgg

SEQ ID NO: 41218 - DNA, 20 bp, Artificial Sequence
  Description of Artificial Sequence: Synthetic oligonucleotide
  Target: SCN9A; (+) strand; PAM type: NRG; PAM sequence: TGG
ggcatgaaaggatgggagaa

SEQ ID NO: 41219 - DNA, 20 bp, Artificial Sequence
  Description of Artificial Sequence: Synthetic oligonucleotide
  Target: SCN9A; (+) strand; PAM type: NRG; PAM sequence: GAG
catgaaaggatgggagaatg

SEQ ID NO: 41220 - DNA, 20 bp, Artificial Sequence
  Description of Artificial Sequence: Synthetic oligonucleotide
  Target: SCN9A; (+) strand; PAM type: NRG; PAM sequence: TGG
aatggagaattgctattcaa

SEQ ID NO: 41221 - DNA, 20 bp, Artificial Sequence
  Description of Artificial Sequence: Synthetic oligonucleotide
  Target: SCN9A; (+) strand; PAM type: NRG; PAM sequence: GGG
atggagaattgctattcaat

SEQ ID NO: 41222 - DNA, 20 bp, Artificial Sequence
  Description of Artificial Sequence: Synthetic oligonucleotide
  Target: SCN9A; (+) strand; PAM type: NRG; PAM sequence: AAG
attgctattcaatgggaata

SEQ ID NO: 41223 - DNA, 20 bp, Artificial Sequence
  Description of Artificial Sequence: Synthetic oligonucleotide
  Target: SCN9A; (+) strand; PAM type: NRG; PAM sequence: AAG
gaataaagtttcaattatgc

SEQ ID NO: 41224 - DNA, 20 bp, Artificial Sequence
  Description of Artificial Sequence: Synthetic oligonucleotide
  Target: SCN9A; (+) strand; PAM type: NRG; PAM sequence: AAG
ttcaattatgcaagatgaat

SEQ ID NO: 41225 - DNA, 20 bp, Artificial Sequence
  Description of Artificial Sequence: Synthetic oligonucleotide
  Target: SCN9A; (+) strand; PAM type: NRG; PAM sequence: TAG
tatgcaagatgaataagttc

SEQ ID NO: 41226 - DNA, 20 bp, Artificial Sequence
  Description of Artificial Sequence: Synthetic oligonucleotide
  Target: SCN9A; (+) strand; PAM type: NRG; PAM sequence: AGG
atgcaagatgaataagttct

SEQ ID NO: 41227 - DNA, 20 bp, Artificial Sequence
  Description of Artificial Sequence: Synthetic oligonucleotide
  Target: SCN9A; (+) strand; PAM type: NRG; PAM sequence: GGG
tgcaagatgaataagttcta

SEQ ID NO: 41228 - DNA, 20 bp, Artificial Sequence
  Description of Artificial Sequence: Synthetic oligonucleotide
  Target: SCN9A; (+) strand; PAM type: NRG; PAM sequence: TAG
taagttctagggacttcctg

SEQ ID NO: 41229 - DNA, 20 bp, Artificial Sequence
  Description of Artificial Sequence: Synthetic oligonucleotide
  Target: SCN9A; (+) strand; PAM type: NRG; PAM sequence: TAG
cctgtagtacttcgtaacta

SEQ ID NO: 41230 - DNA, 20 bp, Artificial Sequence
  Description of Artificial Sequence: Synthetic oligonucleotide
  Target: SCN9A; (+) strand; PAM type: NRG; PAM sequence: TAG
actatagttaacaatatata

SEQ ID NO: 41231 - DNA, 20 bp, Artificial Sequence
  Description of Artificial Sequence: Synthetic oligonucleotide
  Target: SCN9A; (+) strand; PAM type: NRG; PAM sequence: AAG
gtatacttaaaaattttgtt

SEQ ID NO: 41232 - DNA, 20 bp, Artificial Sequence
  Description of Artificial Sequence: Synthetic oligonucleotide
  Target: SCN9A; (+) strand; PAM type: NRG; PAM sequence: CAG
tacttaaaaattttgttaag

SEQ ID NO: 41233 - DNA, 20 bp, Artificial Sequence
  Description of Artificial Sequence: Synthetic oligonucleotide
  Target: SCN9A; (+) strand; PAM type: NRG; PAM sequence: AGG
acttaaaaattttgttaagc

SEQ ID NO: 41234 - DNA, 20 bp, Artificial Sequence
  Description of Artificial Sequence: Synthetic oligonucleotide
  Target: SCN9A; (+) strand; PAM type: NRG; PAM sequence: TAG
taaaaattttgttaagcagg

SEQ ID NO: 41235 - DNA, 20 bp, Artificial Sequence
  Description of Artificial Sequence: Synthetic oligonucleotide
  Target: SCN9A; (+) strand; PAM type: NRG; PAM sequence: AAG
aagcaggtagatctcatatt

SEQ ID NO: 41236 - DNA, 20 bp, Artificial Sequence
  Description of Artificial Sequence: Synthetic oligonucleotide
  Target: SCN9A; (+) strand; PAM type: NRG; PAM sequence: TAG
cttaccacaataattaaaat

SEQ ID NO: 41237 - DNA, 20 bp, Artificial Sequence
  Description of Artificial Sequence: Synthetic oligonucleotide
  Target: SCN9A; (+) strand; PAM type: NRG; PAM sequence: AGG
ttaccacaataattaaaatt

SEQ ID NO: 41238 - DNA, 20 bp, Artificial Sequence
  Description of Artificial Sequence: Synthetic oligonucleotide
  Target: SCN9A; (+) strand; PAM type: NRG; PAM sequence: AAG
cacaataattaaaattagga

SEQ ID NO: 41239 - DNA, 20 bp, Artificial Sequence
  Description of Artificial Sequence: Synthetic oligonucleotide
  Target: SCN9A; (+) strand; PAM type: NRG; PAM sequence: AGG
acaataattaaaattaggaa

SEQ ID NO: 41240 - DNA, 20 bp, Artificial Sequence
  Description of Artificial Sequence: Synthetic oligonucleotide
  Target: SCN9A; (+) strand; PAM type: NRG; PAM sequence: AAG
aattaaaattaggaaaggca

SEQ ID NO: 41241 - DNA, 20 bp, Artificial Sequence
  Description of Artificial Sequence: Synthetic oligonucleotide
  Target: SCN9A; (+) strand; PAM type: NRG; PAM sequence: AAG
aaattaggaaaggcaaagaa

SEQ ID NO: 41242 - DNA, 20 bp, Artificial Sequence
  Description of Artificial Sequence: Synthetic oligonucleotide
  Target: SCN9A; (+) strand; PAM type: NRG; PAM sequence: AGG
aattaggaaaggcaaagaaa

SEQ ID NO: 41243 - DNA, 20 bp, Artificial Sequence
  Description of Artificial Sequence: Synthetic oligonucleotide
  Target: SCN9A; (+) strand; PAM type: NRG; PAM sequence: TGG
tttcatttgttttttttctt

SEQ ID NO: 41244 - DNA, 20 bp, Artificial Sequence
  Description of Artificial Sequence: Synthetic oligonucleotide
  Target: SCN9A; (+) strand; PAM type: NRG; PAM sequence: GAG
tttttttctttggaataaat

SEQ ID NO: 41245 - DNA, 20 bp, Artificial Sequence
  Description of Artificial Sequence: Synthetic oligonucleotide
  Target: SCN9A; (+) strand; PAM type: NRG; PAM sequence: AAG
gaataaatgagttcatcaca

SEQ ID NO: 41246 - DNA, 20 bp, Artificial Sequence
  Description of Artificial Sequence: Synthetic oligonucleotide
  Target: SCN9A; (+) strand; PAM type: NRG; PAM sequence: TAG
atctactacgtacttctaca

SEQ ID NO: 41247 - DNA, 20 bp, Artificial Sequence
  Description of Artificial Sequence: Synthetic oligonucleotide
  Target: SCN9A; (+) strand; PAM type: NRG; PAM sequence: AAG
tagcatgtgttaactaattg

SEQ ID NO: 41248 - DNA, 20 bp, Artificial Sequence
  Description of Artificial Sequence: Synthetic oligonucleotide
  Target: SCN9A; (+) strand; PAM type: NRG; PAM sequence: TGG
gtgttaactaattgaagtgt

SEQ ID NO: 41249 - DNA, 20 bp, Artificial Sequence
  Description of Artificial Sequence: Synthetic oligonucleotide
  Target: SCN9A; (+) strand; PAM type: NRG; PAM sequence: CAG
aagtgttggtcatgtttttt

SEQ ID NO: 41250 - DNA, 20 bp, Artificial Sequence
  Description of Artificial Sequence: Synthetic oligonucleotide
  Target: SCN9A; (+) strand; PAM type: NRG; PAM sequence: AGG
agtgttggtcatgttttttc

SEQ ID NO: 41251 - DNA, 20 bp, Artificial Sequence
  Description of Artificial Sequence: Synthetic oligonucleotide
  Target: SCN9A; (+) strand; PAM type: NRG; PAM sequence: GGG
gtgttggtcatgttttttca

SEQ ID NO: 41252 - DNA, 20 bp, Artificial Sequence
  Description of Artificial Sequence: Synthetic oligonucleotide
  Target: SCN9A; (+) strand; PAM type: NRG; PAM sequence: AAG
ttggtcatgttttttcaggg

SEQ ID NO: 41253 - DNA, 20 bp, Artificial Sequence
  Description of Artificial Sequence: Synthetic oligonucleotide
  Target: SCN9A; (+) strand; PAM type: NRG; PAM sequence: GAG
ggtcatgttttttcagggaa

SEQ ID NO: 41254 - DNA, 20 bp, Artificial Sequence
  Description of Artificial Sequence: Synthetic oligonucleotide
  Target: SCN9A; (+) strand; PAM type: NRG; PAM sequence: TGG
catgttttttcagggaagag

SEQ ID NO: 41255 - DNA, 20 bp, Artificial Sequence
  Description of Artificial Sequence: Synthetic oligonucleotide
  Target: SCN9A; (+) strand; PAM type: NRG; PAM sequence: AAG
ttttttcagggaagagtgga

SEQ ID NO: 41256 - DNA, 20 bp, Artificial Sequence
  Description of Artificial Sequence: Synthetic oligonucleotide
  Target: SCN9A; (+) strand; PAM type: NRG; PAM sequence: CAG
gaaagaaattctaaatcatt

SEQ ID NO: 41257 - DNA, 20 bp, Artificial Sequence
  Description of Artificial Sequence: Synthetic oligonucleotide
  Target: SCN9A; (+) strand; PAM type: NRG; PAM sequence: AAG
aaattctaaatcattcagaa

SEQ ID NO: 41258 - DNA, 20 bp, Artificial Sequence
  Description of Artificial Sequence: Synthetic oligonucleotide
  Target: SCN9A; (+) strand; PAM type: NRG; PAM sequence: AGG
aattctaaatcattcagaaa

SEQ ID NO: 41259 - DNA, 20 bp, Artificial Sequence
  Description of Artificial Sequence: Synthetic oligonucleotide
  Target: SCN9A; (+) strand; PAM type: NRG; PAM sequence: CAG
ctaaatcattcagaaaaggt

SEQ ID NO: 41260 - DNA, 20 bp, Artificial Sequence
  Description of Artificial Sequence: Synthetic oligonucleotide
  Target: SCN9A; (+) strand; PAM type: NRG; PAM sequence: AAG
cagaaaaggtcagaaaataa

SEQ ID NO: 41261 - DNA, 20 bp, Artificial Sequence
  Description of Artificial Sequence: Synthetic oligonucleotide
  Target: SCN9A; (+) strand; PAM type: NRG; PAM sequence: TAG
cagaaaataaaagctatact

SEQ ID NO: 41262 - DNA, 20 bp, Artificial Sequence
  Description of Artificial Sequence: Synthetic oligonucleotide
  Target: SCN9A; (+) strand; PAM type: NRG; PAM sequence: AAG
aaaagctatacttagattgc

SEQ ID NO: 41263 - DNA, 20 bp, Artificial Sequence
  Description of Artificial Sequence: Synthetic oligonucleotide
  Target: SCN9A; (+) strand; PAM type: NRG; PAM sequence: TGG
tagattgcaagatgaaatac

SEQ ID NO: 41264 - DNA, 20 bp, Artificial Sequence
  Description of Artificial Sequence: Synthetic oligonucleotide
  Target: SCN9A; (+) strand; PAM type: NRG; PAM sequence: AAG
attgcaagatgaaatactgg

SEQ ID NO: 41265 - DNA, 20 bp, Artificial Sequence
  Description of Artificial Sequence: Synthetic oligonucleotide
  Target: SCN9A; (+) strand; PAM type: NRG; PAM sequence: TAG
atgaaatactggaagaatga

SEQ ID NO: 41266 - DNA, 20 bp, Artificial Sequence
  Description of Artificial Sequence: Synthetic oligonucleotide
  Target: SCN9A; (+) strand; PAM type: NRG; PAM sequence: AGG
tgaaatactggaagaatgat

SEQ ID NO: 41267 - DNA, 20 bp, Artificial Sequence
  Description of Artificial Sequence: Synthetic oligonucleotide
  Target: SCN9A; (+) strand; PAM type: NRG; PAM sequence: GGG
gaaatactggaagaatgata

SEQ ID NO: 41268 - DNA, 20 bp, Artificial Sequence
  Description of Artificial Sequence: Synthetic oligonucleotide
  Target: SCN9A; (+) strand; PAM type: NRG; PAM sequence: GGG
aaatactggaagaatgatag

SEQ ID NO: 41269 - DNA, 20 bp, Artificial Sequence
  Description of Artificial Sequence: Synthetic oligonucleotide
  Target: SCN9A; (+) strand; PAM type: NRG; PAM sequence: GAG
ggaagaatgataggggatat

SEQ ID NO: 41270 - DNA, 20 bp, Artificial Sequence
  Description of Artificial Sequence: Synthetic oligonucleotide
  Target: SCN9A; (+) strand; PAM type: NRG; PAM sequence: CAG
agtttttgatgcttctaaat

SEQ ID NO: 41271 - DNA, 20 bp, Artificial Sequence
  Description of Artificial Sequence: Synthetic oligonucleotide
  Target: SCN9A; (+) strand; PAM type: NRG; PAM sequence: TGG
cagtaactgtttcctgactt

SEQ ID NO: 41272 - DNA, 20 bp, Artificial Sequence
  Description of Artificial Sequence: Synthetic oligonucleotide
  Target: SCN9A; (+) strand; PAM type: NRG; PAM sequence: TGG
taactgtttcctgactttgg

SEQ ID NO: 41273 - DNA, 20 bp, Artificial Sequence
  Description of Artificial Sequence: Synthetic oligonucleotide
  Target: SCN9A; (+) strand; PAM type: NRG; PAM sequence: TAG
tttcctgactttggtggtga

SEQ ID NO: 41274 - DNA, 20 bp, Artificial Sequence
  Description of Artificial Sequence: Synthetic oligonucleotide
  Target: SCN9A; (+) strand; PAM type: NRG; PAM sequence: CAG
ccatcctattttacttcctg

SEQ ID NO: 41275 - DNA, 20 bp, Artificial Sequence
  Description of Artificial Sequence: Synthetic oligonucleotide
  Target: SCN9A; (+) strand; PAM type: NRG; PAM sequence: TAG
tcctattttacttcctgcag

SEQ ID NO: 41276 - DNA, 20 bp, Artificial Sequence
  Description of Artificial Sequence: Synthetic oligonucleotide
  Target: SCN9A; (+) strand; PAM type: NRG; PAM sequence: AAG
tcctgcagtagaaatgttgt

SEQ ID NO: 41277 - DNA, 20 bp, Artificial Sequence
  Description of Artificial Sequence: Synthetic oligonucleotide
  Target: SCN9A; (+) strand; PAM type: NRG; PAM sequence: AAG
gttgtaagaataacattaac

SEQ ID NO: 41278 - DNA, 20 bp, Artificial Sequence
  Description of Artificial Sequence: Synthetic oligonucleotide
  Target: SCN9A; (+) strand; PAM type: NRG; PAM sequence: CAG
gtaagaataacattaacaag

SEQ ID NO: 41279 - DNA, 20 bp, Artificial Sequence
  Description of Artificial Sequence: Synthetic oligonucleotide
  Target: SCN9A; (+) strand; PAM type: NRG; PAM sequence: AGG
taagaataacattaacaagc

SEQ ID NO: 41280 - DNA, 20 bp, Artificial Sequence
  Description of Artificial Sequence: Synthetic oligonucleotide
  Target: SCN9A; (+) strand; PAM type: NRG; PAM sequence: AAG
gaataacattaacaagcagg

SEQ ID NO: 41281 - DNA, 20 bp, Artificial Sequence
  Description of Artificial Sequence: Synthetic oligonucleotide
  Target: SCN9A; (+) strand; PAM type: NRG; PAM sequence: AAG
attaacaagcaggaagatta

SEQ ID NO: 41282 - DNA, 20 bp, Artificial Sequence
  Description of Artificial Sequence: Synthetic oligonucleotide
  Target: SCN9A; (+) strand; PAM type: NRG; PAM sequence: TGG
gcaggaagattaaagtcaat

SEQ ID NO: 41283 - DNA, 20 bp, Artificial Sequence
  Description of Artificial Sequence: Synthetic oligonucleotide
  Target: SCN9A; (+) strand; PAM type: NRG; PAM sequence: TGG
gattaaagtcaattggatgt

SEQ ID NO: 41284 - DNA, 20 bp, Artificial Sequence
  Description of Artificial Sequence: Synthetic oligonucleotide
  Target: SCN9A; (+) strand; PAM type: NRG; PAM sequence: TAG
tatgctcatactgctctttc

SEQ ID NO: 41285 - DNA, 20 bp, Artificial Sequence
  Description of Artificial Sequence: Synthetic oligonucleotide
  Target: SCN9A; (+) strand; PAM type: NRG; PAM sequence: CAG
cacgcttaatttatcctatg

SEQ ID NO: 41286 - DNA, 20 bp, Artificial Sequence
  Description of Artificial Sequence: Synthetic oligonucleotide
  Target: SCN9A; (+) strand; PAM type: NRG; PAM sequence: AGG
acgcttaatttatcctatgc

SEQ ID NO: 41287 - DNA, 20 bp, Artificial Sequence
  Description of Artificial Sequence: Synthetic oligonucleotide
  Target: SCN9A; (+) strand; PAM type: NRG; PAM sequence: GGG
cgcttaatttatcctatgca

SEQ ID NO: 41288 - DNA, 20 bp, Artificial Sequence
  Description of Artificial Sequence: Synthetic oligonucleotide
  Target: SCN9A; (+) strand; PAM type: NRG; PAM sequence: AAG
ttaatttatcctatgcaggg

SEQ ID NO: 41289 - DNA, 20 bp, Artificial Sequence
  Description of Artificial Sequence: Synthetic oligonucleotide
  Target: SCN9A; (+) strand; PAM type: NRG; PAM sequence: GAG
tatcctatgcagggaagact

SEQ ID NO: 41290 - DNA, 20 bp, Artificial Sequence
  Description of Artificial Sequence: Synthetic oligonucleotide
  Target: SCN9A; (+) strand; PAM type: NRG; PAM sequence: AGG
atcctatgcagggaagactg

SEQ ID NO: 41291 - DNA, 20 bp, Artificial Sequence
  Description of Artificial Sequence: Synthetic oligonucleotide
  Target: SCN9A; (+) strand; PAM type: NRG; PAM sequence: AAG
tgtatgtatatataatgctt

SEQ ID NO: 41292 - DNA, 20 bp, Artificial Sequence
  Description of Artificial Sequence: Synthetic oligonucleotide
  Target: SCN9A; (+) strand; PAM type: NRG; PAM sequence: GAG
gtatatataatgcttaagtt

SEQ ID NO: 41293 - DNA, 20 bp, Artificial Sequence
  Description of Artificial Sequence: Synthetic oligonucleotide
  Target: SCN9A; (+) strand; PAM type: NRG; PAM sequence: CAG
gagaaaaataaattgaaaat

SEQ ID NO: 41294 - DNA, 20 bp, Artificial Sequence
  Description of Artificial Sequence: Synthetic oligonucleotide
  Target: SCN9A; (+) strand; PAM type: NRG; PAM sequence: TGG
tacactttataaatgtaaaa

SEQ ID NO: 41295 - DNA, 20 bp, Artificial Sequence
  Description of Artificial Sequence: Synthetic oligonucleotide
  Target: SCN9A; (+) strand; PAM type: NRG; PAM sequence: CAG
acatctgtatttgtaaatgt

SEQ ID NO: 41296 - DNA, 20 bp, Artificial Sequence
  Description of Artificial Sequence: Synthetic oligonucleotide
  Target: SCN9A; (+) strand; PAM type: NRG; PAM sequence: AGG
catctgtatttgtaaatgtc

SEQ ID NO: 41297 - DNA, 20 bp, Artificial Sequence
  Description of Artificial Sequence: Synthetic oligonucleotide
  Target: SCN9A; (+) strand; PAM type: NRG; PAM sequence: TAG
aatttttgtctacttgcaaa

SEQ ID NO: 41298 - DNA, 20 bp, Artificial Sequence
  Description of Artificial Sequence: Synthetic oligonucleotide
  Target: SCN9A; (+) strand; PAM type: NRG; PAM sequence: TGG
catgcacactaatgacattt

SEQ ID NO: 41299 - DNA, 20 bp, Artificial Sequence
  Description of Artificial Sequence: Synthetic oligonucleotide
  Target: SCN9A; (+) strand; PAM type: NRG; PAM sequence: TAG
tacatgtacatctgtcttct

SEQ ID NO: 41300 - DNA, 20 bp, Artificial Sequence
  Description of Artificial Sequence: Synthetic oligonucleotide
  Target: SCN9A; (+) strand; PAM type: NRG; PAM sequence: AAG
catctgtcttcttagatgct

SEQ ID NO: 41301 - DNA, 20 bp, Artificial Sequence
  Description of Artificial Sequence: Synthetic oligonucleotide
  Target: SCN9A; (+) strand; PAM type: NRG; PAM sequence: CAG
tgtcttcttagatgctaagc

SEQ ID NO: 41302 - DNA, 20 bp, Artificial Sequence
  Description of Artificial Sequence: Synthetic oligonucleotide
  Target: SCN9A; (+) strand; PAM type: NRG; PAM sequence: TAG
tcttttgtaattctaccatt

SEQ ID NO: 41303 - DNA, 20 bp, Artificial Sequence
  Description of Artificial Sequence: Synthetic oligonucleotide
  Target: SCN9A; (+) strand; PAM type: NRG; PAM sequence: AAG
attctaccatttagtctcca

SEQ ID NO: 41304 - DNA, 20 bp, Artificial Sequence
  Description of Artificial Sequence: Synthetic oligonucleotide
  Target: SCN9A; (+) strand; PAM type: NRG; PAM sequence: TAG
tccaaagatctctttttgta

SEQ ID NO: 41305 - DNA, 20 bp, Artificial Sequence
  Description of Artificial Sequence: Synthetic oligonucleotide
  Target: SCN9A; (+) strand; PAM type: NRG; PAM sequence: AGG
ccaaagatctctttttgtat

SEQ ID NO: 41306 - DNA, 20 bp, Artificial Sequence
  Description of Artificial Sequence: Synthetic oligonucleotide
  Target: SCN9A; (+) strand; PAM type: NRG; PAM sequence: TGG
aagatctctttttgtatagg

SEQ ID NO: 41307 - DNA, 20 bp, Artificial Sequence
  Description of Artificial Sequence: Synthetic oligonucleotide
  Target: SCN9A; (+) strand; PAM type: NRG; PAM sequence: CAG
tgtataggtggtaccacaac

SEQ ID NO: 41308 - DNA, 20 bp, Artificial Sequence
  Description of Artificial Sequence: Synthetic oligonucleotide
  Target: SCN9A; (+) strand; PAM type: NRG; PAM sequence: GAG
tataggtggtaccacaacca

SEQ ID NO: 41309 - DNA, 20 bp, Artificial Sequence
  Description of Artificial Sequence: Synthetic oligonucleotide
  Target: SCN9A; (+) strand; PAM type: NRG; PAM sequence: CAG
gtaccacaaccagagtatct

SEQ ID NO: 41310 - DNA, 20 bp, Artificial Sequence
  Description of Artificial Sequence: Synthetic oligonucleotide
  Target: SCN9A; (+) strand; PAM type: NRG; PAM sequence: TAG
cacaaccagagtatctcagt

SEQ ID NO: 41311 - DNA, 20 bp, Artificial Sequence
  Description of Artificial Sequence: Synthetic oligonucleotide
  Target: SCN9A; (+) strand; PAM type: NRG; PAM sequence: AAG
gagtatctcagttagttgac

SEQ ID NO: 41312 - DNA, 20 bp, Artificial Sequence
  Description of Artificial Sequence: Synthetic oligonucleotide
  Target: SCN9A; (+) strand; PAM type: NRG; PAM sequence: CAG
agttagttgacaagaaactc

SEQ ID NO: 41313 - DNA, 20 bp, Artificial Sequence
  Description of Artificial Sequence: Synthetic oligonucleotide
  Target: SCN9A; (+) strand; PAM type: NRG; PAM sequence: TAG
ttgacaagaaactccagaat

SEQ ID NO: 41314 - DNA, 20 bp, Artificial Sequence
  Description of Artificial Sequence: Synthetic oligonucleotide
  Target: SCN9A; (+) strand; PAM type: NRG; PAM sequence: AAG
ctttatctcttgcaaatcac

SEQ ID NO: 41315 - DNA, 20 bp, Artificial Sequence
  Description of Artificial Sequence: Synthetic oligonucleotide
  Target: SCN9A; (+) strand; PAM type: NRG; PAM sequence: TAG
gcaaatcacaagcaatactg

SEQ ID NO: 41316 - DNA, 20 bp, Artificial Sequence
  Description of Artificial Sequence: Synthetic oligonucleotide
  Target: SCN9A; (+) strand; PAM type: NRG; PAM sequence: TGG
taccctctaaaatgttttaa

SEQ ID NO: 41317 - DNA, 20 bp, Artificial Sequence
  Description of Artificial Sequence: Synthetic oligonucleotide
  Target: SCN9A; (+) strand; PAM type: NRG; PAM sequence: CAG
tcctattctccattgacaca

SEQ ID NO: 41318 - DNA, 20 bp, Artificial Sequence
  Description of Artificial Sequence: Synthetic oligonucleotide
  Target: SCN9A; (+) strand; PAM type: NRG; PAM sequence: AGG
cctattctccattgacacac

SEQ ID NO: 41319 - DNA, 20 bp, Artificial Sequence
  Description of Artificial Sequence: Synthetic oligonucleotide
  Target: SCN9A; (+) strand; PAM type: NRG; PAM sequence: TGG
attgacacacaggactaatt

SEQ ID NO: 41320 - DNA, 20 bp, Artificial Sequence
  Description of Artificial Sequence: Synthetic oligonucleotide
  Target: SCN9A; (+) strand; PAM type: NRG; PAM sequence: GAG
tgacacacaggactaatttg

SEQ ID NO: 41321 - DNA, 20 bp, Artificial Sequence
  Description of Artificial Sequence: Synthetic oligonucleotide
  Target: SCN9A; (+) strand; PAM type: NRG; PAM sequence: TAG
acaggactaatttggagact

SEQ ID NO: 41322 - DNA, 20 bp, Artificial Sequence
  Description of Artificial Sequence: Synthetic oligonucleotide
  Target: SCN9A; (+) strand; PAM type: NRG; PAM sequence: TGG
actaatttggagacttagtg

SEQ ID NO: 41323 - DNA, 20 bp, Artificial Sequence
  Description of Artificial Sequence: Synthetic oligonucleotide
  Target: SCN9A; (+) strand; PAM type: NRG; PAM sequence: CAG
tttggagacttagtgtggtc

SEQ ID NO: 41324 - DNA, 20 bp, Artificial Sequence
  Description of Artificial Sequence: Synthetic oligonucleotide
  Target: SCN9A; (+) strand; PAM type: NRG; PAM sequence: AGG
ttggagacttagtgtggtcc

SEQ ID NO: 41325 - DNA, 20 bp, Artificial Sequence
  Description of Artificial Sequence: Synthetic oligonucleotide
  Target: SCN9A; (+) strand; PAM type: NRG; PAM sequence: TGG
gagacttagtgtggtccagg

SEQ ID NO: 41326 - DNA, 20 bp, Artificial Sequence
  Description of Artificial Sequence: Synthetic oligonucleotide
  Target: SCN9A; (+) strand; PAM type: NRG; PAM sequence: CAG
acttagtgtggtccaggtgg

SEQ ID NO: 41327 - DNA, 20 bp, Artificial Sequence
  Description of Artificial Sequence: Synthetic oligonucleotide
  Target: SCN9A; (+) strand; PAM type: NRG; PAM sequence: AGG
cttagtgtggtccaggtggc

SEQ ID NO: 41328 - DNA, 20 bp, Artificial Sequence
  Description of Artificial Sequence: Synthetic oligonucleotide
  Target: SCN9A; (+) strand; PAM type: NRG; PAM sequence: AAG
tgtggtccaggtggcaggtc

SEQ ID NO: 41329 - DNA, 20 bp, Artificial Sequence
  Description of Artificial Sequence: Synthetic oligonucleotide
  Target: SCN9A; (+) strand; PAM type: NRG; PAM sequence: CAG
ggtccaggtggcaggtcaag

SEQ ID NO: 41330 - DNA, 20 bp, Artificial Sequence
  Description of Artificial Sequence: Synthetic oligonucleotide
  Target: SCN9A; (+) strand; PAM type: NRG; PAM sequence: AGG
gtccaggtggcaggtcaagc

SEQ ID NO: 41331 - DNA, 20 bp, Artificial Sequence
  Description of Artificial Sequence: Synthetic oligonucleotide
  Target: SCN9A; (+) strand; PAM type: NRG; PAM sequence: GGG
tccaggtggcaggtcaagca

SEQ ID NO: 41332 - DNA, 20 bp, Artificial Sequence
  Description of Artificial Sequence: Synthetic oligonucleotide
  Target: SCN9A; (+) strand; PAM type: NRG; PAM sequence: TAG
aggtcaagcagggtctgaaa

SEQ ID NO: 41333 - DNA, 20 bp, Artificial Sequence
  Description of Artificial Sequence: Synthetic oligonucleotide
  Target: SCN9A; (+) strand; PAM type: NRG; PAM sequence: TGG
gcagggtctgaaatagtctt

SEQ ID NO: 41334 - DNA, 20 bp, Artificial Sequence
  Description of Artificial Sequence: Synthetic oligonucleotide
  Target: SCN9A; (+) strand; PAM type: NRG; PAM sequence: TAG
aatagtctttggtccttccc

SEQ ID NO: 41335 - DNA, 20 bp, Artificial Sequence
  Description of Artificial Sequence: Synthetic oligonucleotide
  Target: SCN9A; (+) strand; PAM type: NRG; PAM sequence: TAG
gtcattttgtgcatcactgc

SEQ ID NO: 41336 - DNA, 20 bp, Artificial Sequence
  Description of Artificial Sequence: Synthetic oligonucleotide
  Target: SCN9A; (+) strand; PAM type: NRG; PAM sequence: AAG
tgctagattaattttttgta

SEQ ID NO: 41337 - DNA, 20 bp, Artificial Sequence
  Description of Artificial Sequence: Synthetic oligonucleotide
  Target: SCN9A; (+) strand; PAM type: NRG; PAM sequence: CAG
gattaattttttgtaaagct

SEQ ID NO: 41338 - DNA, 20 bp, Artificial Sequence
  Description of Artificial Sequence: Synthetic oligonucleotide
  Target: SCN9A; (+) strand; PAM type: NRG; PAM sequence: TAG
tttttgtaaagctcagtctc

SEQ ID NO: 41339 - DNA, 20 bp, Artificial Sequence
  Description of Artificial Sequence: Synthetic oligonucleotide
  Target: SCN9A; (+) strand; PAM type: NRG; PAM sequence: AAG
taaagctcagtctctagaaa

SEQ ID NO: 41340 - DNA, 20 bp, Artificial Sequence
  Description of Artificial Sequence: Synthetic oligonucleotide
  Target: SCN9A; (+) strand; PAM type: NRG; PAM sequence: TGG
gtctctagaaaaagcaattc

SEQ ID NO: 41341 - DNA, 20 bp, Artificial Sequence
  Description of Artificial Sequence: Synthetic oligonucleotide
  Target: SCN9A; (+) strand; PAM type: NRG; PAM sequence: GAG
ctctagaaaaagcaattctg

SEQ ID NO: 41342 - DNA, 20 bp, Artificial Sequence
  Description of Artificial Sequence: Synthetic oligonucleotide
  Target: SCN9A; (+) strand; PAM type: NRG; PAM sequence: TAG
agaaaaagcaattctggagc

SEQ ID NO: 41343 - DNA, 20 bp, Artificial Sequence
  Description of Artificial Sequence: Synthetic oligonucleotide
  Target: SCN9A; (+) strand; PAM type: NRG; PAM sequence: TAG
tccataatgaaactactttt

SEQ ID NO: 41344 - DNA, 20 bp, Artificial Sequence
  Description of Artificial Sequence: Synthetic oligonucleotide
  Target: SCN9A; (+) strand; PAM type: NRG; PAM sequence: CAG
tgaaactactttttagctgt

SEQ ID NO: 41345 - DNA, 20 bp, Artificial Sequence
  Description of Artificial Sequence: Synthetic oligonucleotide
  Target: SCN9A; (+) strand; PAM type: NRG; PAM sequence: AGG
gaaactactttttagctgtc

SEQ ID NO: 41346 - DNA, 20 bp, Artificial Sequence
  Description of Artificial Sequence: Synthetic oligonucleotide
  Target: SCN9A; (+) strand; PAM type: NRG; PAM sequence: AAG
ctgtcaggccatgtgcaaat

SEQ ID NO: 41347 - DNA, 20 bp, Artificial Sequence
  Description of Artificial Sequence: Synthetic oligonucleotide
  Target: SCN9A; (+) strand; PAM type: NRG; PAM sequence: GAG
gcaaataagataatttttct

SEQ ID NO: 41348 - DNA, 20 bp, Artificial Sequence
  Description of Artificial Sequence: Synthetic oligonucleotide
  Target: SCN9A; (+) strand; PAM type: NRG; PAM sequence: GAG
aaataagataatttttctga

SEQ ID NO: 41349 - DNA, 20 bp, Artificial Sequence
  Description of Artificial Sequence: Synthetic oligonucleotide
  Target: SCN9A; (+) strand; PAM type: NRG; PAM sequence: AGG
aataagataatttttctgag

SEQ ID NO: 41350 - DNA, 20 bp, Artificial Sequence
  Description of Artificial Sequence: Synthetic oligonucleotide
  Target: SCN9A; (+) strand; PAM type: NRG; PAM sequence: GAG
atttttctgagaggttaaat

SEQ ID NO: 41351 - DNA, 20 bp, Artificial Sequence
  Description of Artificial Sequence: Synthetic oligonucleotide
  Target: SCN9A; (+) strand; PAM type: NRG; PAM sequence: AGG
tttttctgagaggttaaatg

SEQ ID NO: 41352 - DNA, 20 bp, Artificial Sequence
  Description of Artificial Sequence: Synthetic oligonucleotide
  Target: SCN9A; (+) strand; PAM type: NRG; PAM sequence: TAG
aatgaggatactatgtcttt

SEQ ID NO: 41353 - DNA, 20 bp, Artificial Sequence
  Description of Artificial Sequence: Synthetic oligonucleotide
  Target: SCN9A; (+) strand; PAM type: NRG; PAM sequence: TAG
aaatttgactacaattatgt

SEQ ID NO: 41354 - DNA, 20 bp, Artificial Sequence
  Description of Artificial Sequence: Synthetic oligonucleotide
  Target: SCN9A; (+) strand; PAM type: NRG; PAM sequence: AAG
tttgactacaattatgttag

SEQ ID NO: 41355 - DNA, 20 bp, Artificial Sequence
  Description of Artificial Sequence: Synthetic oligonucleotide
  Target: SCN9A; (+) strand; PAM type: NRG; PAM sequence: CAG
tatgttagaagtattttaca

SEQ ID NO: 41356 - DNA, 20 bp, Artificial Sequence
  Description of Artificial Sequence: Synthetic oligonucleotide
  Target: SCN9A; (+) strand; PAM type: NRG; PAM sequence: AGG
atgttagaagtattttacac

SEQ ID NO: 41357 - DNA, 20 bp, Artificial Sequence
  Description of Artificial Sequence: Synthetic oligonucleotide
  Target: SCN9A; (+) strand; PAM type: NRG; PAM sequence: TGG
acacaggatctgacatatca

SEQ ID NO: 41358 - DNA, 20 bp, Artificial Sequence
  Description of Artificial Sequence: Synthetic oligonucleotide
  Target: SCN9A; (+) strand; PAM type: NRG; PAM sequence: GAG
acaggatctgacatatcatg

SEQ ID NO: 41359 - DNA, 20 bp, Artificial Sequence
  Description of Artificial Sequence: Synthetic oligonucleotide
  Target: SCN9A; (+) strand; PAM type: NRG; PAM sequence: CAG
aacatatatgaatgaaacac

SEQ ID NO: 41360 - DNA, 20 bp, Artificial Sequence
  Description of Artificial Sequence: Synthetic oligonucleotide
  Target: SCN9A; (+) strand; PAM type: NRG; PAM sequence: AAG
aacaccagctgctattaaaa

SEQ ID NO: 41361 - DNA, 20 bp, Artificial Sequence
  Description of Artificial Sequence: Synthetic oligonucleotide
  Target: SCN9A; (+) strand; PAM type: NRG; PAM sequence: AGG
acaccagctgctattaaaaa

SEQ ID NO: 41362 - DNA, 20 bp, Artificial Sequence
  Description of Artificial Sequence: Synthetic oligonucleotide
  Target: SCN9A; (+) strand; PAM type: NRG; PAM sequence: CGG
ctattaaaaaaggtctaata

SEQ ID NO: 41363 - DNA, 20 bp, Artificial Sequence
  Description of Artificial Sequence: Synthetic oligonucleotide
  Target: SCN9A; (+) strand; PAM type: NRG; PAM sequence: CAG
cggctttttatatctactct

SEQ ID NO: 41364 - DNA, 20 bp, Artificial Sequence
  Description of Artificial Sequence: Synthetic oligonucleotide
  Target: SCN9A; (+) strand; PAM type: NRG; PAM sequence: AGG
ggctttttatatctactctc

SEQ ID NO: 41365 - DNA, 20 bp, Artificial Sequence
  Description of Artificial Sequence: Synthetic oligonucleotide
  Target: SCN9A; (+) strand; PAM type: NRG; PAM sequence: CAG
tttttatatctactctcagg

SEQ ID NO: 41366 - DNA, 20 bp, Artificial Sequence
  Description of Artificial Sequence: Synthetic oligonucleotide
  Target: SCN9A; (+) strand; PAM type: NRG; PAM sequence: AGG
ttttatatctactctcaggc

SEQ ID NO: 41367 - DNA, 20 bp, Artificial Sequence
  Description of Artificial Sequence: Synthetic oligonucleotide
  Target: SCN9A; (+) strand; PAM type: NRG; PAM sequence: AAG
ttaaatttcttcaaaaccga

SEQ ID NO: 41368 - DNA, 20 bp, Artificial Sequence
  Description of Artificial Sequence: Synthetic oligonucleotide
  Target: SCN9A; (+) strand; PAM type: NRG; PAM sequence: TGG
catttctgtttcactccatg

SEQ ID NO: 41369 - DNA, 20 bp, Artificial Sequence
  Description of Artificial Sequence: Synthetic oligonucleotide
  Target: SCN9A; (+) strand; PAM type: NRG; PAM sequence: GGG
atttctgtttcactccatgt

SEQ ID NO: 41370 - DNA, 20 bp, Artificial Sequence
  Description of Artificial Sequence: Synthetic oligonucleotide
  Target: SCN9A; (+) strand; PAM type: NRG; PAM sequence: TAG
ctgtttcactccatgtgggt

SEQ ID NO: 41371 - DNA, 20 bp, Artificial Sequence
  Description of Artificial Sequence: Synthetic oligonucleotide
  Target: SCN9A; (+) strand; PAM type: NRG; PAM sequence: AAG
gtcttctttcccaccttcca

SEQ ID NO: 41372 - DNA, 20 bp, Artificial Sequence
  Description of Artificial Sequence: Synthetic oligonucleotide
  Target: SCN9A; (+) strand; PAM type: NRG; PAM sequence: TAG
gtatttcataaaccattcta

SEQ ID NO: 41373 - DNA, 20 bp, Artificial Sequence
  Description of Artificial Sequence: Synthetic oligonucleotide
  Target: SCN9A; (+) strand; PAM type: NRG; PAM sequence: CAG
tttcataaaccattctatag

SEQ ID NO: 41374 - DNA, 20 bp, Artificial Sequence
  Description of Artificial Sequence: Synthetic oligonucleotide
  Target: SCN9A; (+) strand; PAM type: NRG; PAM sequence: TAG
tattgtatttatcatgatta

SEQ ID NO: 41375 - DNA, 20 bp, Artificial Sequence
  Description of Artificial Sequence: Synthetic oligonucleotide
  Target: SCN9A; (+) strand; PAM type: NRG; PAM sequence: TGG
tttatcatgattatagtatt

SEQ ID NO: 41376 - DNA, 20 bp, Artificial Sequence
  Description of Artificial Sequence: Synthetic oligonucleotide
  Target: SCN9A; (+) strand; PAM type: NRG; PAM sequence: GGG
ttatcatgattatagtattt

SEQ ID NO: 41377 - DNA, 20 bp, Artificial Sequence
  Description of Artificial Sequence: Synthetic oligonucleotide
  Target: SCN9A; (+) strand; PAM type: NRG; PAM sequence: GGG
tatcatgattatagtatttg

SEQ ID NO: 41378 - DNA, 20 bp, Artificial Sequence
  Description of Artificial Sequence: Synthetic oligonucleotide
  Target: SCN9A; (+) strand; PAM type: NRG; PAM sequence: TAG
atgattatagtatttgggga

SEQ ID NO: 41379 - DNA, 20 bp, Artificial Sequence
  Description of Artificial Sequence: Synthetic oligonucleotide
  Target: SCN9A; (+) strand; PAM type: NRG; PAM sequence: GAG
gattatagtatttggggata

SEQ ID NO: 41380 - DNA, 20 bp, Artificial Sequence
  Description of Artificial Sequence: Synthetic oligonucleotide
  Target: SCN9A; (+) strand; PAM type: NRG; PAM sequence: TAG
tagtatttggggatagagca

SEQ ID NO: 41381 - DNA, 20 bp, Artificial Sequence
  Description of Artificial Sequence: Synthetic oligonucleotide
  Target: SCN9A; (+) strand; PAM type: NRG; PAM sequence: TAG
tatttggggatagagcatag

SEQ ID NO: 41382 - DNA, 20 bp, Artificial Sequence
  Description of Artificial Sequence: Synthetic oligonucleotide
  Target: SCN9A; (+) strand; PAM type: NRG; PAM sequence: GAG
tttggggatagagcatagta

SEQ ID NO: 41383 - DNA, 20 bp, Artificial Sequence
  Description of Artificial Sequence: Synthetic oligonucleotide
  Target: SCN9A; (+) strand; PAM type: NRG; PAM sequence: GAG
tggggatagagcatagtaga

SEQ ID NO: 41384 - DNA, 20 bp, Artificial Sequence
  Description of Artificial Sequence: Synthetic oligonucleotide
  Target: SCN9A; (+) strand; PAM type: NRG; PAM sequence: TAG
gagcatagtagagagtttaa

SEQ ID NO: 41385 - DNA, 20 bp, Artificial Sequence
  Description of Artificial Sequence: Synthetic oligonucleotide
  Target: SCN9A; (+) strand; PAM type: NRG; PAM sequence: GAG
gcatagtagagagtttaata

SEQ ID NO: 41386 - DNA, 20 bp, Artificial Sequence
  Description of Artificial Sequence: Synthetic oligonucleotide
  Target: SCN9A; (+) strand; PAM type: NRG; PAM sequence: AAG
tagagagtttaatagagtac

SEQ ID NO: 41387 - DNA, 20 bp, Artificial Sequence
  Description of Artificial Sequence: Synthetic oligonucleotide
  Target: SCN9A; (+) strand; PAM type: NRG; PAM sequence: TGG
acatactcgatatatgacct

SEQ ID NO: 41388 - DNA, 20 bp, Artificial Sequence
  Description of Artificial Sequence: Synthetic oligonucleotide
  Target: SCN9A; (+) strand; PAM type: NRG; PAM sequence: GGG
catactcgatatatgacctt

SEQ ID NO: 41389 - DNA, 20 bp, Artificial Sequence
  Description of Artificial Sequence: Synthetic oligonucleotide
  Target: SCN9A; (+) strand; PAM type: NRG; PAM sequence: AAG
ctcgatatatgaccttgggt

SEQ ID NO: 41390 - DNA, 20 bp, Artificial Sequence
  Description of Artificial Sequence: Synthetic oligonucleotide
  Target: SCN9A; (+) strand; PAM type: NRG; PAM sequence: AAG
gtgcctttcctcatttgtga

SEQ ID NO: 41391 - DNA, 20 bp, Artificial Sequence
  Description of Artificial Sequence: Synthetic oligonucleotide
  Target: SCN9A; (+) strand; PAM type: NRG; PAM sequence: GAG
gcctttcctcatttgtgaaa

SEQ ID NO: 41392 - DNA, 20 bp, Artificial Sequence
  Description of Artificial Sequence: Synthetic oligonucleotide
  Target: SCN9A; (+) strand; PAM type: NRG; PAM sequence: TGG
tacttttgtgattgatgtta

SEQ ID NO: 41393 - DNA, 20 bp, Artificial Sequence
  Description of Artificial Sequence: Synthetic oligonucleotide
  Target: SCN9A; (+) strand; PAM type: NRG; PAM sequence: GGG
acttttgtgattgatgttat

SEQ ID NO: 41394 - DNA, 20 bp, Artificial Sequence
  Description of Artificial Sequence: Synthetic oligonucleotide
  Target: SCN9A; (+) strand; PAM type: NRG; PAM sequence: TGG
ttgtgattgatgttatgggt

SEQ ID NO: 41395 - DNA, 20 bp, Artificial Sequence
  Description of Artificial Sequence: Synthetic oligonucleotide
  Target: SCN9A; (+) strand; PAM type: NRG; PAM sequence: AAG
tgggttggattgtgtgccct

SEQ ID NO: 41396 - DNA, 20 bp, Artificial Sequence
  Description of Artificial Sequence: Synthetic oligonucleotide
  Target: SCN9A; (+) strand; PAM type: NRG; PAM sequence: AAG
gttggattgtgtgccctaag

SEQ ID NO: 41397 - DNA, 20 bp, Artificial Sequence
  Description of Artificial Sequence: Synthetic oligonucleotide
  Target: SCN9A; (+) strand; PAM type: NRG; PAM sequence: AGG
ttggattgtgtgccctaaga

SEQ ID NO: 41398 - DNA, 20 bp, Artificial Sequence
  Description of Artificial Sequence: Synthetic oligonucleotide
  Target: SCN9A; (+) strand; PAM type: NRG; PAM sequence: AAG
tgccctaagaaggtacatat

SEQ ID NO: 41399 - DNA, 20 bp, Artificial Sequence
  Description of Artificial Sequence: Synthetic oligonucleotide
  Target: SCN9A; (+) strand; PAM type: NRG; PAM sequence: TAG
tacatataagtcctaaccct

SEQ ID NO: 41400 - DNA, 20 bp, Artificial Sequence
  Description of Artificial Sequence: Synthetic oligonucleotide
  Target: SCN9A; (+) strand; PAM type: NRG; PAM sequence: CAG
agtcctaacccttagcactt

SEQ ID NO: 41401 - DNA, 20 bp, Artificial Sequence
  Description of Artificial Sequence: Synthetic oligonucleotide
  Target: SCN9A; (+) strand; PAM type: NRG; PAM sequence: CAG
atttgaaaataatgtcattg

SEQ ID NO: 41402 - DNA, 20 bp, Artificial Sequence
  Description of Artificial Sequence: Synthetic oligonucleotide
  Target: SCN9A; (+) strand; PAM type: NRG; PAM sequence: AAG
atgtcattgcagatgtaatt

SEQ ID NO: 41403 - DNA, 20 bp, Artificial Sequence
  Description of Artificial Sequence: Synthetic oligonucleotide
  Target: SCN9A; (+) strand; PAM type: NRG; PAM sequence: AAG
ttgcagatgtaattaagatg

SEQ ID NO: 41404 - DNA, 20 bp, Artificial Sequence
  Description of Artificial Sequence: Synthetic oligonucleotide
  Target: SCN9A; (+) strand; PAM type: NRG; PAM sequence: TGG
taattaagatgaagtcatac

SEQ ID NO: 41405 - DNA, 20 bp, Artificial Sequence
  Description of Artificial Sequence: Synthetic oligonucleotide
  Target: SCN9A; (+) strand; PAM type: NRG; PAM sequence: GAG
attaagatgaagtcatactg

SEQ ID NO: 41406 - DNA, 20 bp, Artificial Sequence
  Description of Artificial Sequence: Synthetic oligonucleotide
  Target: SCN9A; (+) strand; PAM type: NRG; PAM sequence: TGG
aagatgaagtcatactggag

SEQ ID NO: 41407 - DNA, 20 bp, Artificial Sequence
  Description of Artificial Sequence: Synthetic oligonucleotide
  Target: SCN9A; (+) strand; PAM type: NRG; PAM sequence: GAG
gatgaagtcatactggagtg

SEQ ID NO: 41408 - DNA, 20 bp, Artificial Sequence
  Description of Artificial Sequence: Synthetic oligonucleotide
  Target: SCN9A; (+) strand; PAM type: NRG; PAM sequence: TGG
gaagtcatactggagtggag

SEQ ID NO: 41409 - DNA, 20 bp, Artificial Sequence
  Description of Artificial Sequence: Synthetic oligonucleotide
  Target: SCN9A; (+) strand; PAM type: NRG; PAM sequence: GGG
aagtcatactggagtggagt

SEQ ID NO: 41410 - DNA, 20 bp, Artificial Sequence
  Description of Artificial Sequence: Synthetic oligonucleotide
  Target: SCN9A; (+) strand; PAM type: NRG; PAM sequence: CAG
agtggagtgggctcttaatc

SEQ ID NO: 41411 - DNA, 20 bp, Artificial Sequence
  Description of Artificial Sequence: Synthetic oligonucleotide
  Target: SCN9A; (+) strand; PAM type: NRG; PAM sequence: TGG
ggctcttaatccagtgtgac

SEQ ID NO: 41412 - DNA, 20 bp, Artificial Sequence
  Description of Artificial Sequence: Synthetic oligonucleotide
  Target: SCN9A; (+) strand; PAM type: NRG; PAM sequence: TAG
agtgtgactggcatccttac

SEQ ID NO: 41413 - DNA, 20 bp, Artificial Sequence
  Description of Artificial Sequence: Synthetic oligonucleotide
  Target: SCN9A; (+) strand; PAM type: NRG; PAM sequence: TAG
gtgactggcatccttactag

SEQ ID NO: 41414 - DNA, 20 bp, Artificial Sequence
  Description of Artificial Sequence: Synthetic oligonucleotide
  Target: SCN9A; (+) strand; PAM type: NRG; PAM sequence: GAG
gactggcatccttactagta

SEQ ID NO: 41415 - DNA, 20 bp, Artificial Sequence
  Description of Artificial Sequence: Synthetic oligonucleotide
  Target: SCN9A; (+) strand; PAM type: NRG; PAM sequence: AGG
actggcatccttactagtag

SEQ ID NO: 41416 - DNA, 20 bp, Artificial Sequence
  Description of Artificial Sequence: Synthetic oligonucleotide
  Target: SCN9A; (+) strand; PAM type: NRG; PAM sequence: GAG
tggcatccttactagtagag

SEQ ID NO: 41417 - DNA, 20 bp, Artificial Sequence
  Description of Artificial Sequence: Synthetic oligonucleotide
  Target: SCN9A; (+) strand; PAM type: NRG; PAM sequence: AAG
atccttactagtagaggaga

SEQ ID NO: 41418 - DNA, 20 bp, Artificial Sequence
  Description of Artificial Sequence: Synthetic oligonucleotide
  Target: SCN9A; (+) strand; PAM type: NRG; PAM sequence: CAG
tagtagaggagaaagacaca

SEQ ID NO: 41419 - DNA, 20 bp, Artificial Sequence
  Description of Artificial Sequence: Synthetic oligonucleotide
  Target: SCN9A; (+) strand; PAM type: NRG; PAM sequence: GAG
gtagaggagaaagacacaca

SEQ ID NO: 41420 - DNA, 20 bp, Artificial Sequence
  Description of Artificial Sequence: Synthetic oligonucleotide
  Target: SCN9A; (+) strand; PAM type: NRG; PAM sequence: AGG
tagaggagaaagacacacag

SEQ ID NO: 41421 - DNA, 20 bp, Artificial Sequence
  Description of Artificial Sequence: Synthetic oligonucleotide
  Target: SCN9A; (+) strand; PAM type: NRG; PAM sequence: GGG
agaggagaaagacacacaga

SEQ ID NO: 41422 - DNA, 20 bp, Artificial Sequence
  Description of Artificial Sequence: Synthetic oligonucleotide
  Target: SCN9A; (+) strand; PAM type: NRG; PAM sequence: TGG
aaagacacacagagggaaaa

SEQ ID NO: 41423 - DNA, 20 bp, Artificial Sequence
  Description of Artificial Sequence: Synthetic oligonucleotide
  Target: SCN9A; (+) strand; PAM type: NRG; PAM sequence: TGG
aaaatggcatgtcactataa

SEQ ID NO: 41424 - DNA, 20 bp, Artificial Sequence
  Description of Artificial Sequence: Synthetic oligonucleotide
  Target: SCN9A; (+) strand; PAM type: NRG; PAM sequence: GGG
aaatggcatgtcactataat

SEQ ID NO: 41425 - DNA, 20 bp, Artificial Sequence
  Description of Artificial Sequence: Synthetic oligonucleotide
  Target: SCN9A; (+) strand; PAM type: NRG; PAM sequence: GAG
atggcatgtcactataatgg

SEQ ID NO: 41426 - DNA, 20 bp, Artificial Sequence
  Description of Artificial Sequence: Synthetic oligonucleotide
  Target: SCN9A; (+) strand; PAM type: NRG; PAM sequence: GAG
ggcatgtcactataatggga

SEQ ID NO: 41427 - DNA, 20 bp, Artificial Sequence
  Description of Artificial Sequence: Synthetic oligonucleotide
  Target: SCN9A; (+) strand; PAM type: NRG; PAM sequence: TGG
gtcactataatgggagagat

SEQ ID NO: 41428 - DNA, 20 bp, Artificial Sequence
  Description of Artificial Sequence: Synthetic oligonucleotide
  Target: SCN9A; (+) strand; PAM type: NRG; PAM sequence: GAG
cactataatgggagagattg

SEQ ID NO: 41429 - DNA, 20 bp, Artificial Sequence
  Description of Artificial Sequence: Synthetic oligonucleotide
  Target: SCN9A; (+) strand; PAM type: NRG; PAM sequence: AAG
gagttctgttgccataaacc

SEQ ID NO: 41430 - DNA, 20 bp, Artificial Sequence
  Description of Artificial Sequence: Synthetic oligonucleotide
  Target: SCN9A; (+) strand; PAM type: NRG; PAM sequence: TGG
gccataaaccaagaaacacc

SEQ ID NO: 41431 - DNA, 20 bp, Artificial Sequence
  Description of Artificial Sequence: Synthetic oligonucleotide
  Target: SCN9A; (+) strand; PAM type: NRG; PAM sequence: GGG
ccataaaccaagaaacacct

SEQ ID NO: 41432 - DNA, 20 bp, Artificial Sequence
  Description of Artificial Sequence: Synthetic oligonucleotide
  Target: SCN9A; (+) strand; PAM type: NRG; PAM sequence: CAG
ccaagaaacacctgggctac

SEQ ID NO: 41433 - DNA, 20 bp, Artificial Sequence
  Description of Artificial Sequence: Synthetic oligonucleotide
  Target: SCN9A; (+) strand; PAM type: NRG; PAM sequence: AAG
agaaacacctgggctaccag

SEQ ID NO: 41434 - DNA, 20 bp, Artificial Sequence
  Description of Artificial Sequence: Synthetic oligonucleotide
  Target: SCN9A; (+) strand; PAM type: NRG; PAM sequence: TGG
acacctgggctaccagaagc

SEQ ID NO: 41435 - DNA, 20 bp, Artificial Sequence
  Description of Artificial Sequence: Synthetic oligonucleotide
  Target: SCN9A; (+) strand; PAM type: NRG; PAM sequence: AAG
cctgggctaccagaagctgg

SEQ ID NO: 41436 - DNA, 20 bp, Artificial Sequence
  Description of Artificial Sequence: Synthetic oligonucleotide
  Target: SCN9A; (+) strand; PAM type: NRG; PAM sequence: GAG
tgggctaccagaagctggaa

SEQ ID NO: 41437 - DNA, 20 bp, Artificial Sequence
  Description of Artificial Sequence: Synthetic oligonucleotide
  Target: SCN9A; (+) strand; PAM type: NRG; PAM sequence: AGG
gggctaccagaagctggaag

SEQ ID NO: 41438 - DNA, 20 bp, Artificial Sequence
  Description of Artificial Sequence: Synthetic oligonucleotide
  Target: SCN9A; (+) strand; PAM type: NRG; PAM sequence: TAG
ggcaataaaatatattttct

SEQ ID NO: 41439 - DNA, 20 bp, Artificial Sequence
  Description of Artificial Sequence: Synthetic oligonucleotide
  Target: SCN9A; (+) strand; PAM type: NRG; PAM sequence: GAG
caataaaatatattttctta

SEQ ID NO: 41440 - DNA, 20 bp, Artificial Sequence
  Description of Artificial Sequence: Synthetic oligonucleotide
  Target: SCN9A; (+) strand; PAM type: NRG; PAM sequence: AGG
aataaaatatattttcttag

SEQ ID NO: 41441 - DNA, 20 bp, Artificial Sequence
  Description of Artificial Sequence: Synthetic oligonucleotide
  Target: SCN9A; (+) strand; PAM type: NRG; PAM sequence: AAG
atattttcttagaggcttta

SEQ ID NO: 41442 - DNA, 20 bp, Artificial Sequence
  Description of Artificial Sequence: Synthetic oligonucleotide
  Target: SCN9A; (+) strand; PAM type: NRG; PAM sequence: GAG
attttcttagaggctttaaa

SEQ ID NO: 41443 - DNA, 20 bp, Artificial Sequence
  Description of Artificial Sequence: Synthetic oligonucleotide
  Target: SCN9A; (+) strand; PAM type: NRG; PAM sequence: TGG
tagaggctttaaagagaaca

SEQ ID NO: 41444 - DNA, 20 bp, Artificial Sequence
  Description of Artificial Sequence: Synthetic oligonucleotide
  Target: SCN9A; (+) strand; PAM type: NRG; PAM sequence: TGG
acctgctgacactttgaatt

SEQ ID NO: 41445 - DNA, 20 bp, Artificial Sequence
  Description of Artificial Sequence: Synthetic oligonucleotide
  Target: SCN9A; (+) strand; PAM type: NRG; PAM sequence: AAG
tttggacttctaacctccaa

SEQ ID NO: 41446 - DNA, 20 bp, Artificial Sequence
  Description of Artificial Sequence: Synthetic oligonucleotide
  Target: SCN9A; (+) strand; PAM type: NRG; PAM sequence: GAG
cttctaacctccaaaagtgt

SEQ ID NO: 41447 - DNA, 20 bp, Artificial Sequence
  Description of Artificial Sequence: Synthetic oligonucleotide
  Target: SCN9A; (+) strand; PAM type: NRG; PAM sequence: GAG
tctaacctccaaaagtgtga

SEQ ID NO: 41448 - DNA, 20 bp, Artificial Sequence
  Description of Artificial Sequence: Synthetic oligonucleotide
  Target: SCN9A; (+) strand; PAM type: NRG; PAM sequence: AAG
gaatatatttctcttgtttt

SEQ ID NO: 41449 - DNA, 20 bp, Artificial Sequence
  Description of Artificial Sequence: Synthetic oligonucleotide
  Target: SCN9A; (+) strand; PAM type: NRG; PAM sequence: CAG
tttctcttgttttaagccct

SEQ ID NO: 41450 - DNA, 20 bp, Artificial Sequence
  Description of Artificial Sequence: Synthetic oligonucleotide
  Target: SCN9A; (+) strand; PAM type: NRG; PAM sequence: AGG
ttctcttgttttaagccctc

SEQ ID NO: 41451 - DNA, 20 bp, Artificial Sequence
  Description of Artificial Sequence: Synthetic oligonucleotide
  Target: SCN9A; (+) strand; PAM type: NRG; PAM sequence: TAG
tttgtattatcctgttctcg

SEQ ID NO: 41452 - DNA, 20 bp, Artificial Sequence
  Description of Artificial Sequence: Synthetic oligonucleotide
  Target: SCN9A; (+) strand; PAM type: NRG; PAM sequence: AGG
ttgtattatcctgttctcgt

SEQ ID NO: 41453 - DNA, 20 bp, Artificial Sequence
  Description of Artificial Sequence: Synthetic oligonucleotide
  Target: SCN9A; (+) strand; PAM type: NRG; PAM sequence: AAG
tatcctgttctcgtaggtca

SEQ ID NO: 41454 - DNA, 20 bp, Artificial Sequence
  Description of Artificial Sequence: Synthetic oligonucleotide
  Target: SCN9A; (+) strand; PAM type: NRG; PAM sequence: CAG
gtaggtcaaagaaactaata

SEQ ID NO: 41455 - DNA, 20 bp, Artificial Sequence
  Description of Artificial Sequence: Synthetic oligonucleotide
  Target: SCN9A; (+) strand; PAM type: NRG; PAM sequence: AAG
aaactaatacagttgatgtg

SEQ ID NO: 41456 - DNA, 20 bp, Artificial Sequence
  Description of Artificial Sequence: Synthetic oligonucleotide
  Target: SCN9A; (+) strand; PAM type: NRG; PAM sequence: CAG
gattaattaattaaaaattt

SEQ ID NO: 41457 - DNA, 20 bp, Artificial Sequence
  Description of Artificial Sequence: Synthetic oligonucleotide
  Target: SCN9A; (+) strand; PAM type: NRG; PAM sequence: AAG
taattaattaaaaatttcag

SEQ ID NO: 41458 - DNA, 20 bp, Artificial Sequence
  Description of Artificial Sequence: Synthetic oligonucleotide
  Target: SCN9A; (+) strand; PAM type: NRG; PAM sequence: CAG
tcagaagattgctcaaatta

SEQ ID NO: 41459 - DNA, 20 bp, Artificial Sequence
  Description of Artificial Sequence: Synthetic oligonucleotide
  Target: SCN9A; (+) strand; PAM type: NRG; PAM sequence: AAG
ctcaaattacagtattcaac

SEQ ID NO: 41460 - DNA, 20 bp, Artificial Sequence
  Description of Artificial Sequence: Synthetic oligonucleotide
  Target: SCN9A; (+) strand; PAM type: NRG; PAM sequence: GAG
tgctatgacataaactcctt

SEQ ID NO: 41461 - DNA, 20 bp, Artificial Sequence
  Description of Artificial Sequence: Synthetic oligonucleotide
  Target: SCN9A; (+) strand; PAM type: NRG; PAM sequence: CAG
tgacataaactccttgagct

SEQ ID NO: 41462 - DNA, 20 bp, Artificial Sequence
  Description of Artificial Sequence: Synthetic oligonucleotide
  Target: SCN9A; (+) strand; PAM type: NRG; PAM sequence: AGG
gacataaactccttgagctc

SEQ ID NO: 41463 - DNA, 20 bp, Artificial Sequence
  Description of Artificial Sequence: Synthetic oligonucleotide
  Target: SCN9A; (+) strand; PAM type: NRG; PAM sequence: TGG
tcaggaaccatatcttacgt

SEQ ID NO: 41464 - DNA, 20 bp, Artificial Sequence
  Description of Artificial Sequence: Synthetic oligonucleotide
  Target: SCN9A; (+) strand; PAM type: NRG; PAM sequence: AAG
tatcttacgttggtctcccc

SEQ ID NO: 41465 - DNA, 20 bp, Artificial Sequence
  Description of Artificial Sequence: Synthetic oligonucleotide
  Target: SCN9A; (+) strand; PAM type: NRG; PAM sequence: TAG
taaaatgtgttttgaataaa

SEQ ID NO: 41466 - DNA, 20 bp, Artificial Sequence
  Description of Artificial Sequence: Synthetic oligonucleotide
  Target: SCN9A; (+) strand; PAM type: NRG; PAM sequence: TAG
cttaattattcaatcctcta

SEQ ID NO: 41467 - DNA, 20 bp, Artificial Sequence
  Description of Artificial Sequence: Synthetic oligonucleotide
  Target: SCN9A; (+) strand; PAM type: NRG; PAM sequence: AGG
ttaattattcaatcctctat

SEQ ID NO: 41468 - DNA, 20 bp, Artificial Sequence
  Description of Artificial Sequence: Synthetic oligonucleotide
  Target: SCN9A; (+) strand; PAM type: NRG; PAM sequence: TGG
caatcctctataggaaacat

SEQ ID NO: 41469 - DNA, 20 bp, Artificial Sequence
  Description of Artificial Sequence: Synthetic oligonucleotide
  Target: SCN9A; (+) strand; PAM type: NRG; PAM sequence: CAG
ataggaaacattggaaaaaa

SEQ ID NO: 41470 - DNA, 20 bp, Artificial Sequence
  Description of Artificial Sequence: Synthetic oligonucleotide
  Target: SCN9A; (+) strand; PAM type: NRG; PAM sequence: TAG
aaacattggaaaaaacagaa

SEQ ID NO: 41471 - DNA, 20 bp, Artificial Sequence
  Description of Artificial Sequence: Synthetic oligonucleotide
  Target: SCN9A; (+) strand; PAM type: NRG; PAM sequence: TGG
gatatattgctcaaaaccta

SEQ ID NO: 41472 - DNA, 20 bp, Artificial Sequence
  Description of Artificial Sequence: Synthetic oligonucleotide
  Target: SCN9A; (+) strand; PAM type: NRG; PAM sequence: GGG
atatattgctcaaaacctat

SEQ ID NO: 41473 - DNA, 20 bp, Artificial Sequence
  Description of Artificial Sequence: Synthetic oligonucleotide
  Target: SCN9A; (+) strand; PAM type: NRG; PAM sequence: AAG
atgggtttaacctaaatcat

SEQ ID NO: 41474 - DNA, 20 bp, Artificial Sequence
  Description of Artificial Sequence: Synthetic oligonucleotide
  Target: SCN9A; (+) strand; PAM type: NRG; PAM sequence: TAG
gtttaacctaaatcataagt

SEQ ID NO: 41475 - DNA, 20 bp, Artificial Sequence
  Description of Artificial Sequence: Synthetic oligonucleotide
  Target: SCN9A; (+) strand; PAM type: NRG; PAM sequence: CAG
aacctaaatcataagttagc

SEQ ID NO: 41476 - DNA, 20 bp, Artificial Sequence
  Description of Artificial Sequence: Synthetic oligonucleotide
  Target: SCN9A; (+) strand; PAM type: NRG; PAM sequence: TAG
gttagccagaacctattatt

SEQ ID NO: 41477 - DNA, 20 bp, Artificial Sequence
  Description of Artificial Sequence: Synthetic oligonucleotide
  Target: SCN9A; (+) strand; PAM type: NRG; PAM sequence: AAG
ttttctgtgcaaaaatgaat

SEQ ID NO: 41478 - DNA, 20 bp, Artificial Sequence
  Description of Artificial Sequence: Synthetic oligonucleotide
  Target: SCN9A; (+) strand; PAM type: NRG; PAM sequence: AAG
gtgcaaaaatgaataagatt

SEQ ID NO: 41479 - DNA, 20 bp, Artificial Sequence
  Description of Artificial Sequence: Synthetic oligonucleotide
  Target: SCN9A; (+) strand; PAM type: NRG; PAM sequence: TAG
gcatatttgtaattgtatac

SEQ ID NO: 41480 - DNA, 20 bp, Artificial Sequence
  Description of Artificial Sequence: Synthetic oligonucleotide
  Target: SCN9A; (+) strand; PAM type: NRG; PAM sequence: AAG
aattatttgaaaaataaatg

SEQ ID NO: 41481 - DNA, 20 bp, Artificial Sequence
  Description of Artificial Sequence: Synthetic oligonucleotide
  Target: SCN9A; (+) strand; PAM type: NRG; PAM sequence: TGG
aaactttacattatcttttt

SEQ ID NO: 41482 - DNA, 20 bp, Artificial Sequence
  Description of Artificial Sequence: Synthetic oligonucleotide
  Target: SCN9A; (+) strand; PAM type: NRG; PAM sequence: TGG
tacttatcttctttttctgt

SEQ ID NO: 41483 - DNA, 20 bp, Artificial Sequence
  Description of Artificial Sequence: Synthetic oligonucleotide
  Target: SCN9A; (+) strand; PAM type: NRG; PAM sequence: AAG
ctatgatgacaccaatgaac

SEQ ID NO: 41484 - DNA, 20 bp, Artificial Sequence
  Description of Artificial Sequence: Synthetic oligonucleotide
  Target: SCN9A; (+) strand; PAM type: NRG; PAM sequence: AAG
gacaccaatgaacaagttca

SEQ ID NO: 41485 - DNA, 20 bp, Artificial Sequence
  Description of Artificial Sequence: Synthetic oligonucleotide
  Target: SCN9A; (+) strand; PAM type: NRG; PAM sequence: AAG
caatgaacaagttcaaagtg

SEQ ID NO: 41486 - DNA, 20 bp, Artificial Sequence
  Description of Artificial Sequence: Synthetic oligonucleotide
  Target: SCN9A; (+) strand; PAM type: NRG; PAM sequence: AAG
tcaaagtgaagaatgaccca

SEQ ID NO: 41487 - DNA, 20 bp, Artificial Sequence
  Description of Artificial Sequence: Synthetic oligonucleotide
  Target: SCN9A; (+) strand; PAM type: NRG; PAM sequence: AAG
agaatgacccaaagatgata

SEQ ID NO: 41488 - DNA, 20 bp, Artificial Sequence
  Description of Artificial Sequence: Synthetic oligonucleotide
  Target: SCN9A; (+) strand; PAM type: NRG; PAM sequence: TAG
cgacaaaataaatatacatg

SEQ ID NO: 41489 - DNA, 20 bp, Artificial Sequence
  Description of Artificial Sequence: Synthetic oligonucleotide
  Target: SCN9A; (+) strand; PAM type: NRG; PAM sequence: GAG
acaaaataaatatacatgta

SEQ ID NO: 41490 - DNA, 20 bp, Artificial Sequence
  Description of Artificial Sequence: Synthetic oligonucleotide
  Target: SCN9A; (+) strand; PAM type: NRG; PAM sequence: AGG
caaaataaatatacatgtag

SEQ ID NO: 41491 - DNA, 20 bp, Artificial Sequence
  Description of Artificial Sequence: Synthetic oligonucleotide
  Target: SCN9A; (+) strand; PAM type: NRG; PAM sequence: TGG
gtagaggctatattcatatt

SEQ ID NO: 41492 - DNA, 20 bp, Artificial Sequence
  Description of Artificial Sequence: Synthetic oligonucleotide
  Target: SCN9A; (+) strand; PAM type: NRG; PAM sequence: GGG
tagaggctatattcatattt

SEQ ID NO: 41493 - DNA, 20 bp, Artificial Sequence
  Description of Artificial Sequence: Synthetic oligonucleotide
  Target: SCN9A; (+) strand; PAM type: NRG; PAM sequence: AAG
tctacctataaaatttacaa

SEQ ID NO: 41494 - DNA, 20 bp, Artificial Sequence
  Description of Artificial Sequence: Synthetic oligonucleotide
  Target: SCN9A; (+) strand; PAM type: NRG; PAM sequence: TAG
cctataaaatttacaaaagt

SEQ ID NO: 41495 - DNA, 20 bp, Artificial Sequence
  Description of Artificial Sequence: Synthetic oligonucleotide
  Target: SCN9A; (+) strand; PAM type: NRG; PAM sequence: TGG
ttacaaaagttagcattata

SEQ ID NO: 41496 - DNA, 20 bp, Artificial Sequence
  Description of Artificial Sequence: Synthetic oligonucleotide
  Target: SCN9A; (+) strand; PAM type: NRG; PAM sequence: CAG
aaaagttagcattatatgga

SEQ ID NO: 41497 - DNA, 20 bp, Artificial Sequence
  Description of Artificial Sequence: Synthetic oligonucleotide
  Target: SCN9A; (+) strand; PAM type: NRG; PAM sequence: TGG
tcattattttctttttcaca

SEQ ID NO: 41498 - DNA, 20 bp, Artificial Sequence
  Description of Artificial Sequence: Synthetic oligonucleotide
  Target: SCN9A; (+) strand; PAM type: NRG; PAM sequence: CAG
tctttttcacatggtttgac

SEQ ID NO: 41499 - DNA, 20 bp, Artificial Sequence
  Description of Artificial Sequence: Synthetic oligonucleotide
  Target: SCN9A; (+) strand; PAM type: NRG; PAM sequence: AGG
ctttttcacatggtttgacc

SEQ ID NO: 41500 - DNA, 20 bp, Artificial Sequence
  Description of Artificial Sequence: Synthetic oligonucleotide
  Target: SCN9A; (+) strand; PAM type: NRG; PAM sequence: CAG
gtttgaccaggtaattcaaa

SEQ ID NO: 41501 - DNA, 20 bp, Artificial Sequence
  Description of Artificial Sequence: Synthetic oligonucleotide
  Target: SCN9A; (+) strand; PAM type: NRG; PAM sequence: TAG
taattcaaacagtgctatcc

SEQ ID NO: 41502 - DNA, 20 bp, Artificial Sequence
  Description of Artificial Sequence: Synthetic oligonucleotide
  Target: SCN9A; (+) strand; PAM type: NRG; PAM sequence: AGG
aattcaaacagtgctatcct

SEQ ID NO: 41503 - DNA, 20 bp, Artificial Sequence
  Description of Artificial Sequence: Synthetic oligonucleotide
  Target: SCN9A; (+) strand; PAM type: NRG; PAM sequence: TAG
agtgctatcctaggtaaaca

SEQ ID NO: 41504 - DNA, 20 bp, Artificial Sequence
  Description of Artificial Sequence: Synthetic oligonucleotide
  Target: SCN9A; (+) strand; PAM type: NRG; PAM sequence: AGG
gtgctatcctaggtaaacat

SEQ ID NO: 41505 - DNA, 20 bp, Artificial Sequence
  Description of Artificial Sequence: Synthetic oligonucleotide
  Target: SCN9A; (+) strand; PAM type: NRG; PAM sequence: AAG
cctaggtaaacataggattt

SEQ ID NO: 41506 - DNA, 20 bp, Artificial Sequence
  Description of Artificial Sequence: Synthetic oligonucleotide
  Target: SCN9A; (+) strand; PAM type: NRG; PAM sequence: AAG
aggtaaacataggatttaag

SEQ ID NO: 41507 - DNA, 20 bp, Artificial Sequence
  Description of Artificial Sequence: Synthetic oligonucleotide
  Target: SCN9A; (+) strand; PAM type: NRG; PAM sequence: TAG
acataggatttaagaagcca

SEQ ID NO: 41508 - DNA, 20 bp, Artificial Sequence
  Description of Artificial Sequence: Synthetic oligonucleotide
  Target: SCN9A; (+) strand; PAM type: NRG; PAM sequence: GAG
taagaagccatagcattgtt

SEQ ID NO: 41509 - DNA, 20 bp, Artificial Sequence
  Description of Artificial Sequence: Synthetic oligonucleotide
  Target: SCN9A; (+) strand; PAM type: NRG; PAM sequence: AGG
aagaagccatagcattgttg

SEQ ID NO: 41510 - DNA, 20 bp, Artificial Sequence
  Description of Artificial Sequence: Synthetic oligonucleotide
  Target: SCN9A; (+) strand; PAM type: NRG; PAM sequence: AAG
ataatcttcaaataactaca

SEQ ID NO: 41511 - DNA, 20 bp, Artificial Sequence
  Description of Artificial Sequence: Synthetic oligonucleotide
  Target: SCN9A; (+) strand; PAM type: NRG; PAM sequence: AGG
taatcttcaaataactacaa

SEQ ID NO: 41512 - DNA, 20 bp, Artificial Sequence
  Description of Artificial Sequence: Synthetic oligonucleotide
  Target: SCN9A; (+) strand; PAM type: NRG; PAM sequence: GGG
aatcttcaaataactacaaa

SEQ ID NO: 41513 - DNA, 20 bp, Artificial Sequence
  Description of Artificial Sequence: Synthetic oligonucleotide
  Target: SCN9A; (+) strand; PAM type: NRG; PAM sequence: TGG
atgcatatttgtgctcatat

SEQ ID NO: 41514 - DNA, 20 bp, Artificial Sequence
  Description of Artificial Sequence: Synthetic oligonucleotide
  Target: SCN9A; (+) strand; PAM type: NRG; PAM sequence: TAG
catatttgtgctcatattgg

SEQ ID NO: 41515 - DNA, 20 bp, Artificial Sequence
  Description of Artificial Sequence: Synthetic oligonucleotide
  Target: SCN9A; (+) strand; PAM type: NRG; PAM sequence: AGG
atatttgtgctcatattggt

SEQ ID NO: 41516 - DNA, 20 bp, Artificial Sequence
  Description of Artificial Sequence: Synthetic oligonucleotide
  Target: SCN9A; (+) strand; PAM type: NRG; PAM sequence: AAG
ggtaggaaaattcaataact

SEQ ID NO: 41517 - DNA, 20 bp, Artificial Sequence
  Description of Artificial Sequence: Synthetic oligonucleotide
  Target: SCN9A; (+) strand; PAM type: NRG; PAM sequence: AAG
tatgtatatgttatttccaa

SEQ ID NO: 41518 - DNA, 20 bp, Artificial Sequence
  Description of Artificial Sequence: Synthetic oligonucleotide
  Target: SCN9A; (+) strand; PAM type: NRG; PAM sequence: GAG
tttccaaaagtactgtaaat

SEQ ID NO: 41519 - DNA, 20 bp, Artificial Sequence
  Description of Artificial Sequence: Synthetic oligonucleotide
  Target: SCN9A; (+) strand; PAM type: NRG; PAM sequence: TAG
tattttgtaaaaatattacc

SEQ ID NO: 41520 - DNA, 20 bp, Artificial Sequence
  Description of Artificial Sequence: Synthetic oligonucleotide
  Target: SCN9A; (+) strand; PAM type: NRG; PAM sequence: AGG
attttgtaaaaatattacct

SEQ ID NO: 41521 - DNA, 20 bp, Artificial Sequence
  Description of Artificial Sequence: Synthetic oligonucleotide
  Target: SCN9A; (+) strand; PAM type: NRG; PAM sequence: GGG
ttttgtaaaaatattaccta

SEQ ID NO: 41522 - DNA, 20 bp, Artificial Sequence
  Description of Artificial Sequence: Synthetic oligonucleotide
  Target: SCN9A; (+) strand; PAM type: NRG; PAM sequence: GAG
ttgtaaaaatattacctagg

SEQ ID NO: 41523 - DNA, 20 bp, Artificial Sequence
  Description of Artificial Sequence: Synthetic oligonucleotide
  Target: SCN9A; (+) strand; PAM type: NRG; PAM sequence: AAG
tacctagggagtaatcatta

SEQ ID NO: 41524 - DNA, 20 bp, Artificial Sequence
  Description of Artificial Sequence: Synthetic oligonucleotide
  Target: SCN9A; (+) strand; PAM type: NRG; PAM sequence: TAG
gagtaatcattaaagtttct

SEQ ID NO: 41525 - DNA, 20 bp, Artificial Sequence
  Description of Artificial Sequence: Synthetic oligonucleotide
  Target: SCN9A; (+) strand; PAM type: NRG; PAM sequence: TGG
atcattaaagtttcttagca

SEQ ID NO: 41526 - DNA, 20 bp, Artificial Sequence
  Description of Artificial Sequence: Synthetic oligonucleotide
  Target: SCN9A; (+) strand; PAM type: NRG; PAM sequence: AAG
tatttcacataaactcatcc

SEQ ID NO: 41527 - DNA, 20 bp, Artificial Sequence
  Description of Artificial Sequence: Synthetic oligonucleotide
  Target: SCN9A; (+) strand; PAM type: NRG; PAM sequence: AGG
atttcacataaactcatcca

SEQ ID NO: 41528 - DNA, 20 bp, Artificial Sequence
  Description of Artificial Sequence: Synthetic oligonucleotide
  Target: SCN9A; (+) strand; PAM type: NRG; PAM sequence: CAG
ggtgttttaaactgtaaaaa

SEQ ID NO: 41529 - DNA, 20 bp, Artificial Sequence
  Description of Artificial Sequence: Synthetic oligonucleotide
  Target: SCN9A; (+) strand; PAM type: NRG; PAM sequence: AAG
ttaaactgtaaaaacagtaa

SEQ ID NO: 41530 - DNA, 20 bp, Artificial Sequence
  Description of Artificial Sequence: Synthetic oligonucleotide
  Target: SCN9A; (+) strand; PAM type: NRG; PAM sequence: AAG
tattttatttttattttgat

SEQ ID NO: 41531 - DNA, 20 bp, Artificial Sequence
  Description of Artificial Sequence: Synthetic oligonucleotide
  Target: SCN9A; (+) strand; PAM type: NRG; PAM sequence: GAG
ttgataagcgcatatttact

SEQ ID NO: 41532 - DNA, 20 bp, Artificial Sequence
  Description of Artificial Sequence: Synthetic oligonucleotide
  Target: SCN9A; (+) strand; PAM type: NRG; PAM sequence: TAG
gcgcatatttactgagcatt

SEQ ID NO: 41533 - DNA, 20 bp, Artificial Sequence
  Description of Artificial Sequence: Synthetic oligonucleotide
  Target: SCN9A; (+) strand; PAM type: NRG; PAM sequence: CAG
tactgagcatttagtaatgc

SEQ ID NO: 41534 - DNA, 20 bp, Artificial Sequence
  Description of Artificial Sequence: Synthetic oligonucleotide
  Target: SCN9A; (+) strand; PAM type: NRG; PAM sequence: AAG
tagtaatgccagcctgcact

SEQ ID NO: 41535 - DNA, 20 bp, Artificial Sequence
  Description of Artificial Sequence: Synthetic oligonucleotide
  Target: SCN9A; (+) strand; PAM type: NRG; PAM sequence: TGG
ccctgcttctattttcttgt

SEQ ID NO: 41536 - DNA, 20 bp, Artificial Sequence
  Description of Artificial Sequence: Synthetic oligonucleotide
  Target: SCN9A; (+) strand; PAM type: NRG; PAM sequence: GGG
cctgcttctattttcttgtt

SEQ ID NO: 41537 - DNA, 20 bp, Artificial Sequence
  Description of Artificial Sequence: Synthetic oligonucleotide
  Target: SCN9A; (+) strand; PAM type: NRG; PAM sequence: TGG
gttgggtcctcacaacacta

SEQ ID NO: 41538 - DNA, 20 bp, Artificial Sequence
  Description of Artificial Sequence: Synthetic oligonucleotide
  Target: SCN9A; (+) strand; PAM type: NRG; PAM sequence: GAG
tgggtcctcacaacactatg

SEQ ID NO: 41539 - DNA, 20 bp, Artificial Sequence
  Description of Artificial Sequence: Synthetic oligonucleotide
  Target: SCN9A; (+) strand; PAM type: NRG; PAM sequence: TAG
gtcctcacaacactatggag

SEQ ID NO: 41540 - DNA, 20 bp, Artificial Sequence
  Description of Artificial Sequence: Synthetic oligonucleotide
  Target: SCN9A; (+) strand; PAM type: NRG; PAM sequence: AGG
tcctcacaacactatggagt

SEQ ID NO: 41541 - DNA, 20 bp, Artificial Sequence
  Description of Artificial Sequence: Synthetic oligonucleotide
  Target: SCN9A; (+) strand; PAM type: NRG; PAM sequence: TGG
caacactatggagtaggcat

SEQ ID NO: 41542 - DNA, 20 bp, Artificial Sequence
  Description of Artificial Sequence: Synthetic oligonucleotide
  Target: SCN9A; (+) strand; PAM type: NRG; PAM sequence: TAG
gagtaggcattggatgattg

SEQ ID NO: 41543 - DNA, 20 bp, Artificial Sequence
  Description of Artificial Sequence: Synthetic oligonucleotide
  Target: SCN9A; (+) strand; PAM type: NRG; PAM sequence: TAG
ggatgattgtagacatttat

SEQ ID NO: 41544 - DNA, 20 bp, Artificial Sequence
  Description of Artificial Sequence: Synthetic oligonucleotide
  Target: SCN9A; (+) strand; PAM type: NRG; PAM sequence: TAG
gacatttattagacaaatga

SEQ ID NO: 41545 - DNA, 20 bp, Artificial Sequence
  Description of Artificial Sequence: Synthetic oligonucleotide
  Target: SCN9A; (+) strand; PAM type: NRG; PAM sequence: TAG
atgatagattcattaaatta

SEQ ID NO: 41546 - DNA, 20 bp, Artificial Sequence
  Description of Artificial Sequence: Synthetic oligonucleotide
  Target: SCN9A; (+) strand; PAM type: NRG; PAM sequence: TAG
agattcattaaattatagat

SEQ ID NO: 41547 - DNA, 20 bp, Artificial Sequence
  Description of Artificial Sequence: Synthetic oligonucleotide
  Target: SCN9A; (+) strand; PAM type: NRG; PAM sequence: AAG
atagattagacaaataaact

SEQ ID NO: 41548 - DNA, 20 bp, Artificial Sequence
  Description of Artificial Sequence: Synthetic oligonucleotide
  Target: SCN9A; (+) strand; PAM type: NRG; PAM sequence: AAG
agacaaataaactaagtctc

SEQ ID NO: 41549 - DNA, 20 bp, Artificial Sequence
  Description of Artificial Sequence: Synthetic oligonucleotide
  Target: SCN9A; (+) strand; PAM type: NRG; PAM sequence: AAG
caaataaactaagtctcaag

SEQ ID NO: 41550 - DNA, 20 bp, Artificial Sequence
  Description of Artificial Sequence: Synthetic oligonucleotide
  Target: SCN9A; (+) strand; PAM type: NRG; PAM sequence: AGG
aaataaactaagtctcaaga

SEQ ID NO: 41551 - DNA, 20 bp, Artificial Sequence
  Description of Artificial Sequence: Synthetic oligonucleotide
  Target: SCN9A; (+) strand; PAM type: NRG; PAM sequence: AAG
aaactaagtctcaagaaggt

SEQ ID NO: 41552 - DNA, 20 bp, Artificial Sequence
  Description of Artificial Sequence: Synthetic oligonucleotide
  Target: SCN9A; (+) strand; PAM type: NRG; PAM sequence: AGG
aactaagtctcaagaaggta

SEQ ID NO: 41553 - DNA, 20 bp, Artificial Sequence
  Description of Artificial Sequence: Synthetic oligonucleotide
  Target: SCN9A; (+) strand; PAM type: NRG; PAM sequence: AAG
aaggtaaggtaatttgcccg

SEQ ID NO: 41554 - DNA, 20 bp, Artificial Sequence
  Description of Artificial Sequence: Synthetic oligonucleotide
  Target: SCN9A; (+) strand; PAM type: NRG; PAM sequence: CAG
taaggtaatttgcccgaagt

SEQ ID NO: 41555 - DNA, 20 bp, Artificial Sequence
  Description of Artificial Sequence: Synthetic oligonucleotide
  Target: SCN9A; (+) strand; PAM type: NRG; PAM sequence: TAG
aatttgcccgaagtcagttg

SEQ ID NO: 41556 - DNA, 20 bp, Artificial Sequence
  Description of Artificial Sequence: Synthetic oligonucleotide
  Target: SCN9A; (+) strand; PAM type: NRG; PAM sequence: GAG
tttgcccgaagtcagttgta

SEQ ID NO: 41557 - DNA, 20 bp, Artificial Sequence
  Description of Artificial Sequence: Synthetic oligonucleotide
  Target: SCN9A; (+) strand; PAM type: NRG; PAM sequence: TGG
ccgaagtcagttgtagagct

SEQ ID NO: 41558 - DNA, 20 bp, Artificial Sequence
  Description of Artificial Sequence: Synthetic oligonucleotide
  Target: SCN9A; (+) strand; PAM type: NRG; PAM sequence: TGG
gttgtagagcttggatgata

SEQ ID NO: 41559 - DNA, 20 bp, Artificial Sequence
  Description of Artificial Sequence: Synthetic oligonucleotide
  Target: SCN9A; (+) strand; PAM type: NRG; PAM sequence: CAG
agagcttggatgatatggta

SEQ ID NO: 41560 - DNA, 20 bp, Artificial Sequence
  Description of Artificial Sequence: Synthetic oligonucleotide
  Target: SCN9A; (+) strand; PAM type: NRG; PAM sequence: TAG
cttggatgatatggtacagc

SEQ ID NO: 41561 - DNA, 20 bp, Artificial Sequence
  Description of Artificial Sequence: Synthetic oligonucleotide
  Target: SCN9A; (+) strand; PAM type: NRG; PAM sequence: CAG
ggtacagctagaatttgaat

SEQ ID NO: 41562 - DNA, 20 bp, Artificial Sequence
  Description of Artificial Sequence: Synthetic oligonucleotide
  Target: SCN9A; (+) strand; PAM type: NRG; PAM sequence: AGG
gtacagctagaatttgaatc

SEQ ID NO: 41563 - DNA, 20 bp, Artificial Sequence
  Description of Artificial Sequence: Synthetic oligonucleotide
  Target: SCN9A; (+) strand; PAM type: NRG; PAM sequence: TAG
actgctgtactcacaaccac

SEQ ID NO: 41564 - DNA, 20 bp, Artificial Sequence
  Description of Artificial Sequence: Synthetic oligonucleotide
  Target: SCN9A; (+) strand; PAM type: NRG; PAM sequence: AGG
ctgctgtactcacaaccact

SEQ ID NO: 41565 - DNA, 20 bp, Artificial Sequence
  Description of Artificial Sequence: Synthetic oligonucleotide
  Target: SCN9A; (+) strand; PAM type: NRG; PAM sequence: CAG
cacaaccactaggctactat

SEQ ID NO: 41566 - DNA, 20 bp, Artificial Sequence
  Description of Artificial Sequence: Synthetic oligonucleotide
  Target: SCN9A; (+) strand; PAM type: NRG; PAM sequence: AGG
acaaccactaggctactatc

SEQ ID NO: 41567 - DNA, 20 bp, Artificial Sequence
  Description of Artificial Sequence: Synthetic oligonucleotide
  Target: SCN9A; (+) strand; PAM type: NRG; PAM sequence: TGG
accactaggctactatcagg

SEQ ID NO: 41568 - DNA, 20 bp, Artificial Sequence
  Description of Artificial Sequence: Synthetic oligonucleotide
  Target: SCN9A; (+) strand; PAM type: NRG; PAM sequence: GAG
atgttcttcattgtctatgt

SEQ ID NO: 41569 - DNA, 20 bp, Artificial Sequence
  Description of Artificial Sequence: Synthetic oligonucleotide
  Target: SCN9A; (+) strand; PAM type: NRG; PAM sequence: AAG
tcattgtctatgtgagtccc

SEQ ID NO: 41570 - DNA, 20 bp, Artificial Sequence
  Description of Artificial Sequence: Synthetic oligonucleotide
  Target: SCN9A; (+) strand; PAM type: NRG; PAM sequence: AGG
cattgtctatgtgagtccca

SEQ ID NO: 41571 - DNA, 20 bp, Artificial Sequence
  Description of Artificial Sequence: Synthetic oligonucleotide
  Target: SCN9A; (+) strand; PAM type: NRG; PAM sequence: GGG
attgtctatgtgagtcccaa

SEQ ID NO: 41572 - DNA, 20 bp, Artificial Sequence
  Description of Artificial Sequence: Synthetic oligonucleotide
  Target: SCN9A; (+) strand; PAM type: NRG; PAM sequence: AAG
tgagtcccaagggcttcatg

SEQ ID NO: 41573 - DNA, 20 bp, Artificial Sequence
  Description of Artificial Sequence: Synthetic oligonucleotide
  Target: SCN9A; (+) strand; PAM type: NRG; PAM sequence: TAG
ccaagggcttcatgaagtta

SEQ ID NO: 41574 - DNA, 20 bp, Artificial Sequence
  Description of Artificial Sequence: Synthetic oligonucleotide
  Target: SCN9A; (+) strand; PAM type: NRG; PAM sequence: TGG
ggcttcatgaagttatagtt

SEQ ID NO: 41575 - DNA, 20 bp, Artificial Sequence
  Description of Artificial Sequence: Synthetic oligonucleotide
  Target: SCN9A; (+) strand; PAM type: NRG; PAM sequence: AAG
ggaaatcactgaaataaact

SEQ ID NO: 41576 - DNA, 20 bp, Artificial Sequence
  Description of Artificial Sequence: Synthetic oligonucleotide
  Target: SCN9A; (+) strand; PAM type: NRG; PAM sequence: AAG
aatcactgaaataaactaag

SEQ ID NO: 41577 - DNA, 20 bp, Artificial Sequence
  Description of Artificial Sequence: Synthetic oligonucleotide
  Target: SCN9A; (+) strand; PAM type: NRG; PAM sequence: AAG
ctaagaagcttttaaaaata

SEQ ID NO: 41578 - DNA, 20 bp, Artificial Sequence
  Description of Artificial Sequence: Synthetic oligonucleotide
  Target: SCN9A; (+) strand; PAM type: NRG; PAM sequence: TAG
aagcttttaaaaataaagtt

SEQ ID NO: 41579 - DNA, 20 bp, Artificial Sequence
  Description of Artificial Sequence: Synthetic oligonucleotide
  Target: SCN9A; (+) strand; PAM type: NRG; PAM sequence: AAG
taaaaataaagtttagtgct

SEQ ID NO: 41580 - DNA, 20 bp, Artificial Sequence
  Description of Artificial Sequence: Synthetic oligonucleotide
  Target: SCN9A; (+) strand; PAM type: NRG; PAM sequence: CAG
ataatcaatacttacattaa

SEQ ID NO: 41581 - DNA, 20 bp, Artificial Sequence
  Description of Artificial Sequence: Synthetic oligonucleotide
  Target: SCN9A; (+) strand; PAM type: NRG; PAM sequence: AAG
aataatcgtccatcccttaa

SEQ ID NO: 41582 - DNA, 20 bp, Artificial Sequence
  Description of Artificial Sequence: Synthetic oligonucleotide
  Target: SCN9A; (+) strand; PAM type: NRG; PAM sequence: AAG
atcccttaaaagttgccttt

SEQ ID NO: 41583 - DNA, 20 bp, Artificial Sequence
  Description of Artificial Sequence: Synthetic oligonucleotide
  Target: SCN9A; (+) strand; PAM type: NRG; PAM sequence: TAG
gcctttaagaataacattaa

SEQ ID NO: 41584 - DNA, 20 bp, Artificial Sequence
  Description of Artificial Sequence: Synthetic oligonucleotide
  Target: SCN9A; (+) strand; PAM type: NRG; PAM sequence: AAG
attaatagaatttgaatgtt

SEQ ID NO: 41585 - DNA, 20 bp, Artificial Sequence
  Description of Artificial Sequence: Synthetic oligonucleotide
  Target: SCN9A; (+) strand; PAM type: NRG; PAM sequence: TAG
gttaagctcatattctaaaa

SEQ ID NO: 41586 - DNA, 20 bp, Artificial Sequence
  Description of Artificial Sequence: Synthetic oligonucleotide
  Target: SCN9A; (+) strand; PAM type: NRG; PAM sequence: CAG
tattctaaaatagccataaa

SEQ ID NO: 41587 - DNA, 20 bp, Artificial Sequence
  Description of Artificial Sequence: Synthetic oligonucleotide
  Target: SCN9A; (+) strand; PAM type: NRG; PAM sequence: GAG
ttctaaaatagccataaaca

SEQ ID NO: 41588 - DNA, 20 bp, Artificial Sequence
  Description of Artificial Sequence: Synthetic oligonucleotide
  Target: SCN9A; (+) strand; PAM type: NRG; PAM sequence: AAG
ttaatgttaccacaattatt

SEQ ID NO: 41589 - DNA, 20 bp, Artificial Sequence
  Description of Artificial Sequence: Synthetic oligonucleotide
  Target: SCN9A; (+) strand; PAM type: NRG; PAM sequence: TAG
ccacaattattaagtaatac

SEQ ID NO: 41590 - DNA, 20 bp, Artificial Sequence
  Description of Artificial Sequence: Synthetic oligonucleotide
  Target: SCN9A; (+) strand; PAM type: NRG; PAM sequence: AAG
aattattaagtaatactagt

SEQ ID NO: 41591 - DNA, 20 bp, Artificial Sequence
  Description of Artificial Sequence: Synthetic oligonucleotide
  Target: SCN9A; (+) strand; PAM type: NRG; PAM sequence: AAG
caacatgtccatttaatgta

SEQ ID NO: 41592 - DNA, 20 bp, Artificial Sequence
  Description of Artificial Sequence: Synthetic oligonucleotide
  Target: SCN9A; (+) strand; PAM type: NRG; PAM sequence: AAG
aatgtaaagatttttttaaa

SEQ ID NO: 41593 - DNA, 20 bp, Artificial Sequence
  Description of Artificial Sequence: Synthetic oligonucleotide
  Target: SCN9A; (+) strand; PAM type: NRG; PAM sequence: AGG
atgtaaagatttttttaaaa

SEQ ID NO: 41594 - DNA, 20 bp, Artificial Sequence
  Description of Artificial Sequence: Synthetic oligonucleotide
  Target: SCN9A; (+) strand; PAM type: NRG; PAM sequence: AAG
tttaaaaaggacatattccc

SEQ ID NO: 41595 - DNA, 20 bp, Artificial Sequence
  Description of Artificial Sequence: Synthetic oligonucleotide
  Target: SCN9A; (+) strand; PAM type: NRG; PAM sequence: TAG
ccaagtaacattctaaatct

SEQ ID NO: 41596 - DNA, 20 bp, Artificial Sequence
  Description of Artificial Sequence: Synthetic oligonucleotide
  Target: SCN9A; (+) strand; PAM type: NRG; PAM sequence: CAG
aacattctaaatcttagtcc

SEQ ID NO: 41597 - DNA, 20 bp, Artificial Sequence
  Description of Artificial Sequence: Synthetic oligonucleotide
  Target: SCN9A; (+) strand; PAM type: NRG; PAM sequence: CAG
taattatttctaaattgtta

SEQ ID NO: 41598 - DNA, 20 bp, Artificial Sequence
  Description of Artificial Sequence: Synthetic oligonucleotide
  Target: SCN9A; (+) strand; PAM type: NRG; PAM sequence: AAG
acataaccttttatttttta

SEQ ID NO: 41599 - DNA, 20 bp, Artificial Sequence
  Description of Artificial Sequence: Synthetic oligonucleotide
  Target: SCN9A; (+) strand; PAM type: NRG; PAM sequence: AGG
cataaccttttattttttaa

SEQ ID NO: 41600 - DNA, 20 bp, Artificial Sequence
  Description of Artificial Sequence: Synthetic oligonucleotide
  Target: SCN9A; (+) strand; PAM type: NRG; PAM sequence: AAG
ccttttattttttaaaggtg

SEQ ID NO: 41601 - DNA, 20 bp, Artificial Sequence
  Description of Artificial Sequence: Synthetic oligonucleotide
  Target: SCN9A; (+) strand; PAM type: NRG; PAM sequence: AGG
cttttattttttaaaggtga

SEQ ID NO: 41602 - DNA, 20 bp, Artificial Sequence
  Description of Artificial Sequence: Synthetic oligonucleotide
  Target: SCN9A; (+) strand; PAM type: NRG; PAM sequence: AAG
tgaaggaaaattttatgaat

SEQ ID NO: 41603 - DNA, 20 bp, Artificial Sequence
  Description of Artificial Sequence: Synthetic oligonucleotide
  Target: SCN9A; (+) strand; PAM type: NRG; PAM sequence: CAG
ggaaaattttatgaataaga

SEQ ID NO: 41604 - DNA, 20 bp, Artificial Sequence
  Description of Artificial Sequence: Synthetic oligonucleotide
  Target: SCN9A; (+) strand; PAM type: NRG; PAM sequence: AGG
gaaaattttatgaataagac

SEQ ID NO: 41605 - DNA, 20 bp, Artificial Sequence
  Description of Artificial Sequence: Synthetic oligonucleotide
  Target: SCN9A; (+) strand; PAM type: NRG; PAM sequence: AAG
catcttttctccatttttta

SEQ ID NO: 41606 - DNA, 20 bp, Artificial Sequence
  Description of Artificial Sequence: Synthetic oligonucleotide
  Target: SCN9A; (+) strand; PAM type: NRG; PAM sequence: AGG
atcttttctccattttttaa

SEQ ID NO: 41607 - DNA, 20 bp, Artificial Sequence
  Description of Artificial Sequence: Synthetic oligonucleotide
  Target: SCN9A; (+) strand; PAM type: NRG; PAM sequence: GGG
tcttttctccattttttaaa

SEQ ID NO: 41608 - DNA, 20 bp, Artificial Sequence
  Description of Artificial Sequence: Synthetic oligonucleotide
  Target: SCN9A; (+) strand; PAM type: NRG; PAM sequence: TGG
taaagggttctccatgcctg

SEQ ID NO: 41609 - DNA, 20 bp, Artificial Sequence
  Description of Artificial Sequence: Synthetic oligonucleotide
  Target: SCN9A; (+) strand; PAM type: NRG; PAM sequence: GGG
aaagggttctccatgcctgt

SEQ ID NO: 41610 - DNA, 20 bp, Artificial Sequence
  Description of Artificial Sequence: Synthetic oligonucleotide
  Target: SCN9A; (+) strand; PAM type: NRG; PAM sequence: AAG
gggttctccatgcctgtggg

SEQ ID NO: 41611 - DNA, 20 bp, Artificial Sequence
  Description of Artificial Sequence: Synthetic oligonucleotide
  Target: SCN9A; (+) strand; PAM type: NRG; PAM sequence: TAG
aagttcctctcatcccttca

SEQ ID NO: 41612 - DNA, 20 bp, Artificial Sequence
  Description of Artificial Sequence: Synthetic oligonucleotide
  Target: SCN9A; (+) strand; PAM type: NRG; PAM sequence: AAG
tctcatcccttcatagtgtg

SEQ ID NO: 41613 - DNA, 20 bp, Artificial Sequence
  Description of Artificial Sequence: Synthetic oligonucleotide
  Target: SCN9A; (+) strand; PAM type: NRG; PAM sequence: CAG
catcccttcatagtgtgaag

SEQ ID NO: 41614 - DNA, 20 bp, Artificial Sequence
  Description of Artificial Sequence: Synthetic oligonucleotide
  Target: SCN9A; (+) strand; PAM type: NRG; PAM sequence: AGG
atcccttcatagtgtgaagc

SEQ ID NO: 41615 - DNA, 20 bp, Artificial Sequence
  Description of Artificial Sequence: Synthetic oligonucleotide
  Target: SCN9A; (+) strand; PAM type: NRG; PAM sequence: AAG
ccttcatagtgtgaagcagg

SEQ ID NO: 41616 - DNA, 20 bp, Artificial Sequence
  Description of Artificial Sequence: Synthetic oligonucleotide
  Target: SCN9A; (+) strand; PAM type: NRG; PAM sequence: AAG
ttcaaaaacgttcatttttg

SEQ ID NO: 41617 - DNA, 20 bp, Artificial Sequence
  Description of Artificial Sequence: Synthetic oligonucleotide
  Target: SCN9A; (+) strand; PAM type: NRG; PAM sequence: TGG
tttttgaagcaatatttgaa

SEQ ID NO: 41618 - DNA, 20 bp, Artificial Sequence
  Description of Artificial Sequence: Synthetic oligonucleotide
  Target: SCN9A; (+) strand; PAM type: NRG; PAM sequence: AAG
aagcaatatttgaatggtgc

SEQ ID NO: 41619 - DNA, 20 bp, Artificial Sequence
  Description of Artificial Sequence: Synthetic oligonucleotide
  Target: SCN9A; (+) strand; PAM type: NRG; PAM sequence: TGG
aatatttgaatggtgcaaga

SEQ ID NO: 41620 - DNA, 20 bp, Artificial Sequence
  Description of Artificial Sequence: Synthetic oligonucleotide
  Target: SCN9A; (+) strand; PAM type: NRG; PAM sequence: GGG
atatttgaatggtgcaagat

SEQ ID NO: 41621 - DNA, 20 bp, Artificial Sequence
  Description of Artificial Sequence: Synthetic oligonucleotide
  Target: SCN9A; (+) strand; PAM type: NRG; PAM sequence: GAG
atttgaatggtgcaagatgg

SEQ ID NO: 41622 - DNA, 20 bp, Artificial Sequence
  Description of Artificial Sequence: Synthetic oligonucleotide
  Target: SCN9A; (+) strand; PAM type: NRG; PAM sequence: AAG
tgggagtccacatgacacca

SEQ ID NO: 41623 - DNA, 20 bp, Artificial Sequence
  Description of Artificial Sequence: Synthetic oligonucleotide
  Target: SCN9A; (+) strand; PAM type: NRG; PAM sequence: GAG
ggagtccacatgacaccaaa

SEQ ID NO: 41624 - DNA, 20 bp, Artificial Sequence
  Description of Artificial Sequence: Synthetic oligonucleotide
  Target: SCN9A; (+) strand; PAM type: NRG; PAM sequence: CAG
aattaataactcaaatgcaa

SEQ ID NO: 41625 - DNA, 20 bp, Artificial Sequence
  Description of Artificial Sequence: Synthetic oligonucleotide
  Target: SCN9A; (+) strand; PAM type: NRG; PAM sequence: TAG
acccatgcttcttattcatg

SEQ ID NO: 41626 - DNA, 20 bp, Artificial Sequence
  Description of Artificial Sequence: Synthetic oligonucleotide
  Target: SCN9A; (+) strand; PAM type: NRG; PAM sequence: AGG
cccatgcttcttattcatgt

SEQ ID NO: 41627 - DNA, 20 bp, Artificial Sequence
  Description of Artificial Sequence: Synthetic oligonucleotide
  Target: SCN9A; (+) strand; PAM type: NRG; PAM sequence: TAG
attcatgtaggaacatgttc

SEQ ID NO: 41628 - DNA, 20 bp, Artificial Sequence
  Description of Artificial Sequence: Synthetic oligonucleotide
  Target: SCN9A; (+) strand; PAM type: NRG; PAM sequence: AGG
ttcatgtaggaacatgttct

SEQ ID NO: 41629 - DNA, 20 bp, Artificial Sequence
  Description of Artificial Sequence: Synthetic oligonucleotide
  Target: SCN9A; (+) strand; PAM type: NRG; PAM sequence: AAG
tgtaggaacatgttctagga

SEQ ID NO: 41630 - DNA, 20 bp, Artificial Sequence
  Description of Artificial Sequence: Synthetic oligonucleotide
  Target: SCN9A; (+) strand; PAM type: NRG; PAM sequence: GAG
tttttttttttttttttttt

SEQ ID NO: 41631 - DNA, 20 bp, Artificial Sequence
  Description of Artificial Sequence: Synthetic oligonucleotide
  Target: SCN9A; (+) strand; PAM type: NRG; PAM sequence: AAG
tttttttttttttttgagac

SEQ ID NO: 41632 - DNA, 20 bp, Artificial Sequence
  Description of Artificial Sequence: Synthetic oligonucleotide
  Target: SCN9A; (+) strand; PAM type: NRG; PAM sequence: GAG
tttttttttttttgagacaa

SEQ ID NO: 41633 - DNA, 20 bp, Artificial Sequence
  Description of Artificial Sequence: Synthetic oligonucleotide
  Target: SCN9A; (+) strand; PAM type: NRG; PAM sequence: TAG
gagacaagagtctcgctctg

SEQ ID NO: 41634 - DNA, 20 bp, Artificial Sequence
  Description of Artificial Sequence: Synthetic oligonucleotide
  Target: SCN9A; (+) strand; PAM type: NRG; PAM sequence: CAG
aagagtctcgctctgtagcc

SEQ ID NO: 41635 - DNA, 20 bp, Artificial Sequence
  Description of Artificial Sequence: Synthetic oligonucleotide
  Target: SCN9A; (+) strand; PAM type: NRG; PAM sequence: AGG
agagtctcgctctgtagccc

SEQ ID NO: 41636 - DNA, 20 bp, Artificial Sequence
  Description of Artificial Sequence: Synthetic oligonucleotide
  Target: SCN9A; (+) strand; PAM type: NRG; PAM sequence: TGG
tctcgctctgtagcccaggc

SEQ ID NO: 41637 - DNA, 20 bp, Artificial Sequence
  Description of Artificial Sequence: Synthetic oligonucleotide
  Target: SCN9A; (+) strand; PAM type: NRG; PAM sequence: GAG
tcgctctgtagcccaggctg

SEQ ID NO: 41638 - DNA, 20 bp, Artificial Sequence
  Description of Artificial Sequence: Synthetic oligonucleotide
  Target: SCN9A; (+) strand; PAM type: NRG; PAM sequence: CAG
ctgtagcccaggctggagtg

SEQ ID NO: 41639 - DNA, 20 bp, Artificial Sequence
  Description of Artificial Sequence: Synthetic oligonucleotide
  Target: SCN9A; (+) strand; PAM type: NRG; PAM sequence: TGG
tagcccaggctggagtgcag

SEQ ID NO: 41640 - DNA, 20 bp, Artificial Sequence
  Description of Artificial Sequence: Synthetic oligonucleotide
  Target: SCN9A; (+) strand; PAM type: NRG; PAM sequence: TGG
ggagtgcagtggcacgatct

SEQ ID NO: 41641 - DNA, 20 bp, Artificial Sequence
  Description of Artificial Sequence: Synthetic oligonucleotide
  Target: SCN9A; (+) strand; PAM type: NRG; PAM sequence: CAG
ccactgcaacctccgcctcc

SEQ ID NO: 41642 - DNA, 20 bp, Artificial Sequence
  Description of Artificial Sequence: Synthetic oligonucleotide
  Target: SCN9A; (+) strand; PAM type: NRG; PAM sequence: AGG
cactgcaacctccgcctccc

SEQ ID NO: 41643 - DNA, 20 bp, Artificial Sequence
  Description of Artificial Sequence: Synthetic oligonucleotide
  Target: SCN9A; (+) strand; PAM type: NRG; PAM sequence: CAG
ttcacgtgattctcctgcct

SEQ ID NO: 41644 - DNA, 20 bp, Artificial Sequence
  Description of Artificial Sequence: Synthetic oligonucleotide
  Target: SCN9A; (+) strand; PAM type: NRG; PAM sequence: AAG
ttctcctgcctcagcctccc

SEQ ID NO: 41645 - DNA, 20 bp, Artificial Sequence
  Description of Artificial Sequence: Synthetic oligonucleotide
  Target: SCN9A; (+) strand; PAM type: NRG; PAM sequence: CAG
tcctgcctcagcctcccaag

SEQ ID NO: 41646 - DNA, 20 bp, Artificial Sequence
  Description of Artificial Sequence: Synthetic oligonucleotide
  Target: SCN9A; (+) strand; PAM type: NRG; PAM sequence: TAG
gcctcagcctcccaagcagc

SEQ ID NO: 41647 - DNA, 20 bp, Artificial Sequence
  Description of Artificial Sequence: Synthetic oligonucleotide
  Target: SCN9A; (+) strand; PAM type: NRG; PAM sequence: AGG
cctcagcctcccaagcagct

SEQ ID NO: 41648 - DNA, 20 bp, Artificial Sequence
  Description of Artificial Sequence: Synthetic oligonucleotide
  Target: SCN9A; (+) strand; PAM type: NRG; PAM sequence: CAG
ctcccaagcagctaggatta

SEQ ID NO: 41649 - DNA, 20 bp, Artificial Sequence
  Description of Artificial Sequence: Synthetic oligonucleotide
  Target: SCN9A; (+) strand; PAM type: NRG; PAM sequence: AGG
tcccaagcagctaggattac

SEQ ID NO: 41650 - DNA, 20 bp, Artificial Sequence
  Description of Artificial Sequence: Synthetic oligonucleotide
  Target: SCN9A; (+) strand; PAM type: NRG; PAM sequence: CAG
caggcgcctgccaccacacc

SEQ ID NO: 41651 - DNA, 20 bp, Artificial Sequence
  Description of Artificial Sequence: Synthetic oligonucleotide
  Target: SCN9A; (+) strand; PAM type: NRG; PAM sequence: TAG
agctaatttttttgtatttt

SEQ ID NO: 41652 - DNA, 20 bp, Artificial Sequence
  Description of Artificial Sequence: Synthetic oligonucleotide
  Target: SCN9A; (+) strand; PAM type: NRG; PAM sequence: TAG
taatttttttgtatttttag

SEQ ID NO: 41653 - DNA, 20 bp, Artificial Sequence
  Description of Artificial Sequence: Synthetic oligonucleotide
  Target: SCN9A; (+) strand; PAM type: NRG; PAM sequence: GAG
atttttttgtatttttagta

SEQ ID NO: 41654 - DNA, 20 bp, Artificial Sequence
  Description of Artificial Sequence: Synthetic oligonucleotide
  Target: SCN9A; (+) strand; PAM type: NRG; PAM sequence: TGG
ttttgtatttttagtagaga

SEQ ID NO: 41655 - DNA, 20 bp, Artificial Sequence
  Description of Artificial Sequence: Synthetic oligonucleotide
  Target: SCN9A; (+) strand; PAM type: NRG; PAM sequence: GGG
tttgtatttttagtagagat

SEQ ID NO: 41656 - DNA, 20 bp, Artificial Sequence
  Description of Artificial Sequence: Synthetic oligonucleotide
  Target: SCN9A; (+) strand; PAM type: NRG; PAM sequence: GGG
ttgtatttttagtagagatg

SEQ ID NO: 41657 - DNA, 20 bp, Artificial Sequence
  Description of Artificial Sequence: Synthetic oligonucleotide
  Target: SCN9A; (+) strand; PAM type: NRG; PAM sequence: TGG
gagatggggtttcactatgt

SEQ ID NO: 41658 - DNA, 20 bp, Artificial Sequence
  Description of Artificial Sequence: Synthetic oligonucleotide
  Target: SCN9A; (+) strand; PAM type: NRG; PAM sequence: CAG
tggggtttcactatgttggc

SEQ ID NO: 41659 - DNA, 20 bp, Artificial Sequence
  Description of Artificial Sequence: Synthetic oligonucleotide
  Target: SCN9A; (+) strand; PAM type: NRG; PAM sequence: TGG
tttcactatgttggccagac

SEQ ID NO: 41660 - DNA, 20 bp, Artificial Sequence
  Description of Artificial Sequence: Synthetic oligonucleotide
  Target: SCN9A; (+) strand; PAM type: NRG; PAM sequence: TGG
acctcatgatctgcccacct

SEQ ID NO: 41661 - DNA, 20 bp, Artificial Sequence
  Description of Artificial Sequence: Synthetic oligonucleotide
  Target: SCN9A; (+) strand; PAM type: NRG; PAM sequence: AAG
ctgcccaccttggcctccca

SEQ ID NO: 41662 - DNA, 20 bp, Artificial Sequence
  Description of Artificial Sequence: Synthetic oligonucleotide
  Target: SCN9A; (+) strand; PAM type: NRG; PAM sequence: AAG
caccttggcctcccaaagtg

SEQ ID NO: 41663 - DNA, 20 bp, Artificial Sequence
  Description of Artificial Sequence: Synthetic oligonucleotide
  Target: SCN9A; (+) strand; PAM type: NRG; PAM sequence: GAG
ccttggcctcccaaagtgaa

SEQ ID NO: 41664 - DNA, 20 bp, Artificial Sequence
  Description of Artificial Sequence: Synthetic oligonucleotide
  Target: SCN9A; (+) strand; PAM type: NRG; PAM sequence: CAG
ctcccaaagtgaagagacta

SEQ ID NO: 41665 - DNA, 20 bp, Artificial Sequence
  Description of Artificial Sequence: Synthetic oligonucleotide
  Target: SCN9A; (+) strand; PAM type: NRG; PAM sequence: AGG
tcccaaagtgaagagactac

SEQ ID NO: 41666 - DNA, 20 bp, Artificial Sequence
  Description of Artificial Sequence: Synthetic oligonucleotide
  Target: SCN9A; (+) strand; PAM type: NRG; PAM sequence: GAG
agtgaagagactacaggcat

SEQ ID NO: 41667 - DNA, 20 bp, Artificial Sequence
  Description of Artificial Sequence: Synthetic oligonucleotide
  Target: SCN9A; (+) strand; PAM type: NRG; PAM sequence: CGG
caggcatgagccactgcgcc

SEQ ID NO: 41668 - DNA, 20 bp, Artificial Sequence
  Description of Artificial Sequence: Synthetic oligonucleotide
  Target: SCN9A; (+) strand; PAM type: NRG; PAM sequence: AAG
atgagccactgcgcccggcc

SEQ ID NO: 41669 - DNA, 20 bp, Artificial Sequence
  Description of Artificial Sequence: Synthetic oligonucleotide
  Target: SCN9A; (+) strand; PAM type: NRG; PAM sequence: TGG
ccactgcgcccggccaagac

SEQ ID NO: 41670 - DNA, 20 bp, Artificial Sequence
  Description of Artificial Sequence: Synthetic oligonucleotide
  Target: SCN9A; (+) strand; PAM type: NRG; PAM sequence: CAG
gcactgttttaaaaaccaca

SEQ ID NO: 41671 - DNA, 20 bp, Artificial Sequence
  Description of Artificial Sequence: Synthetic oligonucleotide
  Target: SCN9A; (+) strand; PAM type: NRG; PAM sequence: AAG
tataattaatatactattta

SEQ ID NO: 41672 - DNA, 20 bp, Artificial Sequence
  Description of Artificial Sequence: Synthetic oligonucleotide
  Target: SCN9A; (+) strand; PAM type: NRG; PAM sequence: AAG
ccaatatctattaaaatacc

SEQ ID NO: 41673 - DNA, 20 bp, Artificial Sequence
  Description of Artificial Sequence: Synthetic oligonucleotide
  Target: SCN9A; (+) strand; PAM type: NRG; PAM sequence: TGG
aataccaagcactcatgaaa

SEQ ID NO: 41674 - DNA, 20 bp, Artificial Sequence
  Description of Artificial Sequence: Synthetic oligonucleotide
  Target: SCN9A; (+) strand; PAM type: NRG; PAM sequence: GGG
ataccaagcactcatgaaat

SEQ ID NO: 41675 - DNA, 20 bp, Artificial Sequence
  Description of Artificial Sequence: Synthetic oligonucleotide
  Target: SCN9A; (+) strand; PAM type: NRG; PAM sequence: AAG
aatgggacacttacaacttg

SEQ ID NO: 41676 - DNA, 20 bp, Artificial Sequence
  Description of Artificial Sequence: Synthetic oligonucleotide
  Target: SCN9A; (+) strand; PAM type: NRG; PAM sequence: CAG
gggacacttacaacttgaag

SEQ ID NO: 41677 - DNA, 20 bp, Artificial Sequence
  Description of Artificial Sequence: Synthetic oligonucleotide
  Target: SCN9A; (+) strand; PAM type: NRG; PAM sequence: GAG
gacacttacaacttgaagca

SEQ ID NO: 41678 - DNA, 20 bp, Artificial Sequence
  Description of Artificial Sequence: Synthetic oligonucleotide
  Target: SCN9A; (+) strand; PAM type: NRG; PAM sequence: TAG
cttacaacttgaagcagaga

SEQ ID NO: 41679 - DNA, 20 bp, Artificial Sequence
  Description of Artificial Sequence: Synthetic oligonucleotide
  Target: SCN9A; (+) strand; PAM type: NRG; PAM sequence: AGG
ttacaacttgaagcagagat

SEQ ID NO: 41680 - DNA, 20 bp, Artificial Sequence
  Description of Artificial Sequence: Synthetic oligonucleotide
  Target: SCN9A; (+) strand; PAM type: NRG; PAM sequence: AAG
tgaagcagagataggtaacc

SEQ ID NO: 41681 - DNA, 20 bp, Artificial Sequence
  Description of Artificial Sequence: Synthetic oligonucleotide
  Target: SCN9A; (+) strand; PAM type: NRG; PAM sequence: AAG
aaccaagtccgacattatca

SEQ ID NO: 41682 - DNA, 20 bp, Artificial Sequence
  Description of Artificial Sequence: Synthetic oligonucleotide
  Target: SCN9A; (+) strand; PAM type: NRG; PAM sequence: CAG
acattatcaaagttcacttt

SEQ ID NO: 41683 - DNA, 20 bp, Artificial Sequence
  Description of Artificial Sequence: Synthetic oligonucleotide
  Target: SCN9A; (+) strand; PAM type: NRG; PAM sequence: AGG
cattatcaaagttcactttc

SEQ ID NO: 41684 - DNA, 20 bp, Artificial Sequence
  Description of Artificial Sequence: Synthetic oligonucleotide
  Target: SCN9A; (+) strand; PAM type: NRG; PAM sequence: AAG
acattttgactaacattcat

SEQ ID NO: 41685 - DNA, 20 bp, Artificial Sequence
  Description of Artificial Sequence: Synthetic oligonucleotide
  Target: SCN9A; (+) strand; PAM type: NRG; PAM sequence: AGG
cattttgactaacattcata

SEQ ID NO: 41686 - DNA, 20 bp, Artificial Sequence
  Description of Artificial Sequence: Synthetic oligonucleotide
  Target: SCN9A; (+) strand; PAM type: NRG; PAM sequence: GGG
attttgactaacattcataa

SEQ ID NO: 41687 - DNA, 20 bp, Artificial Sequence
  Description of Artificial Sequence: Synthetic oligonucleotide
  Target: SCN9A; (+) strand; PAM type: NRG; PAM sequence: CGG
attcataagggcaaaacatt

SEQ ID NO: 41688 - DNA, 20 bp, Artificial Sequence
  Description of Artificial Sequence: Synthetic oligonucleotide
  Target: SCN9A; (+) strand; PAM type: NRG; PAM sequence: TGG
gcaaaacattcggaacgatt

SEQ ID NO: 41689 - DNA, 20 bp, Artificial Sequence
  Description of Artificial Sequence: Synthetic oligonucleotide
  Target: SCN9A; (+) strand; PAM type: NRG; PAM sequence: CAG
acgatttggaacttgacttg

SEQ ID NO: 41690 - DNA, 20 bp, Artificial Sequence
  Description of Artificial Sequence: Synthetic oligonucleotide
  Target: SCN9A; (+) strand; PAM type: NRG; PAM sequence: AGG
cgatttggaacttgacttgc

SEQ ID NO: 41691 - DNA, 20 bp, Artificial Sequence
  Description of Artificial Sequence: Synthetic oligonucleotide
  Target: SCN9A; (+) strand; PAM type: NRG; PAM sequence: TGG
aggaaaccgtgacccatctg

SEQ ID NO: 41692 - DNA, 20 bp, Artificial Sequence
  Description of Artificial Sequence: Synthetic oligonucleotide
  Target: SCN9A; (+) strand; PAM type: NRG; PAM sequence: TAG
ctgtggtgttaatacactca

SEQ ID NO: 41693 - DNA, 20 bp, Artificial Sequence
  Description of Artificial Sequence: Synthetic oligonucleotide
  Target: SCN9A; (+) strand; PAM type: NRG; PAM sequence: CAG
aatacactcatagaacttgc

SEQ ID NO: 41694 - DNA, 20 bp, Artificial Sequence
  Description of Artificial Sequence: Synthetic oligonucleotide
  Target: SCN9A; (+) strand; PAM type: NRG; PAM sequence: CAG
actcccatgatgctgaatat

SEQ ID NO: 41695 - DNA, 20 bp, Artificial Sequence
  Description of Artificial Sequence: Synthetic oligonucleotide
  Target: SCN9A; (+) strand; PAM type: NRG; PAM sequence: CAG
ccatgatgctgaatatcagc

SEQ ID NO: 41696 - DNA, 20 bp, Artificial Sequence
  Description of Artificial Sequence: Synthetic oligonucleotide
  Target: SCN9A; (+) strand; PAM type: NRG; PAM sequence: AAG
ctgaatatcagccagaatat

SEQ ID NO: 41697 - DNA, 20 bp, Artificial Sequence
  Description of Artificial Sequence: Synthetic oligonucleotide
  Target: SCN9A; (+) strand; PAM type: NRG; PAM sequence: AAG
agccagaatataagacacac

SEQ ID NO: 41698 - DNA, 20 bp, Artificial Sequence
  Description of Artificial Sequence: Synthetic oligonucleotide
  Target: SCN9A; (+) strand; PAM type: NRG; PAM sequence: TAG
cagaatataagacacacaag

SEQ ID NO: 41699 - DNA, 20 bp, Artificial Sequence
  Description of Artificial Sequence: Synthetic oligonucleotide
  Target: SCN9A; (+) strand; PAM type: NRG; PAM sequence: TGG
cacaagtagcacattcatga

SEQ ID NO: 41700 - DNA, 20 bp, Artificial Sequence
  Description of Artificial Sequence: Synthetic oligonucleotide
  Target: SCN9A; (+) strand; PAM type: NRG; PAM sequence: AAG
aagtagcacattcatgatgg

SEQ ID NO: 41701 - DNA, 20 bp, Artificial Sequence
  Description of Artificial Sequence: Synthetic oligonucleotide
  Target: SCN9A; (+) strand; PAM type: NRG; PAM sequence: AGG
agtagcacattcatgatgga

SEQ ID NO: 41702 - DNA, 20 bp, Artificial Sequence
  Description of Artificial Sequence: Synthetic oligonucleotide
  Target: SCN9A; (+) strand; PAM type: NRG; PAM sequence: GAG
atggaaggaattgctcctat

SEQ ID NO: 41703 - DNA, 20 bp, Artificial Sequence
  Description of Artificial Sequence: Synthetic oligonucleotide
  Target: SCN9A; (+) strand; PAM type: NRG; PAM sequence: TAG
tgagtgcattcacaacgacc

SEQ ID NO: 41704 - DNA, 20 bp, Artificial Sequence
  Description of Artificial Sequence: Synthetic oligonucleotide
  Target: SCN9A; (+) strand; PAM type: NRG; PAM sequence: AAG
cacaacgacctagtattcaa

SEQ ID NO: 41705 - DNA, 20 bp, Artificial Sequence
  Description of Artificial Sequence: Synthetic oligonucleotide
  Target: SCN9A; (+) strand; PAM type: NRG; PAM sequence: AAG
acgacctagtattcaaaaga

SEQ ID NO: 41706 - DNA, 20 bp, Artificial Sequence
  Description of Artificial Sequence: Synthetic oligonucleotide
  Target: SCN9A; (+) strand; PAM type: NRG; PAM sequence: AAG
ctagtattcaaaagaaagaa

SEQ ID NO: 41707 - DNA, 20 bp, Artificial Sequence
  Description of Artificial Sequence: Synthetic oligonucleotide
  Target: SCN9A; (+) strand; PAM type: NRG; PAM sequence: TAG
aaaagaaagaaaagcatgat

SEQ ID NO: 41708 - DNA, 20 bp, Artificial Sequence
  Description of Artificial Sequence: Synthetic oligonucleotide
  Target: SCN9A; (+) strand; PAM type: NRG; PAM sequence: AGG
aaagaaagaaaagcatgatt

SEQ ID NO: 41709 - DNA, 20 bp, Artificial Sequence
  Description of Artificial Sequence: Synthetic oligonucleotide
  Target: SCN9A; (+) strand; PAM type: NRG; PAM sequence: TAG
aagaaaagcatgattaggat

SEQ ID NO: 41710 - DNA, 20 bp, Artificial Sequence
  Description of Artificial Sequence: Synthetic oligonucleotide
  Target: SCN9A; (+) strand; PAM type: NRG; PAM sequence: AAG
aaagcatgattaggattagt

SEQ ID NO: 41711 - DNA, 20 bp, Artificial Sequence
  Description of Artificial Sequence: Synthetic oligonucleotide
  Target: SCN9A; (+) strand; PAM type: NRG; PAM sequence: TAG
aggattagtaagatgttaaa

SEQ ID NO: 41712 - DNA, 20 bp, Artificial Sequence
  Description of Artificial Sequence: Synthetic oligonucleotide
  Target: SCN9A; (+) strand; PAM type: NRG; PAM sequence: AGG
ggattagtaagatgttaaat

SEQ ID NO: 41713 - DNA, 20 bp, Artificial Sequence
  Description of Artificial Sequence: Synthetic oligonucleotide
  Target: SCN9A; (+) strand; PAM type: NRG; PAM sequence: AAG
atgttaaataggcaacatga

SEQ ID NO: 41714 - DNA, 20 bp, Artificial Sequence
  Description of Artificial Sequence: Synthetic oligonucleotide
  Target: SCN9A; (+) strand; PAM type: NRG; PAM sequence: CAG
aacatgaaagaaatgccatg

SEQ ID NO: 41715 - DNA, 20 bp, Artificial Sequence
  Description of Artificial Sequence: Synthetic oligonucleotide
  Target: SCN9A; (+) strand; PAM type: NRG; PAM sequence: TAG
ccatgcagacataaataaat

SEQ ID NO: 41716 - DNA, 20 bp, Artificial Sequence
  Description of Artificial Sequence: Synthetic oligonucleotide
  Target: SCN9A; (+) strand; PAM type: NRG; PAM sequence: AAG
cagacataaataaattagaa

SEQ ID NO: 41717 - DNA, 20 bp, Artificial Sequence
  Description of Artificial Sequence: Synthetic oligonucleotide
  Target: SCN9A; (+) strand; PAM type: NRG; PAM sequence: AAG
aaagccgcccttaaatatct

SEQ ID NO: 41718 - DNA, 20 bp, Artificial Sequence
  Description of Artificial Sequence: Synthetic oligonucleotide
  Target: SCN9A; (+) strand; PAM type: NRG; PAM sequence: CAG
atctaagacatcaaaccaac

SEQ ID NO: 41719 - DNA, 20 bp, Artificial Sequence
  Description of Artificial Sequence: Synthetic oligonucleotide
  Target: SCN9A; (+) strand; PAM type: NRG; PAM sequence: CAG
ttaaatgcctactctacact

SEQ ID NO: 41720 - DNA, 20 bp, Artificial Sequence
  Description of Artificial Sequence: Synthetic oligonucleotide
  Target: SCN9A; (+) strand; PAM type: NRG; PAM sequence: CAG
aatgcctactctacactcag

SEQ ID NO: 41721 - DNA, 20 bp, Artificial Sequence
  Description of Artificial Sequence: Synthetic oligonucleotide
  Target: SCN9A; (+) strand; PAM type: NRG; PAM sequence: AAG
tctacactcagcagtgtgcc

SEQ ID NO: 41722 - DNA, 20 bp, Artificial Sequence
  Description of Artificial Sequence: Synthetic oligonucleotide
  Target: SCN9A; (+) strand; PAM type: NRG; PAM sequence: AAG
cactcagcagtgtgccaagc

SEQ ID NO: 41723 - DNA, 20 bp, Artificial Sequence
  Description of Artificial Sequence: Synthetic oligonucleotide
  Target: SCN9A; (+) strand; PAM type: NRG; PAM sequence: AAG
tgtgccaagcaagacaaaat

SEQ ID NO: 41724 - DNA, 20 bp, Artificial Sequence
  Description of Artificial Sequence: Synthetic oligonucleotide
  Target: SCN9A; (+) strand; PAM type: NRG; PAM sequence: CAG
gacatgaactctgtgatcac

SEQ ID NO: 41725 - DNA, 20 bp, Artificial Sequence
  Description of Artificial Sequence: Synthetic oligonucleotide
  Target: SCN9A; (+) strand; PAM type: NRG; PAM sequence: AGG
acatgaactctgtgatcacc

SEQ ID NO: 41726 - DNA, 20 bp, Artificial Sequence
  Description of Artificial Sequence: Synthetic oligonucleotide
  Target: SCN9A; (+) strand; PAM type: NRG; PAM sequence: TAG
ttatcacacaataaaattgt

SEQ ID NO: 41727 - DNA, 20 bp, Artificial Sequence
  Description of Artificial Sequence: Synthetic oligonucleotide
  Target: SCN9A; (+) strand; PAM type: NRG; PAM sequence: AAG
taaaattgttagcaaaatat

SEQ ID NO: 41728 - DNA, 20 bp, Artificial Sequence
  Description of Artificial Sequence: Synthetic oligonucleotide
  Target: SCN9A; (+) strand; PAM type: NRG; PAM sequence: AAG
aaatataagacaaaataact

SEQ ID NO: 41729 - DNA, 20 bp, Artificial Sequence
  Description of Artificial Sequence: Synthetic oligonucleotide
  Target: SCN9A; (+) strand; PAM type: NRG; PAM sequence: TAG
aaataactaagataatataa

SEQ ID NO: 41730 - DNA, 20 bp, Artificial Sequence
  Description of Artificial Sequence: Synthetic oligonucleotide
  Target: SCN9A; (+) strand; PAM type: NRG; PAM sequence: AAG
aaccaaaacctgttattgat

SEQ ID NO: 41731 - DNA, 20 bp, Artificial Sequence
  Description of Artificial Sequence: Synthetic oligonucleotide
  Target: SCN9A; (+) strand; PAM type: NRG; PAM sequence: AGG
accaaaacctgttattgata

SEQ ID NO: 41732 - DNA, 20 bp, Artificial Sequence
  Description of Artificial Sequence: Synthetic oligonucleotide
  Target: SCN9A; (+) strand; PAM type: NRG; PAM sequence: TGG
cttgtaaaatctgtacactc

SEQ ID NO: 41733 - DNA, 20 bp, Artificial Sequence
  Description of Artificial Sequence: Synthetic oligonucleotide
  Target: SCN9A; (+) strand; PAM type: NRG; PAM sequence: AAG
tctgtacactctggaaaaaa

SEQ ID NO: 41734 - DNA, 20 bp, Artificial Sequence
  Description of Artificial Sequence: Synthetic oligonucleotide
  Target: SCN9A; (+) strand; PAM type: NRG; PAM sequence: CAG
gttcatgatcctattattac

SEQ ID NO: 41735 - DNA, 20 bp, Artificial Sequence
  Description of Artificial Sequence: Synthetic oligonucleotide
  Target: SCN9A; (+) strand; PAM type: NRG; PAM sequence: AAG
tcctattattaccagcatta

SEQ ID NO: 41736 - DNA, 20 bp, Artificial Sequence
  Description of Artificial Sequence: Synthetic oligonucleotide
  Target: SCN9A; (+) strand; PAM type: NRG; PAM sequence: TAG
cagcattaaagattccccca

SEQ ID NO: 41737 - DNA, 20 bp, Artificial Sequence
  Description of Artificial Sequence: Synthetic oligonucleotide
  Target: SCN9A; (+) strand; PAM type: NRG; PAM sequence: GAG
gcattaaagattcccccata

SEQ ID NO: 41738 - DNA, 20 bp, Artificial Sequence
  Description of Artificial Sequence: Synthetic oligonucleotide
  Target: SCN9A; (+) strand; PAM type: NRG; PAM sequence: TGG
ttcccccatagagaaactat

SEQ ID NO: 41739 - DNA, 20 bp, Artificial Sequence
  Description of Artificial Sequence: Synthetic oligonucleotide
  Target: SCN9A; (+) strand; PAM type: NRG; PAM sequence: CAG
gagaaactattggtgtatat

SEQ ID NO: 41740 - DNA, 20 bp, Artificial Sequence
  Description of Artificial Sequence: Synthetic oligonucleotide
  Target: SCN9A; (+) strand; PAM type: NRG; PAM sequence: AGG
agaaactattggtgtatatc

SEQ ID NO: 41741 - DNA, 20 bp, Artificial Sequence
  Description of Artificial Sequence: Synthetic oligonucleotide
  Target: SCN9A; (+) strand; PAM type: NRG; PAM sequence: TAG
aactattggtgtatatcagg

SEQ ID NO: 41742 - DNA, 20 bp, Artificial Sequence
  Description of Artificial Sequence: Synthetic oligonucleotide
  Target: SCN9A; (+) strand; PAM type: NRG; PAM sequence: AGG
actattggtgtatatcaggt

SEQ ID NO: 41743 - DNA, 20 bp, Artificial Sequence
  Description of Artificial Sequence: Synthetic oligonucleotide
  Target: SCN9A; (+) strand; PAM type: NRG; PAM sequence: TGG
attggtgtatatcaggtagg

SEQ ID NO: 41744 - DNA, 20 bp, Artificial Sequence
  Description of Artificial Sequence: Synthetic oligonucleotide
  Target: SCN9A; (+) strand; PAM type: NRG; PAM sequence: TGG
caggtaggtggaattatgac

SEQ ID NO: 41745 - DNA, 20 bp, Artificial Sequence
  Description of Artificial Sequence: Synthetic oligonucleotide
  Target: SCN9A; (+) strand; PAM type: NRG; PAM sequence: GAG
ttttcttattctcttttttt

SEQ ID NO: 41746 - DNA, 20 bp, Artificial Sequence
  Description of Artificial Sequence: Synthetic oligonucleotide
  Target: SCN9A; (+) strand; PAM type: NRG; PAM sequence: AAG
ttttgagacattctccacaa

SEQ ID NO: 41747 - DNA, 20 bp, Artificial Sequence
  Description of Artificial Sequence: Synthetic oligonucleotide
  Target: SCN9A; (+) strand; PAM type: NRG; PAM sequence: AGG
tttgagacattctccacaaa

SEQ ID NO: 41748 - DNA, 20 bp, Artificial Sequence
  Description of Artificial Sequence: Synthetic oligonucleotide
  Target: SCN9A; (+) strand; PAM type: NRG; PAM sequence: GAG
acattctccacaaaaggatt

SEQ ID NO: 41749 - DNA, 20 bp, Artificial Sequence
  Description of Artificial Sequence: Synthetic oligonucleotide
  Target: SCN9A; (+) strand; PAM type: NRG; PAM sequence: TGG
aaggattgagaatctttaaa

SEQ ID NO: 41750 - DNA, 20 bp, Artificial Sequence
  Description of Artificial Sequence: Synthetic oligonucleotide
  Target: SCN9A; (+) strand; PAM type: NRG; PAM sequence: TAG
tttaaatggtttaaatcctt

SEQ ID NO: 41751 - DNA, 20 bp, Artificial Sequence
  Description of Artificial Sequence: Synthetic oligonucleotide
  Target: SCN9A; (+) strand; PAM type: NRG; PAM sequence: TGG
tggtttaaatcctttagatt

SEQ ID NO: 41752 - DNA, 20 bp, Artificial Sequence
  Description of Artificial Sequence: Synthetic oligonucleotide
  Target: SCN9A; (+) strand; PAM type: NRG; PAM sequence: TGG
ttaaatcctttagatttggc

SEQ ID NO: 41753 - DNA, 20 bp, Artificial Sequence
  Description of Artificial Sequence: Synthetic oligonucleotide
  Target: SCN9A; (+) strand; PAM type: NRG; PAM sequence: AAG
tttggctggttctacgaaat

SEQ ID NO: 41754 - DNA, 20 bp, Artificial Sequence
  Description of Artificial Sequence: Synthetic oligonucleotide
  Target: SCN9A; (+) strand; PAM type: NRG; PAM sequence: GAG
tggctggttctacgaaataa

SEQ ID NO: 41755 - DNA, 20 bp, Artificial Sequence
  Description of Artificial Sequence: Synthetic oligonucleotide
  Target: SCN9A; (+) strand; PAM type: NRG; PAM sequence: AAG
actctaaatactttatatgt

SEQ ID NO: 41756 - DNA, 20 bp, Artificial Sequence
  Description of Artificial Sequence: Synthetic oligonucleotide
  Target: SCN9A; (+) strand; PAM type: NRG; PAM sequence: TAG
agcctttgactaaatatata

SEQ ID NO: 41757 - DNA, 20 bp, Artificial Sequence
  Description of Artificial Sequence: Synthetic oligonucleotide
  Target: SCN9A; (+) strand; PAM type: NRG; PAM sequence: TGG
tgactaaatatatatagtgc

SEQ ID NO: 41758 - DNA, 20 bp, Artificial Sequence
  Description of Artificial Sequence: Synthetic oligonucleotide
  Target: SCN9A; (+) strand; PAM type: NRG; PAM sequence: CAG
aatatatatagtgctggcct

SEQ ID NO: 41759 - DNA, 20 bp, Artificial Sequence
  Description of Artificial Sequence: Synthetic oligonucleotide
  Target: SCN9A; (+) strand; PAM type: NRG; PAM sequence: AAG
atatagtgctggcctcagtt

SEQ ID NO: 41760 - DNA, 20 bp, Artificial Sequence
  Description of Artificial Sequence: Synthetic oligonucleotide
  Target: SCN9A; (+) strand; PAM type: NRG; PAM sequence: TAG
gcctcagttaagacaaaaat

SEQ ID NO: 41761 - DNA, 20 bp, Artificial Sequence
  Description of Artificial Sequence: Synthetic oligonucleotide
  Target: SCN9A; (+) strand; PAM type: NRG; PAM sequence: AGG
cctcagttaagacaaaaatt

SEQ ID NO: 41762 - DNA, 20 bp, Artificial Sequence
  Description of Artificial Sequence: Synthetic oligonucleotide
  Target: SCN9A; (+) strand; PAM type: NRG; PAM sequence: CAG
gttaagacaaaaattaggaa

SEQ ID NO: 41763 - DNA, 20 bp, Artificial Sequence
  Description of Artificial Sequence: Synthetic oligonucleotide
  Target: SCN9A; (+) strand; PAM type: NRG; PAM sequence: CAG
ctttctttatttctgctttt

SEQ ID NO: 41764 - DNA, 20 bp, Artificial Sequence
  Description of Artificial Sequence: Synthetic oligonucleotide
  Target: SCN9A; (+) strand; PAM type: NRG; PAM sequence: CAG
tttgtactgctattgatcac

SEQ ID NO: 41765 - DNA, 20 bp, Artificial Sequence
  Description of Artificial Sequence: Synthetic oligonucleotide
  Target: SCN9A; (+) strand; PAM type: NRG; PAM sequence: CAG
ccagtttgtctttgccactc

SEQ ID NO: 41766 - DNA, 20 bp, Artificial Sequence
  Description of Artificial Sequence: Synthetic oligonucleotide
  Target: SCN9A; (+) strand; PAM type: NRG; PAM sequence: CAG
ttgccactccagttttcatc

SEQ ID NO: 41767 - DNA, 20 bp, Artificial Sequence
  Description of Artificial Sequence: Synthetic oligonucleotide
  Target: SCN9A; (+) strand; PAM type: NRG; PAM sequence: AGG
tgccactccagttttcatcc

SEQ ID NO: 41768 - DNA, 20 bp, Artificial Sequence
  Description of Artificial Sequence: Synthetic oligonucleotide
  Target: SCN9A; (+) strand; PAM type: NRG; PAM sequence: GGG
gccactccagttttcatcca

SEQ ID NO: 41769 - DNA, 20 bp, Artificial Sequence
  Description of Artificial Sequence: Synthetic oligonucleotide
  Target: SCN9A; (+) strand; PAM type: NRG; PAM sequence: TGG
ttcatccagggcaattcctg

SEQ ID NO: 41770 - DNA, 20 bp, Artificial Sequence
  Description of Artificial Sequence: Synthetic oligonucleotide
  Target: SCN9A; (+) strand; PAM type: NRG; PAM sequence: CAG
ctgtggcatttaacactctc

SEQ ID NO: 41771 - DNA, 20 bp, Artificial Sequence
  Description of Artificial Sequence: Synthetic oligonucleotide
  Target: SCN9A; (+) strand; PAM type: NRG; PAM sequence: CAG
ctacctgtcatcttacactt

SEQ ID NO: 41772 - DNA, 20 bp, Artificial Sequence
  Description of Artificial Sequence: Synthetic oligonucleotide
  Target: SCN9A; (+) strand; PAM type: NRG; PAM sequence: GAG
gtcatcttacacttcagctt

SEQ ID NO: 41773 - DNA, 20 bp, Artificial Sequence
  Description of Artificial Sequence: Synthetic oligonucleotide
  Target: SCN9A; (+) strand; PAM type: NRG; PAM sequence: AAG
ttcagcttgagcacccattc

SEQ ID NO: 41774 - DNA, 20 bp, Artificial Sequence
  Description of Artificial Sequence: Synthetic oligonucleotide
  Target: SCN9A; (+) strand; PAM type: NRG; PAM sequence: AAG
attcaagtacaaatgtgtta

SEQ ID NO: 41775 - DNA, 20 bp, Artificial Sequence
  Description of Artificial Sequence: Synthetic oligonucleotide
  Target: SCN9A; (+) strand; PAM type: NRG; PAM sequence: TAG
tgtgttaaagattaacctgt

SEQ ID NO: 41776 - DNA, 20 bp, Artificial Sequence
  Description of Artificial Sequence: Synthetic oligonucleotide
  Target: SCN9A; (+) strand; PAM type: NRG; PAM sequence: AGG
gtgttaaagattaacctgtt

SEQ ID NO: 41777 - DNA, 20 bp, Artificial Sequence
  Description of Artificial Sequence: Synthetic oligonucleotide
  Target: SCN9A; (+) strand; PAM type: NRG; PAM sequence: GGG
tgttaaagattaacctgtta

SEQ ID NO: 41778 - DNA, 20 bp, Artificial Sequence
  Description of Artificial Sequence: Synthetic oligonucleotide
  Target: SCN9A; (+) strand; PAM type: NRG; PAM sequence: AAG
taaagattaacctgttaggg

SEQ ID NO: 41779 - DNA, 20 bp, Artificial Sequence
  Description of Artificial Sequence: Synthetic oligonucleotide
  Target: SCN9A; (+) strand; PAM type: NRG; PAM sequence: AGG
aaagattaacctgttaggga

SEQ ID NO: 41780 - DNA, 20 bp, Artificial Sequence
  Description of Artificial Sequence: Synthetic oligonucleotide
  Target: SCN9A; (+) strand; PAM type: NRG; PAM sequence: GAG
agattaacctgttagggaag

SEQ ID NO: 41781 - DNA, 20 bp, Artificial Sequence
  Description of Artificial Sequence: Synthetic oligonucleotide
  Target: SCN9A; (+) strand; PAM type: NRG; PAM sequence: TGG
acctgttagggaaggagcac

SEQ ID NO: 41782 - DNA, 20 bp, Artificial Sequence
  Description of Artificial Sequence: Synthetic oligonucleotide
  Target: SCN9A; (+) strand; PAM type: NRG; PAM sequence: GGG
cctgttagggaaggagcact

SEQ ID NO: 41783 - DNA, 20 bp, Artificial Sequence
  Description of Artificial Sequence: Synthetic oligonucleotide
  Target: SCN9A; (+) strand; PAM type: NRG; PAM sequence: AAG
cttcttttctgcaatgtatt

SEQ ID NO: 41784 - DNA, 20 bp, Artificial Sequence
  Description of Artificial Sequence: Synthetic oligonucleotide
  Target: SCN9A; (+) strand; PAM type: NRG; PAM sequence: CAG
cttttctgcaatgtattaag

SEQ ID NO: 41785 - DNA, 20 bp, Artificial Sequence
  Description of Artificial Sequence: Synthetic oligonucleotide
  Target: SCN9A; (+) strand; PAM type: NRG; PAM sequence: AGG
ttttctgcaatgtattaagc

SEQ ID NO: 41786 - DNA, 20 bp, Artificial Sequence
  Description of Artificial Sequence: Synthetic oligonucleotide
  Target: SCN9A; (+) strand; PAM type: NRG; PAM sequence: AAG
aatgtattaagcaggttctc

SEQ ID NO: 41787 - DNA, 20 bp, Artificial Sequence
  Description of Artificial Sequence: Synthetic oligonucleotide
  Target: SCN9A; (+) strand; PAM type: NRG; PAM sequence: TAG
gttctcaagatgctttaaaa

SEQ ID NO: 41788 - DNA, 20 bp, Artificial Sequence
  Description of Artificial Sequence: Synthetic oligonucleotide
  Target: SCN9A; (+) strand; PAM type: NRG; PAM sequence: GAG
tctcaagatgctttaaaata

SEQ ID NO: 41789 - DNA, 20 bp, Artificial Sequence
  Description of Artificial Sequence: Synthetic oligonucleotide
  Target: SCN9A; (+) strand; PAM type: NRG; PAM sequence: AAG
ctttaaaatagagaaatact

SEQ ID NO: 41790 - DNA, 20 bp, Artificial Sequence
  Description of Artificial Sequence: Synthetic oligonucleotide
  Target: SCN9A; (+) strand; PAM type: NRG; PAM sequence: AGG
tttaaaatagagaaatacta

SEQ ID NO: 41791 - DNA, 20 bp, Artificial Sequence
  Description of Artificial Sequence: Synthetic oligonucleotide
  Target: SCN9A; (+) strand; PAM type: NRG; PAM sequence: CAG
aaggatctctgactactaat

SEQ ID NO: 41792 - DNA, 20 bp, Artificial Sequence
  Description of Artificial Sequence: Synthetic oligonucleotide
  Target: SCN9A; (+) strand; PAM type: NRG; PAM sequence: TAG
tgactactaatcagatcatc

SEQ ID NO: 41793 - DNA, 20 bp, Artificial Sequence
  Description of Artificial Sequence: Synthetic oligonucleotide
  Target: SCN9A; (+) strand; PAM type: NRG; PAM sequence: AGG
gactactaatcagatcatct

SEQ ID NO: 41794 - DNA, 20 bp, Artificial Sequence
  Description of Artificial Sequence: Synthetic oligonucleotide
  Target: SCN9A; (+) strand; PAM type: NRG; PAM sequence: GGG
actactaatcagatcatcta

SEQ ID NO: 41795 - DNA, 20 bp, Artificial Sequence
  Description of Artificial Sequence: Synthetic oligonucleotide
  Target: SCN9A; (+) strand; PAM type: NRG; PAM sequence: GAG
tactaatcagatcatctagg

SEQ ID NO: 41796 - DNA, 20 bp, Artificial Sequence
  Description of Artificial Sequence: Synthetic oligonucleotide
  Target: SCN9A; (+) strand; PAM type: NRG; PAM sequence: AAG
taatcagatcatctagggag

SEQ ID NO: 41797 - DNA, 20 bp, Artificial Sequence
  Description of Artificial Sequence: Synthetic oligonucleotide
  Target: SCN9A; (+) strand; PAM type: NRG; PAM sequence: AGG
aatcagatcatctagggaga

SEQ ID NO: 41798 - DNA, 20 bp, Artificial Sequence
  Description of Artificial Sequence: Synthetic oligonucleotide
  Target: SCN9A; (+) strand; PAM type: NRG; PAM sequence: TAG
aacatttttataaatatttt

SEQ ID NO: 41799 - DNA, 20 bp, Artificial Sequence
  Description of Artificial Sequence: Synthetic oligonucleotide
  Target: SCN9A; (+) strand; PAM type: NRG; PAM sequence: AGG
acatttttataaatattttt

SEQ ID NO: 41800 - DNA, 20 bp, Artificial Sequence
  Description of Artificial Sequence: Synthetic oligonucleotide
  Target: SCN9A; (+) strand; PAM type: NRG; PAM sequence: TGG
ataaatatttttaggctttg

SEQ ID NO: 41801 - DNA, 20 bp, Artificial Sequence
  Description of Artificial Sequence: Synthetic oligonucleotide
  Target: SCN9A; (+) strand; PAM type: NRG; PAM sequence: GGG
taaatatttttaggctttgt

SEQ ID NO: 41802 - DNA, 20 bp, Artificial Sequence
  Description of Artificial Sequence: Synthetic oligonucleotide
  Target: SCN9A; (+) strand; PAM type: NRG; PAM sequence: TGG
gcaactattcaactctgcca

SEQ ID NO: 41803 - DNA, 20 bp, Artificial Sequence
  Description of Artificial Sequence: Synthetic oligonucleotide
  Target: SCN9A; (+) strand; PAM type: NRG; PAM sequence: TAG
actattcaactctgccatgg

SEQ ID NO: 41804 - DNA, 20 bp, Artificial Sequence
  Description of Artificial Sequence: Synthetic oligonucleotide
  Target: SCN9A; (+) strand; PAM type: NRG; PAM sequence: TGG
caactctgccatggtagtca

SEQ ID NO: 41805 - DNA, 20 bp, Artificial Sequence
  Description of Artificial Sequence: Synthetic oligonucleotide
  Target: SCN9A; (+) strand; PAM type: NRG; PAM sequence: GGG
aactctgccatggtagtcat

SEQ ID NO: 41806 - DNA, 20 bp, Artificial Sequence
  Description of Artificial Sequence: Synthetic oligonucleotide
  Target: SCN9A; (+) strand; PAM type: NRG; PAM sequence: TGG
tgggtcatacataaacaaac

SEQ ID NO: 41807 - DNA, 20 bp, Artificial Sequence
  Description of Artificial Sequence: Synthetic oligonucleotide
  Target: SCN9A; (+) strand; PAM type: NRG; PAM sequence: TGG
catacataaacaaactggta

SEQ ID NO: 41808 - DNA, 20 bp, Artificial Sequence
  Description of Artificial Sequence: Synthetic oligonucleotide
  Target: SCN9A; (+) strand; PAM type: NRG; PAM sequence: AAG
aactggtatggctgtgttcc

SEQ ID NO: 41809 - DNA, 20 bp, Artificial Sequence
  Description of Artificial Sequence: Synthetic oligonucleotide
  Target: SCN9A; (+) strand; PAM type: NRG; PAM sequence: CAG
caagaacatttttacaaaaa

SEQ ID NO: 41810 - DNA, 20 bp, Artificial Sequence
  Description of Artificial Sequence: Synthetic oligonucleotide
  Target: SCN9A; (+) strand; PAM type: NRG; PAM sequence: AGG
aagaacatttttacaaaaac

SEQ ID NO: 41811 - DNA, 20 bp, Artificial Sequence
  Description of Artificial Sequence: Synthetic oligonucleotide
  Target: SCN9A; (+) strand; PAM type: NRG; PAM sequence: TGG
acatttttacaaaaacaggc

SEQ ID NO: 41812 - DNA, 20 bp, Artificial Sequence
  Description of Artificial Sequence: Synthetic oligonucleotide
  Target: SCN9A; (+) strand; PAM type: NRG; PAM sequence: GGG
catttttacaaaaacaggct

SEQ ID NO: 41813 - DNA, 20 bp, Artificial Sequence
  Description of Artificial Sequence: Synthetic oligonucleotide
  Target: SCN9A; (+) strand; PAM type: NRG; PAM sequence: GGG
atttttacaaaaacaggctg

SEQ ID NO: 41814 - DNA, 20 bp, Artificial Sequence
  Description of Artificial Sequence: Synthetic oligonucleotide
  Target: SCN9A; (+) strand; PAM type: NRG; PAM sequence: TGG
ggctggggtttgttgacctt

SEQ ID NO: 41815 - DNA, 20 bp, Artificial Sequence
  Description of Artificial Sequence: Synthetic oligonucleotide
  Target: SCN9A; (+) strand; PAM type: NRG; PAM sequence: CAG
gggtttgttgacctttggtc

SEQ ID NO: 41816 - DNA, 20 bp, Artificial Sequence
  Description of Artificial Sequence: Synthetic oligonucleotide
  Target: SCN9A; (+) strand; PAM type: NRG; PAM sequence: GAG
gtttgttgacctttggtcca

SEQ ID NO: 41817 - DNA, 20 bp, Artificial Sequence
  Description of Artificial Sequence: Synthetic oligonucleotide
  Target: SCN9A; (+) strand; PAM type: NRG; PAM sequence: TGG
ggtccagagcaatgattatt

SEQ ID NO: 41818 - DNA, 20 bp, Artificial Sequence
  Description of Artificial Sequence: Synthetic oligonucleotide
  Target: SCN9A; (+) strand; PAM type: NRG; PAM sequence: GAG
tccagagcaatgattatttg

SEQ ID NO: 41819 - DNA, 20 bp, Artificial Sequence
  Description of Artificial Sequence: Synthetic oligonucleotide
  Target: SCN9A; (+) strand; PAM type: NRG; PAM sequence: TGG
caatgattatttggagttca

SEQ ID NO: 41820 - DNA, 20 bp, Artificial Sequence
  Description of Artificial Sequence: Synthetic oligonucleotide
  Target: SCN9A; (+) strand; PAM type: NRG; PAM sequence: TAG
atttggagttcatggacctg

SEQ ID NO: 41821 - DNA, 20 bp, Artificial Sequence
  Description of Artificial Sequence: Synthetic oligonucleotide
  Target: SCN9A; (+) strand; PAM type: NRG; PAM sequence: GAG
ttggagttcatggacctgta

SEQ ID NO: 41822 - DNA, 20 bp, Artificial Sequence
  Description of Artificial Sequence: Synthetic oligonucleotide
  Target: SCN9A; (+) strand; PAM type: NRG; PAM sequence: AGG
tggagttcatggacctgtag

SEQ ID NO: 41823 - DNA, 20 bp, Artificial Sequence
  Description of Artificial Sequence: Synthetic oligonucleotide
  Target: SCN9A; (+) strand; PAM type: NRG; PAM sequence: TGG
atggacctgtagaggtttcc

SEQ ID NO: 41824 - DNA, 20 bp, Artificial Sequence
  Description of Artificial Sequence: Synthetic oligonucleotide
  Target: SCN9A; (+) strand; PAM type: NRG; PAM sequence: GGG
tggacctgtagaggtttcct

SEQ ID NO: 41825 - DNA, 20 bp, Artificial Sequence
  Description of Artificial Sequence: Synthetic oligonucleotide
  Target: SCN9A; (+) strand; PAM type: NRG; PAM sequence: GGG
ggacctgtagaggtttcctg

SEQ ID NO: 41826 - DNA, 20 bp, Artificial Sequence
  Description of Artificial Sequence: Synthetic oligonucleotide
  Target: SCN9A; (+) strand; PAM type: NRG; PAM sequence: GGG
gacctgtagaggtttcctgg

SEQ ID NO: 41827 - DNA, 20 bp, Artificial Sequence
  Description of Artificial Sequence: Synthetic oligonucleotide
  Target: SCN9A; (+) strand; PAM type: NRG; PAM sequence: TGG
aaattatataacaaacatta

SEQ ID NO: 41828 - DNA, 20 bp, Artificial Sequence
  Description of Artificial Sequence: Synthetic oligonucleotide
  Target: SCN9A; (+) strand; PAM type: NRG; PAM sequence: CGG
ttatggttgtgctgtctttc

SEQ ID NO: 41829 - DNA, 20 bp, Artificial Sequence
  Description of Artificial Sequence: Synthetic oligonucleotide
  Target: SCN9A; (+) strand; PAM type: NRG; PAM sequence: AAG
ggttgtgctgtctttccgga

SEQ ID NO: 41830 - DNA, 20 bp, Artificial Sequence
  Description of Artificial Sequence: Synthetic oligonucleotide
  Target: SCN9A; (+) strand; PAM type: NRG; PAM sequence: CAG
aagacaattctaactttcat

SEQ ID NO: 41831 - DNA, 20 bp, Artificial Sequence
  Description of Artificial Sequence: Synthetic oligonucleotide
  Target: SCN9A; (+) strand; PAM type: NRG; PAM sequence: CAG
taactttcatcagattctta

SEQ ID NO: 41832 - DNA, 20 bp, Artificial Sequence
  Description of Artificial Sequence: Synthetic oligonucleotide
  Target: SCN9A; (+) strand; PAM type: NRG; PAM sequence: AAG
cagtctatgtgacctcaaaa

SEQ ID NO: 41833 - DNA, 20 bp, Artificial Sequence
  Description of Artificial Sequence: Synthetic oligonucleotide
  Target: SCN9A; (+) strand; PAM type: NRG; PAM sequence: TAG
tatgtgacctcaaaaaagat

SEQ ID NO: 41834 - DNA, 20 bp, Artificial Sequence
  Description of Artificial Sequence: Synthetic oligonucleotide
  Target: SCN9A; (+) strand; PAM type: NRG; PAM sequence: AGG
atgtgacctcaaaaaagatt

SEQ ID NO: 41835 - DNA, 20 bp, Artificial Sequence
  Description of Artificial Sequence: Synthetic oligonucleotide
  Target: SCN9A; (+) strand; PAM type: NRG; PAM sequence: GAG
gtgacctcaaaaaagattag

SEQ ID NO: 41836 - DNA, 20 bp, Artificial Sequence
  Description of Artificial Sequence: Synthetic oligonucleotide
  Target: SCN9A; (+) strand; PAM type: NRG; PAM sequence: AGG
tgacctcaaaaaagattagg

SEQ ID NO: 41837 - DNA, 20 bp, Artificial Sequence
  Description of Artificial Sequence: Synthetic oligonucleotide
  Target: SCN9A; (+) strand; PAM type: NRG; PAM sequence: TAG
tcaaaaaagattaggaggaa

SEQ ID NO: 41838 - DNA, 20 bp, Artificial Sequence
  Description of Artificial Sequence: Synthetic oligonucleotide
  Target: SCN9A; (+) strand; PAM type: NRG; PAM sequence: AGG
caaaaaagattaggaggaat

SEQ ID NO: 41839 - DNA, 20 bp, Artificial Sequence
  Description of Artificial Sequence: Synthetic oligonucleotide
  Target: SCN9A; (+) strand; PAM type: NRG; PAM sequence: TAG
aagattaggaggaataggaa

SEQ ID NO: 41840 - DNA, 20 bp, Artificial Sequence
  Description of Artificial Sequence: Synthetic oligonucleotide
  Target: SCN9A; (+) strand; PAM type: NRG; PAM sequence: GAG
gattaggaggaataggaata

SEQ ID NO: 41841 - DNA, 20 bp, Artificial Sequence
  Description of Artificial Sequence: Synthetic oligonucleotide
  Target: SCN9A; (+) strand; PAM type: NRG; PAM sequence: AAG
aggaataggaatagagaatg

SEQ ID NO: 41842 - DNA, 20 bp, Artificial Sequence
  Description of Artificial Sequence: Synthetic oligonucleotide
  Target: SCN9A; (+) strand; PAM type: NRG; PAM sequence: AAG
ggaatagagaatgaagttca

SEQ ID NO: 41843 - DNA, 20 bp, Artificial Sequence
  Description of Artificial Sequence: Synthetic oligonucleotide
  Target: SCN9A; (+) strand; PAM type: NRG; PAM sequence: TAG
atagagaatgaagttcaaag

SEQ ID NO: 41844 - DNA, 20 bp, Artificial Sequence
  Description of Artificial Sequence: Synthetic oligonucleotide
  Target: SCN9A; (+) strand; PAM type: NRG; PAM sequence: CAG
agaatgaagttcaaagtagc

SEQ ID NO: 41845 - DNA, 20 bp, Artificial Sequence
  Description of Artificial Sequence: Synthetic oligonucleotide
  Target: SCN9A; (+) strand; PAM type: NRG; PAM sequence: TAG
tcaaagtagccagctcttaa

SEQ ID NO: 41846 - DNA, 20 bp, Artificial Sequence
  Description of Artificial Sequence: Synthetic oligonucleotide
  Target: SCN9A; (+) strand; PAM type: NRG; PAM sequence: GAG
aaagtagccagctcttaata

SEQ ID NO: 41847 - DNA, 20 bp, Artificial Sequence
  Description of Artificial Sequence: Synthetic oligonucleotide
  Target: SCN9A; (+) strand; PAM type: NRG; PAM sequence: TAG
tccctactatgtttatcacg

SEQ ID NO: 41848 - DNA, 20 bp, Artificial Sequence
  Description of Artificial Sequence: Synthetic oligonucleotide
  Target: SCN9A; (+) strand; PAM type: NRG; PAM sequence: AGG
ccctactatgtttatcacgt

SEQ ID NO: 41849 - DNA, 20 bp, Artificial Sequence
  Description of Artificial Sequence: Synthetic oligonucleotide
  Target: SCN9A; (+) strand; PAM type: NRG; PAM sequence: TAG
cgtaggcactctgatacatc

SEQ ID NO: 41850 - DNA, 20 bp, Artificial Sequence
  Description of Artificial Sequence: Synthetic oligonucleotide
  Target: SCN9A; (+) strand; PAM type: NRG; PAM sequence: AAG
gatacatctagtcactgacc

SEQ ID NO: 41851 - DNA, 20 bp, Artificial Sequence
  Description of Artificial Sequence: Synthetic oligonucleotide
  Target: SCN9A; (+) strand; PAM type: NRG; PAM sequence: TGG
ttctgtgcctccctaccatg

SEQ ID NO: 41852 - DNA, 20 bp, Artificial Sequence
  Description of Artificial Sequence: Synthetic oligonucleotide
  Target: SCN9A; (+) strand; PAM type: NRG; PAM sequence: TGG
atgcctatctgcctatgatt

SEQ ID NO: 41853 - DNA, 20 bp, Artificial Sequence
  Description of Artificial Sequence: Synthetic oligonucleotide
  Target: SCN9A; (+) strand; PAM type: NRG; PAM sequence: GGG
tgcctatctgcctatgattt

SEQ ID NO: 41854 - DNA, 20 bp, Artificial Sequence
  Description of Artificial Sequence: Synthetic oligonucleotide
  Target: SCN9A; (+) strand; PAM type: NRG; PAM sequence: GGG
gcctatctgcctatgatttg

SEQ ID NO: 41855 - DNA, 20 bp, Artificial Sequence
  Description of Artificial Sequence: Synthetic oligonucleotide
  Target: SCN9A; (+) strand; PAM type: NRG; PAM sequence: CAG
atgatttggggcttactctt

SEQ ID NO: 41856 - DNA, 20 bp, Artificial Sequence
  Description of Artificial Sequence: Synthetic oligonucleotide
  Target: SCN9A; (+) strand; PAM type: NRG; PAM sequence: CAG
acctccttgtgatgtcttcc

SEQ ID NO: 41857 - DNA, 20 bp, Artificial Sequence
  Description of Artificial Sequence: Synthetic oligonucleotide
  Target: SCN9A; (+) strand; PAM type: NRG; PAM sequence: CGG
gatgtcttcccagacttccc

SEQ ID NO: 41858 - DNA, 20 bp, Artificial Sequence
  Description of Artificial Sequence: Synthetic oligonucleotide
  Target: SCN9A; (+) strand; PAM type: NRG; PAM sequence: TAG
tcttcccagacttccccgga

SEQ ID NO: 41859 - DNA, 20 bp, Artificial Sequence
  Description of Artificial Sequence: Synthetic oligonucleotide
  Target: SCN9A; (+) strand; PAM type: NRG; PAM sequence: TGG
cattgaccctactcactctt

SEQ ID NO: 41860 - DNA, 20 bp, Artificial Sequence
  Description of Artificial Sequence: Synthetic oligonucleotide
  Target: SCN9A; (+) strand; PAM type: NRG; PAM sequence: GGG
attgaccctactcactcttt

SEQ ID NO: 41861 - DNA, 20 bp, Artificial Sequence
  Description of Artificial Sequence: Synthetic oligonucleotide
  Target: SCN9A; (+) strand; PAM type: NRG; PAM sequence: GGG
ttgaccctactcactctttg

SEQ ID NO: 41862 - DNA, 20 bp, Artificial Sequence
  Description of Artificial Sequence: Synthetic oligonucleotide
  Target: SCN9A; (+) strand; PAM type: NRG; PAM sequence: CGG
cctactcactctttggggac

SEQ ID NO: 41863 - DNA, 20 bp, Artificial Sequence
  Description of Artificial Sequence: Synthetic oligonucleotide
  Target: SCN9A; (+) strand; PAM type: NRG; PAM sequence: GGG
ctactcactctttggggacc

SEQ ID NO: 41864 - DNA, 20 bp, Artificial Sequence
  Description of Artificial Sequence: Synthetic oligonucleotide
  Target: SCN9A; (+) strand; PAM type: NRG; PAM sequence: GGG
tactcactctttggggaccg

SEQ ID NO: 41865 - DNA, 20 bp, Artificial Sequence
  Description of Artificial Sequence: Synthetic oligonucleotide
  Target: SCN9A; (+) strand; PAM type: NRG; PAM sequence: TAG
atatcacaacacctgacaca

SEQ ID NO: 41866 - DNA, 20 bp, Artificial Sequence
  Description of Artificial Sequence: Synthetic oligonucleotide
  Target: SCN9A; (+) strand; PAM type: NRG; PAM sequence: TGG
cacaacacctgacacatagt

SEQ ID NO: 41867 - DNA, 20 bp, Artificial Sequence
  Description of Artificial Sequence: Synthetic oligonucleotide
  Target: SCN9A; (+) strand; PAM type: NRG; PAM sequence: GAG
aatgtttttctaaaaaatgt

SEQ ID NO: 41868 - DNA, 20 bp, Artificial Sequence
  Description of Artificial Sequence: Synthetic oligonucleotide
  Target: SCN9A; (+) strand; PAM type: NRG; PAM sequence: TGG
ctaaaaaatgtgagtaatga

SEQ ID NO: 41869 - DNA, 20 bp, Artificial Sequence
  Description of Artificial Sequence: Synthetic oligonucleotide
  Target: SCN9A; (+) strand; PAM type: NRG; PAM sequence: TGG
tgtgagtaatgatggaatca

SEQ ID NO: 41870 - DNA, 20 bp, Artificial Sequence
  Description of Artificial Sequence: Synthetic oligonucleotide
  Target: SCN9A; (+) strand; PAM type: NRG; PAM sequence: GGG
gtgagtaatgatggaatcat

SEQ ID NO: 41871 - DNA, 20 bp, Artificial Sequence
  Description of Artificial Sequence: Synthetic oligonucleotide
  Target: SCN9A; (+) strand; PAM type: NRG; PAM sequence: GAG
tgatggaatcatgggtctct

SEQ ID NO: 41872 - DNA, 20 bp, Artificial Sequence
  Description of Artificial Sequence: Synthetic oligonucleotide
  Target: SCN9A; (+) strand; PAM type: NRG; PAM sequence: AAG
ggaatcatgggtctctgaga

SEQ ID NO: 41873 - DNA, 20 bp, Artificial Sequence
  Description of Artificial Sequence: Synthetic oligonucleotide
  Target: SCN9A; (+) strand; PAM type: NRG; PAM sequence: CAG
tcatgggtctctgagaaaga

SEQ ID NO: 41874 - DNA, 20 bp, Artificial Sequence
  Description of Artificial Sequence: Synthetic oligonucleotide
  Target: SCN9A; (+) strand; PAM type: NRG; PAM sequence: AGG
catgggtctctgagaaagac

SEQ ID NO: 41875 - DNA, 20 bp, Artificial Sequence
  Description of Artificial Sequence: Synthetic oligonucleotide
  Target: SCN9A; (+) strand; PAM type: NRG; PAM sequence: TGG
tgagaaagacaggcacctat

SEQ ID NO: 41876 - DNA, 20 bp, Artificial Sequence
  Description of Artificial Sequence: Synthetic oligonucleotide
  Target: SCN9A; (+) strand; PAM type: NRG; PAM sequence: GAG
caggcacctattggtctgat

SEQ ID NO: 41877 - DNA, 20 bp, Artificial Sequence
  Description of Artificial Sequence: Synthetic oligonucleotide
  Target: SCN9A; (+) strand; PAM type: NRG; PAM sequence: AAG
gcacctattggtctgatgag

SEQ ID NO: 41878 - DNA, 20 bp, Artificial Sequence
  Description of Artificial Sequence: Synthetic oligonucleotide
  Target: SCN9A; (+) strand; PAM type: NRG; PAM sequence: CAG
ctattggtctgatgagaagc

SEQ ID NO: 41879 - DNA, 20 bp, Artificial Sequence
  Description of Artificial Sequence: Synthetic oligonucleotide
  Target: SCN9A; (+) strand; PAM type: NRG; PAM sequence: TGG
tggtctgatgagaagccagt

SEQ ID NO: 41880 - DNA, 20 bp, Artificial Sequence
  Description of Artificial Sequence: Synthetic oligonucleotide
  Target: SCN9A; (+) strand; PAM type: NRG; PAM sequence: GGG
ggtctgatgagaagccagtt

SEQ ID NO: 41881 - DNA, 20 bp, Artificial Sequence
  Description of Artificial Sequence: Synthetic oligonucleotide
  Target: SCN9A; (+) strand; PAM type: NRG; PAM sequence: AAG
tgatgagaagccagttggga

SEQ ID NO: 41882 - DNA, 20 bp, Artificial Sequence
  Description of Artificial Sequence: Synthetic oligonucleotide
  Target: SCN9A; (+) strand; PAM type: NRG; PAM sequence: AAG
gaagccagttgggaaagcta

SEQ ID NO: 41883 - DNA, 20 bp, Artificial Sequence
  Description of Artificial Sequence: Synthetic oligonucleotide
  Target: SCN9A; (+) strand; PAM type: NRG; PAM sequence: GAG
agccagttgggaaagctaaa

SEQ ID NO: 41884 - DNA, 20 bp, Artificial Sequence
  Description of Artificial Sequence: Synthetic oligonucleotide
  Target: SCN9A; (+) strand; PAM type: NRG; PAM sequence: AAG
ttgggaaagctaaagagcct

SEQ ID NO: 41885 - DNA, 20 bp, Artificial Sequence
  Description of Artificial Sequence: Synthetic oligonucleotide
  Target: SCN9A; (+) strand; PAM type: NRG; PAM sequence: AGG
tgggaaagctaaagagccta

SEQ ID NO: 41886 - DNA, 20 bp, Artificial Sequence
  Description of Artificial Sequence: Synthetic oligonucleotide
  Target: SCN9A; (+) strand; PAM type: NRG; PAM sequence: AAG
aagagcctaaggactcaaac

SEQ ID NO: 41887 - DNA, 20 bp, Artificial Sequence
  Description of Artificial Sequence: Synthetic oligonucleotide
  Target: SCN9A; (+) strand; PAM type: NRG; PAM sequence: TAG
atttcatttatccttcaaaa

SEQ ID NO: 41888 - DNA, 20 bp, Artificial Sequence
  Description of Artificial Sequence: Synthetic oligonucleotide
  Target: SCN9A; (+) strand; PAM type: NRG; PAM sequence: CGG
tatccttcaaaatagccctg

SEQ ID NO: 41889 - DNA, 20 bp, Artificial Sequence
  Description of Artificial Sequence: Synthetic oligonucleotide
  Target: SCN9A; (+) strand; PAM type: NRG; PAM sequence: TGG
aataaatgtctctttttgca

SEQ ID NO: 41890 - DNA, 20 bp, Artificial Sequence
  Description of Artificial Sequence: Synthetic oligonucleotide
  Target: SCN9A; (+) strand; PAM type: NRG; PAM sequence: TAG
ggttaacaaatgtaactaaa

SEQ ID NO: 41891 - DNA, 20 bp, Artificial Sequence
  Description of Artificial Sequence: Synthetic oligonucleotide
  Target: SCN9A; (+) strand; PAM type: NRG; PAM sequence: CAG
catccaattcacctgtaata

SEQ ID NO: 41892 - DNA, 20 bp, Artificial Sequence
  Description of Artificial Sequence: Synthetic oligonucleotide
  Target: SCN9A; (+) strand; PAM type: NRG; PAM sequence: AAG
attcacctgtaatacagata

SEQ ID NO: 41893 - DNA, 20 bp, Artificial Sequence
  Description of Artificial Sequence: Synthetic oligonucleotide
  Target: SCN9A; (+) strand; PAM type: NRG; PAM sequence: AAG
tgtaatacagataaagaaca

SEQ ID NO: 41894 - DNA, 20 bp, Artificial Sequence
  Description of Artificial Sequence: Synthetic oligonucleotide
  Target: SCN9A; (+) strand; PAM type: NRG; PAM sequence: GAG
taatacagataaagaacaaa

SEQ ID NO: 41895 - DNA, 20 bp, Artificial Sequence
  Description of Artificial Sequence: Synthetic oligonucleotide
  Target: SCN9A; (+) strand; PAM type: NRG; PAM sequence: CAG
gataaagaacaaagagcaaa

SEQ ID NO: 41896 - DNA, 20 bp, Artificial Sequence
  Description of Artificial Sequence: Synthetic oligonucleotide
  Target: SCN9A; (+) strand; PAM type: NRG; PAM sequence: GAG
taaagaacaaagagcaaaca

SEQ ID NO: 41897 - DNA, 20 bp, Artificial Sequence
  Description of Artificial Sequence: Synthetic oligonucleotide
  Target: SCN9A; (+) strand; PAM type: NRG; PAM sequence: TAG
aaagagcaaacagagttaaa

SEQ ID NO: 41898 - DNA, 20 bp, Artificial Sequence
  Description of Artificial Sequence: Synthetic oligonucleotide
  Target: SCN9A; (+) strand; PAM type: NRG; PAM sequence: TGG
gagcaaacagagttaaatag

SEQ ID NO: 41899 - DNA, 20 bp, Artificial Sequence
  Description of Artificial Sequence: Synthetic oligonucleotide
  Target: SCN9A; (+) strand; PAM type: NRG; PAM sequence: GGG
agcaaacagagttaaatagt

SEQ ID NO: 41900 - DNA, 20 bp, Artificial Sequence
  Description of Artificial Sequence: Synthetic oligonucleotide
  Target: SCN9A; (+) strand; PAM type: NRG; PAM sequence: TGG
aacagagttaaatagtgggc

SEQ ID NO: 41901 - DNA, 20 bp, Artificial Sequence
  Description of Artificial Sequence: Synthetic oligonucleotide
  Target: SCN9A; (+) strand; PAM type: NRG; PAM sequence: AAG
gtgggctggcttaatcactg

SEQ ID NO: 41902 - DNA, 20 bp, Artificial Sequence
  Description of Artificial Sequence: Synthetic oligonucleotide
  Target: SCN9A; (+) strand; PAM type: NRG; PAM sequence: AGG
tgggctggcttaatcactga

SEQ ID NO: 41903 - DNA, 20 bp, Artificial Sequence
  Description of Artificial Sequence: Synthetic oligonucleotide
  Target: SCN9A; (+) strand; PAM type: NRG; PAM sequence: AAG
gctggcttaatcactgaagg

SEQ ID NO: 41904 - DNA, 20 bp, Artificial Sequence
  Description of Artificial Sequence: Synthetic oligonucleotide
  Target: SCN9A; (+) strand; PAM type: NRG; PAM sequence: TGG
ggcttaatcactgaaggaag

SEQ ID NO: 41905 - DNA, 20 bp, Artificial Sequence
  Description of Artificial Sequence: Synthetic oligonucleotide
  Target: SCN9A; (+) strand; PAM type: NRG; PAM sequence: TAG
cactgaaggaagtggttttg

SEQ ID NO: 41906 - DNA, 20 bp, Artificial Sequence
  Description of Artificial Sequence: Synthetic oligonucleotide
  Target: SCN9A; (+) strand; PAM type: NRG; PAM sequence: AGG
actgaaggaagtggttttgt

SEQ ID NO: 41907 - DNA, 20 bp, Artificial Sequence
  Description of Artificial Sequence: Synthetic oligonucleotide
  Target: SCN9A; (+) strand; PAM type: NRG; PAM sequence: GGG
ctgaaggaagtggttttgta

SEQ ID NO: 41908 - DNA, 20 bp, Artificial Sequence
  Description of Artificial Sequence: Synthetic oligonucleotide
  Target: SCN9A; (+) strand; PAM type: NRG; PAM sequence: GGG
tgaaggaagtggttttgtag

SEQ ID NO: 41909 - DNA, 20 bp, Artificial Sequence
  Description of Artificial Sequence: Synthetic oligonucleotide
  Target: SCN9A; (+) strand; PAM type: NRG; PAM sequence: AAG
ggaagtggttttgtagggga

SEQ ID NO: 41910 - DNA, 20 bp, Artificial Sequence
  Description of Artificial Sequence: Synthetic oligonucleotide
  Target: SCN9A; (+) strand; PAM type: NRG; PAM sequence: TAG
tttgtaggggaaagttgtga

SEQ ID NO: 41911 - DNA, 20 bp, Artificial Sequence
  Description of Artificial Sequence: Synthetic oligonucleotide
  Target: SCN9A; (+) strand; PAM type: NRG; PAM sequence: AAG
ctattaatgctcaaaaaatt

SEQ ID NO: 41912 - DNA, 20 bp, Artificial Sequence
  Description of Artificial Sequence: Synthetic oligonucleotide
  Target: SCN9A; (+) strand; PAM type: NRG; PAM sequence: TAG
aacttgtaattttcaacttg

SEQ ID NO: 41913 - DNA, 20 bp, Artificial Sequence
  Description of Artificial Sequence: Synthetic oligonucleotide
  Target: SCN9A; (+) strand; PAM type: NRG; PAM sequence: TAG
tgtaattttcaacttgtaga

SEQ ID NO: 41914 - DNA, 20 bp, Artificial Sequence
  Description of Artificial Sequence: Synthetic oligonucleotide
  Target: SCN9A; (+) strand; PAM type: NRG; PAM sequence: TGG
catgatctttcttttatact

SEQ ID NO: 41915 - DNA, 20 bp, Artificial Sequence
  Description of Artificial Sequence: Synthetic oligonucleotide
  Target: SCN9A; (+) strand; PAM type: NRG; PAM sequence: TGG
acttggaaaccgttatacac

SEQ ID NO: 41916 - DNA, 20 bp, Artificial Sequence
  Description of Artificial Sequence: Synthetic oligonucleotide
  Target: SCN9A; (+) strand; PAM type: NRG; PAM sequence: TAG
tatacactggataattaaaa

SEQ ID NO: 41917 - DNA, 20 bp, Artificial Sequence
  Description of Artificial Sequence: Synthetic oligonucleotide
  Target: SCN9A; (+) strand; PAM type: NRG; PAM sequence: CAG
acactggataattaaaatag

SEQ ID NO: 41918 - DNA, 20 bp, Artificial Sequence
  Description of Artificial Sequence: Synthetic oligonucleotide
  Target: SCN9A; (+) strand; PAM type: NRG; PAM sequence: GAG
actggataattaaaatagca

SEQ ID NO: 41919 - DNA, 20 bp, Artificial Sequence
  Description of Artificial Sequence: Synthetic oligonucleotide
  Target: SCN9A; (+) strand; PAM type: NRG; PAM sequence: CAG
aattaaaatagcagagattg

SEQ ID NO: 41920 - DNA, 20 bp, Artificial Sequence
  Description of Artificial Sequence: Synthetic oligonucleotide
  Target: SCN9A; (+) strand; PAM type: NRG; PAM sequence: TAG
gcagagattgcagtcataat

SEQ ID NO: 41921 - DNA, 20 bp, Artificial Sequence
  Description of Artificial Sequence: Synthetic oligonucleotide
  Target: SCN9A; (+) strand; PAM type: NRG; PAM sequence: AGG
cagagattgcagtcataatt

SEQ ID NO: 41922 - DNA, 20 bp, Artificial Sequence
  Description of Artificial Sequence: Synthetic oligonucleotide
  Target: SCN9A; (+) strand; PAM type: NRG; PAM sequence: TAG
tgcagtcataattaggtttg

SEQ ID NO: 41923 - DNA, 20 bp, Artificial Sequence
  Description of Artificial Sequence: Synthetic oligonucleotide
  Target: SCN9A; (+) strand; PAM type: NRG; PAM sequence: AGG
gcagtcataattaggtttgt

SEQ ID NO: 41924 - DNA, 20 bp, Artificial Sequence
  Description of Artificial Sequence: Synthetic oligonucleotide
  Target: SCN9A; (+) strand; PAM type: NRG; PAM sequence: GGG
cagtcataattaggtttgta

SEQ ID NO: 41925 - DNA, 20 bp, Artificial Sequence
  Description of Artificial Sequence: Synthetic oligonucleotide
  Target: SCN9A; (+) strand; PAM type: NRG; PAM sequence: CAG
aattaggtttgtagggataa

SEQ ID NO: 41926 - DNA, 20 bp, Artificial Sequence
  Description of Artificial Sequence: Synthetic oligonucleotide
  Target: SCN9A; (+) strand; PAM type: NRG; PAM sequence: AAG
ggtttgtagggataacagtg

SEQ ID NO: 41927 - DNA, 20 bp, Artificial Sequence
  Description of Artificial Sequence: Synthetic oligonucleotide
  Target: SCN9A; (+) strand; PAM type: NRG; PAM sequence: TGG
tagggataacagtgaagatt

SEQ ID NO: 41928 - DNA, 20 bp, Artificial Sequence
  Description of Artificial Sequence: Synthetic oligonucleotide
  Target: SCN9A; (+) strand; PAM type: NRG; PAM sequence: TAG
ggataacagtgaagatttgg

SEQ ID NO: 41929 - DNA, 20 bp, Artificial Sequence
  Description of Artificial Sequence: Synthetic oligonucleotide
  Target: SCN9A; (+) strand; PAM type: NRG; PAM sequence: AGG
gataacagtgaagatttggt

SEQ ID NO: 41930 - DNA, 20 bp, Artificial Sequence
  Description of Artificial Sequence: Synthetic oligonucleotide
  Target: SCN9A; (+) strand; PAM type: NRG; PAM sequence: AAG
gtgaagatttggtaggctga

SEQ ID NO: 41931 - DNA, 20 bp, Artificial Sequence
  Description of Artificial Sequence: Synthetic oligonucleotide
  Target: SCN9A; (+) strand; PAM type: NRG; PAM sequence: GAG
aagatctctaatgttcactt

SEQ ID NO: 41932 - DNA, 20 bp, Artificial Sequence
  Description of Artificial Sequence: Synthetic oligonucleotide
  Target: SCN9A; (+) strand; PAM type: NRG; PAM sequence: AGG
agatctctaatgttcacttg

SEQ ID NO: 41933 - DNA, 20 bp, Artificial Sequence
  Description of Artificial Sequence: Synthetic oligonucleotide
  Target: SCN9A; (+) strand; PAM type: NRG; PAM sequence: TGG
ctctaatgttcacttgaggc

SEQ ID NO: 41934 - DNA, 20 bp, Artificial Sequence
  Description of Artificial Sequence: Synthetic oligonucleotide
  Target: SCN9A; (+) strand; PAM type: NRG; PAM sequence: AAG
cttgaggctggttaaaaccc

SEQ ID NO: 41935 - DNA, 20 bp, Artificial Sequence
  Description of Artificial Sequence: Synthetic oligonucleotide
  Target: SCN9A; (+) strand; PAM type: NRG; PAM sequence: TGG
caagtttcttatccccatcc

SEQ ID NO: 41936 - DNA, 20 bp, Artificial Sequence
  Description of Artificial Sequence: Synthetic oligonucleotide
  Target: SCN9A; (+) strand; PAM type: NRG; PAM sequence: GAG
agtttcttatccccatcctg

SEQ ID NO: 41937 - DNA, 20 bp, Artificial Sequence
  Description of Artificial Sequence: Synthetic oligonucleotide
  Target: SCN9A; (+) strand; PAM type: NRG; PAM sequence: CAG
ccatcctggagtttctgact

SEQ ID NO: 41938 - DNA, 20 bp, Artificial Sequence
  Description of Artificial Sequence: Synthetic oligonucleotide
  Target: SCN9A; (+) strand; PAM type: NRG; PAM sequence: TAG
tcctggagtttctgactcag

SEQ ID NO: 41939 - DNA, 20 bp, Artificial Sequence
  Description of Artificial Sequence: Synthetic oligonucleotide
  Target: SCN9A; (+) strand; PAM type: NRG; PAM sequence: AGG
cctggagtttctgactcagt

SEQ ID NO: 41940 - DNA, 20 bp, Artificial Sequence
  Description of Artificial Sequence: Synthetic oligonucleotide
  Target: SCN9A; (+) strand; PAM type: NRG; PAM sequence: TGG
agtttctgactcagtaggtc

SEQ ID NO: 41941 - DNA, 20 bp, Artificial Sequence
  Description of Artificial Sequence: Synthetic oligonucleotide
  Target: SCN9A; (+) strand; PAM type: NRG; PAM sequence: GGG
gtttctgactcagtaggtct

SEQ ID NO: 41942 - DNA, 20 bp, Artificial Sequence
  Description of Artificial Sequence: Synthetic oligonucleotide
  Target: SCN9A; (+) strand; PAM type: NRG; PAM sequence: GGG
tttctgactcagtaggtctg

SEQ ID NO: 41943 - DNA, 20 bp, Artificial Sequence
  Description of Artificial Sequence: Synthetic oligonucleotide
  Target: SCN9A; (+) strand; PAM type: NRG; PAM sequence: GAG
tgactcagtaggtctggggt

SEQ ID NO: 41944 - DNA, 20 bp, Artificial Sequence
  Description of Artificial Sequence: Synthetic oligonucleotide
  Target: SCN9A; (+) strand; PAM type: NRG; PAM sequence: AAG
gtaggtctggggtgagatcc

SEQ ID NO: 41945 - DNA, 20 bp, Artificial Sequence
  Description of Artificial Sequence: Synthetic oligonucleotide
  Target: SCN9A; (+) strand; PAM type: NRG; PAM sequence: CAG
ttttttttttttttttgata

SEQ ID NO: 41946 - DNA, 20 bp, Artificial Sequence
  Description of Artificial Sequence: Synthetic oligonucleotide
  Target: SCN9A; (+) strand; PAM type: NRG; PAM sequence: GAG
ttttttttttttttgataca

SEQ ID NO: 41947 - DNA, 20 bp, Artificial Sequence
  Description of Artificial Sequence: Synthetic oligonucleotide
  Target: SCN9A; (+) strand; PAM type: NRG; PAM sequence: CAG
cagagtcttgctctgttccc

SEQ ID NO: 41948 - DNA, 20 bp, Artificial Sequence
  Description of Artificial Sequence: Synthetic oligonucleotide
  Target: SCN9A; (+) strand; PAM type: NRG; PAM sequence: AGG
agagtcttgctctgttcccc

SEQ ID NO: 41949 - DNA, 20 bp, Artificial Sequence
  Description of Artificial Sequence: Synthetic oligonucleotide
  Target: SCN9A; (+) strand; PAM type: NRG; PAM sequence: TGG
tcttgctctgttccccaggc

SEQ ID NO: 41950 - DNA, 20 bp, Artificial Sequence
  Description of Artificial Sequence: Synthetic oligonucleotide
  Target: SCN9A; (+) strand; PAM type: NRG; PAM sequence: GAG
ttgctctgttccccaggctg

SEQ ID NO: 41951 - DNA, 20 bp, Artificial Sequence
  Description of Artificial Sequence: Synthetic oligonucleotide
  Target: SCN9A; (+) strand; PAM type: NRG; PAM sequence: CAG
ctgttccccaggctggagtg

SEQ ID NO: 41952 - DNA, 20 bp, Artificial Sequence
  Description of Artificial Sequence: Synthetic oligonucleotide
  Target: SCN9A; (+) strand; PAM type: NRG; PAM sequence: CGG
ggagtgcagttgcatgatct

SEQ ID NO: 41953 - DNA, 20 bp, Artificial Sequence
  Description of Artificial Sequence: Synthetic oligonucleotide
  Target: SCN9A; (+) strand; PAM type: NRG; PAM sequence: CGG
tcactgcaacctctgcctcc

SEQ ID NO: 41954 - DNA, 20 bp, Artificial Sequence
  Description of Artificial Sequence: Synthetic oligonucleotide
  Target: SCN9A; (+) strand; PAM type: NRG; PAM sequence: GGG
cactgcaacctctgcctccc

SEQ ID NO: 41955 - DNA, 20 bp, Artificial Sequence
  Description of Artificial Sequence: Synthetic oligonucleotide
  Target: SCN9A; (+) strand; PAM type: NRG; PAM sequence: AAG
aacctctgcctcccgggttc

SEQ ID NO: 41956 - DNA, 20 bp, Artificial Sequence
  Description of Artificial Sequence: Synthetic oligonucleotide
  Target: SCN9A; (+) strand; PAM type: NRG; PAM sequence: CAG
ttcaagcgattcttctgcct

SEQ ID NO: 41957 - DNA, 20 bp, Artificial Sequence
  Description of Artificial Sequence: Synthetic oligonucleotide
  Target: SCN9A; (+) strand; PAM type: NRG; PAM sequence: TAG
ttcttctgcctcagcctccc

SEQ ID NO: 41958 - DNA, 20 bp, Artificial Sequence
  Description of Artificial Sequence: Synthetic oligonucleotide
  Target: SCN9A; (+) strand; PAM type: NRG; PAM sequence: TAG
ttctgcctcagcctccctag

SEQ ID NO: 41959 - DNA, 20 bp, Artificial Sequence
  Description of Artificial Sequence: Synthetic oligonucleotide
  Target: SCN9A; (+) strand; PAM type: NRG; PAM sequence: GAG
cctcagcctccctagtagct

SEQ ID NO: 41960 - DNA, 20 bp, Artificial Sequence
  Description of Artificial Sequence: Synthetic oligonucleotide
  Target: SCN9A; (+) strand; PAM type: NRG; PAM sequence: CAG
ctccctagtagctgagacta

SEQ ID NO: 41961 - DNA, 20 bp, Artificial Sequence
  Description of Artificial Sequence: Synthetic oligonucleotide
  Target: SCN9A; (+) strand; PAM type: NRG; PAM sequence: AGG
tccctagtagctgagactac

SEQ ID NO: 41962 - DNA, 20 bp, Artificial Sequence
  Description of Artificial Sequence: Synthetic oligonucleotide
  Target: SCN9A; (+) strand; PAM type: NRG; PAM sequence: GAG
tagtagctgagactacaggt

SEQ ID NO: 41963 - DNA, 20 bp, Artificial Sequence
  Description of Artificial Sequence: Synthetic oligonucleotide
  Target: SCN9A; (+) strand; PAM type: NRG; PAM sequence: CGG
caggtgagcaccactatgcc

SEQ ID NO: 41964 - DNA, 20 bp, Artificial Sequence
  Description of Artificial Sequence: Synthetic oligonucleotide
  Target: SCN9A; (+) strand; PAM type: NRG; PAM sequence: GGG
aggtgagcaccactatgccc

SEQ ID NO: 41965 - DNA, 20 bp, Artificial Sequence
  Description of Artificial Sequence: Synthetic oligonucleotide
  Target: SCN9A; (+) strand; PAM type: NRG; PAM sequence: TAG
cgggtaattttttgcatttt

SEQ ID NO: 41966 - DNA, 20 bp, Artificial Sequence
  Description of Artificial Sequence: Synthetic oligonucleotide
  Target: SCN9A; (+) strand; PAM type: NRG; PAM sequence: TAG
gtaattttttgcatttttag

SEQ ID NO: 41967 - DNA, 20 bp, Artificial Sequence
  Description of Artificial Sequence: Synthetic oligonucleotide
  Target: SCN9A; (+) strand; PAM type: NRG; PAM sequence: GAG
aattttttgcatttttagta

SEQ ID NO: 41968 - DNA, 20 bp, Artificial Sequence
  Description of Artificial Sequence: Synthetic oligonucleotide
  Target: SCN9A; (+) strand; PAM type: NRG; PAM sequence: TGG
ttttgcatttttagtagaga

SEQ ID NO: 41969 - DNA, 20 bp, Artificial Sequence
  Description of Artificial Sequence: Synthetic oligonucleotide
  Target: SCN9A; (+) strand; PAM type: NRG; PAM sequence: GGG
tttgcatttttagtagagat

SEQ ID NO: 41970 - DNA, 20 bp, Artificial Sequence
  Description of Artificial Sequence: Synthetic oligonucleotide
  Target: SCN9A; (+) strand; PAM type: NRG; PAM sequence: GGG
ttgcatttttagtagagatg

SEQ ID NO: 41971 - DNA, 20 bp, Artificial Sequence
  Description of Artificial Sequence: Synthetic oligonucleotide
  Target: SCN9A; (+) strand; PAM type: NRG; PAM sequence: TGG
gagatggggtttcaccatat

SEQ ID NO: 41972 - DNA, 20 bp, Artificial Sequence
  Description of Artificial Sequence: Synthetic oligonucleotide
  Target: SCN9A; (+) strand; PAM type: NRG; PAM sequence: CAG
tggggtttcaccatattggc

SEQ ID NO: 41973 - DNA, 20 bp, Artificial Sequence
  Description of Artificial Sequence: Synthetic oligonucleotide
  Target: SCN9A; (+) strand; PAM type: NRG; PAM sequence: AGG
ggggtttcaccatattggcc

SEQ ID NO: 41974 - DNA, 20 bp, Artificial Sequence
  Description of Artificial Sequence: Synthetic oligonucleotide
  Target: SCN9A; (+) strand; PAM type: NRG; PAM sequence: TGG
tttcaccatattggccaggc

SEQ ID NO: 41975 - DNA, 20 bp, Artificial Sequence
  Description of Artificial Sequence: Synthetic oligonucleotide
  Target: SCN9A; (+) strand; PAM type: NRG; PAM sequence: AAG
gatccgtccgtctttttaat

SEQ ID NO: 41976 - DNA, 20 bp, Artificial Sequence
  Description of Artificial Sequence: Synthetic oligonucleotide
  Target: SCN9A; (+) strand; PAM type: NRG; PAM sequence: TAG
ccgtctttttaataagtttg

SEQ ID NO: 41977 - DNA, 20 bp, Artificial Sequence
  Description of Artificial Sequence: Synthetic oligonucleotide
  Target: SCN9A; (+) strand; PAM type: NRG; PAM sequence: TAG
aagtttgtagataatgctaa

SEQ ID NO: 41978 - DNA, 20 bp, Artificial Sequence
  Description of Artificial Sequence: Synthetic oligonucleotide
  Target: SCN9A; (+) strand; PAM type: NRG; PAM sequence: TGG
ttgtagataatgctaatagc

SEQ ID NO: 41979 - DNA, 20 bp, Artificial Sequence
  Description of Artificial Sequence: Synthetic oligonucleotide
  Target: SCN9A; (+) strand; PAM type: NRG; PAM sequence: CAG
agataatgctaatagctggt

SEQ ID NO: 41980 - DNA, 20 bp, Artificial Sequence
  Description of Artificial Sequence: Synthetic oligonucleotide
  Target: SCN9A; (+) strand; PAM type: NRG; PAM sequence: AAG
tggtcagtaaaccacactta

SEQ ID NO: 41981 - DNA, 20 bp, Artificial Sequence
  Description of Artificial Sequence: Synthetic oligonucleotide
  Target: SCN9A; (+) strand; PAM type: NRG; PAM sequence: CAG
gtaaaccacacttaaagtat

SEQ ID NO: 41982 - DNA, 20 bp, Artificial Sequence
  Description of Artificial Sequence: Synthetic oligonucleotide
  Target: SCN9A; (+) strand; PAM type: NRG; PAM sequence: AAG
accacacttaaagtatcagt

SEQ ID NO: 41983 - DNA, 20 bp, Artificial Sequence
  Description of Artificial Sequence: Synthetic oligonucleotide
  Target: SCN9A; (+) strand; PAM type: NRG; PAM sequence: TGG
cacttaaagtatcagtaagc

SEQ ID NO: 41984 - DNA, 20 bp, Artificial Sequence
  Description of Artificial Sequence: Synthetic oligonucleotide
  Target: SCN9A; (+) strand; PAM type: NRG; PAM sequence: CAG
aatctccgtgttaaattgct

SEQ ID NO: 41985 - DNA, 20 bp, Artificial Sequence
  Description of Artificial Sequence: Synthetic oligonucleotide
  Target: SCN9A; (+) strand; PAM type: NRG; PAM sequence: GAG
tctccgtgttaaattgctca

SEQ ID NO: 41986 - DNA, 20 bp, Artificial Sequence
  Description of Artificial Sequence: Synthetic oligonucleotide
  Target: SCN9A; (+) strand; PAM type: NRG; PAM sequence: AAG
ccgtgttaaattgctcagag

SEQ ID NO: 41987 - DNA, 20 bp, Artificial Sequence
  Description of Artificial Sequence: Synthetic oligonucleotide
  Target: SCN9A; (+) strand; PAM type: NRG; PAM sequence: AGG
cgtgttaaattgctcagaga

SEQ ID NO: 41988 - DNA, 20 bp, Artificial Sequence
  Description of Artificial Sequence: Synthetic oligonucleotide
  Target: SCN9A; (+) strand; PAM type: NRG; PAM sequence: AAG
ttaaattgctcagagaaggt

SEQ ID NO: 41989 - DNA, 20 bp, Artificial Sequence
  Description of Artificial Sequence: Synthetic oligonucleotide
  Target: SCN9A; (+) strand; PAM type: NRG; PAM sequence: AGG
taaattgctcagagaaggta

SEQ ID NO: 41990 - DNA, 20 bp, Artificial Sequence
  Description of Artificial Sequence: Synthetic oligonucleotide
  Target: SCN9A; (+) strand; PAM type: NRG; PAM sequence: TAG
attgctcagagaaggtaagg

SEQ ID NO: 41991 - DNA, 20 bp, Artificial Sequence
  Description of Artificial Sequence: Synthetic oligonucleotide
  Target: SCN9A; (+) strand; PAM type: NRG; PAM sequence: AGG
ttgctcagagaaggtaaggt

SEQ ID NO: 41992 - DNA, 20 bp, Artificial Sequence
  Description of Artificial Sequence: Synthetic oligonucleotide
  Target: SCN9A; (+) strand; PAM type: NRG; PAM sequence: GGG
tgctcagagaaggtaaggta

SEQ ID NO: 41993 - DNA, 20 bp, Artificial Sequence
  Description of Artificial Sequence: Synthetic oligonucleotide
  Target: SCN9A; (+) strand; PAM type: NRG; PAM sequence: GAG
ctcagagaaggtaaggtagg

SEQ ID NO: 41994 - DNA, 20 bp, Artificial Sequence
  Description of Artificial Sequence: Synthetic oligonucleotide
  Target: SCN9A; (+) strand; PAM type: NRG; PAM sequence: AGG
tcagagaaggtaaggtaggg

SEQ ID NO: 41995 - DNA, 20 bp, Artificial Sequence
  Description of Artificial Sequence: Synthetic oligonucleotide
  Target: SCN9A; (+) strand; PAM type: NRG; PAM sequence: CAG
gagaaggtaaggtagggagg

SEQ ID NO: 41996 - DNA, 20 bp, Artificial Sequence
  Description of Artificial Sequence: Synthetic oligonucleotide
  Target: SCN9A; (+) strand; PAM type: NRG; PAM sequence: AAG
ggtaaggtagggaggcagtt

SEQ ID NO: 41997 - DNA, 20 bp, Artificial Sequence
  Description of Artificial Sequence: Synthetic oligonucleotide
  Target: SCN9A; (+) strand; PAM type: NRG; PAM sequence: AAG
aggcagttaagtaaacaaat

SEQ ID NO: 41998 - DNA, 20 bp, Artificial Sequence
  Description of Artificial Sequence: Synthetic oligonucleotide
  Target: SCN9A; (+) strand; PAM type: NRG; PAM sequence: GAG
taagtaaaatacaatataat

SEQ ID NO: 41999 - DNA, 20 bp, Artificial Sequence
  Description of Artificial Sequence: Synthetic oligonucleotide
  Target: SCN9A; (+) strand; PAM type: NRG; PAM sequence: AGG
aagtaaaatacaatataatg

SEQ ID NO: 42000 - DNA, 20 bp, Artificial Sequence
  Description of Artificial Sequence: Synthetic oligonucleotide
  Target: SCN9A; (+) strand; PAM type: NRG; PAM sequence: TAG
atacaatataatgaggattt

SEQ ID NO: 42001 - DNA, 20 bp, Artificial Sequence
  Description of Artificial Sequence: Synthetic oligonucleotide
  Target: SCN9A; (+) strand; PAM type: NRG; PAM sequence: AGG
tacaatataatgaggatttt

SEQ ID NO: 42002 - DNA, 20 bp, Artificial Sequence
  Description of Artificial Sequence: Synthetic oligonucleotide
  Target: SCN9A; (+) strand; PAM type: NRG; PAM sequence: CAG
gaggattttaggtgtctgaa

SEQ ID NO: 42003 - DNA, 20 bp, Artificial Sequence
  Description of Artificial Sequence: Synthetic oligonucleotide
  Target: SCN9A; (+) strand; PAM type: NRG; PAM sequence: GAG
ggattttaggtgtctgaaca

SEQ ID NO: 42004 - DNA, 20 bp, Artificial Sequence
  Description of Artificial Sequence: Synthetic oligonucleotide
  Target: SCN9A; (+) strand; PAM type: NRG; PAM sequence: GAG
attttaggtgtctgaacaga

SEQ ID NO: 42005 - DNA, 20 bp, Artificial Sequence
  Description of Artificial Sequence: Synthetic oligonucleotide
  Target: SCN9A; (+) strand; PAM type: NRG; PAM sequence: GAG
tttaggtgtctgaacagaga

SEQ ID NO: 42006 - DNA, 20 bp, Artificial Sequence
  Description of Artificial Sequence: Synthetic oligonucleotide
  Target: SCN9A; (+) strand; PAM type: NRG; PAM sequence: CAG
ctgaacagagagagaatatc

SEQ ID NO: 42007 - DNA, 20 bp, Artificial Sequence
  Description of Artificial Sequence: Synthetic oligonucleotide
  Target: SCN9A; (+) strand; PAM type: NRG; PAM sequence: TGG
gaatatccagttatgtctcc

SEQ ID NO: 42008 - DNA, 20 bp, Artificial Sequence
  Description of Artificial Sequence: Synthetic oligonucleotide
  Target: SCN9A; (+) strand; PAM type: NRG; PAM sequence: TGG
tatccagttatgtctcctgg

SEQ ID NO: 42009 - DNA, 20 bp, Artificial Sequence
  Description of Artificial Sequence: Synthetic oligonucleotide
  Target: SCN9A; (+) strand; PAM type: NRG; PAM sequence: CGG
cagttatgtctcctggtgga

SEQ ID NO: 42010 - DNA, 20 bp, Artificial Sequence
  Description of Artificial Sequence: Synthetic oligonucleotide
  Target: SCN9A; (+) strand; PAM type: NRG; PAM sequence: AAG
atgtctcctggtggacggac

SEQ ID NO: 42011 - DNA, 20 bp, Artificial Sequence
  Description of Artificial Sequence: Synthetic oligonucleotide
  Target: SCN9A; (+) strand; PAM type: NRG; PAM sequence: AGG
tgtctcctggtggacggaca

SEQ ID NO: 42012 - DNA, 20 bp, Artificial Sequence
  Description of Artificial Sequence: Synthetic oligonucleotide
  Target: SCN9A; (+) strand; PAM type: NRG; PAM sequence: GAG
ggacaaggcaactttaaatt

SEQ ID NO: 42013 - DNA, 20 bp, Artificial Sequence
  Description of Artificial Sequence: Synthetic oligonucleotide
  Target: SCN9A; (+) strand; PAM type: NRG; PAM sequence: AAG
caactttaaattgagcctta

SEQ ID NO: 42014 - DNA, 20 bp, Artificial Sequence
  Description of Artificial Sequence: Synthetic oligonucleotide
  Target: SCN9A; (+) strand; PAM type: NRG; PAM sequence: AGG
aactttaaattgagccttaa

SEQ ID NO: 42015 - DNA, 20 bp, Artificial Sequence
  Description of Artificial Sequence: Synthetic oligonucleotide
  Target: SCN9A; (+) strand; PAM type: NRG; PAM sequence: CAG
ttaaattgagccttaaagga

SEQ ID NO: 42016 - DNA, 20 bp, Artificial Sequence
  Description of Artificial Sequence: Synthetic oligonucleotide
  Target: SCN9A; (+) strand; PAM type: NRG; PAM sequence: TAG
attgagccttaaaggacaga

SEQ ID NO: 42017 - DNA, 20 bp, Artificial Sequence
  Description of Artificial Sequence: Synthetic oligonucleotide
  Target: SCN9A; (+) strand; PAM type: NRG; PAM sequence: AGG
ttgagccttaaaggacagat

SEQ ID NO: 42018 - DNA, 20 bp, Artificial Sequence
  Description of Artificial Sequence: Synthetic oligonucleotide
  Target: SCN9A; (+) strand; PAM type: NRG; PAM sequence: CGG
gtgtttgtctgctatacaaa

SEQ ID NO: 42019 - DNA, 20 bp, Artificial Sequence
  Description of Artificial Sequence: Synthetic oligonucleotide
  Target: SCN9A; (+) strand; PAM type: NRG; PAM sequence: GGG
tgtttgtctgctatacaaac

SEQ ID NO: 42020 - DNA, 20 bp, Artificial Sequence
  Description of Artificial Sequence: Synthetic oligonucleotide
  Target: SCN9A; (+) strand; PAM type: NRG; PAM sequence: TAG
tgtctgctatacaaacgggt

SEQ ID NO: 42021 - DNA, 20 bp, Artificial Sequence
  Description of Artificial Sequence: Synthetic oligonucleotide
  Target: SCN9A; (+) strand; PAM type: NRG; PAM sequence: AGG
gtctgctatacaaacgggtt

SEQ ID NO: 42022 - DNA, 20 bp, Artificial Sequence
  Description of Artificial Sequence: Synthetic oligonucleotide
  Target: SCN9A; (+) strand; PAM type: NRG; PAM sequence: GGG
tctgctatacaaacgggtta

SEQ ID NO: 42023 - DNA, 20 bp, Artificial Sequence
  Description of Artificial Sequence: Synthetic oligonucleotide
  Target: SCN9A; (+) strand; PAM type: NRG; PAM sequence: CGG
ctatacaaacgggttagggt

SEQ ID NO: 42024 - DNA, 20 bp, Artificial Sequence
  Description of Artificial Sequence: Synthetic oligonucleotide
  Target: SCN9A; (+) strand; PAM type: NRG; PAM sequence: GGG
tatacaaacgggttagggtc

SEQ ID NO: 42025 - DNA, 20 bp, Artificial Sequence
  Description of Artificial Sequence: Synthetic oligonucleotide
  Target: SCN9A; (+) strand; PAM type: NRG; PAM sequence: CAG
caaacgggttagggtcggga

SEQ ID NO: 42026 - DNA, 20 bp, Artificial Sequence
  Description of Artificial Sequence: Synthetic oligonucleotide
  Target: SCN9A; (+) strand; PAM type: NRG; PAM sequence: AGG
aaacgggttagggtcgggac

SEQ ID NO: 42027 - DNA, 20 bp, Artificial Sequence
  Description of Artificial Sequence: Synthetic oligonucleotide
  Target: SCN9A; (+) strand; PAM type: NRG; PAM sequence: GGG
aacgggttagggtcgggaca

SEQ ID NO: 42028 - DNA, 20 bp, Artificial Sequence
  Description of Artificial Sequence: Synthetic oligonucleotide
  Target: SCN9A; (+) strand; PAM type: NRG; PAM sequence: CAG
gggttagggtcgggacaggg

SEQ ID NO: 42029 - DNA, 20 bp, Artificial Sequence
  Description of Artificial Sequence: Synthetic oligonucleotide
  Target: SCN9A; (+) strand; PAM type: NRG; PAM sequence: AGG
ggttagggtcgggacagggc

SEQ ID NO: 42030 - DNA, 20 bp, Artificial Sequence
  Description of Artificial Sequence: Synthetic oligonucleotide
  Target: SCN9A; (+) strand; PAM type: NRG; PAM sequence: GGG
gttagggtcgggacagggca

SEQ ID NO: 42031 - DNA, 20 bp, Artificial Sequence
  Description of Artificial Sequence: Synthetic oligonucleotide
  Target: SCN9A; (+) strand; PAM type: NRG; PAM sequence: GGG
ttagggtcgggacagggcag

SEQ ID NO: 42032 - DNA, 20 bp, Artificial Sequence
  Description of Artificial Sequence: Synthetic oligonucleotide
  Target: SCN9A; (+) strand; PAM type: NRG; PAM sequence: AAG
gggtcgggacagggcagggg

SEQ ID NO: 42033 - DNA, 20 bp, Artificial Sequence
  Description of Artificial Sequence: Synthetic oligonucleotide
  Target: SCN9A; (+) strand; PAM type: NRG; PAM sequence: CAG
acagggcaggggaagcattc

SEQ ID NO: 42034 - DNA, 20 bp, Artificial Sequence
  Description of Artificial Sequence: Synthetic oligonucleotide
  Target: SCN9A; (+) strand; PAM type: NRG; PAM sequence: CAG
gcaggggaagcattccagaa

SEQ ID NO: 42035 - DNA, 20 bp, Artificial Sequence
  Description of Artificial Sequence: Synthetic oligonucleotide
  Target: SCN9A; (+) strand; PAM type: NRG; PAM sequence: GAG
aggggaagcattccagaaca

SEQ ID NO: 42036 - DNA, 20 bp, Artificial Sequence
  Description of Artificial Sequence: Synthetic oligonucleotide
  Target: SCN9A; (+) strand; PAM type: NRG; PAM sequence: AGG
ggggaagcattccagaacag

SEQ ID NO: 42037 - DNA, 20 bp, Artificial Sequence
  Description of Artificial Sequence: Synthetic oligonucleotide
  Target: SCN9A; (+) strand; PAM type: NRG; PAM sequence: TAG
tccagaacagaggcataaaa

SEQ ID NO: 42038 - DNA, 20 bp, Artificial Sequence
  Description of Artificial Sequence: Synthetic oligonucleotide
  Target: SCN9A; (+) strand; PAM type: NRG; PAM sequence: CAG
agaacagaggcataaaatag

SEQ ID NO: 42039 - DNA, 20 bp, Artificial Sequence
  Description of Artificial Sequence: Synthetic oligonucleotide
  Target: SCN9A; (+) strand; PAM type: NRG; PAM sequence: AGG
gaacagaggcataaaatagc

SEQ ID NO: 42040 - DNA, 20 bp, Artificial Sequence
  Description of Artificial Sequence: Synthetic oligonucleotide
  Target: SCN9A; (+) strand; PAM type: NRG; PAM sequence: TGG
taaaatagcaggtataaatc

SEQ ID NO: 42041 - DNA, 20 bp, Artificial Sequence
  Description of Artificial Sequence: Synthetic oligonucleotide
  Target: SCN9A; (+) strand; PAM type: NRG; PAM sequence: GAG
aaatagcaggtataaatctg

SEQ ID NO: 42042 - DNA, 20 bp, Artificial Sequence
  Description of Artificial Sequence: Synthetic oligonucleotide
  Target: SCN9A; (+) strand; PAM type: NRG; PAM sequence: AAG
tagcaggtataaatctggag

SEQ ID NO: 42043 - DNA, 20 bp, Artificial Sequence
  Description of Artificial Sequence: Synthetic oligonucleotide
  Target: SCN9A; (+) strand; PAM type: NRG; PAM sequence: TAG
taaatctggagaagaaattt

SEQ ID NO: 42044 - DNA, 20 bp, Artificial Sequence
  Description of Artificial Sequence: Synthetic oligonucleotide
  Target: SCN9A; (+) strand; PAM type: NRG; PAM sequence: GAG
aatctggagaagaaatttta

SEQ ID NO: 42045 - DNA, 20 bp, Artificial Sequence
  Description of Artificial Sequence: Synthetic oligonucleotide
  Target: SCN9A; (+) strand; PAM type: NRG; PAM sequence: AGG
atctggagaagaaattttag

SEQ ID NO: 42046 - DNA, 20 bp, Artificial Sequence
  Description of Artificial Sequence: Synthetic oligonucleotide
  Target: SCN9A; (+) strand; PAM type: NRG; PAM sequence: GAG
ctggagaagaaattttagag

SEQ ID NO: 42047 - DNA, 20 bp, Artificial Sequence
  Description of Artificial Sequence: Synthetic oligonucleotide
  Target: SCN9A; (+) strand; PAM type: NRG; PAM sequence: GAG
ttagaggagtaccaacacat

SEQ ID NO: 42048 - DNA, 20 bp, Artificial Sequence
  Description of Artificial Sequence: Synthetic oligonucleotide
  Target: SCN9A; (+) strand; PAM type: NRG; PAM sequence: AGG
tagaggagtaccaacacatg

SEQ ID NO: 42049 - DNA, 20 bp, Artificial Sequence
  Description of Artificial Sequence: Synthetic oligonucleotide
  Target: SCN9A; (+) strand; PAM type: NRG; PAM sequence: TGG
agtaccaacacatgaggata

SEQ ID NO: 42050 - DNA, 20 bp, Artificial Sequence
  Description of Artificial Sequence: Synthetic oligonucleotide
  Target: SCN9A; (+) strand; PAM type: NRG; PAM sequence: CAG
atgaggatatggactaatta

SEQ ID NO: 42051 - DNA, 20 bp, Artificial Sequence
  Description of Artificial Sequence: Synthetic oligonucleotide
  Target: SCN9A; (+) strand; PAM type: NRG; PAM sequence: TAG
tatggactaattacagaaaa

SEQ ID NO: 42052 - DNA, 20 bp, Artificial Sequence
  Description of Artificial Sequence: Synthetic oligonucleotide
  Target: SCN9A; (+) strand; PAM type: NRG; PAM sequence: GAG
tggactaattacagaaaata

SEQ ID NO: 42053 - DNA, 20 bp, Artificial Sequence
  Description of Artificial Sequence: Synthetic oligonucleotide
  Target: SCN9A; (+) strand; PAM type: NRG; PAM sequence: AAG
tgtcctccatgtgtgttaca

SEQ ID NO: 42054 - DNA, 20 bp, Artificial Sequence
  Description of Artificial Sequence: Synthetic oligonucleotide
  Target: SCN9A; (+) strand; PAM type: NRG; PAM sequence: TGG
catgtgtgttacaaagttgc

SEQ ID NO: 42055 - DNA, 20 bp, Artificial Sequence
  Description of Artificial Sequence: Synthetic oligonucleotide
  Target: SCN9A; (+) strand; PAM type: NRG; PAM sequence: AAG
ctggtttaatacaatcctta

SEQ ID NO: 42056 - DNA, 20 bp, Artificial Sequence
  Description of Artificial Sequence: Synthetic oligonucleotide
  Target: SCN9A; (+) strand; PAM type: NRG; PAM sequence: TAG
tttaatacaatccttaaagc

SEQ ID NO: 42057 - DNA, 20 bp, Artificial Sequence
  Description of Artificial Sequence: Synthetic oligonucleotide
  Target: SCN9A; (+) strand; PAM type: NRG; PAM sequence: AGG
ttaatacaatccttaaagct

SEQ ID NO: 42058 - DNA, 20 bp, Artificial Sequence
  Description of Artificial Sequence: Synthetic oligonucleotide
  Target: SCN9A; (+) strand; PAM type: NRG; PAM sequence: TGG
caatccttaaagctaggtta

SEQ ID NO: 42059 - DNA, 20 bp, Artificial Sequence
  Description of Artificial Sequence: Synthetic oligonucleotide
  Target: SCN9A; (+) strand; PAM type: NRG; PAM sequence: TAG
tccttaaagctaggttatgg

SEQ ID NO: 42060 - DNA, 20 bp, Artificial Sequence
  Description of Artificial Sequence: Synthetic oligonucleotide
  Target: SCN9A; (+) strand; PAM type: NRG; PAM sequence: GAG
cttgtttgtctctgctaatt

SEQ ID NO: 42061 - DNA, 20 bp, Artificial Sequence
  Description of Artificial Sequence: Synthetic oligonucleotide
  Target: SCN9A; (+) strand; PAM type: NRG; PAM sequence: CAG
ctgctaattgagtatctttt

SEQ ID NO: 42062 - DNA, 20 bp, Artificial Sequence
  Description of Artificial Sequence: Synthetic oligonucleotide
  Target: SCN9A; (+) strand; PAM type: NRG; PAM sequence: AGG
tgctaattgagtatcttttc

SEQ ID NO: 42063 - DNA, 20 bp, Artificial Sequence
  Description of Artificial Sequence: Synthetic oligonucleotide
  Target: SCN9A; (+) strand; PAM type: NRG; PAM sequence: CAG
gtatcttttcaggcactctg

SEQ ID NO: 42064 - DNA, 20 bp, Artificial Sequence
  Description of Artificial Sequence: Synthetic oligonucleotide
  Target: SCN9A; (+) strand; PAM type: NRG; PAM sequence: AAG
tttcaggcactctgcagcct

SEQ ID NO: 42065 - DNA, 20 bp, Artificial Sequence
  Description of Artificial Sequence: Synthetic oligonucleotide
  Target: SCN9A; (+) strand; PAM type: NRG; PAM sequence: AAG
ctgcagcctaagtgcaaatt

SEQ ID NO: 42066 - DNA, 20 bp, Artificial Sequence
  Description of Artificial Sequence: Synthetic oligonucleotide
  Target: SCN9A; (+) strand; PAM type: NRG; PAM sequence: GAG
gcaaattaagtaaactctct

SEQ ID NO: 42067 - DNA, 20 bp, Artificial Sequence
  Description of Artificial Sequence: Synthetic oligonucleotide
  Target: SCN9A; (+) strand; PAM type: NRG; PAM sequence: TAG
taagtaaactctctgagctt

SEQ ID NO: 42068 - DNA, 20 bp, Artificial Sequence
  Description of Artificial Sequence: Synthetic oligonucleotide
  Target: SCN9A; (+) strand; PAM type: NRG; PAM sequence: TAG
tagttttctcaaatataatt

SEQ ID NO: 42069 - DNA, 20 bp, Artificial Sequence
  Description of Artificial Sequence: Synthetic oligonucleotide
  Target: SCN9A; (+) strand; PAM type: NRG; PAM sequence: AAG
tactttgcaatgttatttta

SEQ ID NO: 42070 - DNA, 20 bp, Artificial Sequence
  Description of Artificial Sequence: Synthetic oligonucleotide
  Target: SCN9A; (+) strand; PAM type: NRG; PAM sequence: AGG
actttgcaatgttattttaa

SEQ ID NO: 42071 - DNA, 20 bp, Artificial Sequence
  Description of Artificial Sequence: Synthetic oligonucleotide
  Target: SCN9A; (+) strand; PAM type: NRG; PAM sequence: TGG
aaaggtgaaattaaatgtga

SEQ ID NO: 42072 - DNA, 20 bp, Artificial Sequence
  Description of Artificial Sequence: Synthetic oligonucleotide
  Target: SCN9A; (+) strand; PAM type: NRG; PAM sequence: CAG
cttttctaatgctccttacc

SEQ ID NO: 42073 - DNA, 20 bp, Artificial Sequence
  Description of Artificial Sequence: Synthetic oligonucleotide
  Target: SCN9A; (+) strand; PAM type: NRG; PAM sequence: AGG
ttttctaatgctccttaccc

SEQ ID NO: 42074 - DNA, 20 bp, Artificial Sequence
  Description of Artificial Sequence: Synthetic oligonucleotide
  Target: SCN9A; (+) strand; PAM type: NRG; PAM sequence: TAG
tctaatgctccttacccagg

SEQ ID NO: 42075 - DNA, 20 bp, Artificial Sequence
  Description of Artificial Sequence: Synthetic oligonucleotide
  Target: SCN9A; (+) strand; PAM type: NRG; PAM sequence: AAG
attatttgaacacctgatat

SEQ ID NO: 42076 - DNA, 20 bp, Artificial Sequence
  Description of Artificial Sequence: Synthetic oligonucleotide
  Target: SCN9A; (+) strand; PAM type: NRG; PAM sequence: TAG
atttgaacacctgatataag

SEQ ID NO: 42077 - DNA, 20 bp, Artificial Sequence
  Description of Artificial Sequence: Synthetic oligonucleotide
  Target: SCN9A; (+) strand; PAM type: NRG; PAM sequence: AGG
tttgaacacctgatataagt

SEQ ID NO: 42078 - DNA, 20 bp, Artificial Sequence
  Description of Artificial Sequence: Synthetic oligonucleotide
  Target: SCN9A; (+) strand; PAM type: NRG; PAM sequence: GAG
gtccttgattacttatgtat

SEQ ID NO: 42079 - DNA, 20 bp, Artificial Sequence
  Description of Artificial Sequence: Synthetic oligonucleotide
  Target: SCN9A; (+) strand; PAM type: NRG; PAM sequence: GAG
ccttgattacttatgtatga

SEQ ID NO: 42080 - DNA, 20 bp, Artificial Sequence
  Description of Artificial Sequence: Synthetic oligonucleotide
  Target: SCN9A; (+) strand; PAM type: NRG; PAM sequence: TAG
ttatgtatgagagatgatgt

SEQ ID NO: 42081 - DNA, 20 bp, Artificial Sequence
  Description of Artificial Sequence: Synthetic oligonucleotide
  Target: SCN9A; (+) strand; PAM type: NRG; PAM sequence: AGG
tatgtatgagagatgatgtt

SEQ ID NO: 42082 - DNA, 20 bp, Artificial Sequence
  Description of Artificial Sequence: Synthetic oligonucleotide
  Target: SCN9A; (+) strand; PAM type: NRG; PAM sequence: TAG
agagatgatgttaggaacaa

SEQ ID NO: 42083 - DNA, 20 bp, Artificial Sequence
  Description of Artificial Sequence: Synthetic oligonucleotide
  Target: SCN9A; (+) strand; PAM type: NRG; PAM sequence: TGG
caatagtttcccctttcact

SEQ ID NO: 42084 - DNA, 20 bp, Artificial Sequence
  Description of Artificial Sequence: Synthetic oligonucleotide
  Target: SCN9A; (+) strand; PAM type: NRG; PAM sequence: TAG
cccctttcacttggacttcc

SEQ ID NO: 42085 - DNA, 20 bp, Artificial Sequence
  Description of Artificial Sequence: Synthetic oligonucleotide
  Target: SCN9A; (+) strand; PAM type: NRG; PAM sequence: CAG
ttcacttggacttcctagca

SEQ ID NO: 42086 - DNA, 20 bp, Artificial Sequence
  Description of Artificial Sequence: Synthetic oligonucleotide
  Target: SCN9A; (+) strand; PAM type: NRG; PAM sequence: AGG
tcacttggacttcctagcac

SEQ ID NO: 42087 - DNA, 20 bp, Artificial Sequence
  Description of Artificial Sequence: Synthetic oligonucleotide
  Target: SCN9A; (+) strand; PAM type: NRG; PAM sequence: GGG
cacttggacttcctagcaca

SEQ ID NO: 42088 - DNA, 20 bp, Artificial Sequence
  Description of Artificial Sequence: Synthetic oligonucleotide
  Target: SCN9A; (+) strand; PAM type: NRG; PAM sequence: AAG
ttggacttcctagcacaggg

SEQ ID NO: 42089 - DNA, 20 bp, Artificial Sequence
  Description of Artificial Sequence: Synthetic oligonucleotide
  Target: SCN9A; (+) strand; PAM type: NRG; PAM sequence: AAG
atttccatttaatatgaaaa

SEQ ID NO: 42090 - DNA, 20 bp, Artificial Sequence
  Description of Artificial Sequence: Synthetic oligonucleotide
  Target: SCN9A; (+) strand; PAM type: NRG; PAM sequence: TGG
tatgaaaaaagtcactcatt

SEQ ID NO: 42091 - DNA, 20 bp, Artificial Sequence
  Description of Artificial Sequence: Synthetic oligonucleotide
  Target: SCN9A; (+) strand; PAM type: NRG; PAM sequence: TAG
attctattgtttgacaatat

SEQ ID NO: 42092 - DNA, 20 bp, Artificial Sequence
  Description of Artificial Sequence: Synthetic oligonucleotide
  Target: SCN9A; (+) strand; PAM type: NRG; PAM sequence: AAG
ttgtttgacaatattagata

SEQ ID NO: 42093 - DNA, 20 bp, Artificial Sequence
  Description of Artificial Sequence: Synthetic oligonucleotide
  Target: SCN9A; (+) strand; PAM type: NRG; PAM sequence: AGG
tgtttgacaatattagataa

SEQ ID NO: 42094 - DNA, 20 bp, Artificial Sequence
  Description of Artificial Sequence: Synthetic oligonucleotide
  Target: SCN9A; (+) strand; PAM type: NRG; PAM sequence: CAG
ttgacaatattagataaagg

SEQ ID NO: 42095 - DNA, 20 bp, Artificial Sequence
  Description of Artificial Sequence: Synthetic oligonucleotide
  Target: SCN9A; (+) strand; PAM type: NRG; PAM sequence: AGG
tgacaatattagataaaggc

SEQ ID NO: 42096 - DNA, 20 bp, Artificial Sequence
  Description of Artificial Sequence: Synthetic oligonucleotide
  Target: SCN9A; (+) strand; PAM type: NRG; PAM sequence: TAG
tgtgtatatatatatatata

SEQ ID NO: 42097 - DNA, 20 bp, Artificial Sequence
  Description of Artificial Sequence: Synthetic oligonucleotide
  Target: SCN9A; (+) strand; PAM type: NRG; PAM sequence: GAG
tgtatatatatatatatata

SEQ ID NO: 42098 - DNA, 20 bp, Artificial Sequence
  Description of Artificial Sequence: Synthetic oligonucleotide
  Target: SCN9A; (+) strand; PAM type: NRG; PAM sequence: GAG
tatatatatatatatataga

SEQ ID NO: 42099 - DNA, 20 bp, Artificial Sequence
  Description of Artificial Sequence: Synthetic oligonucleotide
  Target: SCN9A; (+) strand; PAM type: NRG; PAM sequence: GAG
tatatatatatatatagaga

SEQ ID NO: 42100 - DNA, 20 bp, Artificial Sequence
  Description of Artificial Sequence: Synthetic oligonucleotide
  Target: SCN9A; (+) strand; PAM type: NRG; PAM sequence: GAG
tatatatatatatagagaga

SEQ ID NO: 42101 - DNA, 20 bp, Artificial Sequence
  Description of Artificial Sequence: Synthetic oligonucleotide
  Target: SCN9A; (+) strand; PAM type: NRG; PAM sequence: GAG
tatatatatatagagagaga

SEQ ID NO: 42102 - DNA, 20 bp, Artificial Sequence
  Description of Artificial Sequence: Synthetic oligonucleotide
  Target: SCN9A; (+) strand; PAM type: NRG; PAM sequence: GAG
tatatatatagagagagaga

SEQ ID NO: 42103 - DNA, 20 bp, Artificial Sequence
  Description of Artificial Sequence: Synthetic oligonucleotide
  Target: SCN9A; (+) strand; PAM type: NRG; PAM sequence: CAG
catatatatactaatatgta

SEQ ID NO: 42104 - DNA, 20 bp, Artificial Sequence
  Description of Artificial Sequence: Synthetic oligonucleotide
  Target: SCN9A; (+) strand; PAM type: NRG; PAM sequence: TAG
atatatgcatattttatata

SEQ ID NO: 42105 - DNA, 20 bp, Artificial Sequence
  Description of Artificial Sequence: Synthetic oligonucleotide
  Target: SCN9A; (+) strand; PAM type: NRG; PAM sequence: TAG
ctgtatatattaatatataa

SEQ ID NO: 42106 - DNA, 20 bp, Artificial Sequence
  Description of Artificial Sequence: Synthetic oligonucleotide
  Target: SCN9A; (+) strand; PAM type: NRG; PAM sequence: TAG
atataatagtatatactaat

SEQ ID NO: 42107 - DNA, 20 bp, Artificial Sequence
  Description of Artificial Sequence: Synthetic oligonucleotide
  Target: SCN9A; (+) strand; PAM type: NRG; PAM sequence: TAG
taattagtattatacttttt

SEQ ID NO: 42108 - DNA, 20 bp, Artificial Sequence
  Description of Artificial Sequence: Synthetic oligonucleotide
  Target: SCN9A; (+) strand; PAM type: NRG; PAM sequence: TAG
atacttttttagtaatatac

SEQ ID NO: 42109 - DNA, 20 bp, Artificial Sequence
  Description of Artificial Sequence: Synthetic oligonucleotide
  Target: SCN9A; (+) strand; PAM type: NRG; PAM sequence: GAG
atatactagtatatactaat

SEQ ID NO: 42110 - DNA, 20 bp, Artificial Sequence
  Description of Artificial Sequence: Synthetic oligonucleotide
  Target: SCN9A; (+) strand; PAM type: NRG; PAM sequence: TAG
aatgagtattatactatttt

SEQ ID NO: 42111 - DNA, 20 bp, Artificial Sequence
  Description of Artificial Sequence: Synthetic oligonucleotide
  Target: SCN9A; (+) strand; PAM type: NRG; PAM sequence: TAG
tatttaattaatgctataat

SEQ ID NO: 42112 - DNA, 20 bp, Artificial Sequence
  Description of Artificial Sequence: Synthetic oligonucleotide
  Target: SCN9A; (+) strand; PAM type: NRG; PAM sequence: TAG
tataattagtatttatatat

SEQ ID NO: 42113 - DNA, 20 bp, Artificial Sequence
  Description of Artificial Sequence: Synthetic oligonucleotide
  Target: SCN9A; (+) strand; PAM type: NRG; PAM sequence: TAG
ttagtatgcatatataccat

SEQ ID NO: 42114 - DNA, 20 bp, Artificial Sequence
  Description of Artificial Sequence: Synthetic oligonucleotide
  Target: SCN9A; (+) strand; PAM type: NRG; PAM sequence: TAG
ataatatgcatatatactat

SEQ ID NO: 42115 - DNA, 20 bp, Artificial Sequence
  Description of Artificial Sequence: Synthetic oligonucleotide
  Target: SCN9A; (+) strand; PAM type: NRG; PAM sequence: TAG
aatatgcatatatatactat

SEQ ID NO: 42116 - DNA, 20 bp, Artificial Sequence
  Description of Artificial Sequence: Synthetic oligonucleotide
  Target: SCN9A; (+) strand; PAM type: NRG; PAM sequence: TAG
ccatatatgcatactatata

SEQ ID NO: 42117 - DNA, 20 bp, Artificial Sequence
  Description of Artificial Sequence: Synthetic oligonucleotide
  Target: SCN9A; (+) strand; PAM type: NRG; PAM sequence: TAG
gtatatatgcatactgtata

SEQ ID NO: 42118 - DNA, 20 bp, Artificial Sequence
  Description of Artificial Sequence: Synthetic oligonucleotide
  Target: SCN9A; (+) strand; PAM type: NRG; PAM sequence: TAG
gtatgtaaatgcatactata

SEQ ID NO: 42119 - DNA, 20 bp, Artificial Sequence
  Description of Artificial Sequence: Synthetic oligonucleotide
  Target: SCN9A; (+) strand; PAM type: NRG; PAM sequence: CAG
tgtacacacacatacataaa

SEQ ID NO: 42120 - DNA, 20 bp, Artificial Sequence
  Description of Artificial Sequence: Synthetic oligonucleotide
  Target: SCN9A; (+) strand; PAM type: NRG; PAM sequence: CAG
agcctatgtatttatgtaaa

SEQ ID NO: 42121 - DNA, 20 bp, Artificial Sequence
  Description of Artificial Sequence: Synthetic oligonucleotide
  Target: SCN9A; (+) strand; PAM type: NRG; PAM sequence: AAG
tttaaaccccattaaaaaat

SEQ ID NO: 42122 - DNA, 20 bp, Artificial Sequence
  Description of Artificial Sequence: Synthetic oligonucleotide
  Target: SCN9A; (+) strand; PAM type: NRG; PAM sequence: AAG
taaaaaataagaacattata

SEQ ID NO: 42123 - DNA, 20 bp, Artificial Sequence
  Description of Artificial Sequence: Synthetic oligonucleotide
  Target: SCN9A; (+) strand; PAM type: NRG; PAM sequence: TAG
aataagaacattataaagtt

SEQ ID NO: 42124 - DNA, 20 bp, Artificial Sequence
  Description of Artificial Sequence: Synthetic oligonucleotide
  Target: SCN9A; (+) strand; PAM type: NRG; PAM sequence: TAG
taccctcattccttcaaatc

SEQ ID NO: 42125 - DNA, 20 bp, Artificial Sequence
  Description of Artificial Sequence: Synthetic oligonucleotide
  Target: SCN9A; (+) strand; PAM type: NRG; PAM sequence: AAG
tcattccttcaaatctagat

SEQ ID NO: 42126 - DNA, 20 bp, Artificial Sequence
  Description of Artificial Sequence: Synthetic oligonucleotide
  Target: SCN9A; (+) strand; PAM type: NRG; PAM sequence: AGG
cattccttcaaatctagata

SEQ ID NO: 42127 - DNA, 20 bp, Artificial Sequence
  Description of Artificial Sequence: Synthetic oligonucleotide
  Target: SCN9A; (+) strand; PAM type: NRG; PAM sequence: TAG
tcaaatctagataaggctct

SEQ ID NO: 42128 - DNA, 20 bp, Artificial Sequence
  Description of Artificial Sequence: Synthetic oligonucleotide
  Target: SCN9A; (+) strand; PAM type: NRG; PAM sequence: GAG
aaatctagataaggctctta

SEQ ID NO: 42129 - DNA, 20 bp, Artificial Sequence
  Description of Artificial Sequence: Synthetic oligonucleotide
  Target: SCN9A; (+) strand; PAM type: NRG; PAM sequence: AGG
aatctagataaggctcttag

SEQ ID NO: 42130 - DNA, 20 bp, Artificial Sequence
  Description of Artificial Sequence: Synthetic oligonucleotide
  Target: SCN9A; (+) strand; PAM type: NRG; PAM sequence: AAG
taaggctcttagaggtctta

SEQ ID NO: 42131 - DNA, 20 bp, Artificial Sequence
  Description of Artificial Sequence: Synthetic oligonucleotide
  Target: SCN9A; (+) strand; PAM type: NRG; PAM sequence: CAG
cttagaggtcttaaagctct

SEQ ID NO: 42132 - DNA, 20 bp, Artificial Sequence
  Description of Artificial Sequence: Synthetic oligonucleotide
  Target: SCN9A; (+) strand; PAM type: NRG; PAM sequence: AAG
cttaaagctctcagtgtccg

SEQ ID NO: 42133 - DNA, 20 bp, Artificial Sequence
  Description of Artificial Sequence: Synthetic oligonucleotide
  Target: SCN9A; (+) strand; PAM type: NRG; PAM sequence: AGG
ttaaagctctcagtgtccga

SEQ ID NO: 42134 - DNA, 20 bp, Artificial Sequence
  Description of Artificial Sequence: Synthetic oligonucleotide
  Target: SCN9A; (+) strand; PAM type: NRG; PAM sequence: GGG
taaagctctcagtgtccgaa

SEQ ID NO: 42135 - DNA, 20 bp, Artificial Sequence
  Description of Artificial Sequence: Synthetic oligonucleotide
  Target: SCN9A; (+) strand; PAM type: NRG; PAM sequence: TGG
cagtgtccgaagggatttaa

SEQ ID NO: 42136 - DNA, 20 bp, Artificial Sequence
  Description of Artificial Sequence: Synthetic oligonucleotide
  Target: SCN9A; (+) strand; PAM type: NRG; PAM sequence: GGG
agtgtccgaagggatttaat

SEQ ID NO: 42137 - DNA, 20 bp, Artificial Sequence
  Description of Artificial Sequence: Synthetic oligonucleotide
  Target: SCN9A; (+) strand; PAM type: NRG; PAM sequence: GGG
gtgtccgaagggatttaatg

SEQ ID NO: 42138 - DNA, 20 bp, Artificial Sequence
  Description of Artificial Sequence: Synthetic oligonucleotide
  Target: SCN9A; (+) strand; PAM type: NRG; PAM sequence: AAG
cgaagggatttaatggggcc

SEQ ID NO: 42139 - DNA, 20 bp, Artificial Sequence
  Description of Artificial Sequence: Synthetic oligonucleotide
  Target: SCN9A; (+) strand; PAM type: NRG; PAM sequence: GAG
atttaatggggccaagatct

SEQ ID NO: 42140 - DNA, 20 bp, Artificial Sequence
  Description of Artificial Sequence: Synthetic oligonucleotide
  Target: SCN9A; (+) strand; PAM type: NRG; PAM sequence: TAG
taatggggccaagatctgag

SEQ ID NO: 42141 - DNA, 20 bp, Artificial Sequence
  Description of Artificial Sequence: Synthetic oligonucleotide
  Target: SCN9A; (+) strand; PAM type: NRG; PAM sequence: AAG
gggccaagatctgagtagcc

SEQ ID NO: 42142 - DNA, 20 bp, Artificial Sequence
  Description of Artificial Sequence: Synthetic oligonucleotide
  Target: SCN9A; (+) strand; PAM type: NRG; PAM sequence: GAG
gccaagatctgagtagccaa

SEQ ID NO: 42143 - DNA, 20 bp, Artificial Sequence
  Description of Artificial Sequence: Synthetic oligonucleotide
  Target: SCN9A; (+) strand; PAM type: NRG; PAM sequence: AAG
gccaagagtgtttgccacta

SEQ ID NO: 42144 - DNA, 20 bp, Artificial Sequence
  Description of Artificial Sequence: Synthetic oligonucleotide
  Target: SCN9A; (+) strand; PAM type: NRG; PAM sequence: AAG
gtttgccactaaagtaacca

SEQ ID NO: 42145 - DNA, 20 bp, Artificial Sequence
  Description of Artificial Sequence: Synthetic oligonucleotide
  Target: SCN9A; (+) strand; PAM type: NRG; PAM sequence: AAG
attgtgtcaataaaatgatg

SEQ ID NO: 42146 - DNA, 20 bp, Artificial Sequence
  Description of Artificial Sequence: Synthetic oligonucleotide
  Target: SCN9A; (+) strand; PAM type: NRG; PAM sequence: AAG
aataaaatgatgaagcataa

SEQ ID NO: 42147 - DNA, 20 bp, Artificial Sequence
  Description of Artificial Sequence: Synthetic oligonucleotide
  Target: SCN9A; (+) strand; PAM type: NRG; PAM sequence: AGG
ataaaatgatgaagcataaa

SEQ ID NO: 42148 - DNA, 20 bp, Artificial Sequence
  Description of Artificial Sequence: Synthetic oligonucleotide
  Target: SCN9A; (+) strand; PAM type: NRG; PAM sequence: AAG
tgatgaagcataaaaggaaa

SEQ ID NO: 42149 - DNA, 20 bp, Artificial Sequence
  Description of Artificial Sequence: Synthetic oligonucleotide
  Target: SCN9A; (+) strand; PAM type: NRG; PAM sequence: AAG
tcaattctgaaactcactaa

SEQ ID NO: 42150 - DNA, 20 bp, Artificial Sequence
  Description of Artificial Sequence: Synthetic oligonucleotide
  Target: SCN9A; (+) strand; PAM type: NRG; PAM sequence: CAG
actcactaaaagcaactcaa

SEQ ID NO: 42151 - DNA, 20 bp, Artificial Sequence
  Description of Artificial Sequence: Synthetic oligonucleotide
  Target: SCN9A; (+) strand; PAM type: NRG; PAM sequence: AGG
ctcactaaaagcaactcaac

SEQ ID NO: 42152 - DNA, 20 bp, Artificial Sequence
  Description of Artificial Sequence: Synthetic oligonucleotide
  Target: SCN9A; (+) strand; PAM type: NRG; PAM sequence: AAG
agcaactcaacaggaacaat

SEQ ID NO: 42153 - DNA, 20 bp, Artificial Sequence
  Description of Artificial Sequence: Synthetic oligonucleotide
  Target: SCN9A; (+) strand; PAM type: NRG; PAM sequence: TGG
actcaacaggaacaataaga

SEQ ID NO: 42154 - DNA, 20 bp, Artificial Sequence
  Description of Artificial Sequence: Synthetic oligonucleotide
  Target: SCN9A; (+) strand; PAM type: NRG; PAM sequence: CGG
gaacaataagatggtatata

SEQ ID NO: 42155 - DNA, 20 bp, Artificial Sequence
  Description of Artificial Sequence: Synthetic oligonucleotide
  Target: SCN9A; (+) strand; PAM type: NRG; PAM sequence: GAG
acaataagatggtatatacg

SEQ ID NO: 42156 - DNA, 20 bp, Artificial Sequence
  Description of Artificial Sequence: Synthetic oligonucleotide
  Target: SCN9A; (+) strand; PAM type: NRG; PAM sequence: TAG
atggtatatacggagttgtg

SEQ ID NO: 42157 - DNA, 20 bp, Artificial Sequence
  Description of Artificial Sequence: Synthetic oligonucleotide
  Target: SCN9A; (+) strand; PAM type: NRG; PAM sequence: TAG
gtgtagtcaatgcctaaaaa

SEQ ID NO: 42158 - DNA, 20 bp, Artificial Sequence
  Description of Artificial Sequence: Synthetic oligonucleotide
  Target: SCN9A; (+) strand; PAM type: NRG; PAM sequence: AGG
tgtagtcaatgcctaaaaat

SEQ ID NO: 42159 - DNA, 20 bp, Artificial Sequence
  Description of Artificial Sequence: Synthetic oligonucleotide
  Target: SCN9A; (+) strand; PAM type: NRG; PAM sequence: GGG
gtagtcaatgcctaaaaata

SEQ ID NO: 42160 - DNA, 20 bp, Artificial Sequence
  Description of Artificial Sequence: Synthetic oligonucleotide
  Target: SCN9A; (+) strand; PAM type: NRG; PAM sequence: AAG
tcaatgcctaaaaatagggt

SEQ ID NO: 42161 - DNA, 20 bp, Artificial Sequence
  Description of Artificial Sequence: Synthetic oligonucleotide
  Target: SCN9A; (+) strand; PAM type: NRG; PAM sequence: TGG
tgcctaaaaatagggtaaga

SEQ ID NO: 42162 - DNA, 20 bp, Artificial Sequence
  Description of Artificial Sequence: Synthetic oligonucleotide
  Target: SCN9A; (+) strand; PAM type: NRG; PAM sequence: AAG
ggtaagatggatgtttctgt

SEQ ID NO: 42163 - DNA, 20 bp, Artificial Sequence
  Description of Artificial Sequence: Synthetic oligonucleotide
  Target: SCN9A; (+) strand; PAM type: NRG; PAM sequence: AGG
gtaagatggatgtttctgta

SEQ ID NO: 42164 - DNA, 20 bp, Artificial Sequence
  Description of Artificial Sequence: Synthetic oligonucleotide
  Target: SCN9A; (+) strand; PAM type: NRG; PAM sequence: TAG
tggatgtttctgtaaggaaa

SEQ ID NO: 42165 - DNA, 20 bp, Artificial Sequence
  Description of Artificial Sequence: Synthetic oligonucleotide
  Target: SCN9A; (+) strand; PAM type: NRG; PAM sequence: AAG
ctgtaaggaaatagatttaa

SEQ ID NO: 42166 - DNA, 20 bp, Artificial Sequence
  Description of Artificial Sequence: Synthetic oligonucleotide
  Target: SCN9A; (+) strand; PAM type: NRG; PAM sequence: AAG
taaggaaatagatttaaaag

SEQ ID NO: 42167 - DNA, 20 bp, Artificial Sequence
  Description of Artificial Sequence: Synthetic oligonucleotide
  Target: SCN9A; (+) strand; PAM type: NRG; PAM sequence: AGG
aaggaaatagatttaaaaga

SEQ ID NO: 42168 - DNA, 20 bp, Artificial Sequence
  Description of Artificial Sequence: Synthetic oligonucleotide
  Target: SCN9A; (+) strand; PAM type: NRG; PAM sequence: AAG
aaaagaaggttaaccaaaat

SEQ ID NO: 42169 - DNA, 20 bp, Artificial Sequence
  Description of Artificial Sequence: Synthetic oligonucleotide
  Target: SCN9A; (+) strand; PAM type: NRG; PAM sequence: AAG
agaaggttaaccaaaataag

SEQ ID NO: 42170 - DNA, 20 bp, Artificial Sequence
  Description of Artificial Sequence: Synthetic oligonucleotide
  Target: SCN9A; (+) strand; PAM type: NRG; PAM sequence: AAG
aaaataagaagaaataatgt

SEQ ID NO: 42171 - DNA, 20 bp, Artificial Sequence
  Description of Artificial Sequence: Synthetic oligonucleotide
  Target: SCN9A; (+) strand; PAM type: NRG; PAM sequence: AAG
aagaagaaataatgtaagca

SEQ ID NO: 42172 - DNA, 20 bp, Artificial Sequence
  Description of Artificial Sequence: Synthetic oligonucleotide
  Target: SCN9A; (+) strand; PAM type: NRG; PAM sequence: AAG
agaaataatgtaagcaaagt

SEQ ID NO: 42173 - DNA, 20 bp, Artificial Sequence
  Description of Artificial Sequence: Synthetic oligonucleotide
  Target: SCN9A; (+) strand; PAM type: NRG; PAM sequence: TAG
agttgtttattctatttgaa

SEQ ID NO: 42174 - DNA, 20 bp, Artificial Sequence
  Description of Artificial Sequence: Synthetic oligonucleotide
  Target: SCN9A; (+) strand; PAM type: NRG; PAM sequence: TAG
attaaatctaaaaatttaat

SEQ ID NO: 42175 - DNA, 20 bp, Artificial Sequence
  Description of Artificial Sequence: Synthetic oligonucleotide
  Target: SCN9A; (+) strand; PAM type: NRG; PAM sequence: TGG
taaaaatttaattagaacaa

SEQ ID NO: 42176 - DNA, 20 bp, Artificial Sequence
  Description of Artificial Sequence: Synthetic oligonucleotide
  Target: SCN9A; (+) strand; PAM type: NRG; PAM sequence: CAG
aacattttaattataaaact

SEQ ID NO: 42177 - DNA, 20 bp, Artificial Sequence
  Description of Artificial Sequence: Synthetic oligonucleotide
  Target: SCN9A; (+) strand; PAM type: NRG; PAM sequence: AGG
acattttaattataaaactc

SEQ ID NO: 42178 - DNA, 20 bp, Artificial Sequence
  Description of Artificial Sequence: Synthetic oligonucleotide
  Target: SCN9A; (+) strand; PAM type: NRG; PAM sequence: AAG
ataaaactcaggtcaaaatg

SEQ ID NO: 42179 - DNA, 20 bp, Artificial Sequence
  Description of Artificial Sequence: Synthetic oligonucleotide
  Target: SCN9A; (+) strand; PAM type: NRG; PAM sequence: AAG
aaatgaagtgtgtgattctg

SEQ ID NO: 42180 - DNA, 20 bp, Artificial Sequence
  Description of Artificial Sequence: Synthetic oligonucleotide
  Target: SCN9A; (+) strand; PAM type: NRG; PAM sequence: AAG
aagtgtgtgattctgaagct

SEQ ID NO: 42181 - DNA, 20 bp, Artificial Sequence
  Description of Artificial Sequence: Synthetic oligonucleotide
  Target: SCN9A; (+) strand; PAM type: NRG; PAM sequence: AAG
attctgaagctaagccctaa

SEQ ID NO: 42182 - DNA, 20 bp, Artificial Sequence
  Description of Artificial Sequence: Synthetic oligonucleotide
  Target: SCN9A; (+) strand; PAM type: NRG; PAM sequence: TGG
gaagctaagccctaaaagtg

SEQ ID NO: 42183 - DNA, 20 bp, Artificial Sequence
  Description of Artificial Sequence: Synthetic oligonucleotide
  Target: SCN9A; (+) strand; PAM type: NRG; PAM sequence: TAG
actcaactaaatctatgtct

SEQ ID NO: 42184 - DNA, 20 bp, Artificial Sequence
  Description of Artificial Sequence: Synthetic oligonucleotide
  Target: SCN9A; (+) strand; PAM type: NRG; PAM sequence: AAG
tcttattaaaaaacattttg

SEQ ID NO: 42185 - DNA, 20 bp, Artificial Sequence
  Description of Artificial Sequence: Synthetic oligonucleotide
  Target: SCN9A; (+) strand; PAM type: NRG; PAM sequence: GAG
ttttgaagactcatgatttt

SEQ ID NO: 42186 - DNA, 20 bp, Artificial Sequence
  Description of Artificial Sequence: Synthetic oligonucleotide
  Target: SCN9A; (+) strand; PAM type: NRG; PAM sequence: TGG
gaagactcatgattttgagt

SEQ ID NO: 42187 - DNA, 20 bp, Artificial Sequence
  Description of Artificial Sequence: Synthetic oligonucleotide
  Target: SCN9A; (+) strand; PAM type: NRG; PAM sequence: GGG
aagactcatgattttgagtt

SEQ ID NO: 42188 - DNA, 20 bp, Artificial Sequence
  Description of Artificial Sequence: Synthetic oligonucleotide
  Target: SCN9A; (+) strand; PAM type: NRG; PAM sequence: GGG
agactcatgattttgagttg

SEQ ID NO: 42189 - DNA, 20 bp, Artificial Sequence
  Description of Artificial Sequence: Synthetic oligonucleotide
  Target: SCN9A; (+) strand; PAM type: NRG; PAM sequence: AAG
agttggggcaaattctcaac

SEQ ID NO: 42190 - DNA, 20 bp, Artificial Sequence
  Description of Artificial Sequence: Synthetic oligonucleotide
  Target: SCN9A; (+) strand; PAM type: NRG; PAM sequence: AAG
cttctgccctacaatttcta

SEQ ID NO: 42191 - DNA, 20 bp, Artificial Sequence
  Description of Artificial Sequence: Synthetic oligonucleotide
  Target: SCN9A; (+) strand; PAM type: NRG; PAM sequence: TAG
gccctacaatttctaaagat

SEQ ID NO: 42192 - DNA, 20 bp, Artificial Sequence
  Description of Artificial Sequence: Synthetic oligonucleotide
  Target: SCN9A; (+) strand; PAM type: NRG; PAM sequence: AAG
atttctaaagattagcacca

SEQ ID NO: 42193 - DNA, 20 bp, Artificial Sequence
  Description of Artificial Sequence: Synthetic oligonucleotide
  Target: SCN9A; (+) strand; PAM type: NRG; PAM sequence: TAG
agcaccaaagatctaccaaa

SEQ ID NO: 42194 - DNA, 20 bp, Artificial Sequence
  Description of Artificial Sequence: Synthetic oligonucleotide
  Target: SCN9A; (+) strand; PAM type: NRG; PAM sequence: TGG
atctaccaaatagtttttca

SEQ ID NO: 42195 - DNA, 20 bp, Artificial Sequence
  Description of Artificial Sequence: Synthetic oligonucleotide
  Target: SCN9A; (+) strand; PAM type: NRG; PAM sequence: GGG
tctaccaaatagtttttcat

SEQ ID NO: 42196 - DNA, 20 bp, Artificial Sequence
  Description of Artificial Sequence: Synthetic oligonucleotide
  Target: SCN9A; (+) strand; PAM type: NRG; PAM sequence: GAG
taccaaatagtttttcatgg

SEQ ID NO: 42197 - DNA, 20 bp, Artificial Sequence
  Description of Artificial Sequence: Synthetic oligonucleotide
  Target: SCN9A; (+) strand; PAM type: NRG; PAM sequence: AAG
gaaaaatcacaattgtactg

SEQ ID NO: 42198 - DNA, 20 bp, Artificial Sequence
  Description of Artificial Sequence: Synthetic oligonucleotide
  Target: SCN9A; (+) strand; PAM type: NRG; PAM sequence: GAG
aaaatcacaattgtactgaa

SEQ ID NO: 42199 - DNA, 20 bp, Artificial Sequence
  Description of Artificial Sequence: Synthetic oligonucleotide
  Target: SCN9A; (+) strand; PAM type: NRG; PAM sequence: GAG
aatcacaattgtactgaaga

SEQ ID NO: 42200 - DNA, 20 bp, Artificial Sequence
  Description of Artificial Sequence: Synthetic oligonucleotide
  Target: SCN9A; (+) strand; PAM type: NRG; PAM sequence: GAG
aattgtactgaagagagaat

SEQ ID NO: 42201 - DNA, 20 bp, Artificial Sequence
  Description of Artificial Sequence: Synthetic oligonucleotide
  Target: SCN9A; (+) strand; PAM type: NRG; PAM sequence: GAG
ttgtactgaagagagaatga

SEQ ID NO: 42202 - DNA, 20 bp, Artificial Sequence
  Description of Artificial Sequence: Synthetic oligonucleotide
  Target: SCN9A; (+) strand; PAM type: NRG; PAM sequence: TAG
tactgaagagagaatgagag

SEQ ID NO: 42203 - DNA, 20 bp, Artificial Sequence
  Description of Artificial Sequence: Synthetic oligonucleotide
  Target: SCN9A; (+) strand; PAM type: NRG; PAM sequence: TGG
atgagagtagctgatctcat

SEQ ID NO: 42204 - DNA, 20 bp, Artificial Sequence
  Description of Artificial Sequence: Synthetic oligonucleotide
  Target: SCN9A; (+) strand; PAM type: NRG; PAM sequence: TAG
cattggcttcacaatcaata

SEQ ID NO: 42205 - DNA, 20 bp, Artificial Sequence
  Description of Artificial Sequence: Synthetic oligonucleotide
  Target: SCN9A; (+) strand; PAM type: NRG; PAM sequence: AAG
acaatcaatatagatataat

SEQ ID NO: 42206 - DNA, 20 bp, Artificial Sequence
  Description of Artificial Sequence: Synthetic oligonucleotide
  Target: SCN9A; (+) strand; PAM type: NRG; PAM sequence: GAG
aatcaatatagatataataa

SEQ ID NO: 42207 - DNA, 20 bp, Artificial Sequence
  Description of Artificial Sequence: Synthetic oligonucleotide
  Target: SCN9A; (+) strand; PAM type: NRG; PAM sequence: TAG
taataagagcttcatcatgt

SEQ ID NO: 42208 - DNA, 20 bp, Artificial Sequence
  Description of Artificial Sequence: Synthetic oligonucleotide
  Target: SCN9A; (+) strand; PAM type: NRG; PAM sequence: TAG
aagagcttcatcatgttaga

SEQ ID NO: 42209 - DNA, 20 bp, Artificial Sequence
  Description of Artificial Sequence: Synthetic oligonucleotide
  Target: SCN9A; (+) strand; PAM type: NRG; PAM sequence: CAG
cttcatcatgttagatagat

SEQ ID NO: 42210 - DNA, 20 bp, Artificial Sequence
  Description of Artificial Sequence: Synthetic oligonucleotide
  Target: SCN9A; (+) strand; PAM type: NRG; PAM sequence: CAG
tcagccacaattaccataac

SEQ ID NO: 42211 - DNA, 20 bp, Artificial Sequence
  Description of Artificial Sequence: Synthetic oligonucleotide
  Target: SCN9A; (+) strand; PAM type: NRG; PAM sequence: AAG
ttaccataaccagtatccaa

SEQ ID NO: 42212 - DNA, 20 bp, Artificial Sequence
  Description of Artificial Sequence: Synthetic oligonucleotide
  Target: SCN9A; (+) strand; PAM type: NRG; PAM sequence: GAG
ccagtatccaaaagaaattt

SEQ ID NO: 42213 - DNA, 20 bp, Artificial Sequence
  Description of Artificial Sequence: Synthetic oligonucleotide
  Target: SCN9A; (+) strand; PAM type: NRG; PAM sequence: AAG
ttcttatcgtaaattatctt

SEQ ID NO: 42214 - DNA, 20 bp, Artificial Sequence
  Description of Artificial Sequence: Synthetic oligonucleotide
  Target: SCN9A; (+) strand; PAM type: NRG; PAM sequence: AAG
tatcgtaaattatcttaaga

SEQ ID NO: 42215 - DNA, 20 bp, Artificial Sequence
  Description of Artificial Sequence: Synthetic oligonucleotide
  Target: SCN9A; (+) strand; PAM type: NRG; PAM sequence: CAG
atcttaagaaagaacatgaa

SEQ ID NO: 42216 - DNA, 20 bp, Artificial Sequence
  Description of Artificial Sequence: Synthetic oligonucleotide
  Target: SCN9A; (+) strand; PAM type: NRG; PAM sequence: TAG
aatacaatcaatacacattt

SEQ ID NO: 42217 - DNA, 20 bp, Artificial Sequence
  Description of Artificial Sequence: Synthetic oligonucleotide
  Target: SCN9A; (+) strand; PAM type: NRG; PAM sequence: AAG
caatacacattttagttaca

SEQ ID NO: 42218 - DNA, 20 bp, Artificial Sequence
  Description of Artificial Sequence: Synthetic oligonucleotide
  Target: SCN9A; (+) strand; PAM type: NRG; PAM sequence: GAG
cattttagttacaaagcaat

SEQ ID NO: 42219 - DNA, 20 bp, Artificial Sequence
  Description of Artificial Sequence: Synthetic oligonucleotide
  Target: SCN9A; (+) strand; PAM type: NRG; PAM sequence: TAG
aatgagctcctccatgacct

SEQ ID NO: 42220 - DNA, 20 bp, Artificial Sequence
  Description of Artificial Sequence: Synthetic oligonucleotide
  Target: SCN9A; (+) strand; PAM type: NRG; PAM sequence: TGG
ctcctccatgaccttagatc

SEQ ID NO: 42221 - DNA, 20 bp, Artificial Sequence
  Description of Artificial Sequence: Synthetic oligonucleotide
  Target: SCN9A; (+) strand; PAM type: NRG; PAM sequence: TAG
aatatgtttactctctgaat

SEQ ID NO: 42222 - DNA, 20 bp, Artificial Sequence
  Description of Artificial Sequence: Synthetic oligonucleotide
  Target: SCN9A; (+) strand; PAM type: NRG; PAM sequence: TGG
tactctctgaattagttcca

SEQ ID NO: 42223 - DNA, 20 bp, Artificial Sequence
  Description of Artificial Sequence: Synthetic oligonucleotide
  Target: SCN9A; (+) strand; PAM type: NRG; PAM sequence: TAG
catttgcctcacatcctgtg

SEQ ID NO: 42224 - DNA, 20 bp, Artificial Sequence
  Description of Artificial Sequence: Synthetic oligonucleotide
  Target: SCN9A; (+) strand; PAM type: NRG; PAM sequence: CAG
ttgcctcacatcctgtgtag

SEQ ID NO: 42225 - DNA, 20 bp, Artificial Sequence
  Description of Artificial Sequence: Synthetic oligonucleotide
  Target: SCN9A; (+) strand; PAM type: NRG; PAM sequence: AGG
tgcctcacatcctgtgtagc

SEQ ID NO: 42226 - DNA, 20 bp, Artificial Sequence
  Description of Artificial Sequence: Synthetic oligonucleotide
  Target: SCN9A; (+) strand; PAM type: NRG; PAM sequence: GAG
cctcacatcctgtgtagcag

SEQ ID NO: 42227 - DNA, 20 bp, Artificial Sequence
  Description of Artificial Sequence: Synthetic oligonucleotide
  Target: SCN9A; (+) strand; PAM type: NRG; PAM sequence: AAG
tgtagcaggagacgatgtct

SEQ ID NO: 42228 - DNA, 20 bp, Artificial Sequence
  Description of Artificial Sequence: Synthetic oligonucleotide
  Target: SCN9A; (+) strand; PAM type: NRG; PAM sequence: TGG
cgatgtctaagaaaaatgtc

SEQ ID NO: 42229 - DNA, 20 bp, Artificial Sequence
  Description of Artificial Sequence: Synthetic oligonucleotide
  Target: SCN9A; (+) strand; PAM type: NRG; PAM sequence: CAG
taagaaaaatgtctggaatg

SEQ ID NO: 42230 - DNA, 20 bp, Artificial Sequence
  Description of Artificial Sequence: Synthetic oligonucleotide
  Target: SCN9A; (+) strand; PAM type: NRG; PAM sequence: AAG
tgcagttcttcattacgaat

SEQ ID NO: 42231 - DNA, 20 bp, Artificial Sequence
  Description of Artificial Sequence: Synthetic oligonucleotide
  Target: SCN9A; (+) strand; PAM type: NRG; PAM sequence: TAG
gttcttcattacgaataagt

SEQ ID NO: 42232 - DNA, 20 bp, Artificial Sequence
  Description of Artificial Sequence: Synthetic oligonucleotide
  Target: SCN9A; (+) strand; PAM type: NRG; PAM sequence: GAG
ttacgaataagttagtgact

SEQ ID NO: 42233 - DNA, 20 bp, Artificial Sequence
  Description of Artificial Sequence: Synthetic oligonucleotide
  Target: SCN9A; (+) strand; PAM type: NRG; PAM sequence: GAG
acgaataagttagtgactga

SEQ ID NO: 42234 - DNA, 20 bp, Artificial Sequence
  Description of Artificial Sequence: Synthetic oligonucleotide
  Target: SCN9A; (+) strand; PAM type: NRG; PAM sequence: GAG
actgagagattcaatttttc

SEQ ID NO: 42235 - DNA, 20 bp, Artificial Sequence
  Description of Artificial Sequence: Synthetic oligonucleotide
  Target: SCN9A; (+) strand; PAM type: NRG; PAM sequence: AGG
ctgagagattcaatttttcg

SEQ ID NO: 42236 - DNA, 20 bp, Artificial Sequence
  Description of Artificial Sequence: Synthetic oligonucleotide
  Target: SCN9A; (+) strand; PAM type: NRG; PAM sequence: GGG
tgagagattcaatttttcga

SEQ ID NO: 42237 - DNA, 20 bp, Artificial Sequence
  Description of Artificial Sequence: Synthetic oligonucleotide
  Target: SCN9A; (+) strand; PAM type: NRG; PAM sequence: AAG
gagattcaatttttcgaggg

SEQ ID NO: 42238 - DNA, 20 bp, Artificial Sequence
  Description of Artificial Sequence: Synthetic oligonucleotide
  Target: SCN9A; (+) strand; PAM type: NRG; PAM sequence: TAG
tcaatttttcgagggaagaa

SEQ ID NO: 42239 - DNA, 20 bp, Artificial Sequence
  Description of Artificial Sequence: Synthetic oligonucleotide
  Target: SCN9A; (+) strand; PAM type: NRG; PAM sequence: AGG
caatttttcgagggaagaat

SEQ ID NO: 42240 - DNA, 20 bp, Artificial Sequence
  Description of Artificial Sequence: Synthetic oligonucleotide
  Target: SCN9A; (+) strand; PAM type: NRG; PAM sequence: CAG
tttcgagggaagaataggaa

SEQ ID NO: 42241 - DNA, 20 bp, Artificial Sequence
  Description of Artificial Sequence: Synthetic oligonucleotide
  Target: SCN9A; (+) strand; PAM type: NRG; PAM sequence: GAG
agggaagaataggaacagat

SEQ ID NO: 42242 - DNA, 20 bp, Artificial Sequence
  Description of Artificial Sequence: Synthetic oligonucleotide
  Target: SCN9A; (+) strand; PAM type: NRG; PAM sequence: GAG
ggaagaataggaacagatga

SEQ ID NO: 42243 - DNA, 20 bp, Artificial Sequence
  Description of Artificial Sequence: Synthetic oligonucleotide
  Target: SCN9A; (+) strand; PAM type: NRG; PAM sequence: CAG
ctttatatatttatctattt

SEQ ID NO: 42244 - DNA, 20 bp, Artificial Sequence
  Description of Artificial Sequence: Synthetic oligonucleotide
  Target: SCN9A; (+) strand; PAM type: NRG; PAM sequence: AGG
tttatatatttatctatttc

SEQ ID NO: 42245 - DNA, 20 bp, Artificial Sequence
  Description of Artificial Sequence: Synthetic oligonucleotide
  Target: SCN9A; (+) strand; PAM type: NRG; PAM sequence: TAG
atatttatctatttcaggcg

SEQ ID NO: 42246 - DNA, 20 bp, Artificial Sequence
  Description of Artificial Sequence: Synthetic oligonucleotide
  Target: SCN9A; (+) strand; PAM type: NRG; PAM sequence: AAG
atctatttcaggcgtagaaa

SEQ ID NO: 42247 - DNA, 20 bp, Artificial Sequence
  Description of Artificial Sequence: Synthetic oligonucleotide
  Target: SCN9A; (+) strand; PAM type: NRG; PAM sequence: AAG
aaaaagtcattgttcacaaa

SEQ ID NO: 42248 - DNA, 20 bp, Artificial Sequence
  Description of Artificial Sequence: Synthetic oligonucleotide
  Target: SCN9A; (+) strand; PAM type: NRG; PAM sequence: CAG
aagttcattgctgttaccat

SEQ ID NO: 42249 - DNA, 20 bp, Artificial Sequence
  Description of Artificial Sequence: Synthetic oligonucleotide
  Target: SCN9A; (+) strand; PAM type: NRG; PAM sequence: GAG
gttcattgctgttaccatca

SEQ ID NO: 42250 - DNA, 20 bp, Artificial Sequence
  Description of Artificial Sequence: Synthetic oligonucleotide
  Target: SCN9A; (+) strand; PAM type: NRG; PAM sequence: CAG
attgctgttaccatcagaga

SEQ ID NO: 42251 - DNA, 20 bp, Artificial Sequence
  Description of Artificial Sequence: Synthetic oligonucleotide
  Target: SCN9A; (+) strand; PAM type: NRG; PAM sequence: AGG
ttgctgttaccatcagagac

SEQ ID NO: 42252 - DNA, 20 bp, Artificial Sequence
  Description of Artificial Sequence: Synthetic oligonucleotide
  Target: SCN9A; (+) strand; PAM type: NRG; PAM sequence: AAG
gacaggtaaactgactgatg

SEQ ID NO: 42253 - DNA, 20 bp, Artificial Sequence
  Description of Artificial Sequence: Synthetic oligonucleotide
  Target: SCN9A; (+) strand; PAM type: NRG; PAM sequence: CGG
aggtaaactgactgatgaag

SEQ ID NO: 42254 - DNA, 20 bp, Artificial Sequence
  Description of Artificial Sequence: Synthetic oligonucleotide
  Target: SCN9A; (+) strand; PAM type: NRG; PAM sequence: GGG
ggtaaactgactgatgaagc

SEQ ID NO: 42255 - DNA, 20 bp, Artificial Sequence
  Description of Artificial Sequence: Synthetic oligonucleotide
  Target: SCN9A; (+) strand; PAM type: NRG; PAM sequence: AAG
aaactgactgatgaagcggg

SEQ ID NO: 42256 - DNA, 20 bp, Artificial Sequence
  Description of Artificial Sequence: Synthetic oligonucleotide
  Target: SCN9A; (+) strand; PAM type: NRG; PAM sequence: AAG
atgaagcgggaagtgtttta

SEQ ID NO: 42257 - DNA, 20 bp, Artificial Sequence
  Description of Artificial Sequence: Synthetic oligonucleotide
  Target: SCN9A; (+) strand; PAM type: NRG; PAM sequence: TAG
ttaaagtgctcatcctcatg

SEQ ID NO: 42258 - DNA, 20 bp, Artificial Sequence
  Description of Artificial Sequence: Synthetic oligonucleotide
  Target: SCN9A; (+) strand; PAM type: NRG; PAM sequence: CAG
tcatcctcatgtagtatttc

SEQ ID NO: 42259 - DNA, 20 bp, Artificial Sequence
  Description of Artificial Sequence: Synthetic oligonucleotide
  Target: SCN9A; (+) strand; PAM type: NRG; PAM sequence: TGG
atgtctcactaaatgtaaca

SEQ ID NO: 42260 - DNA, 20 bp, Artificial Sequence
  Description of Artificial Sequence: Synthetic oligonucleotide
  Target: SCN9A; (+) strand; PAM type: NRG; PAM sequence: AAG
cttttttttttaaattccta

SEQ ID NO: 42261 - DNA, 20 bp, Artificial Sequence
  Description of Artificial Sequence: Synthetic oligonucleotide
  Target: SCN9A; (+) strand; PAM type: NRG; PAM sequence: TAG
aattcctaaagctacgtatt

SEQ ID NO: 42262 - DNA, 20 bp, Artificial Sequence
  Description of Artificial Sequence: Synthetic oligonucleotide
  Target: SCN9A; (+) strand; PAM type: NRG; PAM sequence: CAG
tcctaaagctacgtatttag

SEQ ID NO: 42263 - DNA, 20 bp, Artificial Sequence
  Description of Artificial Sequence: Synthetic oligonucleotide
  Target: SCN9A; (+) strand; PAM type: NRG; PAM sequence: CAG
atgccactcttaaatttgcc

SEQ ID NO: 42264 - DNA, 20 bp, Artificial Sequence
  Description of Artificial Sequence: Synthetic oligonucleotide
  Target: SCN9A; (+) strand; PAM type: NRG; PAM sequence: AAG
acatccattattttccactt

SEQ ID NO: 42265 - DNA, 20 bp, Artificial Sequence
  Description of Artificial Sequence: Synthetic oligonucleotide
  Target: SCN9A; (+) strand; PAM type: NRG; PAM sequence: CAG
atgtatgctccctctttaat

SEQ ID NO: 42266 - DNA, 20 bp, Artificial Sequence
  Description of Artificial Sequence: Synthetic oligonucleotide
  Target: SCN9A; (+) strand; PAM type: NRG; PAM sequence: TGG
ttttttttaatgttttgctg

SEQ ID NO: 42267 - DNA, 20 bp, Artificial Sequence
  Description of Artificial Sequence: Synthetic oligonucleotide
  Target: SCN9A; (+) strand; PAM type: NRG; PAM sequence: TGG
gtcccttttgaaactcatgt

SEQ ID NO: 42268 - DNA, 20 bp, Artificial Sequence
  Description of Artificial Sequence: Synthetic oligonucleotide
  Target: SCN9A; (+) strand; PAM type: NRG; PAM sequence: CAG
gaacttaattcccaatgtaa

SEQ ID NO: 42269 - DNA, 20 bp, Artificial Sequence
  Description of Artificial Sequence: Synthetic oligonucleotide
  Target: SCN9A; (+) strand; PAM type: NRG; PAM sequence: AAG
attcccaatgtaacagtatt

SEQ ID NO: 42270 - DNA, 20 bp, Artificial Sequence
  Description of Artificial Sequence: Synthetic oligonucleotide
  Target: SCN9A; (+) strand; PAM type: NRG; PAM sequence: GAG
tcccaatgtaacagtattaa

SEQ ID NO: 42271 - DNA, 20 bp, Artificial Sequence
  Description of Artificial Sequence: Synthetic oligonucleotide
  Target: SCN9A; (+) strand; PAM type: NRG; PAM sequence: AGG
cccaatgtaacagtattaag

SEQ ID NO: 42272 - DNA, 20 bp, Artificial Sequence
  Description of Artificial Sequence: Synthetic oligonucleotide
  Target: SCN9A; (+) strand; PAM type: NRG; PAM sequence: CAG
aatgtaacagtattaagagg

SEQ ID NO: 42273 - DNA, 20 bp, Artificial Sequence
  Description of Artificial Sequence: Synthetic oligonucleotide
  Target: SCN9A; (+) strand; PAM type: NRG; PAM sequence: GAG
tgtaacagtattaagaggca

SEQ ID NO: 42274 - DNA, 20 bp, Artificial Sequence
  Description of Artificial Sequence: Synthetic oligonucleotide
  Target: SCN9A; (+) strand; PAM type: NRG; PAM sequence: AAG
ttaagaggcagagcctttaa

SEQ ID NO: 42275 - DNA, 20 bp, Artificial Sequence
  Description of Artificial Sequence: Synthetic oligonucleotide
  Target: SCN9A; (+) strand; PAM type: NRG; PAM sequence: AGG
taagaggcagagcctttaaa

SEQ ID NO: 42276 - DNA, 20 bp, Artificial Sequence
  Description of Artificial Sequence: Synthetic oligonucleotide
  Target: SCN9A; (+) strand; PAM type: NRG; PAM sequence: GAG
cagagcctttaaaaggtgat

SEQ ID NO: 42277 - DNA, 20 bp, Artificial Sequence
  Description of Artificial Sequence: Synthetic oligonucleotide
  Target: SCN9A; (+) strand; PAM type: NRG; PAM sequence: AGG
agagcctttaaaaggtgatg

SEQ ID NO: 42278 - DNA, 20 bp, Artificial Sequence
  Description of Artificial Sequence: Synthetic oligonucleotide
  Target: SCN9A; (+) strand; PAM type: NRG; PAM sequence: AAG
taaaaggtgatgaggtcatg

SEQ ID NO: 42279 - DNA, 20 bp, Artificial Sequence
  Description of Artificial Sequence: Synthetic oligonucleotide
  Target: SCN9A; (+) strand; PAM type: NRG; PAM sequence: AGG
aaaaggtgatgaggtcatga

SEQ ID NO: 42280 - DNA, 20 bp, Artificial Sequence
  Description of Artificial Sequence: Synthetic oligonucleotide
  Target: SCN9A; (+) strand; PAM type: NRG; PAM sequence: TGG
gaaggttctgccttcatgaa

SEQ ID NO: 42281 - DNA, 20 bp, Artificial Sequence
  Description of Artificial Sequence: Synthetic oligonucleotide
  Target: SCN9A; (+) strand; PAM type: NRG; PAM sequence: TAG
ctgccttcatgaatggaata

SEQ ID NO: 42282 - DNA, 20 bp, Artificial Sequence
  Description of Artificial Sequence: Synthetic oligonucleotide
  Target: SCN9A; (+) strand; PAM type: NRG; PAM sequence: GAG
gccttcatgaatggaatata

SEQ ID NO: 42283 - DNA, 20 bp, Artificial Sequence
  Description of Artificial Sequence: Synthetic oligonucleotide
  Target: SCN9A; (+) strand; PAM type: NRG; PAM sequence: AAG
tcatgaatggaatatagagt

SEQ ID NO: 42284 - DNA, 20 bp, Artificial Sequence
  Description of Artificial Sequence: Synthetic oligonucleotide
  Target: SCN9A; (+) strand; PAM type: NRG; PAM sequence: AGG
catgaatggaatatagagta

SEQ ID NO: 42285 - DNA, 20 bp, Artificial Sequence
  Description of Artificial Sequence: Synthetic oligonucleotide
  Target: SCN9A; (+) strand; PAM type: NRG; PAM sequence: GGG
atgaatggaatatagagtaa

SEQ ID NO: 42286 - DNA, 20 bp, Artificial Sequence
  Description of Artificial Sequence: Synthetic oligonucleotide
  Target: SCN9A; (+) strand; PAM type: NRG; PAM sequence: TGG
aatatagagtaagggcttaa

SEQ ID NO: 42287 - DNA, 20 bp, Artificial Sequence
  Description of Artificial Sequence: Synthetic oligonucleotide
  Target: SCN9A; (+) strand; PAM type: NRG; PAM sequence: GGG
atatagagtaagggcttaat

SEQ ID NO: 42288 - DNA, 20 bp, Artificial Sequence
  Description of Artificial Sequence: Synthetic oligonucleotide
  Target: SCN9A; (+) strand; PAM type: NRG; PAM sequence: TGG
aagggcttaatgggttatca

SEQ ID NO: 42289 - DNA, 20 bp, Artificial Sequence
  Description of Artificial Sequence: Synthetic oligonucleotide
  Target: SCN9A; (+) strand; PAM type: NRG; PAM sequence: GGG
agggcttaatgggttatcat

SEQ ID NO: 42290 - DNA, 20 bp, Artificial Sequence
  Description of Artificial Sequence: Synthetic oligonucleotide
  Target: SCN9A; (+) strand; PAM type: NRG; PAM sequence: GAG
ggcttaatgggttatcatgg

SEQ ID NO: 42291 - DNA, 20 bp, Artificial Sequence
  Description of Artificial Sequence: Synthetic oligonucleotide
  Target: SCN9A; (+) strand; PAM type: NRG; PAM sequence: GAG
taatgggttatcatgggagt

SEQ ID NO: 42292 - DNA, 20 bp, Artificial Sequence
  Description of Artificial Sequence: Synthetic oligonucleotide
  Target: SCN9A; (+) strand; PAM type: NRG; PAM sequence: TAG
gggttatcatgggagtgagt

SEQ ID NO: 42293 - DNA, 20 bp, Artificial Sequence
  Description of Artificial Sequence: Synthetic oligonucleotide
  Target: SCN9A; (+) strand; PAM type: NRG; PAM sequence: AAG
gggagtgagttagatatcac

SEQ ID NO: 42294 - DNA, 20 bp, Artificial Sequence
  Description of Artificial Sequence: Synthetic oligonucleotide
  Target: SCN9A; (+) strand; PAM type: NRG; PAM sequence: GAG
gagtgagttagatatcacaa

SEQ ID NO: 42295 - DNA, 20 bp, Artificial Sequence
  Description of Artificial Sequence: Synthetic oligonucleotide
  Target: SCN9A; (+) strand; PAM type: NRG; PAM sequence: TGG
tgagttagatatcacaagag

SEQ ID NO: 42296 - DNA, 20 bp, Artificial Sequence
  Description of Artificial Sequence: Synthetic oligonucleotide
  Target: SCN9A; (+) strand; PAM type: NRG; PAM sequence: GGG
gagttagatatcacaagagt

SEQ ID NO: 42297 - DNA, 20 bp, Artificial Sequence
  Description of Artificial Sequence: Synthetic oligonucleotide
  Target: SCN9A; (+) strand; PAM type: NRG; PAM sequence: CAG
agtgggtttattataaaacc

SEQ ID NO: 42298 - DNA, 20 bp, Artificial Sequence
  Description of Artificial Sequence: Synthetic oligonucleotide
  Target: SCN9A; (+) strand; PAM type: NRG; PAM sequence: TGG
gtttattataaaacccagtt

SEQ ID NO: 42299 - DNA, 20 bp, Artificial Sequence
  Description of Artificial Sequence: Synthetic oligonucleotide
  Target: SCN9A; (+) strand; PAM type: NRG; PAM sequence: CAG
ataaaacccagtttggctct

SEQ ID NO: 42300 - DNA, 20 bp, Artificial Sequence
  Description of Artificial Sequence: Synthetic oligonucleotide
  Target: SCN9A; (+) strand; PAM type: NRG; PAM sequence: GAG
ccctcgccatgtgatgccat

SEQ ID NO: 42301 - DNA, 20 bp, Artificial Sequence
  Description of Artificial Sequence: Synthetic oligonucleotide
  Target: SCN9A; (+) strand; PAM type: NRG; PAM sequence: TGG
tgtgatgccatgagctgcct

SEQ ID NO: 42302 - DNA, 20 bp, Artificial Sequence
  Description of Artificial Sequence: Synthetic oligonucleotide
  Target: SCN9A; (+) strand; PAM type: NRG; PAM sequence: GGG
gtgatgccatgagctgcctt

SEQ ID NO: 42303 - DNA, 20 bp, Artificial Sequence
  Description of Artificial Sequence: Synthetic oligonucleotide
  Target: SCN9A; (+) strand; PAM type: NRG; PAM sequence: TGG
tgagctgccttgggactctc

SEQ ID NO: 42304 - DNA, 20 bp, Artificial Sequence
  Description of Artificial Sequence: Synthetic oligonucleotide
  Target: SCN9A; (+) strand; PAM type: NRG; PAM sequence: CAG
ggactctctggtgtgcccac

SEQ ID NO: 42305 - DNA, 20 bp, Artificial Sequence
  Description of Artificial Sequence: Synthetic oligonucleotide
  Target: SCN9A; (+) strand; PAM type: NRG; PAM sequence: AAG
tctctggtgtgcccaccagc

SEQ ID NO: 42306 - DNA, 20 bp, Artificial Sequence
  Description of Artificial Sequence: Synthetic oligonucleotide
  Target: SCN9A; (+) strand; PAM type: NRG; PAM sequence: AAG
tggtgtgcccaccagcaaga

SEQ ID NO: 42307 - DNA, 20 bp, Artificial Sequence
  Description of Artificial Sequence: Synthetic oligonucleotide
  Target: SCN9A; (+) strand; PAM type: NRG; PAM sequence: CAG
accagcaagaaagttcccac

SEQ ID NO: 42308 - DNA, 20 bp, Artificial Sequence
  Description of Artificial Sequence: Synthetic oligonucleotide
  Target: SCN9A; (+) strand; PAM type: NRG; PAM sequence: TGG
aagaaagttcccaccagatg

SEQ ID NO: 42309 - DNA, 20 bp, Artificial Sequence
  Description of Artificial Sequence: Synthetic oligonucleotide
  Target: SCN9A; (+) strand; PAM type: NRG; PAM sequence: TAG
cagatgtggacccttcacct

SEQ ID NO: 42310 - DNA, 20 bp, Artificial Sequence
  Description of Artificial Sequence: Synthetic oligonucleotide
  Target: SCN9A; (+) strand; PAM type: NRG; PAM sequence: CAG
acccttcaccttagacttcc

SEQ ID NO: 42311 - DNA, 20 bp, Artificial Sequence
  Description of Artificial Sequence: Synthetic oligonucleotide
  Target: SCN9A; (+) strand; PAM type: NRG; PAM sequence: CAG
accttagacttcccagcttc

SEQ ID NO: 42312 - DNA, 20 bp, Artificial Sequence
  Description of Artificial Sequence: Synthetic oligonucleotide
  Target: SCN9A; (+) strand; PAM type: NRG; PAM sequence: AAG
ttcccagcttccagaacttt

SEQ ID NO: 42313 - DNA, 20 bp, Artificial Sequence
  Description of Artificial Sequence: Synthetic oligonucleotide
  Target: SCN9A; (+) strand; PAM type: NRG; PAM sequence: CAG
tctttattgaatactttaac

SEQ ID NO: 42314 - DNA, 20 bp, Artificial Sequence
  Description of Artificial Sequence: Synthetic oligonucleotide
  Target: SCN9A; (+) strand; PAM type: NRG; PAM sequence: CAG
ttgaatactttaaccagtct

SEQ ID NO: 42315 - DNA, 20 bp, Artificial Sequence
  Description of Artificial Sequence: Synthetic oligonucleotide
  Target: SCN9A; (+) strand; PAM type: NRG; PAM sequence: AGG
tgaatactttaaccagtctc

SEQ ID NO: 42316 - DNA, 20 bp, Artificial Sequence
  Description of Artificial Sequence: Synthetic oligonucleotide
  Target: SCN9A; (+) strand; PAM type: NRG; PAM sequence: CAG
tttaaccagtctcaggtatt

SEQ ID NO: 42317 - DNA, 20 bp, Artificial Sequence
  Description of Artificial Sequence: Synthetic oligonucleotide
  Target: SCN9A; (+) strand; PAM type: NRG; PAM sequence: CAG
cagtctcaggtattcagtta

SEQ ID NO: 42318 - DNA, 20 bp, Artificial Sequence
  Description of Artificial Sequence: Synthetic oligonucleotide
  Target: SCN9A; (+) strand; PAM type: NRG; PAM sequence: AAG
gtattcagttacagcaataa

SEQ ID NO: 42319 - DNA, 20 bp, Artificial Sequence
  Description of Artificial Sequence: Synthetic oligonucleotide
  Target: SCN9A; (+) strand; PAM type: NRG; PAM sequence: AGG
tattcagttacagcaataaa

SEQ ID NO: 42320 - DNA, 20 bp, Artificial Sequence
  Description of Artificial Sequence: Synthetic oligonucleotide
  Target: SCN9A; (+) strand; PAM type: NRG; PAM sequence: TAG
tcagttacagcaataaaagg

SEQ ID NO: 42321 - DNA, 20 bp, Artificial Sequence
  Description of Artificial Sequence: Synthetic oligonucleotide
  Target: SCN9A; (+) strand; PAM type: NRG; PAM sequence: AAG
acagcaataaaaggtagact

SEQ ID NO: 42322 - DNA, 20 bp, Artificial Sequence
  Description of Artificial Sequence: Synthetic oligonucleotide
  Target: SCN9A; (+) strand; PAM type: NRG; PAM sequence: CAG
catgtctgttataattgata

SEQ ID NO: 42323 - DNA, 20 bp, Artificial Sequence
  Description of Artificial Sequence: Synthetic oligonucleotide
  Target: SCN9A; (+) strand; PAM type: NRG; PAM sequence: TAG
tacagcccctaaaatactaa

SEQ ID NO: 42324 - DNA, 20 bp, Artificial Sequence
  Description of Artificial Sequence: Synthetic oligonucleotide
  Target: SCN9A; (+) strand; PAM type: NRG; PAM sequence: AGG
acagcccctaaaatactaat

SEQ ID NO: 42325 - DNA, 20 bp, Artificial Sequence
  Description of Artificial Sequence: Synthetic oligonucleotide
  Target: SCN9A; (+) strand; PAM type: NRG; PAM sequence: AAG
tactaataggtctgttctcc

SEQ ID NO: 42326 - DNA, 20 bp, Artificial Sequence
  Description of Artificial Sequence: Synthetic oligonucleotide
  Target: SCN9A; (+) strand; PAM type: NRG; PAM sequence: AAG
ctgttctccaagccactgtt

SEQ ID NO: 42327 - DNA, 20 bp, Artificial Sequence
  Description of Artificial Sequence: Synthetic oligonucleotide
  Target: SCN9A; (+) strand; PAM type: NRG; PAM sequence: GAG
tctccaagccactgttaagt

SEQ ID NO: 42328 - DNA, 20 bp, Artificial Sequence
  Description of Artificial Sequence: Synthetic oligonucleotide
  Target: SCN9A; (+) strand; PAM type: NRG; PAM sequence: CGG
gttaagtgagttttatgaca

SEQ ID NO: 42329 - DNA, 20 bp, Artificial Sequence
  Description of Artificial Sequence: Synthetic oligonucleotide
  Target: SCN9A; (+) strand; PAM type: NRG; PAM sequence: AAG
cggaatatatgcatattatt

SEQ ID NO: 42330 - DNA, 20 bp, Artificial Sequence
  Description of Artificial Sequence: Synthetic oligonucleotide
  Target: SCN9A; (+) strand; PAM type: NRG; PAM sequence: TGG
tatgcatattattaagacta

SEQ ID NO: 42331 - DNA, 20 bp, Artificial Sequence
  Description of Artificial Sequence: Synthetic oligonucleotide
  Target: SCN9A; (+) strand; PAM type: NRG; PAM sequence: TAG
atattattaagactatggta

SEQ ID NO: 42332 - DNA, 20 bp, Artificial Sequence
  Description of Artificial Sequence: Synthetic oligonucleotide
  Target: SCN9A; (+) strand; PAM type: NRG; PAM sequence: GAG
ctatggtatagtttgtaact

SEQ ID NO: 42333 - DNA, 20 bp, Artificial Sequence
  Description of Artificial Sequence: Synthetic oligonucleotide
  Target: SCN9A; (+) strand; PAM type: NRG; PAM sequence: AAG
acaaatatacgcctgtactg

SEQ ID NO: 42334 - DNA, 20 bp, Artificial Sequence
  Description of Artificial Sequence: Synthetic oligonucleotide
  Target: SCN9A; (+) strand; PAM type: NRG; PAM sequence: AAG
ctgaagaacactgtttaatc

SEQ ID NO: 42335 - DNA, 20 bp, Artificial Sequence
  Description of Artificial Sequence: Synthetic oligonucleotide
  Target: SCN9A; (+) strand; PAM type: NRG; PAM sequence: AAG
agaacactgtttaatcaagt

SEQ ID NO: 42336 - DNA, 20 bp, Artificial Sequence
  Description of Artificial Sequence: Synthetic oligonucleotide
  Target: SCN9A; (+) strand; PAM type: NRG; PAM sequence: CAG
caagtaagtttcaaataacc

SEQ ID NO: 42337 - DNA, 20 bp, Artificial Sequence
  Description of Artificial Sequence: Synthetic oligonucleotide
  Target: SCN9A; (+) strand; PAM type: NRG; PAM sequence: AAG
gtaagtttcaaataacccag

SEQ ID NO: 42338 - DNA, 20 bp, Artificial Sequence
  Description of Artificial Sequence: Synthetic oligonucleotide
  Target: SCN9A; (+) strand; PAM type: NRG; PAM sequence: CAG
tcaaataacccagaagcctg

SEQ ID NO: 42339 - DNA, 20 bp, Artificial Sequence
  Description of Artificial Sequence: Synthetic oligonucleotide
  Target: SCN9A; (+) strand; PAM type: NRG; PAM sequence: CAG
acccagaagcctgcagaaat

SEQ ID NO: 42340 - DNA, 20 bp, Artificial Sequence
  Description of Artificial Sequence: Synthetic oligonucleotide
  Target: SCN9A; (+) strand; PAM type: NRG; PAM sequence: AAG
gaagcctgcagaaatcagac

SEQ ID NO: 42341 - DNA, 20 bp, Artificial Sequence
  Description of Artificial Sequence: Synthetic oligonucleotide
  Target: SCN9A; (+) strand; PAM type: NRG; PAM sequence: GAG
atcagacaagtccattctct

SEQ ID NO: 42342 - DNA, 20 bp, Artificial Sequence
  Description of Artificial Sequence: Synthetic oligonucleotide
  Target: SCN9A; (+) strand; PAM type: NRG; PAM sequence: TAG
agacaagtccattctctgag

SEQ ID NO: 42343 - DNA, 20 bp, Artificial Sequence
  Description of Artificial Sequence: Synthetic oligonucleotide
  Target: SCN9A; (+) strand; PAM type: NRG; PAM sequence: AAG
ctctgagtagcaaataatat

SEQ ID NO: 42344 - DNA, 20 bp, Artificial Sequence
  Description of Artificial Sequence: Synthetic oligonucleotide
  Target: SCN9A; (+) strand; PAM type: NRG; PAM sequence: TAG
tgagtagcaaataatataag

SEQ ID NO: 42345 - DNA, 20 bp, Artificial Sequence
  Description of Artificial Sequence: Synthetic oligonucleotide
  Target: SCN9A; (+) strand; PAM type: NRG; PAM sequence: CAG
tctgaaatctgaatatacaa

SEQ ID NO: 42346 - DNA, 20 bp, Artificial Sequence
  Description of Artificial Sequence: Synthetic oligonucleotide
  Target: SCN9A; (+) strand; PAM type: NRG; PAM sequence: TAG
atatacaacagaatcatctg

SEQ ID NO: 42347 - DNA, 20 bp, Artificial Sequence
  Description of Artificial Sequence: Synthetic oligonucleotide
  Target: SCN9A; (+) strand; PAM type: NRG; PAM sequence: AGG
tatacaacagaatcatctgt

SEQ ID NO: 42348 - DNA, 20 bp, Artificial Sequence
  Description of Artificial Sequence: Synthetic oligonucleotide
  Target: SCN9A; (+) strand; PAM type: NRG; PAM sequence: GGG
atacaacagaatcatctgta

SEQ ID NO: 42349 - DNA, 20 bp, Artificial Sequence
  Description of Artificial Sequence: Synthetic oligonucleotide
  Target: SCN9A; (+) strand; PAM type: NRG; PAM sequence: CAG
tgatttgccacatccaaccc

SEQ ID NO: 42350 - DNA, 20 bp, Artificial Sequence
  Description of Artificial Sequence: Synthetic oligonucleotide
  Target: SCN9A; (+) strand; PAM type: NRG; PAM sequence: GAG
atttgccacatccaacccca

SEQ ID NO: 42351 - DNA, 20 bp, Artificial Sequence
  Description of Artificial Sequence: Synthetic oligonucleotide
  Target: SCN9A; (+) strand; PAM type: NRG; PAM sequence: CAG
caaccccagagtttctgatt

SEQ ID NO: 42352 - DNA, 20 bp, Artificial Sequence
  Description of Artificial Sequence: Synthetic oligonucleotide
  Target: SCN9A; (+) strand; PAM type: NRG; PAM sequence: TGG
gtttctgattcagtatgtct

SEQ ID NO: 42353 - DNA, 20 bp, Artificial Sequence
  Description of Artificial Sequence: Synthetic oligonucleotide
  Target: SCN9A; (+) strand; PAM type: NRG; PAM sequence: GGG
tttctgattcagtatgtctt

SEQ ID NO: 42354 - DNA, 20 bp, Artificial Sequence
  Description of Artificial Sequence: Synthetic oligonucleotide
  Target: SCN9A; (+) strand; PAM type: NRG; PAM sequence: GGG
ttctgattcagtatgtcttg

SEQ ID NO: 42355 - DNA, 20 bp, Artificial Sequence
  Description of Artificial Sequence: Synthetic oligonucleotide
  Target: SCN9A; (+) strand; PAM type: NRG; PAM sequence: TGG
gattcagtatgtcttggggt

SEQ ID NO: 42356 - DNA, 20 bp, Artificial Sequence
  Description of Artificial Sequence: Synthetic oligonucleotide
  Target: SCN9A; (+) strand; PAM type: NRG; PAM sequence: GGG
attcagtatgtcttggggtt

SEQ ID NO: 42357 - DNA, 20 bp, Artificial Sequence
  Description of Artificial Sequence: Synthetic oligonucleotide
  Target: SCN9A; (+) strand; PAM type: NRG; PAM sequence: GGG
ttcagtatgtcttggggttg

SEQ ID NO: 42358 - DNA, 20 bp, Artificial Sequence
  Description of Artificial Sequence: Synthetic oligonucleotide
  Target: SCN9A; (+) strand; PAM type: NRG; PAM sequence: GGG
tcagtatgtcttggggttgg

SEQ ID NO: 42359 - DNA, 20 bp, Artificial Sequence
  Description of Artificial Sequence: Synthetic oligonucleotide
  Target: SCN9A; (+) strand; PAM type: NRG; PAM sequence: CAG
gtatgtcttggggttggggg

SEQ ID NO: 42360 - DNA, 20 bp, Artificial Sequence
  Description of Artificial Sequence: Synthetic oligonucleotide
  Target: SCN9A; (+) strand; PAM type: NRG; PAM sequence: GAG
gcagaatttgcatctcttat

SEQ ID NO: 42361 - DNA, 20 bp, Artificial Sequence
  Description of Artificial Sequence: Synthetic oligonucleotide
  Target: SCN9A; (+) strand; PAM type: NRG; PAM sequence: CAG
cctacatgtgccaacgtttt

SEQ ID NO: 42362 - DNA, 20 bp, Artificial Sequence
  Description of Artificial Sequence: Synthetic oligonucleotide
  Target: SCN9A; (+) strand; PAM type: NRG; PAM sequence: GAG
gtgccaacgttttcagtttt

SEQ ID NO: 42363 - DNA, 20 bp, Artificial Sequence
  Description of Artificial Sequence: Synthetic oligonucleotide
  Target: SCN9A; (+) strand; PAM type: NRG; PAM sequence: AAG
cagttttgagaccatccttc

SEQ ID NO: 42364 - DNA, 20 bp, Artificial Sequence
  Description of Artificial Sequence: Synthetic oligonucleotide
  Target: SCN9A; (+) strand; PAM type: NRG; PAM sequence: TAG
tccttcaagaacaactgctg

SEQ ID NO: 42365 - DNA, 20 bp, Artificial Sequence
  Description of Artificial Sequence: Synthetic oligonucleotide
  Target: SCN9A; (+) strand; PAM type: NRG; PAM sequence: AAG
caagaacaactgctgtagat

SEQ ID NO: 42366 - DNA, 20 bp, Artificial Sequence
  Description of Artificial Sequence: Synthetic oligonucleotide
  Target: SCN9A; (+) strand; PAM type: NRG; PAM sequence: CAG
agataagtttctatactttt

SEQ ID NO: 42367 - DNA, 20 bp, Artificial Sequence
  Description of Artificial Sequence: Synthetic oligonucleotide
  Target: SCN9A; (+) strand; PAM type: NRG; PAM sequence: CAG
ttttcagaaaaaaaaaaaat

SEQ ID NO: 42368 - DNA, 20 bp, Artificial Sequence
  Description of Artificial Sequence: Synthetic oligonucleotide
  Target: SCN9A; (+) strand; PAM type: NRG; PAM sequence: CAG
cccaaaatttgcatctctgt

SEQ ID NO: 42369 - DNA, 20 bp, Artificial Sequence
  Description of Artificial Sequence: Synthetic oligonucleotide
  Target: SCN9A; (+) strand; PAM type: NRG; PAM sequence: AAG
aaatttgcatctctgtcagc

SEQ ID NO: 42370 - DNA, 20 bp, Artificial Sequence
  Description of Artificial Sequence: Synthetic oligonucleotide
  Target: SCN9A; (+) strand; PAM type: NRG; PAM sequence: TGG
ctgtcagcaagaatattgtg

SEQ ID NO: 42371 - DNA, 20 bp, Artificial Sequence
  Description of Artificial Sequence: Synthetic oligonucleotide
  Target: SCN9A; (+) strand; PAM type: NRG; PAM sequence: GAG
gtcagcaagaatattgtgtg

SEQ ID NO: 42372 - DNA, 20 bp, Artificial Sequence
  Description of Artificial Sequence: Synthetic oligonucleotide
  Target: SCN9A; (+) strand; PAM type: NRG; PAM sequence: TGG
tattaaataatatttcaaat

SEQ ID NO: 42373 - DNA, 20 bp, Artificial Sequence
  Description of Artificial Sequence: Synthetic oligonucleotide
  Target: SCN9A; (+) strand; PAM type: NRG; PAM sequence: GAG
ttaaataatatttcaaattg

SEQ ID NO: 42374 - DNA, 20 bp, Artificial Sequence
  Description of Artificial Sequence: Synthetic oligonucleotide
  Target: SCN9A; (+) strand; PAM type: NRG; PAM sequence: CAG
gcacattacatacccctgaa

SEQ ID NO: 42375 - DNA, 20 bp, Artificial Sequence
  Description of Artificial Sequence: Synthetic oligonucleotide
  Target: SCN9A; (+) strand; PAM type: NRG; PAM sequence: AGG
cacattacatacccctgaac

SEQ ID NO: 42376 - DNA, 20 bp, Artificial Sequence
  Description of Artificial Sequence: Synthetic oligonucleotide
  Target: SCN9A; (+) strand; PAM type: NRG; PAM sequence: GAG
cattacatacccctgaacag

SEQ ID NO: 42377 - DNA, 20 bp, Artificial Sequence
  Description of Artificial Sequence: Synthetic oligonucleotide
  Target: SCN9A; (+) strand; PAM type: NRG; PAM sequence: AGG
attacatacccctgaacagg

SEQ ID NO: 42378 - DNA, 20 bp, Artificial Sequence
  Description of Artificial Sequence: Synthetic oligonucleotide
  Target: SCN9A; (+) strand; PAM type: NRG; PAM sequence: GAG
aacaggaggttatactcact

SEQ ID NO: 42379 - DNA, 20 bp, Artificial Sequence
  Description of Artificial Sequence: Synthetic oligonucleotide
  Target: SCN9A; (+) strand; PAM type: NRG; PAM sequence: CAG
aaacaatttccattattaaa

SEQ ID NO: 42380 - DNA, 20 bp, Artificial Sequence
  Description of Artificial Sequence: Synthetic oligonucleotide
  Target: SCN9A; (+) strand; PAM type: NRG; PAM sequence: AAG
catatctcttaatttaaaat

SEQ ID NO: 42381 - DNA, 20 bp, Artificial Sequence
  Description of Artificial Sequence: Synthetic oligonucleotide
  Target: SCN9A; (+) strand; PAM type: NRG; PAM sequence: GAG
ttacactgaatgatgaaaat

SEQ ID NO: 42382 - DNA, 20 bp, Artificial Sequence
  Description of Artificial Sequence: Synthetic oligonucleotide
  Target: SCN9A; (+) strand; PAM type: NRG; PAM sequence: AAG
gtatttgtgataatatttta

SEQ ID NO: 42383 - DNA, 20 bp, Artificial Sequence
  Description of Artificial Sequence: Synthetic oligonucleotide
  Target: SCN9A; (+) strand; PAM type: NRG; PAM sequence: AAG
aaaatattgtataatttttt

SEQ ID NO: 42384 - DNA, 20 bp, Artificial Sequence
  Description of Artificial Sequence: Synthetic oligonucleotide
  Target: SCN9A; (+) strand; PAM type: NRG; PAM sequence: GAG
aatattgtataattttttaa

SEQ ID NO: 42385 - DNA, 20 bp, Artificial Sequence
  Description of Artificial Sequence: Synthetic oligonucleotide
  Target: SCN9A; (+) strand; PAM type: NRG; PAM sequence: GAG
tattgtataattttttaaga

SEQ ID NO: 42386 - DNA, 20 bp, Artificial Sequence
  Description of Artificial Sequence: Synthetic oligonucleotide
  Target: SCN9A; (+) strand; PAM type: NRG; PAM sequence: GAG
ttgtataattttttaagaga

SEQ ID NO: 42387 - DNA, 20 bp, Artificial Sequence
  Description of Artificial Sequence: Synthetic oligonucleotide
  Target: SCN9A; (+) strand; PAM type: NRG; PAM sequence: CAG
gagagaccccgtcatattta

SEQ ID NO: 42388 - DNA, 20 bp, Artificial Sequence
  Description of Artificial Sequence: Synthetic oligonucleotide
  Target: SCN9A; (+) strand; PAM type: NRG; PAM sequence: AAG
ccccgtcatatttacagttt

SEQ ID NO: 42389 - DNA, 20 bp, Artificial Sequence
  Description of Artificial Sequence: Synthetic oligonucleotide
  Target: SCN9A; (+) strand; PAM type: NRG; PAM sequence: GAG
ccgtcatatttacagtttaa

SEQ ID NO: 42390 - DNA, 20 bp, Artificial Sequence
  Description of Artificial Sequence: Synthetic oligonucleotide
  Target: SCN9A; (+) strand; PAM type: NRG; PAM sequence: AAG
atatttacagtttaagagaa

SEQ ID NO: 42391 - DNA, 20 bp, Artificial Sequence
  Description of Artificial Sequence: Synthetic oligonucleotide
  Target: SCN9A; (+) strand; PAM type: NRG; PAM sequence: TGG
ttctataatttcttcttatt

SEQ ID NO: 42392 - DNA, 20 bp, Artificial Sequence
  Description of Artificial Sequence: Synthetic oligonucleotide
  Target: SCN9A; (+) strand; PAM type: NRG; PAM sequence: GGG
tctataatttcttcttattt

SEQ ID NO: 42393 - DNA, 20 bp, Artificial Sequence
  Description of Artificial Sequence: Synthetic oligonucleotide
  Target: SCN9A; (+) strand; PAM type: NRG; PAM sequence: GGG
ctataatttcttcttatttg

SEQ ID NO: 42394 - DNA, 20 bp, Artificial Sequence
  Description of Artificial Sequence: Synthetic oligonucleotide
  Target: SCN9A; (+) strand; PAM type: NRG; PAM sequence: CAG
taatttcttcttatttgggg

SEQ ID NO: 42395 - DNA, 20 bp, Artificial Sequence
  Description of Artificial Sequence: Synthetic oligonucleotide
  Target: SCN9A; (+) strand; PAM type: NRG; PAM sequence: TAG
ttttatcatttttcattttt

SEQ ID NO: 42396 - DNA, 20 bp, Artificial Sequence
  Description of Artificial Sequence: Synthetic oligonucleotide
  Target: SCN9A; (+) strand; PAM type: NRG; PAM sequence: AGG
tttatcatttttcatttttt

SEQ ID NO: 42397 - DNA, 20 bp, Artificial Sequence
  Description of Artificial Sequence: Synthetic oligonucleotide
  Target: SCN9A; (+) strand; PAM type: NRG; PAM sequence: CAG
atcatttttcattttttagg

SEQ ID NO: 42398 - DNA, 20 bp, Artificial Sequence
  Description of Artificial Sequence: Synthetic oligonucleotide
  Target: SCN9A; (+) strand; PAM type: NRG; PAM sequence: TAG
ttcattttttaggcagtaac

SEQ ID NO: 42399 - DNA, 20 bp, Artificial Sequence
  Description of Artificial Sequence: Synthetic oligonucleotide
  Target: SCN9A; (+) strand; PAM type: NRG; PAM sequence: TAG
atgaatgattaattgaaaaa

SEQ ID NO: 42400 - DNA, 20 bp, Artificial Sequence
  Description of Artificial Sequence: Synthetic oligonucleotide
  Target: SCN9A; (+) strand; PAM type: NRG; PAM sequence: AAG
atgattaattgaaaaatagc

SEQ ID NO: 42401 - DNA, 20 bp, Artificial Sequence
  Description of Artificial Sequence: Synthetic oligonucleotide
  Target: SCN9A; (+) strand; PAM type: NRG; PAM sequence: AAG
agaaatcattactatatccg

SEQ ID NO: 42402 - DNA, 20 bp, Artificial Sequence
  Description of Artificial Sequence: Synthetic oligonucleotide
  Target: SCN9A; (+) strand; PAM type: NRG; PAM sequence: TAG
atcattactatatccgaagt

SEQ ID NO: 42403 - DNA, 20 bp, Artificial Sequence
  Description of Artificial Sequence: Synthetic oligonucleotide
  Target: SCN9A; (+) strand; PAM type: NRG; PAM sequence: TAG
atccgaagttagaattctca

SEQ ID NO: 42404 - DNA, 20 bp, Artificial Sequence
  Description of Artificial Sequence: Synthetic oligonucleotide
  Target: SCN9A; (+) strand; PAM type: NRG; PAM sequence: GAG
ccgaagttagaattctcata

SEQ ID NO: 42405 - DNA, 20 bp, Artificial Sequence
  Description of Artificial Sequence: Synthetic oligonucleotide
  Target: SCN9A; (+) strand; PAM type: NRG; PAM sequence: AGG
cgaagttagaattctcatag

SEQ ID NO: 42406 - DNA, 20 bp, Artificial Sequence
  Description of Artificial Sequence: Synthetic oligonucleotide
  Target: SCN9A; (+) strand; PAM type: NRG; PAM sequence: AAG
aattctcatagaggaaacct

SEQ ID NO: 42407 - DNA, 20 bp, Artificial Sequence
  Description of Artificial Sequence: Synthetic oligonucleotide
  Target: SCN9A; (+) strand; PAM type: NRG; PAM sequence: AAG
aaacctaagataacacatat

SEQ ID NO: 42408 - DNA, 20 bp, Artificial Sequence
  Description of Artificial Sequence: Synthetic oligonucleotide
  Target: SCN9A; (+) strand; PAM type: NRG; PAM sequence: AGG
aacctaagataacacatata

SEQ ID NO: 42409 - DNA, 20 bp, Artificial Sequence
  Description of Artificial Sequence: Synthetic oligonucleotide
  Target: SCN9A; (+) strand; PAM type: NRG; PAM sequence: TAG
cacatataaggtgtaatata

SEQ ID NO: 42410 - DNA, 20 bp, Artificial Sequence
  Description of Artificial Sequence: Synthetic oligonucleotide
  Target: SCN9A; (+) strand; PAM type: NRG; PAM sequence: TAG
ttttttcacattacatatta

SEQ ID NO: 42411 - DNA, 20 bp, Artificial Sequence
  Description of Artificial Sequence: Synthetic oligonucleotide
  Target: SCN9A; (+) strand; PAM type: NRG; PAM sequence: AAG
acattacatattatagaaaa

SEQ ID NO: 42412 - DNA, 20 bp, Artificial Sequence
  Description of Artificial Sequence: Synthetic oligonucleotide
  Target: SCN9A; (+) strand; PAM type: NRG; PAM sequence: AAG
atttaatatgttgtgtgatt

SEQ ID NO: 42413 - DNA, 20 bp, Artificial Sequence
  Description of Artificial Sequence: Synthetic oligonucleotide
  Target: SCN9A; (+) strand; PAM type: NRG; PAM sequence: GAG
aaattattattatttttttt

SEQ ID NO: 42414 - DNA, 20 bp, Artificial Sequence
  Description of Artificial Sequence: Synthetic oligonucleotide
  Target: SCN9A; (+) strand; PAM type: NRG; PAM sequence: TGG
tattattattttttttgaga

SEQ ID NO: 42415 - DNA, 20 bp, Artificial Sequence
  Description of Artificial Sequence: Synthetic oligonucleotide
  Target: SCN9A; (+) strand; PAM type: NRG; PAM sequence: GAG
ttattattttttttgagatg

SEQ ID NO: 42416 - DNA, 20 bp, Artificial Sequence
  Description of Artificial Sequence: Synthetic oligonucleotide
  Target: SCN9A; (+) strand; PAM type: NRG; PAM sequence: AAG
ggagtctcaccctgtcgccc

SEQ ID NO: 42417 - DNA, 20 bp, Artificial Sequence
  Description of Artificial Sequence: Synthetic oligonucleotide
  Target: SCN9A; (+) strand; PAM type: NRG; PAM sequence: TGG
tctcaccctgtcgcccaagc

SEQ ID NO: 42418 - DNA, 20 bp, Artificial Sequence
  Description of Artificial Sequence: Synthetic oligonucleotide
  Target: SCN9A; (+) strand; PAM type: NRG; PAM sequence: GAG
tcaccctgtcgcccaagctg

SEQ ID NO: 42419 - DNA, 20 bp, Artificial Sequence
  Description of Artificial Sequence: Synthetic oligonucleotide
  Target: SCN9A; (+) strand; PAM type: NRG; PAM sequence: CAG
ctgtcgcccaagctggagtg

SEQ ID NO: 42420 - DNA, 20 bp, Artificial Sequence
  Description of Artificial Sequence: Synthetic oligonucleotide
  Target: SCN9A; (+) strand; PAM type: NRG; PAM sequence: TGG
tcgcccaagctggagtgcag

SEQ ID NO: 42421 - DNA, 20 bp, Artificial Sequence
  Description of Artificial Sequence: Synthetic oligonucleotide
  Target: SCN9A; (+) strand; PAM type: NRG; PAM sequence: CGG
tcactgaaacctctgcctac

SEQ ID NO: 42422 - DNA, 20 bp, Artificial Sequence
  Description of Artificial Sequence: Synthetic oligonucleotide
  Target: SCN9A; (+) strand; PAM type: NRG; PAM sequence: GGG
cactgaaacctctgcctacc

SEQ ID NO: 42423 - DNA, 20 bp, Artificial Sequence
  Description of Artificial Sequence: Synthetic oligonucleotide
  Target: SCN9A; (+) strand; PAM type: NRG; PAM sequence: AAG
aacctctgcctaccgggttc

SEQ ID NO: 42424 - DNA, 20 bp, Artificial Sequence
  Description of Artificial Sequence: Synthetic oligonucleotide
  Target: SCN9A; (+) strand; PAM type: NRG; PAM sequence: CAG
ttcaagcgattcttctgcct

SEQ ID NO: 42425 - DNA, 20 bp, Artificial Sequence
  Description of Artificial Sequence: Synthetic oligonucleotide
  Target: SCN9A; (+) strand; PAM type: NRG; PAM sequence: GAG
ttcttctgcctcagcctcct

SEQ ID NO: 42426 - DNA, 20 bp, Artificial Sequence
  Description of Artificial Sequence: Synthetic oligonucleotide
  Target: SCN9A; (+) strand; PAM type: NRG; PAM sequence: TAG
ttctgcctcagcctcctgag

SEQ ID NO: 42427 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctcctgagtagc

SEQ ID NO: 42428 - DNA, 20 bp, Artificial Sequence
  Description of Artificial Sequence: Synthetic oligonucleotide
  Target: SCN9A; (+) strand; PAM type: NRG; PAM sequence: GGG
cctcagcctcctgagtagct

SEQ ID NO: 42429 - DNA, 20 bp, Artificial Sequence
  Description of Artificial Sequence: Synthetic oligonucleotide
  Target: SCN9A; (+) strand; PAM type: NRG; PAM sequence: CAG
ctcctgagtagctgggatta

SEQ ID NO: 42430 - DNA, 20 bp, Artificial Sequence
  Description of Artificial Sequence: Synthetic oligonucleotide
  Target: SCN9A; (+) strand; PAM type: NRG; PAM sequence: AGG
tcctgagtagctgggattac

SEQ ID NO: 42431 - DNA, 20 bp, Artificial Sequence
  Description of Artificial Sequence: Synthetic oligonucleotide
  Target: SCN9A; (+) strand; PAM type: NRG; PAM sequence: TGG
caggcacctgccaccatgtc

SEQ ID NO: 42432 - DNA, 20 bp, Artificial Sequence
  Description of Artificial Sequence: Synthetic oligonucleotide
  Target: SCN9A; (+) strand; PAM type: NRG; PAM sequence: TAG
ggctaattttttgtattttt

SEQ ID NO: 42433 - DNA, 20 bp, Artificial Sequence
  Description of Artificial Sequence: Synthetic oligonucleotide
  Target: SCN9A; (+) strand; PAM type: NRG; PAM sequence: TAG
taattttttgtattttttag

SEQ ID NO: 42434 - DNA, 20 bp, Artificial Sequence
  Description of Artificial Sequence: Synthetic oligonucleotide
  Target: SCN9A; (+) strand; PAM type: NRG; PAM sequence: GAG
attttttgtattttttagta

SEQ ID NO: 42435 - DNA, 20 bp, Artificial Sequence
  Description of Artificial Sequence: Synthetic oligonucleotide
  Target: SCN9A; (+) strand; PAM type: NRG; PAM sequence: CGG
tttgtattttttagtagaga

SEQ ID NO: 42436 - DNA, 20 bp, Artificial Sequence
  Description of Artificial Sequence: Synthetic oligonucleotide
  Target: SCN9A; (+) strand; PAM type: NRG; PAM sequence: GGG
ttgtattttttagtagagac

SEQ ID NO: 42437 - DNA, 20 bp, Artificial Sequence
  Description of Artificial Sequence: Synthetic oligonucleotide
  Target: SCN9A; (+) strand; PAM type: NRG; PAM sequence: GGG
tgtattttttagtagagacg

SEQ ID NO: 42438 - DNA, 20 bp, Artificial Sequence
  Description of Artificial Sequence: Synthetic oligonucleotide
  Target: SCN9A; (+) strand; PAM type: NRG; PAM sequence: TGG
gagacggggtttcaccatgt

SEQ ID NO: 42439 - DNA, 20 bp, Artificial Sequence
  Description of Artificial Sequence: Synthetic oligonucleotide
  Target: SCN9A; (+) strand; PAM type: NRG; PAM sequence: CAG
cggggtttcaccatgttggc

SEQ ID NO: 42440 - DNA, 20 bp, Artificial Sequence
  Description of Artificial Sequence: Synthetic oligonucleotide
  Target: SCN9A; (+) strand; PAM type: NRG; PAM sequence: AGG
ggggtttcaccatgttggcc

SEQ ID NO: 42441 - DNA, 20 bp, Artificial Sequence
  Description of Artificial Sequence: Synthetic oligonucleotide
  Target: SCN9A; (+) strand; PAM type: NRG; PAM sequence: TGG
tttcaccatgttggccaggc

SEQ ID NO: 42442 - DNA, 20 bp, Artificial Sequence
  Description of Artificial Sequence: Synthetic oligonucleotide
  Target: SCN9A; (+) strand; PAM type: NRG; PAM sequence: CAG
tggtctcaaactcctgacct

SEQ ID NO: 42443 - DNA, 20 bp, Artificial Sequence
  Description of Artificial Sequence: Synthetic oligonucleotide
  Target: SCN9A; (+) strand; PAM type: NRG; PAM sequence: AGG
ggtctcaaactcctgacctc

SEQ ID NO: 42444 - DNA, 20 bp, Artificial Sequence
  Description of Artificial Sequence: Synthetic oligonucleotide
  Target: SCN9A; (+) strand; PAM type: NRG; PAM sequence: CGG
ctcaggtgatccacctgcct

SEQ ID NO: 42445 - DNA, 20 bp, Artificial Sequence
  Description of Artificial Sequence: Synthetic oligonucleotide
  Target: SCN9A; (+) strand; PAM type: NRG; PAM sequence: AAG
ccacctgcctcggactctca

SEQ ID NO: 42446 - DNA, 20 bp, Artificial Sequence
  Description of Artificial Sequence: Synthetic oligonucleotide
  Target: SCN9A; (+) strand; PAM type: NRG; PAM sequence: TGG
gcctcggactctcaaagtgc

SEQ ID NO: 42447 - DNA, 20 bp, Artificial Sequence
  Description of Artificial Sequence: Synthetic oligonucleotide
  Target: SCN9A; (+) strand; PAM type: NRG; PAM sequence: GGG
cctcggactctcaaagtgct

SEQ ID NO: 42448 - DNA, 20 bp, Artificial Sequence
  Description of Artificial Sequence: Synthetic oligonucleotide
  Target: SCN9A; (+) strand; PAM type: NRG; PAM sequence: CAG
ctctcaaagtgctgggatta

SEQ ID NO: 42449 - DNA, 20 bp, Artificial Sequence
  Description of Artificial Sequence: Synthetic oligonucleotide
  Target: SCN9A; (+) strand; PAM type: NRG; PAM sequence: AGG
tctcaaagtgctgggattac

SEQ ID NO: 42450 - DNA, 20 bp, Artificial Sequence
  Description of Artificial Sequence: Synthetic oligonucleotide
  Target: SCN9A; (+) strand; PAM type: NRG; PAM sequence: GAG
agtgctgggattacaggcgt

SEQ ID NO: 42451 - DNA, 20 bp, Artificial Sequence
  Description of Artificial Sequence: Synthetic oligonucleotide
  Target: SCN9A; (+) strand; PAM type: NRG; PAM sequence: TGG
caggcgtgagctaccgcgcc

SEQ ID NO: 42452 - DNA, 20 bp, Artificial Sequence
  Description of Artificial Sequence: Synthetic oligonucleotide
  Target: SCN9A; (+) strand; PAM type: NRG; PAM sequence: CAG
cgtgagctaccgcgcctggc

SEQ ID NO: 42453 - DNA, 20 bp, Artificial Sequence
  Description of Artificial Sequence: Synthetic oligonucleotide
  Target: SCN9A; (+) strand; PAM type: NRG; PAM sequence: AAG
gagctaccgcgcctggccag

SEQ ID NO: 42454 - DNA, 20 bp, Artificial Sequence
  Description of Artificial Sequence: Synthetic oligonucleotide
  Target: SCN9A; (+) strand; PAM type: NRG; PAM sequence: AAG
cgcgcctggccagaagccaa

SEQ ID NO: 42455 - DNA, 20 bp, Artificial Sequence
  Description of Artificial Sequence: Synthetic oligonucleotide
  Target: SCN9A; (+) strand; PAM type: NRG; PAM sequence: AAG
ccagaagccaaaagtttatg

SEQ ID NO: 42456 - DNA, 20 bp, Artificial Sequence
  Description of Artificial Sequence: Synthetic oligonucleotide
  Target: SCN9A; (+) strand; PAM type: NRG; PAM sequence: CAG
gtttatgaagctttgaataa

SEQ ID NO: 42457 - DNA, 20 bp, Artificial Sequence
  Description of Artificial Sequence: Synthetic oligonucleotide
  Target: SCN9A; (+) strand; PAM type: NRG; PAM sequence: GAG
tgaagctttgaataacagtt

SEQ ID NO: 42458 - DNA, 20 bp, Artificial Sequence
  Description of Artificial Sequence: Synthetic oligonucleotide
  Target: SCN9A; (+) strand; PAM type: NRG; PAM sequence: GAG
agttgagaaattgaactttt

SEQ ID NO: 42459 - DNA, 20 bp, Artificial Sequence
  Description of Artificial Sequence: Synthetic oligonucleotide
  Target: SCN9A; (+) strand; PAM type: NRG; PAM sequence: TGG
ttgagtaaatatgactaatt

SEQ ID NO: 42460 - DNA, 20 bp, Artificial Sequence
  Description of Artificial Sequence: Synthetic oligonucleotide
  Target: SCN9A; (+) strand; PAM type: NRG; PAM sequence: CAG
actaatttggtaacattttg

SEQ ID NO: 42461 - DNA, 20 bp, Artificial Sequence
  Description of Artificial Sequence: Synthetic oligonucleotide
  Target: SCN9A; (+) strand; PAM type: NRG; PAM sequence: CAG
atttggtaacattttgcagt

SEQ ID NO: 42462 - DNA, 20 bp, Artificial Sequence
  Description of Artificial Sequence: Synthetic oligonucleotide
  Target: SCN9A; (+) strand; PAM type: NRG; PAM sequence: AAG
atgaattcaacttttcttaa

SEQ ID NO: 42463 - DNA, 20 bp, Artificial Sequence
  Description of Artificial Sequence: Synthetic oligonucleotide
  Target: SCN9A; (+) strand; PAM type: NRG; PAM sequence: TGG
agctcgataatgcaaaccct

SEQ ID NO: 42464 - DNA, 20 bp, Artificial Sequence
  Description of Artificial Sequence: Synthetic oligonucleotide
  Target: SCN9A; (+) strand; PAM type: NRG; PAM sequence: AAG
aaacccttggttaaatttta

SEQ ID NO: 42465 - DNA, 20 bp, Artificial Sequence
  Description of Artificial Sequence: Synthetic oligonucleotide
  Target: SCN9A; (+) strand; PAM type: NRG; PAM sequence: TGG
ttaaattttaaagcacttat

SEQ ID NO: 42466 - DNA, 20 bp, Artificial Sequence
  Description of Artificial Sequence: Synthetic oligonucleotide
  Target: SCN9A; (+) strand; PAM type: NRG; PAM sequence: CAG
gtgttgacctctaattatgt

SEQ ID NO: 42467 - DNA, 20 bp, Artificial Sequence
  Description of Artificial Sequence: Synthetic oligonucleotide
  Target: SCN9A; (+) strand; PAM type: NRG; PAM sequence: AGG
tgttgacctctaattatgtc

SEQ ID NO: 42468 - DNA, 20 bp, Artificial Sequence
  Description of Artificial Sequence: Synthetic oligonucleotide
  Target: SCN9A; (+) strand; PAM type: NRG; PAM sequence: TGG
taattatgtcaggcatcata

SEQ ID NO: 42469 - DNA, 20 bp, Artificial Sequence
  Description of Artificial Sequence: Synthetic oligonucleotide
  Target: SCN9A; (+) strand; PAM type: NRG; PAM sequence: TAG
ctaaaaactatgactgatta

SEQ ID NO: 42470 - DNA, 20 bp, Artificial Sequence
  Description of Artificial Sequence: Synthetic oligonucleotide
  Target: SCN9A; (+) strand; PAM type: NRG; PAM sequence: AGG
taaaaactatgactgattat

SEQ ID NO: 42471 - DNA, 20 bp, Artificial Sequence
  Description of Artificial Sequence: Synthetic oligonucleotide
  Target: SCN9A; (+) strand; PAM type: NRG; PAM sequence: AAG
atgtttcttccctaaacaca

SEQ ID NO: 42472 - DNA, 20 bp, Artificial Sequence
  Description of Artificial Sequence: Synthetic oligonucleotide
  Target: SCN9A; (+) strand; PAM type: NRG; PAM sequence: AGG
tgtttcttccctaaacacaa

SEQ ID NO: 42473 - DNA, 20 bp, Artificial Sequence
  Description of Artificial Sequence: Synthetic oligonucleotide
  Target: SCN9A; (+) strand; PAM type: NRG; PAM sequence: TAG
tcttccctaaacacaaaggt

SEQ ID NO: 42474 - DNA, 20 bp, Artificial Sequence
  Description of Artificial Sequence: Synthetic oligonucleotide
  Target: SCN9A; (+) strand; PAM type: NRG; PAM sequence: AGG
cttccctaaacacaaaggtt

SEQ ID NO: 42475 - DNA, 20 bp, Artificial Sequence
  Description of Artificial Sequence: Synthetic oligonucleotide
  Target: SCN9A; (+) strand; PAM type: NRG; PAM sequence: TAG
aggttaggtttctgaaaatc

SEQ ID NO: 42476 - DNA, 20 bp, Artificial Sequence
  Description of Artificial Sequence: Synthetic oligonucleotide
  Target: SCN9A; (+) strand; PAM type: NRG; PAM sequence: AAG
ttaggtttctgaaaatctag

SEQ ID NO: 42477 - DNA, 20 bp, Artificial Sequence
  Description of Artificial Sequence: Synthetic oligonucleotide
  Target: SCN9A; (+) strand; PAM type: NRG; PAM sequence: TAG
ttctgaaaatctagaagaat

SEQ ID NO: 42478 - DNA, 20 bp, Artificial Sequence
  Description of Artificial Sequence: Synthetic oligonucleotide
  Target: SCN9A; (+) strand; PAM type: NRG; PAM sequence: AAG
aaatctagaagaattagtaa

SEQ ID NO: 42479 - DNA, 20 bp, Artificial Sequence
  Description of Artificial Sequence: Synthetic oligonucleotide
  Target: SCN9A; (+) strand; PAM type: NRG; PAM sequence: AAG
agaagaattagtaaaagata

SEQ ID NO: 42480 - DNA, 20 bp, Artificial Sequence
  Description of Artificial Sequence: Synthetic oligonucleotide
  Target: SCN9A; (+) strand; PAM type: NRG; PAM sequence: GAG
gataaagaacatatcattct

SEQ ID NO: 42481 - DNA, 20 bp, Artificial Sequence
  Description of Artificial Sequence: Synthetic oligonucleotide
  Target: SCN9A; (+) strand; PAM type: NRG; PAM sequence: AAG
catatcattctgagaaaaat

SEQ ID NO: 42482 - DNA, 20 bp, Artificial Sequence
  Description of Artificial Sequence: Synthetic oligonucleotide
  Target: SCN9A; (+) strand; PAM type: NRG; PAM sequence: TGG
cattctgagaaaaataagac

SEQ ID NO: 42483 - DNA, 20 bp, Artificial Sequence
  Description of Artificial Sequence: Synthetic oligonucleotide
  Target: SCN9A; (+) strand; PAM type: NRG; PAM sequence: GGG
attctgagaaaaataagact

SEQ ID NO: 42484 - DNA, 20 bp, Artificial Sequence
  Description of Artificial Sequence: Synthetic oligonucleotide
  Target: SCN9A; (+) strand; PAM type: NRG; PAM sequence: GAG
tctgagaaaaataagactgg

SEQ ID NO: 42485 - DNA, 20 bp, Artificial Sequence
  Description of Artificial Sequence: Synthetic oligonucleotide
  Target: SCN9A; (+) strand; PAM type: NRG; PAM sequence: GAG
aaaaataagactgggagatt

SEQ ID NO: 42486 - DNA, 20 bp, Artificial Sequence
  Description of Artificial Sequence: Synthetic oligonucleotide
  Target: SCN9A; (+) strand; PAM type: NRG; PAM sequence: AGG
aaaataagactgggagattg

SEQ ID NO: 42487 - DNA, 20 bp, Artificial Sequence
  Description of Artificial Sequence: Synthetic oligonucleotide
  Target: SCN9A; (+) strand; PAM type: NRG; PAM sequence: AAG
ttgaggttataaaataatgt

SEQ ID NO: 42488 - DNA, 20 bp, Artificial Sequence
  Description of Artificial Sequence: Synthetic oligonucleotide
  Target: SCN9A; (+) strand; PAM type: NRG; PAM sequence: AAG
ggttataaaataatgtaaga

SEQ ID NO: 42489 - DNA, 20 bp, Artificial Sequence
  Description of Artificial Sequence: Synthetic oligonucleotide
  Target: SCN9A; (+) strand; PAM type: NRG; PAM sequence: AAG
aatatgtcatatatattatt

SEQ ID NO: 42490 - DNA, 20 bp, Artificial Sequence
  Description of Artificial Sequence: Synthetic oligonucleotide
  Target: SCN9A; (+) strand; PAM type: NRG; PAM sequence: TAG
ttattaaaatataaaataat

SEQ ID NO: 42491 - DNA, 20 bp, Artificial Sequence
  Description of Artificial Sequence: Synthetic oligonucleotide
  Target: SCN9A; (+) strand; PAM type: NRG; PAM sequence: GAG
attaaaatataaaataatta

SEQ ID NO: 42492 - DNA, 20 bp, Artificial Sequence
  Description of Artificial Sequence: Synthetic oligonucleotide
  Target: SCN9A; (+) strand; PAM type: NRG; PAM sequence: TGG
attcaatgaaatgataataa

SEQ ID NO: 42493 - DNA, 20 bp, Artificial Sequence
  Description of Artificial Sequence: Synthetic oligonucleotide
  Target: SCN9A; (+) strand; PAM type: NRG; PAM sequence: GGG
ttcaatgaaatgataataat

SEQ ID NO: 42494 - DNA, 20 bp, Artificial Sequence
  Description of Artificial Sequence: Synthetic oligonucleotide
  Target: SCN9A; (+) strand; PAM type: NRG; PAM sequence: TAG
aataatgggtattgtaccgt

SEQ ID NO: 42495 - DNA, 20 bp, Artificial Sequence
  Description of Artificial Sequence: Synthetic oligonucleotide
  Target: SCN9A; (+) strand; PAM type: NRG; PAM sequence: GAG
tgtaccgttagtttctattt

SEQ ID NO: 42496 - DNA, 20 bp, Artificial Sequence
  Description of Artificial Sequence: Synthetic oligonucleotide
  Target: SCN9A; (+) strand; PAM type: NRG; PAM sequence: GAG
taccgttagtttctatttga

SEQ ID NO: 42497 - DNA, 20 bp, Artificial Sequence
  Description of Artificial Sequence: Synthetic oligonucleotide
  Target: SCN9A; (+) strand; PAM type: NRG; PAM sequence: AAG
ttgatctcaccgactatttt

SEQ ID NO: 42498 - DNA, 20 bp, Artificial Sequence
  Description of Artificial Sequence: Synthetic oligonucleotide
  Target: SCN9A; (+) strand; PAM type: NRG; PAM sequence: CAG
gatttcttctctatctcaat

SEQ ID NO: 42499 - DNA, 20 bp, Artificial Sequence
  Description of Artificial Sequence: Synthetic oligonucleotide
  Target: SCN9A; (+) strand; PAM type: NRG; PAM sequence: AAG
ttcttctctatctcaatcag

SEQ ID NO: 42500 - DNA, 20 bp, Artificial Sequence
  Description of Artificial Sequence: Synthetic oligonucleotide
  Target: SCN9A; (+) strand; PAM type: NRG; PAM sequence: AAG
ttaaaataatatgtaaacta

SEQ ID NO: 42501 - DNA, 20 bp, Artificial Sequence
  Description of Artificial Sequence: Synthetic oligonucleotide
  Target: SCN9A; (+) strand; PAM type: NRG; PAM sequence: AAG
ttatgtattttccatcatcc

SEQ ID NO: 42502 - DNA, 20 bp, Artificial Sequence
  Description of Artificial Sequence: Synthetic oligonucleotide
  Target: SCN9A; (+) strand; PAM type: NRG; PAM sequence: CAG
tccatcatccaagtattcaa

SEQ ID NO: 42503 - DNA, 20 bp, Artificial Sequence
  Description of Artificial Sequence: Synthetic oligonucleotide
  Target: SCN9A; (+) strand; PAM type: NRG; PAM sequence: TGG
cctctgccccactgccattc

SEQ ID NO: 42504 - DNA, 20 bp, Artificial Sequence
  Description of Artificial Sequence: Synthetic oligonucleotide
  Target: SCN9A; (+) strand; PAM type: NRG; PAM sequence: GAG
tctgccccactgccattctg

SEQ ID NO: 42505 - DNA, 20 bp, Artificial Sequence
  Description of Artificial Sequence: Synthetic oligonucleotide
  Target: SCN9A; (+) strand; PAM type: NRG; PAM sequence: AAG
ccactgccattctggagatg

SEQ ID NO: 42506 - DNA, 20 bp, Artificial Sequence
  Description of Artificial Sequence: Synthetic oligonucleotide
  Target: SCN9A; (+) strand; PAM type: NRG; PAM sequence: AGG
cactgccattctggagatga

SEQ ID NO: 42507 - DNA, 20 bp, Artificial Sequence
  Description of Artificial Sequence: Synthetic oligonucleotide
  Target: SCN9A; (+) strand; PAM type: NRG; PAM sequence: GGG
actgccattctggagatgaa

SEQ ID NO: 42508 - DNA, 20 bp, Artificial Sequence
  Description of Artificial Sequence: Synthetic oligonucleotide
  Target: SCN9A; (+) strand; PAM type: NRG; PAM sequence: AAG
ccattctggagatgaagggc

SEQ ID NO: 42509 - DNA, 20 bp, Artificial Sequence
  Description of Artificial Sequence: Synthetic oligonucleotide
  Target: SCN9A; (+) strand; PAM type: NRG; PAM sequence: GAG
gaagggcaagtcgcatattt

SEQ ID NO: 42510 - DNA, 20 bp, Artificial Sequence
  Description of Artificial Sequence: Synthetic oligonucleotide
  Target: SCN9A; (+) strand; PAM type: NRG; PAM sequence: TAG
ggcaagtcgcatatttgaga

SEQ ID NO: 42511 - DNA, 20 bp, Artificial Sequence
  Description of Artificial Sequence: Synthetic oligonucleotide
  Target: SCN9A; (+) strand; PAM type: NRG; PAM sequence: GAG
caagtcgcatatttgagata

SEQ ID NO: 42512 - DNA, 20 bp, Artificial Sequence
  Description of Artificial Sequence: Synthetic oligonucleotide
  Target: SCN9A; (+) strand; PAM type: NRG; PAM sequence: TGG
gagacaattgtgtctcattt

SEQ ID NO: 42513 - DNA, 20 bp, Artificial Sequence
  Description of Artificial Sequence: Synthetic oligonucleotide
  Target: SCN9A; (+) strand; PAM type: NRG; PAM sequence: TGG
attttggtttttcctataat

SEQ ID NO: 42514 - DNA, 20 bp, Artificial Sequence
  Description of Artificial Sequence: Synthetic oligonucleotide
  Target: SCN9A; (+) strand; PAM type: NRG; PAM sequence: GGG
ttttggtttttcctataatt

SEQ ID NO: 42515 - DNA, 20 bp, Artificial Sequence
  Description of Artificial Sequence: Synthetic oligonucleotide
  Target: SCN9A; (+) strand; PAM type: NRG; PAM sequence: GAG
tttttcctataattgggtct

SEQ ID NO: 42516 - DNA, 20 bp, Artificial Sequence
  Description of Artificial Sequence: Synthetic oligonucleotide
  Target: SCN9A; (+) strand; PAM type: NRG; PAM sequence: TAG
tcctataattgggtctgaga

SEQ ID NO: 42517 - DNA, 20 bp, Artificial Sequence
  Description of Artificial Sequence: Synthetic oligonucleotide
  Target: SCN9A; (+) strand; PAM type: NRG; PAM sequence: AAG
cttctctctccccaaataca

SEQ ID NO: 42518 - DNA, 20 bp, Artificial Sequence
  Description of Artificial Sequence: Synthetic oligonucleotide
  Target: SCN9A; (+) strand; PAM type: NRG; PAM sequence: TAG
tgtatttgtataatgatttt

SEQ ID NO: 42519 - DNA, 20 bp, Artificial Sequence
  Description of Artificial Sequence: Synthetic oligonucleotide
  Target: SCN9A; (+) strand; PAM type: NRG; PAM sequence: TAG
aatgatttttagaaaaattt

SEQ ID NO: 42520 - DNA, 20 bp, Artificial Sequence
  Description of Artificial Sequence: Synthetic oligonucleotide
  Target: SCN9A; (+) strand; PAM type: NRG; PAM sequence: CAG
aaaaattttagctcacatat

SEQ ID NO: 42521 - DNA, 20 bp, Artificial Sequence
  Description of Artificial Sequence: Synthetic oligonucleotide
  Target: SCN9A; (+) strand; PAM type: NRG; PAM sequence: AAG
aattttgttttattcttaac

SEQ ID NO: 42522 - DNA, 20 bp, Artificial Sequence
  Description of Artificial Sequence: Synthetic oligonucleotide
  Target: SCN9A; (+) strand; PAM type: NRG; PAM sequence: CAG
aaaaaatcacatctcctttg

SEQ ID NO: 42523 - DNA, 20 bp, Artificial Sequence
  Description of Artificial Sequence: Synthetic oligonucleotide
  Target: SCN9A; (+) strand; PAM type: NRG; PAM sequence: CAG
ttataaatgttacaatgtca

SEQ ID NO: 42524 - DNA, 20 bp, Artificial Sequence
  Description of Artificial Sequence: Synthetic oligonucleotide
  Target: SCN9A; (+) strand; PAM type: NRG; PAM sequence: CAG
ttctgttctaatattcctca

SEQ ID NO: 42525 - DNA, 20 bp, Artificial Sequence
  Description of Artificial Sequence: Synthetic oligonucleotide
  Target: SCN9A; (+) strand; PAM type: NRG; PAM sequence: TGG
cctcacagatatatttccac

SEQ ID NO: 42526 - DNA, 20 bp, Artificial Sequence
  Description of Artificial Sequence: Synthetic oligonucleotide
  Target: SCN9A; (+) strand; PAM type: NRG; PAM sequence: AAG
ggctgtgttaatatttctaa

SEQ ID NO: 42527 - DNA, 20 bp, Artificial Sequence
  Description of Artificial Sequence: Synthetic oligonucleotide
  Target: SCN9A; (+) strand; PAM type: NRG; PAM sequence: TAG
tttctaaaagaataaaccta

SEQ ID NO: 42528 - DNA, 20 bp, Artificial Sequence
  Description of Artificial Sequence: Synthetic oligonucleotide
  Target: SCN9A; (+) strand; PAM type: NRG; PAM sequence: AAG
ctatagcctgaaaatatatg

SEQ ID NO: 42529 - DNA, 20 bp, Artificial Sequence
  Description of Artificial Sequence: Synthetic oligonucleotide
  Target: SCN9A; (+) strand; PAM type: NRG; PAM sequence: TAG
taaaatatgataatatgcaa

SEQ ID NO: 42530 - DNA, 20 bp, Artificial Sequence
  Description of Artificial Sequence: Synthetic oligonucleotide
  Target: SCN9A; (+) strand; PAM type: NRG; PAM sequence: TGG
aatatgataatatgcaatag

SEQ ID NO: 42531 - DNA, 20 bp, Artificial Sequence
  Description of Artificial Sequence: Synthetic oligonucleotide
  Target: SCN9A; (+) strand; PAM type: NRG; PAM sequence: AAG
gataatatgcaatagtggtg

SEQ ID NO: 42532 - DNA, 20 bp, Artificial Sequence
  Description of Artificial Sequence: Synthetic oligonucleotide
  Target: SCN9A; (+) strand; PAM type: NRG; PAM sequence: AGG
ataatatgcaatagtggtga

SEQ ID NO: 42533 - DNA, 20 bp, Artificial Sequence
  Description of Artificial Sequence: Synthetic oligonucleotide
  Target: SCN9A; (+) strand; PAM type: NRG; PAM sequence: CAG
gaaggttttttcacaacaca

SEQ ID NO: 42534 - DNA, 20 bp, Artificial Sequence
  Description of Artificial Sequence: Synthetic oligonucleotide
  Target: SCN9A; (+) strand; PAM type: NRG; PAM sequence: AAG
gttttttcacaacacacagt

SEQ ID NO: 42535 - DNA, 20 bp, Artificial Sequence
  Description of Artificial Sequence: Synthetic oligonucleotide
  Target: SCN9A; (+) strand; PAM type: NRG; PAM sequence: AAG
ctcttttaaaatgtactcaa

SEQ ID NO: 42536 - DNA, 20 bp, Artificial Sequence
  Description of Artificial Sequence: Synthetic oligonucleotide
  Target: SCN9A; (+) strand; PAM type: NRG; PAM sequence: TAG
aaagtacctacatcaacaat

SEQ ID NO: 42537 - DNA, 20 bp, Artificial Sequence
  Description of Artificial Sequence: Synthetic oligonucleotide
  Target: SCN9A; (+) strand; PAM type: NRG; PAM sequence: AGG
aagtacctacatcaacaatt

SEQ ID NO: 42538 - DNA, 20 bp, Artificial Sequence
  Description of Artificial Sequence: Synthetic oligonucleotide
  Target: SCN9A; (+) strand; PAM type: NRG; PAM sequence: CAG
acatcaacaattaggaaatc

SEQ ID NO: 42539 - DNA, 20 bp, Artificial Sequence
  Description of Artificial Sequence: Synthetic oligonucleotide
  Target: SCN9A; (+) strand; PAM type: NRG; PAM sequence: CAG
ttaggaaatccagccaacac

SEQ ID NO: 42540 - DNA, 20 bp, Artificial Sequence
  Description of Artificial Sequence: Synthetic oligonucleotide
  Target: SCN9A; (+) strand; PAM type: NRG; PAM sequence: AGG
taggaaatccagccaacacc

SEQ ID NO: 42541 - DNA, 20 bp, Artificial Sequence
  Description of Artificial Sequence: Synthetic oligonucleotide
  Target: SCN9A; (+) strand; PAM type: NRG; PAM sequence: TGG
atccagccaacaccaggcat

SEQ ID NO: 42542 - DNA, 20 bp, Artificial Sequence
  Description of Artificial Sequence: Synthetic oligonucleotide
  Target: SCN9A; (+) strand; PAM type: NRG; PAM sequence: TAG
taaccatatgctatccattt

SEQ ID NO: 42543 - DNA, 20 bp, Artificial Sequence
  Description of Artificial Sequence: Synthetic oligonucleotide
  Target: SCN9A; (+) strand; PAM type: NRG; PAM sequence: AAG
ccatatgctatccattttag

SEQ ID NO: 42544 - DNA, 20 bp, Artificial Sequence
  Description of Artificial Sequence: Synthetic oligonucleotide
  Target: SCN9A; (+) strand; PAM type: NRG; PAM sequence: CAG
atccattttagaagcatttc

SEQ ID NO: 42545 - DNA, 20 bp, Artificial Sequence
  Description of Artificial Sequence: Synthetic oligonucleotide
  Target: SCN9A; (+) strand; PAM type: NRG; PAM sequence: AAG
ttagaagcatttccagaatg

SEQ ID NO: 42546 - DNA, 20 bp, Artificial Sequence
  Description of Artificial Sequence: Synthetic oligonucleotide
  Target: SCN9A; (+) strand; PAM type: NRG; PAM sequence: AAG
catttccagaatgaagatgt

SEQ ID NO: 42547 - DNA, 20 bp, Artificial Sequence
  Description of Artificial Sequence: Synthetic oligonucleotide
  Target: SCN9A; (+) strand; PAM type: NRG; PAM sequence: AAG
ccagaatgaagatgtaagtg

SEQ ID NO: 42548 - DNA, 20 bp, Artificial Sequence
  Description of Artificial Sequence: Synthetic oligonucleotide
  Target: SCN9A; (+) strand; PAM type: NRG; PAM sequence: CAG
aagatcttgtctgcatactc

SEQ ID NO: 42549 - DNA, 20 bp, Artificial Sequence
  Description of Artificial Sequence: Synthetic oligonucleotide
  Target: SCN9A; (+) strand; PAM type: NRG; PAM sequence: AGG
agatcttgtctgcatactcc

SEQ ID NO: 42550 - DNA, 20 bp, Artificial Sequence
  Description of Artificial Sequence: Synthetic oligonucleotide
  Target: SCN9A; (+) strand; PAM type: NRG; PAM sequence: TGG
atactccaggataatcttaa

SEQ ID NO: 42551 - DNA, 20 bp, Artificial Sequence
  Description of Artificial Sequence: Synthetic oligonucleotide
  Target: SCN9A; (+) strand; PAM type: NRG; PAM sequence: AAG
ttcaatataaatatcttcaa

SEQ ID NO: 42552 - DNA, 20 bp, Artificial Sequence
  Description of Artificial Sequence: Synthetic oligonucleotide
  Target: SCN9A; (+) strand; PAM type: NRG; PAM sequence: TGG
taaatatcttcaaaagcctg

SEQ ID NO: 42553 - DNA, 20 bp, Artificial Sequence
  Description of Artificial Sequence: Synthetic oligonucleotide
  Target: SCN9A; (+) strand; PAM type: NRG; PAM sequence: AAG
agcctgtggaaataatattc

SEQ ID NO: 42554 - DNA, 20 bp, Artificial Sequence
  Description of Artificial Sequence: Synthetic oligonucleotide
  Target: SCN9A; (+) strand; PAM type: NRG; PAM sequence: AAG
gtttcaatcatgcacaactt

SEQ ID NO: 42555 - DNA, 20 bp, Artificial Sequence
  Description of Artificial Sequence: Synthetic oligonucleotide
  Target: SCN9A; (+) strand; PAM type: NRG; PAM sequence: CAG
catgattcatttaaaaaaaa

SEQ ID NO: 42556 - DNA, 20 bp, Artificial Sequence
  Description of Artificial Sequence: Synthetic oligonucleotide
  Target: SCN9A; (+) strand; PAM type: NRG; PAM sequence: AGG
atgattcatttaaaaaaaac

SEQ ID NO: 42557 - DNA, 20 bp, Artificial Sequence
  Description of Artificial Sequence: Synthetic oligonucleotide
  Target: SCN9A; (+) strand; PAM type: NRG; PAM sequence: AAG
aaaaatacaattctaatgct

SEQ ID NO: 42558 - DNA, 20 bp, Artificial Sequence
  Description of Artificial Sequence: Synthetic oligonucleotide
  Target: SCN9A; (+) strand; PAM type: NRG; PAM sequence: TGG
gctgaaacataatattgaca

SEQ ID NO: 42559 - DNA, 20 bp, Artificial Sequence
  Description of Artificial Sequence: Synthetic oligonucleotide
  Target: SCN9A; (+) strand; PAM type: NRG; PAM sequence: GGG
ctgaaacataatattgacat

SEQ ID NO: 42560 - DNA, 20 bp, Artificial Sequence
  Description of Artificial Sequence: Synthetic oligonucleotide
  Target: SCN9A; (+) strand; PAM type: NRG; PAM sequence: CAG
aacataatattgacatgggc

SEQ ID NO: 42561 - DNA, 20 bp, Artificial Sequence
  Description of Artificial Sequence: Synthetic oligonucleotide
  Target: SCN9A; (+) strand; PAM type: NRG; PAM sequence: TGG
gggccagctgacattttttc

SEQ ID NO: 42562 - DNA, 20 bp, Artificial Sequence
  Description of Artificial Sequence: Synthetic oligonucleotide
  Target: SCN9A; (+) strand; PAM type: NRG; PAM sequence: CAG
ctgacattttttctggttta

SEQ ID NO: 42563 - DNA, 20 bp, Artificial Sequence
  Description of Artificial Sequence: Synthetic oligonucleotide
  Target: SCN9A; (+) strand; PAM type: NRG; PAM sequence: CAG
ggtttacagttatcatataa

SEQ ID NO: 42564 - DNA, 20 bp, Artificial Sequence
  Description of Artificial Sequence: Synthetic oligonucleotide
  Target: SCN9A; (+) strand; PAM type: NRG; PAM sequence: TAG
tacagttatcatataacagt

SEQ ID NO: 42565 - DNA, 20 bp, Artificial Sequence
  Description of Artificial Sequence: Synthetic oligonucleotide
  Target: SCN9A; (+) strand; PAM type: NRG; PAM sequence: TAG
tatcatataacagttagttc

SEQ ID NO: 42566 - DNA, 20 bp, Artificial Sequence
  Description of Artificial Sequence: Synthetic oligonucleotide
  Target: SCN9A; (+) strand; PAM type: NRG; PAM sequence: CAG
gttagttctagccttctcac

SEQ ID NO: 42567 - DNA, 20 bp, Artificial Sequence
  Description of Artificial Sequence: Synthetic oligonucleotide
  Target: SCN9A; (+) strand; PAM type: NRG; PAM sequence: TGG
cttctcaccagtgctgctgc

SEQ ID NO: 42568 - DNA, 20 bp, Artificial Sequence
  Description of Artificial Sequence: Synthetic oligonucleotide
  Target: SCN9A; (+) strand; PAM type: NRG; PAM sequence: CAG
ccagtgctgctgctggtctt

SEQ ID NO: 42569 - DNA, 20 bp, Artificial Sequence
  Description of Artificial Sequence: Synthetic oligonucleotide
  Target: SCN9A; (+) strand; PAM type: NRG; PAM sequence: GAG
agtgctgctgctggtcttca

SEQ ID NO: 42570 - DNA, 20 bp, Artificial Sequence
  Description of Artificial Sequence: Synthetic oligonucleotide
  Target: SCN9A; (+) strand; PAM type: NRG; PAM sequence: AGG
gtgctgctgctggtcttcag

SEQ ID NO: 42571 - DNA, 20 bp, Artificial Sequence
  Description of Artificial Sequence: Synthetic oligonucleotide
  Target: SCN9A; (+) strand; PAM type: NRG; PAM sequence: AAG
gctgctggtcttcagaggtc

SEQ ID NO: 42572 - DNA, 20 bp, Artificial Sequence
  Description of Artificial Sequence: Synthetic oligonucleotide
  Target: SCN9A; (+) strand; PAM type: NRG; PAM sequence: GAG
tgctggtcttcagaggtcaa

SEQ ID NO: 42573 - DNA, 20 bp, Artificial Sequence
  Description of Artificial Sequence: Synthetic oligonucleotide
  Target: SCN9A; (+) strand; PAM type: NRG; PAM sequence: AAG
ggtcttcagaggtcaagaga

SEQ ID NO: 42574 - DNA, 20 bp, Artificial Sequence
  Description of Artificial Sequence: Synthetic oligonucleotide
  Target: SCN9A; (+) strand; PAM type: NRG; PAM sequence: AAG
gaggtcaagagaaagtgcaa

SEQ ID NO: 42575 - DNA, 20 bp, Artificial Sequence
  Description of Artificial Sequence: Synthetic oligonucleotide
  Target: SCN9A; (+) strand; PAM type: NRG; PAM sequence: AAG
aattacttataatccacaaa

SEQ ID NO: 42576 - DNA, 20 bp, Artificial Sequence
  Description of Artificial Sequence: Synthetic oligonucleotide
  Target: SCN9A; (+) strand; PAM type: NRG; PAM sequence: TGG
tcctctttctccattaaaat

SEQ ID NO: 42577 - DNA, 20 bp, Artificial Sequence
  Description of Artificial Sequence: Synthetic oligonucleotide
  Target: SCN9A; (+) strand; PAM type: NRG; PAM sequence: AAG
tttctccattaaaattggat

SEQ ID NO: 42578 - DNA, 20 bp, Artificial Sequence
  Description of Artificial Sequence: Synthetic oligonucleotide
  Target: SCN9A; (+) strand; PAM type: NRG; PAM sequence: TAG
cattaaaattggataagtcc

SEQ ID NO: 42579 - DNA, 20 bp, Artificial Sequence
  Description of Artificial Sequence: Synthetic oligonucleotide
  Target: SCN9A; (+) strand; PAM type: NRG; PAM sequence: AAG
tggataagtcctagcaattt

SEQ ID NO: 42580 - DNA, 20 bp, Artificial Sequence
  Description of Artificial Sequence: Synthetic oligonucleotide
  Target: SCN9A; (+) strand; PAM type: NRG; PAM sequence: TGG
caatttaagacatgatccca

SEQ ID NO: 42581 - DNA, 20 bp, Artificial Sequence
  Description of Artificial Sequence: Synthetic oligonucleotide
  Target: SCN9A; (+) strand; PAM type: NRG; PAM sequence: CAG
ttaagacatgatcccatggc

SEQ ID NO: 42582 - DNA, 20 bp, Artificial Sequence
  Description of Artificial Sequence: Synthetic oligonucleotide
  Target: SCN9A; (+) strand; PAM type: NRG; PAM sequence: CAG
acactcccctttttccccac

SEQ ID NO: 42583 - DNA, 20 bp, Artificial Sequence
  Description of Artificial Sequence: Synthetic oligonucleotide
  Target: SCN9A; (+) strand; PAM type: NRG; PAM sequence: TAG
ctcccctttttccccaccag

SEQ ID NO: 42584 - DNA, 20 bp, Artificial Sequence
  Description of Artificial Sequence: Synthetic oligonucleotide
  Target: SCN9A; (+) strand; PAM type: NRG; PAM sequence: AGG
tcccctttttccccaccagt

SEQ ID NO: 42585 - DNA, 20 bp, Artificial Sequence
  Description of Artificial Sequence: Synthetic oligonucleotide
  Target: SCN9A; (+) strand; PAM type: NRG; PAM sequence: TGG
ttttccccaccagtaggatg

SEQ ID NO: 42586 - DNA, 20 bp, Artificial Sequence
  Description of Artificial Sequence: Synthetic oligonucleotide
  Target: SCN9A; (+) strand; PAM type: NRG; PAM sequence: GAG
ttccccaccagtaggatgtg

SEQ ID NO: 42587 - DNA, 20 bp, Artificial Sequence
  Description of Artificial Sequence: Synthetic oligonucleotide
  Target: SCN9A; (+) strand; PAM type: NRG; PAM sequence: CAG
aggatgtggagcctgtcttt

SEQ ID NO: 42588 - DNA, 20 bp, Artificial Sequence
  Description of Artificial Sequence: Synthetic oligonucleotide
  Target: SCN9A; (+) strand; PAM type: NRG; PAM sequence: CAG
tctcaaatgcttgtgcatcc

SEQ ID NO: 42589 - DNA, 20 bp, Artificial Sequence
  Description of Artificial Sequence: Synthetic oligonucleotide
  Target: SCN9A; (+) strand; PAM type: NRG; PAM sequence: TAG
tgcttgtgcatcccagtgcc

SEQ ID NO: 42590 - DNA, 20 bp, Artificial Sequence
  Description of Artificial Sequence: Synthetic oligonucleotide
  Target: SCN9A; (+) strand; PAM type: NRG; PAM sequence: CAG
gcctagtaccatgttaataa

SEQ ID NO: 42591 - DNA, 20 bp, Artificial Sequence
  Description of Artificial Sequence: Synthetic oligonucleotide
  Target: SCN9A; (+) strand; PAM type: NRG; PAM sequence: CAG
tagtaccatgttaataacag

SEQ ID NO: 42592 - DNA, 20 bp, Artificial Sequence
  Description of Artificial Sequence: Synthetic oligonucleotide
  Target: SCN9A; (+) strand; PAM type: NRG; PAM sequence: CAG
taccatgttaataacagcag

SEQ ID NO: 42593 - DNA, 20 bp, Artificial Sequence
  Description of Artificial Sequence: Synthetic oligonucleotide
  Target: SCN9A; (+) strand; PAM type: NRG; PAM sequence: AGG
accatgttaataacagcagc

SEQ ID NO: 42594 - DNA, 20 bp, Artificial Sequence
  Description of Artificial Sequence: Synthetic oligonucleotide
  Target: SCN9A; (+) strand; PAM type: NRG; PAM sequence: AAG
tgttaataacagcagcagga

SEQ ID NO: 42595 - DNA, 20 bp, Artificial Sequence
  Description of Artificial Sequence: Synthetic oligonucleotide
  Target: SCN9A; (+) strand; PAM type: NRG; PAM sequence: AGG
gttaataacagcagcaggaa

SEQ ID NO: 42596 - DNA, 20 bp, Artificial Sequence
  Description of Artificial Sequence: Synthetic oligonucleotide
  Target: SCN9A; (+) strand; PAM type: NRG; PAM sequence: AAG
ataacagcagcaggaaagga

SEQ ID NO: 42597 - DNA, 20 bp, Artificial Sequence
  Description of Artificial Sequence: Synthetic oligonucleotide
  Target: SCN9A; (+) strand; PAM type: NRG; PAM sequence: CAG
atttgctaaatgaatgactg

SEQ ID NO: 42598 - DNA, 20 bp, Artificial Sequence
  Description of Artificial Sequence: Synthetic oligonucleotide
  Target: SCN9A; (+) strand; PAM type: NRG; PAM sequence: TAG
tgctaaatgaatgactgcag

SEQ ID NO: 42599 - DNA, 20 bp, Artificial Sequence
  Description of Artificial Sequence: Synthetic oligonucleotide
  Target: SCN9A; (+) strand; PAM type: NRG; PAM sequence: TAG
gaatgactgcagtagcttaa

SEQ ID NO: 42600 - DNA, 20 bp, Artificial Sequence
  Description of Artificial Sequence: Synthetic oligonucleotide
  Target: SCN9A; (+) strand; PAM type: NRG; PAM sequence: AGG
aatgactgcagtagcttaat

SEQ ID NO: 42601 - DNA, 20 bp, Artificial Sequence
  Description of Artificial Sequence: Synthetic oligonucleotide
  Target: SCN9A; (+) strand; PAM type: NRG; PAM sequence: TAG
gcagtagcttaataggccta

SEQ ID NO: 42602 - DNA, 20 bp, Artificial Sequence
  Description of Artificial Sequence: Synthetic oligonucleotide
  Target: SCN9A; (+) strand; PAM type: NRG; PAM sequence: CAG
cttaataggcctatagaaca

SEQ ID NO: 42603 - DNA, 20 bp, Artificial Sequence
  Description of Artificial Sequence: Synthetic oligonucleotide
  Target: SCN9A; (+) strand; PAM type: NRG; PAM sequence: GAG
taataggcctatagaacaca

SEQ ID NO: 42604 - DNA, 20 bp, Artificial Sequence
  Description of Artificial Sequence: Synthetic oligonucleotide
  Target: SCN9A; (+) strand; PAM type: NRG; PAM sequence: AGG
aataggcctatagaacacag

SEQ ID NO: 42605 - DNA, 20 bp, Artificial Sequence
  Description of Artificial Sequence: Synthetic oligonucleotide
  Target: SCN9A; (+) strand; PAM type: NRG; PAM sequence: GGG
ataggcctatagaacacaga

SEQ ID NO: 42606 - DNA, 20 bp, Artificial Sequence
  Description of Artificial Sequence: Synthetic oligonucleotide
  Target: SCN9A; (+) strand; PAM type: NRG; PAM sequence: AAG
catccatatattatccttca

SEQ ID NO: 42607 - DNA, 20 bp, Artificial Sequence
  Description of Artificial Sequence: Synthetic oligonucleotide
  Target: SCN9A; (+) strand; PAM type: NRG; PAM sequence: CAG
tatattatccttcaaagctt

SEQ ID NO: 42608 - DNA, 20 bp, Artificial Sequence
  Description of Artificial Sequence: Synthetic oligonucleotide
  Target: SCN9A; (+) strand; PAM type: NRG; PAM sequence: CGG
ttctattctctccattaatg

SEQ ID NO: 42609 - DNA, 20 bp, Artificial Sequence
  Description of Artificial Sequence: Synthetic oligonucleotide
  Target: SCN9A; (+) strand; PAM type: NRG; PAM sequence: AAG
cggtgcttcctatgctttcc

SEQ ID NO: 42610 - DNA, 20 bp, Artificial Sequence
  Description of Artificial Sequence: Synthetic oligonucleotide
  Target: SCN9A; (+) strand; PAM type: NRG; PAM sequence: TAG
ctatgctttccaagaaattt

SEQ ID NO: 42611 - DNA, 20 bp, Artificial Sequence
  Description of Artificial Sequence: Synthetic oligonucleotide
  Target: SCN9A; (+) strand; PAM type: NRG; PAM sequence: AAG
gctttccaagaaattttagt

SEQ ID NO: 42612 - DNA, 20 bp, Artificial Sequence
  Description of Artificial Sequence: Synthetic oligonucleotide
  Target: SCN9A; (+) strand; PAM type: NRG; PAM sequence: TAG
acaacattatgtgacaacat

SEQ ID NO: 42613 - DNA, 20 bp, Artificial Sequence
  Description of Artificial Sequence: Synthetic oligonucleotide
  Target: SCN9A; (+) strand; PAM type: NRG; PAM sequence: AGG
caacattatgtgacaacatt

SEQ ID NO: 42614 - DNA, 20 bp, Artificial Sequence
  Description of Artificial Sequence: Synthetic oligonucleotide
  Target: SCN9A; (+) strand; PAM type: NRG; PAM sequence: GAG
attatgtgacaacattaggt

SEQ ID NO: 42615 - DNA, 20 bp, Artificial Sequence
  Description of Artificial Sequence: Synthetic oligonucleotide
  Target: SCN9A; (+) strand; PAM type: NRG; PAM sequence: TAG
taggtgagctctatctaatg

SEQ ID NO: 42616 - DNA, 20 bp, Artificial Sequence
  Description of Artificial Sequence: Synthetic oligonucleotide
  Target: SCN9A; (+) strand; PAM type: NRG; PAM sequence: AGG
aggtgagctctatctaatgt

SEQ ID NO: 42617 - DNA, 20 bp, Artificial Sequence
  Description of Artificial Sequence: Synthetic oligonucleotide
  Target: SCN9A; (+) strand; PAM type: NRG; PAM sequence: GGG
ggtgagctctatctaatgta

SEQ ID NO: 42618 - DNA, 20 bp, Artificial Sequence
  Description of Artificial Sequence: Synthetic oligonucleotide
  Target: SCN9A; (+) strand; PAM type: NRG; PAM sequence: TGG
cgctttactgttactaattt

SEQ ID NO: 42619 - DNA, 20 bp, Artificial Sequence
  Description of Artificial Sequence: Synthetic oligonucleotide
  Target: SCN9A; (+) strand; PAM type: NRG; PAM sequence: GAG
ttgtgtatgctcttctgtct

SEQ ID NO: 42620 - DNA, 20 bp, Artificial Sequence
  Description of Artificial Sequence: Synthetic oligonucleotide
  Target: SCN9A; (+) strand; PAM type: NRG; PAM sequence: AGG
tgtgtatgctcttctgtctg

SEQ ID NO: 42621 - DNA, 20 bp, Artificial Sequence
  Description of Artificial Sequence: Synthetic oligonucleotide
  Target: SCN9A; (+) strand; PAM type: NRG; PAM sequence: GAG
tgtatgctcttctgtctgag

SEQ ID NO: 42622 - DNA, 20 bp, Artificial Sequence
  Description of Artificial Sequence: Synthetic oligonucleotide
  Target: SCN9A; (+) strand; PAM type: NRG; PAM sequence: CAG
ctgtctgaggagccacaaca

SEQ ID NO: 42623 - DNA, 20 bp, Artificial Sequence
  Description of Artificial Sequence: Synthetic oligonucleotide
  Target: SCN9A; (+) strand; PAM type: NRG; PAM sequence: AAG
gaggagccacaacacagtga

SEQ ID NO: 42624 - DNA, 20 bp, Artificial Sequence
  Description of Artificial Sequence: Synthetic oligonucleotide
  Target: SCN9A; (+) strand; PAM type: NRG; PAM sequence: AGG
aggagccacaacacagtgaa

SEQ ID NO: 42625 - DNA, 20 bp, Artificial Sequence
  Description of Artificial Sequence: Synthetic oligonucleotide
  Target: SCN9A; (+) strand; PAM type: NRG; PAM sequence: CAG
gccacaacacagtgaaagga

SEQ ID NO: 42626 - DNA, 20 bp, Artificial Sequence
  Description of Artificial Sequence: Synthetic oligonucleotide
  Target: SCN9A; (+) strand; PAM type: NRG; PAM sequence: AGG
ccacaacacagtgaaaggac

SEQ ID NO: 42627 - DNA, 20 bp, Artificial Sequence
  Description of Artificial Sequence: Synthetic oligonucleotide
  Target: SCN9A; (+) strand; PAM type: NRG; PAM sequence: GGG
cacaacacagtgaaaggaca

SEQ ID NO: 42628 - DNA, 20 bp, Artificial Sequence
  Description of Artificial Sequence: Synthetic oligonucleotide
  Target: SCN9A; (+) strand; PAM type: NRG; PAM sequence: TAG
ggacagggtgactttgactt

SEQ ID NO: 42629 - DNA, 20 bp, Artificial Sequence
  Description of Artificial Sequence: Synthetic oligonucleotide
  Target: SCN9A; (+) strand; PAM type: NRG; PAM sequence: CAG
gtgactttgactttagactt

SEQ ID NO: 42630 - DNA, 20 bp, Artificial Sequence
  Description of Artificial Sequence: Synthetic oligonucleotide
  Target: SCN9A; (+) strand; PAM type: NRG; PAM sequence: AAG
cagccacatgtcccttgaca

SEQ ID NO: 42631 - DNA, 20 bp, Artificial Sequence
  Description of Artificial Sequence: Synthetic oligonucleotide
  Target: SCN9A; (+) strand; PAM type: NRG; PAM sequence: AAG
tcccttgacaaagaatttga

SEQ ID NO: 42632 - DNA, 20 bp, Artificial Sequence
  Description of Artificial Sequence: Synthetic oligonucleotide
  Target: SCN9A; (+) strand; PAM type: NRG; PAM sequence: AGG
cccttgacaaagaatttgaa

SEQ ID NO: 42633 - DNA, 20 bp, Artificial Sequence
  Description of Artificial Sequence: Synthetic oligonucleotide
  Target: SCN9A; (+) strand; PAM type: NRG; PAM sequence: TGG
atttgaaaggactgaaaaat

SEQ ID NO: 42634 - DNA, 20 bp, Artificial Sequence
  Description of Artificial Sequence: Synthetic oligonucleotide
  Target: SCN9A; (+) strand; PAM type: NRG; PAM sequence: GGG
tttgaaaggactgaaaaatt

SEQ ID NO: 42635 - DNA, 20 bp, Artificial Sequence
  Description of Artificial Sequence: Synthetic oligonucleotide
  Target: SCN9A; (+) strand; PAM type: NRG; PAM sequence: CAG
aaaaattgggctcattgttg

SEQ ID NO: 42636 - DNA, 20 bp, Artificial Sequence
  Description of Artificial Sequence: Synthetic oligonucleotide
  Target: SCN9A; (+) strand; PAM type: NRG; PAM sequence: GAG
attgggctcattgttgcagt

SEQ ID NO: 42637 - DNA, 20 bp, Artificial Sequence
  Description of Artificial Sequence: Synthetic oligonucleotide
  Target: SCN9A; (+) strand; PAM type: NRG; PAM sequence: AAG
gctcattgttgcagtgagcc

SEQ ID NO: 42638 - DNA, 20 bp, Artificial Sequence
  Description of Artificial Sequence: Synthetic oligonucleotide
  Target: SCN9A; (+) strand; PAM type: NRG; PAM sequence: CAG
aagatcacgccactgcactc

SEQ ID NO: 42639 - DNA, 20 bp, Artificial Sequence
  Description of Artificial Sequence: Synthetic oligonucleotide
  Target: SCN9A; (+) strand; PAM type: NRG; PAM sequence: TGG
cacgccactgcactccagcc

SEQ ID NO: 42640 - DNA, 20 bp, Artificial Sequence
  Description of Artificial Sequence: Synthetic oligonucleotide
  Target: SCN9A; (+) strand; PAM type: NRG; PAM sequence: GGG
acgccactgcactccagcct

SEQ ID NO: 42641 - DNA, 20 bp, Artificial Sequence
  Description of Artificial Sequence: Synthetic oligonucleotide
  Target: SCN9A; (+) strand; PAM type: NRG; PAM sequence: CAG
ctgcactccagcctgggcaa

SEQ ID NO: 42642 - DNA, 20 bp, Artificial Sequence
  Description of Artificial Sequence: Synthetic oligonucleotide
  Target: SCN9A; (+) strand; PAM type: NRG; PAM sequence: GAG
gcactccagcctgggcaaca

SEQ ID NO: 42643 - DNA, 20 bp, Artificial Sequence
  Description of Artificial Sequence: Synthetic oligonucleotide
  Target: SCN9A; (+) strand; PAM type: NRG; PAM sequence: AAG
tccagcctgggcaacagagc

SEQ ID NO: 42644 - DNA, 20 bp, Artificial Sequence
  Description of Artificial Sequence: Synthetic oligonucleotide
  Target: SCN9A; (+) strand; PAM type: NRG; PAM sequence: AAG
tcaaaaaaaaaaaaaaaaaa

SEQ ID NO: 42645 - DNA, 20 bp, Artificial Sequence
  Description of Artificial Sequence: Synthetic oligonucleotide
  Target: SCN9A; (+) strand; PAM type: NRG; PAM sequence: AGG
caaaaaaaaaaaaaaaaaaa

SEQ ID NO: 42646 - DNA, 20 bp, Artificial Sequence
  Description of Artificial Sequence: Synthetic oligonucleotide
  Target: SCN9A; (+) strand; PAM type: NRG; PAM sequence: GAG
aaaaaaaaaaaaggctcatt

SEQ ID NO: 42647 - DNA, 20 bp, Artificial Sequence
  Description of Artificial Sequence: Synthetic oligonucleotide
  Target: SCN9A; (+) strand; PAM type: NRG; PAM sequence: CAG
aaaatgattgctgatctcaa

SEQ ID NO: 42648 - DNA, 20 bp, Artificial Sequence
  Description of Artificial Sequence: Synthetic oligonucleotide
  Target: SCN9A; (+) strand; PAM type: NRG; PAM sequence: AGG
aaatgattgctgatctcaac

SEQ ID NO: 42649 - DNA, 20 bp, Artificial Sequence
  Description of Artificial Sequence: Synthetic oligonucleotide
  Target: SCN9A; (+) strand; PAM type: NRG; PAM sequence: AAG
tgctgatctcaacaggtcta

SEQ ID NO: 42650 - DNA, 20 bp, Artificial Sequence
  Description of Artificial Sequence: Synthetic oligonucleotide
  Target: SCN9A; (+) strand; PAM type: NRG; PAM sequence: TAG
tctcaacaggtctaaagtgt

SEQ ID NO: 42651 - DNA, 20 bp, Artificial Sequence
  Description of Artificial Sequence: Synthetic oligonucleotide
  Target: SCN9A; (+) strand; PAM type: NRG; PAM sequence: CAG
agtgttagaactttctcttt

SEQ ID NO: 42652 - DNA, 20 bp, Artificial Sequence
  Description of Artificial Sequence: Synthetic oligonucleotide
  Target: SCN9A; (+) strand; PAM type: NRG; PAM sequence: TGG
cgaaacactattaaccctgt

SEQ ID NO: 42653 - DNA, 20 bp, Artificial Sequence
  Description of Artificial Sequence: Synthetic oligonucleotide
  Target: SCN9A; (+) strand; PAM type: NRG; PAM sequence: AAG
aaccctgttggataaaatga

SEQ ID NO: 42654 - DNA, 20 bp, Artificial Sequence
  Description of Artificial Sequence: Synthetic oligonucleotide
  Target: SCN9A; (+) strand; PAM type: NRG; PAM sequence: AAG
gttggataaaatgaaagtca

SEQ ID NO: 42655 - DNA, 20 bp, Artificial Sequence
  Description of Artificial Sequence: Synthetic oligonucleotide
  Target: SCN9A; (+) strand; PAM type: NRG; PAM sequence: TGG
tcaaagacctgtatccttcg

SEQ ID NO: 42656 - DNA, 20 bp, Artificial Sequence
  Description of Artificial Sequence: Synthetic oligonucleotide
  Target: SCN9A; (+) strand; PAM type: NRG; PAM sequence: CAG
ttatatttattacctgtcta

SEQ ID NO: 42657 - DNA, 20 bp, Artificial Sequence
  Description of Artificial Sequence: Synthetic oligonucleotide
  Target: SCN9A; (+) strand; PAM type: NRG; PAM sequence: CAG
agtcatgaacttgtgccatt

SEQ ID NO: 42658 - DNA, 20 bp, Artificial Sequence
  Description of Artificial Sequence: Synthetic oligonucleotide
  Target: SCN9A; (+) strand; PAM type: NRG; PAM sequence: TAG
caatactctaaaattatcct

SEQ ID NO: 42659 - DNA, 20 bp, Artificial Sequence
  Description of Artificial Sequence: Synthetic oligonucleotide
  Target: SCN9A; (+) strand; PAM type: NRG; PAM sequence: CAG
tactctaaaattatccttag

SEQ ID NO: 42660 - DNA, 20 bp, Artificial Sequence
  Description of Artificial Sequence: Synthetic oligonucleotide
  Target: SCN9A; (+) strand; PAM type: NRG; PAM sequence: TGG
aaaattatccttagcagttt

SEQ ID NO: 42661 - DNA, 20 bp, Artificial Sequence
  Description of Artificial Sequence: Synthetic oligonucleotide
  Target: SCN9A; (+) strand; PAM type: NRG; PAM sequence: GGG
aaattatccttagcagtttt

SEQ ID NO: 42662 - DNA, 20 bp, Artificial Sequence
  Description of Artificial Sequence: Synthetic oligonucleotide
  Target: SCN9A; (+) strand; PAM type: NRG; PAM sequence: TGG
tagcagttttgggaaactgt

SEQ ID NO: 42663 - DNA, 20 bp, Artificial Sequence
  Description of Artificial Sequence: Synthetic oligonucleotide
  Target: SCN9A; (+) strand; PAM type: NRG; PAM sequence: AAG
aactgttggtatcaatattg

SEQ ID NO: 42664 - DNA, 20 bp, Artificial Sequence
  Description of Artificial Sequence: Synthetic oligonucleotide
  Target: SCN9A; (+) strand; PAM type: NRG; PAM sequence: AAG
ttggtatcaatattgaagaa

SEQ ID NO: 42665 - DNA, 20 bp, Artificial Sequence
  Description of Artificial Sequence: Synthetic oligonucleotide
  Target: SCN9A; (+) strand; PAM type: NRG; PAM sequence: GAG
ggtatcaatattgaagaaaa

SEQ ID NO: 42666 - DNA, 20 bp, Artificial Sequence
  Description of Artificial Sequence: Synthetic oligonucleotide
  Target: SCN9A; (+) strand; PAM type: NRG; PAM sequence: AAG
caatattgaagaaaagagac

SEQ ID NO: 42667 - DNA, 20 bp, Artificial Sequence
  Description of Artificial Sequence: Synthetic oligonucleotide
  Target: SCN9A; (+) strand; PAM type: NRG; PAM sequence: TGG
attgaagaaaagagacaagt

SEQ ID NO: 42668 - DNA, 20 bp, Artificial Sequence
  Description of Artificial Sequence: Synthetic oligonucleotide
  Target: SCN9A; (+) strand; PAM type: NRG; PAM sequence: GGG
ttgaagaaaagagacaagtt

SEQ ID NO: 42669 - DNA, 20 bp, Artificial Sequence
  Description of Artificial Sequence: Synthetic oligonucleotide
  Target: SCN9A; (+) strand; PAM type: NRG; PAM sequence: GGG
tgaagaaaagagacaagttg

SEQ ID NO: 42670 - DNA, 20 bp, Artificial Sequence
  Description of Artificial Sequence: Synthetic oligonucleotide
  Target: SCN9A; (+) strand; PAM type: NRG; PAM sequence: CAG
agaaaagagacaagttgggg

SEQ ID NO: 42671 - DNA, 20 bp, Artificial Sequence
  Description of Artificial Sequence: Synthetic oligonucleotide
  Target: SCN9A; (+) strand; PAM type: NRG; PAM sequence: AAG
aagagacaagttggggcaga

SEQ ID NO: 42672 - DNA, 20 bp, Artificial Sequence
  Description of Artificial Sequence: Synthetic oligonucleotide
  Target: SCN9A; (+) strand; PAM type: NRG; PAM sequence: TGG
gttggggcagaaagactgaa

SEQ ID NO: 42673 - DNA, 20 bp, Artificial Sequence
  Description of Artificial Sequence: Synthetic oligonucleotide
  Target: SCN9A; (+) strand; PAM type: NRG; PAM sequence: AAG
aaagactgaatggacctact

SEQ ID NO: 42674 - DNA, 20 bp, Artificial Sequence
  Description of Artificial Sequence: Synthetic oligonucleotide
  Target: SCN9A; (+) strand; PAM type: NRG; PAM sequence: AAG
tggacctactaagatgcaaa

SEQ ID NO: 42675 - DNA, 20 bp, Artificial Sequence
  Description of Artificial Sequence: Synthetic oligonucleotide
  Target: SCN9A; (+) strand; PAM type: NRG; PAM sequence: AAG
acctactaagatgcaaaaag

SEQ ID NO: 42676 - DNA, 20 bp, Artificial Sequence
  Description of Artificial Sequence: Synthetic oligonucleotide
  Target: SCN9A; (+) strand; PAM type: NRG; PAM sequence: AGG
cctactaagatgcaaaaaga

SEQ ID NO: 42677 - DNA, 20 bp, Artificial Sequence
  Description of Artificial Sequence: Synthetic oligonucleotide
  Target: SCN9A; (+) strand; PAM type: NRG; PAM sequence: CAG
aagatgcaaaaagaaggtcc

SEQ ID NO: 42678 - DNA, 20 bp, Artificial Sequence
  Description of Artificial Sequence: Synthetic oligonucleotide
  Target: SCN9A; (+) strand; PAM type: NRG; PAM sequence: CAG
atgcaaaaagaaggtcccag

SEQ ID NO: 42679 - DNA, 20 bp, Artificial Sequence
  Description of Artificial Sequence: Synthetic oligonucleotide
  Target: SCN9A; (+) strand; PAM type: NRG; PAM sequence: TGG
aaaaagaaggtcccagcagt

SEQ ID NO: 42680 - DNA, 20 bp, Artificial Sequence
  Description of Artificial Sequence: Synthetic oligonucleotide
  Target: SCN9A; (+) strand; PAM type: NRG; PAM sequence: CAG
aagaaggtcccagcagttgg

SEQ ID NO: 42681 - DNA, 20 bp, Artificial Sequence
  Description of Artificial Sequence: Synthetic oligonucleotide
  Target: SCN9A; (+) strand; PAM type: NRG; PAM sequence: GAG
gaaggtcccagcagttggca

SEQ ID NO: 42682 - DNA, 20 bp, Artificial Sequence
  Description of Artificial Sequence: Synthetic oligonucleotide
  Target: SCN9A; (+) strand; PAM type: NRG; PAM sequence: AGG
aaggtcccagcagttggcag

SEQ ID NO: 42683 - DNA, 20 bp, Artificial Sequence
  Description of Artificial Sequence: Synthetic oligonucleotide
  Target: SCN9A; (+) strand; PAM type: NRG; PAM sequence: TGG
gcagaggttctgaaattcaa

SEQ ID NO: 42684 - DNA, 20 bp, Artificial Sequence
  Description of Artificial Sequence: Synthetic oligonucleotide
  Target: SCN9A; (+) strand; PAM type: NRG; PAM sequence: AAG
tctgaaattcaatggaattg

SEQ ID NO: 42685 - DNA, 20 bp, Artificial Sequence
  Description of Artificial Sequence: Synthetic oligonucleotide
  Target: SCN9A; (+) strand; PAM type: NRG; PAM sequence: CAG
aattcaatggaattgaagtg

SEQ ID NO: 42686 - DNA, 20 bp, Artificial Sequence
  Description of Artificial Sequence: Synthetic oligonucleotide
  Target: SCN9A; (+) strand; PAM type: NRG; PAM sequence: GAG
ttcaatggaattgaagtgca

SEQ ID NO: 42687 - DNA, 20 bp, Artificial Sequence
  Description of Artificial Sequence: Synthetic oligonucleotide
  Target: SCN9A; (+) strand; PAM type: NRG; PAM sequence: AGG
tcaatggaattgaagtgcag

SEQ ID NO: 42688 - DNA, 20 bp, Artificial Sequence
  Description of Artificial Sequence: Synthetic oligonucleotide
  Target: SCN9A; (+) strand; PAM type: NRG; PAM sequence: GGG
caatggaattgaagtgcaga

SEQ ID NO: 42689 - DNA, 20 bp, Artificial Sequence
  Description of Artificial Sequence: Synthetic oligonucleotide
  Target: SCN9A; (+) strand; PAM type: NRG; PAM sequence: GAG
atggaattgaagtgcagagg

SEQ ID NO: 42690 - DNA, 20 bp, Artificial Sequence
  Description of Artificial Sequence: Synthetic oligonucleotide
  Target: SCN9A; (+) strand; PAM type: NRG; PAM sequence: AGG
tggaattgaagtgcagaggg

SEQ ID NO: 42691 - DNA, 20 bp, Artificial Sequence
  Description of Artificial Sequence: Synthetic oligonucleotide
  Target: SCN9A; (+) strand; PAM type: NRG; PAM sequence: TAG
gaagtgcagagggaggcttc

SEQ ID NO: 42692 - DNA, 20 bp, Artificial Sequence
  Description of Artificial Sequence: Synthetic oligonucleotide
  Target: SCN9A; (+) strand; PAM type: NRG; PAM sequence: CAG
agagggaggcttctagccct

SEQ ID NO: 42693 - DNA, 20 bp, Artificial Sequence
  Description of Artificial Sequence: Synthetic oligonucleotide
  Target: SCN9A; (+) strand; PAM type: NRG; PAM sequence: AGG
gagggaggcttctagccctc

SEQ ID NO: 42694 - DNA, 20 bp, Artificial Sequence
  Description of Artificial Sequence: Synthetic oligonucleotide
  Target: SCN9A; (+) strand; PAM type: NRG; PAM sequence: TGG
tccactccacccccaaattc

SEQ ID NO: 42695 - DNA, 20 bp, Artificial Sequence
  Description of Artificial Sequence: Synthetic oligonucleotide
  Target: SCN9A; (+) strand; PAM type: NRG; PAM sequence: GAG
cactccacccccaaattctg

SEQ ID NO: 42696 - DNA, 20 bp, Artificial Sequence
  Description of Artificial Sequence: Synthetic oligonucleotide
  Target: SCN9A; (+) strand; PAM type: NRG; PAM sequence: AGG
actccacccccaaattctgg

SEQ ID NO: 42697 - DNA, 20 bp, Artificial Sequence
  Description of Artificial Sequence: Synthetic oligonucleotide
  Target: SCN9A; (+) strand; PAM type: NRG; PAM sequence: CAG
cccccaaattctggaggaat

SEQ ID NO: 42698 - DNA, 20 bp, Artificial Sequence
  Description of Artificial Sequence: Synthetic oligonucleotide
  Target: SCN9A; (+) strand; PAM type: NRG; PAM sequence: AGG
ccccaaattctggaggaatc

SEQ ID NO: 42699 - DNA, 20 bp, Artificial Sequence
  Description of Artificial Sequence: Synthetic oligonucleotide
  Target: SCN9A; (+) strand; PAM type: NRG; PAM sequence: AAG
aaattctggaggaatcaggc

SEQ ID NO: 42700 - DNA, 20 bp, Artificial Sequence
  Description of Artificial Sequence: Synthetic oligonucleotide
  Target: SCN9A; (+) strand; PAM type: NRG; PAM sequence: TGG
agccatctaaaccgaaacta

SEQ ID NO: 42701 - DNA, 20 bp, Artificial Sequence
  Description of Artificial Sequence: Synthetic oligonucleotide
  Target: SCN9A; (+) strand; PAM type: NRG; PAM sequence: CAG
ccgaaactatggcaatgact

SEQ ID NO: 42702 - DNA, 20 bp, Artificial Sequence
  Description of Artificial Sequence: Synthetic oligonucleotide
  Target: SCN9A; (+) strand; PAM type: NRG; PAM sequence: AAG
gactcagtccttgaaataca

SEQ ID NO: 42703 - DNA, 20 bp, Artificial Sequence
  Description of Artificial Sequence: Synthetic oligonucleotide
  Target: SCN9A; (+) strand; PAM type: NRG; PAM sequence: AAG
agtccttgaaatacaaagac

SEQ ID NO: 42704 - DNA, 20 bp, Artificial Sequence
  Description of Artificial Sequence: Synthetic oligonucleotide
  Target: SCN9A; (+) strand; PAM type: NRG; PAM sequence: AGG
gtccttgaaatacaaagaca

SEQ ID NO: 42705 - DNA, 20 bp, Artificial Sequence
  Description of Artificial Sequence: Synthetic oligonucleotide
  Target: SCN9A; (+) strand; PAM type: NRG; PAM sequence: AAG
cttgaaatacaaagacaagg

SEQ ID NO: 42706 - DNA, 20 bp, Artificial Sequence
  Description of Artificial Sequence: Synthetic oligonucleotide
  Target: SCN9A; (+) strand; PAM type: NRG; PAM sequence: AGG
ttgaaatacaaagacaagga

SEQ ID NO: 42707 - DNA, 20 bp, Artificial Sequence
  Description of Artificial Sequence: Synthetic oligonucleotide
  Target: SCN9A; (+) strand; PAM type: NRG; PAM sequence: GGG
tgaaatacaaagacaaggaa

SEQ ID NO: 42708 - DNA, 20 bp, Artificial Sequence
  Description of Artificial Sequence: Synthetic oligonucleotide
  Target: SCN9A; (+) strand; PAM type: NRG; PAM sequence: GGG
gaaatacaaagacaaggaag

SEQ ID NO: 42709 - DNA, 20 bp, Artificial Sequence
  Description of Artificial Sequence: Synthetic oligonucleotide
  Target: SCN9A; (+) strand; PAM type: NRG; PAM sequence: TAG
acaaagacaaggaaggggct

SEQ ID NO: 42710 - DNA, 20 bp, Artificial Sequence
  Description of Artificial Sequence: Synthetic oligonucleotide
  Target: SCN9A; (+) strand; PAM type: NRG; PAM sequence: AAG
caaggaaggggcttagtcac

SEQ ID NO: 42711 - DNA, 20 bp, Artificial Sequence
  Description of Artificial Sequence: Synthetic oligonucleotide
  Target: SCN9A; (+) strand; PAM type: NRG; PAM sequence: AGG
aaggaaggggcttagtcaca

SEQ ID NO: 42712 - DNA, 20 bp, Artificial Sequence
  Description of Artificial Sequence: Synthetic oligonucleotide
  Target: SCN9A; (+) strand; PAM type: NRG; PAM sequence: AAG
gcttagtcacaaggaaaacg

SEQ ID NO: 42713 - DNA, 20 bp, Artificial Sequence
  Description of Artificial Sequence: Synthetic oligonucleotide
  Target: SCN9A; (+) strand; PAM type: NRG; PAM sequence: TAG
aggaaaacgaagcctgtttc

SEQ ID NO: 42714 - DNA, 20 bp, Artificial Sequence
  Description of Artificial Sequence: Synthetic oligonucleotide
  Target: SCN9A; (+) strand; PAM type: NRG; PAM sequence: TGG
acgaagcctgtttctagaac

SEQ ID NO: 42715 - DNA, 20 bp, Artificial Sequence
  Description of Artificial Sequence: Synthetic oligonucleotide
  Target: SCN9A; (+) strand; PAM type: NRG; PAM sequence: CAG
ctgtttctagaactggtgta

SEQ ID NO: 42716 - DNA, 20 bp, Artificial Sequence
  Description of Artificial Sequence: Synthetic oligonucleotide
  Target: SCN9A; (+) strand; PAM type: NRG; PAM sequence: AGG
tgtttctagaactggtgtac

SEQ ID NO: 42717 - DNA, 20 bp, Artificial Sequence
  Description of Artificial Sequence: Synthetic oligonucleotide
  Target: SCN9A; (+) strand; PAM type: NRG; PAM sequence: GGG
gtttctagaactggtgtaca

SEQ ID NO: 42718 - DNA, 20 bp, Artificial Sequence
  Description of Artificial Sequence: Synthetic oligonucleotide
  Target: SCN9A; (+) strand; PAM type: NRG; PAM sequence: CAG
ctagaactggtgtacagggt

SEQ ID NO: 42719 - DNA, 20 bp, Artificial Sequence
  Description of Artificial Sequence: Synthetic oligonucleotide
  Target: SCN9A; (+) strand; PAM type: NRG; PAM sequence: GAG
agaactggtgtacagggtca

SEQ ID NO: 42720 - DNA, 20 bp, Artificial Sequence
  Description of Artificial Sequence: Synthetic oligonucleotide
  Target: SCN9A; (+) strand; PAM type: NRG; PAM sequence: CAG
actggtgtacagggtcagag

SEQ ID NO: 42721 - DNA, 20 bp, Artificial Sequence
  Description of Artificial Sequence: Synthetic oligonucleotide
  Target: SCN9A; (+) strand; PAM type: NRG; PAM sequence: GAG
tggtgtacagggtcagagca

SEQ ID NO: 42722 - DNA, 20 bp, Artificial Sequence
  Description of Artificial Sequence: Synthetic oligonucleotide
  Target: SCN9A; (+) strand; PAM type: NRG; PAM sequence: CAG
acagggtcagagcagagccg

SEQ ID NO: 42723 - DNA, 20 bp, Artificial Sequence
  Description of Artificial Sequence: Synthetic oligonucleotide
  Target: SCN9A; (+) strand; PAM type: NRG; PAM sequence: AGG
cagggtcagagcagagccgc

SEQ ID NO: 42724 - DNA, 20 bp, Artificial Sequence
  Description of Artificial Sequence: Synthetic oligonucleotide
  Target: SCN9A; (+) strand; PAM type: NRG; PAM sequence: AAG
ggtcagagcagagccgcagg

SEQ ID NO: 42725 - DNA, 20 bp, Artificial Sequence
  Description of Artificial Sequence: Synthetic oligonucleotide
  Target: SCN9A; (+) strand; PAM type: NRG; PAM sequence: GAG
ccgcaggaagtcttgatgat

SEQ ID NO: 42726 - DNA, 20 bp, Artificial Sequence
  Description of Artificial Sequence: Synthetic oligonucleotide
  Target: SCN9A; (+) strand; PAM type: NRG; PAM sequence: TGG
gatgagaacctctctctgac

SEQ ID NO: 42727 - DNA, 20 bp, Artificial Sequence
  Description of Artificial Sequence: Synthetic oligonucleotide
  Target: SCN9A; (+) strand; PAM type: NRG; PAM sequence: CAG
aacctctctctgactggtcc

SEQ ID NO: 42728 - DNA, 20 bp, Artificial Sequence
  Description of Artificial Sequence: Synthetic oligonucleotide
  Target: SCN9A; (+) strand; PAM type: NRG; PAM sequence: GAG
cctctctctgactggtccca

SEQ ID NO: 42729 - DNA, 20 bp, Artificial Sequence
  Description of Artificial Sequence: Synthetic oligonucleotide
  Target: SCN9A; (+) strand; PAM type: NRG; PAM sequence: CAG
ctctctgactggtcccagag

SEQ ID NO: 42730 - DNA, 20 bp, Artificial Sequence
  Description of Artificial Sequence: Synthetic oligonucleotide
  Target: SCN9A; (+) strand; PAM type: NRG; PAM sequence: AGG
tctctgactggtcccagagc

SEQ ID NO: 42731 - DNA, 20 bp, Artificial Sequence
  Description of Artificial Sequence: Synthetic oligonucleotide
  Target: SCN9A; (+) strand; PAM type: NRG; PAM sequence: TAG
actggtcccagagcaggaat

SEQ ID NO: 42732 - DNA, 20 bp, Artificial Sequence
  Description of Artificial Sequence: Synthetic oligonucleotide
  Target: SCN9A; (+) strand; PAM type: NRG; PAM sequence: CAG
ccagagcaggaattagaatt

SEQ ID NO: 42733 - DNA, 20 bp, Artificial Sequence
  Description of Artificial Sequence: Synthetic oligonucleotide
  Target: SCN9A; (+) strand; PAM type: NRG; PAM sequence: CAG
aggaattagaattcagccca

SEQ ID NO: 42734 - DNA, 20 bp, Artificial Sequence
  Description of Artificial Sequence: Synthetic oligonucleotide
  Target: SCN9A; (+) strand; PAM type: NRG; PAM sequence: AGG
ggaattagaattcagcccac

SEQ ID NO: 42735 - DNA, 20 bp, Artificial Sequence
  Description of Artificial Sequence: Synthetic oligonucleotide
  Target: SCN9A; (+) strand; PAM type: NRG; PAM sequence: GGG
gaattagaattcagcccaca

SEQ ID NO: 42736 - DNA, 20 bp, Artificial Sequence
  Description of Artificial Sequence: Synthetic oligonucleotide
  Target: SCN9A; (+) strand; PAM type: NRG; PAM sequence: GGG
aattagaattcagcccacag

SEQ ID NO: 42737 - DNA, 20 bp, Artificial Sequence
  Description of Artificial Sequence: Synthetic oligonucleotide
  Target: SCN9A; (+) strand; PAM type: NRG; PAM sequence: TAG
aattcagcccacaggggttc

SEQ ID NO: 42738 - DNA, 20 bp, Artificial Sequence
  Description of Artificial Sequence: Synthetic oligonucleotide
  Target: SCN9A; (+) strand; PAM type: NRG; PAM sequence: CAG
cccacaggggttctagcttc

SEQ ID NO: 42739 - DNA, 20 bp, Artificial Sequence
  Description of Artificial Sequence: Synthetic oligonucleotide
  Target: SCN9A; (+) strand; PAM type: NRG; PAM sequence: TGG
agcttccagaaccaattttg

SEQ ID NO: 42740 - DNA, 20 bp, Artificial Sequence
  Description of Artificial Sequence: Synthetic oligonucleotide
  Target: SCN9A; (+) strand; PAM type: NRG; PAM sequence: TAG
cagaaccaattttgtggatg

SEQ ID NO: 42741 - DNA, 20 bp, Artificial Sequence
  Description of Artificial Sequence: Synthetic oligonucleotide
  Target: SCN9A; (+) strand; PAM type: NRG; PAM sequence: AGG
agaaccaattttgtggatgt

SEQ ID NO: 42742 - DNA, 20 bp, Artificial Sequence
  Description of Artificial Sequence: Synthetic oligonucleotide
  Target: SCN9A; (+) strand; PAM type: NRG; PAM sequence: GAG
aaccaattttgtggatgtag

SEQ ID NO: 42743 - DNA, 20 bp, Artificial Sequence
  Description of Artificial Sequence: Synthetic oligonucleotide
  Target: SCN9A; (+) strand; PAM type: NRG; PAM sequence: AAG
aattttgtggatgtaggagc

SEQ ID NO: 42744 - DNA, 20 bp, Artificial Sequence
  Description of Artificial Sequence: Synthetic oligonucleotide
  Target: SCN9A; (+) strand; PAM type: NRG; PAM sequence: AGG
attttgtggatgtaggagca

SEQ ID NO: 42745 - DNA, 20 bp, Artificial Sequence
  Description of Artificial Sequence: Synthetic oligonucleotide
  Target: SCN9A; (+) strand; PAM type: NRG; PAM sequence: GAG
tttgtggatgtaggagcaag

SEQ ID NO: 42746 - DNA, 20 bp, Artificial Sequence
  Description of Artificial Sequence: Synthetic oligonucleotide
  Target: SCN9A; (+) strand; PAM type: NRG; PAM sequence: AGG
ttgtggatgtaggagcaagg

SEQ ID NO: 42747 - DNA, 20 bp, Artificial Sequence
  Description of Artificial Sequence: Synthetic oligonucleotide
  Target: SCN9A; (+) strand; PAM type: NRG; PAM sequence: AAG
ggatgtaggagcaaggaggc

SEQ ID NO: 42748 - DNA, 20 bp, Artificial Sequence
  Description of Artificial Sequence: Synthetic oligonucleotide
  Target: SCN9A; (+) strand; PAM type: NRG; PAM sequence: GAG
aggcaagaatgaccttatgt

SEQ ID NO: 42749 - DNA, 20 bp, Artificial Sequence
  Description of Artificial Sequence: Synthetic oligonucleotide
  Target: SCN9A; (+) strand; PAM type: NRG; PAM sequence: TAG
tatgtgagctctatctgatt

SEQ ID NO: 42750 - DNA, 20 bp, Artificial Sequence
  Description of Artificial Sequence: Synthetic oligonucleotide
  Target: SCN9A; (+) strand; PAM type: NRG; PAM sequence: AGG
atgtgagctctatctgattt

SEQ ID NO: 42751 - DNA, 20 bp, Artificial Sequence
  Description of Artificial Sequence: Synthetic oligonucleotide
  Target: SCN9A; (+) strand; PAM type: NRG; PAM sequence: CAG
cgctttactgttactaaatt

SEQ ID NO: 42752 - DNA, 20 bp, Artificial Sequence
  Description of Artificial Sequence: Synthetic oligonucleotide
  Target: SCN9A; (+) strand; PAM type: NRG; PAM sequence: GAG
ttgtgtatactcttctttct

SEQ ID NO: 42753 - DNA, 20 bp, Artificial Sequence
  Description of Artificial Sequence: Synthetic oligonucleotide
  Target: SCN9A; (+) strand; PAM type: NRG; PAM sequence: AGG
tgtgtatactcttctttctg

SEQ ID NO: 42754 - DNA, 20 bp, Artificial Sequence
  Description of Artificial Sequence: Synthetic oligonucleotide
  Target: SCN9A; (+) strand; PAM type: NRG; PAM sequence: GAG
tgtatactcttctttctgag

SEQ ID NO: 42755 - DNA, 20 bp, Artificial Sequence
  Description of Artificial Sequence: Synthetic oligonucleotide
  Target: SCN9A; (+) strand; PAM type: NRG; PAM sequence: CAG
ctttctgaggagccacaaca

SEQ ID NO: 42756 - DNA, 20 bp, Artificial Sequence
  Description of Artificial Sequence: Synthetic oligonucleotide
  Target: SCN9A; (+) strand; PAM type: NRG; PAM sequence: AAG
aggagccacaacacagtgaa

SEQ ID NO: 42757 - DNA, 20 bp, Artificial Sequence
  Description of Artificial Sequence: Synthetic oligonucleotide
  Target: SCN9A; (+) strand; PAM type: NRG; PAM sequence: TGG
cacaacacagtgaaaagata

SEQ ID NO: 42758 - DNA, 20 bp, Artificial Sequence
  Description of Artificial Sequence: Synthetic oligonucleotide
  Target: SCN9A; (+) strand; PAM type: NRG; PAM sequence: TAG
agatatggtgactttgattt

SEQ ID NO: 42759 - DNA, 20 bp, Artificial Sequence
  Description of Artificial Sequence: Synthetic oligonucleotide
  Target: SCN9A; (+) strand; PAM type: NRG; PAM sequence: CAG
tttgattttagatgtcaatt

SEQ ID NO: 42760 - DNA, 20 bp, Artificial Sequence
  Description of Artificial Sequence: Synthetic oligonucleotide
  Target: SCN9A; (+) strand; PAM type: NRG; PAM sequence: TAG
tttagatgtcaattcagtga

SEQ ID NO: 42761 - DNA, 20 bp, Artificial Sequence
  Description of Artificial Sequence: Synthetic oligonucleotide
  Target: SCN9A; (+) strand; PAM type: NRG; PAM sequence: TAG
gtgatagctctgtcatttac

SEQ ID NO: 42762 - DNA, 20 bp, Artificial Sequence
  Description of Artificial Sequence: Synthetic oligonucleotide
  Target: SCN9A; (+) strand; PAM type: NRG; PAM sequence: TGG
gctctgtcatttactagctt

SEQ ID NO: 42763 - DNA, 20 bp, Artificial Sequence
  Description of Artificial Sequence: Synthetic oligonucleotide
  Target: SCN9A; (+) strand; PAM type: NRG; PAM sequence: GGG
ctctgtcatttactagcttt

SEQ ID NO: 42764 - DNA, 20 bp, Artificial Sequence
  Description of Artificial Sequence: Synthetic oligonucleotide
  Target: SCN9A; (+) strand; PAM type: NRG; PAM sequence: AAG
tttactagctttgggacatt

SEQ ID NO: 42765 - DNA, 20 bp, Artificial Sequence
  Description of Artificial Sequence: Synthetic oligonucleotide
  Target: SCN9A; (+) strand; PAM type: NRG; PAM sequence: CAG
gcaacttttaaaactgtacc

SEQ ID NO: 42766 - DNA, 20 bp, Artificial Sequence
  Description of Artificial Sequence: Synthetic oligonucleotide
  Target: SCN9A; (+) strand; PAM type: NRG; PAM sequence: TGG
actgtacccagcttcatcat

SEQ ID NO: 42767 - DNA, 20 bp, Artificial Sequence
  Description of Artificial Sequence: Synthetic oligonucleotide
  Target: SCN9A; (+) strand; PAM type: NRG; PAM sequence: AAG
agcttcatcattggtaaaat

SEQ ID NO: 42768 - DNA, 20 bp, Artificial Sequence
  Description of Artificial Sequence: Synthetic oligonucleotide
  Target: SCN9A; (+) strand; PAM type: NRG; PAM sequence: CAG
agcaaaatatcataatctca

SEQ ID NO: 42769 - DNA, 20 bp, Artificial Sequence
  Description of Artificial Sequence: Synthetic oligonucleotide
  Target: SCN9A; (+) strand; PAM type: NRG; PAM sequence: AGG
gcaaaatatcataatctcac

SEQ ID NO: 42770 - DNA, 20 bp, Artificial Sequence
  Description of Artificial Sequence: Synthetic oligonucleotide
  Target: SCN9A; (+) strand; PAM type: NRG; PAM sequence: GGG
caaaatatcataatctcaca

SEQ ID NO: 42771 - DNA, 20 bp, Artificial Sequence
  Description of Artificial Sequence: Synthetic oligonucleotide
  Target: SCN9A; (+) strand; PAM type: NRG; PAM sequence: GAG
gggttgtttgaaaattaaat

SEQ ID NO: 42772 - DNA, 20 bp, Artificial Sequence
  Description of Artificial Sequence: Synthetic oligonucleotide
  Target: SCN9A; (+) strand; PAM type: NRG; PAM sequence: AAG
aattaaatgagaaaatctaa

SEQ ID NO: 42773 - DNA, 20 bp, Artificial Sequence
  Description of Artificial Sequence: Synthetic oligonucleotide
  Target: SCN9A; (+) strand; PAM type: NRG; PAM sequence: AAG
taaatgagaaaatctaaaag

SEQ ID NO: 42774 - DNA, 20 bp, Artificial Sequence
  Description of Artificial Sequence: Synthetic oligonucleotide
  Target: SCN9A; (+) strand; PAM type: NRG; PAM sequence: AAG
agaagattctgaaacacaat

SEQ ID NO: 42775 - DNA, 20 bp, Artificial Sequence
  Description of Artificial Sequence: Synthetic oligonucleotide
  Target: SCN9A; (+) strand; PAM type: NRG; PAM sequence: AAG
ttctgaaacacaataagtat

SEQ ID NO: 42776 - DNA, 20 bp, Artificial Sequence
  Description of Artificial Sequence: Synthetic oligonucleotide
  Target: SCN9A; (+) strand; PAM type: NRG; PAM sequence: GAG
acaataagtataagctaaat

SEQ ID NO: 42777 - DNA, 20 bp, Artificial Sequence
  Description of Artificial Sequence: Synthetic oligonucleotide
  Target: SCN9A; (+) strand; PAM type: NRG; PAM sequence: GAG
aataagtataagctaaatga

SEQ ID NO: 42778 - DNA, 20 bp, Artificial Sequence
  Description of Artificial Sequence: Synthetic oligonucleotide
  Target: SCN9A; (+) strand; PAM type: NRG; PAM sequence: TAG
cttctttttaacttttattt

SEQ ID NO: 42779 - DNA, 20 bp, Artificial Sequence
  Description of Artificial Sequence: Synthetic oligonucleotide
  Target: SCN9A; (+) strand; PAM type: NRG; PAM sequence: AGG
ttctttttaacttttatttt

SEQ ID NO: 42780 - DNA, 20 bp, Artificial Sequence
  Description of Artificial Sequence: Synthetic oligonucleotide
  Target: SCN9A; (+) strand; PAM type: NRG; PAM sequence: GAG
ttaacttttattttaggttt

SEQ ID NO: 42781 - DNA, 20 bp, Artificial Sequence
  Description of Artificial Sequence: Synthetic oligonucleotide
  Target: SCN9A; (+) strand; PAM type: NRG; PAM sequence: AGG
taacttttattttaggtttg

SEQ ID NO: 42782 - DNA, 20 bp, Artificial Sequence
  Description of Artificial Sequence: Synthetic oligonucleotide
  Target: SCN9A; (+) strand; PAM type: NRG; PAM sequence: GGG
aacttttattttaggtttga

SEQ ID NO: 42783 - DNA, 20 bp, Artificial Sequence
  Description of Artificial Sequence: Synthetic oligonucleotide
  Target: SCN9A; (+) strand; PAM type: NRG; PAM sequence: AAG
taggtttgagggtacatgtg

SEQ ID NO: 42784 - DNA, 20 bp, Artificial Sequence
  Description of Artificial Sequence: Synthetic oligonucleotide
  Target: SCN9A; (+) strand; PAM type: NRG; PAM sequence: AGG
aggtttgagggtacatgtga

SEQ ID NO: 42785 - DNA, 20 bp, Artificial Sequence
  Description of Artificial Sequence: Synthetic oligonucleotide
  Target: SCN9A; (+) strand; PAM type: NRG; PAM sequence: TAG
acatgtgaaggtttgttaca

SEQ ID NO: 42786 - DNA, 20 bp, Artificial Sequence
  Description of Artificial Sequence: Synthetic oligonucleotide
  Target: SCN9A; (+) strand; PAM type: NRG; PAM sequence: AGG
catgtgaaggtttgttacat

SEQ ID NO: 42787 - DNA, 20 bp, Artificial Sequence
  Description of Artificial Sequence: Synthetic oligonucleotide
  Target: SCN9A; (+) strand; PAM type: NRG; PAM sequence: TGG
acataggtaaacacgtgtca

SEQ ID NO: 42788 - DNA, 20 bp, Artificial Sequence
  Description of Artificial Sequence: Synthetic oligonucleotide
  Target: SCN9A; (+) strand; PAM type: NRG; PAM sequence: GGG
cataggtaaacacgtgtcat

SEQ ID NO: 42789 - DNA, 20 bp, Artificial Sequence
  Description of Artificial Sequence: Synthetic oligonucleotide
  Target: SCN9A; (+) strand; PAM type: NRG; PAM sequence: GGG
ataggtaaacacgtgtcatg

SEQ ID NO: 42790 - DNA, 20 bp, Artificial Sequence
  Description of Artificial Sequence: Synthetic oligonucleotide
  Target: SCN9A; (+) strand; PAM type: NRG; PAM sequence: GGG
taggtaaacacgtgtcatgg

SEQ ID NO: 42791 - DNA, 20 bp, Artificial Sequence
  Description of Artificial Sequence: Synthetic oligonucleotide
  Target: SCN9A; (+) strand; PAM type: NRG; PAM sequence: TAG
tgctatacttttaaaaaatc

SEQ ID NO: 42792 - DNA, 20 bp, Artificial Sequence
  Description of Artificial Sequence: Synthetic oligonucleotide
  Target: SCN9A; (+) strand; PAM type: NRG; PAM sequence: TGG
tttaaaaaatctagtttaat

SEQ ID NO: 42793 - DNA, 20 bp, Artificial Sequence
  Description of Artificial Sequence: Synthetic oligonucleotide
  Target: SCN9A; (+) strand; PAM type: NRG; PAM sequence: AAG
gtttaattggcaacctgtct

SEQ ID NO: 42794 - DNA, 20 bp, Artificial Sequence
  Description of Artificial Sequence: Synthetic oligonucleotide
  Target: SCN9A; (+) strand; PAM type: NRG; PAM sequence: CAG
acctgtctaagtacaaacac

SEQ ID NO: 42795 - DNA, 20 bp, Artificial Sequence
  Description of Artificial Sequence: Synthetic oligonucleotide
  Target: SCN9A; (+) strand; PAM type: NRG; PAM sequence: GAG
tttatttaaaatacactttt

SEQ ID NO: 42796 - DNA, 20 bp, Artificial Sequence
  Description of Artificial Sequence: Synthetic oligonucleotide
  Target: SCN9A; (+) strand; PAM type: NRG; PAM sequence: TAG
ccaaatgtcttcctctgttt

SEQ ID NO: 42797 - DNA, 20 bp, Artificial Sequence
  Description of Artificial Sequence: Synthetic oligonucleotide
  Target: SCN9A; (+) strand; PAM type: NRG; PAM sequence: AAG
ctgttttagacattttgaac

SEQ ID NO: 42798 - DNA, 20 bp, Artificial Sequence
  Description of Artificial Sequence: Synthetic oligonucleotide
  Target: SCN9A; (+) strand; PAM type: NRG; PAM sequence: AGG
tgttttagacattttgaaca

SEQ ID NO: 42799 - DNA, 20 bp, Artificial Sequence
  Description of Artificial Sequence: Synthetic oligonucleotide
  Target: SCN9A; (+) strand; PAM type: NRG; PAM sequence: CAG
aatctcctctctgaaattct

SEQ ID NO: 42800 - DNA, 20 bp, Artificial Sequence
  Description of Artificial Sequence: Synthetic oligonucleotide
  Target: SCN9A; (+) strand; PAM type: NRG; PAM sequence: GAG
aaattctcagtcacatatgt

SEQ ID NO: 42801 - DNA, 20 bp, Artificial Sequence
  Description of Artificial Sequence: Synthetic oligonucleotide
  Target: SCN9A; (+) strand; PAM type: NRG; PAM sequence: CAG
tctcagtcacatatgtgagt

SEQ ID NO: 42802 - DNA, 20 bp, Artificial Sequence
  Description of Artificial Sequence: Synthetic oligonucleotide
  Target: SCN9A; (+) strand; PAM type: NRG; PAM sequence: TGG
gtcacatatgtgagtcagca

SEQ ID NO: 42803 - DNA, 20 bp, Artificial Sequence
  Description of Artificial Sequence: Synthetic oligonucleotide
  Target: SCN9A; (+) strand; PAM type: NRG; PAM sequence: GGG
tcacatatgtgagtcagcat

SEQ ID NO: 42804 - DNA, 20 bp, Artificial Sequence
  Description of Artificial Sequence: Synthetic oligonucleotide
  Target: SCN9A; (+) strand; PAM type: NRG; PAM sequence: TAG
cagcatgggataaacctcct

SEQ ID NO: 42805 - DNA, 20 bp, Artificial Sequence
  Description of Artificial Sequence: Synthetic oligonucleotide
  Target: SCN9A; (+) strand; PAM type: NRG; PAM sequence: TAG
ggataaacctccttagttac

SEQ ID NO: 42806 - DNA, 20 bp, Artificial Sequence
  Description of Artificial Sequence: Synthetic oligonucleotide
  Target: SCN9A; (+) strand; PAM type: NRG; PAM sequence: AGG
gataaacctccttagttact

SEQ ID NO: 42807 - DNA, 20 bp, Artificial Sequence
  Description of Artificial Sequence: Synthetic oligonucleotide
  Target: SCN9A; (+) strand; PAM type: NRG; PAM sequence: TGG
gttactaggaatacattgca

SEQ ID NO: 42808 - DNA, 20 bp, Artificial Sequence
  Description of Artificial Sequence: Synthetic oligonucleotide
  Target: SCN9A; (+) strand; PAM type: NRG; PAM sequence: TAG
actaggaatacattgcatgg

SEQ ID NO: 42809 - DNA, 20 bp, Artificial Sequence
  Description of Artificial Sequence: Synthetic oligonucleotide
  Target: SCN9A; (+) strand; PAM type: NRG; PAM sequence: TGG
acactatcatgatttctact

SEQ ID NO: 42810 - DNA, 20 bp, Artificial Sequence
  Description of Artificial Sequence: Synthetic oligonucleotide
  Target: SCN9A; (+) strand; PAM type: NRG; PAM sequence: CAG
gatttctacttggatgactc

SEQ ID NO: 42811 - DNA, 20 bp, Artificial Sequence
  Description of Artificial Sequence: Synthetic oligonucleotide
  Target: SCN9A; (+) strand; PAM type: NRG; PAM sequence: AGG
atttctacttggatgactcc

SEQ ID NO: 42812 - DNA, 20 bp, Artificial Sequence
  Description of Artificial Sequence: Synthetic oligonucleotide
  Target: SCN9A; (+) strand; PAM type: NRG; PAM sequence: AAG
ctacttggatgactccaggt

SEQ ID NO: 42813 - DNA, 20 bp, Artificial Sequence
  Description of Artificial Sequence: Synthetic oligonucleotide
  Target: SCN9A; (+) strand; PAM type: NRG; PAM sequence: AGG
tacttggatgactccaggta

SEQ ID NO: 42814 - DNA, 20 bp, Artificial Sequence
  Description of Artificial Sequence: Synthetic oligonucleotide
  Target: SCN9A; (+) strand; PAM type: NRG; PAM sequence: TAG
atgactccaggtaaggaaaa

SEQ ID NO: 42815 - DNA, 20 bp, Artificial Sequence
  Description of Artificial Sequence: Synthetic oligonucleotide
  Target: SCN9A; (+) strand; PAM type: NRG; PAM sequence: GAG
gactccaggtaaggaaaata

SEQ ID NO: 42816 - DNA, 20 bp, Artificial Sequence
  Description of Artificial Sequence: Synthetic oligonucleotide
  Target: SCN9A; (+) strand; PAM type: NRG; PAM sequence: GAG
tgatcacattttctgtttct

SEQ ID NO: 42817 - DNA, 20 bp, Artificial Sequence
  Description of Artificial Sequence: Synthetic oligonucleotide
  Target: SCN9A; (+) strand; PAM type: NRG; PAM sequence: GAG
atcacattttctgtttctga

SEQ ID NO: 42818 - DNA, 20 bp, Artificial Sequence
  Description of Artificial Sequence: Synthetic oligonucleotide
  Target: SCN9A; (+) strand; PAM type: NRG; PAM sequence: GAG
attttctgtttctgagagtt

SEQ ID NO: 42819 - DNA, 20 bp, Artificial Sequence
  Description of Artificial Sequence: Synthetic oligonucleotide
  Target: SCN9A; (+) strand; PAM type: NRG; PAM sequence: TAG
ttctgagagttgagacttga

SEQ ID NO: 42820 - DNA, 20 bp, Artificial Sequence
  Description of Artificial Sequence: Synthetic oligonucleotide
  Target: SCN9A; (+) strand; PAM type: NRG; PAM sequence: AGG
tctgagagttgagacttgat

SEQ ID NO: 42821 - DNA, 20 bp, Artificial Sequence
  Description of Artificial Sequence: Synthetic oligonucleotide
  Target: SCN9A; (+) strand; PAM type: NRG; PAM sequence: AAG
agagttgagacttgatagga

SEQ ID NO: 42822 - DNA, 20 bp, Artificial Sequence
  Description of Artificial Sequence: Synthetic oligonucleotide
  Target: SCN9A; (+) strand; PAM type: NRG; PAM sequence: AGG
gagttgagacttgataggaa

SEQ ID NO: 42823 - DNA, 20 bp, Artificial Sequence
  Description of Artificial Sequence: Synthetic oligonucleotide
  Target: SCN9A; (+) strand; PAM type: NRG; PAM sequence: AAG
tgagacttgataggaaagga

SEQ ID NO: 42824 - DNA, 20 bp, Artificial Sequence
  Description of Artificial Sequence: Synthetic oligonucleotide
  Target: SCN9A; (+) strand; PAM type: NRG; PAM sequence: CAG
ttgataggaaaggaaagcca

SEQ ID NO: 42825 - DNA, 20 bp, Artificial Sequence
  Description of Artificial Sequence: Synthetic oligonucleotide
  Target: SCN9A; (+) strand; PAM type: NRG; PAM sequence: TGG
ataggaaaggaaagccacag

SEQ ID NO: 42826 - DNA, 20 bp, Artificial Sequence
  Description of Artificial Sequence: Synthetic oligonucleotide
  Target: SCN9A; (+) strand; PAM type: NRG; PAM sequence: GGG
taggaaaggaaagccacagt

SEQ ID NO: 42827 - DNA, 20 bp, Artificial Sequence
  Description of Artificial Sequence: Synthetic oligonucleotide
  Target: SCN9A; (+) strand; PAM type: NRG; PAM sequence: CAG
aaagccacagtgggtccctg

SEQ ID NO: 42828 - DNA, 20 bp, Artificial Sequence
  Description of Artificial Sequence: Synthetic oligonucleotide
  Target: SCN9A; (+) strand; PAM type: NRG; PAM sequence: AGG
aagccacagtgggtccctgc

SEQ ID NO: 42829 - DNA, 20 bp, Artificial Sequence
  Description of Artificial Sequence: Synthetic oligonucleotide
  Target: SCN9A; (+) strand; PAM type: NRG; PAM sequence: TGG
agtgggtccctgcaggttgt

SEQ ID NO: 42830 - DNA, 20 bp, Artificial Sequence
  Description of Artificial Sequence: Synthetic oligonucleotide
  Target: SCN9A; (+) strand; PAM type: NRG; PAM sequence: GGG
gtgggtccctgcaggttgtt

SEQ ID NO: 42831 - DNA, 20 bp, Artificial Sequence
  Description of Artificial Sequence: Synthetic oligonucleotide
  Target: SCN9A; (+) strand; PAM type: NRG; PAM sequence: GGG
tgggtccctgcaggttgttg

SEQ ID NO: 42832 - DNA, 20 bp, Artificial Sequence
  Description of Artificial Sequence: Synthetic oligonucleotide
  Target: SCN9A; (+) strand; PAM type: NRG; PAM sequence: GAG
ggtccctgcaggttgttggg

SEQ ID NO: 42833 - DNA, 20 bp, Artificial Sequence
  Description of Artificial Sequence: Synthetic oligonucleotide
  Target: SCN9A; (+) strand; PAM type: NRG; PAM sequence: AAG
aggttgttggggagtgtgcc

SEQ ID NO: 42834 - DNA, 20 bp, Artificial Sequence
  Description of Artificial Sequence: Synthetic oligonucleotide
  Target: SCN9A; (+) strand; PAM type: NRG; PAM sequence: CAG
ggggagtgtgccaagaatgc

SEQ ID NO: 42835 - DNA, 20 bp, Artificial Sequence
  Description of Artificial Sequence: Synthetic oligonucleotide
  Target: SCN9A; (+) strand; PAM type: NRG; PAM sequence: AGG
gggagtgtgccaagaatgcc

SEQ ID NO: 42836 - DNA, 20 bp, Artificial Sequence
  Description of Artificial Sequence: Synthetic oligonucleotide
  Target: SCN9A; (+) strand; PAM type: NRG; PAM sequence: TAG
ggctctgcctgctccttacc

SEQ ID NO: 42837 - DNA, 20 bp, Artificial Sequence
  Description of Artificial Sequence: Synthetic oligonucleotide
  Target: SCN9A; (+) strand; PAM type: NRG; PAM sequence: AGG
gctctgcctgctccttacct

SEQ ID NO: 42838 - DNA, 20 bp, Artificial Sequence
  Description of Artificial Sequence: Synthetic oligonucleotide
  Target: SCN9A; (+) strand; PAM type: NRG; PAM sequence: CAG
tccttacctaggacattcct

SEQ ID NO: 42839 - DNA, 20 bp, Artificial Sequence
  Description of Artificial Sequence: Synthetic oligonucleotide
  Target: SCN9A; (+) strand; PAM type: NRG; PAM sequence: AGG
ccttacctaggacattcctc

SEQ ID NO: 42840 - DNA, 20 bp, Artificial Sequence
  Description of Artificial Sequence: Synthetic oligonucleotide
  Target: SCN9A; (+) strand; PAM type: NRG; PAM sequence: GGG
cttacctaggacattcctca

SEQ ID NO: 42841 - DNA, 20 bp, Artificial Sequence
  Description of Artificial Sequence: Synthetic oligonucleotide
  Target: SCN9A; (+) strand; PAM type: NRG; PAM sequence: CAG
attcctcagggttgtgtttg

SEQ ID NO: 42842 - DNA, 20 bp, Artificial Sequence
  Description of Artificial Sequence: Synthetic oligonucleotide
  Target: SCN9A; (+) strand; PAM type: NRG; PAM sequence: GAG
ctcagggttgtgtttgcagt

SEQ ID NO: 42843 - DNA, 20 bp, Artificial Sequence
  Description of Artificial Sequence: Synthetic oligonucleotide
  Target: SCN9A; (+) strand; PAM type: NRG; PAM sequence: GAG
tgtttgcagtgagcaacctt

SEQ ID NO: 42844 - DNA, 20 bp, Artificial Sequence
  Description of Artificial Sequence: Synthetic oligonucleotide
  Target: SCN9A; (+) strand; PAM type: NRG; PAM sequence: GAG
agtgagcaaccttgagacat

SEQ ID NO: 42845 - DNA, 20 bp, Artificial Sequence
  Description of Artificial Sequence: Synthetic oligonucleotide
  Target: SCN9A; (+) strand; PAM type: NRG; PAM sequence: AGG
gtgagcaaccttgagacatg

SEQ ID NO: 42846 - DNA, 20 bp, Artificial Sequence
  Description of Artificial Sequence: Synthetic oligonucleotide
  Target: SCN9A; (+) strand; PAM type: NRG; PAM sequence: TAG
agcaaccttgagacatgagg

SEQ ID NO: 42847 - DNA, 20 bp, Artificial Sequence
  Description of Artificial Sequence: Synthetic oligonucleotide
  Target: SCN9A; (+) strand; PAM type: NRG; PAM sequence: AGG
gcaaccttgagacatgaggt

SEQ ID NO: 42848 - DNA, 20 bp, Artificial Sequence
  Description of Artificial Sequence: Synthetic oligonucleotide
  Target: SCN9A; (+) strand; PAM type: NRG; PAM sequence: GGG
caaccttgagacatgaggta

SEQ ID NO: 42849 - DNA, 20 bp, Artificial Sequence
  Description of Artificial Sequence: Synthetic oligonucleotide
  Target: SCN9A; (+) strand; PAM type: NRG; PAM sequence: TGG
gagacatgaggtagggtctc

SEQ ID NO: 42850 - DNA, 20 bp, Artificial Sequence
  Description of Artificial Sequence: Synthetic oligonucleotide
  Target: SCN9A; (+) strand; PAM type: NRG; PAM sequence: GGG
agacatgaggtagggtctct

SEQ ID NO: 42851 - DNA, 20 bp, Artificial Sequence
  Description of Artificial Sequence: Synthetic oligonucleotide
  Target: SCN9A; (+) strand; PAM type: NRG; PAM sequence: AAG
gaggtagggtctctgggaca

SEQ ID NO: 42852 - DNA, 20 bp, Artificial Sequence
  Description of Artificial Sequence: Synthetic oligonucleotide
  Target: SCN9A; (+) strand; PAM type: NRG; PAM sequence: GAG
ggtagggtctctgggacaaa

SEQ ID NO: 42853 - DNA, 20 bp, Artificial Sequence
  Description of Artificial Sequence: Synthetic oligonucleotide
  Target: SCN9A; (+) strand; PAM type: NRG; PAM sequence: CAG
agggtctctgggacaaagag

SEQ ID NO: 42854 - DNA, 20 bp, Artificial Sequence
  Description of Artificial Sequence: Synthetic oligonucleotide
  Target: SCN9A; (+) strand; PAM type: NRG; PAM sequence: AGG
gggtctctgggacaaagagc

SEQ ID NO: 42855 - DNA, 20 bp, Artificial Sequence
  Description of Artificial Sequence: Synthetic oligonucleotide
  Target: SCN9A; (+) strand; PAM type: NRG; PAM sequence: GGG
ggtctctgggacaaagagca

SEQ ID NO: 42856 - DNA, 20 bp, Artificial Sequence
  Description of Artificial Sequence: Synthetic oligonucleotide
  Target: SCN9A; (+) strand; PAM type: NRG; PAM sequence: TGG
gcagggttgcttatgttgct

SEQ ID NO: 42857 - DNA, 20 bp, Artificial Sequence
  Description of Artificial Sequence: Synthetic oligonucleotide
  Target: SCN9A; (+) strand; PAM type: NRG; PAM sequence: AAG
gcttatgttgcttggtataa

SEQ ID NO: 42858 - DNA, 20 bp, Artificial Sequence
  Description of Artificial Sequence: Synthetic oligonucleotide
  Target: SCN9A; (+) strand; PAM type: NRG; PAM sequence: AGG
cttatgttgcttggtataaa

SEQ ID NO: 42859 - DNA, 20 bp, Artificial Sequence
  Description of Artificial Sequence: Synthetic oligonucleotide
  Target: SCN9A; (+) strand; PAM type: NRG; PAM sequence: AAG
tataaaaggatgcattccct

SEQ ID NO: 42860 - DNA, 20 bp, Artificial Sequence
  Description of Artificial Sequence: Synthetic oligonucleotide
  Target: SCN9A; (+) strand; PAM type: NRG; PAM sequence: CAG
aaggatgcattccctaagct

SEQ ID NO: 42861 - DNA, 20 bp, Artificial Sequence
  Description of Artificial Sequence: Synthetic oligonucleotide
  Target: SCN9A; (+) strand; PAM type: NRG; PAM sequence: CAG
tccctaagctcagtgttcct

SEQ ID NO: 42862 - DNA, 20 bp, Artificial Sequence
  Description of Artificial Sequence: Synthetic oligonucleotide
  Target: SCN9A; (+) strand; PAM type: NRG; PAM sequence: CAG
tatatgtgtacacactcatt

SEQ ID NO: 42863 - DNA, 20 bp, Artificial Sequence
  Description of Artificial Sequence: Synthetic oligonucleotide
  Target: SCN9A; (+) strand; PAM type: NRG; PAM sequence: AGG
atatgtgtacacactcattc

SEQ ID NO: 42864 - DNA, 20 bp, Artificial Sequence
  Description of Artificial Sequence: Synthetic oligonucleotide
  Target: SCN9A; (+) strand; PAM type: NRG; PAM sequence: GAG
ggctcatataatgcccccat

SEQ ID NO: 42865 - DNA, 20 bp, Artificial Sequence
  Description of Artificial Sequence: Synthetic oligonucleotide
  Target: SCN9A; (+) strand; PAM type: NRG; PAM sequence: TGG
tataatgcccccatgagacc

SEQ ID NO: 42866 - DNA, 20 bp, Artificial Sequence
  Description of Artificial Sequence: Synthetic oligonucleotide
  Target: SCN9A; (+) strand; PAM type: NRG; PAM sequence: GGG
ataatgcccccatgagacct

SEQ ID NO: 42867 - DNA, 20 bp, Artificial Sequence
  Description of Artificial Sequence: Synthetic oligonucleotide
  Target: SCN9A; (+) strand; PAM type: NRG; PAM sequence: AAG
gcccccatgagacctgggta

SEQ ID NO: 42868 - DNA, 20 bp, Artificial Sequence
  Description of Artificial Sequence: Synthetic oligonucleotide
  Target: SCN9A; (+) strand; PAM type: NRG; PAM sequence: AGG
cccccatgagacctgggtaa

SEQ ID NO: 42869 - DNA, 20 bp, Artificial Sequence
  Description of Artificial Sequence: Synthetic oligonucleotide
  Target: SCN9A; (+) strand; PAM type: NRG; PAM sequence: GGG
ccccatgagacctgggtaaa

SEQ ID NO: 42870 - DNA, 20 bp, Artificial Sequence
  Description of Artificial Sequence: Synthetic oligonucleotide
  Target: SCN9A; (+) strand; PAM type: NRG; PAM sequence: GGG
cccatgagacctgggtaaag

SEQ ID NO: 42871 - DNA, 20 bp, Artificial Sequence
  Description of Artificial Sequence: Synthetic oligonucleotide
  Target: SCN9A; (+) strand; PAM type: NRG; PAM sequence: GGG
ccatgagacctgggtaaagg

SEQ ID NO: 42872 - DNA, 20 bp, Artificial Sequence
  Description of Artificial Sequence: Synthetic oligonucleotide
  Target: SCN9A; (+) strand; PAM type: NRG; PAM sequence: CAG
ctgggtaaagggggaaccaa

SEQ ID NO: 42873 - DNA, 20 bp, Artificial Sequence
  Description of Artificial Sequence: Synthetic oligonucleotide
  Target: SCN9A; (+) strand; PAM type: NRG; PAM sequence: AAG
tcatgctactttccacacat

SEQ ID NO: 42874 - DNA, 20 bp, Artificial Sequence
  Description of Artificial Sequence: Synthetic oligonucleotide
  Target: SCN9A; (+) strand; PAM type: NRG; PAM sequence: AAG
ctttccacacataagtaaca

SEQ ID NO: 42875 - DNA, 20 bp, Artificial Sequence
  Description of Artificial Sequence: Synthetic oligonucleotide
  Target: SCN9A; (+) strand; PAM type: NRG; PAM sequence: AAG
aagtcctttatctctgaccc

SEQ ID NO: 42876 - DNA, 20 bp, Artificial Sequence
  Description of Artificial Sequence: Synthetic oligonucleotide
  Target: SCN9A; (+) strand; PAM type: NRG; PAM sequence: CAG
aagcacctcatatcttctgc

SEQ ID NO: 42877 - DNA, 20 bp, Artificial Sequence
  Description of Artificial Sequence: Synthetic oligonucleotide
  Target: SCN9A; (+) strand; PAM type: NRG; PAM sequence: CAG
ttctgccagcatccatgaaa

SEQ ID NO: 42878 - DNA, 20 bp, Artificial Sequence
  Description of Artificial Sequence: Synthetic oligonucleotide
  Target: SCN9A; (+) strand; PAM type: NRG; PAM sequence: CAG
cagcatccatgaaacagtat

SEQ ID NO: 42879 - DNA, 20 bp, Artificial Sequence
  Description of Artificial Sequence: Synthetic oligonucleotide
  Target: SCN9A; (+) strand; PAM type: NRG; PAM sequence: TAG
acagtatcagatcaacctat

SEQ ID NO: 42880 - DNA, 20 bp, Artificial Sequence
  Description of Artificial Sequence: Synthetic oligonucleotide
  Target: SCN9A; (+) strand; PAM type: NRG; PAM sequence: AAG
agatcaacctattagcatat

SEQ ID NO: 42881 - DNA, 20 bp, Artificial Sequence
  Description of Artificial Sequence: Synthetic oligonucleotide
  Target: SCN9A; (+) strand; PAM type: NRG; PAM sequence: CAG
aacctattagcatataagta

SEQ ID NO: 42882 - DNA, 20 bp, Artificial Sequence
  Description of Artificial Sequence: Synthetic oligonucleotide
  Target: SCN9A; (+) strand; PAM type: NRG; PAM sequence: AAG
atataagtacagtaaaatca

SEQ ID NO: 42883 - DNA, 20 bp, Artificial Sequence
  Description of Artificial Sequence: Synthetic oligonucleotide
  Target: SCN9A; (+) strand; PAM type: NRG; PAM sequence: AAG
aatcaaagtccaaactcatg

SEQ ID NO: 42884 - DNA, 20 bp, Artificial Sequence
  Description of Artificial Sequence: Synthetic oligonucleotide
  Target: SCN9A; (+) strand; PAM type: NRG; PAM sequence: GAG
aactcatgaagactgtctat

SEQ ID NO: 42885 - DNA, 20 bp, Artificial Sequence
  Description of Artificial Sequence: Synthetic oligonucleotide
  Target: SCN9A; (+) strand; PAM type: NRG; PAM sequence: AGG
actcatgaagactgtctatg

SEQ ID NO: 42886 - DNA, 20 bp, Artificial Sequence
  Description of Artificial Sequence: Synthetic oligonucleotide
  Target: SCN9A; (+) strand; PAM type: NRG; PAM sequence: AAG
atgaagactgtctatgaggc

SEQ ID NO: 42887 - DNA, 20 bp, Artificial Sequence
  Description of Artificial Sequence: Synthetic oligonucleotide
  Target: SCN9A; (+) strand; PAM type: NRG; PAM sequence: AAG
tgtctatgaggcaagttaca

SEQ ID NO: 42888 - DNA, 20 bp, Artificial Sequence
  Description of Artificial Sequence: Synthetic oligonucleotide
  Target: SCN9A; (+) strand; PAM type: NRG; PAM sequence: GAG
aggcaagttacaaagttctt

SEQ ID NO: 42889 - DNA, 20 bp, Artificial Sequence
  Description of Artificial Sequence: Synthetic oligonucleotide
  Target: SCN9A; (+) strand; PAM type: NRG; PAM sequence: TAG
gttcttgagtattctatttt

SEQ ID NO: 42890 - DNA, 20 bp, Artificial Sequence
  Description of Artificial Sequence: Synthetic oligonucleotide
  Target: SCN9A; (+) strand; PAM type: NRG; PAM sequence: CAG
ttttagtataatgaaacttc

SEQ ID NO: 42891 - DNA, 20 bp, Artificial Sequence
  Description of Artificial Sequence: Synthetic oligonucleotide
  Target: SCN9A; (+) strand; PAM type: NRG; PAM sequence: TGG
tagtataatgaaacttccag

SEQ ID NO: 42892 - DNA, 20 bp, Artificial Sequence
  Description of Artificial Sequence: Synthetic oligonucleotide
  Target: SCN9A; (+) strand; PAM type: NRG; PAM sequence: TAG
gaaacttccagtggtatatc

SEQ ID NO: 42893 - DNA, 20 bp, Artificial Sequence
  Description of Artificial Sequence: Synthetic oligonucleotide
  Target: SCN9A; (+) strand; PAM type: NRG; PAM sequence: TAG
cttccagtggtatatctagc

SEQ ID NO: 42894 - DNA, 20 bp, Artificial Sequence
  Description of Artificial Sequence: Synthetic oligonucleotide
  Target: SCN9A; (+) strand; PAM type: NRG; PAM sequence: TGG
gtggtatatctagctagatc

SEQ ID NO: 42895 - DNA, 20 bp, Artificial Sequence
  Description of Artificial Sequence: Synthetic oligonucleotide
  Target: SCN9A; (+) strand; PAM type: NRG; PAM sequence: GGG
tggtatatctagctagatct

SEQ ID NO: 42896 - DNA, 20 bp, Artificial Sequence
  Description of Artificial Sequence: Synthetic oligonucleotide
  Target: SCN9A; (+) strand; PAM type: NRG; PAM sequence: TGG
agctagatctgggctcctaa

SEQ ID NO: 42897 - DNA, 20 bp, Artificial Sequence
  Description of Artificial Sequence: Synthetic oligonucleotide
  Target: SCN9A; (+) strand; PAM type: NRG; PAM sequence: TGG
gggctcctaatggcttctaa

SEQ ID NO: 42898 - DNA, 20 bp, Artificial Sequence
  Description of Artificial Sequence: Synthetic oligonucleotide
  Target: SCN9A; (+) strand; PAM type: NRG; PAM sequence: CAG
ttctaatggctcatctctgt

SEQ ID NO: 42899 - DNA, 20 bp, Artificial Sequence
  Description of Artificial Sequence: Synthetic oligonucleotide
  Target: SCN9A; (+) strand; PAM type: NRG; PAM sequence: CAG
tggctcatctctgtcagcgt

SEQ ID NO: 42900 - DNA, 20 bp, Artificial Sequence
  Description of Artificial Sequence: Synthetic oligonucleotide
  Target: SCN9A; (+) strand; PAM type: NRG; PAM sequence: CAG
ctcatctctgtcagcgtcag

SEQ ID NO: 42901 - DNA, 20 bp, Artificial Sequence
  Description of Artificial Sequence: Synthetic oligonucleotide
  Target: SCN9A; (+) strand; PAM type: NRG; PAM sequence: AGG
tcatctctgtcagcgtcagc

SEQ ID NO: 42902 - DNA, 20 bp, Artificial Sequence
  Description of Artificial Sequence: Synthetic oligonucleotide
  Target: SCN9A; (+) strand; PAM type: NRG; PAM sequence: AAG
cagcaggaaaaatgacaatt

SEQ ID NO: 42903 - DNA, 20 bp, Artificial Sequence
  Description of Artificial Sequence: Synthetic oligonucleotide
  Target: SCN9A; (+) strand; PAM type: NRG; PAM sequence: AAG
gaaaaatgacaattaagaaa

SEQ ID NO: 42904 - DNA, 20 bp, Artificial Sequence
  Description of Artificial Sequence: Synthetic oligonucleotide
  Target: SCN9A; (+) strand; PAM type: NRG; PAM sequence: AGG
aaaaatgacaattaagaaaa

SEQ ID NO: 42905 - DNA, 20 bp, Artificial Sequence
  Description of Artificial Sequence: Synthetic oligonucleotide
  Target: SCN9A; (+) strand; PAM type: NRG; PAM sequence: CAG
tgacaattaagaaaaaggtt

SEQ ID NO: 42906 - DNA, 20 bp, Artificial Sequence
  Description of Artificial Sequence: Synthetic oligonucleotide
  Target: SCN9A; (+) strand; PAM type: NRG; PAM sequence: AGG
gacaattaagaaaaaggttc

SEQ ID NO: 42907 - DNA, 20 bp, Artificial Sequence
  Description of Artificial Sequence: Synthetic oligonucleotide
  Target: SCN9A; (+) strand; PAM type: NRG; PAM sequence: TAG
aattaagaaaaaggttcagg

SEQ ID NO: 42908 - DNA, 20 bp, Artificial Sequence
  Description of Artificial Sequence: Synthetic oligonucleotide
  Target: SCN9A; (+) strand; PAM type: NRG; PAM sequence: TAG
caggtagcttgtaattctac

SEQ ID NO: 42909 - DNA, 20 bp, Artificial Sequence
  Description of Artificial Sequence: Synthetic oligonucleotide
  Target: SCN9A; (+) strand; PAM type: NRG; PAM sequence: TGG
tagatctctttcaactctca

SEQ ID NO: 42910 - DNA, 20 bp, Artificial Sequence
  Description of Artificial Sequence: Synthetic oligonucleotide
  Target: SCN9A; (+) strand; PAM type: NRG; PAM sequence: AAG
atctctttcaactctcatgg

SEQ ID NO: 42911 - DNA, 20 bp, Artificial Sequence
  Description of Artificial Sequence: Synthetic oligonucleotide
  Target: SCN9A; (+) strand; PAM type: NRG; PAM sequence: AAG
gaagctgcttgtatgtgtac

SEQ ID NO: 42912 - DNA, 20 bp, Artificial Sequence
  Description of Artificial Sequence: Synthetic oligonucleotide
  Target: SCN9A; (+) strand; PAM type: NRG; PAM sequence: GAG
gcttgtatgtgtacaagaat

SEQ ID NO: 42913 - DNA, 20 bp, Artificial Sequence
  Description of Artificial Sequence: Synthetic oligonucleotide
  Target: SCN9A; (+) strand; PAM type: NRG; PAM sequence: AAG
tttccctttttataacacac

SEQ ID NO: 42914 - DNA, 20 bp, Artificial Sequence
  Description of Artificial Sequence: Synthetic oligonucleotide
  Target: SCN9A; (+) strand; PAM type: NRG; PAM sequence: AAG
taacacacaagatgcttcac

SEQ ID NO: 42915 - DNA, 20 bp, Artificial Sequence
  Description of Artificial Sequence: Synthetic oligonucleotide
  Target: SCN9A; (+) strand; PAM type: NRG; PAM sequence: TAG
aagctgaccttgctttctca

SEQ ID NO: 42916 - DNA, 20 bp, Artificial Sequence
  Description of Artificial Sequence: Synthetic oligonucleotide
  Target: SCN9A; (+) strand; PAM type: NRG; PAM sequence: TGG
ttgctttctcatagtatctc

SEQ ID NO: 42917 - DNA, 20 bp, Artificial Sequence
  Description of Artificial Sequence: Synthetic oligonucleotide
  Target: SCN9A; (+) strand; PAM type: NRG; PAM sequence: CAG
tcttcttcccaccacacttg

SEQ ID NO: 42918 - DNA, 20 bp, Artificial Sequence
  Description of Artificial Sequence: Synthetic oligonucleotide
  Target: SCN9A; (+) strand; PAM type: NRG; PAM sequence: CAG
ttcccaccacacttgcagtt

SEQ ID NO: 42919 - DNA, 20 bp, Artificial Sequence
  Description of Artificial Sequence: Synthetic oligonucleotide
  Target: SCN9A; (+) strand; PAM type: NRG; PAM sequence: CAG
ccaccacacttgcagttcag

SEQ ID NO: 42920 - DNA, 20 bp, Artificial Sequence
  Description of Artificial Sequence: Synthetic oligonucleotide
  Target: SCN9A; (+) strand; PAM type: NRG; PAM sequence: CAG
gattgtatacttgttcccct

SEQ ID NO: 42921 - DNA, 20 bp, Artificial Sequence
  Description of Artificial Sequence: Synthetic oligonucleotide
  Target: SCN9A; (+) strand; PAM type: NRG; PAM sequence: TAG
ctcagcctgccttgcctaac

SEQ ID NO: 42922 - DNA, 20 bp, Artificial Sequence
  Description of Artificial Sequence: Synthetic oligonucleotide
  Target: SCN9A; (+) strand; PAM type: NRG; PAM sequence: TAG
aaaattcctgttcgtctttc

SEQ ID NO: 42923 - DNA, 20 bp, Artificial Sequence
  Description of Artificial Sequence: Synthetic oligonucleotide
  Target: SCN9A; (+) strand; PAM type: NRG; PAM sequence: AAG
tcgtctttctagaccctgaa

SEQ ID NO: 42924 - DNA, 20 bp, Artificial Sequence
  Description of Artificial Sequence: Synthetic oligonucleotide
  Target: SCN9A; (+) strand; PAM type: NRG; PAM sequence: AAG
atttacgtttctgaaattgc

SEQ ID NO: 42925 - DNA, 20 bp, Artificial Sequence
  Description of Artificial Sequence: Synthetic oligonucleotide
  Target: SCN9A; (+) strand; PAM type: NRG; PAM sequence: CAG
tacgtttctgaaattgcaag

SEQ ID NO: 42926 - DNA, 20 bp, Artificial Sequence
  Description of Artificial Sequence: Synthetic oligonucleotide
  Target: SCN9A; (+) strand; PAM type: NRG; PAM sequence: CAG
agcagttgttctccttgcta

SEQ ID NO: 42927 - DNA, 20 bp, Artificial Sequence
  Description of Artificial Sequence: Synthetic oligonucleotide
  Target: SCN9A; (+) strand; PAM type: NRG; PAM sequence: AAG
ctttgcttacaaacacatcc

SEQ ID NO: 42928 - DNA, 20 bp, Artificial Sequence
  Description of Artificial Sequence: Synthetic oligonucleotide
  Target: SCN9A; (+) strand; PAM type: NRG; PAM sequence: CAG
acaaacacatccaagctcta

SEQ ID NO: 42929 - DNA, 20 bp, Artificial Sequence
  Description of Artificial Sequence: Synthetic oligonucleotide
  Target: SCN9A; (+) strand; PAM type: NRG; PAM sequence: GAG
cttctcttctccattgctct

SEQ ID NO: 42930 - DNA, 20 bp, Artificial Sequence
  Description of Artificial Sequence: Synthetic oligonucleotide
  Target: SCN9A; (+) strand; PAM type: NRG; PAM sequence: AAG
tccattgctctgagctcctt

SEQ ID NO: 42931 - DNA, 20 bp, Artificial Sequence
  Description of Artificial Sequence: Synthetic oligonucleotide
  Target: SCN9A; (+) strand; PAM type: NRG; PAM sequence: CAG
ctgagctccttaagaataaa

SEQ ID NO: 42932 - DNA, 20 bp, Artificial Sequence
  Description of Artificial Sequence: Synthetic oligonucleotide
  Target: SCN9A; (+) strand; PAM type: NRG; PAM sequence: TGG
ccttaagaataaacagtacc

SEQ ID NO: 42933 - DNA, 20 bp, Artificial Sequence
  Description of Artificial Sequence: Synthetic oligonucleotide
  Target: SCN9A; (+) strand; PAM type: NRG; PAM sequence: AAG
tatttatctttgcattgtga

SEQ ID NO: 42934 - DNA, 20 bp, Artificial Sequence
  Description of Artificial Sequence: Synthetic oligonucleotide
  Target: SCN9A; (+) strand; PAM type: NRG; PAM sequence: TGG
tgaaagttgatcatacaaat

SEQ ID NO: 42935 - DNA, 20 bp, Artificial Sequence
  Description of Artificial Sequence: Synthetic oligonucleotide
  Target: SCN9A; (+) strand; PAM type: NRG; PAM sequence: GGG
gaaagttgatcatacaaatt

SEQ ID NO: 42936 - DNA, 20 bp, Artificial Sequence
  Description of Artificial Sequence: Synthetic oligonucleotide
  Target: SCN9A; (+) strand; PAM type: NRG; PAM sequence: TAG
agttgatcatacaaattggg

SEQ ID NO: 42937 - DNA, 20 bp, Artificial Sequence
  Description of Artificial Sequence: Synthetic oligonucleotide
  Target: SCN9A; (+) strand; PAM type: NRG; PAM sequence: CAG
ttcttgtcctactcaactaa

SEQ ID NO: 42938 - DNA, 20 bp, Artificial Sequence
  Description of Artificial Sequence: Synthetic oligonucleotide
  Target: SCN9A; (+) strand; PAM type: NRG; PAM sequence: AAG
tactcaactaacagtcaact

SEQ ID NO: 42939 - DNA, 20 bp, Artificial Sequence
  Description of Artificial Sequence: Synthetic oligonucleotide
  Target: SCN9A; (+) strand; PAM type: NRG; PAM sequence: GAG
ctcaactaacagtcaactaa

SEQ ID NO: 42940 - DNA, 20 bp, Artificial Sequence
  Description of Artificial Sequence: Synthetic oligonucleotide
  Target: SCN9A; (+) strand; PAM type: NRG; PAM sequence: AAG
ctaacagtcaactaagagtc

SEQ ID NO: 42941 - DNA, 20 bp, Artificial Sequence
  Description of Artificial Sequence: Synthetic oligonucleotide
  Target: SCN9A; (+) strand; PAM type: NRG; PAM sequence: AAG
acagtcaactaagagtcaag

SEQ ID NO: 42942 - DNA, 20 bp, Artificial Sequence
  Description of Artificial Sequence: Synthetic oligonucleotide
  Target: SCN9A; (+) strand; PAM type: NRG; PAM sequence: AGG
cagtcaactaagagtcaaga

SEQ ID NO: 42943 - DNA, 20 bp, Artificial Sequence
  Description of Artificial Sequence: Synthetic oligonucleotide
  Target: SCN9A; (+) strand; PAM type: NRG; PAM sequence: CAG
tcaactaagagtcaagaagg

SEQ ID NO: 42944 - DNA, 20 bp, Artificial Sequence
  Description of Artificial Sequence: Synthetic oligonucleotide
  Target: SCN9A; (+) strand; PAM type: NRG; PAM sequence: AGG
caactaagagtcaagaaggc

SEQ ID NO: 42945 - DNA, 20 bp, Artificial Sequence
  Description of Artificial Sequence: Synthetic oligonucleotide
  Target: SCN9A; (+) strand; PAM type: NRG; PAM sequence: GGG
aactaagagtcaagaaggca

SEQ ID NO: 42946 - DNA, 20 bp, Artificial Sequence
  Description of Artificial Sequence: Synthetic oligonucleotide
  Target: SCN9A; (+) strand; PAM type: NRG; PAM sequence: GGG
actaagagtcaagaaggcag

SEQ ID NO: 42947 - DNA, 20 bp, Artificial Sequence
  Description of Artificial Sequence: Synthetic oligonucleotide
  Target: SCN9A; (+) strand; PAM type: NRG; PAM sequence: GGG
ctaagagtcaagaaggcagg

SEQ ID NO: 42948 - DNA, 20 bp, Artificial Sequence
  Description of Artificial Sequence: Synthetic oligonucleotide
  Target: SCN9A; (+) strand; PAM type: NRG; PAM sequence: AAG
agtcaagaaggcagggggaa

SEQ ID NO: 42949 - DNA, 20 bp, Artificial Sequence
  Description of Artificial Sequence: Synthetic oligonucleotide
  Target: SCN9A; (+) strand; PAM type: NRG; PAM sequence: CAG
aaggcagggggaaaagctct

SEQ ID NO: 42950 - DNA, 20 bp, Artificial Sequence
  Description of Artificial Sequence: Synthetic oligonucleotide
  Target: SCN9A; (+) strand; PAM type: NRG; PAM sequence: AGG
aggcagggggaaaagctctc

SEQ ID NO: 42951 - DNA, 20 bp, Artificial Sequence
  Description of Artificial Sequence: Synthetic oligonucleotide
  Target: SCN9A; (+) strand; PAM type: NRG; PAM sequence: GGG
ggcagggggaaaagctctca

SEQ ID NO: 42952 - DNA, 20 bp, Artificial Sequence
  Description of Artificial Sequence: Synthetic oligonucleotide
  Target: SCN9A; (+) strand; PAM type: NRG; PAM sequence: AAG
agggtacaaaacattactcc

SEQ ID NO: 42953 - DNA, 20 bp, Artificial Sequence
  Description of Artificial Sequence: Synthetic oligonucleotide
  Target: SCN9A; (+) strand; PAM type: NRG; PAM sequence: AAG
caagaattataattctctgc

SEQ ID NO: 42954 - DNA, 20 bp, Artificial Sequence
  Description of Artificial Sequence: Synthetic oligonucleotide
  Target: SCN9A; (+) strand; PAM type: NRG; PAM sequence: AAG
ctctgcaagactgactgttg

SEQ ID NO: 42955 - DNA, 20 bp, Artificial Sequence
  Description of Artificial Sequence: Synthetic oligonucleotide
  Target: SCN9A; (+) strand; PAM type: NRG; PAM sequence: TAG
tgcttgttgtaacttgaaat

SEQ ID NO: 42956 - DNA, 20 bp, Artificial Sequence
  Description of Artificial Sequence: Synthetic oligonucleotide
  Target: SCN9A; (+) strand; PAM type: NRG; PAM sequence: TAG
cttgaaattagttttatcta

SEQ ID NO: 42957 - DNA, 20 bp, Artificial Sequence
  Description of Artificial Sequence: Synthetic oligonucleotide
  Target: SCN9A; (+) strand; PAM type: NRG; PAM sequence: GAG
tagttttatctatagcttct

SEQ ID NO: 42958 - DNA, 20 bp, Artificial Sequence
  Description of Artificial Sequence: Synthetic oligonucleotide
  Target: SCN9A; (+) strand; PAM type: NRG; PAM sequence: AGG
agttttatctatagcttctg

SEQ ID NO: 42959 - DNA, 20 bp, Artificial Sequence
  Description of Artificial Sequence: Synthetic oligonucleotide
  Target: SCN9A; (+) strand; PAM type: NRG; PAM sequence: TAG
tgaggaaacctgttacactc

SEQ ID NO: 42960 - DNA, 20 bp, Artificial Sequence
  Description of Artificial Sequence: Synthetic oligonucleotide
  Target: SCN9A; (+) strand; PAM type: NRG; PAM sequence: AGG
gaggaaacctgttacactct

SEQ ID NO: 42961 - DNA, 20 bp, Artificial Sequence
  Description of Artificial Sequence: Synthetic oligonucleotide
  Target: SCN9A; (+) strand; PAM type: NRG; PAM sequence: CAG
tgccaacgactgttgctcgc

SEQ ID NO: 42962 - DNA, 20 bp, Artificial Sequence
  Description of Artificial Sequence: Synthetic oligonucleotide
  Target: SCN9A; (+) strand; PAM type: NRG; PAM sequence: TGG
aacgactgttgctcgccagt

SEQ ID NO: 42963 - DNA, 20 bp, Artificial Sequence
  Description of Artificial Sequence: Synthetic oligonucleotide
  Target: SCN9A; (+) strand; PAM type: NRG; PAM sequence: GAG
cgactgttgctcgccagttg

SEQ ID NO: 42964 - DNA, 20 bp, Artificial Sequence
  Description of Artificial Sequence: Synthetic oligonucleotide
  Target: SCN9A; (+) strand; PAM type: NRG; PAM sequence: CAG
gctcgccagttggagcttac

SEQ ID NO: 42965 - DNA, 20 bp, Artificial Sequence
  Description of Artificial Sequence: Synthetic oligonucleotide
  Target: SCN9A; (+) strand; PAM type: NRG; PAM sequence: CAG
gttggagcttaccagttccc

SEQ ID NO: 42966 - DNA, 20 bp, Artificial Sequence
  Description of Artificial Sequence: Synthetic oligonucleotide
  Target: SCN9A; (+) strand; PAM type: NRG; PAM sequence: TAG
ccagttccccagatccttac

SEQ ID NO: 42967 - DNA, 20 bp, Artificial Sequence
  Description of Artificial Sequence: Synthetic oligonucleotide
  Target: SCN9A; (+) strand; PAM type: NRG; PAM sequence: AGG
cagttccccagatccttact

SEQ ID NO: 42968 - DNA, 20 bp, Artificial Sequence
  Description of Artificial Sequence: Synthetic oligonucleotide
  Target: SCN9A; (+) strand; PAM type: NRG; PAM sequence: GGG
agttccccagatccttacta

SEQ ID NO: 42969 - DNA, 20 bp, Artificial Sequence
  Description of Artificial Sequence: Synthetic oligonucleotide
  Target: SCN9A; (+) strand; PAM type: NRG; PAM sequence: AAG
agggccaatgaactttctca

SEQ ID NO: 42970 - DNA, 20 bp, Artificial Sequence
  Description of Artificial Sequence: Synthetic oligonucleotide
  Target: SCN9A; (+) strand; PAM type: NRG; PAM sequence: GAG
ggccaatgaactttctcaaa

SEQ ID NO: 42971 - DNA, 20 bp, Artificial Sequence
  Description of Artificial Sequence: Synthetic oligonucleotide
  Target: SCN9A; (+) strand; PAM type: NRG; PAM sequence: CAG
aaccttctctctttgttcta

SEQ ID NO: 42972 - DNA, 20 bp, Artificial Sequence
  Description of Artificial Sequence: Synthetic oligonucleotide
  Target: SCN9A; (+) strand; PAM type: NRG; PAM sequence: AGG
accttctctctttgttctac

SEQ ID NO: 42973 - DNA, 20 bp, Artificial Sequence
  Description of Artificial Sequence: Synthetic oligonucleotide
  Target: SCN9A; (+) strand; PAM type: NRG; PAM sequence: GGG
ccttctctctttgttctaca

SEQ ID NO: 42974 - DNA, 20 bp, Artificial Sequence
  Description of Artificial Sequence: Synthetic oligonucleotide
  Target: SCN9A; (+) strand; PAM type: NRG; PAM sequence: AAG
ctctctttgttctacaggga

SEQ ID NO: 42975 - DNA, 20 bp, Artificial Sequence
  Description of Artificial Sequence: Synthetic oligonucleotide
  Target: SCN9A; (+) strand; PAM type: NRG; PAM sequence: CAG
ttctacagggaaagtgcttt

SEQ ID NO: 42976 - DNA, 20 bp, Artificial Sequence
  Description of Artificial Sequence: Synthetic oligonucleotide
  Target: SCN9A; (+) strand; PAM type: NRG; PAM sequence: CAG
agtgctttcagtttatgcca

SEQ ID NO: 42977 - DNA, 20 bp, Artificial Sequence
  Description of Artificial Sequence: Synthetic oligonucleotide
  Target: SCN9A; (+) strand; PAM type: NRG; PAM sequence: CAG
gttttgcaaactgatattgc

SEQ ID NO: 42978 - DNA, 20 bp, Artificial Sequence
  Description of Artificial Sequence: Synthetic oligonucleotide
  Target: SCN9A; (+) strand; PAM type: NRG; PAM sequence: TAG
taaaattctcttttctatta

SEQ ID NO: 42979 - DNA, 20 bp, Artificial Sequence
  Description of Artificial Sequence: Synthetic oligonucleotide
  Target: SCN9A; (+) strand; PAM type: NRG; PAM sequence: TGG
tcttttctattatagccatc

SEQ ID NO: 42980 - DNA, 20 bp, Artificial Sequence
  Description of Artificial Sequence: Synthetic oligonucleotide
  Target: SCN9A; (+) strand; PAM type: NRG; PAM sequence: GGG
cttttctattatagccatct

SEQ ID NO: 42981 - DNA, 20 bp, Artificial Sequence
  Description of Artificial Sequence: Synthetic oligonucleotide
  Target: SCN9A; (+) strand; PAM type: NRG; PAM sequence: TGG
ttctattatagccatctggg

SEQ ID NO: 42982 - DNA, 20 bp, Artificial Sequence
  Description of Artificial Sequence: Synthetic oligonucleotide
  Target: SCN9A; (+) strand; PAM type: NRG; PAM sequence: TGG
tagccatctgggtggtcctt

SEQ ID NO: 42983 - DNA, 20 bp, Artificial Sequence
  Description of Artificial Sequence: Synthetic oligonucleotide
  Target: SCN9A; (+) strand; PAM type: NRG; PAM sequence: CAG
ctgggtggtcctttggacaa

SEQ ID NO: 42984 - DNA, 20 bp, Artificial Sequence
  Description of Artificial Sequence: Synthetic oligonucleotide
  Target: SCN9A; (+) strand; PAM type: NRG; PAM sequence: CAG
gtcctttggacaacagcatt

SEQ ID NO: 42985 - DNA, 20 bp, Artificial Sequence
  Description of Artificial Sequence: Synthetic oligonucleotide
  Target: SCN9A; (+) strand; PAM type: NRG; PAM sequence: AGG
tcctttggacaacagcattc

SEQ ID NO: 42986 - DNA, 20 bp, Artificial Sequence
  Description of Artificial Sequence: Synthetic oligonucleotide
  Target: SCN9A; (+) strand; PAM type: NRG; PAM sequence: GGG
cctttggacaacagcattca

SEQ ID NO: 42987 - DNA, 20 bp, Artificial Sequence
  Description of Artificial Sequence: Synthetic oligonucleotide
  Target: SCN9A; (+) strand; PAM type: NRG; PAM sequence: CAG
ttggacaacagcattcaggg

SEQ ID NO: 42988 - DNA, 20 bp, Artificial Sequence
  Description of Artificial Sequence: Synthetic oligonucleotide
  Target: SCN9A; (+) strand; PAM type: NRG; PAM sequence: AAG
acaacagcattcagggcagc

SEQ ID NO: 42989 - DNA, 20 bp, Artificial Sequence
  Description of Artificial Sequence: Synthetic oligonucleotide
  Target: SCN9A; (+) strand; PAM type: NRG; PAM sequence: AGG
caacagcattcagggcagca

SEQ ID NO: 42990 - DNA, 20 bp, Artificial Sequence
  Description of Artificial Sequence: Synthetic oligonucleotide
  Target: SCN9A; (+) strand; PAM type: NRG; PAM sequence: TGG
agggcagcaaggataatgcc

SEQ ID NO: 42991 - DNA, 20 bp, Artificial Sequence
  Description of Artificial Sequence: Synthetic oligonucleotide
  Target: SCN9A; (+) strand; PAM type: NRG; PAM sequence: TAG
caaggataatgcctggcatg

SEQ ID NO: 42992 - DNA, 20 bp, Artificial Sequence
  Description of Artificial Sequence: Synthetic oligonucleotide
  Target: SCN9A; (+) strand; PAM type: NRG; PAM sequence: AGG
aaggataatgcctggcatgt

SEQ ID NO: 42993 - DNA, 20 bp, Artificial Sequence
  Description of Artificial Sequence: Synthetic oligonucleotide
  Target: SCN9A; (+) strand; PAM type: NRG; PAM sequence: GAG
ggataatgcctggcatgtag

SEQ ID NO: 42994 - DNA, 20 bp, Artificial Sequence
  Description of Artificial Sequence: Synthetic oligonucleotide
  Target: SCN9A; (+) strand; PAM type: NRG; PAM sequence: CAG
gcctggcatgtaggagtgct

SEQ ID NO: 42995 - DNA, 20 bp, Artificial Sequence
  Description of Artificial Sequence: Synthetic oligonucleotide
  Target: SCN9A; (+) strand; PAM type: NRG; PAM sequence: GAG
gtgctcagtaactatttact

SEQ ID NO: 42996 - DNA, 20 bp, Artificial Sequence
  Description of Artificial Sequence: Synthetic oligonucleotide
  Target: SCN9A; (+) strand; PAM type: NRG; PAM sequence: AAG
agtaactatttactgagctc

SEQ ID NO: 42997 - DNA, 20 bp, Artificial Sequence
  Description of Artificial Sequence: Synthetic oligonucleotide
  Target: SCN9A; (+) strand; PAM type: NRG; PAM sequence: TGG
ctcaagtaaaattttgtcat

SEQ ID NO: 42998 - DNA, 20 bp, Artificial Sequence
  Description of Artificial Sequence: Synthetic oligonucleotide
  Target: SCN9A; (+) strand; PAM type: NRG; PAM sequence: TAG
tttgtcattggcactaatca

SEQ ID NO: 42999 - DNA, 20 bp, Artificial Sequence
  Description of Artificial Sequence: Synthetic oligonucleotide
  Target: SCN9A; (+) strand; PAM type: NRG; PAM sequence: AGG
ttgtcattggcactaatcat

SEQ ID NO: 43000 - DNA, 20 bp, Artificial Sequence
  Description of Artificial Sequence: Synthetic oligonucleotide
  Target: SCN9A; (+) strand; PAM type: NRG; PAM sequence: GGG
tgtcattggcactaatcata

SEQ ID NO: 43001 - DNA, 20 bp, Artificial Sequence
  Description of Artificial Sequence: Synthetic oligonucleotide
  Target: SCN9A; (+) strand; PAM type: NRG; PAM sequence: TAG
ctaatcatagggattaattc

SEQ ID NO: 43002 - DNA, 20 bp, Artificial Sequence
  Description of Artificial Sequence: Synthetic oligonucleotide
  Target: SCN9A; (+) strand; PAM type: NRG; PAM sequence: AGG
taatcatagggattaattct

SEQ ID NO: 43003 - DNA, 20 bp, Artificial Sequence
  Description of Artificial Sequence: Synthetic oligonucleotide
  Target: SCN9A; (+) strand; PAM type: NRG; PAM sequence: TAG
gccatgatatttttatcttt

SEQ ID NO: 43004 - DNA, 20 bp, Artificial Sequence
  Description of Artificial Sequence: Synthetic oligonucleotide
  Target: SCN9A; (+) strand; PAM type: NRG; PAM sequence: AAG
ttatcttttagctcatttta

SEQ ID NO: 43005 - DNA, 20 bp, Artificial Sequence
  Description of Artificial Sequence: Synthetic oligonucleotide
  Target: SCN9A; (+) strand; PAM type: NRG; PAM sequence: TAG
acttaatcaatatattgact

SEQ ID NO: 43006 - DNA, 20 bp, Artificial Sequence
  Description of Artificial Sequence: Synthetic oligonucleotide
  Target: SCN9A; (+) strand; PAM type: NRG; PAM sequence: AGG
cttaatcaatatattgactt

SEQ ID NO: 43007 - DNA, 20 bp, Artificial Sequence
  Description of Artificial Sequence: Synthetic oligonucleotide
  Target: SCN9A; (+) strand; PAM type: NRG; PAM sequence: CAG
caatatattgacttaggtgt

SEQ ID NO: 43008 - DNA, 20 bp, Artificial Sequence
  Description of Artificial Sequence: Synthetic oligonucleotide
  Target: SCN9A; (+) strand; PAM type: NRG; PAM sequence: CAG
ttaggtgtcagatcatttac

SEQ ID NO: 43009 - DNA, 20 bp, Artificial Sequence
  Description of Artificial Sequence: Synthetic oligonucleotide
  Target: SCN9A; (+) strand; PAM type: NRG; PAM sequence: AGG
taggtgtcagatcatttacc

SEQ ID NO: 43010 - DNA, 20 bp, Artificial Sequence
  Description of Artificial Sequence: Synthetic oligonucleotide
  Target: SCN9A; (+) strand; PAM type: NRG; PAM sequence: GGG
aggtgtcagatcatttacca

SEQ ID NO: 43011 - DNA, 20 bp, Artificial Sequence
  Description of Artificial Sequence: Synthetic oligonucleotide
  Target: SCN9A; (+) strand; PAM type: NRG; PAM sequence: GAG
tttaccagggcaccactgct

SEQ ID NO: 43012 - DNA, 20 bp, Artificial Sequence
  Description of Artificial Sequence: Synthetic oligonucleotide
  Target: SCN9A; (+) strand; PAM type: NRG; PAM sequence: CAG
accagggcaccactgctgag

SEQ ID NO: 43013 - DNA, 20 bp, Artificial Sequence
  Description of Artificial Sequence: Synthetic oligonucleotide
  Target: SCN9A; (+) strand; PAM type: NRG; PAM sequence: AGG
ccagggcaccactgctgagc

SEQ ID NO: 43014 - DNA, 20 bp, Artificial Sequence
  Description of Artificial Sequence: Synthetic oligonucleotide
  Target: SCN9A; (+) strand; PAM type: NRG; PAM sequence: GAG
ccactgctgagcaggatcat

SEQ ID NO: 43015 - DNA, 20 bp, Artificial Sequence
  Description of Artificial Sequence: Synthetic oligonucleotide
  Target: SCN9A; (+) strand; PAM type: NRG; PAM sequence: AGG
cactgctgagcaggatcatg

SEQ ID NO: 43016 - DNA, 20 bp, Artificial Sequence
  Description of Artificial Sequence: Synthetic oligonucleotide
  Target: SCN9A; (+) strand; PAM type: NRG; PAM sequence: AAG
gcaggatcatgaggacaatg

SEQ ID NO: 43017 - DNA, 20 bp, Artificial Sequence
  Description of Artificial Sequence: Synthetic oligonucleotide
  Target: SCN9A; (+) strand; PAM type: NRG; PAM sequence: TAG
aactgtgttcaacaatcttg

SEQ ID NO: 43018 - DNA, 20 bp, Artificial Sequence
  Description of Artificial Sequence: Synthetic oligonucleotide
  Target: SCN9A; (+) strand; PAM type: NRG; PAM sequence: CAG
tgtgttcaacaatcttgtag

SEQ ID NO: 43019 - DNA, 20 bp, Artificial Sequence
  Description of Artificial Sequence: Synthetic oligonucleotide
  Target: SCN9A; (+) strand; PAM type: NRG; PAM sequence: AGG
gtgttcaacaatcttgtagc

SEQ ID NO: 43020 - DNA, 20 bp, Artificial Sequence
  Description of Artificial Sequence: Synthetic oligonucleotide
  Target: SCN9A; (+) strand; PAM type: NRG; PAM sequence: CAG
aggttttcctgatgttccac

SEQ ID NO: 43021 - DNA, 20 bp, Artificial Sequence
  Description of Artificial Sequence: Synthetic oligonucleotide
  Target: SCN9A; (+) strand; PAM type: NRG; PAM sequence: TGG
tccctgactctatgttaact

SEQ ID NO: 43022 - DNA, 20 bp, Artificial Sequence
  Description of Artificial Sequence: Synthetic oligonucleotide
  Target: SCN9A; (+) strand; PAM type: NRG; PAM sequence: CAG
ctgactctatgttaacttgg

SEQ ID NO: 43023 - DNA, 20 bp, Artificial Sequence
  Description of Artificial Sequence: Synthetic oligonucleotide
  Target: SCN9A; (+) strand; PAM type: NRG; PAM sequence: GAG
ctatgttaacttggcagcat

SEQ ID NO: 43024 - DNA, 20 bp, Artificial Sequence
  Description of Artificial Sequence: Synthetic oligonucleotide
  Target: SCN9A; (+) strand; PAM type: NRG; PAM sequence: AAG
acctccatacacaacctgac

SEQ ID NO: 43025 - DNA, 20 bp, Artificial Sequence
  Description of Artificial Sequence: Synthetic oligonucleotide
  Target: SCN9A; (+) strand; PAM type: NRG; PAM sequence: AAG
ccatacacaacctgacaaga

SEQ ID NO: 43026 - DNA, 20 bp, Artificial Sequence
  Description of Artificial Sequence: Synthetic oligonucleotide
  Target: SCN9A; (+) strand; PAM type: NRG; PAM sequence: CAG
gcatgttaaatcttgatatt

SEQ ID NO: 43027 - DNA, 20 bp, Artificial Sequence
  Description of Artificial Sequence: Synthetic oligonucleotide
  Target: SCN9A; (+) strand; PAM type: NRG; PAM sequence: CAG
aacacctatacttgcaattt

SEQ ID NO: 43028 - DNA, 20 bp, Artificial Sequence
  Description of Artificial Sequence: Synthetic oligonucleotide
  Target: SCN9A; (+) strand; PAM type: NRG; PAM sequence: TAG
cctatacttgcaatttcaga

SEQ ID NO: 43029 - DNA, 20 bp, Artificial Sequence
  Description of Artificial Sequence: Synthetic oligonucleotide
  Target: SCN9A; (+) strand; PAM type: NRG; PAM sequence: TGG
aatttcagatagatttaatt

SEQ ID NO: 43030 - DNA, 20 bp, Artificial Sequence
  Description of Artificial Sequence: Synthetic oligonucleotide
  Target: SCN9A; (+) strand; PAM type: NRG; PAM sequence: TAG
tttgcatgatgttttctaaa

SEQ ID NO: 43031 - DNA, 20 bp, Artificial Sequence
  Description of Artificial Sequence: Synthetic oligonucleotide
  Target: SCN9A; (+) strand; PAM type: NRG; PAM sequence: TAG
gatgttttctaaatagttgt

SEQ ID NO: 43032 - DNA, 20 bp, Artificial Sequence
  Description of Artificial Sequence: Synthetic oligonucleotide
  Target: SCN9A; (+) strand; PAM type: NRG; PAM sequence: TAG
ttttctaaatagttgttagt

SEQ ID NO: 43033 - DNA, 20 bp, Artificial Sequence
  Description of Artificial Sequence: Synthetic oligonucleotide
  Target: SCN9A; (+) strand; PAM type: NRG; PAM sequence: TAG
aaatagttgttagttagttt

SEQ ID NO: 43034 - DNA, 20 bp, Artificial Sequence
  Description of Artificial Sequence: Synthetic oligonucleotide
  Target: SCN9A; (+) strand; PAM type: NRG; PAM sequence: CAG
tgtaatccccaatttctctt

SEQ ID NO: 43035 - DNA, 20 bp, Artificial Sequence
  Description of Artificial Sequence: Synthetic oligonucleotide
  Target: SCN9A; (+) strand; PAM type: NRG; PAM sequence: CAG
tttctcttcagtctcctcca

SEQ ID NO: 43036 - DNA, 20 bp, Artificial Sequence
  Description of Artificial Sequence: Synthetic oligonucleotide
  Target: SCN9A; (+) strand; PAM type: NRG; PAM sequence: AAG
aatgaatgaactaaaatctg

SEQ ID NO: 43037 - DNA, 20 bp, Artificial Sequence
  Description of Artificial Sequence: Synthetic oligonucleotide
  Target: SCN9A; (+) strand; PAM type: NRG; PAM sequence: TAG
tctgaagacgacatgaattt

SEQ ID NO: 43038 - DNA, 20 bp, Artificial Sequence
  Description of Artificial Sequence: Synthetic oligonucleotide
  Target: SCN9A; (+) strand; PAM type: NRG; PAM sequence: AGG
ctgaagacgacatgaatttt

SEQ ID NO: 43039 - DNA, 20 bp, Artificial Sequence
  Description of Artificial Sequence: Synthetic oligonucleotide
  Target: SCN9A; (+) strand; PAM type: NRG; PAM sequence: GGG
tgaagacgacatgaatttta

SEQ ID NO: 43040 - DNA, 20 bp, Artificial Sequence
  Description of Artificial Sequence: Synthetic oligonucleotide
  Target: SCN9A; (+) strand; PAM type: NRG; PAM sequence: CAG
tttagggtcttcttttctga

SEQ ID NO: 43041 - DNA, 20 bp, Artificial Sequence
  Description of Artificial Sequence: Synthetic oligonucleotide
  Target: SCN9A; (+) strand; PAM type: NRG; PAM sequence: TAG
ttctgacagataaatttttc

SEQ ID NO: 43042 - DNA, 20 bp, Artificial Sequence
  Description of Artificial Sequence: Synthetic oligonucleotide
  Target: SCN9A; (+) strand; PAM type: NRG; PAM sequence: TAG
atttttctagtctataattt

SEQ ID NO: 43043 - DNA, 20 bp, Artificial Sequence
  Description of Artificial Sequence: Synthetic oligonucleotide
  Target: SCN9A; (+) strand; PAM type: NRG; PAM sequence: TGG
tagatacttccactcctcta

SEQ ID NO: 43044 - DNA, 20 bp, Artificial Sequence
  Description of Artificial Sequence: Synthetic oligonucleotide
  Target: SCN9A; (+) strand; PAM type: NRG; PAM sequence: GAG
acacctttctaaacaatatt

SEQ ID NO: 43045 - DNA, 20 bp, Artificial Sequence
  Description of Artificial Sequence: Synthetic oligonucleotide
  Target: SCN9A; (+) strand; PAM type: NRG; PAM sequence: TAG
ctaaacaatattgagaaaat

SEQ ID NO: 43046 - DNA, 20 bp, Artificial Sequence
  Description of Artificial Sequence: Synthetic oligonucleotide
  Target: SCN9A; (+) strand; PAM type: NRG; PAM sequence: TGG
aacaatattgagaaaattag

SEQ ID NO: 43047 - DNA, 20 bp, Artificial Sequence
  Description of Artificial Sequence: Synthetic oligonucleotide
  Target: SCN9A; (+) strand; PAM type: NRG; PAM sequence: AAG
tagtggaaactcctgaaatt

SEQ ID NO: 43048 - DNA, 20 bp, Artificial Sequence
  Description of Artificial Sequence: Synthetic oligonucleotide
  Target: SCN9A; (+) strand; PAM type: NRG; PAM sequence: AAG
actcctgaaattaagttcaa

SEQ ID NO: 43049 - DNA, 20 bp, Artificial Sequence
  Description of Artificial Sequence: Synthetic oligonucleotide
  Target: SCN9A; (+) strand; PAM type: NRG; PAM sequence: TAG
caaaagaaactcatcttgat

SEQ ID NO: 43050 - DNA, 20 bp, Artificial Sequence
  Description of Artificial Sequence: Synthetic oligonucleotide
  Target: SCN9A; (+) strand; PAM type: NRG; PAM sequence: AAG
aagaaactcatcttgattag

SEQ ID NO: 43051 - DNA, 20 bp, Artificial Sequence
  Description of Artificial Sequence: Synthetic oligonucleotide
  Target: SCN9A; (+) strand; PAM type: NRG; PAM sequence: CAG
ctcatcttgattagaagatc

SEQ ID NO: 43052 - DNA, 20 bp, Artificial Sequence
  Description of Artificial Sequence: Synthetic oligonucleotide
  Target: SCN9A; (+) strand; PAM type: NRG; PAM sequence: AAG
gatccagatgaaactgtttc

SEQ ID NO: 43053 - DNA, 20 bp, Artificial Sequence
  Description of Artificial Sequence: Synthetic oligonucleotide
  Target: SCN9A; (+) strand; PAM type: NRG; PAM sequence: AAG
gaaactgtttcaagtattct

SEQ ID NO: 43054 - DNA, 20 bp, Artificial Sequence
  Description of Artificial Sequence: Synthetic oligonucleotide
  Target: SCN9A; (+) strand; PAM type: NRG; PAM sequence: TGG
ttgaaaattgtacttaaaaa

SEQ ID NO: 43055 - DNA, 20 bp, Artificial Sequence
  Description of Artificial Sequence: Synthetic oligonucleotide
  Target: SCN9A; (+) strand; PAM type: NRG; PAM sequence: TAG
aaattgtacttaaaaatggt

SEQ ID NO: 43056 - DNA, 20 bp, Artificial Sequence
  Description of Artificial Sequence: Synthetic oligonucleotide
  Target: SCN9A; (+) strand; PAM type: NRG; PAM sequence: AGG
aattgtacttaaaaatggtt

SEQ ID NO: 43057 - DNA, 20 bp, Artificial Sequence
  Description of Artificial Sequence: Synthetic oligonucleotide
  Target: SCN9A; (+) strand; PAM type: NRG; PAM sequence: CAG
tgtacatgatttcctttcct

SEQ ID NO: 43058 - DNA, 20 bp, Artificial Sequence
  Description of Artificial Sequence: Synthetic oligonucleotide
  Target: SCN9A; (+) strand; PAM type: NRG; PAM sequence: TAG
tttcctcagtgaatttatgt

SEQ ID NO: 43059 - DNA, 20 bp, Artificial Sequence
  Description of Artificial Sequence: Synthetic oligonucleotide
  Target: SCN9A; (+) strand; PAM type: NRG; PAM sequence: AGG
ttcctcagtgaatttatgtt

SEQ ID NO: 43060 - DNA, 20 bp, Artificial Sequence
  Description of Artificial Sequence: Synthetic oligonucleotide
  Target: SCN9A; (+) strand; PAM type: NRG; PAM sequence: TGG
agtgaatttatgttaggttt

SEQ ID NO: 43061 - DNA, 20 bp, Artificial Sequence
  Description of Artificial Sequence: Synthetic oligonucleotide
  Target: SCN9A; (+) strand; PAM type: NRG; PAM sequence: TAG
aatttatgttaggttttggt

SEQ ID NO: 43062 - DNA, 20 bp, Artificial Sequence
  Description of Artificial Sequence: Synthetic oligonucleotide
  Target: SCN9A; (+) strand; PAM type: NRG; PAM sequence: AGG
atttatgttaggttttggtt

SEQ ID NO: 43063 - DNA, 20 bp, Artificial Sequence
  Description of Artificial Sequence: Synthetic oligonucleotide
  Target: SCN9A; (+) strand; PAM type: NRG; PAM sequence: TAG
tatgttaggttttggttagg

SEQ ID NO: 43064 - DNA, 20 bp, Artificial Sequence
  Description of Artificial Sequence: Synthetic oligonucleotide
  Target: SCN9A; (+) strand; PAM type: NRG; PAM sequence: CAG
tttggttaggtagataaaaa

SEQ ID NO: 43065 - DNA, 20 bp, Artificial Sequence
  Description of Artificial Sequence: Synthetic oligonucleotide
  Target: SCN9A; (+) strand; PAM type: NRG; PAM sequence: TAG
cagaaataaatgactataac

SEQ ID NO: 43066 - DNA, 20 bp, Artificial Sequence
  Description of Artificial Sequence: Synthetic oligonucleotide
  Target: SCN9A; (+) strand; PAM type: NRG; PAM sequence: TGG
taaatgactataactagata

SEQ ID NO: 43067 - DNA, 20 bp, Artificial Sequence
  Description of Artificial Sequence: Synthetic oligonucleotide
  Target: SCN9A; (+) strand; PAM type: NRG; PAM sequence: AAG
ataactagatatggcaacta

SEQ ID NO: 43068 - DNA, 20 bp, Artificial Sequence
  Description of Artificial Sequence: Synthetic oligonucleotide
  Target: SCN9A; (+) strand; PAM type: NRG; PAM sequence: CAG
agatatggcaactaaagtga

SEQ ID NO: 43069 - DNA, 20 bp, Artificial Sequence
  Description of Artificial Sequence: Synthetic oligonucleotide
  Target: SCN9A; (+) strand; PAM type: NRG; PAM sequence: TAG
atggcaactaaagtgacaga

SEQ ID NO: 43070 - DNA, 20 bp, Artificial Sequence
  Description of Artificial Sequence: Synthetic oligonucleotide
  Target: SCN9A; (+) strand; PAM type: NRG; PAM sequence: CAG
caactaaagtgacagatagt

SEQ ID NO: 43071 - DNA, 20 bp, Artificial Sequence
  Description of Artificial Sequence: Synthetic oligonucleotide
  Target: SCN9A; (+) strand; PAM type: NRG; PAM sequence: AGG
aactaaagtgacagatagtc

SEQ ID NO: 43072 - DNA, 20 bp, Artificial Sequence
  Description of Artificial Sequence: Synthetic oligonucleotide
  Target: SCN9A; (+) strand; PAM type: NRG; PAM sequence: GGG
actaaagtgacagatagtca

SEQ ID NO: 43073 - DNA, 20 bp, Artificial Sequence
  Description of Artificial Sequence: Synthetic oligonucleotide
  Target: SCN9A; (+) strand; PAM type: NRG; PAM sequence: TAG
atagtcagggttcattttga

SEQ ID NO: 43074 - DNA, 20 bp, Artificial Sequence
  Description of Artificial Sequence: Synthetic oligonucleotide
  Target: SCN9A; (+) strand; PAM type: NRG; PAM sequence: TGG
cagggttcattttgatagca

SEQ ID NO: 43075 - DNA, 20 bp, Artificial Sequence
  Description of Artificial Sequence: Synthetic oligonucleotide
  Target: SCN9A; (+) strand; PAM type: NRG; PAM sequence: AAG
ggttcattttgatagcatgg

SEQ ID NO: 43076 - DNA, 20 bp, Artificial Sequence
  Description of Artificial Sequence: Synthetic oligonucleotide
  Target: SCN9A; (+) strand; PAM type: NRG; PAM sequence: TGG
tggaagaaatcaatctcacc

SEQ ID NO: 43077 - DNA, 20 bp, Artificial Sequence
  Description of Artificial Sequence: Synthetic oligonucleotide
  Target: SCN9A; (+) strand; PAM type: NRG; PAM sequence: GAG
tctcacctggcttatttctt

SEQ ID NO: 43078 - DNA, 20 bp, Artificial Sequence
  Description of Artificial Sequence: Synthetic oligonucleotide
  Target: SCN9A; (+) strand; PAM type: NRG; PAM sequence: AAG
acctggcttatttcttgaga

SEQ ID NO: 43079 - DNA, 20 bp, Artificial Sequence
  Description of Artificial Sequence: Synthetic oligonucleotide
  Target: SCN9A; (+) strand; PAM type: NRG; PAM sequence: GAG
ctggcttatttcttgagaaa

SEQ ID NO: 43080 - DNA, 20 bp, Artificial Sequence
  Description of Artificial Sequence: Synthetic oligonucleotide
  Target: SCN9A; (+) strand; PAM type: NRG; PAM sequence: GAG
ggcttatttcttgagaaaga

SEQ ID NO: 43081 - DNA, 20 bp, Artificial Sequence
  Description of Artificial Sequence: Synthetic oligonucleotide
  Target: SCN9A; (+) strand; PAM type: NRG; PAM sequence: CAG
atttcttgagaaagagagat

SEQ ID NO: 43082 - DNA, 20 bp, Artificial Sequence
  Description of Artificial Sequence: Synthetic oligonucleotide
  Target: SCN9A; (+) strand; PAM type: NRG; PAM sequence: TAG
tcttgagaaagagagatcag

SEQ ID NO: 43083 - DNA, 20 bp, Artificial Sequence
  Description of Artificial Sequence: Synthetic oligonucleotide
  Target: SCN9A; (+) strand; PAM type: NRG; PAM sequence: GAG
ttgagaaagagagatcagta

SEQ ID NO: 43084 - DNA, 20 bp, Artificial Sequence
  Description of Artificial Sequence: Synthetic oligonucleotide
  Target: SCN9A; (+) strand; PAM type: NRG; PAM sequence: AGG
tgagaaagagagatcagtag

SEQ ID NO: 43085 - DNA, 20 bp, Artificial Sequence
  Description of Artificial Sequence: Synthetic oligonucleotide
  Target: SCN9A; (+) strand; PAM type: NRG; PAM sequence: TAG
agagatcagtagaggcttcc

SEQ ID NO: 43086 - DNA, 20 bp, Artificial Sequence
  Description of Artificial Sequence: Synthetic oligonucleotide
  Target: SCN9A; (+) strand; PAM type: NRG; PAM sequence: AAG
gatcagtagaggcttcctag

SEQ ID NO: 43087 - DNA, 20 bp, Artificial Sequence
  Description of Artificial Sequence: Synthetic oligonucleotide
  Target: SCN9A; (+) strand; PAM type: NRG; PAM sequence: GAG
tcagtagaggcttcctagaa

SEQ ID NO: 43088 - DNA, 20 bp, Artificial Sequence
  Description of Artificial Sequence: Synthetic oligonucleotide
  Target: SCN9A; (+) strand; PAM type: NRG; PAM sequence: TGG
tagaggcttcctagaagaga

SEQ ID NO: 43089 - DNA, 20 bp, Artificial Sequence
  Description of Artificial Sequence: Synthetic oligonucleotide
  Target: SCN9A; (+) strand; PAM type: NRG; PAM sequence: GAG
gaggcttcctagaagagatg

SEQ ID NO: 43090 - DNA, 20 bp, Artificial Sequence
  Description of Artificial Sequence: Synthetic oligonucleotide
  Target: SCN9A; (+) strand; PAM type: NRG; PAM sequence: TGG
ttcctagaagagatggagcc

SEQ ID NO: 43091 - DNA, 20 bp, Artificial Sequence
  Description of Artificial Sequence: Synthetic oligonucleotide
  Target: SCN9A; (+) strand; PAM type: NRG; PAM sequence: GGG
tcctagaagagatggagcct

SEQ ID NO: 43092 - DNA, 20 bp, Artificial Sequence
  Description of Artificial Sequence: Synthetic oligonucleotide
  Target: SCN9A; (+) strand; PAM type: NRG; PAM sequence: CAG
cctgggttgaatcaaaatat

SEQ ID NO: 43093 - DNA, 20 bp, Artificial Sequence
  Description of Artificial Sequence: Synthetic oligonucleotide
  Target: SCN9A; (+) strand; PAM type: NRG; PAM sequence: AAG
gaatcaaaatatcagtaaaa

SEQ ID NO: 43094 - DNA, 20 bp, Artificial Sequence
  Description of Artificial Sequence: Synthetic oligonucleotide
  Target: SCN9A; (+) strand; PAM type: NRG; PAM sequence: GAG
atcaaaatatcagtaaaaaa

SEQ ID NO: 43095 - DNA, 20 bp, Artificial Sequence
  Description of Artificial Sequence: Synthetic oligonucleotide
  Target: SCN9A; (+) strand; PAM type: NRG; PAM sequence: TGG
aatatcagtaaaaaagagtt

SEQ ID NO: 43096 - DNA, 20 bp, Artificial Sequence
  Description of Artificial Sequence: Synthetic oligonucleotide
  Target: SCN9A; (+) strand; PAM type: NRG; PAM sequence: GGG
atatcagtaaaaaagagttt

SEQ ID NO: 43097 - DNA, 20 bp, Artificial Sequence
  Description of Artificial Sequence: Synthetic oligonucleotide
  Target: SCN9A; (+) strand; PAM type: NRG; PAM sequence: TGG
tcagtaaaaaagagtttggg

SEQ ID NO: 43098 - DNA, 20 bp, Artificial Sequence
  Description of Artificial Sequence: Synthetic oligonucleotide
  Target: SCN9A; (+) strand; PAM type: NRG; PAM sequence: CAG
aaagagtttgggtggaattc

SEQ ID NO: 43099 - DNA, 20 bp, Artificial Sequence
  Description of Artificial Sequence: Synthetic oligonucleotide
  Target: SCN9A; (+) strand; PAM type: NRG; PAM sequence: AGG
aagagtttgggtggaattcc

SEQ ID NO: 43100 - DNA, 20 bp, Artificial Sequence
  Description of Artificial Sequence: Synthetic oligonucleotide
  Target: SCN9A; (+) strand; PAM type: NRG; PAM sequence: CAG
agtttgggtggaattccagg

SEQ ID NO: 43101 - DNA, 20 bp, Artificial Sequence
  Description of Artificial Sequence: Synthetic oligonucleotide
  Target: SCN9A; (+) strand; PAM type: NRG; PAM sequence: TAG
gcagcaaaaattgttatgca

SEQ ID NO: 43102 - DNA, 20 bp, Artificial Sequence
  Description of Artificial Sequence: Synthetic oligonucleotide
  Target: SCN9A; (+) strand; PAM type: NRG; PAM sequence: CAG
ttatgcatagaaatttaaac

SEQ ID NO: 43103 - DNA, 20 bp, Artificial Sequence
  Description of Artificial Sequence: Synthetic oligonucleotide
  Target: SCN9A; (+) strand; PAM type: NRG; PAM sequence: TAG
catagaaatttaaaccagtt

SEQ ID NO: 43104 - DNA, 20 bp, Artificial Sequence
  Description of Artificial Sequence: Synthetic oligonucleotide
  Target: SCN9A; (+) strand; PAM type: NRG; PAM sequence: AAG
ccagtttagaattgtgatgc

SEQ ID NO: 43105 - DNA, 20 bp, Artificial Sequence
  Description of Artificial Sequence: Synthetic oligonucleotide
  Target: SCN9A; (+) strand; PAM type: NRG; PAM sequence: CAG
gtttagaattgtgatgcaag

SEQ ID NO: 43106 - DNA, 20 bp, Artificial Sequence
  Description of Artificial Sequence: Synthetic oligonucleotide
  Target: SCN9A; (+) strand; PAM type: NRG; PAM sequence: AAG
gatgcaagcagaatgtacac

SEQ ID NO: 43107 - DNA, 20 bp, Artificial Sequence
  Description of Artificial Sequence: Synthetic oligonucleotide
  Target: SCN9A; (+) strand; PAM type: NRG; PAM sequence: GAG
tgcaagcagaatgtacacaa

SEQ ID NO: 43108 - DNA, 20 bp, Artificial Sequence
  Description of Artificial Sequence: Synthetic oligonucleotide
  Target: SCN9A; (+) strand; PAM type: NRG; PAM sequence: AGG
gcaagcagaatgtacacaag

SEQ ID NO: 43109 - DNA, 20 bp, Artificial Sequence
  Description of Artificial Sequence: Synthetic oligonucleotide
  Target: SCN9A; (+) strand; PAM type: NRG; PAM sequence: AAG
gcagaatgtacacaagaggc

SEQ ID NO: 43110 - DNA, 20 bp, Artificial Sequence
  Description of Artificial Sequence: Synthetic oligonucleotide
  Target: SCN9A; (+) strand; PAM type: NRG; PAM sequence: AGG
cagaatgtacacaagaggca

SEQ ID NO: 43111 - DNA, 20 bp, Artificial Sequence
  Description of Artificial Sequence: Synthetic oligonucleotide
  Target: SCN9A; (+) strand; PAM type: NRG; PAM sequence: GGG
agaatgtacacaagaggcaa

SEQ ID NO: 43112 - DNA, 20 bp, Artificial Sequence
  Description of Artificial Sequence: Synthetic oligonucleotide
  Target: SCN9A; (+) strand; PAM type: NRG; PAM sequence: GAG
tgtacacaagaggcaagggt

SEQ ID NO: 43113 - DNA, 20 bp, Artificial Sequence
  Description of Artificial Sequence: Synthetic oligonucleotide
  Target: SCN9A; (+) strand; PAM type: NRG; PAM sequence: GAG
tacacaagaggcaagggtga

SEQ ID NO: 43114 - DNA, 20 bp, Artificial Sequence
  Description of Artificial Sequence: Synthetic oligonucleotide
  Target: SCN9A; (+) strand; PAM type: NRG; PAM sequence: AGG
acacaagaggcaagggtgag

SEQ ID NO: 43115 - DNA, 20 bp, Artificial Sequence
  Description of Artificial Sequence: Synthetic oligonucleotide
  Target: SCN9A; (+) strand; PAM type: NRG; PAM sequence: GAG
aagaggcaagggtgagaggt

SEQ ID NO: 43116 - DNA, 20 bp, Artificial Sequence
  Description of Artificial Sequence: Synthetic oligonucleotide
  Target: SCN9A; (+) strand; PAM type: NRG; PAM sequence: TAG
gcaagggtgagaggtgagct

SEQ ID NO: 43117 - DNA, 20 bp, Artificial Sequence
  Description of Artificial Sequence: Synthetic oligonucleotide
  Target: SCN9A; (+) strand; PAM type: NRG; PAM sequence: TGG
agaggtgagcttagaaaaat

SEQ ID NO: 43118 - DNA, 20 bp, Artificial Sequence
  Description of Artificial Sequence: Synthetic oligonucleotide
  Target: SCN9A; (+) strand; PAM type: NRG; PAM sequence: CAG
gtgagcttagaaaaattggt

SEQ ID NO: 43119 - DNA, 20 bp, Artificial Sequence
  Description of Artificial Sequence: Synthetic oligonucleotide
  Target: SCN9A; (+) strand; PAM type: NRG; PAM sequence: TGG
tagaaaaattggtcagatta

SEQ ID NO: 43120 - DNA, 20 bp, Artificial Sequence
  Description of Artificial Sequence: Synthetic oligonucleotide
  Target: SCN9A; (+) strand; PAM type: NRG; PAM sequence: AAG
aaaattggtcagattatgga

SEQ ID NO: 43121 - DNA, 20 bp, Artificial Sequence
  Description of Artificial Sequence: Synthetic oligonucleotide
  Target: SCN9A; (+) strand; PAM type: NRG; PAM sequence: TGG
ggtcagattatggaaagcat

SEQ ID NO: 43122 - DNA, 20 bp, Artificial Sequence
  Description of Artificial Sequence: Synthetic oligonucleotide
  Target: SCN9A; (+) strand; PAM type: NRG; PAM sequence: AAG
aaagcattggcctttacctt

SEQ ID NO: 43123 - DNA, 20 bp, Artificial Sequence
  Description of Artificial Sequence: Synthetic oligonucleotide
  Target: SCN9A; (+) strand; PAM type: NRG; PAM sequence: AGG
aagcattggcctttacctta

SEQ ID NO: 43124 - DNA, 20 bp, Artificial Sequence
  Description of Artificial Sequence: Synthetic oligonucleotide
  Target: SCN9A; (+) strand; PAM type: NRG; PAM sequence: GAG
gcattggcctttaccttaag

SEQ ID NO: 43125 - DNA, 20 bp, Artificial Sequence
  Description of Artificial Sequence: Synthetic oligonucleotide
  Target: SCN9A; (+) strand; PAM type: NRG; PAM sequence: TGG
ggcctttaccttaaggagtt

SEQ ID NO: 43126 - DNA, 20 bp, Artificial Sequence
  Description of Artificial Sequence: Synthetic oligonucleotide
  Target: SCN9A; (+) strand; PAM type: NRG; PAM sequence: GAG
agtttggcttatatcctatt

SEQ ID NO: 43127 - DNA, 20 bp, Artificial Sequence
  Description of Artificial Sequence: Synthetic oligonucleotide
  Target: SCN9A; (+) strand; PAM type: NRG; PAM sequence: AGG
gtttggcttatatcctattg

SEQ ID NO: 43128 - DNA, 20 bp, Artificial Sequence
  Description of Artificial Sequence: Synthetic oligonucleotide
  Target: SCN9A; (+) strand; PAM type: NRG; PAM sequence: GAG
gcttatatcctattgaggtt

SEQ ID NO: 43129 - DNA, 20 bp, Artificial Sequence
  Description of Artificial Sequence: Synthetic oligonucleotide
  Target: SCN9A; (+) strand; PAM type: NRG; PAM sequence: AGG
cttatatcctattgaggttg

SEQ ID NO: 43130 - DNA, 20 bp, Artificial Sequence
  Description of Artificial Sequence: Synthetic oligonucleotide
  Target: SCN9A; (+) strand; PAM type: NRG; PAM sequence: GAG
tatatcctattgaggttgag

SEQ ID NO: 43131 - DNA, 20 bp, Artificial Sequence
  Description of Artificial Sequence: Synthetic oligonucleotide
  Target: SCN9A; (+) strand; PAM type: NRG; PAM sequence: AAG
tcctattgaggttgaggagt

SEQ ID NO: 43132 - DNA, 20 bp, Artificial Sequence
  Description of Artificial Sequence: Synthetic oligonucleotide
  Target: SCN9A; (+) strand; PAM type: NRG; PAM sequence: AAG
ttgaggttgaggagtaagta

SEQ ID NO: 43133 - DNA, 20 bp, Artificial Sequence
  Description of Artificial Sequence: Synthetic oligonucleotide
  Target: SCN9A; (+) strand; PAM type: NRG; PAM sequence: AGG
tgaggttgaggagtaagtaa

SEQ ID NO: 43134 - DNA, 20 bp, Artificial Sequence
  Description of Artificial Sequence: Synthetic oligonucleotide
  Target: SCN9A; (+) strand; PAM type: NRG; PAM sequence: GGG
gaggttgaggagtaagtaaa

SEQ ID NO: 43135 - DNA, 20 bp, Artificial Sequence
  Description of Artificial Sequence: Synthetic oligonucleotide
  Target: SCN9A; (+) strand; PAM type: NRG; PAM sequence: AAG
aggagtaagtaaagggttat

SEQ ID NO: 43136 - DNA, 20 bp, Artificial Sequence
  Description of Artificial Sequence: Synthetic oligonucleotide
  Target: SCN9A; (+) strand; PAM type: NRG; PAM sequence: CAG
agtaagtaaagggttataag

SEQ ID NO: 43137 - DNA, 20 bp, Artificial Sequence
  Description of Artificial Sequence: Synthetic oligonucleotide
  Target: SCN9A; (+) strand; PAM type: NRG; PAM sequence: AGG
gtaagtaaagggttataagc

SEQ ID NO: 43138 - DNA, 20 bp, Artificial Sequence
  Description of Artificial Sequence: Synthetic oligonucleotide
  Target: SCN9A; (+) strand; PAM type: NRG; PAM sequence: GGG
taagtaaagggttataagca

SEQ ID NO: 43139 - DNA, 20 bp, Artificial Sequence
  Description of Artificial Sequence: Synthetic oligonucleotide
  Target: SCN9A; (+) strand; PAM type: NRG; PAM sequence: GAG
aagggttataagcagggaac

SEQ ID NO: 43140 - DNA, 20 bp, Artificial Sequence
  Description of Artificial Sequence: Synthetic oligonucleotide
  Target: SCN9A; (+) strand; PAM type: NRG; PAM sequence: TAG
tacgcaaattgcaatgtaaa

SEQ ID NO: 43141 - DNA, 20 bp, Artificial Sequence
  Description of Artificial Sequence: Synthetic oligonucleotide
  Target: SCN9A; (+) strand; PAM type: NRG; PAM sequence: CGG
aatgtaaatagatgtctcca

SEQ ID NO: 43142 - DNA, 20 bp, Artificial Sequence
  Description of Artificial Sequence: Synthetic oligonucleotide
  Target: SCN9A; (+) strand; PAM type: NRG; PAM sequence: TGG
atagatgtctccacggtaca

SEQ ID NO: 43143 - DNA, 20 bp, Artificial Sequence
  Description of Artificial Sequence: Synthetic oligonucleotide
  Target: SCN9A; (+) strand; PAM type: NRG; PAM sequence: GAG
agatgtctccacggtacatg

SEQ ID NO: 43144 - DNA, 20 bp, Artificial Sequence
  Description of Artificial Sequence: Synthetic oligonucleotide
  Target: SCN9A; (+) strand; PAM type: NRG; PAM sequence: AGG
gatgtctccacggtacatgg

SEQ ID NO: 43145 - DNA, 20 bp, Artificial Sequence
  Description of Artificial Sequence: Synthetic oligonucleotide
  Target: SCN9A; (+) strand; PAM type: NRG; PAM sequence: AAG
ctccacggtacatggaggat

SEQ ID NO: 43146 - DNA, 20 bp, Artificial Sequence
  Description of Artificial Sequence: Synthetic oligonucleotide
  Target: SCN9A; (+) strand; PAM type: NRG; PAM sequence: TGG
acggtacatggaggataagt

SEQ ID NO: 43147 - DNA, 20 bp, Artificial Sequence
  Description of Artificial Sequence: Synthetic oligonucleotide
  Target: SCN9A; (+) strand; PAM type: NRG; PAM sequence: AAG
gtacatggaggataagttgg

SEQ ID NO: 43148 - DNA, 20 bp, Artificial Sequence
  Description of Artificial Sequence: Synthetic oligonucleotide
  Target: SCN9A; (+) strand; PAM type: NRG; PAM sequence: AGG
tacatggaggataagttgga

SEQ ID NO: 43149 - DNA, 20 bp, Artificial Sequence
  Description of Artificial Sequence: Synthetic oligonucleotide
  Target: SCN9A; (+) strand; PAM type: NRG; PAM sequence: GGG
acatggaggataagttggaa

SEQ ID NO: 43150 - DNA, 20 bp, Artificial Sequence
  Description of Artificial Sequence: Synthetic oligonucleotide
  Target: SCN9A; (+) strand; PAM type: NRG; PAM sequence: TAG
ggataagttggaagggtgaa

SEQ ID NO: 43151 - DNA, 20 bp, Artificial Sequence
  Description of Artificial Sequence: Synthetic oligonucleotide
  Target: SCN9A; (+) strand; PAM type: NRG; PAM sequence: GAG
ataagttggaagggtgaata

SEQ ID NO: 43152 - DNA, 20 bp, Artificial Sequence
  Description of Artificial Sequence: Synthetic oligonucleotide
  Target: SCN9A; (+) strand; PAM type: NRG; PAM sequence: GAG
aagttggaagggtgaataga

SEQ ID NO: 43153 - DNA, 20 bp, Artificial Sequence
  Description of Artificial Sequence: Synthetic oligonucleotide
  Target: SCN9A; (+) strand; PAM type: NRG; PAM sequence: AGG
agttggaagggtgaatagag

SEQ ID NO: 43154 - DNA, 20 bp, Artificial Sequence
  Description of Artificial Sequence: Synthetic oligonucleotide
  Target: SCN9A; (+) strand; PAM type: NRG; PAM sequence: GAG
ttggaagggtgaatagagag

SEQ ID NO: 43155 - DNA, 20 bp, Artificial Sequence
  Description of Artificial Sequence: Synthetic oligonucleotide
  Target: SCN9A; (+) strand; PAM type: NRG; PAM sequence: TAG
gaagggtgaatagagaggag

SEQ ID NO: 43156 - DNA, 20 bp, Artificial Sequence
  Description of Artificial Sequence: Synthetic oligonucleotide
  Target: SCN9A; (+) strand; PAM type: NRG; PAM sequence: AGG
aagggtgaatagagaggagt

SEQ ID NO: 43157 - DNA, 20 bp, Artificial Sequence
  Description of Artificial Sequence: Synthetic oligonucleotide
  Target: SCN9A; (+) strand; PAM type: NRG; PAM sequence: GGG
agggtgaatagagaggagta

SEQ ID NO: 43158 - DNA, 20 bp, Artificial Sequence
  Description of Artificial Sequence: Synthetic oligonucleotide
  Target: SCN9A; (+) strand; PAM type: NRG; PAM sequence: GGG
gggtgaatagagaggagtag

SEQ ID NO: 43159 - DNA, 20 bp, Artificial Sequence
  Description of Artificial Sequence: Synthetic oligonucleotide
  Target: SCN9A; (+) strand; PAM type: NRG; PAM sequence: AAG
aatagagaggagtaggggtg

SEQ ID NO: 43160 - DNA, 20 bp, Artificial Sequence
  Description of Artificial Sequence: Synthetic oligonucleotide
  Target: SCN9A; (+) strand; PAM type: NRG; PAM sequence: AAG
gagaggagtaggggtgaaga

SEQ ID NO: 43161 - DNA, 20 bp, Artificial Sequence
  Description of Artificial Sequence: Synthetic oligonucleotide
  Target: SCN9A; (+) strand; PAM type: NRG; PAM sequence: CAG
ggtgaagaaagtttcatacc

SEQ ID NO: 43162 - DNA, 20 bp, Artificial Sequence
  Description of Artificial Sequence: Synthetic oligonucleotide
  Target: SCN9A; (+) strand; PAM type: NRG; PAM sequence: TGG
ttcatacccagaaaaccatt

SEQ ID NO: 43163 - DNA, 20 bp, Artificial Sequence
  Description of Artificial Sequence: Synthetic oligonucleotide
  Target: SCN9A; (+) strand; PAM type: NRG; PAM sequence: TGG
ccagaaaaccatttggattc

SEQ ID NO: 43164 - DNA, 20 bp, Artificial Sequence
  Description of Artificial Sequence: Synthetic oligonucleotide
  Target: SCN9A; (+) strand; PAM type: NRG; PAM sequence: CAG
aaaccatttggattctggtc

SEQ ID NO: 43165 - DNA, 20 bp, Artificial Sequence
  Description of Artificial Sequence: Synthetic oligonucleotide
  Target: SCN9A; (+) strand; PAM type: NRG; PAM sequence: TGG
ttctggtccagtatcctgtc

SEQ ID NO: 43166 - DNA, 20 bp, Artificial Sequence
  Description of Artificial Sequence: Synthetic oligonucleotide
  Target: SCN9A; (+) strand; PAM type: NRG; PAM sequence: GAG
ctggtccagtatcctgtctg

SEQ ID NO: 43167 - DNA, 20 bp, Artificial Sequence
  Description of Artificial Sequence: Synthetic oligonucleotide
  Target: SCN9A; (+) strand; PAM type: NRG; PAM sequence: AGG
tggtccagtatcctgtctgg

SEQ ID NO: 43168 - DNA, 20 bp, Artificial Sequence
  Description of Artificial Sequence: Synthetic oligonucleotide
  Target: SCN9A; (+) strand; PAM type: NRG; PAM sequence: GGG
ggtccagtatcctgtctgga

SEQ ID NO: 43169 - DNA, 20 bp, Artificial Sequence
  Description of Artificial Sequence: Synthetic oligonucleotide
  Target: SCN9A; (+) strand; PAM type: NRG; PAM sequence: AAG
cagtatcctgtctggaggga

SEQ ID NO: 43170 - DNA, 20 bp, Artificial Sequence
  Description of Artificial Sequence: Synthetic oligonucleotide
  Target: SCN9A; (+) strand; PAM type: NRG; PAM sequence: TAG
tcctgtctggagggaaagat

SEQ ID NO: 43171 - DNA, 20 bp, Artificial Sequence
  Description of Artificial Sequence: Synthetic oligonucleotide
  Target: SCN9A; (+) strand; PAM type: NRG; PAM sequence: TAG
gtctggagggaaagattagt

SEQ ID NO: 43172 - DNA, 20 bp, Artificial Sequence
  Description of Artificial Sequence: Synthetic oligonucleotide
  Target: SCN9A; (+) strand; PAM type: NRG; PAM sequence: AGG
tctggagggaaagattagtt

SEQ ID NO: 43173 - DNA, 20 bp, Artificial Sequence
  Description of Artificial Sequence: Synthetic oligonucleotide
  Target: SCN9A; (+) strand; PAM type: NRG; PAM sequence: TAG
gggaaagattagttaggaac

SEQ ID NO: 43174 - DNA, 20 bp, Artificial Sequence
  Description of Artificial Sequence: Synthetic oligonucleotide
  Target: SCN9A; (+) strand; PAM type: NRG; PAM sequence: GAG
gaaagattagttaggaacta

SEQ ID NO: 43175 - DNA, 20 bp, Artificial Sequence
  Description of Artificial Sequence: Synthetic oligonucleotide
  Target: SCN9A; (+) strand; PAM type: NRG; PAM sequence: CAG
gttaggaactagagttgtaa

SEQ ID NO: 43176 - DNA, 20 bp, Artificial Sequence
  Description of Artificial Sequence: Synthetic oligonucleotide
  Target: SCN9A; (+) strand; PAM type: NRG; PAM sequence: AAG
actagagttgtaacagattc

SEQ ID NO: 43177 - DNA, 20 bp, Artificial Sequence
  Description of Artificial Sequence: Synthetic oligonucleotide
  Target: SCN9A; (+) strand; PAM type: NRG; PAM sequence: TGG
taacagattcaagacatatt

SEQ ID NO: 43178 - DNA, 20 bp, Artificial Sequence
  Description of Artificial Sequence: Synthetic oligonucleotide
  Target: SCN9A; (+) strand; PAM type: NRG; PAM sequence: CAG
cagattcaagacatatttgg

SEQ ID NO: 43179 - DNA, 20 bp, Artificial Sequence
  Description of Artificial Sequence: Synthetic oligonucleotide
  Target: SCN9A; (+) strand; PAM type: NRG; PAM sequence: CAG
acatatttggcagataaaat

SEQ ID NO: 43180 - DNA, 20 bp, Artificial Sequence
  Description of Artificial Sequence: Synthetic oligonucleotide
  Target: SCN9A; (+) strand; PAM type: NRG; PAM sequence: CAG
tatttggcagataaaatcag

SEQ ID NO: 43181 - DNA, 20 bp, Artificial Sequence
  Description of Artificial Sequence: Synthetic oligonucleotide
  Target: SCN9A; (+) strand; PAM type: NRG; PAM sequence: AGG
atttggcagataaaatcagc

SEQ ID NO: 43182 - DNA, 20 bp, Artificial Sequence
  Description of Artificial Sequence: Synthetic oligonucleotide
  Target: SCN9A; (+) strand; PAM type: NRG; PAM sequence: TGG
cagataaaatcagcaggatt

SEQ ID NO: 43183 - DNA, 20 bp, Artificial Sequence
  Description of Artificial Sequence: Synthetic oligonucleotide
  Target: SCN9A; (+) strand; PAM type: NRG; PAM sequence: TGG
agcaggatttggtgattgat

SEQ ID NO: 43184 - DNA, 20 bp, Artificial Sequence
  Description of Artificial Sequence: Synthetic oligonucleotide
  Target: SCN9A; (+) strand; PAM type: NRG; PAM sequence: AAG
attgattggatatcaaatgt

SEQ ID NO: 43185 - DNA, 20 bp, Artificial Sequence
  Description of Artificial Sequence: Synthetic oligonucleotide
  Target: SCN9A; (+) strand; PAM type: NRG; PAM sequence: GAG
tgattggatatcaaatgtaa

SEQ ID NO: 43186 - DNA, 20 bp, Artificial Sequence
  Description of Artificial Sequence: Synthetic oligonucleotide
  Target: SCN9A; (+) strand; PAM type: NRG; PAM sequence: AAG
tggatatcaaatgtaagaga

SEQ ID NO: 43187 - DNA, 20 bp, Artificial Sequence
  Description of Artificial Sequence: Synthetic oligonucleotide
  Target: SCN9A; (+) strand; PAM type: NRG; PAM sequence: AGG
ggatatcaaatgtaagagaa

SEQ ID NO: 43188 - DNA, 20 bp, Artificial Sequence
  Description of Artificial Sequence: Synthetic oligonucleotide
  Target: SCN9A; (+) strand; PAM type: NRG; PAM sequence: AAG
tatcaaatgtaagagaaagg

SEQ ID NO: 43189 - DNA, 20 bp, Artificial Sequence
  Description of Artificial Sequence: Synthetic oligonucleotide
  Target: SCN9A; (+) strand; PAM type: NRG; PAM sequence: AGG
atcaaatgtaagagaaagga

SEQ ID NO: 43190 - DNA, 20 bp, Artificial Sequence
  Description of Artificial Sequence: Synthetic oligonucleotide
  Target: SCN9A; (+) strand; PAM type: NRG; PAM sequence: CAG
gtaagagaaaggaaggatcc

SEQ ID NO: 43191 - DNA, 20 bp, Artificial Sequence
  Description of Artificial Sequence: Synthetic oligonucleotide
  Target: SCN9A; (+) strand; PAM type: NRG; PAM sequence: AGG
taagagaaaggaaggatccc

SEQ ID NO: 43192 - DNA, 20 bp, Artificial Sequence
  Description of Artificial Sequence: Synthetic oligonucleotide
  Target: SCN9A; (+) strand; PAM type: NRG; PAM sequence: CAG
aggaaggatcccaggactac

SEQ ID NO: 43193 - DNA, 20 bp, Artificial Sequence
  Description of Artificial Sequence: Synthetic oligonucleotide
  Target: SCN9A; (+) strand; PAM type: NRG; PAM sequence: AGG
ggaaggatcccaggactacc

SEQ ID NO: 43194 - DNA, 20 bp, Artificial Sequence
  Description of Artificial Sequence: Synthetic oligonucleotide
  Target: SCN9A; (+) strand; PAM type: NRG; PAM sequence: TGG
aggatcccaggactaccagg

SEQ ID NO: 43195 - DNA, 20 bp, Artificial Sequence
  Description of Artificial Sequence: Synthetic oligonucleotide
  Target: SCN9A; (+) strand; PAM type: NRG; PAM sequence: TAG
caggactaccaggtggatgt

SEQ ID NO: 43196 - DNA, 20 bp, Artificial Sequence
  Description of Artificial Sequence: Synthetic oligonucleotide
  Target: SCN9A; (+) strand; PAM type: NRG; PAM sequence: CAG
gactaccaggtggatgttag

SEQ ID NO: 43197 - DNA, 20 bp, Artificial Sequence
  Description of Artificial Sequence: Synthetic oligonucleotide
  Target: SCN9A; (+) strand; PAM type: NRG; PAM sequence: CAG
tagcagtgaattgaaaacca

SEQ ID NO: 43198 - DNA, 20 bp, Artificial Sequence
  Description of Artificial Sequence: Synthetic oligonucleotide
  Target: SCN9A; (+) strand; PAM type: NRG; PAM sequence: AGG
agcagtgaattgaaaaccac

SEQ ID NO: 43199 - DNA, 20 bp, Artificial Sequence
  Description of Artificial Sequence: Synthetic oligonucleotide
  Target: SCN9A; (+) strand; PAM type: NRG; PAM sequence: GAG
cagtgaattgaaaaccacag

SEQ ID NO: 43200 - DNA, 20 bp, Artificial Sequence
  Description of Artificial Sequence: Synthetic oligonucleotide
  Target: SCN9A; (+) strand; PAM type: NRG; PAM sequence: AGG
agtgaattgaaaaccacagg

SEQ ID NO: 43201 - DNA, 20 bp, Artificial Sequence
  Description of Artificial Sequence: Synthetic oligonucleotide
  Target: SCN9A; (+) strand; PAM type: NRG; PAM sequence: GAG
tgaattgaaaaccacaggag

SEQ ID NO: 43202 - DNA, 20 bp, Artificial Sequence
  Description of Artificial Sequence: Synthetic oligonucleotide
  Target: SCN9A; (+) strand; PAM type: NRG; PAM sequence: AGG
gaattgaaaaccacaggagg

SEQ ID NO: 43203 - DNA, 20 bp, Artificial Sequence
  Description of Artificial Sequence: Synthetic oligonucleotide
  Target: SCN9A; (+) strand; PAM type: NRG; PAM sequence: GAG
attgaaaaccacaggaggag

SEQ ID NO: 43204 - DNA, 20 bp, Artificial Sequence
  Description of Artificial Sequence: Synthetic oligonucleotide
  Target: SCN9A; (+) strand; PAM type: NRG; PAM sequence: CGG
cacaggaggaggagctgact

SEQ ID NO: 43205 - DNA, 20 bp, Artificial Sequence
  Description of Artificial Sequence: Synthetic oligonucleotide
  Target: SCN9A; (+) strand; PAM type: NRG; PAM sequence: CAG
aggaggaggagctgactcgg

SEQ ID NO: 43206 - DNA, 20 bp, Artificial Sequence
  Description of Artificial Sequence: Synthetic oligonucleotide
  Target: SCN9A; (+) strand; PAM type: NRG; PAM sequence: AGG
ggaggaggagctgactcggc

SEQ ID NO: 43207 - DNA, 20 bp, Artificial Sequence
  Description of Artificial Sequence: Synthetic oligonucleotide
  Target: SCN9A; (+) strand; PAM type: NRG; PAM sequence: GAG
actcggcaggtaatgatttt

SEQ ID NO: 43208 - DNA, 20 bp, Artificial Sequence
  Description of Artificial Sequence: Synthetic oligonucleotide
  Target: SCN9A; (+) strand; PAM type: NRG; PAM sequence: CAG
gcctgtgaattgtttaaata

SEQ ID NO: 43209 - DNA, 20 bp, Artificial Sequence
  Description of Artificial Sequence: Synthetic oligonucleotide
  Target: SCN9A; (+) strand; PAM type: NRG; PAM sequence: TAG
gtttaaatacagatatccta

SEQ ID NO: 43210 - DNA, 20 bp, Artificial Sequence
  Description of Artificial Sequence: Synthetic oligonucleotide
  Target: SCN9A; (+) strand; PAM type: NRG; PAM sequence: TGG
tatcctatagattttaaaaa

SEQ ID NO: 43211 - DNA, 20 bp, Artificial Sequence
  Description of Artificial Sequence: Synthetic oligonucleotide
  Target: SCN9A; (+) strand; PAM type: NRG; PAM sequence: GGG
atcctatagattttaaaaat

SEQ ID NO: 43212 - DNA, 20 bp, Artificial Sequence
  Description of Artificial Sequence: Synthetic oligonucleotide
  Target: SCN9A; (+) strand; PAM type: NRG; PAM sequence: GGG
tcctatagattttaaaaatg

SEQ ID NO: 43213 - DNA, 20 bp, Artificial Sequence
  Description of Artificial Sequence: Synthetic oligonucleotide
  Target: SCN9A; (+) strand; PAM type: NRG; PAM sequence: GGG
cctatagattttaaaaatgg

SEQ ID NO: 43214 - DNA, 20 bp, Artificial Sequence
  Description of Artificial Sequence: Synthetic oligonucleotide
  Target: SCN9A; (+) strand; PAM type: NRG; PAM sequence: TGG
atagattttaaaaatggggg

SEQ ID NO: 43215 - DNA, 20 bp, Artificial Sequence
  Description of Artificial Sequence: Synthetic oligonucleotide
  Target: SCN9A; (+) strand; PAM type: NRG; PAM sequence: GGG
tagattttaaaaatgggggt

SEQ ID NO: 43216 - DNA, 20 bp, Artificial Sequence
  Description of Artificial Sequence: Synthetic oligonucleotide
  Target: SCN9A; (+) strand; PAM type: NRG; PAM sequence: CGG
atgggggtgggaacctgaaa

SEQ ID NO: 43217 - DNA, 20 bp, Artificial Sequence
  Description of Artificial Sequence: Synthetic oligonucleotide
  Target: SCN9A; (+) strand; PAM type: NRG; PAM sequence: GGG
tgggggtgggaacctgaaac

SEQ ID NO: 43218 - DNA, 20 bp, Artificial Sequence
  Description of Artificial Sequence: Synthetic oligonucleotide
  Target: SCN9A; (+) strand; PAM type: NRG; PAM sequence: TAG
tgaaacgggaaaaacctgtc

SEQ ID NO: 43219 - DNA, 20 bp, Artificial Sequence
  Description of Artificial Sequence: Synthetic oligonucleotide
  Target: SCN9A; (+) strand; PAM type: NRG; PAM sequence: AAG
cgggaaaaacctgtctagaa

SEQ ID NO: 43220 - DNA, 20 bp, Artificial Sequence
  Description of Artificial Sequence: Synthetic oligonucleotide
  Target: SCN9A; (+) strand; PAM type: NRG; PAM sequence: TAG
cctgtctagaaaagaattct

SEQ ID NO: 43221 - DNA, 20 bp, Artificial Sequence
  Description of Artificial Sequence: Synthetic oligonucleotide
  Target: SCN9A; (+) strand; PAM type: NRG; PAM sequence: TAG
aaagaattcttagtaataat

SEQ ID NO: 43222 - DNA, 20 bp, Artificial Sequence
  Description of Artificial Sequence: Synthetic oligonucleotide
  Target: SCN9A; (+) strand; PAM type: NRG; PAM sequence: AAG
tagcatacatgtatctgctg

SEQ ID NO: 43223 - DNA, 20 bp, Artificial Sequence
  Description of Artificial Sequence: Synthetic oligonucleotide
  Target: SCN9A; (+) strand; PAM type: NRG; PAM sequence: CAG
atacatgtatctgctgaagt

SEQ ID NO: 43224 - DNA, 20 bp, Artificial Sequence
  Description of Artificial Sequence: Synthetic oligonucleotide
  Target: SCN9A; (+) strand; PAM type: NRG; PAM sequence: CAG
tgtatctgctgaagtcagaa

SEQ ID NO: 43225 - DNA, 20 bp, Artificial Sequence
  Description of Artificial Sequence: Synthetic oligonucleotide
  Target: SCN9A; (+) strand; PAM type: NRG; PAM sequence: GAG
ctgaagtcagaacagttttt

SEQ ID NO: 43226 - DNA, 20 bp, Artificial Sequence
  Description of Artificial Sequence: Synthetic oligonucleotide
  Target: SCN9A; (+) strand; PAM type: NRG; PAM sequence: AGG
tgaagtcagaacagtttttg

SEQ ID NO: 43227 - DNA, 20 bp, Artificial Sequence
  Description of Artificial Sequence: Synthetic oligonucleotide
  Target: SCN9A; (+) strand; PAM type: NRG; PAM sequence: AAG
agtttttgaggtcacacaaa

SEQ ID NO: 43228 - DNA, 20 bp, Artificial Sequence
  Description of Artificial Sequence: Synthetic oligonucleotide
  Target: SCN9A; (+) strand; PAM type: NRG; PAM sequence: GAG
tttttgaggtcacacaaaaa

SEQ ID NO: 43229 - DNA, 20 bp, Artificial Sequence
  Description of Artificial Sequence: Synthetic oligonucleotide
  Target: SCN9A; (+) strand; PAM type: NRG; PAM sequence: TAG
ggtcacacaaaaagagtatt

SEQ ID NO: 43230 - DNA, 20 bp, Artificial Sequence
  Description of Artificial Sequence: Synthetic oligonucleotide
  Target: SCN9A; (+) strand; PAM type: NRG; PAM sequence: AGG
gtcacacaaaaagagtattt

SEQ ID NO: 43231 - DNA, 20 bp, Artificial Sequence
  Description of Artificial Sequence: Synthetic oligonucleotide
  Target: SCN9A; (+) strand; PAM type: NRG; PAM sequence: GGG
tcacacaaaaagagtattta

SEQ ID NO: 43232 - DNA, 20 bp, Artificial Sequence
  Description of Artificial Sequence: Synthetic oligonucleotide
  Target: SCN9A; (+) strand; PAM type: NRG; PAM sequence: GAG
acaaaaagagtatttagggt

SEQ ID NO: 43233 - DNA, 20 bp, Artificial Sequence
  Description of Artificial Sequence: Synthetic oligonucleotide
  Target: SCN9A; (+) strand; PAM type: NRG; PAM sequence: CAG
aaaagagtatttagggtgag

SEQ ID NO: 43234 - DNA, 20 bp, Artificial Sequence
  Description of Artificial Sequence: Synthetic oligonucleotide
  Target: SCN9A; (+) strand; PAM type: NRG; PAM sequence: AAG
gtatttagggtgagcagaaa

SEQ ID NO: 43235 - DNA, 20 bp, Artificial Sequence
  Description of Artificial Sequence: Synthetic oligonucleotide
  Target: SCN9A; (+) strand; PAM type: NRG; PAM sequence: AGG
tatttagggtgagcagaaaa

SEQ ID NO: 43236 - DNA, 20 bp, Artificial Sequence
  Description of Artificial Sequence: Synthetic oligonucleotide
  Target: SCN9A; (+) strand; PAM type: NRG; PAM sequence: GGG
atttagggtgagcagaaaaa

SEQ ID NO: 43237 - DNA, 20 bp, Artificial Sequence
  Description of Artificial Sequence: Synthetic oligonucleotide
  Target: SCN9A; (+) strand; PAM type: NRG; PAM sequence: AAG
cattctgaaacaacaatatt

SEQ ID NO: 43238 - DNA, 20 bp, Artificial Sequence
  Description of Artificial Sequence: Synthetic oligonucleotide
  Target: SCN9A; (+) strand; PAM type: NRG; PAM sequence: AGG
attctgaaacaacaatatta

SEQ ID NO: 43239 - DNA, 20 bp, Artificial Sequence
  Description of Artificial Sequence: Synthetic oligonucleotide
  Target: SCN9A; (+) strand; PAM type: NRG; PAM sequence: GGG
ttctgaaacaacaatattaa

SEQ ID NO: 43240 - DNA, 20 bp, Artificial Sequence
  Description of Artificial Sequence: Synthetic oligonucleotide
  Target: SCN9A; (+) strand; PAM type: NRG; PAM sequence: GAG
ctgaaacaacaatattaagg

SEQ ID NO: 43241 - DNA, 20 bp, Artificial Sequence
  Description of Artificial Sequence: Synthetic oligonucleotide
  Target: SCN9A; (+) strand; PAM type: NRG; PAM sequence: GAG
gaaacaacaatattaaggga

SEQ ID NO: 43242 - DNA, 20 bp, Artificial Sequence
  Description of Artificial Sequence: Synthetic oligonucleotide
  Target: SCN9A; (+) strand; PAM type: NRG; PAM sequence: TGG
tattaagggagagaattcaa

SEQ ID NO: 43243 - DNA, 20 bp, Artificial Sequence
  Description of Artificial Sequence: Synthetic oligonucleotide
  Target: SCN9A; (+) strand; PAM type: NRG; PAM sequence: AAG
agaattcaatggtgtgctga

SEQ ID NO: 43244 - DNA, 20 bp, Artificial Sequence
  Description of Artificial Sequence: Synthetic oligonucleotide
  Target: SCN9A; (+) strand; PAM type: NRG; PAM sequence: CAG
attcaatggtgtgctgaaag

SEQ ID NO: 43245 - DNA, 20 bp, Artificial Sequence
  Description of Artificial Sequence: Synthetic oligonucleotide
  Target: SCN9A; (+) strand; PAM type: NRG; PAM sequence: CAG
aattcttgttgttaaactgt

SEQ ID NO: 43246 - DNA, 20 bp, Artificial Sequence
  Description of Artificial Sequence: Synthetic oligonucleotide
  Target: SCN9A; (+) strand; PAM type: NRG; PAM sequence: AAG
tcctgcttgtctgttgttaa

SEQ ID NO: 43247 - DNA, 20 bp, Artificial Sequence
  Description of Artificial Sequence: Synthetic oligonucleotide
  Target: SCN9A; (+) strand; PAM type: NRG; PAM sequence: CAG
tgcttgtctgttgttaaaag

SEQ ID NO: 43248 - DNA, 20 bp, Artificial Sequence
  Description of Artificial Sequence: Synthetic oligonucleotide
  Target: SCN9A; (+) strand; PAM type: NRG; PAM sequence: TAG
aatatttgactatataaact

SEQ ID NO: 43249 - DNA, 20 bp, Artificial Sequence
  Description of Artificial Sequence: Synthetic oligonucleotide
  Target: SCN9A; (+) strand; PAM type: NRG; PAM sequence: AAG
agaattctataacttacctt

SEQ ID NO: 43250 - DNA, 20 bp, Artificial Sequence
  Description of Artificial Sequence: Synthetic oligonucleotide
  Target: SCN9A; (+) strand; PAM type: NRG; PAM sequence: AGG
gaattctataacttacctta

SEQ ID NO: 43251 - DNA, 20 bp, Artificial Sequence
  Description of Artificial Sequence: Synthetic oligonucleotide
  Target: SCN9A; (+) strand; PAM type: NRG; PAM sequence: AAG
tctataacttaccttaagga

SEQ ID NO: 43252 - DNA, 20 bp, Artificial Sequence
  Description of Artificial Sequence: Synthetic oligonucleotide
  Target: SCN9A; (+) strand; PAM type: NRG; PAM sequence: AGG
ctataacttaccttaaggaa

SEQ ID NO: 43253 - DNA, 20 bp, Artificial Sequence
  Description of Artificial Sequence: Synthetic oligonucleotide
  Target: SCN9A; (+) strand; PAM type: NRG; PAM sequence: AAG
aaggaaaggtaataaatact

SEQ ID NO: 43254 - DNA, 20 bp, Artificial Sequence
  Description of Artificial Sequence: Synthetic oligonucleotide
  Target: SCN9A; (+) strand; PAM type: NRG; PAM sequence: TAG
atttgtctattccgtttgaa

SEQ ID NO: 43255 - DNA, 20 bp, Artificial Sequence
  Description of Artificial Sequence: Synthetic oligonucleotide
  Target: SCN9A; (+) strand; PAM type: NRG; PAM sequence: CAG
tgtctattccgtttgaatag

SEQ ID NO: 43256 - DNA, 20 bp, Artificial Sequence
  Description of Artificial Sequence: Synthetic oligonucleotide
  Target: SCN9A; (+) strand; PAM type: NRG; PAM sequence: AAG
ctattccgtttgaatagcag

SEQ ID NO: 43257 - DNA, 20 bp, Artificial Sequence
  Description of Artificial Sequence: Synthetic oligonucleotide
  Target: SCN9A; (+) strand; PAM type: NRG; PAM sequence: TGG
ccgtttgaatagcagaagta

SEQ ID NO: 43258 - DNA, 20 bp, Artificial Sequence
  Description of Artificial Sequence: Synthetic oligonucleotide
  Target: SCN9A; (+) strand; PAM type: NRG; PAM sequence: CGG
gcagaagtatggcatactgt

SEQ ID NO: 43259 - DNA, 20 bp, Artificial Sequence
  Description of Artificial Sequence: Synthetic oligonucleotide
  Target: SCN9A; (+) strand; PAM type: NRG; PAM sequence: GGG
cagaagtatggcatactgtc

SEQ ID NO: 43260 - DNA, 20 bp, Artificial Sequence
  Description of Artificial Sequence: Synthetic oligonucleotide
  Target: SCN9A; (+) strand; PAM type: NRG; PAM sequence: TGG
tattgtgcatctcttctttc

SEQ ID NO: 43261 - DNA, 20 bp, Artificial Sequence
  Description of Artificial Sequence: Synthetic oligonucleotide
  Target: SCN9A; (+) strand; PAM type: NRG; PAM sequence: CGG
gtgcatctcttctttctgga

SEQ ID NO: 43262 - DNA, 20 bp, Artificial Sequence
  Description of Artificial Sequence: Synthetic oligonucleotide
  Target: SCN9A; (+) strand; PAM type: NRG; PAM sequence: TGG
catctcttctttctggacgg

SEQ ID NO: 43263 - DNA, 20 bp, Artificial Sequence
  Description of Artificial Sequence: Synthetic oligonucleotide
  Target: SCN9A; (+) strand; PAM type: NRG; PAM sequence: TGG
ggacggtggtctattctctc

SEQ ID NO: 43264 - DNA, 20 bp, Artificial Sequence
  Description of Artificial Sequence: Synthetic oligonucleotide
  Target: SCN9A; (+) strand; PAM type: NRG; PAM sequence: TGG
tctctctggattattctctc

SEQ ID NO: 43265 - DNA, 20 bp, Artificial Sequence
  Description of Artificial Sequence: Synthetic oligonucleotide
  Target: SCN9A; (+) strand; PAM type: NRG; PAM sequence: CAG
tctggattattctctctgga

SEQ ID NO: 43266 - DNA, 20 bp, Artificial Sequence
  Description of Artificial Sequence: Synthetic oligonucleotide
  Target: SCN9A; (+) strand; PAM type: NRG; PAM sequence: TAG
ggattattctctctggacag

SEQ ID NO: 43267 - DNA, 20 bp, Artificial Sequence
  Description of Artificial Sequence: Synthetic oligonucleotide
  Target: SCN9A; (+) strand; PAM type: NRG; PAM sequence: TGG
gtagtaatatgctatactat

SEQ ID NO: 43268 - DNA, 20 bp, Artificial Sequence
  Description of Artificial Sequence: Synthetic oligonucleotide
  Target: SCN9A; (+) strand; PAM type: NRG; PAM sequence: GGG
tagtaatatgctatactatt

SEQ ID NO: 43269 - DNA, 20 bp, Artificial Sequence
  Description of Artificial Sequence: Synthetic oligonucleotide
  Target: SCN9A; (+) strand; PAM type: NRG; PAM sequence: TGG
tactgtgcaactcttctttc

SEQ ID NO: 43270 - DNA, 20 bp, Artificial Sequence
  Description of Artificial Sequence: Synthetic oligonucleotide
  Target: SCN9A; (+) strand; PAM type: NRG; PAM sequence: TGG
caactcttctttctggatgc

SEQ ID NO: 43271 - DNA, 20 bp, Artificial Sequence
  Description of Artificial Sequence: Synthetic oligonucleotide
  Target: SCN9A; (+) strand; PAM type: NRG; PAM sequence: TGG
ggatgctggtctattctatc

SEQ ID NO: 43272 - DNA, 20 bp, Artificial Sequence
  Description of Artificial Sequence: Synthetic oligonucleotide
  Target: SCN9A; (+) strand; PAM type: NRG; PAM sequence: TGG
tctatctggcctattctatc

SEQ ID NO: 43273 - DNA, 20 bp, Artificial Sequence
  Description of Artificial Sequence: Synthetic oligonucleotide
  Target: SCN9A; (+) strand; PAM type: NRG; PAM sequence: TGG
tctggcctattctatctgga

SEQ ID NO: 43274 - DNA, 20 bp, Artificial Sequence
  Description of Artificial Sequence: Synthetic oligonucleotide
  Target: SCN9A; (+) strand; PAM type: NRG; PAM sequence: TGG
ggcctattctatctggatgg

SEQ ID NO: 43275 - DNA, 20 bp, Artificial Sequence
  Description of Artificial Sequence: Synthetic oligonucleotide
  Target: SCN9A; (+) strand; PAM type: NRG; PAM sequence: AAG
ctattctatctggatggtgg

SEQ ID NO: 43276 - DNA, 20 bp, Artificial Sequence
  Description of Artificial Sequence: Synthetic oligonucleotide
  Target: SCN9A; (+) strand; PAM type: NRG; PAM sequence: GAG
tggaagtatgtcacactgtt

SEQ ID NO: 43277 - DNA, 20 bp, Artificial Sequence
  Description of Artificial Sequence: Synthetic oligonucleotide
  Target: SCN9A; (+) strand; PAM type: NRG; PAM sequence: TAG
tctcttcttaactctgcatt

SEQ ID NO: 43278 - DNA, 20 bp, Artificial Sequence
  Description of Artificial Sequence: Synthetic oligonucleotide
  Target: SCN9A; (+) strand; PAM type: NRG; PAM sequence: CAG
tgcatttagcaatttcacat

SEQ ID NO: 43279 - DNA, 20 bp, Artificial Sequence
  Description of Artificial Sequence: Synthetic oligonucleotide
  Target: SCN9A; (+) strand; PAM type: NRG; PAM sequence: TAG
atttagcaatttcacatcag

SEQ ID NO: 43280 - DNA, 20 bp, Artificial Sequence
  Description of Artificial Sequence: Synthetic oligonucleotide
  Target: SCN9A; (+) strand; PAM type: NRG; PAM sequence: CAG
tcacatcagtagtttgaaat

SEQ ID NO: 43281 - DNA, 20 bp, Artificial Sequence
  Description of Artificial Sequence: Synthetic oligonucleotide
  Target: SCN9A; (+) strand; PAM type: NRG; PAM sequence: TGG
cagtagtttgaaatcagtga

SEQ ID NO: 43282 - DNA, 20 bp, Artificial Sequence
  Description of Artificial Sequence: Synthetic oligonucleotide
  Target: SCN9A; (+) strand; PAM type: NRG; PAM sequence: TGG
tagtttgaaatcagtgatgg

SEQ ID NO: 43283 - DNA, 20 bp, Artificial Sequence
  Description of Artificial Sequence: Synthetic oligonucleotide
  Target: SCN9A; (+) strand; PAM type: NRG; PAM sequence: GGG
agtttgaaatcagtgatggt

SEQ ID NO: 43284 - DNA, 20 bp, Artificial Sequence
  Description of Artificial Sequence: Synthetic oligonucleotide
  Target: SCN9A; (+) strand; PAM type: NRG; PAM sequence: AAG
tttacattacaaaaatctcc

SEQ ID NO: 43285 - DNA, 20 bp, Artificial Sequence
  Description of Artificial Sequence: Synthetic oligonucleotide
  Target: SCN9A; (+) strand; PAM type: NRG; PAM sequence: GAG
aatctccaagcactacaaat

SEQ ID NO: 43286 - DNA, 20 bp, Artificial Sequence
  Description of Artificial Sequence: Synthetic oligonucleotide
  Target: SCN9A; (+) strand; PAM type: NRG; PAM sequence: GAG
tctccaagcactacaaatga

SEQ ID NO: 43287 - DNA, 20 bp, Artificial Sequence
  Description of Artificial Sequence: Synthetic oligonucleotide
  Target: SCN9A; (+) strand; PAM type: NRG; PAM sequence: TAG
atgagagcttcttgattttc

SEQ ID NO: 43288 - DNA, 20 bp, Artificial Sequence
  Description of Artificial Sequence: Synthetic oligonucleotide
  Target: SCN9A; (+) strand; PAM type: NRG; PAM sequence: GAG
gagagcttcttgattttcta

SEQ ID NO: 43289 - DNA, 20 bp, Artificial Sequence
  Description of Artificial Sequence: Synthetic oligonucleotide
  Target: SCN9A; (+) strand; PAM type: NRG; PAM sequence: TAG
agcttcttgattttctagag

SEQ ID NO: 43290 - DNA, 20 bp, Artificial Sequence
  Description of Artificial Sequence: Synthetic oligonucleotide
  Target: SCN9A; (+) strand; PAM type: NRG; PAM sequence: AAG
tgattttctagagtagaatt

SEQ ID NO: 43291 - DNA, 20 bp, Artificial Sequence
  Description of Artificial Sequence: Synthetic oligonucleotide
  Target: SCN9A; (+) strand; PAM type: NRG; PAM sequence: AAG
ttttctagagtagaattaag

SEQ ID NO: 43292 - DNA, 20 bp, Artificial Sequence
  Description of Artificial Sequence: Synthetic oligonucleotide
  Target: SCN9A; (+) strand; PAM type: NRG; PAM sequence: AGG
tttctagagtagaattaaga

SEQ ID NO: 43293 - DNA, 20 bp, Artificial Sequence
  Description of Artificial Sequence: Synthetic oligonucleotide
  Target: SCN9A; (+) strand; PAM type: NRG; PAM sequence: TGG
gagtagaattaagaaggtga

SEQ ID NO: 43294 - DNA, 20 bp, Artificial Sequence
  Description of Artificial Sequence: Synthetic oligonucleotide
  Target: SCN9A; (+) strand; PAM type: NRG; PAM sequence: GAG
gtagaattaagaaggtgatg

SEQ ID NO: 43295 - DNA, 20 bp, Artificial Sequence
  Description of Artificial Sequence: Synthetic oligonucleotide
  Target: SCN9A; (+) strand; PAM type: NRG; PAM sequence: AGG
tagaattaagaaggtgatgg

SEQ ID NO: 43296 - DNA, 20 bp, Artificial Sequence
  Description of Artificial Sequence: Synthetic oligonucleotide
  Target: SCN9A; (+) strand; PAM type: NRG; PAM sequence: CAG
tggaggaaatgccaataaaa

SEQ ID NO: 43297 - DNA, 20 bp, Artificial Sequence
  Description of Artificial Sequence: Synthetic oligonucleotide
  Target: SCN9A; (+) strand; PAM type: NRG; PAM sequence: CAG
atgccaataaaacagataaa

SEQ ID NO: 43298 - DNA, 20 bp, Artificial Sequence
  Description of Artificial Sequence: Synthetic oligonucleotide
  Target: SCN9A; (+) strand; PAM type: NRG; PAM sequence: AAG
aataaaacagataaacagtc

SEQ ID NO: 43299 - DNA, 20 bp, Artificial Sequence
  Description of Artificial Sequence: Synthetic oligonucleotide
  Target: SCN9A; (+) strand; PAM type: NRG; PAM sequence: AGG
ataaaacagataaacagtca

SEQ ID NO: 43300 - DNA, 20 bp, Artificial Sequence
  Description of Artificial Sequence: Synthetic oligonucleotide
  Target: SCN9A; (+) strand; PAM type: NRG; PAM sequence: TAG
gtcaaggtgtattgtgtttg

SEQ ID NO: 43301 - DNA, 20 bp, Artificial Sequence
  Description of Artificial Sequence: Synthetic oligonucleotide
  Target: SCN9A; (+) strand; PAM type: NRG; PAM sequence: TAG
tttgtagccattactctgaa

SEQ ID NO: 43302 - DNA, 20 bp, Artificial Sequence
  Description of Artificial Sequence: Synthetic oligonucleotide
  Target: SCN9A; (+) strand; PAM type: NRG; PAM sequence: GAG
tgcttacatcactgatgaat

SEQ ID NO: 43303 - DNA, 20 bp, Artificial Sequence
  Description of Artificial Sequence: Synthetic oligonucleotide
  Target: SCN9A; (+) strand; PAM type: NRG; PAM sequence: AAG
acatcactgatgaatgagta

SEQ ID NO: 43304 - DNA, 20 bp, Artificial Sequence
  Description of Artificial Sequence: Synthetic oligonucleotide
  Target: SCN9A; (+) strand; PAM type: NRG; PAM sequence: TAG
atgagtaaagttctgacata

SEQ ID NO: 43305 - DNA, 20 bp, Artificial Sequence
  Description of Artificial Sequence: Synthetic oligonucleotide
  Target: SCN9A; (+) strand; PAM type: NRG; PAM sequence: AAG
cactgactaacataaatatc

SEQ ID NO: 43306 - DNA, 20 bp, Artificial Sequence
  Description of Artificial Sequence: Synthetic oligonucleotide
  Target: SCN9A; (+) strand; PAM type: NRG; PAM sequence: CAG
tgactaacataaatatcaag

SEQ ID NO: 43307 - DNA, 20 bp, Artificial Sequence
  Description of Artificial Sequence: Synthetic oligonucleotide
  Target: SCN9A; (+) strand; PAM type: NRG; PAM sequence: TAG
ctaaaactatacttgtttat

SEQ ID NO: 43308 - DNA, 20 bp, Artificial Sequence
  Description of Artificial Sequence: Synthetic oligonucleotide
  Target: SCN9A; (+) strand; PAM type: NRG; PAM sequence: TAG
ttgtttattagctgcaaaaa

SEQ ID NO: 43309 - DNA, 20 bp, Artificial Sequence
  Description of Artificial Sequence: Synthetic oligonucleotide
  Target: SCN9A; (+) strand; PAM type: NRG; PAM sequence: AGG
tgtttattagctgcaaaaat

SEQ ID NO: 43310 - DNA, 20 bp, Artificial Sequence
  Description of Artificial Sequence: Synthetic oligonucleotide
  Target: SCN9A; (+) strand; PAM type: NRG; PAM sequence: AAG
taggttgcctatacatgcaa

SEQ ID NO: 43311 - DNA, 20 bp, Artificial Sequence
  Description of Artificial Sequence: Synthetic oligonucleotide
  Target: SCN9A; (+) strand; PAM type: NRG; PAM sequence: TGG
tgcctatacatgcaaaagtt

SEQ ID NO: 43312 - DNA, 20 bp, Artificial Sequence
  Description of Artificial Sequence: Synthetic oligonucleotide
  Target: SCN9A; (+) strand; PAM type: NRG; PAM sequence: AAG
atacatgcaaaagtttggca

SEQ ID NO: 43313 - DNA, 20 bp, Artificial Sequence
  Description of Artificial Sequence: Synthetic oligonucleotide
  Target: SCN9A; (+) strand; PAM type: NRG; PAM sequence: AAG
agtttggcaaagttcaaaaa

SEQ ID NO: 43314 - DNA, 20 bp, Artificial Sequence
  Description of Artificial Sequence: Synthetic oligonucleotide
  Target: SCN9A; (+) strand; PAM type: NRG; PAM sequence: GAG
gttcaaaaaaagcattcttt

SEQ ID NO: 43315 - DNA, 20 bp, Artificial Sequence
  Description of Artificial Sequence: Synthetic oligonucleotide
  Target: SCN9A; (+) strand; PAM type: NRG; PAM sequence: CAG
ttgagaaacaatttgatata

SEQ ID NO: 43316 - DNA, 20 bp, Artificial Sequence
  Description of Artificial Sequence: Synthetic oligonucleotide
  Target: SCN9A; (+) strand; PAM type: NRG; PAM sequence: AAG
tatacagaatgttcaataaa

SEQ ID NO: 43317 - DNA, 20 bp, Artificial Sequence
  Description of Artificial Sequence: Synthetic oligonucleotide
  Target: SCN9A; (+) strand; PAM type: NRG; PAM sequence: CAG
tgtgtcatatatcctaatat

SEQ ID NO: 43318 - DNA, 20 bp, Artificial Sequence
  Description of Artificial Sequence: Synthetic oligonucleotide
  Target: SCN9A; (+) strand; PAM type: NRG; PAM sequence: TAG
cctaatatcagtaaaattta

SEQ ID NO: 43319 - DNA, 20 bp, Artificial Sequence
  Description of Artificial Sequence: Synthetic oligonucleotide
  Target: SCN9A; (+) strand; PAM type: NRG; PAM sequence: AAG
aaatttatagtaaatgatat

SEQ ID NO: 43320 - DNA, 20 bp, Artificial Sequence
  Description of Artificial Sequence: Synthetic oligonucleotide
  Target: SCN9A; (+) strand; PAM type: NRG; PAM sequence: TGG
tacacattttttattttcct

SEQ ID NO: 43321 - DNA, 20 bp, Artificial Sequence
  Description of Artificial Sequence: Synthetic oligonucleotide
  Target: SCN9A; (+) strand; PAM type: NRG; PAM sequence: GAG
cacattttttattttccttg

SEQ ID NO: 43322 - DNA, 20 bp, Artificial Sequence
  Description of Artificial Sequence: Synthetic oligonucleotide
  Target: SCN9A; (+) strand; PAM type: NRG; PAM sequence: CAG
ttttattttccttggagaac

SEQ ID NO: 43323 - DNA, 20 bp, Artificial Sequence
  Description of Artificial Sequence: Synthetic oligonucleotide
  Target: SCN9A; (+) strand; PAM type: NRG; PAM sequence: TAG
aatatttacctacacatcac

SEQ ID NO: 43324 - DNA, 20 bp, Artificial Sequence
  Description of Artificial Sequence: Synthetic oligonucleotide
  Target: SCN9A; (+) strand; PAM type: NRG; PAM sequence: AGG
atatttacctacacatcact

SEQ ID NO: 43325 - DNA, 20 bp, Artificial Sequence
  Description of Artificial Sequence: Synthetic oligonucleotide
  Target: SCN9A; (+) strand; PAM type: NRG; PAM sequence: CAG
ttacctacacatcactagga

SEQ ID NO: 43326 - DNA, 20 bp, Artificial Sequence
  Description of Artificial Sequence: Synthetic oligonucleotide
  Target: SCN9A; (+) strand; PAM type: NRG; PAM sequence: AGG
tacctacacatcactaggac

SEQ ID NO: 43327 - DNA, 20 bp, Artificial Sequence
  Description of Artificial Sequence: Synthetic oligonucleotide
  Target: SCN9A; (+) strand; PAM type: NRG; PAM sequence: TAG
ctacacatcactaggacagg

SEQ ID NO: 43328 - DNA, 20 bp, Artificial Sequence
  Description of Artificial Sequence: Synthetic oligonucleotide
  Target: SCN9A; (+) strand; PAM type: NRG; PAM sequence: GAG
acacatcactaggacaggta

SEQ ID NO: 43329 - DNA, 20 bp, Artificial Sequence
  Description of Artificial Sequence: Synthetic oligonucleotide
  Target: SCN9A; (+) strand; PAM type: NRG; PAM sequence: AGG
cacatcactaggacaggtag

SEQ ID NO: 43330 - DNA, 20 bp, Artificial Sequence
  Description of Artificial Sequence: Synthetic oligonucleotide
  Target: SCN9A; (+) strand; PAM type: NRG; PAM sequence: GAG
catcactaggacaggtagag

SEQ ID NO: 43331 - DNA, 20 bp, Artificial Sequence
  Description of Artificial Sequence: Synthetic oligonucleotide
  Target: SCN9A; (+) strand; PAM type: NRG; PAM sequence: AAG
aggtagaggagaaaactttg

SEQ ID NO: 43332 - DNA, 20 bp, Artificial Sequence
  Description of Artificial Sequence: Synthetic oligonucleotide
  Target: SCN9A; (+) strand; PAM type: NRG; PAM sequence: TAG
tagaggagaaaactttgaag

SEQ ID NO: 43333 - DNA, 20 bp, Artificial Sequence
  Description of Artificial Sequence: Synthetic oligonucleotide
  Target: SCN9A; (+) strand; PAM type: NRG; PAM sequence: GAG
aactttgaagtagatgaaat

SEQ ID NO: 43334 - DNA, 20 bp, Artificial Sequence
  Description of Artificial Sequence: Synthetic oligonucleotide
  Target: SCN9A; (+) strand; PAM type: NRG; PAM sequence: GAG
ctttgaagtagatgaaatga

SEQ ID NO: 43335 - DNA, 20 bp, Artificial Sequence
  Description of Artificial Sequence: Synthetic oligonucleotide
  Target: SCN9A; (+) strand; PAM type: NRG; PAM sequence: AAG
agatgaaatgagagatgaac

SEQ ID NO: 43336 - DNA, 20 bp, Artificial Sequence
  Description of Artificial Sequence: Synthetic oligonucleotide
  Target: SCN9A; (+) strand; PAM type: NRG; PAM sequence: AAG
tgaaatgagagatgaacaag

SEQ ID NO: 43337 - DNA, 20 bp, Artificial Sequence
  Description of Artificial Sequence: Synthetic oligonucleotide
  Target: SCN9A; (+) strand; PAM type: NRG; PAM sequence: AGG
gaaatgagagatgaacaaga

SEQ ID NO: 43338 - DNA, 20 bp, Artificial Sequence
  Description of Artificial Sequence: Synthetic oligonucleotide
  Target: SCN9A; (+) strand; PAM type: NRG; PAM sequence: AAG
agagatgaacaagaaggacc

SEQ ID NO: 43339 - DNA, 20 bp, Artificial Sequence
  Description of Artificial Sequence: Synthetic oligonucleotide
  Target: SCN9A; (+) strand; PAM type: NRG; PAM sequence: GAG
agatgaacaagaaggaccaa

SEQ ID NO: 43340 - DNA, 20 bp, Artificial Sequence
  Description of Artificial Sequence: Synthetic oligonucleotide
  Target: SCN9A; (+) strand; PAM type: NRG; PAM sequence: AGG
gatgaacaagaaggaccaag

SEQ ID NO: 43341 - DNA, 20 bp, Artificial Sequence
  Description of Artificial Sequence: Synthetic oligonucleotide
  Target: SCN9A; (+) strand; PAM type: NRG; PAM sequence: GGG
atgaacaagaaggaccaaga

SEQ ID NO: 43342 - DNA, 20 bp, Artificial Sequence
  Description of Artificial Sequence: Synthetic oligonucleotide
  Target: SCN9A; (+) strand; PAM type: NRG; PAM sequence: CAG
caagaaggaccaagagggtg

SEQ ID NO: 43343 - DNA, 20 bp, Artificial Sequence
  Description of Artificial Sequence: Synthetic oligonucleotide
  Target: SCN9A; (+) strand; PAM type: NRG; PAM sequence: AAG
ggaccaagagggtgcagtaa

SEQ ID NO: 43344 - DNA, 20 bp, Artificial Sequence
  Description of Artificial Sequence: Synthetic oligonucleotide
  Target: SCN9A; (+) strand; PAM type: NRG; PAM sequence: GAG
accaagagggtgcagtaaaa

SEQ ID NO: 43345 - DNA, 20 bp, Artificial Sequence
  Description of Artificial Sequence: Synthetic oligonucleotide
  Target: SCN9A; (+) strand; PAM type: NRG; PAM sequence: AAG
gtgcagtaaaagagaaacca

SEQ ID NO: 43346 - DNA, 20 bp, Artificial Sequence
  Description of Artificial Sequence: Synthetic oligonucleotide
  Target: SCN9A; (+) strand; PAM type: NRG; PAM sequence: GAG
gcagtaaaagagaaaccaaa

SEQ ID NO: 43347 - DNA, 20 bp, Artificial Sequence
  Description of Artificial Sequence: Synthetic oligonucleotide
  Target: SCN9A; (+) strand; PAM type: NRG; PAM sequence: AAG
aagagaaaccaaagagtaaa

SEQ ID NO: 43348 - DNA, 20 bp, Artificial Sequence
  Description of Artificial Sequence: Synthetic oligonucleotide
  Target: SCN9A; (+) strand; PAM type: NRG; PAM sequence: AAG
caaagagtaaaaagttttat

SEQ ID NO: 43349 - DNA, 20 bp, Artificial Sequence
  Description of Artificial Sequence: Synthetic oligonucleotide
  Target: SCN9A; (+) strand; PAM type: NRG; PAM sequence: AAG
agagtaaaaagttttataag

SEQ ID NO: 43350 - DNA, 20 bp, Artificial Sequence
  Description of Artificial Sequence: Synthetic oligonucleotide
  Target: SCN9A; (+) strand; PAM type: NRG; PAM sequence: CAG
gttttataagaagtgataaa

SEQ ID NO: 43351 - DNA, 20 bp, Artificial Sequence
  Description of Artificial Sequence: Synthetic oligonucleotide
  Target: SCN9A; (+) strand; PAM type: NRG; PAM sequence: GAG
tttataagaagtgataaaca

SEQ ID NO: 43352 - DNA, 20 bp, Artificial Sequence
  Description of Artificial Sequence: Synthetic oligonucleotide
  Target: SCN9A; (+) strand; PAM type: NRG; PAM sequence: AAG
ataaacagagctatgaacat

SEQ ID NO: 43353 - DNA, 20 bp, Artificial Sequence
  Description of Artificial Sequence: Synthetic oligonucleotide
  Target: SCN9A; (+) strand; PAM type: NRG; PAM sequence: GAG
aaacagagctatgaacataa

SEQ ID NO: 43354 - DNA, 20 bp, Artificial Sequence
  Description of Artificial Sequence: Synthetic oligonucleotide
  Target: SCN9A; (+) strand; PAM type: NRG; PAM sequence: AGG
aacagagctatgaacataag

SEQ ID NO: 43355 - DNA, 20 bp, Artificial Sequence
  Description of Artificial Sequence: Synthetic oligonucleotide
  Target: SCN9A; (+) strand; PAM type: NRG; PAM sequence: CAG
agctatgaacataagaggcc

SEQ ID NO: 43356 - DNA, 20 bp, Artificial Sequence
  Description of Artificial Sequence: Synthetic oligonucleotide
  Target: SCN9A; (+) strand; PAM type: NRG; PAM sequence: AAG
atgaacataagaggcccaga

SEQ ID NO: 43357 - DNA, 20 bp, Artificial Sequence
  Description of Artificial Sequence: Synthetic oligonucleotide
  Target: SCN9A; (+) strand; PAM type: NRG; PAM sequence: GAG
gaacataagaggcccagaaa

SEQ ID NO: 43358 - DNA, 20 bp, Artificial Sequence
  Description of Artificial Sequence: Synthetic oligonucleotide
  Target: SCN9A; (+) strand; PAM type: NRG; PAM sequence: AAG
gaaaaattttaatcaattta

SEQ ID NO: 43359 - DNA, 20 bp, Artificial Sequence
  Description of Artificial Sequence: Synthetic oligonucleotide
  Target: SCN9A; (+) strand; PAM type: NRG; PAM sequence: AAG
aatcaatttaaagtttatta

SEQ ID NO: 43360 - DNA, 20 bp, Artificial Sequence
  Description of Artificial Sequence: Synthetic oligonucleotide
  Target: SCN9A; (+) strand; PAM type: NRG; PAM sequence: TAG
ttaaagtttattaaagcaac

SEQ ID NO: 43361 - DNA, 20 bp, Artificial Sequence
  Description of Artificial Sequence: Synthetic oligonucleotide
  Target: SCN9A; (+) strand; PAM type: NRG; PAM sequence: AAG
aagcaactagaattactctg

SEQ ID NO: 43362 - DNA, 20 bp, Artificial Sequence
  Description of Artificial Sequence: Synthetic oligonucleotide
  Target: SCN9A; (+) strand; PAM type: NRG; PAM sequence: AAG
actagaattactctgaagaa

SEQ ID NO: 43363 - DNA, 20 bp, Artificial Sequence
  Description of Artificial Sequence: Synthetic oligonucleotide
  Target: SCN9A; (+) strand; PAM type: NRG; PAM sequence: GAG
tagaattactctgaagaaaa

SEQ ID NO: 43364 - DNA, 20 bp, Artificial Sequence
  Description of Artificial Sequence: Synthetic oligonucleotide
  Target: SCN9A; (+) strand; PAM type: NRG; PAM sequence: GAG
gaattactctgaagaaaaga

SEQ ID NO: 43365 - DNA, 20 bp, Artificial Sequence
  Description of Artificial Sequence: Synthetic oligonucleotide
  Target: SCN9A; (+) strand; PAM type: NRG; PAM sequence: AAG
gaaaagagagactctttaaa

SEQ ID NO: 43366 - DNA, 20 bp, Artificial Sequence
  Description of Artificial Sequence: Synthetic oligonucleotide
  Target: SCN9A; (+) strand; PAM type: NRG; PAM sequence: CAG
gactctttaaaaagtaacta

SEQ ID NO: 43367 - DNA, 20 bp, Artificial Sequence
  Description of Artificial Sequence: Synthetic oligonucleotide
  Target: SCN9A; (+) strand; PAM type: NRG; PAM sequence: TAG
aattcttcctcataaaattt

SEQ ID NO: 43368 - DNA, 20 bp, Artificial Sequence
  Description of Artificial Sequence: Synthetic oligonucleotide
  Target: SCN9A; (+) strand; PAM type: NRG; PAM sequence: TAG
ttagatgaaaaacctcattt

SEQ ID NO: 43369 - DNA, 20 bp, Artificial Sequence
  Description of Artificial Sequence: Synthetic oligonucleotide
  Target: SCN9A; (+) strand; PAM type: NRG; PAM sequence: AAG
gaaaaacctcattttagatg

SEQ ID NO: 43370 - DNA, 20 bp, Artificial Sequence
  Description of Artificial Sequence: Synthetic oligonucleotide
  Target: SCN9A; (+) strand; PAM type: NRG; PAM sequence: AGG
aaaaacctcattttagatga

SEQ ID NO: 43371 - DNA, 20 bp, Artificial Sequence
  Description of Artificial Sequence: Synthetic oligonucleotide
  Target: SCN9A; (+) strand; PAM type: NRG; PAM sequence: CAG
aacctcattttagatgaagg

SEQ ID NO: 43372 - DNA, 20 bp, Artificial Sequence
  Description of Artificial Sequence: Synthetic oligonucleotide
  Target: SCN9A; (+) strand; PAM type: NRG; PAM sequence: AGG
acctcattttagatgaaggc

SEQ ID NO: 43373 - DNA, 20 bp, Artificial Sequence
  Description of Artificial Sequence: Synthetic oligonucleotide
  Target: SCN9A; (+) strand; PAM type: NRG; PAM sequence: GAG
ctcattttagatgaaggcag

SEQ ID NO: 43374 - DNA, 20 bp, Artificial Sequence
  Description of Artificial Sequence: Synthetic oligonucleotide
  Target: SCN9A; (+) strand; PAM type: NRG; PAM sequence: AGG
tcattttagatgaaggcagg

SEQ ID NO: 43375 - DNA, 20 bp, Artificial Sequence
  Description of Artificial Sequence: Synthetic oligonucleotide
  Target: SCN9A; (+) strand; PAM type: NRG; PAM sequence: TGG
ttttagatgaaggcaggagg

SEQ ID NO: 43376 - DNA, 20 bp, Artificial Sequence
  Description of Artificial Sequence: Synthetic oligonucleotide
  Target: SCN9A; (+) strand; PAM type: NRG; PAM sequence: GGG
tttagatgaaggcaggaggt

SEQ ID NO: 43377 - DNA, 20 bp, Artificial Sequence
  Description of Artificial Sequence: Synthetic oligonucleotide
  Target: SCN9A; (+) strand; PAM type: NRG; PAM sequence: AAG
gatgaaggcaggaggtggga

SEQ ID NO: 43378 - DNA, 20 bp, Artificial Sequence
  Description of Artificial Sequence: Synthetic oligonucleotide
  Target: SCN9A; (+) strand; PAM type: NRG; PAM sequence: AAG
aaggcaggaggtgggaaagt

SEQ ID NO: 43379 - DNA, 20 bp, Artificial Sequence
  Description of Artificial Sequence: Synthetic oligonucleotide
  Target: SCN9A; (+) strand; PAM type: NRG; PAM sequence: TGG
aggaggtgggaaagtaagaa

SEQ ID NO: 43380 - DNA, 20 bp, Artificial Sequence
  Description of Artificial Sequence: Synthetic oligonucleotide
  Target: SCN9A; (+) strand; PAM type: NRG; PAM sequence: GGG
ggaggtgggaaagtaagaat

SEQ ID NO: 43381 - DNA, 20 bp, Artificial Sequence
  Description of Artificial Sequence: Synthetic oligonucleotide
  Target: SCN9A; (+) strand; PAM type: NRG; PAM sequence: CAG
ggtgggaaagtaagaatggg

SEQ ID NO: 43382 - DNA, 20 bp, Artificial Sequence
  Description of Artificial Sequence: Synthetic oligonucleotide
  Target: SCN9A; (+) strand; PAM type: NRG; PAM sequence: CAG
cacttttttgatacctgttt

SEQ ID NO: 43383 - DNA, 20 bp, Artificial Sequence
  Description of Artificial Sequence: Synthetic oligonucleotide
  Target: SCN9A; (+) strand; PAM type: NRG; PAM sequence: AAG
ttttttgatacctgtttcag

SEQ ID NO: 43384 - DNA, 20 bp, Artificial Sequence
  Description of Artificial Sequence: Synthetic oligonucleotide
  Target: SCN9A; (+) strand; PAM type: NRG; PAM sequence: TAG
tgtttcagaagtttgaattt

SEQ ID NO: 43385 - DNA, 20 bp, Artificial Sequence
  Description of Artificial Sequence: Synthetic oligonucleotide
  Target: SCN9A; (+) strand; PAM type: NRG; PAM sequence: AAG
tgaattttagatatttctaa

SEQ ID NO: 43386 - DNA, 20 bp, Artificial Sequence
  Description of Artificial Sequence: Synthetic oligonucleotide
  Target: SCN9A; (+) strand; PAM type: NRG; PAM sequence: AAG
aaacaatataattcattaac

SEQ ID NO: 43387 - DNA, 20 bp, Artificial Sequence
  Description of Artificial Sequence: Synthetic oligonucleotide
  Target: SCN9A; (+) strand; PAM type: NRG; PAM sequence: GAG
ataattcattaacaagtatt

SEQ ID NO: 43388 - DNA, 20 bp, Artificial Sequence
  Description of Artificial Sequence: Synthetic oligonucleotide
  Target: SCN9A; (+) strand; PAM type: NRG; PAM sequence: AAG
ttaacaagtattgagttttc

SEQ ID NO: 43389 - DNA, 20 bp, Artificial Sequence
  Description of Artificial Sequence: Synthetic oligonucleotide
  Target: SCN9A; (+) strand; PAM type: NRG; PAM sequence: CAG
gagttttcaagtaacaactt

SEQ ID NO: 43390 - DNA, 20 bp, Artificial Sequence
  Description of Artificial Sequence: Synthetic oligonucleotide
  Target: SCN9A; (+) strand; PAM type: NRG; PAM sequence: AAG
taacaacttcagataatcat

SEQ ID NO: 43391 - DNA, 20 bp, Artificial Sequence
  Description of Artificial Sequence: Synthetic oligonucleotide
  Target: SCN9A; (+) strand; PAM type: NRG; PAM sequence: TAG
atgttctaaaacaacaaaac

SEQ ID NO: 43392 - DNA, 20 bp, Artificial Sequence
  Description of Artificial Sequence: Synthetic oligonucleotide
  Target: SCN9A; (+) strand; PAM type: NRG; PAM sequence: AAG
aaaactagaatcctcttgac

SEQ ID NO: 43393 - DNA, 20 bp, Artificial Sequence
  Description of Artificial Sequence: Synthetic oligonucleotide
  Target: SCN9A; (+) strand; PAM type: NRG; PAM sequence: TGG
tcctcttgacaagatgcacc

SEQ ID NO: 43394 - DNA, 20 bp, Artificial Sequence
  Description of Artificial Sequence: Synthetic oligonucleotide
  Target: SCN9A; (+) strand; PAM type: NRG; PAM sequence: TAG
tcttgacaagatgcacctgg

SEQ ID NO: 43395 - DNA, 20 bp, Artificial Sequence
  Description of Artificial Sequence: Synthetic oligonucleotide
  Target: SCN9A; (+) strand; PAM type: NRG; PAM sequence: AAG
tgaatcttttcatgtttctg

SEQ ID NO: 43396 - DNA, 20 bp, Artificial Sequence
  Description of Artificial Sequence: Synthetic oligonucleotide
  Target: SCN9A; (+) strand; PAM type: NRG; PAM sequence: TAG
tcatgtttctgaagtctaat

SEQ ID NO: 43397 - DNA, 20 bp, Artificial Sequence
  Description of Artificial Sequence: Synthetic oligonucleotide
  Target: SCN9A; (+) strand; PAM type: NRG; PAM sequence: CAG
gtctaattagtgcattgatc

SEQ ID NO: 43398 - DNA, 20 bp, Artificial Sequence
  Description of Artificial Sequence: Synthetic oligonucleotide
  Target: SCN9A; (+) strand; PAM type: NRG; PAM sequence: AAG
tgcattgatccagttgatat

SEQ ID NO: 43399 - DNA, 20 bp, Artificial Sequence
  Description of Artificial Sequence: Synthetic oligonucleotide
  Target: SCN9A; (+) strand; PAM type: NRG; PAM sequence: AGG
gcattgatccagttgatata

SEQ ID NO: 43400 - DNA, 20 bp, Artificial Sequence
  Description of Artificial Sequence: Synthetic oligonucleotide
  Target: SCN9A; (+) strand; PAM type: NRG; PAM sequence: TAG
gttgatataaggttattttc

SEQ ID NO: 43401 - DNA, 20 bp, Artificial Sequence
  Description of Artificial Sequence: Synthetic oligonucleotide
  Target: SCN9A; (+) strand; PAM type: NRG; PAM sequence: CAG
ttttctagcactttaatttc

SEQ ID NO: 43402 - DNA, 20 bp, Artificial Sequence
  Description of Artificial Sequence: Synthetic oligonucleotide
  Target: SCN9A; (+) strand; PAM type: NRG; PAM sequence: TAG
cactttaatttccagctcta

SEQ ID NO: 43403 - DNA, 20 bp, Artificial Sequence
  Description of Artificial Sequence: Synthetic oligonucleotide
  Target: SCN9A; (+) strand; PAM type: NRG; PAM sequence: CAG
tttccagctctatagaaata

SEQ ID NO: 43404 - DNA, 20 bp, Artificial Sequence
  Description of Artificial Sequence: Synthetic oligonucleotide
  Target: SCN9A; (+) strand; PAM type: NRG; PAM sequence: AAG
tctatagaaatacagcaaac

SEQ ID NO: 43405 - DNA, 20 bp, Artificial Sequence
  Description of Artificial Sequence: Synthetic oligonucleotide
  Target: SCN9A; (+) strand; PAM type: NRG; PAM sequence: AGG
ctatagaaatacagcaaaca

SEQ ID NO: 43406 - DNA, 20 bp, Artificial Sequence
  Description of Artificial Sequence: Synthetic oligonucleotide
  Target: SCN9A; (+) strand; PAM type: NRG; PAM sequence: TGG
tccctctccccctatgtctc

SEQ ID NO: 43407 - DNA, 20 bp, Artificial Sequence
  Description of Artificial Sequence: Synthetic oligonucleotide
  Target: SCN9A; (+) strand; PAM type: NRG; PAM sequence: TGG
gtgttcctgttttttctctc

SEQ ID NO: 43408 - DNA, 20 bp, Artificial Sequence
  Description of Artificial Sequence: Synthetic oligonucleotide
  Target: SCN9A; (+) strand; PAM type: NRG; PAM sequence: AAG
ttcctgttttttctctctgg

SEQ ID NO: 43409 - DNA, 20 bp, Artificial Sequence
  Description of Artificial Sequence: Synthetic oligonucleotide
  Target: SCN9A; (+) strand; PAM type: NRG; PAM sequence: AAG
ttttctctctggaagtttct

SEQ ID NO: 43410 - DNA, 20 bp, Artificial Sequence
  Description of Artificial Sequence: Synthetic oligonucleotide
  Target: SCN9A; (+) strand; PAM type: NRG; PAM sequence: CAG
tctggaagtttctaagttcc

SEQ ID NO: 43411 - DNA, 20 bp, Artificial Sequence
  Description of Artificial Sequence: Synthetic oligonucleotide
  Target: SCN9A; (+) strand; PAM type: NRG; PAM sequence: AAG
ggaagtttctaagttcccag

SEQ ID NO: 43412 - DNA, 20 bp, Artificial Sequence
  Description of Artificial Sequence: Synthetic oligonucleotide
  Target: SCN9A; (+) strand; PAM type: NRG; PAM sequence: GAG
gttcccagaagactcaaact

SEQ ID NO: 43413 - DNA, 20 bp, Artificial Sequence
  Description of Artificial Sequence: Synthetic oligonucleotide
  Target: SCN9A; (+) strand; PAM type: NRG; PAM sequence: TAG
atgcttgctctttgtgctta

SEQ ID NO: 43414 - DNA, 20 bp, Artificial Sequence
  Description of Artificial Sequence: Synthetic oligonucleotide
  Target: SCN9A; (+) strand; PAM type: NRG; PAM sequence: TAG
tgtgcttatagtactcatca

SEQ ID NO: 43415 - DNA, 20 bp, Artificial Sequence
  Description of Artificial Sequence: Synthetic oligonucleotide
  Target: SCN9A; (+) strand; PAM type: NRG; PAM sequence: TGG
actcatcatagtcctctact

SEQ ID NO: 43416 - DNA, 20 bp, Artificial Sequence
  Description of Artificial Sequence: Synthetic oligonucleotide
  Target: SCN9A; (+) strand; PAM type: NRG; PAM sequence: TAG
tagtcctctacttggcttaa

SEQ ID NO: 43417 - DNA, 20 bp, Artificial Sequence
  Description of Artificial Sequence: Synthetic oligonucleotide
  Target: SCN9A; (+) strand; PAM type: NRG; PAM sequence: AGG
agtcctctacttggcttaat

SEQ ID NO: 43418 - DNA, 20 bp, Artificial Sequence
  Description of Artificial Sequence: Synthetic oligonucleotide
  Target: SCN9A; (+) strand; PAM type: NRG; PAM sequence: TAG
ttggcttaataggtcattta

SEQ ID NO: 43419 - DNA, 20 bp, Artificial Sequence
  Description of Artificial Sequence: Synthetic oligonucleotide
  Target: SCN9A; (+) strand; PAM type: NRG; PAM sequence: AAG
catttatagttgatttttaa

SEQ ID NO: 43420 - DNA, 20 bp, Artificial Sequence
  Description of Artificial Sequence: Synthetic oligonucleotide
  Target: SCN9A; (+) strand; PAM type: NRG; PAM sequence: AAG
aaaagacttgattccccaaa

SEQ ID NO: 43421 - DNA, 20 bp, Artificial Sequence
  Description of Artificial Sequence: Synthetic oligonucleotide
  Target: SCN9A; (+) strand; PAM type: NRG; PAM sequence: GAG
aagacttgattccccaaaaa

SEQ ID NO: 43422 - DNA, 20 bp, Artificial Sequence
  Description of Artificial Sequence: Synthetic oligonucleotide
  Target: SCN9A; (+) strand; PAM type: NRG; PAM sequence: AAG
aaagagttatataatcttct

SEQ ID NO: 43423 - DNA, 20 bp, Artificial Sequence
  Description of Artificial Sequence: Synthetic oligonucleotide
  Target: SCN9A; (+) strand; PAM type: NRG; PAM sequence: CAG
gagttatataatcttctaag

SEQ ID NO: 43424 - DNA, 20 bp, Artificial Sequence
  Description of Artificial Sequence: Synthetic oligonucleotide
  Target: SCN9A; (+) strand; PAM type: NRG; PAM sequence: TAG
tatataatcttctaagcagt

SEQ ID NO: 43425 - DNA, 20 bp, Artificial Sequence
  Description of Artificial Sequence: Synthetic oligonucleotide
  Target: SCN9A; (+) strand; PAM type: NRG; PAM sequence: AAG
agcagttagtcataatttga

SEQ ID NO: 43426 - DNA, 20 bp, Artificial Sequence
  Description of Artificial Sequence: Synthetic oligonucleotide
  Target: SCN9A; (+) strand; PAM type: NRG; PAM sequence: AGG
gcagttagtcataatttgaa

SEQ ID NO: 43427 - DNA, 20 bp, Artificial Sequence
  Description of Artificial Sequence: Synthetic oligonucleotide
  Target: SCN9A; (+) strand; PAM type: NRG; PAM sequence: TGG
tctatactttacataaacat

SEQ ID NO: 43428 - DNA, 20 bp, Artificial Sequence
  Description of Artificial Sequence: Synthetic oligonucleotide
  Target: SCN9A; (+) strand; PAM type: NRG; PAM sequence: AAG
tacataaacattggatgaaa

SEQ ID NO: 43429 - DNA, 20 bp, Artificial Sequence
  Description of Artificial Sequence: Synthetic oligonucleotide
  Target: SCN9A; (+) strand; PAM type: NRG; PAM sequence: AAG
ttggatgaaaaagaaaaaaa

SEQ ID NO: 43430 - DNA, 20 bp, Artificial Sequence
  Description of Artificial Sequence: Synthetic oligonucleotide
  Target: SCN9A; (+) strand; PAM type: NRG; PAM sequence: AGG
tggatgaaaaagaaaaaaaa

SEQ ID NO: 43431 - DNA, 20 bp, Artificial Sequence
  Description of Artificial Sequence: Synthetic oligonucleotide
  Target: SCN9A; (+) strand; PAM type: NRG; PAM sequence: TGG
aaaagaaaaaaaaaggtgaa

SEQ ID NO: 43432 - DNA, 20 bp, Artificial Sequence
  Description of Artificial Sequence: Synthetic oligonucleotide
  Target: SCN9A; (+) strand; PAM type: NRG; PAM sequence: TAG
gtgaatggaaaatctacaca

SEQ ID NO: 43433 - DNA, 20 bp, Artificial Sequence
  Description of Artificial Sequence: Synthetic oligonucleotide
  Target: SCN9A; (+) strand; PAM type: NRG; PAM sequence: CAG
catttatacaatgttaatta

SEQ ID NO: 43434 - DNA, 20 bp, Artificial Sequence
  Description of Artificial Sequence: Synthetic oligonucleotide
  Target: SCN9A; (+) strand; PAM type: NRG; PAM sequence: CAG
aattacagtgaacatgatct

SEQ ID NO: 43435 - DNA, 20 bp, Artificial Sequence
  Description of Artificial Sequence: Synthetic oligonucleotide
  Target: SCN9A; (+) strand; PAM type: NRG; PAM sequence: TAG
aattattatctacatgcatt

SEQ ID NO: 43436 - DNA, 20 bp, Artificial Sequence
  Description of Artificial Sequence: Synthetic oligonucleotide
  Target: SCN9A; (+) strand; PAM type: NRG; PAM sequence: AAG
ttatctacatgcatttagtt

SEQ ID NO: 43437 - DNA, 20 bp, Artificial Sequence
  Description of Artificial Sequence: Synthetic oligonucleotide
  Target: SCN9A; (+) strand; PAM type: NRG; PAM sequence: GAG
atctacatgcatttagttaa

SEQ ID NO: 43438 - DNA, 20 bp, Artificial Sequence
  Description of Artificial Sequence: Synthetic oligonucleotide
  Target: SCN9A; (+) strand; PAM type: NRG; PAM sequence: GAG
ctacatgcatttagttaaga

SEQ ID NO: 43439 - DNA, 20 bp, Artificial Sequence
  Description of Artificial Sequence: Synthetic oligonucleotide
  Target: SCN9A; (+) strand; PAM type: NRG; PAM sequence: CAG
tcgataaaatgatataaaaa

SEQ ID NO: 43440 - DNA, 20 bp, Artificial Sequence
  Description of Artificial Sequence: Synthetic oligonucleotide
  Target: SCN9A; (+) strand; PAM type: NRG; PAM sequence: GAG
gataaaatgatataaaaaca

SEQ ID NO: 43441 - DNA, 20 bp, Artificial Sequence
  Description of Artificial Sequence: Synthetic oligonucleotide
  Target: SCN9A; (+) strand; PAM type: NRG; PAM sequence: AAG
atgatataaaaacagagtaa

SEQ ID NO: 43442 - DNA, 20 bp, Artificial Sequence
  Description of Artificial Sequence: Synthetic oligonucleotide
  Target: SCN9A; (+) strand; PAM type: NRG; PAM sequence: AGG
tgatataaaaacagagtaaa

SEQ ID NO: 43443 - DNA, 20 bp, Artificial Sequence
  Description of Artificial Sequence: Synthetic oligonucleotide
  Target: SCN9A; (+) strand; PAM type: NRG; PAM sequence: GGG
gatataaaaacagagtaaaa

SEQ ID NO: 43444 - DNA, 20 bp, Artificial Sequence
  Description of Artificial Sequence: Synthetic oligonucleotide
  Target: SCN9A; (+) strand; PAM type: NRG; PAM sequence: TAG
ataaaaacagagtaaaaggg

SEQ ID NO: 43445 - DNA, 20 bp, Artificial Sequence
  Description of Artificial Sequence: Synthetic oligonucleotide
  Target: SCN9A; (+) strand; PAM type: NRG; PAM sequence: AGG
taaaaacagagtaaaagggt

SEQ ID NO: 43446 - DNA, 20 bp, Artificial Sequence
  Description of Artificial Sequence: Synthetic oligonucleotide
  Target: SCN9A; (+) strand; PAM type: NRG; PAM sequence: GGG
aaaaacagagtaaaagggta

SEQ ID NO: 43447 - DNA, 20 bp, Artificial Sequence
  Description of Artificial Sequence: Synthetic oligonucleotide
  Target: SCN9A; (+) strand; PAM type: NRG; PAM sequence: AAG
tagggtcaaaaattaactct

SEQ ID NO: 43448 - DNA, 20 bp, Artificial Sequence
  Description of Artificial Sequence: Synthetic oligonucleotide
  Target: SCN9A; (+) strand; PAM type: NRG; PAM sequence: CAG
aactctaagttaatcttttt

SEQ ID NO: 43449 - DNA, 20 bp, Artificial Sequence
  Description of Artificial Sequence: Synthetic oligonucleotide
  Target: SCN9A; (+) strand; PAM type: NRG; PAM sequence: AGG
actctaagttaatctttttc

SEQ ID NO: 43450 - DNA, 20 bp, Artificial Sequence
  Description of Artificial Sequence: Synthetic oligonucleotide
  Target: SCN9A; (+) strand; PAM type: NRG; PAM sequence: GGG
ctctaagttaatctttttca

SEQ ID NO: 43451 - DNA, 20 bp, Artificial Sequence
  Description of Artificial Sequence: Synthetic oligonucleotide
  Target: SCN9A; (+) strand; PAM type: NRG; PAM sequence: CAG
ttcagggaaaataaaaatac

SEQ ID NO: 43452 - DNA, 20 bp, Artificial Sequence
  Description of Artificial Sequence: Synthetic oligonucleotide
  Target: SCN9A; (+) strand; PAM type: NRG; PAM sequence: GAG
cagggaaaataaaaatacca

SEQ ID NO: 43453 - DNA, 20 bp, Artificial Sequence
  Description of Artificial Sequence: Synthetic oligonucleotide
  Target: SCN9A; (+) strand; PAM type: NRG; PAM sequence: GAG
gggaaaataaaaataccaga

SEQ ID NO: 43454 - DNA, 20 bp, Artificial Sequence
  Description of Artificial Sequence: Synthetic oligonucleotide
  Target: SCN9A; (+) strand; PAM type: NRG; PAM sequence: GAG
gaaaataaaaataccagaga

SEQ ID NO: 43455 - DNA, 20 bp, Artificial Sequence
  Description of Artificial Sequence: Synthetic oligonucleotide
  Target: SCN9A; (+) strand; PAM type: NRG; PAM sequence: GAG
ccagagagagcgaaaaaaat

SEQ ID NO: 43456 - DNA, 20 bp, Artificial Sequence
  Description of Artificial Sequence: Synthetic oligonucleotide
  Target: SCN9A; (+) strand; PAM type: NRG; PAM sequence: TAG
tgaattttttaatattaact

SEQ ID NO: 43457 - DNA, 20 bp, Artificial Sequence
  Description of Artificial Sequence: Synthetic oligonucleotide
  Target: SCN9A; (+) strand; PAM type: NRG; PAM sequence: TAG
ttaatattaacttagtgctt

SEQ ID NO: 43458 - DNA, 20 bp, Artificial Sequence
  Description of Artificial Sequence: Synthetic oligonucleotide
  Target: SCN9A; (+) strand; PAM type: NRG; PAM sequence: AAG
taaaaacaatgatcacatat

SEQ ID NO: 43459 - DNA, 20 bp, Artificial Sequence
  Description of Artificial Sequence: Synthetic oligonucleotide
  Target: SCN9A; (+) strand; PAM type: NRG; PAM sequence: AAG
aacaatgatcacatataaga

SEQ ID NO: 43460 - DNA, 20 bp, Artificial Sequence
  Description of Artificial Sequence: Synthetic oligonucleotide
  Target: SCN9A; (+) strand; PAM type: NRG; PAM sequence: CAG
aagaaagaatttatctttct

SEQ ID NO: 43461 - DNA, 20 bp, Artificial Sequence
  Description of Artificial Sequence: Synthetic oligonucleotide
  Target: SCN9A; (+) strand; PAM type: NRG; PAM sequence: AGG
agaaagaatttatctttctc

SEQ ID NO: 43462 - DNA, 20 bp, Artificial Sequence
  Description of Artificial Sequence: Synthetic oligonucleotide
  Target: SCN9A; (+) strand; PAM type: NRG; PAM sequence: GGG
gaaagaatttatctttctca

SEQ ID NO: 43463 - DNA, 20 bp, Artificial Sequence
  Description of Artificial Sequence: Synthetic oligonucleotide
  Target: SCN9A; (+) strand; PAM type: NRG; PAM sequence: GGG
aaagaatttatctttctcag

SEQ ID NO: 43464 - DNA, 20 bp, Artificial Sequence
  Description of Artificial Sequence: Synthetic oligonucleotide
  Target: SCN9A; (+) strand; PAM type: NRG; PAM sequence: TGG
ctttctcaggggcaaattat

SEQ ID NO: 43465 - DNA, 20 bp, Artificial Sequence
  Description of Artificial Sequence: Synthetic oligonucleotide
  Target: SCN9A; (+) strand; PAM type: NRG; PAM sequence: AAG
tcaggggcaaattattggat

SEQ ID NO: 43466 - DNA, 20 bp, Artificial Sequence
  Description of Artificial Sequence: Synthetic oligonucleotide
  Target: SCN9A; (+) strand; PAM type: NRG; PAM sequence: TGG
ggataagaaaattatccctt

SEQ ID NO: 43467 - DNA, 20 bp, Artificial Sequence
  Description of Artificial Sequence: Synthetic oligonucleotide
  Target: SCN9A; (+) strand; PAM type: NRG; PAM sequence: AAG
agaaaattatccctttggtt

SEQ ID NO: 43468 - DNA, 20 bp, Artificial Sequence
  Description of Artificial Sequence: Synthetic oligonucleotide
  Target: SCN9A; (+) strand; PAM type: NRG; PAM sequence: AAG
aaattatccctttggttaag

SEQ ID NO: 43469 - DNA, 20 bp, Artificial Sequence
  Description of Artificial Sequence: Synthetic oligonucleotide
  Target: SCN9A; (+) strand; PAM type: NRG; PAM sequence: TGG
gttaagaagattttgctctc

SEQ ID NO: 43470 - DNA, 20 bp, Artificial Sequence
  Description of Artificial Sequence: Synthetic oligonucleotide
  Target: SCN9A; (+) strand; PAM type: NRG; PAM sequence: GGG
ttaagaagattttgctctct

SEQ ID NO: 43471 - DNA, 20 bp, Artificial Sequence
  Description of Artificial Sequence: Synthetic oligonucleotide
  Target: SCN9A; (+) strand; PAM type: NRG; PAM sequence: AAG
ttttgtcaatcttaaaattg

SEQ ID NO: 43472 - DNA, 20 bp, Artificial Sequence
  Description of Artificial Sequence: Synthetic oligonucleotide
  Target: SCN9A; (+) strand; PAM type: NRG; PAM sequence: AGG
tttgtcaatcttaaaattga

SEQ ID NO: 43473 - DNA, 20 bp, Artificial Sequence
  Description of Artificial Sequence: Synthetic oligonucleotide
  Target: SCN9A; (+) strand; PAM type: NRG; PAM sequence: GGG
ttgtcaatcttaaaattgaa

SEQ ID NO: 43474 - DNA, 20 bp, Artificial Sequence
  Description of Artificial Sequence: Synthetic oligonucleotide
  Target: SCN9A; (+) strand; PAM type: NRG; PAM sequence: GAG
gaaacattattcttatgatt

SEQ ID NO: 43475 - DNA, 20 bp, Artificial Sequence
  Description of Artificial Sequence: Synthetic oligonucleotide
  Target: SCN9A; (+) strand; PAM type: NRG; PAM sequence: AGG
aaacattattcttatgattg

SEQ ID NO: 43476 - DNA, 20 bp, Artificial Sequence
  Description of Artificial Sequence: Synthetic oligonucleotide
  Target: SCN9A; (+) strand; PAM type: NRG; PAM sequence: TAG
aaaacactaaaaatcctaat

SEQ ID NO: 43477 - DNA, 20 bp, Artificial Sequence
  Description of Artificial Sequence: Synthetic oligonucleotide
  Target: SCN9A; (+) strand; PAM type: NRG; PAM sequence: AAG
actaaaaatcctaattagaa

SEQ ID NO: 43478 - DNA, 20 bp, Artificial Sequence
  Description of Artificial Sequence: Synthetic oligonucleotide
  Target: SCN9A; (+) strand; PAM type: NRG; PAM sequence: TAG
aaaatcctaattagaaaagt

SEQ ID NO: 43479 - DNA, 20 bp, Artificial Sequence
  Description of Artificial Sequence: Synthetic oligonucleotide
  Target: SCN9A; (+) strand; PAM type: NRG; PAM sequence: AAG
taaactttcaatctgaaatg

SEQ ID NO: 43480 - DNA, 20 bp, Artificial Sequence
  Description of Artificial Sequence: Synthetic oligonucleotide
  Target: SCN9A; (+) strand; PAM type: NRG; PAM sequence: CAG
agtttcataaatattgccct

SEQ ID NO: 43481 - DNA, 20 bp, Artificial Sequence
  Description of Artificial Sequence: Synthetic oligonucleotide
  Target: SCN9A; (+) strand; PAM type: NRG; PAM sequence: AGG
gtttcataaatattgccctc

SEQ ID NO: 43482 - DNA, 20 bp, Artificial Sequence
  Description of Artificial Sequence: Synthetic oligonucleotide
  Target: SCN9A; (+) strand; PAM type: NRG; PAM sequence: GGG
tttcataaatattgccctca

SEQ ID NO: 43483 - DNA, 20 bp, Artificial Sequence
  Description of Artificial Sequence: Synthetic oligonucleotide
  Target: SCN9A; (+) strand; PAM type: NRG; PAM sequence: CAG
cctcagggtttattacacct

SEQ ID NO: 43484 - DNA, 20 bp, Artificial Sequence
  Description of Artificial Sequence: Synthetic oligonucleotide
  Target: SCN9A; (+) strand; PAM type: NRG; PAM sequence: GAG
tcagggtttattacacctca

SEQ ID NO: 43485 - DNA, 20 bp, Artificial Sequence
  Description of Artificial Sequence: Synthetic oligonucleotide
  Target: SCN9A; (+) strand; PAM type: NRG; PAM sequence: GAG
agggtttattacacctcaga

SEQ ID NO: 43486 - DNA, 20 bp, Artificial Sequence
  Description of Artificial Sequence: Synthetic oligonucleotide
  Target: SCN9A; (+) strand; PAM type: NRG; PAM sequence: GAG
gagtttctttctcttatttt

SEQ ID NO: 43487 - DNA, 20 bp, Artificial Sequence
  Description of Artificial Sequence: Synthetic oligonucleotide
  Target: SCN9A; (+) strand; PAM type: NRG; PAM sequence: AGG
agtttctttctcttattttg

SEQ ID NO: 43488 - DNA, 20 bp, Artificial Sequence
  Description of Artificial Sequence: Synthetic oligonucleotide
  Target: SCN9A; (+) strand; PAM type: NRG; PAM sequence: AAG
tctttctcttattttgaggc

SEQ ID NO: 43489 - DNA, 20 bp, Artificial Sequence
  Description of Artificial Sequence: Synthetic oligonucleotide
  Target: SCN9A; (+) strand; PAM type: NRG; PAM sequence: GAG
tttctcttattttgaggcaa

SEQ ID NO: 43490 - DNA, 20 bp, Artificial Sequence
  Description of Artificial Sequence: Synthetic oligonucleotide
  Target: SCN9A; (+) strand; PAM type: NRG; PAM sequence: TGG
ttattttgaggcaagagtga

SEQ ID NO: 43491 - DNA, 20 bp, Artificial Sequence
  Description of Artificial Sequence: Synthetic oligonucleotide
  Target: SCN9A; (+) strand; PAM type: NRG; PAM sequence: GAG
attttgaggcaagagtgatg

SEQ ID NO: 43492 - DNA, 20 bp, Artificial Sequence
  Description of Artificial Sequence: Synthetic oligonucleotide
  Target: SCN9A; (+) strand; PAM type: NRG; PAM sequence: TGG
agagtgatggagcgcctgtc

SEQ ID NO: 43493 - DNA, 20 bp, Artificial Sequence
  Description of Artificial Sequence: Synthetic oligonucleotide
  Target: SCN9A; (+) strand; PAM type: NRG; PAM sequence: AAG
gcctgtctggtttttgtgca

SEQ ID NO: 43494 - DNA, 20 bp, Artificial Sequence
  Description of Artificial Sequence: Synthetic oligonucleotide
  Target: SCN9A; (+) strand; PAM type: NRG; PAM sequence: AGG
cctgtctggtttttgtgcaa

SEQ ID NO: 43495 - DNA, 20 bp, Artificial Sequence
  Description of Artificial Sequence: Synthetic oligonucleotide
  Target: SCN9A; (+) strand; PAM type: NRG; PAM sequence: AAG
tttgtgcaaaggtatatccc

SEQ ID NO: 43496 - DNA, 20 bp, Artificial Sequence
  Description of Artificial Sequence: Synthetic oligonucleotide
  Target: SCN9A; (+) strand; PAM type: NRG; PAM sequence: GAG
tgtgcaaaggtatatcccaa

SEQ ID NO: 43497 - DNA, 20 bp, Artificial Sequence
  Description of Artificial Sequence: Synthetic oligonucleotide
  Target: SCN9A; (+) strand; PAM type: NRG; PAM sequence: AAG
atcccaagagatttccaact

SEQ ID NO: 43498 - DNA, 20 bp, Artificial Sequence
  Description of Artificial Sequence: Synthetic oligonucleotide
  Target: SCN9A; (+) strand; PAM type: NRG; PAM sequence: TGG
caagagatttccaactaagc

SEQ ID NO: 43499 - DNA, 20 bp, Artificial Sequence
  Description of Artificial Sequence: Synthetic oligonucleotide
  Target: SCN9A; (+) strand; PAM type: NRG; PAM sequence: TAG
agatttccaactaagctggt

SEQ ID NO: 43500 - DNA, 20 bp, Artificial Sequence
  Description of Artificial Sequence: Synthetic oligonucleotide
  Target: SCN9A; (+) strand; PAM type: NRG; PAM sequence: AAG
ttatcataccttctctttaa

SEQ ID NO: 43501 - DNA, 20 bp, Artificial Sequence
  Description of Artificial Sequence: Synthetic oligonucleotide
  Target: SCN9A; (+) strand; PAM type: NRG; PAM sequence: AGG
tatcataccttctctttaaa

SEQ ID NO: 43502 - DNA, 20 bp, Artificial Sequence
  Description of Artificial Sequence: Synthetic oligonucleotide
  Target: SCN9A; (+) strand; PAM type: NRG; PAM sequence: CAG
ttaattgaatgtaaacataa

SEQ ID NO: 43503 - DNA, 20 bp, Artificial Sequence
  Description of Artificial Sequence: Synthetic oligonucleotide
  Target: SCN9A; (+) strand; PAM type: NRG; PAM sequence: GAG
aattgaatgtaaacataaca

SEQ ID NO: 43504 - DNA, 20 bp, Artificial Sequence
  Description of Artificial Sequence: Synthetic oligonucleotide
  Target: SCN9A; (+) strand; PAM type: NRG; PAM sequence: TGG
gaatctctcaaacattttaa

SEQ ID NO: 43505 - DNA, 20 bp, Artificial Sequence
  Description of Artificial Sequence: Synthetic oligonucleotide
  Target: SCN9A; (+) strand; PAM type: NRG; PAM sequence: GGG
aatctctcaaacattttaat

SEQ ID NO: 43506 - DNA, 20 bp, Artificial Sequence
  Description of Artificial Sequence: Synthetic oligonucleotide
  Target: SCN9A; (+) strand; PAM type: NRG; PAM sequence: CAG
tcaaacattttaatgggtcc

SEQ ID NO: 43507 - DNA, 20 bp, Artificial Sequence
  Description of Artificial Sequence: Synthetic oligonucleotide
  Target: SCN9A; (+) strand; PAM type: NRG; PAM sequence: GAG
acattttaatgggtcccagt

SEQ ID NO: 43508 - DNA, 20 bp, Artificial Sequence
  Description of Artificial Sequence: Synthetic oligonucleotide
  Target: SCN9A; (+) strand; PAM type: NRG; PAM sequence: TGG
tgagtaaatgctatttcttt

SEQ ID NO: 43509 - DNA, 20 bp, Artificial Sequence
  Description of Artificial Sequence: Synthetic oligonucleotide
  Target: SCN9A; (+) strand; PAM type: NRG; PAM sequence: GGG
gagtaaatgctatttctttt

SEQ ID NO: 43510 - DNA, 20 bp, Artificial Sequence
  Description of Artificial Sequence: Synthetic oligonucleotide
  Target: SCN9A; (+) strand; PAM type: NRG; PAM sequence: TGG
taaatgctatttcttttggg

SEQ ID NO: 43511 - DNA, 20 bp, Artificial Sequence
  Description of Artificial Sequence: Synthetic oligonucleotide
  Target: SCN9A; (+) strand; PAM type: NRG; PAM sequence: TGG
gtttcactaatgtgctctca

SEQ ID NO: 43512 - DNA, 20 bp, Artificial Sequence
  Description of Artificial Sequence: Synthetic oligonucleotide
  Target: SCN9A; (+) strand; PAM type: NRG; PAM sequence: AAG
ctctcatggtgcattacata

SEQ ID NO: 43513 - DNA, 20 bp, Artificial Sequence
  Description of Artificial Sequence: Synthetic oligonucleotide
  Target: SCN9A; (+) strand; PAM type: NRG; PAM sequence: GAG
cattacataaagtctatgct

SEQ ID NO: 43514 - DNA, 20 bp, Artificial Sequence
  Description of Artificial Sequence: Synthetic oligonucleotide
  Target: SCN9A; (+) strand; PAM type: NRG; PAM sequence: AAG
agtttcatcatgttaaacca

SEQ ID NO: 43515 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaaaaaaaaaaaaaa

SEQ ID NO: 43516 - DNA, 20 bp, Artificial Sequence
  Description of Artificial Sequence: Synthetic oligonucleotide
  Target: SCN9A; (+) strand; PAM type: NRG; PAM sequence: AGG
aaaaaaaaaaaaaaaaaaaa

SEQ ID NO: 43517 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaaaaaaaaaaagga

SEQ ID NO: 43518 - DNA, 20 bp, Artificial Sequence
  Description of Artificial Sequence: Synthetic oligonucleotide
  Target: SCN9A; (+) strand; PAM type: NRG; PAM sequence: AGG
aaaaaaaaaaaaaaaaggaa

SEQ ID NO: 43519 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaaaaaaggaaagga

SEQ ID NO: 43520 - DNA, 20 bp, Artificial Sequence
  Description of Artificial Sequence: Synthetic oligonucleotide
  Target: SCN9A; (+) strand; PAM type: NRG; PAM sequence: AAG
aaaaaggaaaggaaagaaaa

SEQ ID NO: 43521 - DNA, 20 bp, Artificial Sequence
  Description of Artificial Sequence: Synthetic oligonucleotide
  Target: SCN9A; (+) strand; PAM type: NRG; PAM sequence: AAG
gaaaccactgaccacttcaa

SEQ ID NO: 43522 - DNA, 20 bp, Artificial Sequence
  Description of Artificial Sequence: Synthetic oligonucleotide
  Target: SCN9A; (+) strand; PAM type: NRG; PAM sequence: CAG
ccactgaccacttcaaaaga

SEQ ID NO: 43523 - DNA, 20 bp, Artificial Sequence
  Description of Artificial Sequence: Synthetic oligonucleotide
  Target: SCN9A; (+) strand; PAM type: NRG; PAM sequence: CAG
ctattcattaaaaaccataa

SEQ ID NO: 43524 - DNA, 20 bp, Artificial Sequence
  Description of Artificial Sequence: Synthetic oligonucleotide
  Target: SCN9A; (+) strand; PAM type: NRG; PAM sequence: AAG
taaaaattgattatgaaaac

SEQ ID NO: 43525 - DNA, 20 bp, Artificial Sequence
  Description of Artificial Sequence: Synthetic oligonucleotide
  Target: SCN9A; (+) strand; PAM type: NRG; PAM sequence: AAG
tgttaacattatctttccaa

SEQ ID NO: 43526 - DNA, 20 bp, Artificial Sequence
  Description of Artificial Sequence: Synthetic oligonucleotide
  Target: SCN9A; (+) strand; PAM type: NRG; PAM sequence: AAG
aacattatctttccaaaaga

SEQ ID NO: 43527 - DNA, 20 bp, Artificial Sequence
  Description of Artificial Sequence: Synthetic oligonucleotide
  Target: SCN9A; (+) strand; PAM type: NRG; PAM sequence: AAG
ccaaaagaaagaaaaaataa

SEQ ID NO: 43528 - DNA, 20 bp, Artificial Sequence
  Description of Artificial Sequence: Synthetic oligonucleotide
  Target: SCN9A; (+) strand; PAM type: NRG; PAM sequence: AAG
aagaaaaaataaaagtcaca

SEQ ID NO: 43529 - DNA, 20 bp, Artificial Sequence
  Description of Artificial Sequence: Synthetic oligonucleotide
  Target: SCN9A; (+) strand; PAM type: NRG; PAM sequence: AGG
agaaaaaataaaagtcacaa

SEQ ID NO: 43530 - DNA, 20 bp, Artificial Sequence
  Description of Artificial Sequence: Synthetic oligonucleotide
  Target: SCN9A; (+) strand; PAM type: NRG; PAM sequence: GAG
aaaaaataaaagtcacaaag

SEQ ID NO: 43531 - DNA, 20 bp, Artificial Sequence
  Description of Artificial Sequence: Synthetic oligonucleotide
  Target: SCN9A; (+) strand; PAM type: NRG; PAM sequence: TGG
aataaaagtcacaaaggagt

SEQ ID NO: 43532 - DNA, 20 bp, Artificial Sequence
  Description of Artificial Sequence: Synthetic oligonucleotide
  Target: SCN9A; (+) strand; PAM type: NRG; PAM sequence: AAG
agttggttattgtgttacta

SEQ ID NO: 43533 - DNA, 20 bp, Artificial Sequence
  Description of Artificial Sequence: Synthetic oligonucleotide
  Target: SCN9A; (+) strand; PAM type: NRG; PAM sequence: TAG
ggttattgtgttactaaagt

SEQ ID NO: 43534 - DNA, 20 bp, Artificial Sequence
  Description of Artificial Sequence: Synthetic oligonucleotide
  Target: SCN9A; (+) strand; PAM type: NRG; PAM sequence: TAG
ctaaagttagaattaattat

SEQ ID NO: 43535 - DNA, 20 bp, Artificial Sequence
  Description of Artificial Sequence: Synthetic oligonucleotide
  Target: SCN9A; (+) strand; PAM type: NRG; PAM sequence: TAG
attaattattagttatttta

SEQ ID NO: 43536 - DNA, 20 bp, Artificial Sequence
  Description of Artificial Sequence: Synthetic oligonucleotide
  Target: SCN9A; (+) strand; PAM type: NRG; PAM sequence: AGG
ttaattattagttattttat

SEQ ID NO: 43537 - DNA, 20 bp, Artificial Sequence
  Description of Artificial Sequence: Synthetic oligonucleotide
  Target: SCN9A; (+) strand; PAM type: NRG; PAM sequence: AAG
attattagttattttatagg

SEQ ID NO: 43538 - DNA, 20 bp, Artificial Sequence
  Description of Artificial Sequence: Synthetic oligonucleotide
  Target: SCN9A; (+) strand; PAM type: NRG; PAM sequence: AGG
ttattagttattttatagga

SEQ ID NO: 43539 - DNA, 20 bp, Artificial Sequence
  Description of Artificial Sequence: Synthetic oligonucleotide
  Target: SCN9A; (+) strand; PAM type: NRG; PAM sequence: GGG
tattagttattttataggaa

SEQ ID NO: 43540 - DNA, 20 bp, Artificial Sequence
  Description of Artificial Sequence: Synthetic oligonucleotide
  Target: SCN9A; (+) strand; PAM type: NRG; PAM sequence: GGG
attagttattttataggaag

SEQ ID NO: 43541 - DNA, 20 bp, Artificial Sequence
  Description of Artificial Sequence: Synthetic oligonucleotide
  Target: SCN9A; (+) strand; PAM type: NRG; PAM sequence: GGG
ttagttattttataggaagg

SEQ ID NO: 43542 - DNA, 20 bp, Artificial Sequence
  Description of Artificial Sequence: Synthetic oligonucleotide
  Target: SCN9A; (+) strand; PAM type: NRG; PAM sequence: AAG
gtgaatacaaaacattttga

SEQ ID NO: 43543 - DNA, 20 bp, Artificial Sequence
  Description of Artificial Sequence: Synthetic oligonucleotide
  Target: SCN9A; (+) strand; PAM type: NRG; PAM sequence: AGG
tgaatacaaaacattttgaa

SEQ ID NO: 43544 - DNA, 20 bp, Artificial Sequence
  Description of Artificial Sequence: Synthetic oligonucleotide
  Target: SCN9A; (+) strand; PAM type: NRG; PAM sequence: AAG
atacaaaacattttgaaagg

SEQ ID NO: 43545 - DNA, 20 bp, Artificial Sequence
  Description of Artificial Sequence: Synthetic oligonucleotide
  Target: SCN9A; (+) strand; PAM type: NRG; PAM sequence: TGG
attttgaaaggaagatgatt

SEQ ID NO: 43546 - DNA, 20 bp, Artificial Sequence
  Description of Artificial Sequence: Synthetic oligonucleotide
  Target: SCN9A; (+) strand; PAM type: NRG; PAM sequence: AAG
atgatttggcttctcctacc

SEQ ID NO: 43547 - DNA, 20 bp, Artificial Sequence
  Description of Artificial Sequence: Synthetic oligonucleotide
  Target: SCN9A; (+) strand; PAM type: NRG; PAM sequence: CAG
ggcttctcctaccaagttaa

SEQ ID NO: 43548 - DNA, 20 bp, Artificial Sequence
  Description of Artificial Sequence: Synthetic oligonucleotide
  Target: SCN9A; (+) strand; PAM type: NRG; PAM sequence: GAG
tattaccattattatttttt

SEQ ID NO: 43549 - DNA, 20 bp, Artificial Sequence
  Description of Artificial Sequence: Synthetic oligonucleotide
  Target: SCN9A; (+) strand; PAM type: NRG; PAM sequence: CAG
accattattattttttgaga

SEQ ID NO: 43550 - DNA, 20 bp, Artificial Sequence
  Description of Artificial Sequence: Synthetic oligonucleotide
  Target: SCN9A; (+) strand; PAM type: NRG; PAM sequence: GAG
cattattattttttgagaca

SEQ ID NO: 43551 - DNA, 20 bp, Artificial Sequence
  Description of Artificial Sequence: Synthetic oligonucleotide
  Target: SCN9A; (+) strand; PAM type: NRG; PAM sequence: CAG
acagagtctcactttgttgc

SEQ ID NO: 43552 - DNA, 20 bp, Artificial Sequence
  Description of Artificial Sequence: Synthetic oligonucleotide
  Target: SCN9A; (+) strand; PAM type: NRG; PAM sequence: AGG
cagagtctcactttgttgcc

SEQ ID NO: 43553 - DNA, 20 bp, Artificial Sequence
  Description of Artificial Sequence: Synthetic oligonucleotide
  Target: SCN9A; (+) strand; PAM type: NRG; PAM sequence: TGG
gtctcactttgttgccaggc

SEQ ID NO: 43554 - DNA, 20 bp, Artificial Sequence
  Description of Artificial Sequence: Synthetic oligonucleotide
  Target: SCN9A; (+) strand; PAM type: NRG; PAM sequence: GAG
ctcactttgttgccaggctg

SEQ ID NO: 43555 - DNA, 20 bp, Artificial Sequence
  Description of Artificial Sequence: Synthetic oligonucleotide
  Target: SCN9A; (+) strand; PAM type: NRG; PAM sequence: CAG
tttgttgccaggctggagtg

SEQ ID NO: 43556 - DNA, 20 bp, Artificial Sequence
  Description of Artificial Sequence: Synthetic oligonucleotide
  Target: SCN9A; (+) strand; PAM type: NRG; PAM sequence: TAG
gttgccaggctggagtgcag

SEQ ID NO: 43557 - DNA, 20 bp, Artificial Sequence
  Description of Artificial Sequence: Synthetic oligonucleotide
  Target: SCN9A; (+) strand; PAM type: NRG; PAM sequence: CAG
gccaggctggagtgcagtag

SEQ ID NO: 43558 - DNA, 20 bp, Artificial Sequence
  Description of Artificial Sequence: Synthetic oligonucleotide
  Target: SCN9A; (+) strand; PAM type: NRG; PAM sequence: AGG
ccaggctggagtgcagtagc

SEQ ID NO: 43559 - DNA, 20 bp, Artificial Sequence
  Description of Artificial Sequence: Synthetic oligonucleotide
  Target: SCN9A; (+) strand; PAM type: NRG; PAM sequence: CAG
ggagtgcagtagcaggatct

SEQ ID NO: 43560 - DNA, 20 bp, Artificial Sequence
  Description of Artificial Sequence: Synthetic oligonucleotide
  Target: SCN9A; (+) strand; PAM type: NRG; PAM sequence: TGG
tcactgcaacctctgcctcc

SEQ ID NO: 43561 - DNA, 20 bp, Artificial Sequence
  Description of Artificial Sequence: Synthetic oligonucleotide
  Target: SCN9A; (+) strand; PAM type: NRG; PAM sequence: GGG
cactgcaacctctgcctcct

SEQ ID NO: 43562 - DNA, 20 bp, Artificial Sequence
  Description of Artificial Sequence: Synthetic oligonucleotide
  Target: SCN9A; (+) strand; PAM type: NRG; PAM sequence: AAG
aacctctgcctcctgggttc

SEQ ID NO: 43563 - DNA, 20 bp, Artificial Sequence
  Description of Artificial Sequence: Synthetic oligonucleotide
  Target: SCN9A; (+) strand; PAM type: NRG; PAM sequence: CAG
ttcaagcgattctcctgcct

SEQ ID NO: 43564 - DNA, 20 bp, Artificial Sequence
  Description of Artificial Sequence: Synthetic oligonucleotide
  Target: SCN9A; (+) strand; PAM type: NRG; PAM sequence: GAG
ttctcctgcctcagcctctt

SEQ ID NO: 43565 - DNA, 20 bp, Artificial Sequence
  Description of Artificial Sequence: Synthetic oligonucleotide
  Target: SCN9A; (+) strand; PAM type: NRG; PAM sequence: TAG
tcctgcctcagcctcttgag

SEQ ID NO: 43566 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctcttgagtagc

SEQ ID NO: 43567 - DNA, 20 bp, Artificial Sequence
  Description of Artificial Sequence: Synthetic oligonucleotide
  Target: SCN9A; (+) strand; PAM type: NRG; PAM sequence: GGG
cctcagcctcttgagtagct

SEQ ID NO: 43568 - DNA, 20 bp, Artificial Sequence
  Description of Artificial Sequence: Synthetic oligonucleotide
  Target: SCN9A; (+) strand; PAM type: NRG; PAM sequence: CAG
ctcttgagtagctgggacta

SEQ ID NO: 43569 - DNA, 20 bp, Artificial Sequence
  Description of Artificial Sequence: Synthetic oligonucleotide
  Target: SCN9A; (+) strand; PAM type: NRG; PAM sequence: AGG
tcttgagtagctgggactac

SEQ ID NO: 43570 - DNA, 20 bp, Artificial Sequence
  Description of Artificial Sequence: Synthetic oligonucleotide
  Target: SCN9A; (+) strand; PAM type: NRG; PAM sequence: CAG
ggactacaggcgctcaccac

SEQ ID NO: 43571 - DNA, 20 bp, Artificial Sequence
  Description of Artificial Sequence: Synthetic oligonucleotide
  Target: SCN9A; (+) strand; PAM type: NRG; PAM sequence: AGG
gactacaggcgctcaccacc

SEQ ID NO: 43572 - DNA, 20 bp, Artificial Sequence
  Description of Artificial Sequence: Synthetic oligonucleotide
  Target: SCN9A; (+) strand; PAM type: NRG; PAM sequence: CAG
caggcgctcaccaccaggct

SEQ ID NO: 43573 - DNA, 20 bp, Artificial Sequence
  Description of Artificial Sequence: Synthetic oligonucleotide
  Target: SCN9A; (+) strand; PAM type: NRG; PAM sequence: TAG
tcagctaatttttgtatttt

SEQ ID NO: 43574 - DNA, 20 bp, Artificial Sequence
  Description of Artificial Sequence: Synthetic oligonucleotide
  Target: SCN9A; (+) strand; PAM type: NRG; PAM sequence: TAG
gctaatttttgtatttttag

SEQ ID NO: 43575 - DNA, 20 bp, Artificial Sequence
  Description of Artificial Sequence: Synthetic oligonucleotide
  Target: SCN9A; (+) strand; PAM type: NRG; PAM sequence: CGG
ttttgtatttttagtagaaa

SEQ ID NO: 43576 - DNA, 20 bp, Artificial Sequence
  Description of Artificial Sequence: Synthetic oligonucleotide
  Target: SCN9A; (+) strand; PAM type: NRG; PAM sequence: GGG
tttgtatttttagtagaaac

SEQ ID NO: 43577 - DNA, 20 bp, Artificial Sequence
  Description of Artificial Sequence: Synthetic oligonucleotide
  Target: SCN9A; (+) strand; PAM type: NRG; PAM sequence: TAG
gaaacgggatttcaccatgt

SEQ ID NO: 43578 - DNA, 20 bp, Artificial Sequence
  Description of Artificial Sequence: Synthetic oligonucleotide
  Target: SCN9A; (+) strand; PAM type: NRG; PAM sequence: CAG
cgggatttcaccatgttagc

SEQ ID NO: 43579 - DNA, 20 bp, Artificial Sequence
  Description of Artificial Sequence: Synthetic oligonucleotide
  Target: SCN9A; (+) strand; PAM type: NRG; PAM sequence: AGG
gggatttcaccatgttagcc

SEQ ID NO: 43580 - DNA, 20 bp, Artificial Sequence
  Description of Artificial Sequence: Synthetic oligonucleotide
  Target: SCN9A; (+) strand; PAM type: NRG; PAM sequence: TGG
tttcaccatgttagccagga

SEQ ID NO: 43581 - DNA, 20 bp, Artificial Sequence
  Description of Artificial Sequence: Synthetic oligonucleotide
  Target: SCN9A; (+) strand; PAM type: NRG; PAM sequence: AAG
gatctcttgaccttgtgaaa

SEQ ID NO: 43582 - DNA, 20 bp, Artificial Sequence
  Description of Artificial Sequence: Synthetic oligonucleotide
  Target: SCN9A; (+) strand; PAM type: NRG; PAM sequence: AGG
atctcttgaccttgtgaaaa

SEQ ID NO: 43583 - DNA, 20 bp, Artificial Sequence
  Description of Artificial Sequence: Synthetic oligonucleotide
  Target: SCN9A; (+) strand; PAM type: NRG; PAM sequence: AAG
ttactaatttgataatctaa

SEQ ID NO: 43584 - DNA, 20 bp, Artificial Sequence
  Description of Artificial Sequence: Synthetic oligonucleotide
  Target: SCN9A; (+) strand; PAM type: NRG; PAM sequence: CAG
ctaatttgataatctaaaag

SEQ ID NO: 43585 - DNA, 20 bp, Artificial Sequence
  Description of Artificial Sequence: Synthetic oligonucleotide
  Target: SCN9A; (+) strand; PAM type: NRG; PAM sequence: TAG
cagcacaatataaaaccaca

SEQ ID NO: 43586 - DNA, 20 bp, Artificial Sequence
  Description of Artificial Sequence: Synthetic oligonucleotide
  Target: SCN9A; (+) strand; PAM type: NRG; PAM sequence: AAG
tataaaaccacatagaccca

SEQ ID NO: 43587 - DNA, 20 bp, Artificial Sequence
  Description of Artificial Sequence: Synthetic oligonucleotide
  Target: SCN9A; (+) strand; PAM type: NRG; PAM sequence: GAG
taaaaccacatagacccaaa

SEQ ID NO: 43588 - DNA, 20 bp, Artificial Sequence
  Description of Artificial Sequence: Synthetic oligonucleotide
  Target: SCN9A; (+) strand; PAM type: NRG; PAM sequence: TAG
atgtcatgttcataattata

SEQ ID NO: 43589 - DNA, 20 bp, Artificial Sequence
  Description of Artificial Sequence: Synthetic oligonucleotide
  Target: SCN9A; (+) strand; PAM type: NRG; PAM sequence: AGG
tgtcatgttcataattatat

SEQ ID NO: 43590 - DNA, 20 bp, Artificial Sequence
  Description of Artificial Sequence: Synthetic oligonucleotide
  Target: SCN9A; (+) strand; PAM type: NRG; PAM sequence: AAG
tcataattatataggttgcc

SEQ ID NO: 43591 - DNA, 20 bp, Artificial Sequence
  Description of Artificial Sequence: Synthetic oligonucleotide
  Target: SCN9A; (+) strand; PAM type: NRG; PAM sequence: TAG
atataggttgccaagtcatg

SEQ ID NO: 43592 - DNA, 20 bp, Artificial Sequence
  Description of Artificial Sequence: Synthetic oligonucleotide
  Target: SCN9A; (+) strand; PAM type: NRG; PAM sequence: AAG
ttgccaagtcatgtagaact

SEQ ID NO: 43593 - DNA, 20 bp, Artificial Sequence
  Description of Artificial Sequence: Synthetic oligonucleotide
  Target: SCN9A; (+) strand; PAM type: NRG; PAM sequence: AGG
tgccaagtcatgtagaacta

SEQ ID NO: 43594 - DNA, 20 bp, Artificial Sequence
  Description of Artificial Sequence: Synthetic oligonucleotide
  Target: SCN9A; (+) strand; PAM type: NRG; PAM sequence: TAG
aagtcatgtagaactaagga

SEQ ID NO: 43595 - DNA, 20 bp, Artificial Sequence
  Description of Artificial Sequence: Synthetic oligonucleotide
  Target: SCN9A; (+) strand; PAM type: NRG; PAM sequence: AAG
atgtagaactaaggatagta

SEQ ID NO: 43596 - DNA, 20 bp, Artificial Sequence
  Description of Artificial Sequence: Synthetic oligonucleotide
  Target: SCN9A; (+) strand; PAM type: NRG; PAM sequence: CAG
gaactaaggatagtaaagaa

SEQ ID NO: 43597 - DNA, 20 bp, Artificial Sequence
  Description of Artificial Sequence: Synthetic oligonucleotide
  Target: SCN9A; (+) strand; PAM type: NRG; PAM sequence: AGG
aactaaggatagtaaagaac

SEQ ID NO: 43598 - DNA, 20 bp, Artificial Sequence
  Description of Artificial Sequence: Synthetic oligonucleotide
  Target: SCN9A; (+) strand; PAM type: NRG; PAM sequence: GGG
actaaggatagtaaagaaca

SEQ ID NO: 43599 - DNA, 20 bp, Artificial Sequence
  Description of Artificial Sequence: Synthetic oligonucleotide
  Target: SCN9A; (+) strand; PAM type: NRG; PAM sequence: AAG
aggatagtaaagaacagggc

SEQ ID NO: 43600 - DNA, 20 bp, Artificial Sequence
  Description of Artificial Sequence: Synthetic oligonucleotide
  Target: SCN9A; (+) strand; PAM type: NRG; PAM sequence: CGG
aaagaacagggcaagatata

SEQ ID NO: 43601 - DNA, 20 bp, Artificial Sequence
  Description of Artificial Sequence: Synthetic oligonucleotide
  Target: SCN9A; (+) strand; PAM type: NRG; PAM sequence: AAG
gaacagggcaagatatacgg

SEQ ID NO: 43602 - DNA, 20 bp, Artificial Sequence
  Description of Artificial Sequence: Synthetic oligonucleotide
  Target: SCN9A; (+) strand; PAM type: NRG; PAM sequence: CAG
cagggcaagatatacggaag

SEQ ID NO: 43603 - DNA, 20 bp, Artificial Sequence
  Description of Artificial Sequence: Synthetic oligonucleotide
  Target: SCN9A; (+) strand; PAM type: NRG; PAM sequence: AAG
agatatacggaagcagtctg

SEQ ID NO: 43604 - DNA, 20 bp, Artificial Sequence
  Description of Artificial Sequence: Synthetic oligonucleotide
  Target: SCN9A; (+) strand; PAM type: NRG; PAM sequence: AAG
gtctgaagtcttcaaataca

SEQ ID NO: 43605 - DNA, 20 bp, Artificial Sequence
  Description of Artificial Sequence: Synthetic oligonucleotide
  Target: SCN9A; (+) strand; PAM type: NRG; PAM sequence: TAG
agtcttcaaatacaaagtaa

SEQ ID NO: 43606 - DNA, 20 bp, Artificial Sequence
  Description of Artificial Sequence: Synthetic oligonucleotide
  Target: SCN9A; (+) strand; PAM type: NRG; PAM sequence: CAG
caaatacaaagtaatagaca

SEQ ID NO: 43607 - DNA, 20 bp, Artificial Sequence
  Description of Artificial Sequence: Synthetic oligonucleotide
  Target: SCN9A; (+) strand; PAM type: NRG; PAM sequence: GAG
aatacaaagtaatagacaca

SEQ ID NO: 43608 - DNA, 20 bp, Artificial Sequence
  Description of Artificial Sequence: Synthetic oligonucleotide
  Target: SCN9A; (+) strand; PAM type: NRG; PAM sequence: AAG
aaagtaatagacacagagct

SEQ ID NO: 43609 - DNA, 20 bp, Artificial Sequence
  Description of Artificial Sequence: Synthetic oligonucleotide
  Target: SCN9A; (+) strand; PAM type: NRG; PAM sequence: AGG
aagtaatagacacagagcta

SEQ ID NO: 43610 - DNA, 20 bp, Artificial Sequence
  Description of Artificial Sequence: Synthetic oligonucleotide
  Target: SCN9A; (+) strand; PAM type: NRG; PAM sequence: AAG
gctaaggaacaaccttgcat

SEQ ID NO: 43611 - DNA, 20 bp, Artificial Sequence
  Description of Artificial Sequence: Synthetic oligonucleotide
  Target: SCN9A; (+) strand; PAM type: NRG; PAM sequence: GAG
taaggaacaaccttgcataa

SEQ ID NO: 43612 - DNA, 20 bp, Artificial Sequence
  Description of Artificial Sequence: Synthetic oligonucleotide
  Target: SCN9A; (+) strand; PAM type: NRG; PAM sequence: AGG
aaggaacaaccttgcataag

SEQ ID NO: 43613 - DNA, 20 bp, Artificial Sequence
  Description of Artificial Sequence: Synthetic oligonucleotide
  Target: SCN9A; (+) strand; PAM type: NRG; PAM sequence: GGG
aggaacaaccttgcataaga

SEQ ID NO: 43614 - DNA, 20 bp, Artificial Sequence
  Description of Artificial Sequence: Synthetic oligonucleotide
  Target: SCN9A; (+) strand; PAM type: NRG; PAM sequence: GAG
gaacaaccttgcataagagg

SEQ ID NO: 43615 - DNA, 20 bp, Artificial Sequence
  Description of Artificial Sequence: Synthetic oligonucleotide
  Target: SCN9A; (+) strand; PAM type: NRG; PAM sequence: GAG
acaaccttgcataagaggga

SEQ ID NO: 43616 - DNA, 20 bp, Artificial Sequence
  Description of Artificial Sequence: Synthetic oligonucleotide
  Target: SCN9A; (+) strand; PAM type: NRG; PAM sequence: AAG
cttgcataagagggagagaa

SEQ ID NO: 43617 - DNA, 20 bp, Artificial Sequence
  Description of Artificial Sequence: Synthetic oligonucleotide
  Target: SCN9A; (+) strand; PAM type: NRG; PAM sequence: AGG
ttgcataagagggagagaaa

SEQ ID NO: 43618 - DNA, 20 bp, Artificial Sequence
  Description of Artificial Sequence: Synthetic oligonucleotide
  Target: SCN9A; (+) strand; PAM type: NRG; PAM sequence: AAG
gagggagagaaaaggtgaat

SEQ ID NO: 43619 - DNA, 20 bp, Artificial Sequence
  Description of Artificial Sequence: Synthetic oligonucleotide
  Target: SCN9A; (+) strand; PAM type: NRG; PAM sequence: GAG
gggagagaaaaggtgaataa

SEQ ID NO: 43620 - DNA, 20 bp, Artificial Sequence
  Description of Artificial Sequence: Synthetic oligonucleotide
  Target: SCN9A; (+) strand; PAM type: NRG; PAM sequence: AGG
ggagagaaaaggtgaataag

SEQ ID NO: 43621 - DNA, 20 bp, Artificial Sequence
  Description of Artificial Sequence: Synthetic oligonucleotide
  Target: SCN9A; (+) strand; PAM type: NRG; PAM sequence: CAG
aaaaggtgaataagaggaac

SEQ ID NO: 43622 - DNA, 20 bp, Artificial Sequence
  Description of Artificial Sequence: Synthetic oligonucleotide
  Target: SCN9A; (+) strand; PAM type: NRG; PAM sequence: TAG
atgcaatcaatgaaatacat

SEQ ID NO: 43623 - DNA, 20 bp, Artificial Sequence
  Description of Artificial Sequence: Synthetic oligonucleotide
  Target: SCN9A; (+) strand; PAM type: NRG; PAM sequence: AAG
atcaatgaaatacattagta

SEQ ID NO: 43624 - DNA, 20 bp, Artificial Sequence
  Description of Artificial Sequence: Synthetic oligonucleotide
  Target: SCN9A; (+) strand; PAM type: NRG; PAM sequence: AAG
ttagtaaagtgataattatg

SEQ ID NO: 43625 - DNA, 20 bp, Artificial Sequence
  Description of Artificial Sequence: Synthetic oligonucleotide
  Target: SCN9A; (+) strand; PAM type: NRG; PAM sequence: GAG
tgaaatgaatcaacaaatgt

SEQ ID NO: 43626 - DNA, 20 bp, Artificial Sequence
  Description of Artificial Sequence: Synthetic oligonucleotide
  Target: SCN9A; (+) strand; PAM type: NRG; PAM sequence: CAG
atcgttttaacatttatctt

SEQ ID NO: 43627 - DNA, 20 bp, Artificial Sequence
  Description of Artificial Sequence: Synthetic oligonucleotide
  Target: SCN9A; (+) strand; PAM type: NRG; PAM sequence: TGG
ttcagtaaaaacatgctact

SEQ ID NO: 43628 - DNA, 20 bp, Artificial Sequence
  Description of Artificial Sequence: Synthetic oligonucleotide
  Target: SCN9A; (+) strand; PAM type: NRG; PAM sequence: CAG
taattttttctgttaccttt

SEQ ID NO: 43629 - DNA, 20 bp, Artificial Sequence
  Description of Artificial Sequence: Synthetic oligonucleotide
  Target: SCN9A; (+) strand; PAM type: NRG; PAM sequence: AGG
aattttttctgttacctttc

SEQ ID NO: 43630 - DNA, 20 bp, Artificial Sequence
  Description of Artificial Sequence: Synthetic oligonucleotide
  Target: SCN9A; (+) strand; PAM type: NRG; PAM sequence: TAG
tttttctgttacctttcagg

SEQ ID NO: 43631 - DNA, 20 bp, Artificial Sequence
  Description of Artificial Sequence: Synthetic oligonucleotide
  Target: SCN9A; (+) strand; PAM type: NRG; PAM sequence: CAG
ttctgttacctttcaggtag

SEQ ID NO: 43632 - DNA, 20 bp, Artificial Sequence
  Description of Artificial Sequence: Synthetic oligonucleotide
  Target: SCN9A; (+) strand; PAM type: NRG; PAM sequence: GAG
ctgttacctttcaggtagca

SEQ ID NO: 43633 - DNA, 20 bp, Artificial Sequence
  Description of Artificial Sequence: Synthetic oligonucleotide
  Target: SCN9A; (+) strand; PAM type: NRG; PAM sequence: TGG
tttcaggtagcagagatctc

SEQ ID NO: 43634 - DNA, 20 bp, Artificial Sequence
  Description of Artificial Sequence: Synthetic oligonucleotide
  Target: SCN9A; (+) strand; PAM type: NRG; PAM sequence: GAG
tcaggtagcagagatctctg

SEQ ID NO: 43635 - DNA, 20 bp, Artificial Sequence
  Description of Artificial Sequence: Synthetic oligonucleotide
  Target: SCN9A; (+) strand; PAM type: NRG; PAM sequence: AGG
caggtagcagagatctctgg

SEQ ID NO: 43636 - DNA, 20 bp, Artificial Sequence
  Description of Artificial Sequence: Synthetic oligonucleotide
  Target: SCN9A; (+) strand; PAM type: NRG; PAM sequence: TGG
ggtgaaacattgctctgaac

SEQ ID NO: 43637 - DNA, 20 bp, Artificial Sequence
  Description of Artificial Sequence: Synthetic oligonucleotide
  Target: SCN9A; (+) strand; PAM type: NRG; PAM sequence: TAG
ctctgaactggcattgattc

SEQ ID NO: 43638 - DNA, 20 bp, Artificial Sequence
  Description of Artificial Sequence: Synthetic oligonucleotide
  Target: SCN9A; (+) strand; PAM type: NRG; PAM sequence: CAG
aactggcattgattctagcc

SEQ ID NO: 43639 - DNA, 20 bp, Artificial Sequence
  Description of Artificial Sequence: Synthetic oligonucleotide
  Target: SCN9A; (+) strand; PAM type: NRG; PAM sequence: TAG
tgattctagcccagctcttg

SEQ ID NO: 43640 - DNA, 20 bp, Artificial Sequence
  Description of Artificial Sequence: Synthetic oligonucleotide
  Target: SCN9A; (+) strand; PAM type: NRG; PAM sequence: AAG
tagaccaattaccaacttgt

SEQ ID NO: 43641 - DNA, 20 bp, Artificial Sequence
  Description of Artificial Sequence: Synthetic oligonucleotide
  Target: SCN9A; (+) strand; PAM type: NRG; PAM sequence: AAG
tcatgattcttcattctgac

SEQ ID NO: 43642 - DNA, 20 bp, Artificial Sequence
  Description of Artificial Sequence: Synthetic oligonucleotide
  Target: SCN9A; (+) strand; PAM type: NRG; PAM sequence: CAG
tctgacaagcccatgcttct

SEQ ID NO: 43643 - DNA, 20 bp, Artificial Sequence
  Description of Artificial Sequence: Synthetic oligonucleotide
  Target: SCN9A; (+) strand; PAM type: NRG; PAM sequence: TGG
catgcttctcagtcttcatg

SEQ ID NO: 43644 - DNA, 20 bp, Artificial Sequence
  Description of Artificial Sequence: Synthetic oligonucleotide
  Target: SCN9A; (+) strand; PAM type: NRG; PAM sequence: CAG
atgtggaaactatgcatttc

SEQ ID NO: 43645 - DNA, 20 bp, Artificial Sequence
  Description of Artificial Sequence: Synthetic oligonucleotide
  Target: SCN9A; (+) strand; PAM type: NRG; PAM sequence: AAG
actatgcatttccagttttt

SEQ ID NO: 43646 - DNA, 20 bp, Artificial Sequence
  Description of Artificial Sequence: Synthetic oligonucleotide
  Target: SCN9A; (+) strand; PAM type: NRG; PAM sequence: CAG
aatccatcaacaaatccctt

SEQ ID NO: 43647 - DNA, 20 bp, Artificial Sequence
  Description of Artificial Sequence: Synthetic oligonucleotide
  Target: SCN9A; (+) strand; PAM type: NRG; PAM sequence: CAG
ctctaacttcaaaatatact

SEQ ID NO: 43648 - DNA, 20 bp, Artificial Sequence
  Description of Artificial Sequence: Synthetic oligonucleotide
  Target: SCN9A; (+) strand; PAM type: NRG; PAM sequence: TAG
tatacaaaactctaccatac

SEQ ID NO: 43649 - DNA, 20 bp, Artificial Sequence
  Description of Artificial Sequence: Synthetic oligonucleotide
  Target: SCN9A; (+) strand; PAM type: NRG; PAM sequence: AAG
aaactctaccatactagtct

SEQ ID NO: 43650 - DNA, 20 bp, Artificial Sequence
  Description of Artificial Sequence: Synthetic oligonucleotide
  Target: SCN9A; (+) strand; PAM type: NRG; PAM sequence: TGG
agctcccatcacctctcacc

SEQ ID NO: 43651 - DNA, 20 bp, Artificial Sequence
  Description of Artificial Sequence: Synthetic oligonucleotide
  Target: SCN9A; (+) strand; PAM type: NRG; PAM sequence: CAG
acctctcacctggatttatg

SEQ ID NO: 43652 - DNA, 20 bp, Artificial Sequence
  Description of Artificial Sequence: Synthetic oligonucleotide
  Target: SCN9A; (+) strand; PAM type: NRG; PAM sequence: AAG
tggatttatgcagaaactcc

SEQ ID NO: 43653 - DNA, 20 bp, Artificial Sequence
  Description of Artificial Sequence: Synthetic oligonucleotide
  Target: SCN9A; (+) strand; PAM type: NRG; PAM sequence: CAG
agaaactccaagaaatcttc

SEQ ID NO: 43654 - DNA, 20 bp, Artificial Sequence
  Description of Artificial Sequence: Synthetic oligonucleotide
  Target: SCN9A; (+) strand; PAM type: NRG; PAM sequence: AAG
ctattcgcccttccactctt

SEQ ID NO: 43655 - DNA, 20 bp, Artificial Sequence
  Description of Artificial Sequence: Synthetic oligonucleotide
  Target: SCN9A; (+) strand; PAM type: NRG; PAM sequence: GAG
ctcttaagattgcacattgt

SEQ ID NO: 43656 - DNA, 20 bp, Artificial Sequence
  Description of Artificial Sequence: Synthetic oligonucleotide
  Target: SCN9A; (+) strand; PAM type: NRG; PAM sequence: TGG
tcttcaaatgtcttataatc

SEQ ID NO: 43657 - DNA, 20 bp, Artificial Sequence
  Description of Artificial Sequence: Synthetic oligonucleotide
  Target: SCN9A; (+) strand; PAM type: NRG; PAM sequence: TGG
tgttttatttgtttgtttgt

SEQ ID NO: 43658 - DNA, 20 bp, Artificial Sequence
  Description of Artificial Sequence: Synthetic oligonucleotide
  Target: SCN9A; (+) strand; PAM type: NRG; PAM sequence: GAG
ttttatttgtttgtttgttg

SEQ ID NO: 43659 - DNA, 20 bp, Artificial Sequence
  Description of Artificial Sequence: Synthetic oligonucleotide
  Target: SCN9A; (+) strand; PAM type: NRG; PAM sequence: CAG
atttgtttgtttgttggaga

SEQ ID NO: 43660 - DNA, 20 bp, Artificial Sequence
  Description of Artificial Sequence: Synthetic oligonucleotide
  Target: SCN9A; (+) strand; PAM type: NRG; PAM sequence: GAG
ttgtttgtttgttggagaca

SEQ ID NO: 43661 - DNA, 20 bp, Artificial Sequence
  Description of Artificial Sequence: Synthetic oligonucleotide
  Target: SCN9A; (+) strand; PAM type: NRG; PAM sequence: CAG
cagagtcttcctctgtcgtc

SEQ ID NO: 43662 - DNA, 20 bp, Artificial Sequence
  Description of Artificial Sequence: Synthetic oligonucleotide
  Target: SCN9A; (+) strand; PAM type: NRG; PAM sequence: AGG
agagtcttcctctgtcgtcc

SEQ ID NO: 43663 - DNA, 20 bp, Artificial Sequence
  Description of Artificial Sequence: Synthetic oligonucleotide
  Target: SCN9A; (+) strand; PAM type: NRG; PAM sequence: TGG
tcttcctctgtcgtccaggc

SEQ ID NO: 43664 - DNA, 20 bp, Artificial Sequence
  Description of Artificial Sequence: Synthetic oligonucleotide
  Target: SCN9A; (+) strand; PAM type: NRG; PAM sequence: GAG
ttcctctgtcgtccaggctg

SEQ ID NO: 43665 - DNA, 20 bp, Artificial Sequence
  Description of Artificial Sequence: Synthetic oligonucleotide
  Target: SCN9A; (+) strand; PAM type: NRG; PAM sequence: CAG
ctgtcgtccaggctggagtg

SEQ ID NO: 43666 - DNA, 20 bp, Artificial Sequence
  Description of Artificial Sequence: Synthetic oligonucleotide
  Target: SCN9A; (+) strand; PAM type: NRG; PAM sequence: TGG
tcgtccaggctggagtgcag

SEQ ID NO: 43667 - DNA, 20 bp, Artificial Sequence
  Description of Artificial Sequence: Synthetic oligonucleotide
  Target: SCN9A; (+) strand; PAM type: NRG; PAM sequence: TGG
ggagtgcagtggcacaatct

SEQ ID NO: 43668 - DNA, 20 bp, Artificial Sequence
  Description of Artificial Sequence: Synthetic oligonucleotide
  Target: SCN9A; (+) strand; PAM type: NRG; PAM sequence: TGG
tcactgcaacctctgcctcc

SEQ ID NO: 43669 - DNA, 20 bp, Artificial Sequence
  Description of Artificial Sequence: Synthetic oligonucleotide
  Target: SCN9A; (+) strand; PAM type: NRG; PAM sequence: AAG
aacctctgcctcctggattc

SEQ ID NO: 43670 - DNA, 20 bp, Artificial Sequence
  Description of Artificial Sequence: Synthetic oligonucleotide
  Target: SCN9A; (+) strand; PAM type: NRG; PAM sequence: CAG
ttcaagtaattctcgtgcct

SEQ ID NO: 43671 - DNA, 20 bp, Artificial Sequence
  Description of Artificial Sequence: Synthetic oligonucleotide
  Target: SCN9A; (+) strand; PAM type: NRG; PAM sequence: AAG
ttctcgtgcctcagcctcac

SEQ ID NO: 43672 - DNA, 20 bp, Artificial Sequence
  Description of Artificial Sequence: Synthetic oligonucleotide
  Target: SCN9A; (+) strand; PAM type: NRG; PAM sequence: TAG
tcgtgcctcagcctcacaag

SEQ ID NO: 43673 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctcacaagtagc

SEQ ID NO: 43674 - DNA, 20 bp, Artificial Sequence
  Description of Artificial Sequence: Synthetic oligonucleotide
  Target: SCN9A; (+) strand; PAM type: NRG; PAM sequence: GGG
cctcagcctcacaagtagct

SEQ ID NO: 43675 - DNA, 20 bp, Artificial Sequence
  Description of Artificial Sequence: Synthetic oligonucleotide
  Target: SCN9A; (+) strand; PAM type: NRG; PAM sequence: TAG
ctcacaagtagctgggatta

SEQ ID NO: 43676 - DNA, 20 bp, Artificial Sequence
  Description of Artificial Sequence: Synthetic oligonucleotide
  Target: SCN9A; (+) strand; PAM type: NRG; PAM sequence: AGG
tcacaagtagctgggattat

SEQ ID NO: 43677 - DNA, 20 bp, Artificial Sequence
  Description of Artificial Sequence: Synthetic oligonucleotide
  Target: SCN9A; (+) strand; PAM type: NRG; PAM sequence: AAG
gattataggcatgtatcacc

SEQ ID NO: 43678 - DNA, 20 bp, Artificial Sequence
  Description of Artificial Sequence: Synthetic oligonucleotide
  Target: SCN9A; (+) strand; PAM type: NRG; PAM sequence: CAG
attaatttttttttcatttt

SEQ ID NO: 43679 - DNA, 20 bp, Artificial Sequence
  Description of Artificial Sequence: Synthetic oligonucleotide
  Target: SCN9A; (+) strand; PAM type: NRG; PAM sequence: TGG
tttttcattttcagtaaaaa

SEQ ID NO: 43680 - DNA, 20 bp, Artificial Sequence
  Description of Artificial Sequence: Synthetic oligonucleotide
  Target: SCN9A; (+) strand; PAM type: NRG; PAM sequence: GGG
ttttcattttcagtaaaaat

SEQ ID NO: 43681 - DNA, 20 bp, Artificial Sequence
  Description of Artificial Sequence: Synthetic oligonucleotide
  Target: SCN9A; (+) strand; PAM type: NRG; PAM sequence: GGG
tttcattttcagtaaaaatg

SEQ ID NO: 43682 - DNA, 20 bp, Artificial Sequence
  Description of Artificial Sequence: Synthetic oligonucleotide
  Target: SCN9A; (+) strand; PAM type: NRG; PAM sequence: TGG
aaaatggggtttcgctacgt

SEQ ID NO: 43683 - DNA, 20 bp, Artificial Sequence
  Description of Artificial Sequence: Synthetic oligonucleotide
  Target: SCN9A; (+) strand; PAM type: NRG; PAM sequence: CAG
tggggtttcgctacgttggc

SEQ ID NO: 43684 - DNA, 20 bp, Artificial Sequence
  Description of Artificial Sequence: Synthetic oligonucleotide
  Target: SCN9A; (+) strand; PAM type: NRG; PAM sequence: AGG
ggggtttcgctacgttggcc

SEQ ID NO: 43685 - DNA, 20 bp, Artificial Sequence
  Description of Artificial Sequence: Synthetic oligonucleotide
  Target: SCN9A; (+) strand; PAM type: NRG; PAM sequence: TGG
tttcgctacgttggccaggc

SEQ ID NO: 43686 - DNA, 20 bp, Artificial Sequence
  Description of Artificial Sequence: Synthetic oligonucleotide
  Target: SCN9A; (+) strand; PAM type: NRG; PAM sequence: TGG
ccaggctggtcttgaactcc

SEQ ID NO: 43687 - DNA, 20 bp, Artificial Sequence
  Description of Artificial Sequence: Synthetic oligonucleotide
  Target: SCN9A; (+) strand; PAM type: NRG; PAM sequence: AAG
ggtcttgaactcctggcctc

SEQ ID NO: 43688 - DNA, 20 bp, Artificial Sequence
  Description of Artificial Sequence: Synthetic oligonucleotide
  Target: SCN9A; (+) strand; PAM type: NRG; PAM sequence: CGG
cctcaagtgatcgcccacct

SEQ ID NO: 43689 - DNA, 20 bp, Artificial Sequence
  Description of Artificial Sequence: Synthetic oligonucleotide
  Target: SCN9A; (+) strand; PAM type: NRG; PAM sequence: AAG
tcgcccacctcggcctccca

SEQ ID NO: 43690 - DNA, 20 bp, Artificial Sequence
  Description of Artificial Sequence: Synthetic oligonucleotide
  Target: SCN9A; (+) strand; PAM type: NRG; PAM sequence: TGG
acctcggcctcccaaagtac

SEQ ID NO: 43691 - DNA, 20 bp, Artificial Sequence
  Description of Artificial Sequence: Synthetic oligonucleotide
  Target: SCN9A; (+) strand; PAM type: NRG; PAM sequence: TAG
ctcccaaagtactggaatta

SEQ ID NO: 43692 - DNA, 20 bp, Artificial Sequence
  Description of Artificial Sequence: Synthetic oligonucleotide
  Target: SCN9A; (+) strand; PAM type: NRG; PAM sequence: AGG
tcccaaagtactggaattat

SEQ ID NO: 43693 - DNA, 20 bp, Artificial Sequence
  Description of Artificial Sequence: Synthetic oligonucleotide
  Target: SCN9A; (+) strand; PAM type: NRG; PAM sequence: GAG
agtactggaattataggtgt

SEQ ID NO: 43694 - DNA, 20 bp, Artificial Sequence
  Description of Artificial Sequence: Synthetic oligonucleotide
  Target: SCN9A; (+) strand; PAM type: NRG; PAM sequence: CAG
taggtgtgagccacttcacc

SEQ ID NO: 43695 - DNA, 20 bp, Artificial Sequence
  Description of Artificial Sequence: Synthetic oligonucleotide
  Target: SCN9A; (+) strand; PAM type: NRG; PAM sequence: TGG
tcattattctccatctattt

SEQ ID NO: 43696 - DNA, 20 bp, Artificial Sequence
  Description of Artificial Sequence: Synthetic oligonucleotide
  Target: SCN9A; (+) strand; PAM type: NRG; PAM sequence: TGG
ctccatctattttggcctct

SEQ ID NO: 43697 - DNA, 20 bp, Artificial Sequence
  Description of Artificial Sequence: Synthetic oligonucleotide
  Target: SCN9A; (+) strand; PAM type: NRG; PAM sequence: TGG
tgttatgcatatcctcacct

SEQ ID NO: 43698 - DNA, 20 bp, Artificial Sequence
  Description of Artificial Sequence: Synthetic oligonucleotide
  Target: SCN9A; (+) strand; PAM type: NRG; PAM sequence: GGG
gttatgcatatcctcacctt

SEQ ID NO: 43699 - DNA, 20 bp, Artificial Sequence
  Description of Artificial Sequence: Synthetic oligonucleotide
  Target: SCN9A; (+) strand; PAM type: NRG; PAM sequence: GGG
ttatgcatatcctcaccttg

SEQ ID NO: 43700 - DNA, 20 bp, Artificial Sequence
  Description of Artificial Sequence: Synthetic oligonucleotide
  Target: SCN9A; (+) strand; PAM type: NRG; PAM sequence: CGG
tttccctccatatatttgca

SEQ ID NO: 43701 - DNA, 20 bp, Artificial Sequence
  Description of Artificial Sequence: Synthetic oligonucleotide
  Target: SCN9A; (+) strand; PAM type: NRG; PAM sequence: CGG
cttcaattttctttacatca

SEQ ID NO: 43702 - DNA, 20 bp, Artificial Sequence
  Description of Artificial Sequence: Synthetic oligonucleotide
  Target: SCN9A; (+) strand; PAM type: NRG; PAM sequence: AAG
caattttctttacatcacgg

SEQ ID NO: 43703 - DNA, 20 bp, Artificial Sequence
  Description of Artificial Sequence: Synthetic oligonucleotide
  Target: SCN9A; (+) strand; PAM type: NRG; PAM sequence: TAG
cggaagaaacgccaccttta

SEQ ID NO: 43704 - DNA, 20 bp, Artificial Sequence
  Description of Artificial Sequence: Synthetic oligonucleotide
  Target: SCN9A; (+) strand; PAM type: NRG; PAM sequence: AGG
ggaagaaacgccacctttat

SEQ ID NO: 43705 - DNA, 20 bp, Artificial Sequence
  Description of Artificial Sequence: Synthetic oligonucleotide
  Target: SCN9A; (+) strand; PAM type: NRG; PAM sequence: CAG
agaaacgccacctttatagg

SEQ ID NO: 43706 - DNA, 20 bp, Artificial Sequence
  Description of Artificial Sequence: Synthetic oligonucleotide
  Target: SCN9A; (+) strand; PAM type: NRG; PAM sequence: AGG
gaaacgccacctttataggc

SEQ ID NO: 43707 - DNA, 20 bp, Artificial Sequence
  Description of Artificial Sequence: Synthetic oligonucleotide
  Target: SCN9A; (+) strand; PAM type: NRG; PAM sequence: TAG
tctgaccaatcattcattga

SEQ ID NO: 43708 - DNA, 20 bp, Artificial Sequence
  Description of Artificial Sequence: Synthetic oligonucleotide
  Target: SCN9A; (+) strand; PAM type: NRG; PAM sequence: TAG
ttgatagcatatttatgtgc

SEQ ID NO: 43709 - DNA, 20 bp, Artificial Sequence
  Description of Artificial Sequence: Synthetic oligonucleotide
  Target: SCN9A; (+) strand; PAM type: NRG; PAM sequence: AAG
tagcatatttatgtgctagt

SEQ ID NO: 43710 - DNA, 20 bp, Artificial Sequence
  Description of Artificial Sequence: Synthetic oligonucleotide
  Target: SCN9A; (+) strand; PAM type: NRG; PAM sequence: TGG
aagttcttccccctcactct

SEQ ID NO: 43711 - DNA, 20 bp, Artificial Sequence
  Description of Artificial Sequence: Synthetic oligonucleotide
  Target: SCN9A; (+) strand; PAM type: NRG; PAM sequence: TAG
ttttccatataccttctcca

SEQ ID NO: 43712 - DNA, 20 bp, Artificial Sequence
  Description of Artificial Sequence: Synthetic oligonucleotide
  Target: SCN9A; (+) strand; PAM type: NRG; PAM sequence: CAG
tacatcttgatatgtttctt

SEQ ID NO: 43713 - DNA, 20 bp, Artificial Sequence
  Description of Artificial Sequence: Synthetic oligonucleotide
  Target: SCN9A; (+) strand; PAM type: NRG; PAM sequence: AAG
tcttgatatgtttcttcagc

SEQ ID NO: 43714 - DNA, 20 bp, Artificial Sequence
  Description of Artificial Sequence: Synthetic oligonucleotide
  Target: SCN9A; (+) strand; PAM type: NRG; PAM sequence: AGG
cttgatatgtttcttcagca

SEQ ID NO: 43715 - DNA, 20 bp, Artificial Sequence
  Description of Artificial Sequence: Synthetic oligonucleotide
  Target: SCN9A; (+) strand; PAM type: NRG; PAM sequence: GGG
ttgatatgtttcttcagcaa

SEQ ID NO: 43716 - DNA, 20 bp, Artificial Sequence
  Description of Artificial Sequence: Synthetic oligonucleotide
  Target: SCN9A; (+) strand; PAM type: NRG; PAM sequence: GGG
tgatatgtttcttcagcaag

SEQ ID NO: 43717 - DNA, 20 bp, Artificial Sequence
  Description of Artificial Sequence: Synthetic oligonucleotide
  Target: SCN9A; (+) strand; PAM type: NRG; PAM sequence: CAG
aaggggtattgttttgttca

SEQ ID NO: 43718 - DNA, 20 bp, Artificial Sequence
  Description of Artificial Sequence: Synthetic oligonucleotide
  Target: SCN9A; (+) strand; PAM type: NRG; PAM sequence: CAG
ttcacagctccatctccctc

SEQ ID NO: 43719 - DNA, 20 bp, Artificial Sequence
  Description of Artificial Sequence: Synthetic oligonucleotide
  Target: SCN9A; (+) strand; PAM type: NRG; PAM sequence: TGG
ctccatctccctccagtgcc

SEQ ID NO: 43720 - DNA, 20 bp, Artificial Sequence
  Description of Artificial Sequence: Synthetic oligonucleotide
  Target: SCN9A; (+) strand; PAM type: NRG; PAM sequence: TGG
ctccctccagtgcctggaac

SEQ ID NO: 43721 - DNA, 20 bp, Artificial Sequence
  Description of Artificial Sequence: Synthetic oligonucleotide
  Target: SCN9A; (+) strand; PAM type: NRG; PAM sequence: TGG
ccagtgcctggaactggacc

SEQ ID NO: 43722 - DNA, 20 bp, Artificial Sequence
  Description of Artificial Sequence: Synthetic oligonucleotide
  Target: SCN9A; (+) strand; PAM type: NRG; PAM sequence: CAG
ctggaactggacctggcaca

SEQ ID NO: 43723 - DNA, 20 bp, Artificial Sequence
  Description of Artificial Sequence: Synthetic oligonucleotide
  Target: SCN9A; (+) strand; PAM type: NRG; PAM sequence: AGG
tggaactggacctggcacac

SEQ ID NO: 43724 - DNA, 20 bp, Artificial Sequence
  Description of Artificial Sequence: Synthetic oligonucleotide
  Target: SCN9A; (+) strand; PAM type: NRG; PAM sequence: TGG
tttaataattatttgtttac

SEQ ID NO: 43725 - DNA, 20 bp, Artificial Sequence
  Description of Artificial Sequence: Synthetic oligonucleotide
  Target: SCN9A; (+) strand; PAM type: NRG; PAM sequence: AAG
attatttgtttactggaata

SEQ ID NO: 43726 - DNA, 20 bp, Artificial Sequence
  Description of Artificial Sequence: Synthetic oligonucleotide
  Target: SCN9A; (+) strand; PAM type: NRG; PAM sequence: CGG
agaatgattatgtgaataca

SEQ ID NO: 43727 - DNA, 20 bp, Artificial Sequence
  Description of Artificial Sequence: Synthetic oligonucleotide
  Target: SCN9A; (+) strand; PAM type: NRG; PAM sequence: AAG
ttatgtgaatacacggttga

SEQ ID NO: 43728 - DNA, 20 bp, Artificial Sequence
  Description of Artificial Sequence: Synthetic oligonucleotide
  Target: SCN9A; (+) strand; PAM type: NRG; PAM sequence: AGG
tatgtgaatacacggttgaa

SEQ ID NO: 43729 - DNA, 20 bp, Artificial Sequence
  Description of Artificial Sequence: Synthetic oligonucleotide
  Target: SCN9A; (+) strand; PAM type: NRG; PAM sequence: AAG
gaatacacggttgaaaggct

SEQ ID NO: 43730 - DNA, 20 bp, Artificial Sequence
  Description of Artificial Sequence: Synthetic oligonucleotide
  Target: SCN9A; (+) strand; PAM type: NRG; PAM sequence: TGG
ggttgaaaggctaagcaaat

SEQ ID NO: 43731 - DNA, 20 bp, Artificial Sequence
  Description of Artificial Sequence: Synthetic oligonucleotide
  Target: SCN9A; (+) strand; PAM type: NRG; PAM sequence: TAG
ggctgcttcactgaatttat

SEQ ID NO: 43732 - DNA, 20 bp, Artificial Sequence
  Description of Artificial Sequence: Synthetic oligonucleotide
  Target: SCN9A; (+) strand; PAM type: NRG; PAM sequence: AGG
gctgcttcactgaatttatt

SEQ ID NO: 43733 - DNA, 20 bp, Artificial Sequence
  Description of Artificial Sequence: Synthetic oligonucleotide
  Target: SCN9A; (+) strand; PAM type: NRG; PAM sequence: CAG
tcactgaatttattaggcta

SEQ ID NO: 43734 - DNA, 20 bp, Artificial Sequence
  Description of Artificial Sequence: Synthetic oligonucleotide
  Target: SCN9A; (+) strand; PAM type: NRG; PAM sequence: CAG
aatttattaggctacagatc

SEQ ID NO: 43735 - DNA, 20 bp, Artificial Sequence
  Description of Artificial Sequence: Synthetic oligonucleotide
  Target: SCN9A; (+) strand; PAM type: NRG; PAM sequence: GAG
tttattaggctacagatcca

SEQ ID NO: 43736 - DNA, 20 bp, Artificial Sequence
  Description of Artificial Sequence: Synthetic oligonucleotide
  Target: SCN9A; (+) strand; PAM type: NRG; PAM sequence: AAG
acagatccagagactgtatg

SEQ ID NO: 43737 - DNA, 20 bp, Artificial Sequence
  Description of Artificial Sequence: Synthetic oligonucleotide
  Target: SCN9A; (+) strand; PAM type: NRG; PAM sequence: TGG
agactgtatgaagtctctgc

SEQ ID NO: 43738 - DNA, 20 bp, Artificial Sequence
  Description of Artificial Sequence: Synthetic oligonucleotide
  Target: SCN9A; (+) strand; PAM type: NRG; PAM sequence: GAG
actgtatgaagtctctgctg

SEQ ID NO: 43739 - DNA, 20 bp, Artificial Sequence
  Description of Artificial Sequence: Synthetic oligonucleotide
  Target: SCN9A; (+) strand; PAM type: NRG; PAM sequence: AAG
gtctctgctggagcacataa

SEQ ID NO: 43740 - DNA, 20 bp, Artificial Sequence
  Description of Artificial Sequence: Synthetic oligonucleotide
  Target: SCN9A; (+) strand; PAM type: NRG; PAM sequence: AGG
tctctgctggagcacataaa

SEQ ID NO: 43741 - DNA, 20 bp, Artificial Sequence
  Description of Artificial Sequence: Synthetic oligonucleotide
  Target: SCN9A; (+) strand; PAM type: NRG; PAM sequence: GGG
ctctgctggagcacataaaa

SEQ ID NO: 43742 - DNA, 20 bp, Artificial Sequence
  Description of Artificial Sequence: Synthetic oligonucleotide
  Target: SCN9A; (+) strand; PAM type: NRG; PAM sequence: CAG
cacataaaagggatgtgact

SEQ ID NO: 43743 - DNA, 20 bp, Artificial Sequence
  Description of Artificial Sequence: Synthetic oligonucleotide
  Target: SCN9A; (+) strand; PAM type: NRG; PAM sequence: GAG
cataaaagggatgtgactca

SEQ ID NO: 43744 - DNA, 20 bp, Artificial Sequence
  Description of Artificial Sequence: Synthetic oligonucleotide
  Target: SCN9A; (+) strand; PAM type: NRG; PAM sequence: CAG
ctcagagatatatgctccct

SEQ ID NO: 43745 - DNA, 20 bp, Artificial Sequence
  Description of Artificial Sequence: Synthetic oligonucleotide
  Target: SCN9A; (+) strand; PAM type: NRG; PAM sequence: TGG
gctccctcagtaaatttcaa

SEQ ID NO: 43746 - DNA, 20 bp, Artificial Sequence
  Description of Artificial Sequence: Synthetic oligonucleotide
  Target: SCN9A; (+) strand; PAM type: NRG; PAM sequence: AAG
tcagtaaatttcaatggtcc

SEQ ID NO: 43747 - DNA, 20 bp, Artificial Sequence
  Description of Artificial Sequence: Synthetic oligonucleotide
  Target: SCN9A; (+) strand; PAM type: NRG; PAM sequence: CAG
aaatttcaatggtccaagcc

SEQ ID NO: 43748 - DNA, 20 bp, Artificial Sequence
  Description of Artificial Sequence: Synthetic oligonucleotide
  Target: SCN9A; (+) strand; PAM type: NRG; PAM sequence: AGG
aatttcaatggtccaagccc

SEQ ID NO: 43749 - DNA, 20 bp, Artificial Sequence
  Description of Artificial Sequence: Synthetic oligonucleotide
  Target: SCN9A; (+) strand; PAM type: NRG; PAM sequence: TGG
tggtccaagcccaggttcat

SEQ ID NO: 43750 - DNA, 20 bp, Artificial Sequence
  Description of Artificial Sequence: Synthetic oligonucleotide
  Target: SCN9A; (+) strand; PAM type: NRG; PAM sequence: TGG
ccataatatttcttctatac

SEQ ID NO: 43751 - DNA, 20 bp, Artificial Sequence
  Description of Artificial Sequence: Synthetic oligonucleotide
  Target: SCN9A; (+) strand; PAM type: NRG; PAM sequence: CAG
tatttcttctatactggcct

SEQ ID NO: 43752 - DNA, 20 bp, Artificial Sequence
  Description of Artificial Sequence: Synthetic oligonucleotide
  Target: SCN9A; (+) strand; PAM type: NRG; PAM sequence: TGG
cttctatactggcctcagtt

SEQ ID NO: 43753 - DNA, 20 bp, Artificial Sequence
  Description of Artificial Sequence: Synthetic oligonucleotide
  Target: SCN9A; (+) strand; PAM type: NRG; PAM sequence: AAG
ctatactggcctcagtttgg

SEQ ID NO: 43754 - DNA, 20 bp, Artificial Sequence
  Description of Artificial Sequence: Synthetic oligonucleotide
  Target: SCN9A; (+) strand; PAM type: NRG; PAM sequence: CAG
ttggaagcaatgaataatct

SEQ ID NO: 43755 - DNA, 20 bp, Artificial Sequence
  Description of Artificial Sequence: Synthetic oligonucleotide
  Target: SCN9A; (+) strand; PAM type: NRG; PAM sequence: GAG
ggaagcaatgaataatctca

SEQ ID NO: 43756 - DNA, 20 bp, Artificial Sequence
  Description of Artificial Sequence: Synthetic oligonucleotide
  Target: SCN9A; (+) strand; PAM type: NRG; PAM sequence: AAG
taatctcagagtattcacaa

SEQ ID NO: 43757 - DNA, 20 bp, Artificial Sequence
  Description of Artificial Sequence: Synthetic oligonucleotide
  Target: SCN9A; (+) strand; PAM type: NRG; PAM sequence: TAG
agtattttcattgatgttta

SEQ ID NO: 43758 - DNA, 20 bp, Artificial Sequence
  Description of Artificial Sequence: Synthetic oligonucleotide
  Target: SCN9A; (+) strand; PAM type: NRG; PAM sequence: AGG
gtattttcattgatgtttat

SEQ ID NO: 43759 - DNA, 20 bp, Artificial Sequence
  Description of Artificial Sequence: Synthetic oligonucleotide
  Target: SCN9A; (+) strand; PAM type: NRG; PAM sequence: CAG
tgtattatatcttattataa

SEQ ID NO: 43760 - DNA, 20 bp, Artificial Sequence
  Description of Artificial Sequence: Synthetic oligonucleotide
  Target: SCN9A; (+) strand; PAM type: NRG; PAM sequence: CAG
tcttattataacagcaccta

SEQ ID NO: 43761 - DNA, 20 bp, Artificial Sequence
  Description of Artificial Sequence: Synthetic oligonucleotide
  Target: SCN9A; (+) strand; PAM type: NRG; PAM sequence: TAG
acagcacctacagtctgaaa

SEQ ID NO: 43762 - DNA, 20 bp, Artificial Sequence
  Description of Artificial Sequence: Synthetic oligonucleotide
  Target: SCN9A; (+) strand; PAM type: NRG; PAM sequence: TAG
acctacagtctgaaatagca

SEQ ID NO: 43763 - DNA, 20 bp, Artificial Sequence
  Description of Artificial Sequence: Synthetic oligonucleotide
  Target: SCN9A; (+) strand; PAM type: NRG; PAM sequence: AAG
atagtattaatactttctgt

SEQ ID NO: 43764 - DNA, 20 bp, Artificial Sequence
  Description of Artificial Sequence: Synthetic oligonucleotide
  Target: SCN9A; (+) strand; PAM type: NRG; PAM sequence: GAG
agtattaatactttctgtaa

SEQ ID NO: 43765 - DNA, 20 bp, Artificial Sequence
  Description of Artificial Sequence: Synthetic oligonucleotide
  Target: SCN9A; (+) strand; PAM type: NRG; PAM sequence: AAG
aatactttctgtaagagttt

SEQ ID NO: 43766 - DNA, 20 bp, Artificial Sequence
  Description of Artificial Sequence: Synthetic oligonucleotide
  Target: SCN9A; (+) strand; PAM type: NRG; PAM sequence: AAG
gtaagagtttaagttttttg

SEQ ID NO: 43767 - DNA, 20 bp, Artificial Sequence
  Description of Artificial Sequence: Synthetic oligonucleotide
  Target: SCN9A; (+) strand; PAM type: NRG; PAM sequence: TGG
agttttttgaagtcattttt

SEQ ID NO: 43768 - DNA, 20 bp, Artificial Sequence
  Description of Artificial Sequence: Synthetic oligonucleotide
  Target: SCN9A; (+) strand; PAM type: NRG; PAM sequence: AAG
attttttggtttgaaacttt

SEQ ID NO: 43769 - DNA, 20 bp, Artificial Sequence
  Description of Artificial Sequence: Synthetic oligonucleotide
  Target: SCN9A; (+) strand; PAM type: NRG; PAM sequence: AAG
gaaactttaagttgattgat

SEQ ID NO: 43770 - DNA, 20 bp, Artificial Sequence
  Description of Artificial Sequence: Synthetic oligonucleotide
  Target: SCN9A; (+) strand; PAM type: NRG; PAM sequence: TAG
tgataagcccaacttctttc

SEQ ID NO: 43771 - DNA, 20 bp, Artificial Sequence
  Description of Artificial Sequence: Synthetic oligonucleotide
  Target: SCN9A; (+) strand; PAM type: NRG; PAM sequence: TAG
caacttctttctagttatcc

SEQ ID NO: 43772 - DNA, 20 bp, Artificial Sequence
  Description of Artificial Sequence: Synthetic oligonucleotide
  Target: SCN9A; (+) strand; PAM type: NRG; PAM sequence: AAG
tctagttatcctagaatttt

SEQ ID NO: 43773 - DNA, 20 bp, Artificial Sequence
  Description of Artificial Sequence: Synthetic oligonucleotide
  Target: SCN9A; (+) strand; PAM type: NRG; PAM sequence: TAG
atgatcattcataaaatgaa

SEQ ID NO: 43774 - DNA, 20 bp, Artificial Sequence
  Description of Artificial Sequence: Synthetic oligonucleotide
  Target: SCN9A; (+) strand; PAM type: NRG; PAM sequence: AGG
tgatcattcataaaatgaat

SEQ ID NO: 43775 - DNA, 20 bp, Artificial Sequence
  Description of Artificial Sequence: Synthetic oligonucleotide
  Target: SCN9A; (+) strand; PAM type: NRG; PAM sequence: GGG
gatcattcataaaatgaata

SEQ ID NO: 43776 - DNA, 20 bp, Artificial Sequence
  Description of Artificial Sequence: Synthetic oligonucleotide
  Target: SCN9A; (+) strand; PAM type: NRG; PAM sequence: TGG
aaaatgaatagggaaaatct

SEQ ID NO: 43777 - DNA, 20 bp, Artificial Sequence
  Description of Artificial Sequence: Synthetic oligonucleotide
  Target: SCN9A; (+) strand; PAM type: NRG; PAM sequence: TAG
atgaatagggaaaatcttgg

SEQ ID NO: 43778 - DNA, 20 bp, Artificial Sequence
  Description of Artificial Sequence: Synthetic oligonucleotide
  Target: SCN9A; (+) strand; PAM type: NRG; PAM sequence: AAG
ggtagcatcaatacaaattt

SEQ ID NO: 43779 - DNA, 20 bp, Artificial Sequence
  Description of Artificial Sequence: Synthetic oligonucleotide
  Target: SCN9A; (+) strand; PAM type: NRG; PAM sequence: GAG
atactgctaataaatttctt

SEQ ID NO: 43780 - DNA, 20 bp, Artificial Sequence
  Description of Artificial Sequence: Synthetic oligonucleotide
  Target: SCN9A; (+) strand; PAM type: NRG; PAM sequence: AGG
tactgctaataaatttcttg

SEQ ID NO: 43781 - DNA, 20 bp, Artificial Sequence
  Description of Artificial Sequence: Synthetic oligonucleotide
  Target: SCN9A; (+) strand; PAM type: NRG; PAM sequence: GAG
ctgctaataaatttcttgag

SEQ ID NO: 43782 - DNA, 20 bp, Artificial Sequence
  Description of Artificial Sequence: Synthetic oligonucleotide
  Target: SCN9A; (+) strand; PAM type: NRG; PAM sequence: CAG
ctaataaatttcttgaggag

SEQ ID NO: 43783 - DNA, 20 bp, Artificial Sequence
  Description of Artificial Sequence: Synthetic oligonucleotide
  Target: SCN9A; (+) strand; PAM type: NRG; PAM sequence: AGG
taataaatttcttgaggagc

SEQ ID NO: 43784 - DNA, 20 bp, Artificial Sequence
  Description of Artificial Sequence: Synthetic oligonucleotide
  Target: SCN9A; (+) strand; PAM type: NRG; PAM sequence: TGG
attcttaaatctctgtaaca

SEQ ID NO: 43785 - DNA, 20 bp, Artificial Sequence
  Description of Artificial Sequence: Synthetic oligonucleotide
  Target: SCN9A; (+) strand; PAM type: NRG; PAM sequence: AAG
ctgtaacatggacactttta

SEQ ID NO: 43786 - DNA, 20 bp, Artificial Sequence
  Description of Artificial Sequence: Synthetic oligonucleotide
  Target: SCN9A; (+) strand; PAM type: NRG; PAM sequence: AGG
tgtaacatggacacttttaa

SEQ ID NO: 43787 - DNA, 20 bp, Artificial Sequence
  Description of Artificial Sequence: Synthetic oligonucleotide
  Target: SCN9A; (+) strand; PAM type: NRG; PAM sequence: TAG
ggaaactgtgcatttgctta

SEQ ID NO: 43788 - DNA, 20 bp, Artificial Sequence
  Description of Artificial Sequence: Synthetic oligonucleotide
  Target: SCN9A; (+) strand; PAM type: NRG; PAM sequence: CAG
tttgcttatagcactaattt

SEQ ID NO: 43789 - DNA, 20 bp, Artificial Sequence
  Description of Artificial Sequence: Synthetic oligonucleotide
  Target: SCN9A; (+) strand; PAM type: NRG; PAM sequence: AAG
cttatagcactaatttcagc

SEQ ID NO: 43790 - DNA, 20 bp, Artificial Sequence
  Description of Artificial Sequence: Synthetic oligonucleotide
  Target: SCN9A; (+) strand; PAM type: NRG; PAM sequence: TGG
agcacaaaatttatattgac

SEQ ID NO: 43791 - DNA, 20 bp, Artificial Sequence
  Description of Artificial Sequence: Synthetic oligonucleotide
  Target: SCN9A; (+) strand; PAM type: NRG; PAM sequence: TGG
ttcttacataaaatgatatt

SEQ ID NO: 43792 - DNA, 20 bp, Artificial Sequence
  Description of Artificial Sequence: Synthetic oligonucleotide
  Target: SCN9A; (+) strand; PAM type: NRG; PAM sequence: AAG
tgatatttggtgtgtattta

SEQ ID NO: 43793 - DNA, 20 bp, Artificial Sequence
  Description of Artificial Sequence: Synthetic oligonucleotide
  Target: SCN9A; (+) strand; PAM type: NRG; PAM sequence: TAG
gaaaatccatgcactctttg

SEQ ID NO: 43794 - DNA, 20 bp, Artificial Sequence
  Description of Artificial Sequence: Synthetic oligonucleotide
  Target: SCN9A; (+) strand; PAM type: NRG; PAM sequence: AAG
gcttaacccatgaatgttat

SEQ ID NO: 43795 - DNA, 20 bp, Artificial Sequence
  Description of Artificial Sequence: Synthetic oligonucleotide
  Target: SCN9A; (+) strand; PAM type: NRG; PAM sequence: CAG
ccatgaatgttataagaaac

SEQ ID NO: 43796 - DNA, 20 bp, Artificial Sequence
  Description of Artificial Sequence: Synthetic oligonucleotide
  Target: SCN9A; (+) strand; PAM type: NRG; PAM sequence: GAG
aatgttataagaaaccagtt

SEQ ID NO: 43797 - DNA, 20 bp, Artificial Sequence
  Description of Artificial Sequence: Synthetic oligonucleotide
  Target: SCN9A; (+) strand; PAM type: NRG; PAM sequence: TGG
gaaaccagttgagaaaatct

SEQ ID NO: 43798 - DNA, 20 bp, Artificial Sequence
  Description of Artificial Sequence: Synthetic oligonucleotide
  Target: SCN9A; (+) strand; PAM type: NRG; PAM sequence: AAG
gagaaaatcttggacactga

SEQ ID NO: 43799 - DNA, 20 bp, Artificial Sequence
  Description of Artificial Sequence: Synthetic oligonucleotide
  Target: SCN9A; (+) strand; PAM type: NRG; PAM sequence: AAG
aaatcttggacactgaaagc

SEQ ID NO: 43800 - DNA, 20 bp, Artificial Sequence
  Description of Artificial Sequence: Synthetic oligonucleotide
  Target: SCN9A; (+) strand; PAM type: NRG; PAM sequence: GAG
tttcaaaaaatactaatgct

SEQ ID NO: 43801 - DNA, 20 bp, Artificial Sequence
  Description of Artificial Sequence: Synthetic oligonucleotide
  Target: SCN9A; (+) strand; PAM type: NRG; PAM sequence: AGG
ttcaaaaaatactaatgctg

SEQ ID NO: 43802 - DNA, 20 bp, Artificial Sequence
  Description of Artificial Sequence: Synthetic oligonucleotide
  Target: SCN9A; (+) strand; PAM type: NRG; PAM sequence: GGG
tcaaaaaatactaatgctga

SEQ ID NO: 43803 - DNA, 20 bp, Artificial Sequence
  Description of Artificial Sequence: Synthetic oligonucleotide
  Target: SCN9A; (+) strand; PAM type: NRG; PAM sequence: AAG
aaaatactaatgctgagggt

SEQ ID NO: 43804 - DNA, 20 bp, Artificial Sequence
  Description of Artificial Sequence: Synthetic oligonucleotide
  Target: SCN9A; (+) strand; PAM type: NRG; PAM sequence: TAG
gctgagggtaagcccatgac

SEQ ID NO: 43805 - DNA, 20 bp, Artificial Sequence
  Description of Artificial Sequence: Synthetic oligonucleotide
  Target: SCN9A; (+) strand; PAM type: NRG; PAM sequence: AAG
gggtaagcccatgactagat

SEQ ID NO: 43806 - DNA, 20 bp, Artificial Sequence
  Description of Artificial Sequence: Synthetic oligonucleotide
  Target: SCN9A; (+) strand; PAM type: NRG; PAM sequence: TAG
cccatgactagataagtcat

SEQ ID NO: 43807 - DNA, 20 bp, Artificial Sequence
  Description of Artificial Sequence: Synthetic oligonucleotide
  Target: SCN9A; (+) strand; PAM type: NRG; PAM sequence: AAG
tgctatcataacttctgtat

SEQ ID NO: 43808 - DNA, 20 bp, Artificial Sequence
  Description of Artificial Sequence: Synthetic oligonucleotide
  Target: SCN9A; (+) strand; PAM type: NRG; PAM sequence: CAG
cttctgtataagattgttaa

SEQ ID NO: 43809 - DNA, 20 bp, Artificial Sequence
  Description of Artificial Sequence: Synthetic oligonucleotide
  Target: SCN9A; (+) strand; PAM type: NRG; PAM sequence: AAG
gattgttaacagaatccttg

SEQ ID NO: 43810 - DNA, 20 bp, Artificial Sequence
  Description of Artificial Sequence: Synthetic oligonucleotide
  Target: SCN9A; (+) strand; PAM type: NRG; PAM sequence: AAG
taacagaatccttgaagaat

SEQ ID NO: 43811 - DNA, 20 bp, Artificial Sequence
  Description of Artificial Sequence: Synthetic oligonucleotide
  Target: SCN9A; (+) strand; PAM type: NRG; PAM sequence: AAG
gaatccttgaagaataagaa

SEQ ID NO: 43812 - DNA, 20 bp, Artificial Sequence
  Description of Artificial Sequence: Synthetic oligonucleotide
  Target: SCN9A; (+) strand; PAM type: NRG; PAM sequence: TAG
tccttgaagaataagaaaag

SEQ ID NO: 43813 - DNA, 20 bp, Artificial Sequence
  Description of Artificial Sequence: Synthetic oligonucleotide
  Target: SCN9A; (+) strand; PAM type: NRG; PAM sequence: AAG
ttgaagaataagaaaagtag

SEQ ID NO: 43814 - DNA, 20 bp, Artificial Sequence
  Description of Artificial Sequence: Synthetic oligonucleotide
  Target: SCN9A; (+) strand; PAM type: NRG; PAM sequence: AAG
aagaataagaaaagtagaag

SEQ ID NO: 43815 - DNA, 20 bp, Artificial Sequence
  Description of Artificial Sequence: Synthetic oligonucleotide
  Target: SCN9A; (+) strand; PAM type: NRG; PAM sequence: AGG
agaataagaaaagtagaaga

SEQ ID NO: 43816 - DNA, 20 bp, Artificial Sequence
  Description of Artificial Sequence: Synthetic oligonucleotide
  Target: SCN9A; (+) strand; PAM type: NRG; PAM sequence: AAG
ataagaaaagtagaagaagg

SEQ ID NO: 43817 - DNA, 20 bp, Artificial Sequence
  Description of Artificial Sequence: Synthetic oligonucleotide
  Target: SCN9A; (+) strand; PAM type: NRG; PAM sequence: TAG
gaaaagtagaagaaggaaga

SEQ ID NO: 43818 - DNA, 20 bp, Artificial Sequence
  Description of Artificial Sequence: Synthetic oligonucleotide
  Target: SCN9A; (+) strand; PAM type: NRG; PAM sequence: AGG
aaaagtagaagaaggaagat

SEQ ID NO: 43819 - DNA, 20 bp, Artificial Sequence
  Description of Artificial Sequence: Synthetic oligonucleotide
  Target: SCN9A; (+) strand; PAM type: NRG; PAM sequence: TAG
aaggaagataggcactgtgc

SEQ ID NO: 43820 - DNA, 20 bp, Artificial Sequence
  Description of Artificial Sequence: Synthetic oligonucleotide
  Target: SCN9A; (+) strand; PAM type: NRG; PAM sequence: AAG
aagataggcactgtgctagt

SEQ ID NO: 43821 - DNA, 20 bp, Artificial Sequence
  Description of Artificial Sequence: Synthetic oligonucleotide
  Target: SCN9A; (+) strand; PAM type: NRG; PAM sequence: TAG
attatcttatttgatcctct

SEQ ID NO: 43822 - DNA, 20 bp, Artificial Sequence
  Description of Artificial Sequence: Synthetic oligonucleotide
  Target: SCN9A; (+) strand; PAM type: NRG; PAM sequence: TGG
ctcttagcatcgctgtgatg

SEQ ID NO: 43823 - DNA, 20 bp, Artificial Sequence
  Description of Artificial Sequence: Synthetic oligonucleotide
  Target: SCN9A; (+) strand; PAM type: NRG; PAM sequence: CAG
atgctgatatccccatttta

SEQ ID NO: 43824 - DNA, 20 bp, Artificial Sequence
  Description of Artificial Sequence: Synthetic oligonucleotide
  Target: SCN9A; (+) strand; PAM type: NRG; PAM sequence: GAG
gatatccccattttacagat

SEQ ID NO: 43825 - DNA, 20 bp, Artificial Sequence
  Description of Artificial Sequence: Synthetic oligonucleotide
  Target: SCN9A; (+) strand; PAM type: NRG; PAM sequence: AAG
ttttacagatgagatatctg

SEQ ID NO: 43826 - DNA, 20 bp, Artificial Sequence
  Description of Artificial Sequence: Synthetic oligonucleotide
  Target: SCN9A; (+) strand; PAM type: NRG; PAM sequence: AAG
agatgagatatctgaagaac

SEQ ID NO: 43827 - DNA, 20 bp, Artificial Sequence
  Description of Artificial Sequence: Synthetic oligonucleotide
  Target: SCN9A; (+) strand; PAM type: NRG; PAM sequence: AAG
caagattttaaattgtgcac

SEQ ID NO: 43828 - DNA, 20 bp, Artificial Sequence
  Description of Artificial Sequence: Synthetic oligonucleotide
  Target: SCN9A; (+) strand; PAM type: NRG; PAM sequence: CAG
aaattgtgcacaagttctca

SEQ ID NO: 43829 - DNA, 20 bp, Artificial Sequence
  Description of Artificial Sequence: Synthetic oligonucleotide
  Target: SCN9A; (+) strand; PAM type: NRG; PAM sequence: AGG
aattgtgcacaagttctcac

SEQ ID NO: 43830 - DNA, 20 bp, Artificial Sequence
  Description of Artificial Sequence: Synthetic oligonucleotide
  Target: SCN9A; (+) strand; PAM type: NRG; PAM sequence: CAG
tgtgcacaagttctcacagg

SEQ ID NO: 43831 - DNA, 20 bp, Artificial Sequence
  Description of Artificial Sequence: Synthetic oligonucleotide
  Target: SCN9A; (+) strand; PAM type: NRG; PAM sequence: AAG
acaagttctcacaggcagat

SEQ ID NO: 43832 - DNA, 20 bp, Artificial Sequence
  Description of Artificial Sequence: Synthetic oligonucleotide
  Target: SCN9A; (+) strand; PAM type: NRG; PAM sequence: CGG
gttctcacaggcagataagt

SEQ ID NO: 43833 - DNA, 20 bp, Artificial Sequence
  Description of Artificial Sequence: Synthetic oligonucleotide
  Target: SCN9A; (+) strand; PAM type: NRG; PAM sequence: TAG
aggcagataagtcggcaaat

SEQ ID NO: 43834 - DNA, 20 bp, Artificial Sequence
  Description of Artificial Sequence: Synthetic oligonucleotide
  Target: SCN9A; (+) strand; PAM type: NRG; PAM sequence: CAG
aaattagaacatatgtttat

SEQ ID NO: 43835 - DNA, 20 bp, Artificial Sequence
  Description of Artificial Sequence: Synthetic oligonucleotide
  Target: SCN9A; (+) strand; PAM type: NRG; PAM sequence: AGG
aattagaacatatgtttatc

SEQ ID NO: 43836 - DNA, 20 bp, Artificial Sequence
  Description of Artificial Sequence: Synthetic oligonucleotide
  Target: SCN9A; (+) strand; PAM type: NRG; PAM sequence: AAG
catatgtttatcaggctcca

SEQ ID NO: 43837 - DNA, 20 bp, Artificial Sequence
  Description of Artificial Sequence: Synthetic oligonucleotide
  Target: SCN9A; (+) strand; PAM type: NRG; PAM sequence: CAG
tgtattactgtattacattg

SEQ ID NO: 43838 - DNA, 20 bp, Artificial Sequence
  Description of Artificial Sequence: Synthetic oligonucleotide
  Target: SCN9A; (+) strand; PAM type: NRG; PAM sequence: TGG
attacattgcagccctactc

SEQ ID NO: 43839 - DNA, 20 bp, Artificial Sequence
  Description of Artificial Sequence: Synthetic oligonucleotide
  Target: SCN9A; (+) strand; PAM type: NRG; PAM sequence: GGG
ttacattgcagccctactct

SEQ ID NO: 43840 - DNA, 20 bp, Artificial Sequence
  Description of Artificial Sequence: Synthetic oligonucleotide
  Target: SCN9A; (+) strand; PAM type: NRG; PAM sequence: TAG
tctgggcttgtatttttacc

SEQ ID NO: 43841 - DNA, 20 bp, Artificial Sequence
  Description of Artificial Sequence: Synthetic oligonucleotide
  Target: SCN9A; (+) strand; PAM type: NRG; PAM sequence: CAG
tagatgatacaatacttgtt

SEQ ID NO: 43842 - DNA, 20 bp, Artificial Sequence
  Description of Artificial Sequence: Synthetic oligonucleotide
  Target: SCN9A; (+) strand; PAM type: NRG; PAM sequence: CAG
gcattatccctgacaaattc

SEQ ID NO: 43843 - DNA, 20 bp, Artificial Sequence
  Description of Artificial Sequence: Synthetic oligonucleotide
  Target: SCN9A; (+) strand; PAM type: NRG; PAM sequence: AAG
ttatccctgacaaattccag

SEQ ID NO: 43844 - DNA, 20 bp, Artificial Sequence
  Description of Artificial Sequence: Synthetic oligonucleotide
  Target: SCN9A; (+) strand; PAM type: NRG; PAM sequence: TAG
tccctgacaaattccagaag

SEQ ID NO: 43845 - DNA, 20 bp, Artificial Sequence
  Description of Artificial Sequence: Synthetic oligonucleotide
  Target: SCN9A; (+) strand; PAM type: NRG; PAM sequence: AAG
tgacaaattccagaagtagt

SEQ ID NO: 43846 - DNA, 20 bp, Artificial Sequence
  Description of Artificial Sequence: Synthetic oligonucleotide
  Target: SCN9A; (+) strand; PAM type: NRG; PAM sequence: CAG
tccagaagtagtaagaaatt

SEQ ID NO: 43847 - DNA, 20 bp, Artificial Sequence
  Description of Artificial Sequence: Synthetic oligonucleotide
  Target: SCN9A; (+) strand; PAM type: NRG; PAM sequence: CAG
tagtaagaaattcagcatat

SEQ ID NO: 43848 - DNA, 20 bp, Artificial Sequence
  Description of Artificial Sequence: Synthetic oligonucleotide
  Target: SCN9A; (+) strand; PAM type: NRG; PAM sequence: AAG
aagaaattcagcatatcaga

SEQ ID NO: 43849 - DNA, 20 bp, Artificial Sequence
  Description of Artificial Sequence: Synthetic oligonucleotide
  Target: SCN9A; (+) strand; PAM type: NRG; PAM sequence: CAG
tcagcatatcagaaagcata

SEQ ID NO: 43850 - DNA, 20 bp, Artificial Sequence
  Description of Artificial Sequence: Synthetic oligonucleotide
  Target: SCN9A; (+) strand; PAM type: NRG; PAM sequence: AGG
cagcatatcagaaagcatac

SEQ ID NO: 43851 - DNA, 20 bp, Artificial Sequence
  Description of Artificial Sequence: Synthetic oligonucleotide
  Target: SCN9A; (+) strand; PAM type: NRG; PAM sequence: GAG
gcatatcagaaagcatacag

SEQ ID NO: 43852 - DNA, 20 bp, Artificial Sequence
  Description of Artificial Sequence: Synthetic oligonucleotide
  Target: SCN9A; (+) strand; PAM type: NRG; PAM sequence: TAG
tatcagaaagcatacaggag

SEQ ID NO: 43853 - DNA, 20 bp, Artificial Sequence
  Description of Artificial Sequence: Synthetic oligonucleotide
  Target: SCN9A; (+) strand; PAM type: NRG; PAM sequence: AAG
cagaaagcatacaggagtag

SEQ ID NO: 43854 - DNA, 20 bp, Artificial Sequence
  Description of Artificial Sequence: Synthetic oligonucleotide
  Target: SCN9A; (+) strand; PAM type: NRG; PAM sequence: AGG
agaaagcatacaggagtaga

SEQ ID NO: 43855 - DNA, 20 bp, Artificial Sequence
  Description of Artificial Sequence: Synthetic oligonucleotide
  Target: SCN9A; (+) strand; PAM type: NRG; PAM sequence: GAG
aaagcatacaggagtagaag

SEQ ID NO: 43856 - DNA, 20 bp, Artificial Sequence
  Description of Artificial Sequence: Synthetic oligonucleotide
  Target: SCN9A; (+) strand; PAM type: NRG; PAM sequence: AGG
aagcatacaggagtagaagg

SEQ ID NO: 43857 - DNA, 20 bp, Artificial Sequence
  Description of Artificial Sequence: Synthetic oligonucleotide
  Target: SCN9A; (+) strand; PAM type: NRG; PAM sequence: AAG
aggaggtactgttacaaaac

SEQ ID NO: 43858 - DNA, 20 bp, Artificial Sequence
  Description of Artificial Sequence: Synthetic oligonucleotide
  Target: SCN9A; (+) strand; PAM type: NRG; PAM sequence: GAG
gaggtactgttacaaaacaa

SEQ ID NO: 43859 - DNA, 20 bp, Artificial Sequence
  Description of Artificial Sequence: Synthetic oligonucleotide
  Target: SCN9A; (+) strand; PAM type: NRG; PAM sequence: AAG
ctgttacaaaacaagagact

SEQ ID NO: 43860 - DNA, 20 bp, Artificial Sequence
  Description of Artificial Sequence: Synthetic oligonucleotide
  Target: SCN9A; (+) strand; PAM type: NRG; PAM sequence: AGG
tgttacaaaacaagagacta

SEQ ID NO: 43861 - DNA, 20 bp, Artificial Sequence
  Description of Artificial Sequence: Synthetic oligonucleotide
  Target: SCN9A; (+) strand; PAM type: NRG; PAM sequence: AAG
agagactaaggccaaatgta

SEQ ID NO: 43862 - DNA, 20 bp, Artificial Sequence
  Description of Artificial Sequence: Synthetic oligonucleotide
  Target: SCN9A; (+) strand; PAM type: NRG; PAM sequence: AAG
tgtaaagaactttacatgtc

SEQ ID NO: 43863 - DNA, 20 bp, Artificial Sequence
  Description of Artificial Sequence: Synthetic oligonucleotide
  Target: SCN9A; (+) strand; PAM type: NRG; PAM sequence: AAG
agaactttacatgtcaagtt

SEQ ID NO: 43864 - DNA, 20 bp, Artificial Sequence
  Description of Artificial Sequence: Synthetic oligonucleotide
  Target: SCN9A; (+) strand; PAM type: NRG; PAM sequence: AGG
gaactttacatgtcaagtta

SEQ ID NO: 43865 - DNA, 20 bp, Artificial Sequence
  Description of Artificial Sequence: Synthetic oligonucleotide
  Target: SCN9A; (+) strand; PAM type: NRG; PAM sequence: CAG
acatgtcaagttaaggactt

SEQ ID NO: 43866 - DNA, 20 bp, Artificial Sequence
  Description of Artificial Sequence: Synthetic oligonucleotide
  Target: SCN9A; (+) strand; PAM type: NRG; PAM sequence: TAG
aaggacttcagactttaccc

SEQ ID NO: 43867 - DNA, 20 bp, Artificial Sequence
  Description of Artificial Sequence: Synthetic oligonucleotide
  Target: SCN9A; (+) strand; PAM type: NRG; PAM sequence: GAG
ggacttcagactttacccta

SEQ ID NO: 43868 - DNA, 20 bp, Artificial Sequence
  Description of Artificial Sequence: Synthetic oligonucleotide
  Target: SCN9A; (+) strand; PAM type: NRG; PAM sequence: AGG
gacttcagactttaccctag

SEQ ID NO: 43869 - DNA, 20 bp, Artificial Sequence
  Description of Artificial Sequence: Synthetic oligonucleotide
  Target: SCN9A; (+) strand; PAM type: NRG; PAM sequence: AAG
cagactttaccctagaggcc

SEQ ID NO: 43870 - DNA, 20 bp, Artificial Sequence
  Description of Artificial Sequence: Synthetic oligonucleotide
  Target: SCN9A; (+) strand; PAM type: NRG; PAM sequence: AGG
agactttaccctagaggcca

SEQ ID NO: 43871 - DNA, 20 bp, Artificial Sequence
  Description of Artificial Sequence: Synthetic oligonucleotide
  Target: SCN9A; (+) strand; PAM type: NRG; PAM sequence: TAG
ggccaaggattctcacattt

SEQ ID NO: 43872 - DNA, 20 bp, Artificial Sequence
  Description of Artificial Sequence: Synthetic oligonucleotide
  Target: SCN9A; (+) strand; PAM type: NRG; PAM sequence: AAG
gtgtgcatgcaaatcctctt

SEQ ID NO: 43873 - DNA, 20 bp, Artificial Sequence
  Description of Artificial Sequence: Synthetic oligonucleotide
  Target: SCN9A; (+) strand; PAM type: NRG; PAM sequence: AGG
tgtgcatgcaaatcctctta

SEQ ID NO: 43874 - DNA, 20 bp, Artificial Sequence
  Description of Artificial Sequence: Synthetic oligonucleotide
  Target: SCN9A; (+) strand; PAM type: NRG; PAM sequence: GGG
gtgcatgcaaatcctcttaa

SEQ ID NO: 43875 - DNA, 20 bp, Artificial Sequence
  Description of Artificial Sequence: Synthetic oligonucleotide
  Target: SCN9A; (+) strand; PAM type: NRG; PAM sequence: TGG
tgcaaatcctcttaagggct

SEQ ID NO: 43876 - DNA, 20 bp, Artificial Sequence
  Description of Artificial Sequence: Synthetic oligonucleotide
  Target: SCN9A; (+) strand; PAM type: NRG; PAM sequence: GGG
gcaaatcctcttaagggctt

SEQ ID NO: 43877 - DNA, 20 bp, Artificial Sequence
  Description of Artificial Sequence: Synthetic oligonucleotide
  Target: SCN9A; (+) strand; PAM type: NRG; PAM sequence: CAG
aagggcttgggccctatctc

SEQ ID NO: 43878 - DNA, 20 bp, Artificial Sequence
  Description of Artificial Sequence: Synthetic oligonucleotide
  Target: SCN9A; (+) strand; PAM type: NRG; PAM sequence: GAG
gggcttgggccctatctcca

SEQ ID NO: 43879 - DNA, 20 bp, Artificial Sequence
  Description of Artificial Sequence: Synthetic oligonucleotide
  Target: SCN9A; (+) strand; PAM type: NRG; PAM sequence: TAG
gttcctgatgaacttgtgac

SEQ ID NO: 43880 - DNA, 20 bp, Artificial Sequence
  Description of Artificial Sequence: Synthetic oligonucleotide
  Target: SCN9A; (+) strand; PAM type: NRG; PAM sequence: AAG
ctgatgaacttgtgactagc

SEQ ID NO: 43881 - DNA, 20 bp, Artificial Sequence
  Description of Artificial Sequence: Synthetic oligonucleotide
  Target: SCN9A; (+) strand; PAM type: NRG; PAM sequence: AGG
tgatgaacttgtgactagca

SEQ ID NO: 43882 - DNA, 20 bp, Artificial Sequence
  Description of Artificial Sequence: Synthetic oligonucleotide
  Target: SCN9A; (+) strand; PAM type: NRG; PAM sequence: AAG
tgactagcaaggaaaacttt

SEQ ID NO: 43883 - DNA, 20 bp, Artificial Sequence
  Description of Artificial Sequence: Synthetic oligonucleotide
  Target: SCN9A; (+) strand; PAM type: NRG; PAM sequence: AGG
gactagcaaggaaaacttta

SEQ ID NO: 43884 - DNA, 20 bp, Artificial Sequence
  Description of Artificial Sequence: Synthetic oligonucleotide
  Target: SCN9A; (+) strand; PAM type: NRG; PAM sequence: GGG
actagcaaggaaaactttaa

SEQ ID NO: 43885 - DNA, 20 bp, Artificial Sequence
  Description of Artificial Sequence: Synthetic oligonucleotide
  Target: SCN9A; (+) strand; PAM type: NRG; PAM sequence: AAG
aaaactttaagggtctctca

SEQ ID NO: 43886 - DNA, 20 bp, Artificial Sequence
  Description of Artificial Sequence: Synthetic oligonucleotide
  Target: SCN9A; (+) strand; PAM type: NRG; PAM sequence: TAG
taagggtctctcaaagtctt

SEQ ID NO: 43887 - DNA, 20 bp, Artificial Sequence
  Description of Artificial Sequence: Synthetic oligonucleotide
  Target: SCN9A; (+) strand; PAM type: NRG; PAM sequence: GAG
tctctcaaagtctttagctt

SEQ ID NO: 43888 - DNA, 20 bp, Artificial Sequence
  Description of Artificial Sequence: Synthetic oligonucleotide
  Target: SCN9A; (+) strand; PAM type: NRG; PAM sequence: AGG
ctctcaaagtctttagcttg

SEQ ID NO: 43889 - DNA, 20 bp, Artificial Sequence
  Description of Artificial Sequence: Synthetic oligonucleotide
  Target: SCN9A; (+) strand; PAM type: NRG; PAM sequence: GGG
tctcaaagtctttagcttga

SEQ ID NO: 43890 - DNA, 20 bp, Artificial Sequence
  Description of Artificial Sequence: Synthetic oligonucleotide
  Target: SCN9A; (+) strand; PAM type: NRG; PAM sequence: AAG
aaagtctttagcttgagggt

SEQ ID NO: 43891 - DNA, 20 bp, Artificial Sequence
  Description of Artificial Sequence: Synthetic oligonucleotide
  Target: SCN9A; (+) strand; PAM type: NRG; PAM sequence: AGG
aagtctttagcttgagggta

SEQ ID NO: 43892 - DNA, 20 bp, Artificial Sequence
  Description of Artificial Sequence: Synthetic oligonucleotide
  Target: SCN9A; (+) strand; PAM type: NRG; PAM sequence: TAG
tctttagcttgagggtaagg

SEQ ID NO: 43893 - DNA, 20 bp, Artificial Sequence
  Description of Artificial Sequence: Synthetic oligonucleotide
  Target: SCN9A; (+) strand; PAM type: NRG; PAM sequence: AAG
tgagggtaaggtagatcatg

SEQ ID NO: 43894 - DNA, 20 bp, Artificial Sequence
  Description of Artificial Sequence: Synthetic oligonucleotide
  Target: SCN9A; (+) strand; PAM type: NRG; PAM sequence: AAG
agatcatgaagttactaata

SEQ ID NO: 43895 - DNA, 20 bp, Artificial Sequence
  Description of Artificial Sequence: Synthetic oligonucleotide
  Target: SCN9A; (+) strand; PAM type: NRG; PAM sequence: TGG
atgaagttactaataaagac

SEQ ID NO: 43896 - DNA, 20 bp, Artificial Sequence
  Description of Artificial Sequence: Synthetic oligonucleotide
  Target: SCN9A; (+) strand; PAM type: NRG; PAM sequence: GAG
gaagttactaataaagactg

SEQ ID NO: 43897 - DNA, 20 bp, Artificial Sequence
  Description of Artificial Sequence: Synthetic oligonucleotide
  Target: SCN9A; (+) strand; PAM type: NRG; PAM sequence: AGG
aagttactaataaagactgg

SEQ ID NO: 43898 - DNA, 20 bp, Artificial Sequence
  Description of Artificial Sequence: Synthetic oligonucleotide
  Target: SCN9A; (+) strand; PAM type: NRG; PAM sequence: AAG
ttactaataaagactggagg

SEQ ID NO: 43899 - DNA, 20 bp, Artificial Sequence
  Description of Artificial Sequence: Synthetic oligonucleotide
  Target: SCN9A; (+) strand; PAM type: NRG; PAM sequence: AAG
ggaagctgtaaaccatacta

SEQ ID NO: 43900 - DNA, 20 bp, Artificial Sequence
  Description of Artificial Sequence: Synthetic oligonucleotide
  Target: SCN9A; (+) strand; PAM type: NRG; PAM sequence: TGG
aaaaaaaaacttattaaact

SEQ ID NO: 43901 - DNA, 20 bp, Artificial Sequence
  Description of Artificial Sequence: Synthetic oligonucleotide
  Target: SCN9A; (+) strand; PAM type: NRG; PAM sequence: CAG
ttggaatgttttacaaacaa

SEQ ID NO: 43902 - DNA, 20 bp, Artificial Sequence
  Description of Artificial Sequence: Synthetic oligonucleotide
  Target: SCN9A; (+) strand; PAM type: NRG; PAM sequence: TGG
aatgttttacaaacaacaga

SEQ ID NO: 43903 - DNA, 20 bp, Artificial Sequence
  Description of Artificial Sequence: Synthetic oligonucleotide
  Target: SCN9A; (+) strand; PAM type: NRG; PAM sequence: TGG
caacagatggtgatgaccaa

SEQ ID NO: 43904 - DNA, 20 bp, Artificial Sequence
  Description of Artificial Sequence: Synthetic oligonucleotide
  Target: SCN9A; (+) strand; PAM type: NRG; PAM sequence: GGG
aacagatggtgatgaccaat

SEQ ID NO: 43905 - DNA, 20 bp, Artificial Sequence
  Description of Artificial Sequence: Synthetic oligonucleotide
  Target: SCN9A; (+) strand; PAM type: NRG; PAM sequence: GGG
acagatggtgatgaccaatg

SEQ ID NO: 43906 - DNA, 20 bp, Artificial Sequence
  Description of Artificial Sequence: Synthetic oligonucleotide
  Target: SCN9A; (+) strand; PAM type: NRG; PAM sequence: AAG
gatgaccaatggggaattgt

SEQ ID NO: 43907 - DNA, 20 bp, Artificial Sequence
  Description of Artificial Sequence: Synthetic oligonucleotide
  Target: SCN9A; (+) strand; PAM type: NRG; PAM sequence: CAG
gaccaatggggaattgtaag

SEQ ID NO: 43908 - DNA, 20 bp, Artificial Sequence
  Description of Artificial Sequence: Synthetic oligonucleotide
  Target: SCN9A; (+) strand; PAM type: NRG; PAM sequence: TGG
tggggaattgtaagcagatc

SEQ ID NO: 43909 - DNA, 20 bp, Artificial Sequence
  Description of Artificial Sequence: Synthetic oligonucleotide
  Target: SCN9A; (+) strand; PAM type: NRG; PAM sequence: GGG
ggggaattgtaagcagatct

SEQ ID NO: 43910 - DNA, 20 bp, Artificial Sequence
  Description of Artificial Sequence: Synthetic oligonucleotide
  Target: SCN9A; (+) strand; PAM type: NRG; PAM sequence: AAG
tgtaagcagatctgggactc

SEQ ID NO: 43911 - DNA, 20 bp, Artificial Sequence
  Description of Artificial Sequence: Synthetic oligonucleotide
  Target: SCN9A; (+) strand; PAM type: NRG; PAM sequence: GAG
taagcagatctgggactcaa

SEQ ID NO: 43912 - DNA, 20 bp, Artificial Sequence
  Description of Artificial Sequence: Synthetic oligonucleotide
  Target: SCN9A; (+) strand; PAM type: NRG; PAM sequence: GAG
cagatctgggactcaagagt

SEQ ID NO: 43913 - DNA, 20 bp, Artificial Sequence
  Description of Artificial Sequence: Synthetic oligonucleotide
  Target: SCN9A; (+) strand; PAM type: NRG; PAM sequence: AGG
agatctgggactcaagagtg

SEQ ID NO: 43914 - DNA, 20 bp, Artificial Sequence
  Description of Artificial Sequence: Synthetic oligonucleotide
  Target: SCN9A; (+) strand; PAM type: NRG; PAM sequence: TAG
ctgggactcaagagtgaggt

SEQ ID NO: 43915 - DNA, 20 bp, Artificial Sequence
  Description of Artificial Sequence: Synthetic oligonucleotide
  Target: SCN9A; (+) strand; PAM type: NRG; PAM sequence: GAG
gggactcaagagtgaggtta

SEQ ID NO: 43916 - DNA, 20 bp, Artificial Sequence
  Description of Artificial Sequence: Synthetic oligonucleotide
  Target: SCN9A; (+) strand; PAM type: NRG; PAM sequence: AGG
ggactcaagagtgaggttag

SEQ ID NO: 43917 - DNA, 20 bp, Artificial Sequence
  Description of Artificial Sequence: Synthetic oligonucleotide
  Target: SCN9A; (+) strand; PAM type: NRG; PAM sequence: AAG
caagagtgaggttagaggta

SEQ ID NO: 43918 - DNA, 20 bp, Artificial Sequence
  Description of Artificial Sequence: Synthetic oligonucleotide
  Target: SCN9A; (+) strand; PAM type: NRG; PAM sequence: AAG
gaggtaaagacattgatgtt

SEQ ID NO: 43919 - DNA, 20 bp, Artificial Sequence
  Description of Artificial Sequence: Synthetic oligonucleotide
  Target: SCN9A; (+) strand; PAM type: NRG; PAM sequence: GAG
ggtaaagacattgatgttaa

SEQ ID NO: 43920 - DNA, 20 bp, Artificial Sequence
  Description of Artificial Sequence: Synthetic oligonucleotide
  Target: SCN9A; (+) strand; PAM type: NRG; PAM sequence: TAG
acattgatgttaagagtcaa

SEQ ID NO: 43921 - DNA, 20 bp, Artificial Sequence
  Description of Artificial Sequence: Synthetic oligonucleotide
  Target: SCN9A; (+) strand; PAM type: NRG; PAM sequence: CAG
gatgttaagagtcaatagca

SEQ ID NO: 43922 - DNA, 20 bp, Artificial Sequence
  Description of Artificial Sequence: Synthetic oligonucleotide
  Target: SCN9A; (+) strand; PAM type: NRG; PAM sequence: TGG
aagagtcaatagcacagaaa

SEQ ID NO: 43923 - DNA, 20 bp, Artificial Sequence
  Description of Artificial Sequence: Synthetic oligonucleotide
  Target: SCN9A; (+) strand; PAM type: NRG; PAM sequence: AAG
tagcacagaaatggcttttc

SEQ ID NO: 43924 - DNA, 20 bp, Artificial Sequence
  Description of Artificial Sequence: Synthetic oligonucleotide
  Target: SCN9A; (+) strand; PAM type: NRG; PAM sequence: CAG
agaaatggcttttcaagcca

SEQ ID NO: 43925 - DNA, 20 bp, Artificial Sequence
  Description of Artificial Sequence: Synthetic oligonucleotide
  Target: SCN9A; (+) strand; PAM type: NRG; PAM sequence: AGG
gaaatggcttttcaagccac

SEQ ID NO: 43926 - DNA, 20 bp, Artificial Sequence
  Description of Artificial Sequence: Synthetic oligonucleotide
  Target: SCN9A; (+) strand; PAM type: NRG; PAM sequence: CAG
caggcatgcatgaaacacct

SEQ ID NO: 43927 - DNA, 20 bp, Artificial Sequence
  Description of Artificial Sequence: Synthetic oligonucleotide
  Target: SCN9A; (+) strand; PAM type: NRG; PAM sequence: GAG
ggcatgcatgaaacacctca

SEQ ID NO: 43928 - DNA, 20 bp, Artificial Sequence
  Description of Artificial Sequence: Synthetic oligonucleotide
  Target: SCN9A; (+) strand; PAM type: NRG; PAM sequence: CAG
catgaaacacctcagagctt

SEQ ID NO: 43929 - DNA, 20 bp, Artificial Sequence
  Description of Artificial Sequence: Synthetic oligonucleotide
  Target: SCN9A; (+) strand; PAM type: NRG; PAM sequence: AAG
acacctcagagcttcagaat

SEQ ID NO: 43930 - DNA, 20 bp, Artificial Sequence
  Description of Artificial Sequence: Synthetic oligonucleotide
  Target: SCN9A; (+) strand; PAM type: NRG; PAM sequence: AAG
tcagagcttcagaataagaa

SEQ ID NO: 43931 - DNA, 20 bp, Artificial Sequence
  Description of Artificial Sequence: Synthetic oligonucleotide
  Target: SCN9A; (+) strand; PAM type: NRG; PAM sequence: AAG
agaataagaaaagataactg

SEQ ID NO: 43932 - DNA, 20 bp, Artificial Sequence
  Description of Artificial Sequence: Synthetic oligonucleotide
  Target: SCN9A; (+) strand; PAM type: NRG; PAM sequence: TGG
ataactgaagattgaacatg

SEQ ID NO: 43933 - DNA, 20 bp, Artificial Sequence
  Description of Artificial Sequence: Synthetic oligonucleotide
  Target: SCN9A; (+) strand; PAM type: NRG; PAM sequence: GGG
taactgaagattgaacatgt

SEQ ID NO: 43934 - DNA, 20 bp, Artificial Sequence
  Description of Artificial Sequence: Synthetic oligonucleotide
  Target: SCN9A; (+) strand; PAM type: NRG; PAM sequence: GGG
aactgaagattgaacatgtg

SEQ ID NO: 43935 - DNA, 20 bp, Artificial Sequence
  Description of Artificial Sequence: Synthetic oligonucleotide
  Target: SCN9A; (+) strand; PAM type: NRG; PAM sequence: GAG
ctgaagattgaacatgtggg

SEQ ID NO: 43936 - DNA, 20 bp, Artificial Sequence
  Description of Artificial Sequence: Synthetic oligonucleotide
  Target: SCN9A; (+) strand; PAM type: NRG; PAM sequence: CAG
tggggagaaatcattattta

SEQ ID NO: 43937 - DNA, 20 bp, Artificial Sequence
  Description of Artificial Sequence: Synthetic oligonucleotide
  Target: SCN9A; (+) strand; PAM type: NRG; PAM sequence: AGG
ggggagaaatcattatttac

SEQ ID NO: 43938 - DNA, 20 bp, Artificial Sequence
  Description of Artificial Sequence: Synthetic oligonucleotide
  Target: SCN9A; (+) strand; PAM type: NRG; PAM sequence: CAG
atcattatttacaggatgtg

SEQ ID NO: 43939 - DNA, 20 bp, Artificial Sequence
  Description of Artificial Sequence: Synthetic oligonucleotide
  Target: SCN9A; (+) strand; PAM type: NRG; PAM sequence: AAG
tgcagaaaaaatactcatta

SEQ ID NO: 43940 - DNA, 20 bp, Artificial Sequence
  Description of Artificial Sequence: Synthetic oligonucleotide
  Target: SCN9A; (+) strand; PAM type: NRG; PAM sequence: TAG
aaaaatactcattaaagaaa

SEQ ID NO: 43941 - DNA, 20 bp, Artificial Sequence
  Description of Artificial Sequence: Synthetic oligonucleotide
  Target: SCN9A; (+) strand; PAM type: NRG; PAM sequence: GAG
aaatactcattaaagaaata

SEQ ID NO: 43942 - DNA, 20 bp, Artificial Sequence
  Description of Artificial Sequence: Synthetic oligonucleotide
  Target: SCN9A; (+) strand; PAM type: NRG; PAM sequence: GAG
atactcattaaagaaataga

SEQ ID NO: 43943 - DNA, 20 bp, Artificial Sequence
  Description of Artificial Sequence: Synthetic oligonucleotide
  Target: SCN9A; (+) strand; PAM type: NRG; PAM sequence: GAG
actcattaaagaaatagaga

SEQ ID NO: 43944 - DNA, 20 bp, Artificial Sequence
  Description of Artificial Sequence: Synthetic oligonucleotide
  Target: SCN9A; (+) strand; PAM type: NRG; PAM sequence: AGG
ctcattaaagaaatagagag

SEQ ID NO: 43945 - DNA, 20 bp, Artificial Sequence
  Description of Artificial Sequence: Synthetic oligonucleotide
  Target: SCN9A; (+) strand; PAM type: NRG; PAM sequence: CAG
aagaaatagagagaggaact

SEQ ID NO: 43946 - DNA, 20 bp, Artificial Sequence
  Description of Artificial Sequence: Synthetic oligonucleotide
  Target: SCN9A; (+) strand; PAM type: NRG; PAM sequence: AAG
agagaggaactcagaactct

SEQ ID NO: 43947 - DNA, 20 bp, Artificial Sequence
  Description of Artificial Sequence: Synthetic oligonucleotide
  Target: SCN9A; (+) strand; PAM type: NRG; PAM sequence: AAG
cagaactctaagacaaataa

SEQ ID NO: 43948 - DNA, 20 bp, Artificial Sequence
  Description of Artificial Sequence: Synthetic oligonucleotide
  Target: SCN9A; (+) strand; PAM type: NRG; PAM sequence: AAG
ctaagacaaataaaagacca

SEQ ID NO: 43949 - DNA, 20 bp, Artificial Sequence
  Description of Artificial Sequence: Synthetic oligonucleotide
  Target: SCN9A; (+) strand; PAM type: NRG; PAM sequence: AGG
taagacaaataaaagaccaa

SEQ ID NO: 43950 - DNA, 20 bp, Artificial Sequence
  Description of Artificial Sequence: Synthetic oligonucleotide
  Target: SCN9A; (+) strand; PAM type: NRG; PAM sequence: TAG
gacaaataaaagaccaaagg

SEQ ID NO: 43951 - DNA, 20 bp, Artificial Sequence
  Description of Artificial Sequence: Synthetic oligonucleotide
  Target: SCN9A; (+) strand; PAM type: NRG; PAM sequence: TGG
aaaagaccaaaggtagacta

SEQ ID NO: 43952 - DNA, 20 bp, Artificial Sequence
  Description of Artificial Sequence: Synthetic oligonucleotide
  Target: SCN9A; (+) strand; PAM type: NRG; PAM sequence: AAG
agactatggcctctgaaact

SEQ ID NO: 43953 - DNA, 20 bp, Artificial Sequence
  Description of Artificial Sequence: Synthetic oligonucleotide
  Target: SCN9A; (+) strand; PAM type: NRG; PAM sequence: AGG
gactatggcctctgaaacta

SEQ ID NO: 43954 - DNA, 20 bp, Artificial Sequence
  Description of Artificial Sequence: Synthetic oligonucleotide
  Target: SCN9A; (+) strand; PAM type: NRG; PAM sequence: AAG
atggcctctgaaactaagga

SEQ ID NO: 43955 - DNA, 20 bp, Artificial Sequence
  Description of Artificial Sequence: Synthetic oligonucleotide
  Target: SCN9A; (+) strand; PAM type: NRG; PAM sequence: AGG
tggcctctgaaactaaggaa

SEQ ID NO: 43956 - DNA, 20 bp, Artificial Sequence
  Description of Artificial Sequence: Synthetic oligonucleotide
  Target: SCN9A; (+) strand; PAM type: NRG; PAM sequence: AAG
cctctgaaactaaggaaagg

SEQ ID NO: 43957 - DNA, 20 bp, Artificial Sequence
  Description of Artificial Sequence: Synthetic oligonucleotide
  Target: SCN9A; (+) strand; PAM type: NRG; PAM sequence: GAG
ctaaggaaaggaagaatttt

SEQ ID NO: 43958 - DNA, 20 bp, Artificial Sequence
  Description of Artificial Sequence: Synthetic oligonucleotide
  Target: SCN9A; (+) strand; PAM type: NRG; PAM sequence: GAG
aaggaaaggaagaattttga

SEQ ID NO: 43959 - DNA, 20 bp, Artificial Sequence
  Description of Artificial Sequence: Synthetic oligonucleotide
  Target: SCN9A; (+) strand; PAM type: NRG; PAM sequence: GAG
ggaaaggaagaattttgaga

SEQ ID NO: 43960 - DNA, 20 bp, Artificial Sequence
  Description of Artificial Sequence: Synthetic oligonucleotide
  Target: SCN9A; (+) strand; PAM type: NRG; PAM sequence: TAG
aagaattttgagagagactg

SEQ ID NO: 43961 - DNA, 20 bp, Artificial Sequence
  Description of Artificial Sequence: Synthetic oligonucleotide
  Target: SCN9A; (+) strand; PAM type: NRG; PAM sequence: CAG
ttgagagagactgtagtcaa

SEQ ID NO: 43962 - DNA, 20 bp, Artificial Sequence
  Description of Artificial Sequence: Synthetic oligonucleotide
  Target: SCN9A; (+) strand; PAM type: NRG; PAM sequence: CAG
ctgtagtcaacagtatcaaa

SEQ ID NO: 43963 - DNA, 20 bp, Artificial Sequence
  Description of Artificial Sequence: Synthetic oligonucleotide
  Target: SCN9A; (+) strand; PAM type: NRG; PAM sequence: GAG
acagtatcaaacagttttct

SEQ ID NO: 43964 - DNA, 20 bp, Artificial Sequence
  Description of Artificial Sequence: Synthetic oligonucleotide
  Target: SCN9A; (+) strand; PAM type: NRG; PAM sequence: GAG
agtatcaaacagttttctga

SEQ ID NO: 43965 - DNA, 20 bp, Artificial Sequence
  Description of Artificial Sequence: Synthetic oligonucleotide
  Target: SCN9A; (+) strand; PAM type: NRG; PAM sequence: TAG
tcaaacagttttctgagagt

SEQ ID NO: 43966 - DNA, 20 bp, Artificial Sequence
  Description of Artificial Sequence: Synthetic oligonucleotide
  Target: SCN9A; (+) strand; PAM type: NRG; PAM sequence: GAG
acagttttctgagagttagt

SEQ ID NO: 43967 - DNA, 20 bp, Artificial Sequence
  Description of Artificial Sequence: Synthetic oligonucleotide
  Target: SCN9A; (+) strand; PAM type: NRG; PAM sequence: TAG
gttttctgagagttagtgag

SEQ ID NO: 43968 - DNA, 20 bp, Artificial Sequence
  Description of Artificial Sequence: Synthetic oligonucleotide
  Target: SCN9A; (+) strand; PAM type: NRG; PAM sequence: AAG
tagattccatttttgattaa

SEQ ID NO: 43969 - DNA, 20 bp, Artificial Sequence
  Description of Artificial Sequence: Synthetic oligonucleotide
  Target: SCN9A; (+) strand; PAM type: NRG; PAM sequence: AGG
agattccatttttgattaaa

SEQ ID NO: 43970 - DNA, 20 bp, Artificial Sequence
  Description of Artificial Sequence: Synthetic oligonucleotide
  Target: SCN9A; (+) strand; PAM type: NRG; PAM sequence: CAG
ccatttttgattaaaaggac

SEQ ID NO: 43971 - DNA, 20 bp, Artificial Sequence
  Description of Artificial Sequence: Synthetic oligonucleotide
  Target: SCN9A; (+) strand; PAM type: NRG; PAM sequence: GAG
atttttgattaaaaggacca

SEQ ID NO: 43972 - DNA, 20 bp, Artificial Sequence
  Description of Artificial Sequence: Synthetic oligonucleotide
  Target: SCN9A; (+) strand; PAM type: NRG; PAM sequence: CAG
tgattaaaaggaccagagta

SEQ ID NO: 43973 - DNA, 20 bp, Artificial Sequence
  Description of Artificial Sequence: Synthetic oligonucleotide
  Target: SCN9A; (+) strand; PAM type: NRG; PAM sequence: TGG
tctttcattaacttgtattc

SEQ ID NO: 43974 - DNA, 20 bp, Artificial Sequence
  Description of Artificial Sequence: Synthetic oligonucleotide
  Target: SCN9A; (+) strand; PAM type: NRG; PAM sequence: TGG
ttcattaacttgtattctgg

SEQ ID NO: 43975 - DNA, 20 bp, Artificial Sequence
  Description of Artificial Sequence: Synthetic oligonucleotide
  Target: SCN9A; (+) strand; PAM type: NRG; PAM sequence: TGG
ttctggtggttccattgatc

SEQ ID NO: 43976 - DNA, 20 bp, Artificial Sequence
  Description of Artificial Sequence: Synthetic oligonucleotide
  Target: SCN9A; (+) strand; PAM type: NRG; PAM sequence: GGG
tctggtggttccattgatct

SEQ ID NO: 43977 - DNA, 20 bp, Artificial Sequence
  Description of Artificial Sequence: Synthetic oligonucleotide
  Target: SCN9A; (+) strand; PAM type: NRG; PAM sequence: AAG
ttgatctgggaatacgaatt

SEQ ID NO: 43978 - DNA, 20 bp, Artificial Sequence
  Description of Artificial Sequence: Synthetic oligonucleotide
  Target: SCN9A; (+) strand; PAM type: NRG; PAM sequence: AGG
tgatctgggaatacgaatta

SEQ ID NO: 43979 - DNA, 20 bp, Artificial Sequence
  Description of Artificial Sequence: Synthetic oligonucleotide
  Target: SCN9A; (+) strand; PAM type: NRG; PAM sequence: AAG
acgaattaaggctctaaaat

SEQ ID NO: 43980 - DNA, 20 bp, Artificial Sequence
  Description of Artificial Sequence: Synthetic oligonucleotide
  Target: SCN9A; (+) strand; PAM type: NRG; PAM sequence: AAG
aattaaggctctaaaataag

SEQ ID NO: 43981 - DNA, 20 bp, Artificial Sequence
  Description of Artificial Sequence: Synthetic oligonucleotide
  Target: SCN9A; (+) strand; PAM type: NRG; PAM sequence: TAG
taaggctctaaaataagaag

SEQ ID NO: 43982 - DNA, 20 bp, Artificial Sequence
  Description of Artificial Sequence: Synthetic oligonucleotide
  Target: SCN9A; (+) strand; PAM type: NRG; PAM sequence: TAG
ggctctaaaataagaagtag

SEQ ID NO: 43983 - DNA, 20 bp, Artificial Sequence
  Description of Artificial Sequence: Synthetic oligonucleotide
  Target: SCN9A; (+) strand; PAM type: NRG; PAM sequence: CAG
aagaagtagtagcatgctta

SEQ ID NO: 43984 - DNA, 20 bp, Artificial Sequence
  Description of Artificial Sequence: Synthetic oligonucleotide
  Target: SCN9A; (+) strand; PAM type: NRG; PAM sequence: CAG
catgcttacagtctaacata

SEQ ID NO: 43985 - DNA, 20 bp, Artificial Sequence
  Description of Artificial Sequence: Synthetic oligonucleotide
  Target: SCN9A; (+) strand; PAM type: NRG; PAM sequence: TAG
tacagtctaacatacagtga

SEQ ID NO: 43986 - DNA, 20 bp, Artificial Sequence
  Description of Artificial Sequence: Synthetic oligonucleotide
  Target: SCN9A; (+) strand; PAM type: NRG; PAM sequence: AGG
acagtctaacatacagtgat

SEQ ID NO: 43987 - DNA, 20 bp, Artificial Sequence
  Description of Artificial Sequence: Synthetic oligonucleotide
  Target: SCN9A; (+) strand; PAM type: NRG; PAM sequence: TAG
cagtgataggaaattactgt

SEQ ID NO: 43988 - DNA, 20 bp, Artificial Sequence
  Description of Artificial Sequence: Synthetic oligonucleotide
  Target: SCN9A; (+) strand; PAM type: NRG; PAM sequence: AAG
ataggaaattactgttagtc

SEQ ID NO: 43989 - DNA, 20 bp, Artificial Sequence
  Description of Artificial Sequence: Synthetic oligonucleotide
  Target: SCN9A; (+) strand; PAM type: NRG; PAM sequence: TAG
ttactgttagtcaagtgcca

SEQ ID NO: 43990 - DNA, 20 bp, Artificial Sequence
  Description of Artificial Sequence: Synthetic oligonucleotide
  Target: SCN9A; (+) strand; PAM type: NRG; PAM sequence: TGG
ttagtcaagtgccatagatg

SEQ ID NO: 43991 - DNA, 20 bp, Artificial Sequence
  Description of Artificial Sequence: Synthetic oligonucleotide
  Target: SCN9A; (+) strand; PAM type: NRG; PAM sequence: AAG
tgccatagatgtggaaactc

SEQ ID NO: 43992 - DNA, 20 bp, Artificial Sequence
  Description of Artificial Sequence: Synthetic oligonucleotide
  Target: SCN9A; (+) strand; PAM type: NRG; PAM sequence: TAG
tagatgtggaaactcaagct

SEQ ID NO: 43993 - DNA, 20 bp, Artificial Sequence
  Description of Artificial Sequence: Synthetic oligonucleotide
  Target: SCN9A; (+) strand; PAM type: NRG; PAM sequence: GAG
gatgtggaaactcaagctta

SEQ ID NO: 43994 - DNA, 20 bp, Artificial Sequence
  Description of Artificial Sequence: Synthetic oligonucleotide
  Target: SCN9A; (+) strand; PAM type: NRG; PAM sequence: GAG
tgtggaaactcaagcttaga

SEQ ID NO: 43995 - DNA, 20 bp, Artificial Sequence
  Description of Artificial Sequence: Synthetic oligonucleotide
  Target: SCN9A; (+) strand; PAM type: NRG; PAM sequence: TAG
aactcaagcttagagagctc

SEQ ID NO: 43996 - DNA, 20 bp, Artificial Sequence
  Description of Artificial Sequence: Synthetic oligonucleotide
  Target: SCN9A; (+) strand; PAM type: NRG; PAM sequence: CAG
acttgcccttaatcatcata

SEQ ID NO: 43997 - DNA, 20 bp, Artificial Sequence
  Description of Artificial Sequence: Synthetic oligonucleotide
  Target: SCN9A; (+) strand; PAM type: NRG; PAM sequence: TAG
ccttaatcatcatacagcta

SEQ ID NO: 43998 - DNA, 20 bp, Artificial Sequence
  Description of Artificial Sequence: Synthetic oligonucleotide
  Target: SCN9A; (+) strand; PAM type: NRG; PAM sequence: CAG
tcatacagctatagctgaat

SEQ ID NO: 43999 - DNA, 20 bp, Artificial Sequence
  Description of Artificial Sequence: Synthetic oligonucleotide
  Target: SCN9A; (+) strand; PAM type: NRG; PAM sequence: TGG
cagctatagctgaatcagca

SEQ ID NO: 44000 - DNA, 20 bp, Artificial Sequence
  Description of Artificial Sequence: Synthetic oligonucleotide
  Target: SCN9A; (+) strand; PAM type: NRG; PAM sequence: TGG
atagctgaatcagcatggaa

SEQ ID NO: 44001 - DNA, 20 bp, Artificial Sequence
  Description of Artificial Sequence: Synthetic oligonucleotide
  Target: SCN9A; (+) strand; PAM type: NRG; PAM sequence: GAG
agctgaatcagcatggaatg

SEQ ID NO: 44002 - DNA, 20 bp, Artificial Sequence
  Description of Artificial Sequence: Synthetic oligonucleotide
  Target: SCN9A; (+) strand; PAM type: NRG; PAM sequence: TGG
tctgacttaccgacaacctc

SEQ ID NO: 44003 - DNA, 20 bp, Artificial Sequence
  Description of Artificial Sequence: Synthetic oligonucleotide
  Target: SCN9A; (+) strand; PAM type: NRG; PAM sequence: AAG
acttaccgacaacctctggt

SEQ ID NO: 44004 - DNA, 20 bp, Artificial Sequence
  Description of Artificial Sequence: Synthetic oligonucleotide
  Target: SCN9A; (+) strand; PAM type: NRG; PAM sequence: TAG
cgacaacctctggtaagtat

SEQ ID NO: 44005 - DNA, 20 bp, Artificial Sequence
  Description of Artificial Sequence: Synthetic oligonucleotide
  Target: SCN9A; (+) strand; PAM type: NRG; PAM sequence: AGG
gacaacctctggtaagtatt

SEQ ID NO: 44006 - DNA, 20 bp, Artificial Sequence
  Description of Artificial Sequence: Synthetic oligonucleotide
  Target: SCN9A; (+) strand; PAM type: NRG; PAM sequence: AAG
tctggtaagtattaggcgtt

SEQ ID NO: 44007 - DNA, 20 bp, Artificial Sequence
  Description of Artificial Sequence: Synthetic oligonucleotide
  Target: SCN9A; (+) strand; PAM type: NRG; PAM sequence: CAG
ttaggcgttaagacaaaccc

SEQ ID NO: 44008 - DNA, 20 bp, Artificial Sequence
  Description of Artificial Sequence: Synthetic oligonucleotide
  Target: SCN9A; (+) strand; PAM type: NRG; PAM sequence: AAG
caaaccccagaacactaatt

SEQ ID NO: 44009 - DNA, 20 bp, Artificial Sequence
  Description of Artificial Sequence: Synthetic oligonucleotide
  Target: SCN9A; (+) strand; PAM type: NRG; PAM sequence: AGG
aaaccccagaacactaatta

SEQ ID NO: 44010 - DNA, 20 bp, Artificial Sequence
  Description of Artificial Sequence: Synthetic oligonucleotide
  Target: SCN9A; (+) strand; PAM type: NRG; PAM sequence: AAG
ctaattaaggaatgctaacc

SEQ ID NO: 44011 - DNA, 20 bp, Artificial Sequence
  Description of Artificial Sequence: Synthetic oligonucleotide
  Target: SCN9A; (+) strand; PAM type: NRG; PAM sequence: AGG
taattaaggaatgctaacca

SEQ ID NO: 44012 - DNA, 20 bp, Artificial Sequence
  Description of Artificial Sequence: Synthetic oligonucleotide
  Target: SCN9A; (+) strand; PAM type: NRG; PAM sequence: CAG
ttgtcttaccatctgtgaaa

SEQ ID NO: 44013 - DNA, 20 bp, Artificial Sequence
  Description of Artificial Sequence: Synthetic oligonucleotide
  Target: SCN9A; (+) strand; PAM type: NRG; PAM sequence: AGG
tgtcttaccatctgtgaaac

SEQ ID NO: 44014 - DNA, 20 bp, Artificial Sequence
  Description of Artificial Sequence: Synthetic oligonucleotide
  Target: SCN9A; (+) strand; PAM type: NRG; PAM sequence: TGG
ccatctgtgaaacaggcctc

SEQ ID NO: 44015 - DNA, 20 bp, Artificial Sequence
  Description of Artificial Sequence: Synthetic oligonucleotide
  Target: SCN9A; (+) strand; PAM type: NRG; PAM sequence: CGG
gaaacaggcctctggctcat

SEQ ID NO: 44016 - DNA, 20 bp, Artificial Sequence
  Description of Artificial Sequence: Synthetic oligonucleotide
  Target: SCN9A; (+) strand; PAM type: NRG; PAM sequence: TAG
ctctggctcatcggaattca

SEQ ID NO: 44017 - DNA, 20 bp, Artificial Sequence
  Description of Artificial Sequence: Synthetic oligonucleotide
  Target: SCN9A; (+) strand; PAM type: NRG; PAM sequence: AGG
tctggctcatcggaattcat

SEQ ID NO: 44018 - DNA, 20 bp, Artificial Sequence
  Description of Artificial Sequence: Synthetic oligonucleotide
  Target: SCN9A; (+) strand; PAM type: NRG; PAM sequence: CAG
ctcatcggaattcataggtt

SEQ ID NO: 44019 - DNA, 20 bp, Artificial Sequence
  Description of Artificial Sequence: Synthetic oligonucleotide
  Target: SCN9A; (+) strand; PAM type: NRG; PAM sequence: CAG
ctctgcttcttctccttctc

SEQ ID NO: 44020 - DNA, 20 bp, Artificial Sequence
  Description of Artificial Sequence: Synthetic oligonucleotide
  Target: SCN9A; (+) strand; PAM type: NRG; PAM sequence: AGG
tctgcttcttctccttctcc

SEQ ID NO: 44021 - DNA, 20 bp, Artificial Sequence
  Description of Artificial Sequence: Synthetic oligonucleotide
  Target: SCN9A; (+) strand; PAM type: NRG; PAM sequence: AAG
ttcttctccttctccaggca

SEQ ID NO: 44022 - DNA, 20 bp, Artificial Sequence
  Description of Artificial Sequence: Synthetic oligonucleotide
  Target: SCN9A; (+) strand; PAM type: NRG; PAM sequence: AGG
tcttctccttctccaggcaa

SEQ ID NO: 44023 - DNA, 20 bp, Artificial Sequence
  Description of Artificial Sequence: Synthetic oligonucleotide
  Target: SCN9A; (+) strand; PAM type: NRG; PAM sequence: GGG
cttctccttctccaggcaaa

SEQ ID NO: 44024 - DNA, 20 bp, Artificial Sequence
  Description of Artificial Sequence: Synthetic oligonucleotide
  Target: SCN9A; (+) strand; PAM type: NRG; PAM sequence: GAG
tatcaactgtgctgcactct

SEQ ID NO: 44025 - DNA, 20 bp, Artificial Sequence
  Description of Artificial Sequence: Synthetic oligonucleotide
  Target: SCN9A; (+) strand; PAM type: NRG; PAM sequence: AGG
atcaactgtgctgcactctg

SEQ ID NO: 44026 - DNA, 20 bp, Artificial Sequence
  Description of Artificial Sequence: Synthetic oligonucleotide
  Target: SCN9A; (+) strand; PAM type: NRG; PAM sequence: GAG
caactgtgctgcactctgag

SEQ ID NO: 44027 - DNA, 20 bp, Artificial Sequence
  Description of Artificial Sequence: Synthetic oligonucleotide
  Target: SCN9A; (+) strand; PAM type: NRG; PAM sequence: CGG
tgcactctgaggagcttgac

SEQ ID NO: 44028 - DNA, 20 bp, Artificial Sequence
  Description of Artificial Sequence: Synthetic oligonucleotide
  Target: SCN9A; (+) strand; PAM type: NRG; PAM sequence: TAG
agcttgaccggtttaatctc

SEQ ID NO: 44029 - DNA, 20 bp, Artificial Sequence
  Description of Artificial Sequence: Synthetic oligonucleotide
  Target: SCN9A; (+) strand; PAM type: NRG; PAM sequence: AAG
tgaccggtttaatctctaga

SEQ ID NO: 44030 - DNA, 20 bp, Artificial Sequence
  Description of Artificial Sequence: Synthetic oligonucleotide
  Target: SCN9A; (+) strand; PAM type: NRG; PAM sequence: AGG
gaccggtttaatctctagaa

SEQ ID NO: 44031 - DNA, 20 bp, Artificial Sequence
  Description of Artificial Sequence: Synthetic oligonucleotide
  Target: SCN9A; (+) strand; PAM type: NRG; PAM sequence: CAG
aaaggaattcaccaccccac

SEQ ID NO: 44032 - DNA, 20 bp, Artificial Sequence
  Description of Artificial Sequence: Synthetic oligonucleotide
  Target: SCN9A; (+) strand; PAM type: NRG; PAM sequence: AGG
aaggaattcaccaccccacc

SEQ ID NO: 44033 - DNA, 20 bp, Artificial Sequence
  Description of Artificial Sequence: Synthetic oligonucleotide
  Target: SCN9A; (+) strand; PAM type: NRG; PAM sequence: TAG
gaattcaccaccccaccagg

SEQ ID NO: 44034 - DNA, 20 bp, Artificial Sequence
  Description of Artificial Sequence: Synthetic oligonucleotide
  Target: SCN9A; (+) strand; PAM type: NRG; PAM sequence: TAG
accccaccaggtagttcatt

SEQ ID NO: 44035 - DNA, 20 bp, Artificial Sequence
  Description of Artificial Sequence: Synthetic oligonucleotide
  Target: SCN9A; (+) strand; PAM type: NRG; PAM sequence: GAG
cccaccaggtagttcattta

SEQ ID NO: 44036 - DNA, 20 bp, Artificial Sequence
  Description of Artificial Sequence: Synthetic oligonucleotide
  Target: SCN9A; (+) strand; PAM type: NRG; PAM sequence: AAG
ttcattcaaatatgatattt

SEQ ID NO: 44037 - DNA, 20 bp, Artificial Sequence
  Description of Artificial Sequence: Synthetic oligonucleotide
  Target: SCN9A; (+) strand; PAM type: NRG; PAM sequence: CAG
tttaagccttatttaataat

SEQ ID NO: 44038 - DNA, 20 bp, Artificial Sequence
  Description of Artificial Sequence: Synthetic oligonucleotide
  Target: SCN9A; (+) strand; PAM type: NRG; PAM sequence: AAG
ttaataatcagactcatgca

SEQ ID NO: 44039 - DNA, 20 bp, Artificial Sequence
  Description of Artificial Sequence: Synthetic oligonucleotide
  Target: SCN9A; (+) strand; PAM type: NRG; PAM sequence: AAG
catgcaaagtattatgaaaa

SEQ ID NO: 44040 - DNA, 20 bp, Artificial Sequence
  Description of Artificial Sequence: Synthetic oligonucleotide
  Target: SCN9A; (+) strand; PAM type: NRG; PAM sequence: TAG
gtattatgaaaaaagattaa

SEQ ID NO: 44041 - DNA, 20 bp, Artificial Sequence
  Description of Artificial Sequence: Synthetic oligonucleotide
  Target: SCN9A; (+) strand; PAM type: NRG; PAM sequence: TGG
aaaaaagattaatagtatga

SEQ ID NO: 44042 - DNA, 20 bp, Artificial Sequence
  Description of Artificial Sequence: Synthetic oligonucleotide
  Target: SCN9A; (+) strand; PAM type: NRG; PAM sequence: GAG
aaaatgtataaacacatatt

SEQ ID NO: 44043 - DNA, 20 bp, Artificial Sequence
  Description of Artificial Sequence: Synthetic oligonucleotide
  Target: SCN9A; (+) strand; PAM type: NRG; PAM sequence: AGG
aaatgtataaacacatattg

SEQ ID NO: 44044 - DNA, 20 bp, Artificial Sequence
  Description of Artificial Sequence: Synthetic oligonucleotide
  Target: SCN9A; (+) strand; PAM type: NRG; PAM sequence: AAG
tataaacacatattgaggtc

SEQ ID NO: 44045 - DNA, 20 bp, Artificial Sequence
  Description of Artificial Sequence: Synthetic oligonucleotide
  Target: SCN9A; (+) strand; PAM type: NRG; PAM sequence: AAG
attatgtttattatactaac

SEQ ID NO: 44046 - DNA, 20 bp, Artificial Sequence
  Description of Artificial Sequence: Synthetic oligonucleotide
  Target: SCN9A; (+) strand; PAM type: NRG; PAM sequence: TGG
ttattatactaacaagtacg

SEQ ID NO: 44047 - DNA, 20 bp, Artificial Sequence
  Description of Artificial Sequence: Synthetic oligonucleotide
  Target: SCN9A; (+) strand; PAM type: NRG; PAM sequence: TAG
aacaagtacgtggccaaaat

SEQ ID NO: 44048 - DNA, 20 bp, Artificial Sequence
  Description of Artificial Sequence: Synthetic oligonucleotide
  Target: SCN9A; (+) strand; PAM type: NRG; PAM sequence: AAG
gtacgtggccaaaattagat

SEQ ID NO: 44049 - DNA, 20 bp, Artificial Sequence
  Description of Artificial Sequence: Synthetic oligonucleotide
  Target: SCN9A; (+) strand; PAM type: NRG; PAM sequence: AGG
tacgtggccaaaattagata

SEQ ID NO: 44050 - DNA, 20 bp, Artificial Sequence
  Description of Artificial Sequence: Synthetic oligonucleotide
  Target: SCN9A; (+) strand; PAM type: NRG; PAM sequence: TGG
ttgatgttaactatcacttt

SEQ ID NO: 44051 - DNA, 20 bp, Artificial Sequence
  Description of Artificial Sequence: Synthetic oligonucleotide
  Target: SCN9A; (+) strand; PAM type: NRG; PAM sequence: AAG
tgttaactatcacttttgga

SEQ ID NO: 44052 - DNA, 20 bp, Artificial Sequence
  Description of Artificial Sequence: Synthetic oligonucleotide
  Target: SCN9A; (+) strand; PAM type: NRG; PAM sequence: TGG
aaatttttaatataaattta

SEQ ID NO: 44053 - DNA, 20 bp, Artificial Sequence
  Description of Artificial Sequence: Synthetic oligonucleotide
  Target: SCN9A; (+) strand; PAM type: NRG; PAM sequence: GAG
gacactgacaatcattattt

SEQ ID NO: 44054 - DNA, 20 bp, Artificial Sequence
  Description of Artificial Sequence: Synthetic oligonucleotide
  Target: SCN9A; (+) strand; PAM type: NRG; PAM sequence: AGG
acactgacaatcattatttg

SEQ ID NO: 44055 - DNA, 20 bp, Artificial Sequence
  Description of Artificial Sequence: Synthetic oligonucleotide
  Target: SCN9A; (+) strand; PAM type: NRG; PAM sequence: AAG
ccctatttgcaatataatac

SEQ ID NO: 44056 - DNA, 20 bp, Artificial Sequence
  Description of Artificial Sequence: Synthetic oligonucleotide
  Target: SCN9A; (+) strand; PAM type: NRG; PAM sequence: AAG
tactaatgcctgatcattga

SEQ ID NO: 44057 - DNA, 20 bp, Artificial Sequence
  Description of Artificial Sequence: Synthetic oligonucleotide
  Target: SCN9A; (+) strand; PAM type: NRG; PAM sequence: CAG
atgcctgatcattgaaagct

SEQ ID NO: 44058 - DNA, 20 bp, Artificial Sequence
  Description of Artificial Sequence: Synthetic oligonucleotide
  Target: SCN9A; (+) strand; PAM type: NRG; PAM sequence: TAG
cattgaaagctcagatcaaa

SEQ ID NO: 44059 - DNA, 20 bp, Artificial Sequence
  Description of Artificial Sequence: Synthetic oligonucleotide
  Target: SCN9A; (+) strand; PAM type: NRG; PAM sequence: TGG
gaaagctcagatcaaatagt

SEQ ID NO: 44060 - DNA, 20 bp, Artificial Sequence
  Description of Artificial Sequence: Synthetic oligonucleotide
  Target: SCN9A; (+) strand; PAM type: NRG; PAM sequence: TAG
gttggcaaaaaacttattga

SEQ ID NO: 44061 - DNA, 20 bp, Artificial Sequence
  Description of Artificial Sequence: Synthetic oligonucleotide
  Target: SCN9A; (+) strand; PAM type: NRG; PAM sequence: AAG
gatagttaaaattttttaaa

SEQ ID NO: 44062 - DNA, 20 bp, Artificial Sequence
  Description of Artificial Sequence: Synthetic oligonucleotide
  Target: SCN9A; (+) strand; PAM type: NRG; PAM sequence: AAG
ttaaaattttttaaaaagat

SEQ ID NO: 44063 - DNA, 20 bp, Artificial Sequence
  Description of Artificial Sequence: Synthetic oligonucleotide
  Target: SCN9A; (+) strand; PAM type: NRG; PAM sequence: AAG
ttttttaaaaagataagtgc

SEQ ID NO: 44064 - DNA, 20 bp, Artificial Sequence
  Description of Artificial Sequence: Synthetic oligonucleotide
  Target: SCN9A; (+) strand; PAM type: NRG; PAM sequence: AAG
aaaaagataagtgcaagata

SEQ ID NO: 44065 - DNA, 20 bp, Artificial Sequence
  Description of Artificial Sequence: Synthetic oligonucleotide
  Target: SCN9A; (+) strand; PAM type: NRG; PAM sequence: TAG
ctcttgaatttaaatatatg

SEQ ID NO: 44066 - DNA, 20 bp, Artificial Sequence
  Description of Artificial Sequence: Synthetic oligonucleotide
  Target: SCN9A; (+) strand; PAM type: NRG; PAM sequence: CAG
ttgaatttaaatatatgtag

SEQ ID NO: 44067 - DNA, 20 bp, Artificial Sequence
  Description of Artificial Sequence: Synthetic oligonucleotide
  Target: SCN9A; (+) strand; PAM type: NRG; PAM sequence: AGG
tgaatttaaatatatgtagc

SEQ ID NO: 44068 - DNA, 20 bp, Artificial Sequence
  Description of Artificial Sequence: Synthetic oligonucleotide
  Target: SCN9A; (+) strand; PAM type: NRG; PAM sequence: TAG
atatatgtagcaggatgata

SEQ ID NO: 44069 - DNA, 20 bp, Artificial Sequence
  Description of Artificial Sequence: Synthetic oligonucleotide
  Target: SCN9A; (+) strand; PAM type: NRG; PAM sequence: TAG
atgtagcaggatgatataga

SEQ ID NO: 44070 - DNA, 20 bp, Artificial Sequence
  Description of Artificial Sequence: Synthetic oligonucleotide
  Target: SCN9A; (+) strand; PAM type: NRG; PAM sequence: AAG
tagcaggatgatatagatag

SEQ ID NO: 44071 - DNA, 20 bp, Artificial Sequence
  Description of Artificial Sequence: Synthetic oligonucleotide
  Target: SCN9A; (+) strand; PAM type: NRG; PAM sequence: AAG
tagatagaagttctttgatc

SEQ ID NO: 44072 - DNA, 20 bp, Artificial Sequence
  Description of Artificial Sequence: Synthetic oligonucleotide
  Target: SCN9A; (+) strand; PAM type: NRG; PAM sequence: CGG
caagaccacaaaatcaaata

SEQ ID NO: 44073 - DNA, 20 bp, Artificial Sequence
  Description of Artificial Sequence: Synthetic oligonucleotide
  Target: SCN9A; (+) strand; PAM type: NRG; PAM sequence: TAG
ccattttgtatataacattt

SEQ ID NO: 44074 - DNA, 20 bp, Artificial Sequence
  Description of Artificial Sequence: Synthetic oligonucleotide
  Target: SCN9A; (+) strand; PAM type: NRG; PAM sequence: TAG
gtatataacattttagtata

SEQ ID NO: 44075 - DNA, 20 bp, Artificial Sequence
  Description of Artificial Sequence: Synthetic oligonucleotide
  Target: SCN9A; (+) strand; PAM type: NRG; PAM sequence: TAG
tataacattttagtatatag

SEQ ID NO: 44076 - DNA, 20 bp, Artificial Sequence
  Description of Artificial Sequence: Synthetic oligonucleotide
  Target: SCN9A; (+) strand; PAM type: NRG; PAM sequence: AAG
cattttagtatatagtagaa

SEQ ID NO: 44077 - DNA, 20 bp, Artificial Sequence
  Description of Artificial Sequence: Synthetic oligonucleotide
  Target: SCN9A; (+) strand; PAM type: NRG; PAM sequence: CAG
atatagtagaaaagatcaaa

SEQ ID NO: 44078 - DNA, 20 bp, Artificial Sequence
  Description of Artificial Sequence: Synthetic oligonucleotide
  Target: SCN9A; (+) strand; PAM type: NRG; PAM sequence: AAG
acagtattatttataatgtc

SEQ ID NO: 44079 - DNA, 20 bp, Artificial Sequence
  Description of Artificial Sequence: Synthetic oligonucleotide
  Target: SCN9A; (+) strand; PAM type: NRG; PAM sequence: AAG
tattatttataatgtcaaga

SEQ ID NO: 44080 - DNA, 20 bp, Artificial Sequence
  Description of Artificial Sequence: Synthetic oligonucleotide
  Target: SCN9A; (+) strand; PAM type: NRG; PAM sequence: TGG
tatttataatgtcaagaaag

SEQ ID NO: 44081 - DNA, 20 bp, Artificial Sequence
  Description of Artificial Sequence: Synthetic oligonucleotide
  Target: SCN9A; (+) strand; PAM type: NRG; PAM sequence: AAG
tgtcaagaaagtggctacta

SEQ ID NO: 44082 - DNA, 20 bp, Artificial Sequence
  Description of Artificial Sequence: Synthetic oligonucleotide
  Target: SCN9A; (+) strand; PAM type: NRG; PAM sequence: AAG
aagaaagtggctactaaagt

SEQ ID NO: 44083 - DNA, 20 bp, Artificial Sequence
  Description of Artificial Sequence: Synthetic oligonucleotide
  Target: SCN9A; (+) strand; PAM type: NRG; PAM sequence: AAG
cacatgcaaactctgaaaca

SEQ ID NO: 44084 - DNA, 20 bp, Artificial Sequence
  Description of Artificial Sequence: Synthetic oligonucleotide
  Target: SCN9A; (+) strand; PAM type: NRG; PAM sequence: AAG
aaactctgaaacaaagatcg

SEQ ID NO: 44085 - DNA, 20 bp, Artificial Sequence
  Description of Artificial Sequence: Synthetic oligonucleotide
  Target: SCN9A; (+) strand; PAM type: NRG; PAM sequence: TGG
agatcgaagaaaattaaaca

SEQ ID NO: 44086 - DNA, 20 bp, Artificial Sequence
  Description of Artificial Sequence: Synthetic oligonucleotide
  Target: SCN9A; (+) strand; PAM type: NRG; PAM sequence: CAG
tcgaagaaaattaaacatgg

SEQ ID NO: 44087 - DNA, 20 bp, Artificial Sequence
  Description of Artificial Sequence: Synthetic oligonucleotide
  Target: SCN9A; (+) strand; PAM type: NRG; PAM sequence: TGG
aaacatggcagacttacaca

SEQ ID NO: 44088 - DNA, 20 bp, Artificial Sequence
  Description of Artificial Sequence: Synthetic oligonucleotide
  Target: SCN9A; (+) strand; PAM type: NRG; PAM sequence: AAG
cattgtcattatgatcatat

SEQ ID NO: 44089 - DNA, 20 bp, Artificial Sequence
  Description of Artificial Sequence: Synthetic oligonucleotide
  Target: SCN9A; (+) strand; PAM type: NRG; PAM sequence: TAG
ataagtgatcataacgcaaa

SEQ ID NO: 44090 - DNA, 20 bp, Artificial Sequence
  Description of Artificial Sequence: Synthetic oligonucleotide
  Target: SCN9A; (+) strand; PAM type: NRG; PAM sequence: AGG
taagtgatcataacgcaaat

SEQ ID NO: 44091 - DNA, 20 bp, Artificial Sequence
  Description of Artificial Sequence: Synthetic oligonucleotide
  Target: SCN9A; (+) strand; PAM type: NRG; PAM sequence: CAG
gcaaataggtttttctcacc

SEQ ID NO: 44092 - DNA, 20 bp, Artificial Sequence
  Description of Artificial Sequence: Synthetic oligonucleotide
  Target: SCN9A; (+) strand; PAM type: NRG; PAM sequence: GAG
aaataggtttttctcaccca

SEQ ID NO: 44093 - DNA, 20 bp, Artificial Sequence
  Description of Artificial Sequence: Synthetic oligonucleotide
  Target: SCN9A; (+) strand; PAM type: NRG; PAM sequence: GAG
tttctcacccagagctttat

SEQ ID NO: 44094 - DNA, 20 bp, Artificial Sequence
  Description of Artificial Sequence: Synthetic oligonucleotide
  Target: SCN9A; (+) strand; PAM type: NRG; PAM sequence: AAG
cacatacacacacacacacg

SEQ ID NO: 44095 - DNA, 20 bp, Artificial Sequence
  Description of Artificial Sequence: Synthetic oligonucleotide
  Target: SCN9A; (+) strand; PAM type: NRG; PAM sequence: CAG
atctttacaaaaaatacata

SEQ ID NO: 44096 - DNA, 20 bp, Artificial Sequence
  Description of Artificial Sequence: Synthetic oligonucleotide
  Target: SCN9A; (+) strand; PAM type: NRG; PAM sequence: TAG
aaaaatacatacagcaactg

SEQ ID NO: 44097 - DNA, 20 bp, Artificial Sequence
  Description of Artificial Sequence: Synthetic oligonucleotide
  Target: SCN9A; (+) strand; PAM type: NRG; PAM sequence: AAG
ttcccaaatattgttttata

SEQ ID NO: 44098 - DNA, 20 bp, Artificial Sequence
  Description of Artificial Sequence: Synthetic oligonucleotide
  Target: SCN9A; (+) strand; PAM type: NRG; PAM sequence: AGG
tcccaaatattgttttataa

SEQ ID NO: 44099 - DNA, 20 bp, Artificial Sequence
  Description of Artificial Sequence: Synthetic oligonucleotide
  Target: SCN9A; (+) strand; PAM type: NRG; PAM sequence: GAG
ccaaatattgttttataaag

SEQ ID NO: 44100 - DNA, 20 bp, Artificial Sequence
  Description of Artificial Sequence: Synthetic oligonucleotide
  Target: SCN9A; (+) strand; PAM type: NRG; PAM sequence: AAG
tattgttttataaaggagta

SEQ ID NO: 44101 - DNA, 20 bp, Artificial Sequence
  Description of Artificial Sequence: Synthetic oligonucleotide
  Target: SCN9A; (+) strand; PAM type: NRG; PAM sequence: CAG
tgttttataaaggagtaaag

SEQ ID NO: 44102 - DNA, 20 bp, Artificial Sequence
  Description of Artificial Sequence: Synthetic oligonucleotide
  Target: SCN9A; (+) strand; PAM type: NRG; PAM sequence: TGG
ggagtaaagcagcatatcaa

SEQ ID NO: 44103 - DNA, 20 bp, Artificial Sequence
  Description of Artificial Sequence: Synthetic oligonucleotide
  Target: SCN9A; (+) strand; PAM type: NRG; PAM sequence: AAG
gtaaagcagcatatcaatgg

SEQ ID NO: 44104 - DNA, 20 bp, Artificial Sequence
  Description of Artificial Sequence: Synthetic oligonucleotide
  Target: SCN9A; (+) strand; PAM type: NRG; PAM sequence: GAG
aaagcagcatatcaatggaa

SEQ ID NO: 44105 - DNA, 20 bp, Artificial Sequence
  Description of Artificial Sequence: Synthetic oligonucleotide
  Target: SCN9A; (+) strand; PAM type: NRG; PAM sequence: AAG
aaatgacatgtgaatattga

SEQ ID NO: 44106 - DNA, 20 bp, Artificial Sequence
  Description of Artificial Sequence: Synthetic oligonucleotide
  Target: SCN9A; (+) strand; PAM type: NRG; PAM sequence: TAG
atgtgaatattgaaagctac

SEQ ID NO: 44107 - DNA, 20 bp, Artificial Sequence
  Description of Artificial Sequence: Synthetic oligonucleotide
  Target: SCN9A; (+) strand; PAM type: NRG; PAM sequence: AAG
tacaacacaattctcttatt

SEQ ID NO: 44108 - DNA, 20 bp, Artificial Sequence
  Description of Artificial Sequence: Synthetic oligonucleotide
  Target: SCN9A; (+) strand; PAM type: NRG; PAM sequence: TAG
agttacaactttatcttttt

SEQ ID NO: 44109 - DNA, 20 bp, Artificial Sequence
  Description of Artificial Sequence: Synthetic oligonucleotide
  Target: SCN9A; (+) strand; PAM type: NRG; PAM sequence: GAG
ttacaactttatctttttta

SEQ ID NO: 44110 - DNA, 20 bp, Artificial Sequence
  Description of Artificial Sequence: Synthetic oligonucleotide
  Target: SCN9A; (+) strand; PAM type: NRG; PAM sequence: TAG
caactttatcttttttagag

SEQ ID NO: 44111 - DNA, 20 bp, Artificial Sequence
  Description of Artificial Sequence: Synthetic oligonucleotide
  Target: SCN9A; (+) strand; PAM type: NRG; PAM sequence: AAG
tatcttttttagagtagttc

SEQ ID NO: 44112 - DNA, 20 bp, Artificial Sequence
  Description of Artificial Sequence: Synthetic oligonucleotide
  Target: SCN9A; (+) strand; PAM type: NRG; PAM sequence: AAG
ttttttagagtagttcaagc

SEQ ID NO: 44113 - DNA, 20 bp, Artificial Sequence
  Description of Artificial Sequence: Synthetic oligonucleotide
  Target: SCN9A; (+) strand; PAM type: NRG; PAM sequence: AAG
agagtagttcaagcaagtgc

SEQ ID NO: 44114 - DNA, 20 bp, Artificial Sequence
  Description of Artificial Sequence: Synthetic oligonucleotide
  Target: SCN9A; (+) strand; PAM type: NRG; PAM sequence: CAG
aaataataaaatacttattt

SEQ ID NO: 44115 - DNA, 20 bp, Artificial Sequence
  Description of Artificial Sequence: Synthetic oligonucleotide
  Target: SCN9A; (+) strand; PAM type: NRG; PAM sequence: TAG
atgaatttgtattaatatga

SEQ ID NO: 44116 - DNA, 20 bp, Artificial Sequence
  Description of Artificial Sequence: Synthetic oligonucleotide
  Target: SCN9A; (+) strand; PAM type: NRG; PAM sequence: AAG
taatatgatagcccaatcta

SEQ ID NO: 44117 - DNA, 20 bp, Artificial Sequence
  Description of Artificial Sequence: Synthetic oligonucleotide
  Target: SCN9A; (+) strand; PAM type: NRG; PAM sequence: AGG
aatatgatagcccaatctaa

SEQ ID NO: 44118 - DNA, 20 bp, Artificial Sequence
  Description of Artificial Sequence: Synthetic oligonucleotide
  Target: SCN9A; (+) strand; PAM type: NRG; PAM sequence: TAG
caatctaaaggtttgacttt

SEQ ID NO: 44119 - DNA, 20 bp, Artificial Sequence
  Description of Artificial Sequence: Synthetic oligonucleotide
  Target: SCN9A; (+) strand; PAM type: NRG; PAM sequence: GAG
atctaaaggtttgactttta

SEQ ID NO: 44120 - DNA, 20 bp, Artificial Sequence
  Description of Artificial Sequence: Synthetic oligonucleotide
  Target: SCN9A; (+) strand; PAM type: NRG; PAM sequence: TGG
ttgacttttagagattgact

SEQ ID NO: 44121 - DNA, 20 bp, Artificial Sequence
  Description of Artificial Sequence: Synthetic oligonucleotide
  Target: SCN9A; (+) strand; PAM type: NRG; PAM sequence: AAG
acttttagagattgacttgg

SEQ ID NO: 44122 - DNA, 20 bp, Artificial Sequence
  Description of Artificial Sequence: Synthetic oligonucleotide
  Target: SCN9A; (+) strand; PAM type: NRG; PAM sequence: TAG
ttagagattgacttggaagc

SEQ ID NO: 44123 - DNA, 20 bp, Artificial Sequence
  Description of Artificial Sequence: Synthetic oligonucleotide
  Target: SCN9A; (+) strand; PAM type: NRG; PAM sequence: AAG
gagattgacttggaagctag

SEQ ID NO: 44124 - DNA, 20 bp, Artificial Sequence
  Description of Artificial Sequence: Synthetic oligonucleotide
  Target: SCN9A; (+) strand; PAM type: NRG; PAM sequence: TGG
gaagctagaagtattcttga

SEQ ID NO: 44125 - DNA, 20 bp, Artificial Sequence
  Description of Artificial Sequence: Synthetic oligonucleotide
  Target: SCN9A; (+) strand; PAM type: NRG; PAM sequence: GGG
aagctagaagtattcttgat

SEQ ID NO: 44126 - DNA, 20 bp, Artificial Sequence
  Description of Artificial Sequence: Synthetic oligonucleotide
  Target: SCN9A; (+) strand; PAM type: NRG; PAM sequence: TAG
tcaatgctattattatcacc

SEQ ID NO: 44127 - DNA, 20 bp, Artificial Sequence
  Description of Artificial Sequence: Synthetic oligonucleotide
  Target: SCN9A; (+) strand; PAM type: NRG; PAM sequence: TGG
agtatacaacatcataaaaa

SEQ ID NO: 44128 - DNA, 20 bp, Artificial Sequence
  Description of Artificial Sequence: Synthetic oligonucleotide
  Target: SCN9A; (+) strand; PAM type: NRG; PAM sequence: TGG
acaacatcataaaaatggca

SEQ ID NO: 44129 - DNA, 20 bp, Artificial Sequence
  Description of Artificial Sequence: Synthetic oligonucleotide
  Target: SCN9A; (+) strand; PAM type: NRG; PAM sequence: AAG
tcataaaaatggcatggata

SEQ ID NO: 44130 - DNA, 20 bp, Artificial Sequence
  Description of Artificial Sequence: Synthetic oligonucleotide
  Target: SCN9A; (+) strand; PAM type: NRG; PAM sequence: AAG
atggataaagtattgtacat

SEQ ID NO: 44131 - DNA, 20 bp, Artificial Sequence
  Description of Artificial Sequence: Synthetic oligonucleotide
  Target: SCN9A; (+) strand; PAM type: NRG; PAM sequence: AGG
tggataaagtattgtacata

SEQ ID NO: 44132 - DNA, 20 bp, Artificial Sequence
  Description of Artificial Sequence: Synthetic oligonucleotide
  Target: SCN9A; (+) strand; PAM type: NRG; PAM sequence: AAG
ttgtacataaggaatgatgt

SEQ ID NO: 44133 - DNA, 20 bp, Artificial Sequence
  Description of Artificial Sequence: Synthetic oligonucleotide
  Target: SCN9A; (+) strand; PAM type: NRG; PAM sequence: CAG
tacataaggaatgatgtaag

SEQ ID NO: 44134 - DNA, 20 bp, Artificial Sequence
  Description of Artificial Sequence: Synthetic oligonucleotide
  Target: SCN9A; (+) strand; PAM type: NRG; PAM sequence: TGG
gacaatgtctttcttataac

SEQ ID NO: 44135 - DNA, 20 bp, Artificial Sequence
  Description of Artificial Sequence: Synthetic oligonucleotide
  Target: SCN9A; (+) strand; PAM type: NRG; PAM sequence: GAG
caatgtctttcttataactg

SEQ ID NO: 44136 - DNA, 20 bp, Artificial Sequence
  Description of Artificial Sequence: Synthetic oligonucleotide
  Target: SCN9A; (+) strand; PAM type: NRG; PAM sequence: AAG
ataattatgaacaacctatt

SEQ ID NO: 44137 - DNA, 20 bp, Artificial Sequence
  Description of Artificial Sequence: Synthetic oligonucleotide
  Target: SCN9A; (+) strand; PAM type: NRG; PAM sequence: GAG
aattatgaacaacctattaa

SEQ ID NO: 44138 - DNA, 20 bp, Artificial Sequence
  Description of Artificial Sequence: Synthetic oligonucleotide
  Target: SCN9A; (+) strand; PAM type: NRG; PAM sequence: TGG
agaactcctccaatctatgt

SEQ ID NO: 44139 - DNA, 20 bp, Artificial Sequence
  Description of Artificial Sequence: Synthetic oligonucleotide
  Target: SCN9A; (+) strand; PAM type: NRG; PAM sequence: TAG
tcctccaatctatgttggcc

SEQ ID NO: 44140 - DNA, 20 bp, Artificial Sequence
  Description of Artificial Sequence: Synthetic oligonucleotide
  Target: SCN9A; (+) strand; PAM type: NRG; PAM sequence: GAG
ctccaatctatgttggccta

SEQ ID NO: 44141 - DNA, 20 bp, Artificial Sequence
  Description of Artificial Sequence: Synthetic oligonucleotide
  Target: SCN9A; (+) strand; PAM type: NRG; PAM sequence: AGG
tccaatctatgttggcctag

SEQ ID NO: 44142 - DNA, 20 bp, Artificial Sequence
  Description of Artificial Sequence: Synthetic oligonucleotide
  Target: SCN9A; (+) strand; PAM type: NRG; PAM sequence: CAG
cctagaggcattattcccac

SEQ ID NO: 44143 - DNA, 20 bp, Artificial Sequence
  Description of Artificial Sequence: Synthetic oligonucleotide
  Target: SCN9A; (+) strand; PAM type: NRG; PAM sequence: AGG
ctagaggcattattcccacc

SEQ ID NO: 44144 - DNA, 20 bp, Artificial Sequence
  Description of Artificial Sequence: Synthetic oligonucleotide
  Target: SCN9A; (+) strand; PAM type: NRG; PAM sequence: CAG
ggcattattcccaccaggtc

SEQ ID NO: 44145 - DNA, 20 bp, Artificial Sequence
  Description of Artificial Sequence: Synthetic oligonucleotide
  Target: SCN9A; (+) strand; PAM type: NRG; PAM sequence: AGG
gcattattcccaccaggtcc

SEQ ID NO: 44146 - DNA, 20 bp, Artificial Sequence
  Description of Artificial Sequence: Synthetic oligonucleotide
  Target: SCN9A; (+) strand; PAM type: NRG; PAM sequence: GAG
attattcccaccaggtccag

SEQ ID NO: 44147 - DNA, 20 bp, Artificial Sequence
  Description of Artificial Sequence: Synthetic oligonucleotide
  Target: SCN9A; (+) strand; PAM type: NRG; PAM sequence: CAG
caggtccaggagtttgataa

SEQ ID NO: 44148 - DNA, 20 bp, Artificial Sequence
  Description of Artificial Sequence: Synthetic oligonucleotide
  Target: SCN9A; (+) strand; PAM type: NRG; PAM sequence: CAG
caggagtttgataacagttt

SEQ ID NO: 44149 - DNA, 20 bp, Artificial Sequence
  Description of Artificial Sequence: Synthetic oligonucleotide
  Target: SCN9A; (+) strand; PAM type: NRG; PAM sequence: AAG
gataacagtttcagttatga

SEQ ID NO: 44150 - DNA, 20 bp, Artificial Sequence
  Description of Artificial Sequence: Synthetic oligonucleotide
  Target: SCN9A; (+) strand; PAM type: NRG; PAM sequence: CAG
agtttcagttatgaaagtat

SEQ ID NO: 44151 - DNA, 20 bp, Artificial Sequence
  Description of Artificial Sequence: Synthetic oligonucleotide
  Target: SCN9A; (+) strand; PAM type: NRG; PAM sequence: TAG
ctgattgaattcatctaaat

SEQ ID NO: 44152 - DNA, 20 bp, Artificial Sequence
  Description of Artificial Sequence: Synthetic oligonucleotide
  Target: SCN9A; (+) strand; PAM type: NRG; PAM sequence: AAG
aaattagtttaatttaaaat

SEQ ID NO: 44153 - DNA, 20 bp, Artificial Sequence
  Description of Artificial Sequence: Synthetic oligonucleotide
  Target: SCN9A; (+) strand; PAM type: NRG; PAM sequence: TAG
tttaatttaaaataagataa

SEQ ID NO: 44154 - DNA, 20 bp, Artificial Sequence
  Description of Artificial Sequence: Synthetic oligonucleotide
  Target: SCN9A; (+) strand; PAM type: NRG; PAM sequence: TAG
ctgaatattctataaaacta

SEQ ID NO: 44155 - DNA, 20 bp, Artificial Sequence
  Description of Artificial Sequence: Synthetic oligonucleotide
  Target: SCN9A; (+) strand; PAM type: NRG; PAM sequence: TAG
tattctataaaactatagaa

SEQ ID NO: 44156 - DNA, 20 bp, Artificial Sequence
  Description of Artificial Sequence: Synthetic oligonucleotide
  Target: SCN9A; (+) strand; PAM type: NRG; PAM sequence: AGG
attctataaaactatagaat

SEQ ID NO: 44157 - DNA, 20 bp, Artificial Sequence
  Description of Artificial Sequence: Synthetic oligonucleotide
  Target: SCN9A; (+) strand; PAM type: NRG; PAM sequence: AAG
aaactatagaataggcttta

SEQ ID NO: 44158 - DNA, 20 bp, Artificial Sequence
  Description of Artificial Sequence: Synthetic oligonucleotide
  Target: SCN9A; (+) strand; PAM type: NRG; PAM sequence: TAG
aggctttaaagtataaacta

SEQ ID NO: 44159 - DNA, 20 bp, Artificial Sequence
  Description of Artificial Sequence: Synthetic oligonucleotide
  Target: SCN9A; (+) strand; PAM type: NRG; PAM sequence: GAG
taaagtataaactatagaat

SEQ ID NO: 44160 - DNA, 20 bp, Artificial Sequence
  Description of Artificial Sequence: Synthetic oligonucleotide
  Target: SCN9A; (+) strand; PAM type: NRG; PAM sequence: AAG
gaatgagttttaaaatatat

SEQ ID NO: 44161 - DNA, 20 bp, Artificial Sequence
  Description of Artificial Sequence: Synthetic oligonucleotide
  Target: SCN9A; (+) strand; PAM type: NRG; PAM sequence: CAG
aatatataagttttaaaata

SEQ ID NO: 44162 - DNA, 20 bp, Artificial Sequence
  Description of Artificial Sequence: Synthetic oligonucleotide
  Target: SCN9A; (+) strand; PAM type: NRG; PAM sequence: CAG
ttttaaaatacagattaatc

SEQ ID NO: 44163 - DNA, 20 bp, Artificial Sequence
  Description of Artificial Sequence: Synthetic oligonucleotide
  Target: SCN9A; (+) strand; PAM type: NRG; PAM sequence: AGG
tttaaaatacagattaatcc

SEQ ID NO: 44164 - DNA, 20 bp, Artificial Sequence
  Description of Artificial Sequence: Synthetic oligonucleotide
  Target: SCN9A; (+) strand; PAM type: NRG; PAM sequence: TGG
attaatccaggaaacgatgt

SEQ ID NO: 44165 - DNA, 20 bp, Artificial Sequence
  Description of Artificial Sequence: Synthetic oligonucleotide
  Target: SCN9A; (+) strand; PAM type: NRG; PAM sequence: AAG
gccaattgccacaaaatcca

SEQ ID NO: 44166 - DNA, 20 bp, Artificial Sequence
  Description of Artificial Sequence: Synthetic oligonucleotide
  Target: SCN9A; (+) strand; PAM type: NRG; PAM sequence: TAG
aaaatccaaagtaccatatt

SEQ ID NO: 44167 - DNA, 20 bp, Artificial Sequence
  Description of Artificial Sequence: Synthetic oligonucleotide
  Target: SCN9A; (+) strand; PAM type: NRG; PAM sequence: AAG
atccaaagtaccatatttag

SEQ ID NO: 44168 - DNA, 20 bp, Artificial Sequence
  Description of Artificial Sequence: Synthetic oligonucleotide
  Target: SCN9A; (+) strand; PAM type: NRG; PAM sequence: CAG
gtaccatatttagaagacta

SEQ ID NO: 44169 - DNA, 20 bp, Artificial Sequence
  Description of Artificial Sequence: Synthetic oligonucleotide
  Target: SCN9A; (+) strand; PAM type: NRG; PAM sequence: TGG
ttagaagactacagttttaa

SEQ ID NO: 44170 - DNA, 20 bp, Artificial Sequence
  Description of Artificial Sequence: Synthetic oligonucleotide
  Target: SCN9A; (+) strand; PAM type: NRG; PAM sequence: CGG
ggcttcaattcctgacctct

SEQ ID NO: 44171 - DNA, 20 bp, Artificial Sequence
  Description of Artificial Sequence: Synthetic oligonucleotide
  Target: SCN9A; (+) strand; PAM type: NRG; PAM sequence: CAG
ggctgcacgtgaactatcac

SEQ ID NO: 44172 - DNA, 20 bp, Artificial Sequence
  Description of Artificial Sequence: Synthetic oligonucleotide
  Target: SCN9A; (+) strand; PAM type: NRG; PAM sequence: GAG
ctgcacgtgaactatcacca

SEQ ID NO: 44173 - DNA, 20 bp, Artificial Sequence
  Description of Artificial Sequence: Synthetic oligonucleotide
  Target: SCN9A; (+) strand; PAM type: NRG; PAM sequence: AAG
cacgtgaactatcaccagag

SEQ ID NO: 44174 - DNA, 20 bp, Artificial Sequence
  Description of Artificial Sequence: Synthetic oligonucleotide
  Target: SCN9A; (+) strand; PAM type: NRG; PAM sequence: AAG
aactatcaccagagaagtga

SEQ ID NO: 44175 - DNA, 20 bp, Artificial Sequence
  Description of Artificial Sequence: Synthetic oligonucleotide
  Target: SCN9A; (+) strand; PAM type: NRG; PAM sequence: AAG
tcaccagagaagtgaaagac

SEQ ID NO: 44176 - DNA, 20 bp, Artificial Sequence
  Description of Artificial Sequence: Synthetic oligonucleotide
  Target: SCN9A; (+) strand; PAM type: NRG; PAM sequence: AGG
caccagagaagtgaaagaca

SEQ ID NO: 44177 - DNA, 20 bp, Artificial Sequence
  Description of Artificial Sequence: Synthetic oligonucleotide
  Target: SCN9A; (+) strand; PAM type: NRG; PAM sequence: AAG
caaggccctattattctgtg

SEQ ID NO: 44178 - DNA, 20 bp, Artificial Sequence
  Description of Artificial Sequence: Synthetic oligonucleotide
  Target: SCN9A; (+) strand; PAM type: NRG; PAM sequence: AAG
ccctattattctgtgaagtt

SEQ ID NO: 44179 - DNA, 20 bp, Artificial Sequence
  Description of Artificial Sequence: Synthetic oligonucleotide
  Target: SCN9A; (+) strand; PAM type: NRG; PAM sequence: CAG
ttattctgtgaagttaagac

SEQ ID NO: 44180 - DNA, 20 bp, Artificial Sequence
  Description of Artificial Sequence: Synthetic oligonucleotide
  Target: SCN9A; (+) strand; PAM type: NRG; PAM sequence: AGG
tattctgtgaagttaagacc

SEQ ID NO: 44181 - DNA, 20 bp, Artificial Sequence
  Description of Artificial Sequence: Synthetic oligonucleotide
  Target: SCN9A; (+) strand; PAM type: NRG; PAM sequence: AAG
aggcccttcatttctgaaaa

SEQ ID NO: 44182 - DNA, 20 bp, Artificial Sequence
  Description of Artificial Sequence: Synthetic oligonucleotide
  Target: SCN9A; (+) strand; PAM type: NRG; PAM sequence: TGG
atttctgaaaaaagaattat

SEQ ID NO: 44183 - DNA, 20 bp, Artificial Sequence
  Description of Artificial Sequence: Synthetic oligonucleotide
  Target: SCN9A; (+) strand; PAM type: NRG; PAM sequence: TGG
tgaaaaaagaattattggcc

SEQ ID NO: 44184 - DNA, 20 bp, Artificial Sequence
  Description of Artificial Sequence: Synthetic oligonucleotide
  Target: SCN9A; (+) strand; PAM type: NRG; PAM sequence: GGG
gaaaaaagaattattggcct

SEQ ID NO: 44185 - DNA, 20 bp, Artificial Sequence
  Description of Artificial Sequence: Synthetic oligonucleotide
  Target: SCN9A; (+) strand; PAM type: NRG; PAM sequence: GAG
gaattattggcctgggtttt

SEQ ID NO: 44186 - DNA, 20 bp, Artificial Sequence
  Description of Artificial Sequence: Synthetic oligonucleotide
  Target: SCN9A; (+) strand; PAM type: NRG; PAM sequence: AGG
aattattggcctgggttttg

SEQ ID NO: 44187 - DNA, 20 bp, Artificial Sequence
  Description of Artificial Sequence: Synthetic oligonucleotide
  Target: SCN9A; (+) strand; PAM type: NRG; PAM sequence: AAG
ttggcctgggttttgaggta

SEQ ID NO: 44188 - DNA, 20 bp, Artificial Sequence
  Description of Artificial Sequence: Synthetic oligonucleotide
  Target: SCN9A; (+) strand; PAM type: NRG; PAM sequence: CAG
gcctgggttttgaggtaaag

SEQ ID NO: 44189 - DNA, 20 bp, Artificial Sequence
  Description of Artificial Sequence: Synthetic oligonucleotide
  Target: SCN9A; (+) strand; PAM type: NRG; PAM sequence: GAG
gggttttgaggtaaagcagt

SEQ ID NO: 44190 - DNA, 20 bp, Artificial Sequence
  Description of Artificial Sequence: Synthetic oligonucleotide
  Target: SCN9A; (+) strand; PAM type: NRG; PAM sequence: GAG
gttttgaggtaaagcagtga

SEQ ID NO: 44191 - DNA, 20 bp, Artificial Sequence
  Description of Artificial Sequence: Synthetic oligonucleotide
  Target: SCN9A; (+) strand; PAM type: NRG; PAM sequence: AGG
ttttgaggtaaagcagtgag

SEQ ID NO: 44192 - DNA, 20 bp, Artificial Sequence
  Description of Artificial Sequence: Synthetic oligonucleotide
  Target: SCN9A; (+) strand; PAM type: NRG; PAM sequence: TAG
gcagtgagaggaattgctga

SEQ ID NO: 44193 - DNA, 20 bp, Artificial Sequence
  Description of Artificial Sequence: Synthetic oligonucleotide
  Target: SCN9A; (+) strand; PAM type: NRG; PAM sequence: AAG
tgagaggaattgctgataga

SEQ ID NO: 44194 - DNA, 20 bp, Artificial Sequence
  Description of Artificial Sequence: Synthetic oligonucleotide
  Target: SCN9A; (+) strand; PAM type: NRG; PAM sequence: AAG
ttgctgatagaaagaataca

SEQ ID NO: 44195 - DNA, 20 bp, Artificial Sequence
  Description of Artificial Sequence: Synthetic oligonucleotide
  Target: SCN9A; (+) strand; PAM type: NRG; PAM sequence: TAG
acaaagcacccccctgctat

SEQ ID NO: 44196 - DNA, 20 bp, Artificial Sequence
  Description of Artificial Sequence: Synthetic oligonucleotide
  Target: SCN9A; (+) strand; PAM type: NRG; PAM sequence: TAG
attagacacaatattaacaa

SEQ ID NO: 44197 - DNA, 20 bp, Artificial Sequence
  Description of Artificial Sequence: Synthetic oligonucleotide
  Target: SCN9A; (+) strand; PAM type: NRG; PAM sequence: AGG
ttagacacaatattaacaat

SEQ ID NO: 44198 - DNA, 20 bp, Artificial Sequence
  Description of Artificial Sequence: Synthetic oligonucleotide
  Target: SCN9A; (+) strand; PAM type: NRG; PAM sequence: TAG
acaatattaacaataggaaa

SEQ ID NO: 44199 - DNA, 20 bp, Artificial Sequence
  Description of Artificial Sequence: Synthetic oligonucleotide
  Target: SCN9A; (+) strand; PAM type: NRG; PAM sequence: TGG
acaataggaaatagttataa

SEQ ID NO: 44200 - DNA, 20 bp, Artificial Sequence
  Description of Artificial Sequence: Synthetic oligonucleotide
  Target: SCN9A; (+) strand; PAM type: NRG; PAM sequence: GAG
agttataatggtttttctct

SEQ ID NO: 44201 - DNA, 20 bp, Artificial Sequence
  Description of Artificial Sequence: Synthetic oligonucleotide
  Target: SCN9A; (+) strand; PAM type: NRG; PAM sequence: TGG
ataatggtttttctctgagc

SEQ ID NO: 44202 - DNA, 20 bp, Artificial Sequence
  Description of Artificial Sequence: Synthetic oligonucleotide
  Target: SCN9A; (+) strand; PAM type: NRG; PAM sequence: CAG
aataaaatgattcttatttg

SEQ ID NO: 44203 - DNA, 20 bp, Artificial Sequence
  Description of Artificial Sequence: Synthetic oligonucleotide
  Target: SCN9A; (+) strand; PAM type: NRG; PAM sequence: TAG
tatttgcagaattctgactt

SEQ ID NO: 44204 - DNA, 20 bp, Artificial Sequence
  Description of Artificial Sequence: Synthetic oligonucleotide
  Target: SCN9A; (+) strand; PAM type: NRG; PAM sequence: AAG
gactttagctaaattcatga

SEQ ID NO: 44205 - DNA, 20 bp, Artificial Sequence
  Description of Artificial Sequence: Synthetic oligonucleotide
  Target: SCN9A; (+) strand; PAM type: NRG; PAM sequence: TGG
catcttcaaacatcaataat

SEQ ID NO: 44206 - DNA, 20 bp, Artificial Sequence
  Description of Artificial Sequence: Synthetic oligonucleotide
  Target: SCN9A; (+) strand; PAM type: NRG; PAM sequence: AAG
aattggttttctcactgttt

SEQ ID NO: 44207 - DNA, 20 bp, Artificial Sequence
  Description of Artificial Sequence: Synthetic oligonucleotide
  Target: SCN9A; (+) strand; PAM type: NRG; PAM sequence: GAG
ttggttttctcactgtttaa

SEQ ID NO: 44208 - DNA, 20 bp, Artificial Sequence
  Description of Artificial Sequence: Synthetic oligonucleotide
  Target: SCN9A; (+) strand; PAM type: NRG; PAM sequence: GAG
ggttttctcactgtttaaga

SEQ ID NO: 44209 - DNA, 20 bp, Artificial Sequence
  Description of Artificial Sequence: Synthetic oligonucleotide
  Target: SCN9A; (+) strand; PAM type: NRG; PAM sequence: AAG
tgtttaagagagcattaaca

SEQ ID NO: 44210 - DNA, 20 bp, Artificial Sequence
  Description of Artificial Sequence: Synthetic oligonucleotide
  Target: SCN9A; (+) strand; PAM type: NRG; PAM sequence: TAG
aacaaagatttatgccaaat

SEQ ID NO: 44211 - DNA, 20 bp, Artificial Sequence
  Description of Artificial Sequence: Synthetic oligonucleotide
  Target: SCN9A; (+) strand; PAM type: NRG; PAM sequence: GAG
tttatgccaaattagattat

SEQ ID NO: 44212 - DNA, 20 bp, Artificial Sequence
  Description of Artificial Sequence: Synthetic oligonucleotide
  Target: SCN9A; (+) strand; PAM type: NRG; PAM sequence: AAG
tgccaaattagattatgagc

SEQ ID NO: 44213 - DNA, 20 bp, Artificial Sequence
  Description of Artificial Sequence: Synthetic oligonucleotide
  Target: SCN9A; (+) strand; PAM type: NRG; PAM sequence: TAG
aaaattcacgtgattttata

SEQ ID NO: 44214 - DNA, 20 bp, Artificial Sequence
  Description of Artificial Sequence: Synthetic oligonucleotide
  Target: SCN9A; (+) strand; PAM type: NRG; PAM sequence: CAG
ttgaaactttttttcatatg

SEQ ID NO: 44215 - DNA, 20 bp, Artificial Sequence
  Description of Artificial Sequence: Synthetic oligonucleotide
  Target: SCN9A; (+) strand; PAM type: NRG; PAM sequence: AGG
tgaaactttttttcatatgc

SEQ ID NO: 44216 - DNA, 20 bp, Artificial Sequence
  Description of Artificial Sequence: Synthetic oligonucleotide
  Target: SCN9A; (+) strand; PAM type: NRG; PAM sequence: TGG
caggttttatgtttttttaa

SEQ ID NO: 44217 - DNA, 20 bp, Artificial Sequence
  Description of Artificial Sequence: Synthetic oligonucleotide
  Target: SCN9A; (+) strand; PAM type: NRG; PAM sequence: CAG
ttttaatggtcaattgaatt

SEQ ID NO: 44218 - DNA, 20 bp, Artificial Sequence
  Description of Artificial Sequence: Synthetic oligonucleotide
  Target: SCN9A; (+) strand; PAM type: NRG; PAM sequence: TGG
atggtcaattgaattcagct

SEQ ID NO: 44219 - DNA, 20 bp, Artificial Sequence
  Description of Artificial Sequence: Synthetic oligonucleotide
  Target: SCN9A; (+) strand; PAM type: NRG; PAM sequence: CAG
caattgaattcagcttggca

SEQ ID NO: 44220 - DNA, 20 bp, Artificial Sequence
  Description of Artificial Sequence: Synthetic oligonucleotide
  Target: SCN9A; (+) strand; PAM type: NRG; PAM sequence: AAG
gcacagaattttacatcata

SEQ ID NO: 44221 - DNA, 20 bp, Artificial Sequence
  Description of Artificial Sequence: Synthetic oligonucleotide
  Target: SCN9A; (+) strand; PAM type: NRG; PAM sequence: TGG
tattcaatattattgttcaa

SEQ ID NO: 44222 - DNA, 20 bp, Artificial Sequence
  Description of Artificial Sequence: Synthetic oligonucleotide
  Target: SCN9A; (+) strand; PAM type: NRG; PAM sequence: GGG
attcaatattattgttcaat

SEQ ID NO: 44223 - DNA, 20 bp, Artificial Sequence
  Description of Artificial Sequence: Synthetic oligonucleotide
  Target: SCN9A; (+) strand; PAM type: NRG; PAM sequence: CAG
aatattattgttcaatggga

SEQ ID NO: 44224 - DNA, 20 bp, Artificial Sequence
  Description of Artificial Sequence: Synthetic oligonucleotide
  Target: SCN9A; (+) strand; PAM type: NRG; PAM sequence: CAG
tattaattaatttgtattta

SEQ ID NO: 44225 - DNA, 20 bp, Artificial Sequence
  Description of Artificial Sequence: Synthetic oligonucleotide
  Target: SCN9A; (+) strand; PAM type: NRG; PAM sequence: TGG
tatttacagacaaattatta

SEQ ID NO: 44226 - DNA, 20 bp, Artificial Sequence
  Description of Artificial Sequence: Synthetic oligonucleotide
  Target: SCN9A; (+) strand; PAM type: NRG; PAM sequence: TAG
agacaaattattatggctaa

SEQ ID NO: 44227 - DNA, 20 bp, Artificial Sequence
  Description of Artificial Sequence: Synthetic oligonucleotide
  Target: SCN9A; (+) strand; PAM type: NRG; PAM sequence: TAG
tattatggctaatagattct

SEQ ID NO: 44228 - DNA, 20 bp, Artificial Sequence
  Description of Artificial Sequence: Synthetic oligonucleotide
  Target: SCN9A; (+) strand; PAM type: NRG; PAM sequence: TGG
ttagacattcaatgttttct

SEQ ID NO: 44229 - DNA, 20 bp, Artificial Sequence
  Description of Artificial Sequence: Synthetic oligonucleotide
  Target: SCN9A; (+) strand; PAM type: NRG; PAM sequence: GGG
tagacattcaatgttttctt

SEQ ID NO: 44230 - DNA, 20 bp, Artificial Sequence
  Description of Artificial Sequence: Synthetic oligonucleotide
  Target: SCN9A; (+) strand; PAM type: NRG; PAM sequence: AAG
tgttttcttgggaatgcatt

SEQ ID NO: 44231 - DNA, 20 bp, Artificial Sequence
  Description of Artificial Sequence: Synthetic oligonucleotide
  Target: SCN9A; (+) strand; PAM type: NRG; PAM sequence: CAG
gaatgcattaagtattcaaa

SEQ ID NO: 44232 - DNA, 20 bp, Artificial Sequence
  Description of Artificial Sequence: Synthetic oligonucleotide
  Target: SCN9A; (+) strand; PAM type: NRG; PAM sequence: AAG
atataaaattaaatgtttat

SEQ ID NO: 44233 - DNA, 20 bp, Artificial Sequence
  Description of Artificial Sequence: Synthetic oligonucleotide
  Target: SCN9A; (+) strand; PAM type: NRG; PAM sequence: TAG
aaatgtttataagcatgctt

SEQ ID NO: 44234 - DNA, 20 bp, Artificial Sequence
  Description of Artificial Sequence: Synthetic oligonucleotide
  Target: SCN9A; (+) strand; PAM type: NRG; PAM sequence: TAG
ataagcatgctttagcaata

SEQ ID NO: 44235 - DNA, 20 bp, Artificial Sequence
  Description of Artificial Sequence: Synthetic oligonucleotide
  Target: SCN9A; (+) strand; PAM type: NRG; PAM sequence: CAG
gcatgctttagcaatataga

SEQ ID NO: 44236 - DNA, 20 bp, Artificial Sequence
  Description of Artificial Sequence: Synthetic oligonucleotide
  Target: SCN9A; (+) strand; PAM type: NRG; PAM sequence: TAG
tttagcaatatagacagttc

SEQ ID NO: 44237 - DNA, 20 bp, Artificial Sequence
  Description of Artificial Sequence: Synthetic oligonucleotide
  Target: SCN9A; (+) strand; PAM type: NRG; PAM sequence: CAG
atagacagttctagtcaatt

SEQ ID NO: 44238 - DNA, 20 bp, Artificial Sequence
  Description of Artificial Sequence: Synthetic oligonucleotide
  Target: SCN9A; (+) strand; PAM type: NRG; PAM sequence: CAG
tttgaaatctatacttgcta

SEQ ID NO: 44239 - DNA, 20 bp, Artificial Sequence
  Description of Artificial Sequence: Synthetic oligonucleotide
  Target: SCN9A; (+) strand; PAM type: NRG; PAM sequence: AAG
atctatacttgctacagtat

SEQ ID NO: 44240 - DNA, 20 bp, Artificial Sequence
  Description of Artificial Sequence: Synthetic oligonucleotide
  Target: SCN9A; (+) strand; PAM type: NRG; PAM sequence: TAG
tgctacagtataagcttctt

SEQ ID NO: 44241 - DNA, 20 bp, Artificial Sequence
  Description of Artificial Sequence: Synthetic oligonucleotide
  Target: SCN9A; (+) strand; PAM type: NRG; PAM sequence: CAG
tacagtataagcttctttag

SEQ ID NO: 44242 - DNA, 20 bp, Artificial Sequence
  Description of Artificial Sequence: Synthetic oligonucleotide
  Target: SCN9A; (+) strand; PAM type: NRG; PAM sequence: AAG
agcttctttagcagatttct

SEQ ID NO: 44243 - DNA, 20 bp, Artificial Sequence
  Description of Artificial Sequence: Synthetic oligonucleotide
  Target: SCN9A; (+) strand; PAM type: NRG; PAM sequence: GAG
cttctttagcagatttctaa

SEQ ID NO: 44244 - DNA, 20 bp, Artificial Sequence
  Description of Artificial Sequence: Synthetic oligonucleotide
  Target: SCN9A; (+) strand; PAM type: NRG; PAM sequence: TAG
tctaagagaatacctttata

SEQ ID NO: 44245 - DNA, 20 bp, Artificial Sequence
  Description of Artificial Sequence: Synthetic oligonucleotide
  Target: SCN9A; (+) strand; PAM type: NRG; PAM sequence: AAG
agagaatacctttatataga

SEQ ID NO: 44246 - DNA, 20 bp, Artificial Sequence
  Description of Artificial Sequence: Synthetic oligonucleotide
  Target: SCN9A; (+) strand; PAM type: NRG; PAM sequence: AGG
gagaatacctttatatagaa

SEQ ID NO: 44247 - DNA, 20 bp, Artificial Sequence
  Description of Artificial Sequence: Synthetic oligonucleotide
  Target: SCN9A; (+) strand; PAM type: NRG; PAM sequence: AAG
aaaggctgatatatataata

SEQ ID NO: 44248 - DNA, 20 bp, Artificial Sequence
  Description of Artificial Sequence: Synthetic oligonucleotide
  Target: SCN9A; (+) strand; PAM type: NRG; PAM sequence: CGG
aataaagtttttttttcctg

SEQ ID NO: 44249 - DNA, 20 bp, Artificial Sequence
  Description of Artificial Sequence: Synthetic oligonucleotide
  Target: SCN9A; (+) strand; PAM type: NRG; PAM sequence: CAG
tgaaatatattgaattctca

SEQ ID NO: 44250 - DNA, 20 bp, Artificial Sequence
  Description of Artificial Sequence: Synthetic oligonucleotide
  Target: SCN9A; (+) strand; PAM type: NRG; PAM sequence: TAG
aatatattgaattctcacag

SEQ ID NO: 44251 - DNA, 20 bp, Artificial Sequence
  Description of Artificial Sequence: Synthetic oligonucleotide
  Target: SCN9A; (+) strand; PAM type: NRG; PAM sequence: AGG
atatattgaattctcacagt

SEQ ID NO: 44252 - DNA, 20 bp, Artificial Sequence
  Description of Artificial Sequence: Synthetic oligonucleotide
  Target: SCN9A; (+) strand; PAM type: NRG; PAM sequence: AAG
cagtaggcatcaccatattt

SEQ ID NO: 44253 - DNA, 20 bp, Artificial Sequence
  Description of Artificial Sequence: Synthetic oligonucleotide
  Target: SCN9A; (+) strand; PAM type: NRG; PAM sequence: AAG
atatatgttttttactatac

SEQ ID NO: 44254 - DNA, 20 bp, Artificial Sequence
  Description of Artificial Sequence: Synthetic oligonucleotide
  Target: SCN9A; (+) strand; PAM type: NRG; PAM sequence: AGG
tatatgttttttactataca

SEQ ID NO: 44255 - DNA, 20 bp, Artificial Sequence
  Description of Artificial Sequence: Synthetic oligonucleotide
  Target: SCN9A; (+) strand; PAM type: NRG; PAM sequence: AAG
atgttttttactatacaagg

SEQ ID NO: 44256 - DNA, 20 bp, Artificial Sequence
  Description of Artificial Sequence: Synthetic oligonucleotide
  Target: SCN9A; (+) strand; PAM type: NRG; PAM sequence: TAG
aaactcaatcatctgttgtt

SEQ ID NO: 44257 - DNA, 20 bp, Artificial Sequence
  Description of Artificial Sequence: Synthetic oligonucleotide
  Target: SCN9A; (+) strand; PAM type: NRG; PAM sequence: TGG
tttagttttccatgtaattt

SEQ ID NO: 44258 - DNA, 20 bp, Artificial Sequence
  Description of Artificial Sequence: Synthetic oligonucleotide
  Target: SCN9A; (+) strand; PAM type: NRG; PAM sequence: AAG
ccatgtaattttggaaatga

SEQ ID NO: 44259 - DNA, 20 bp, Artificial Sequence
  Description of Artificial Sequence: Synthetic oligonucleotide
  Target: SCN9A; (+) strand; PAM type: NRG; PAM sequence: TAG
aaatgaaagaatgactatat

SEQ ID NO: 44260 - DNA, 20 bp, Artificial Sequence
  Description of Artificial Sequence: Synthetic oligonucleotide
  Target: SCN9A; (+) strand; PAM type: NRG; PAM sequence: GAG
atgaaagaatgactatatta

SEQ ID NO: 44261 - DNA, 20 bp, Artificial Sequence
  Description of Artificial Sequence: Synthetic oligonucleotide
  Target: SCN9A; (+) strand; PAM type: NRG; PAM sequence: AAG
aaagaatgactatattagag

SEQ ID NO: 44262 - DNA, 20 bp, Artificial Sequence
  Description of Artificial Sequence: Synthetic oligonucleotide
  Target: SCN9A; (+) strand; PAM type: NRG; PAM sequence: TAG
gagaagtgaaataaatgctt

SEQ ID NO: 44263 - DNA, 20 bp, Artificial Sequence
  Description of Artificial Sequence: Synthetic oligonucleotide
  Target: SCN9A; (+) strand; PAM type: NRG; PAM sequence: AAG
aaataaatgctttagtatga

SEQ ID NO: 44264 - DNA, 20 bp, Artificial Sequence
  Description of Artificial Sequence: Synthetic oligonucleotide
  Target: SCN9A; (+) strand; PAM type: NRG; PAM sequence: TAG
atttcttttgctattataaa

SEQ ID NO: 44265 - DNA, 20 bp, Artificial Sequence
  Description of Artificial Sequence: Synthetic oligonucleotide
  Target: SCN9A; (+) strand; PAM type: NRG; PAM sequence: AGG
tttcttttgctattataaat

SEQ ID NO: 44266 - DNA, 20 bp, Artificial Sequence
  Description of Artificial Sequence: Synthetic oligonucleotide
  Target: SCN9A; (+) strand; PAM type: NRG; PAM sequence: TGG
gaccttctgtaattttcaca

SEQ ID NO: 44267 - DNA, 20 bp, Artificial Sequence
  Description of Artificial Sequence: Synthetic oligonucleotide
  Target: SCN9A; (+) strand; PAM type: NRG; PAM sequence: AAG
atggatttgatttctaataa

SEQ ID NO: 44268 - DNA, 20 bp, Artificial Sequence
  Description of Artificial Sequence: Synthetic oligonucleotide
  Target: SCN9A; (+) strand; PAM type: NRG; PAM sequence: AGG
tggatttgatttctaataaa

SEQ ID NO: 44269 - DNA, 20 bp, Artificial Sequence
  Description of Artificial Sequence: Synthetic oligonucleotide
  Target: SCN9A; (+) strand; PAM type: NRG; PAM sequence: GGG
ggatttgatttctaataaaa

SEQ ID NO: 44270 - DNA, 20 bp, Artificial Sequence
  Description of Artificial Sequence: Synthetic oligonucleotide
  Target: SCN9A; (+) strand; PAM type: NRG; PAM sequence: AAG
tttgatttctaataaaaggg

SEQ ID NO: 44271 - DNA, 20 bp, Artificial Sequence
  Description of Artificial Sequence: Synthetic oligonucleotide
  Target: SCN9A; (+) strand; PAM type: NRG; PAM sequence: TGG
gtatcaatttttttcatcat

SEQ ID NO: 44272 - DNA, 20 bp, Artificial Sequence
  Description of Artificial Sequence: Synthetic oligonucleotide
  Target: SCN9A; (+) strand; PAM type: NRG; PAM sequence: CAG
tcaatttttttcatcattgg

SEQ ID NO: 44273 - DNA, 20 bp, Artificial Sequence
  Description of Artificial Sequence: Synthetic oligonucleotide
  Target: SCN9A; (+) strand; PAM type: NRG; PAM sequence: TAG
ttttttcatcattggcagtc

SEQ ID NO: 44274 - DNA, 20 bp, Artificial Sequence
  Description of Artificial Sequence: Synthetic oligonucleotide
  Target: SCN9A; (+) strand; PAM type: NRG; PAM sequence: AAG
tggcagtctagttataaata

SEQ ID NO: 44275 - DNA, 20 bp, Artificial Sequence
  Description of Artificial Sequence: Synthetic oligonucleotide
  Target: SCN9A; (+) strand; PAM type: NRG; PAM sequence: AAG
aataaagtaaatataaatat

SEQ ID NO: 44276 - DNA, 20 bp, Artificial Sequence
  Description of Artificial Sequence: Synthetic oligonucleotide
  Target: SCN9A; (+) strand; PAM type: NRG; PAM sequence: TAG
agtaaatataaatataagca

SEQ ID NO: 44277 - DNA, 20 bp, Artificial Sequence
  Description of Artificial Sequence: Synthetic oligonucleotide
  Target: SCN9A; (+) strand; PAM type: NRG; PAM sequence: AGG
gtaaatataaatataagcat

SEQ ID NO: 44278 - DNA, 20 bp, Artificial Sequence
  Description of Artificial Sequence: Synthetic oligonucleotide
  Target: SCN9A; (+) strand; PAM type: NRG; PAM sequence: AAG
ataaatataagcataggatc

SEQ ID NO: 44279 - DNA, 20 bp, Artificial Sequence
  Description of Artificial Sequence: Synthetic oligonucleotide
  Target: SCN9A; (+) strand; PAM type: NRG; PAM sequence: AAG
aatataagcataggatcaag

SEQ ID NO: 44280 - DNA, 20 bp, Artificial Sequence
  Description of Artificial Sequence: Synthetic oligonucleotide
  Target: SCN9A; (+) strand; PAM type: NRG; PAM sequence: AGG
atataagcataggatcaaga

SEQ ID NO: 44281 - DNA, 20 bp, Artificial Sequence
  Description of Artificial Sequence: Synthetic oligonucleotide
  Target: SCN9A; (+) strand; PAM type: NRG; PAM sequence: TGG
taagcataggatcaagaagg

SEQ ID NO: 44282 - DNA, 20 bp, Artificial Sequence
  Description of Artificial Sequence: Synthetic oligonucleotide
  Target: SCN9A; (+) strand; PAM type: NRG; PAM sequence: TAG
gatcaagaaggtggactcac

SEQ ID NO: 44283 - DNA, 20 bp, Artificial Sequence
  Description of Artificial Sequence: Synthetic oligonucleotide
  Target: SCN9A; (+) strand; PAM type: NRG; PAM sequence: TAG
gaaggtggactcactagtat

SEQ ID NO: 44284 - DNA, 20 bp, Artificial Sequence
  Description of Artificial Sequence: Synthetic oligonucleotide
  Target: SCN9A; (+) strand; PAM type: NRG; PAM sequence: AGG
aaggtggactcactagtatt

SEQ ID NO: 44285 - DNA, 20 bp, Artificial Sequence
  Description of Artificial Sequence: Synthetic oligonucleotide
  Target: SCN9A; (+) strand; PAM type: NRG; PAM sequence: CAG
gactcactagtattaggaat

SEQ ID NO: 44286 - DNA, 20 bp, Artificial Sequence
  Description of Artificial Sequence: Synthetic oligonucleotide
  Target: SCN9A; (+) strand; PAM type: NRG; PAM sequence: AAG
tcactagtattaggaatcag

SEQ ID NO: 44287 - DNA, 20 bp, Artificial Sequence
  Description of Artificial Sequence: Synthetic oligonucleotide
  Target: SCN9A; (+) strand; PAM type: NRG; PAM sequence: TAG
aatcagaagtgtaccataat

SEQ ID NO: 44288 - DNA, 20 bp, Artificial Sequence
  Description of Artificial Sequence: Synthetic oligonucleotide
  Target: SCN9A; (+) strand; PAM type: NRG; PAM sequence: AAG
atattgactgtgccttctaa

SEQ ID NO: 44289 - DNA, 20 bp, Artificial Sequence
  Description of Artificial Sequence: Synthetic oligonucleotide
  Target: SCN9A; (+) strand; PAM type: NRG; PAM sequence: AAG
aaagtgttttaaaaatatga

SEQ ID NO: 44290 - DNA, 20 bp, Artificial Sequence
  Description of Artificial Sequence: Synthetic oligonucleotide
  Target: SCN9A; (+) strand; PAM type: NRG; PAM sequence: TAG
ttaaaaatatgaaagtgata

SEQ ID NO: 44291 - DNA, 20 bp, Artificial Sequence
  Description of Artificial Sequence: Synthetic oligonucleotide
  Target: SCN9A; (+) strand; PAM type: NRG; PAM sequence: TAG
caaacattttaaatgtataa

SEQ ID NO: 44292 - DNA, 20 bp, Artificial Sequence
  Description of Artificial Sequence: Synthetic oligonucleotide
  Target: SCN9A; (+) strand; PAM type: NRG; PAM sequence: CAG
taaatgtataatagtattta

SEQ ID NO: 44293 - DNA, 20 bp, Artificial Sequence
  Description of Artificial Sequence: Synthetic oligonucleotide
  Target: SCN9A; (+) strand; PAM type: NRG; PAM sequence: AAG
gtatttacagtgcaaaataa

SEQ ID NO: 44294 - DNA, 20 bp, Artificial Sequence
  Description of Artificial Sequence: Synthetic oligonucleotide
  Target: SCN9A; (+) strand; PAM type: NRG; PAM sequence: GAG
ctccttgattcaaccccctt

SEQ ID NO: 44295 - DNA, 20 bp, Artificial Sequence
  Description of Artificial Sequence: Synthetic oligonucleotide
  Target: SCN9A; (+) strand; PAM type: NRG; PAM sequence: AGG
tccttgattcaacccccttg

SEQ ID NO: 44296 - DNA, 20 bp, Artificial Sequence
  Description of Artificial Sequence: Synthetic oligonucleotide
  Target: SCN9A; (+) strand; PAM type: NRG; PAM sequence: GAG
tcaacccccttgaggtaatc

SEQ ID NO: 44297 - DNA, 20 bp, Artificial Sequence
  Description of Artificial Sequence: Synthetic oligonucleotide
  Target: SCN9A; (+) strand; PAM type: NRG; PAM sequence: GAG
aacccccttgaggtaatcga

SEQ ID NO: 44298 - DNA, 20 bp, Artificial Sequence
  Description of Artificial Sequence: Synthetic oligonucleotide
  Target: SCN9A; (+) strand; PAM type: NRG; PAM sequence: GAG
cccccttgaggtaatcgaga

SEQ ID NO: 44299 - DNA, 20 bp, Artificial Sequence
  Description of Artificial Sequence: Synthetic oligonucleotide
  Target: SCN9A; (+) strand; PAM type: NRG; PAM sequence: GAG
cccttgaggtaatcgagaga

SEQ ID NO: 44300 - DNA, 20 bp, Artificial Sequence
  Description of Artificial Sequence: Synthetic oligonucleotide
  Target: SCN9A; (+) strand; PAM type: NRG; PAM sequence: AAG
aggtaatcgagagagagaaa

SEQ ID NO: 44301 - DNA, 20 bp, Artificial Sequence
  Description of Artificial Sequence: Synthetic oligonucleotide
  Target: SCN9A; (+) strand; PAM type: NRG; PAM sequence: GAG
gtaatcgagagagagaaaaa

SEQ ID NO: 44302 - DNA, 20 bp, Artificial Sequence
  Description of Artificial Sequence: Synthetic oligonucleotide
  Target: SCN9A; (+) strand; PAM type: NRG; PAM sequence: GAG
aatcgagagagagaaaaaga

SEQ ID NO: 44303 - DNA, 20 bp, Artificial Sequence
  Description of Artificial Sequence: Synthetic oligonucleotide
  Target: SCN9A; (+) strand; PAM type: NRG; PAM sequence: GAG
tcgagagagagaaaaagaga

SEQ ID NO: 44304 - DNA, 20 bp, Artificial Sequence
  Description of Artificial Sequence: Synthetic oligonucleotide
  Target: SCN9A; (+) strand; PAM type: NRG; PAM sequence: GAG
gagagagagaaaaagagaga

SEQ ID NO: 44305 - DNA, 20 bp, Artificial Sequence
  Description of Artificial Sequence: Synthetic oligonucleotide
  Target: SCN9A; (+) strand; PAM type: NRG; PAM sequence: AGG
agagagagaaaaagagagag

SEQ ID NO: 44306 - DNA, 20 bp, Artificial Sequence
  Description of Artificial Sequence: Synthetic oligonucleotide
  Target: SCN9A; (+) strand; PAM type: NRG; PAM sequence: GAG
agagagaaaaagagagagag

SEQ ID NO: 44307 - DNA, 20 bp, Artificial Sequence
  Description of Artificial Sequence: Synthetic oligonucleotide
  Target: SCN9A; (+) strand; PAM type: NRG; PAM sequence: GAG
agagaaaaagagagagagga

SEQ ID NO: 44308 - DNA, 20 bp, Artificial Sequence
  Description of Artificial Sequence: Synthetic oligonucleotide
  Target: SCN9A; (+) strand; PAM type: NRG; PAM sequence: GAG
agaaaaagagagagaggaga

SEQ ID NO: 44309 - DNA, 20 bp, Artificial Sequence
  Description of Artificial Sequence: Synthetic oligonucleotide
  Target: SCN9A; (+) strand; PAM type: NRG; PAM sequence: GAG
aaaaagagagagaggagaga

SEQ ID NO: 44310 - DNA, 20 bp, Artificial Sequence
  Description of Artificial Sequence: Synthetic oligonucleotide
  Target: SCN9A; (+) strand; PAM type: NRG; PAM sequence: GAG
aaagagagagaggagagaga

SEQ ID NO: 44311 - DNA, 20 bp, Artificial Sequence
  Description of Artificial Sequence: Synthetic oligonucleotide
  Target: SCN9A; (+) strand; PAM type: NRG; PAM sequence: GAG
agagagagaggagagagaga

SEQ ID NO: 44312 - DNA, 20 bp, Artificial Sequence
  Description of Artificial Sequence: Synthetic oligonucleotide
  Target: SCN9A; (+) strand; PAM type: NRG; PAM sequence: GAG
agagagaggagagagagaga

SEQ ID NO: 44313 - DNA, 20 bp, Artificial Sequence
  Description of Artificial Sequence: Synthetic oligonucleotide
  Target: SCN9A; (+) strand; PAM type: NRG; PAM sequence: GAG
agagaggagagagagagaga

SEQ ID NO: 44314 - DNA, 20 bp, Artificial Sequence
  Description of Artificial Sequence: Synthetic oligonucleotide
  Target: SCN9A; (+) strand; PAM type: NRG; PAM sequence: GAG
agaggagagagagagagaga

SEQ ID NO: 44315 - DNA, 20 bp, Artificial Sequence
  Description of Artificial Sequence: Synthetic oligonucleotide
  Target: SCN9A; (+) strand; PAM type: NRG; PAM sequence: GAG
aggagagagagagagagaga

SEQ ID NO: 44316 - DNA, 20 bp, Artificial Sequence
  Description of Artificial Sequence: Synthetic oligonucleotide
  Target: SCN9A; (+) strand; PAM type: NRG; PAM sequence: GAG
gagagagagagagagagaga

SEQ ID NO: 44317 - DNA, 20 bp, Artificial Sequence
  Description of Artificial Sequence: Synthetic oligonucleotide
  Target: SCN9A; (+) strand; PAM type: NRG; PAM sequence: GAG
gagagagagagagagagaga

SEQ ID NO: 44318 - DNA, 20 bp, Artificial Sequence
  Description of Artificial Sequence: Synthetic oligonucleotide
  Target: SCN9A; (+) strand; PAM type: NRG; PAM sequence: CAG
acatatctttccatattttt

SEQ ID NO: 44319 - DNA, 20 bp, Artificial Sequence
  Description of Artificial Sequence: Synthetic oligonucleotide
  Target: SCN9A; (+) strand; PAM type: NRG; PAM sequence: TAG
tgtgcatccatacaacacta

SEQ ID NO: 44320 - DNA, 20 bp, Artificial Sequence
  Description of Artificial Sequence: Synthetic oligonucleotide
  Target: SCN9A; (+) strand; PAM type: NRG; PAM sequence: TAG
atcttgattgtaaacttatg

SEQ ID NO: 44321 - DNA, 20 bp, Artificial Sequence
  Description of Artificial Sequence: Synthetic oligonucleotide
  Target: SCN9A; (+) strand; PAM type: NRG; PAM sequence: AAG
gtaaacttatgtagctattt

SEQ ID NO: 44322 - DNA, 20 bp, Artificial Sequence
  Description of Artificial Sequence: Synthetic oligonucleotide
  Target: SCN9A; (+) strand; PAM type: NRG; PAM sequence: AAG
tgaaaatatgtccaaattaa

SEQ ID NO: 44323 - DNA, 20 bp, Artificial Sequence
  Description of Artificial Sequence: Synthetic oligonucleotide
  Target: SCN9A; (+) strand; PAM type: NRG; PAM sequence: TGG
aaaagctttattattcttca

SEQ ID NO: 44324 - DNA, 20 bp, Artificial Sequence
  Description of Artificial Sequence: Synthetic oligonucleotide
  Target: SCN9A; (+) strand; PAM type: NRG; PAM sequence: AAG
ttttccctttgattgccttg

SEQ ID NO: 44325 - DNA, 20 bp, Artificial Sequence
  Description of Artificial Sequence: Synthetic oligonucleotide
  Target: SCN9A; (+) strand; PAM type: NRG; PAM sequence: GAG
tgttttctactatactgctt

SEQ ID NO: 44326 - DNA, 20 bp, Artificial Sequence
  Description of Artificial Sequence: Synthetic oligonucleotide
  Target: SCN9A; (+) strand; PAM type: NRG; PAM sequence: TAG
tttctactatactgcttgag

SEQ ID NO: 44327 - DNA, 20 bp, Artificial Sequence
  Description of Artificial Sequence: Synthetic oligonucleotide
  Target: SCN9A; (+) strand; PAM type: NRG; PAM sequence: TAG
gttaaatatatgtatcatat

SEQ ID NO: 44328 - DNA, 20 bp, Artificial Sequence
  Description of Artificial Sequence: Synthetic oligonucleotide
  Target: SCN9A; (+) strand; PAM type: NRG; PAM sequence: AAG
atcatattagaacatgtcct

SEQ ID NO: 44329 - DNA, 20 bp, Artificial Sequence
  Description of Artificial Sequence: Synthetic oligonucleotide
  Target: SCN9A; (+) strand; PAM type: NRG; PAM sequence: TGG
ttcacttacaaatttatcac

SEQ ID NO: 44330 - DNA, 20 bp, Artificial Sequence
  Description of Artificial Sequence: Synthetic oligonucleotide
  Target: SCN9A; (+) strand; PAM type: NRG; PAM sequence: AAG
atttatcactggcatttcct

SEQ ID NO: 44331 - DNA, 20 bp, Artificial Sequence
  Description of Artificial Sequence: Synthetic oligonucleotide
  Target: SCN9A; (+) strand; PAM type: NRG; PAM sequence: AAG
aagataaacattaacgatgt

SEQ ID NO: 44332 - DNA, 20 bp, Artificial Sequence
  Description of Artificial Sequence: Synthetic oligonucleotide
  Target: SCN9A; (+) strand; PAM type: NRG; PAM sequence: TGG
aagcctatttcatgctatca

SEQ ID NO: 44333 - DNA, 20 bp, Artificial Sequence
  Description of Artificial Sequence: Synthetic oligonucleotide
  Target: SCN9A; (+) strand; PAM type: NRG; PAM sequence: TGG
tttcatgctatcatggatga

SEQ ID NO: 44334 - DNA, 20 bp, Artificial Sequence
  Description of Artificial Sequence: Synthetic oligonucleotide
  Target: SCN9A; (+) strand; PAM type: NRG; PAM sequence: TAG
tcatggatgatggttaatgc

SEQ ID NO: 44335 - DNA, 20 bp, Artificial Sequence
  Description of Artificial Sequence: Synthetic oligonucleotide
  Target: SCN9A; (+) strand; PAM type: NRG; PAM sequence: AAG
tgctagttatttattgttcc

SEQ ID NO: 44336 - DNA, 20 bp, Artificial Sequence
  Description of Artificial Sequence: Synthetic oligonucleotide
  Target: SCN9A; (+) strand; PAM type: NRG; PAM sequence: GAG
ctagttatttattgttccaa

SEQ ID NO: 44337 - DNA, 20 bp, Artificial Sequence
  Description of Artificial Sequence: Synthetic oligonucleotide
  Target: SCN9A; (+) strand; PAM type: NRG; PAM sequence: AGG
tagttatttattgttccaag

SEQ ID NO: 44338 - DNA, 20 bp, Artificial Sequence
  Description of Artificial Sequence: Synthetic oligonucleotide
  Target: SCN9A; (+) strand; PAM type: NRG; PAM sequence: GAG
tttattgttccaagaggtgt

SEQ ID NO: 44339 - DNA, 20 bp, Artificial Sequence
  Description of Artificial Sequence: Synthetic oligonucleotide
  Target: SCN9A; (+) strand; PAM type: NRG; PAM sequence: AGG
ttattgttccaagaggtgtg

SEQ ID NO: 44340 - DNA, 20 bp, Artificial Sequence
  Description of Artificial Sequence: Synthetic oligonucleotide
  Target: SCN9A; (+) strand; PAM type: NRG; PAM sequence: TAG
ttgttccaagaggtgtgagg

SEQ ID NO: 44341 - DNA, 20 bp, Artificial Sequence
  Description of Artificial Sequence: Synthetic oligonucleotide
  Target: SCN9A; (+) strand; PAM type: NRG; PAM sequence: AGG
tgttccaagaggtgtgaggt

SEQ ID NO: 44342 - DNA, 20 bp, Artificial Sequence
  Description of Artificial Sequence: Synthetic oligonucleotide
  Target: SCN9A; (+) strand; PAM type: NRG; PAM sequence: GAG
ttccaagaggtgtgaggtag

SEQ ID NO: 44343 - DNA, 20 bp, Artificial Sequence
  Description of Artificial Sequence: Synthetic oligonucleotide
  Target: SCN9A; (+) strand; PAM type: NRG; PAM sequence: AAG
cttgataatctaacgctcaa

SEQ ID NO: 44344 - DNA, 20 bp, Artificial Sequence
  Description of Artificial Sequence: Synthetic oligonucleotide
  Target: SCN9A; (+) strand; PAM type: NRG; PAM sequence: AAG
gataatctaacgctcaaaag

SEQ ID NO: 44345 - DNA, 20 bp, Artificial Sequence
  Description of Artificial Sequence: Synthetic oligonucleotide
  Target: SCN9A; (+) strand; PAM type: NRG; PAM sequence: CAG
aaagaagaaactatcaaaca

SEQ ID NO: 44346 - DNA, 20 bp, Artificial Sequence
  Description of Artificial Sequence: Synthetic oligonucleotide
  Target: SCN9A; (+) strand; PAM type: NRG; PAM sequence: CAG
gaagaaactatcaaacacag

SEQ ID NO: 44347 - DNA, 20 bp, Artificial Sequence
  Description of Artificial Sequence: Synthetic oligonucleotide
  Target: SCN9A; (+) strand; PAM type: NRG; PAM sequence: CAG
cagcagcactgtacaaaaca

SEQ ID NO: 44348 - DNA, 20 bp, Artificial Sequence
  Description of Artificial Sequence: Synthetic oligonucleotide
  Target: SCN9A; (+) strand; PAM type: NRG; PAM sequence: AAG
ctcaacaaaaaccttactca

SEQ ID NO: 44349 - DNA, 20 bp, Artificial Sequence
  Description of Artificial Sequence: Synthetic oligonucleotide
  Target: SCN9A; (+) strand; PAM type: NRG; PAM sequence: GAG
caacaaaaaccttactcaaa

SEQ ID NO: 44350 - DNA, 20 bp, Artificial Sequence
  Description of Artificial Sequence: Synthetic oligonucleotide
  Target: SCN9A; (+) strand; PAM type: NRG; PAM sequence: AAG
agagaatgattgatgctgaa

SEQ ID NO: 44351 - DNA, 20 bp, Artificial Sequence
  Description of Artificial Sequence: Synthetic oligonucleotide
  Target: SCN9A; (+) strand; PAM type: NRG; PAM sequence: AAG
actgaaaaatgttacatttc

SEQ ID NO: 44352 - DNA, 20 bp, Artificial Sequence
  Description of Artificial Sequence: Synthetic oligonucleotide
  Target: SCN9A; (+) strand; PAM type: NRG; PAM sequence: AAG
tgcttcacacaacaaaaaaa

SEQ ID NO: 44353 - DNA, 20 bp, Artificial Sequence
  Description of Artificial Sequence: Synthetic oligonucleotide
  Target: SCN9A; (+) strand; PAM type: NRG; PAM sequence: AAG
caaaaaaaaagatattcttt

SEQ ID NO: 44354 - DNA, 20 bp, Artificial Sequence
  Description of Artificial Sequence: Synthetic oligonucleotide
  Target: SCN9A; (+) strand; PAM type: NRG; PAM sequence: AGG
aaaaaaaaagatattcttta

SEQ ID NO: 44355 - DNA, 20 bp, Artificial Sequence
  Description of Artificial Sequence: Synthetic oligonucleotide
  Target: SCN9A; (+) strand; PAM type: NRG; PAM sequence: GAG
aaaaaaagatattctttaag

SEQ ID NO: 44356 - DNA, 20 bp, Artificial Sequence
  Description of Artificial Sequence: Synthetic oligonucleotide
  Target: SCN9A; (+) strand; PAM type: NRG; PAM sequence: CAG
aaaagatattctttaaggag

SEQ ID NO: 44357 - DNA, 20 bp, Artificial Sequence
  Description of Artificial Sequence: Synthetic oligonucleotide
  Target: SCN9A; (+) strand; PAM type: NRG; PAM sequence: GAG
aagatattctttaaggagca

SEQ ID NO: 44358 - DNA, 20 bp, Artificial Sequence
  Description of Artificial Sequence: Synthetic oligonucleotide
  Target: SCN9A; (+) strand; PAM type: NRG; PAM sequence: TAG
attctttaaggagcagagcc

SEQ ID NO: 44359 - DNA, 20 bp, Artificial Sequence
  Description of Artificial Sequence: Synthetic oligonucleotide
  Target: SCN9A; (+) strand; PAM type: NRG; PAM sequence: TGG
ttaaggagcagagcctagaa

SEQ ID NO: 44360 - DNA, 20 bp, Artificial Sequence
  Description of Artificial Sequence: Synthetic oligonucleotide
  Target: SCN9A; (+) strand; PAM type: NRG; PAM sequence: GAG
ctagaatggttatttcacct

SEQ ID NO: 44361 - DNA, 20 bp, Artificial Sequence
  Description of Artificial Sequence: Synthetic oligonucleotide
  Target: SCN9A; (+) strand; PAM type: NRG; PAM sequence: AAG
gagccttaaaatactcacaa

SEQ ID NO: 44362 - DNA, 20 bp, Artificial Sequence
  Description of Artificial Sequence: Synthetic oligonucleotide
  Target: SCN9A; (+) strand; PAM type: NRG; PAM sequence: CAG
cttaaaatactcacaaaaga

SEQ ID NO: 44363 - DNA, 20 bp, Artificial Sequence
  Description of Artificial Sequence: Synthetic oligonucleotide
  Target: SCN9A; (+) strand; PAM type: NRG; PAM sequence: AAG
aaatactcacaaaagacagt

SEQ ID NO: 44364 - DNA, 20 bp, Artificial Sequence
  Description of Artificial Sequence: Synthetic oligonucleotide
  Target: SCN9A; (+) strand; PAM type: NRG; PAM sequence: AAG
actcacaaaagacagtaaga

SEQ ID NO: 44365 - DNA, 20 bp, Artificial Sequence
  Description of Artificial Sequence: Synthetic oligonucleotide
  Target: SCN9A; (+) strand; PAM type: NRG; PAM sequence: GAG
caaaagacagtaagaaagtt

SEQ ID NO: 44366 - DNA, 20 bp, Artificial Sequence
  Description of Artificial Sequence: Synthetic oligonucleotide
  Target: SCN9A; (+) strand; PAM type: NRG; PAM sequence: GAG
aaagacagtaagaaagttga

SEQ ID NO: 44367 - DNA, 20 bp, Artificial Sequence
  Description of Artificial Sequence: Synthetic oligonucleotide
  Target: SCN9A; (+) strand; PAM type: NRG; PAM sequence: AAG
gacagtaagaaagttgagag

SEQ ID NO: 44368 - DNA, 20 bp, Artificial Sequence
  Description of Artificial Sequence: Synthetic oligonucleotide
  Target: SCN9A; (+) strand; PAM type: NRG; PAM sequence: AAG
agttgagagaagcaaatcaa

SEQ ID NO: 44369 - DNA, 20 bp, Artificial Sequence
  Description of Artificial Sequence: Synthetic oligonucleotide
  Target: SCN9A; (+) strand; PAM type: NRG; PAM sequence: AGG
gttgagagaagcaaatcaaa

SEQ ID NO: 44370 - DNA, 20 bp, Artificial Sequence
  Description of Artificial Sequence: Synthetic oligonucleotide
  Target: SCN9A; (+) strand; PAM type: NRG; PAM sequence: GAG
tgagagaagcaaatcaaaag

SEQ ID NO: 44371 - DNA, 20 bp, Artificial Sequence
  Description of Artificial Sequence: Synthetic oligonucleotide
  Target: SCN9A; (+) strand; PAM type: NRG; PAM sequence: AGG
gagagaagcaaatcaaaagg

SEQ ID NO: 44372 - DNA, 20 bp, Artificial Sequence
  Description of Artificial Sequence: Synthetic oligonucleotide
  Target: SCN9A; (+) strand; PAM type: NRG; PAM sequence: GAG
gagaagcaaatcaaaaggag

SEQ ID NO: 44373 - DNA, 20 bp, Artificial Sequence
  Description of Artificial Sequence: Synthetic oligonucleotide
  Target: SCN9A; (+) strand; PAM type: NRG; PAM sequence: TGG
agcaaatcaaaaggaggaga

SEQ ID NO: 44374 - DNA, 20 bp, Artificial Sequence
  Description of Artificial Sequence: Synthetic oligonucleotide
  Target: SCN9A; (+) strand; PAM type: NRG; PAM sequence: GGG
gcaaatcaaaaggaggagat

SEQ ID NO: 44375 - DNA, 20 bp, Artificial Sequence
  Description of Artificial Sequence: Synthetic oligonucleotide
  Target: SCN9A; (+) strand; PAM type: NRG; PAM sequence: AAG
aaaggaggagatgggtataa

SEQ ID NO: 44376 - DNA, 20 bp, Artificial Sequence
  Description of Artificial Sequence: Synthetic oligonucleotide
  Target: SCN9A; (+) strand; PAM type: NRG; PAM sequence: GAG
aggaggagatgggtataaaa

SEQ ID NO: 44377 - DNA, 20 bp, Artificial Sequence
  Description of Artificial Sequence: Synthetic oligonucleotide
  Target: SCN9A; (+) strand; PAM type: NRG; PAM sequence: AAG
aggagatgggtataaaagag

SEQ ID NO: 44378 - DNA, 20 bp, Artificial Sequence
  Description of Artificial Sequence: Synthetic oligonucleotide
  Target: SCN9A; (+) strand; PAM type: NRG; PAM sequence: TGG
ataaaagagaagaaaaatta

SEQ ID NO: 44379 - DNA, 20 bp, Artificial Sequence
  Description of Artificial Sequence: Synthetic oligonucleotide
  Target: SCN9A; (+) strand; PAM type: NRG; PAM sequence: CAG
aaagagaagaaaaattatgg

SEQ ID NO: 44380 - DNA, 20 bp, Artificial Sequence
  Description of Artificial Sequence: Synthetic oligonucleotide
  Target: SCN9A; (+) strand; PAM type: NRG; PAM sequence: CAG
agaagaaaaattatggcaga

SEQ ID NO: 44381 - DNA, 20 bp, Artificial Sequence
  Description of Artificial Sequence: Synthetic oligonucleotide
  Target: SCN9A; (+) strand; PAM type: NRG; PAM sequence: TGG
agaaaaattatggcagacag

SEQ ID NO: 44382 - DNA, 20 bp, Artificial Sequence
  Description of Artificial Sequence: Synthetic oligonucleotide
  Target: SCN9A; (+) strand; PAM type: NRG; PAM sequence: AAG
atggcagacagtggtaaact

SEQ ID NO: 44383 - DNA, 20 bp, Artificial Sequence
  Description of Artificial Sequence: Synthetic oligonucleotide
  Target: SCN9A; (+) strand; PAM type: NRG; PAM sequence: AAG
aagctccattatctgttaat

SEQ ID NO: 44384 - DNA, 20 bp, Artificial Sequence
  Description of Artificial Sequence: Synthetic oligonucleotide
  Target: SCN9A; (+) strand; PAM type: NRG; PAM sequence: AAG
tccattatctgttaataagc

SEQ ID NO: 44385 - DNA, 20 bp, Artificial Sequence
  Description of Artificial Sequence: Synthetic oligonucleotide
  Target: SCN9A; (+) strand; PAM type: NRG; PAM sequence: AAG
ttatctgttaataagcaaga

SEQ ID NO: 44386 - DNA, 20 bp, Artificial Sequence
  Description of Artificial Sequence: Synthetic oligonucleotide
  Target: SCN9A; (+) strand; PAM type: NRG; PAM sequence: TAG
caagaaagacattttaaaat

SEQ ID NO: 44387 - DNA, 20 bp, Artificial Sequence
  Description of Artificial Sequence: Synthetic oligonucleotide
  Target: SCN9A; (+) strand; PAM type: NRG; PAM sequence: AAG
gacattttaaaattagtttc

SEQ ID NO: 44388 - DNA, 20 bp, Artificial Sequence
  Description of Artificial Sequence: Synthetic oligonucleotide
  Target: SCN9A; (+) strand; PAM type: NRG; PAM sequence: TAG
catcttttaatttaattgtg

SEQ ID NO: 44389 - DNA, 20 bp, Artificial Sequence
  Description of Artificial Sequence: Synthetic oligonucleotide
  Target: SCN9A; (+) strand; PAM type: NRG; PAM sequence: CGG
aatttaattgtgtagtttta

SEQ ID NO: 44390 - DNA, 20 bp, Artificial Sequence
  Description of Artificial Sequence: Synthetic oligonucleotide
  Target: SCN9A; (+) strand; PAM type: NRG; PAM sequence: AAG
aattgtgttcttgaatcatt

SEQ ID NO: 44391 - DNA, 20 bp, Artificial Sequence
  Description of Artificial Sequence: Synthetic oligonucleotide
  Target: SCN9A; (+) strand; PAM type: NRG; PAM sequence: AGG
attgtgttcttgaatcatta

SEQ ID NO: 44392 - DNA, 20 bp, Artificial Sequence
  Description of Artificial Sequence: Synthetic oligonucleotide
  Target: SCN9A; (+) strand; PAM type: NRG; PAM sequence: GAG
tgtgttcttgaatcattaag

SEQ ID NO: 44393 - DNA, 20 bp, Artificial Sequence
  Description of Artificial Sequence: Synthetic oligonucleotide
  Target: SCN9A; (+) strand; PAM type: NRG; PAM sequence: TAG
tgaatcattaaggagtaaaa

SEQ ID NO: 44394 - DNA, 20 bp, Artificial Sequence
  Description of Artificial Sequence: Synthetic oligonucleotide
  Target: SCN9A; (+) strand; PAM type: NRG; PAM sequence: AAG
aaaatagtaaatttcaatta

SEQ ID NO: 44395 - DNA, 20 bp, Artificial Sequence
  Description of Artificial Sequence: Synthetic oligonucleotide
  Target: SCN9A; (+) strand; PAM type: NRG; PAM sequence: AGG
aaatagtaaatttcaattaa

SEQ ID NO: 44396 - DNA, 20 bp, Artificial Sequence
  Description of Artificial Sequence: Synthetic oligonucleotide
  Target: SCN9A; (+) strand; PAM type: NRG; PAM sequence: AAG
aaatttcaattaaaggatca

SEQ ID NO: 44397 - DNA, 20 bp, Artificial Sequence
  Description of Artificial Sequence: Synthetic oligonucleotide
  Target: SCN9A; (+) strand; PAM type: NRG; PAM sequence: AGG
aatttcaattaaaggatcaa

SEQ ID NO: 44398 - DNA, 20 bp, Artificial Sequence
  Description of Artificial Sequence: Synthetic oligonucleotide
  Target: SCN9A; (+) strand; PAM type: NRG; PAM sequence: GAG
aaaggatcaaaggatccttt

SEQ ID NO: 44399 - DNA, 20 bp, Artificial Sequence
  Description of Artificial Sequence: Synthetic oligonucleotide
  Target: SCN9A; (+) strand; PAM type: NRG; PAM sequence: AAG
ggatcaaaggatcctttgag

SEQ ID NO: 44400 - DNA, 20 bp, Artificial Sequence
  Description of Artificial Sequence: Synthetic oligonucleotide
  Target: SCN9A; (+) strand; PAM type: NRG; PAM sequence: TAG
tttgagaagaaatccacaca

SEQ ID NO: 44401 - DNA, 20 bp, Artificial Sequence
  Description of Artificial Sequence: Synthetic oligonucleotide
  Target: SCN9A; (+) strand; PAM type: NRG; PAM sequence: TGG
atccacacatagttactatg

SEQ ID NO: 44402 - DNA, 20 bp, Artificial Sequence
  Description of Artificial Sequence: Synthetic oligonucleotide
  Target: SCN9A; (+) strand; PAM type: NRG; PAM sequence: AAG
acatagttactatgtggcat

SEQ ID NO: 44403 - DNA, 20 bp, Artificial Sequence
  Description of Artificial Sequence: Synthetic oligonucleotide
  Target: SCN9A; (+) strand; PAM type: NRG; PAM sequence: GAG
atagttactatgtggcataa

SEQ ID NO: 44404 - DNA, 20 bp, Artificial Sequence
  Description of Artificial Sequence: Synthetic oligonucleotide
  Target: SCN9A; (+) strand; PAM type: NRG; PAM sequence: AAG
ataagagtccaatattttcc

SEQ ID NO: 44405 - DNA, 20 bp, Artificial Sequence
  Description of Artificial Sequence: Synthetic oligonucleotide
  Target: SCN9A; (+) strand; PAM type: NRG; PAM sequence: CAG
ccaagtttcccattatgtta

SEQ ID NO: 44406 - DNA, 20 bp, Artificial Sequence
  Description of Artificial Sequence: Synthetic oligonucleotide
  Target: SCN9A; (+) strand; PAM type: NRG; PAM sequence: AGG
caagtttcccattatgttac

SEQ ID NO: 44407 - DNA, 20 bp, Artificial Sequence
  Description of Artificial Sequence: Synthetic oligonucleotide
  Target: SCN9A; (+) strand; PAM type: NRG; PAM sequence: TAG
ccattatgttacaggacaac

SEQ ID NO: 44408 - DNA, 20 bp, Artificial Sequence
  Description of Artificial Sequence: Synthetic oligonucleotide
  Target: SCN9A; (+) strand; PAM type: NRG; PAM sequence: TGG
gatgtttaaatactctcttc

SEQ ID NO: 44409 - DNA, 20 bp, Artificial Sequence
  Description of Artificial Sequence: Synthetic oligonucleotide
  Target: SCN9A; (+) strand; PAM type: NRG; PAM sequence: TAG
ttaaatactctcttctggtg

SEQ ID NO: 44410 - DNA, 20 bp, Artificial Sequence
  Description of Artificial Sequence: Synthetic oligonucleotide
  Target: SCN9A; (+) strand; PAM type: NRG; PAM sequence: CAG
tcttctctcttgcaatcatt

SEQ ID NO: 44411 - DNA, 20 bp, Artificial Sequence
  Description of Artificial Sequence: Synthetic oligonucleotide
  Target: SCN9A; (+) strand; PAM type: NRG; PAM sequence: AGG
cttctctcttgcaatcattc

SEQ ID NO: 44412 - DNA, 20 bp, Artificial Sequence
  Description of Artificial Sequence: Synthetic oligonucleotide
  Target: SCN9A; (+) strand; PAM type: NRG; PAM sequence: GGG
ttctctcttgcaatcattca

SEQ ID NO: 44413 - DNA, 20 bp, Artificial Sequence
  Description of Artificial Sequence: Synthetic oligonucleotide
  Target: SCN9A; (+) strand; PAM type: NRG; PAM sequence: TGG
ggcctttatttttttccttc

SEQ ID NO: 44414 - DNA, 20 bp, Artificial Sequence
  Description of Artificial Sequence: Synthetic oligonucleotide
  Target: SCN9A; (+) strand; PAM type: NRG; PAM sequence: GAG
cctttatttttttccttctg

SEQ ID NO: 44415 - DNA, 20 bp, Artificial Sequence
  Description of Artificial Sequence: Synthetic oligonucleotide
  Target: SCN9A; (+) strand; PAM type: NRG; PAM sequence: TAG
atgtgaacattatcctctta

SEQ ID NO: 44416 - DNA, 20 bp, Artificial Sequence
  Description of Artificial Sequence: Synthetic oligonucleotide
  Target: SCN9A; (+) strand; PAM type: NRG; PAM sequence: GAG
gtgaacattatcctcttata

SEQ ID NO: 44417 - DNA, 20 bp, Artificial Sequence
  Description of Artificial Sequence: Synthetic oligonucleotide
  Target: SCN9A; (+) strand; PAM type: NRG; PAM sequence: TGG
tcttatagagtttttaaaat

SEQ ID NO: 44418 - DNA, 20 bp, Artificial Sequence
  Description of Artificial Sequence: Synthetic oligonucleotide
  Target: SCN9A; (+) strand; PAM type: NRG; PAM sequence: GAG
ttatagagtttttaaaattg

SEQ ID NO: 44419 - DNA, 20 bp, Artificial Sequence
  Description of Artificial Sequence: Synthetic oligonucleotide
  Target: SCN9A; (+) strand; PAM type: NRG; PAM sequence: AGG
tatagagtttttaaaattgg

SEQ ID NO: 44420 - DNA, 20 bp, Artificial Sequence
  Description of Artificial Sequence: Synthetic oligonucleotide
  Target: SCN9A; (+) strand; PAM type: NRG; PAM sequence: TAG
aatattattgatattactat

SEQ ID NO: 44421 - DNA, 20 bp, Artificial Sequence
  Description of Artificial Sequence: Synthetic oligonucleotide
  Target: SCN9A; (+) strand; PAM type: NRG; PAM sequence: GAG
ctattagtgcttttcatctt

SEQ ID NO: 44422 - DNA, 20 bp, Artificial Sequence
  Description of Artificial Sequence: Synthetic oligonucleotide
  Target: SCN9A; (+) strand; PAM type: NRG; PAM sequence: TAG
tcacatttcttaacatgatt

SEQ ID NO: 44423 - DNA, 20 bp, Artificial Sequence
  Description of Artificial Sequence: Synthetic oligonucleotide
  Target: SCN9A; (+) strand; PAM type: NRG; PAM sequence: TGG
cttaacatgatttagatttc

SEQ ID NO: 44424 - DNA, 20 bp, Artificial Sequence
  Description of Artificial Sequence: Synthetic oligonucleotide
  Target: SCN9A; (+) strand; PAM type: NRG; PAM sequence: GGG
ttaacatgatttagatttct

SEQ ID NO: 44425 - DNA, 20 bp, Artificial Sequence
  Description of Artificial Sequence: Synthetic oligonucleotide
  Target: SCN9A; (+) strand; PAM type: NRG; PAM sequence: GAG
tttagatttctgggcccctt

SEQ ID NO: 44426 - DNA, 20 bp, Artificial Sequence
  Description of Artificial Sequence: Synthetic oligonucleotide
  Target: SCN9A; (+) strand; PAM type: NRG; PAM sequence: AGG
ttagatttctgggccccttg

SEQ ID NO: 44427 - DNA, 20 bp, Artificial Sequence
  Description of Artificial Sequence: Synthetic oligonucleotide
  Target: SCN9A; (+) strand; PAM type: NRG; PAM sequence: AAG
tttttgatatgaaatttctc

SEQ ID NO: 44428 - DNA, 20 bp, Artificial Sequence
  Description of Artificial Sequence: Synthetic oligonucleotide
  Target: SCN9A; (+) strand; PAM type: NRG; PAM sequence: AAG
tttctcaagattctttttaa

SEQ ID NO: 44429 - DNA, 20 bp, Artificial Sequence
  Description of Artificial Sequence: Synthetic oligonucleotide
  Target: SCN9A; (+) strand; PAM type: NRG; PAM sequence: AGG
ttctcaagattctttttaaa

SEQ ID NO: 44430 - DNA, 20 bp, Artificial Sequence
  Description of Artificial Sequence: Synthetic oligonucleotide
  Target: SCN9A; (+) strand; PAM type: NRG; PAM sequence: AAG
tttttaaaaggtaatgcctc

SEQ ID NO: 44431 - DNA, 20 bp, Artificial Sequence
  Description of Artificial Sequence: Synthetic oligonucleotide
  Target: SCN9A; (+) strand; PAM type: NRG; PAM sequence: AAG
ctcaagttaaaaaatcactg

SEQ ID NO: 44432 - DNA, 20 bp, Artificial Sequence
  Description of Artificial Sequence: Synthetic oligonucleotide
  Target: SCN9A; (+) strand; PAM type: NRG; PAM sequence: CAG
gttaaaaaatcactgaagct

SEQ ID NO: 44433 - DNA, 20 bp, Artificial Sequence
  Description of Artificial Sequence: Synthetic oligonucleotide
  Target: SCN9A; (+) strand; PAM type: NRG; PAM sequence: AGG
ttaaaaaatcactgaagctc

SEQ ID NO: 44434 - DNA, 20 bp, Artificial Sequence
  Description of Artificial Sequence: Synthetic oligonucleotide
  Target: SCN9A; (+) strand; PAM type: NRG; PAM sequence: CAG
tcactgaagctcaggaattt

SEQ ID NO: 44435 - DNA, 20 bp, Artificial Sequence
  Description of Artificial Sequence: Synthetic oligonucleotide
  Target: SCN9A; (+) strand; PAM type: NRG; PAM sequence: AGG
cactgaagctcaggaatttc

SEQ ID NO: 44436 - DNA, 20 bp, Artificial Sequence
  Description of Artificial Sequence: Synthetic oligonucleotide
  Target: SCN9A; (+) strand; PAM type: NRG; PAM sequence: TGG
caggaatttcaggaaaaaaa

SEQ ID NO: 44437 - DNA, 20 bp, Artificial Sequence
  Description of Artificial Sequence: Synthetic oligonucleotide
  Target: SCN9A; (+) strand; PAM type: NRG; PAM sequence: CAG
gaaataattaaaaaatactc

SEQ ID NO: 44438 - DNA, 20 bp, Artificial Sequence
  Description of Artificial Sequence: Synthetic oligonucleotide
  Target: SCN9A; (+) strand; PAM type: NRG; PAM sequence: CAG
atactccagatattattgat

SEQ ID NO: 44439 - DNA, 20 bp, Artificial Sequence
  Description of Artificial Sequence: Synthetic oligonucleotide
  Target: SCN9A; (+) strand; PAM type: NRG; PAM sequence: TGG
ctccagatattattgatcag

SEQ ID NO: 44440 - DNA, 20 bp, Artificial Sequence
  Description of Artificial Sequence: Synthetic oligonucleotide
  Target: SCN9A; (+) strand; PAM type: NRG; PAM sequence: AAG
tgtattttcttctgttgtct

SEQ ID NO: 44441 - DNA, 20 bp, Artificial Sequence
  Description of Artificial Sequence: Synthetic oligonucleotide
  Target: SCN9A; (+) strand; PAM type: NRG; PAM sequence: TAG
taatgttacttccactaatt

SEQ ID NO: 44442 - DNA, 20 bp, Artificial Sequence
  Description of Artificial Sequence: Synthetic oligonucleotide
  Target: SCN9A; (+) strand; PAM type: NRG; PAM sequence: CAG
tgttacttccactaatttag

SEQ ID NO: 44443 - DNA, 20 bp, Artificial Sequence
  Description of Artificial Sequence: Synthetic oligonucleotide
  Target: SCN9A; (+) strand; PAM type: NRG; PAM sequence: CAG
ctaatttagcagaaaattgt

SEQ ID NO: 44444 - DNA, 20 bp, Artificial Sequence
  Description of Artificial Sequence: Synthetic oligonucleotide
  Target: SCN9A; (+) strand; PAM type: NRG; PAM sequence: TAG
aaaattgtcagtttattaac

SEQ ID NO: 44445 - DNA, 20 bp, Artificial Sequence
  Description of Artificial Sequence: Synthetic oligonucleotide
  Target: SCN9A; (+) strand; PAM type: NRG; PAM sequence: TGG
taactagttgcaataaattc

SEQ ID NO: 44446 - DNA, 20 bp, Artificial Sequence
  Description of Artificial Sequence: Synthetic oligonucleotide
  Target: SCN9A; (+) strand; PAM type: NRG; PAM sequence: GGG
aactagttgcaataaattct

SEQ ID NO: 44447 - DNA, 20 bp, Artificial Sequence
  Description of Artificial Sequence: Synthetic oligonucleotide
  Target: SCN9A; (+) strand; PAM type: NRG; PAM sequence: TGG
ctgggctcacattctaatta

SEQ ID NO: 44448 - DNA, 20 bp, Artificial Sequence
  Description of Artificial Sequence: Synthetic oligonucleotide
  Target: SCN9A; (+) strand; PAM type: NRG; PAM sequence: GGG
tgggctcacattctaattat

SEQ ID NO: 44449 - DNA, 20 bp, Artificial Sequence
  Description of Artificial Sequence: Synthetic oligonucleotide
  Target: SCN9A; (+) strand; PAM type: NRG; PAM sequence: TAG
attatgggcaactaaaactt

SEQ ID NO: 44450 - DNA, 20 bp, Artificial Sequence
  Description of Artificial Sequence: Synthetic oligonucleotide
  Target: SCN9A; (+) strand; PAM type: NRG; PAM sequence: AAG
tttagctctttttttaaaaa

SEQ ID NO: 44451 - DNA, 20 bp, Artificial Sequence
  Description of Artificial Sequence: Synthetic oligonucleotide
  Target: SCN9A; (+) strand; PAM type: NRG; PAM sequence: AGG
ttagctctttttttaaaaaa

SEQ ID NO: 44452 - DNA, 20 bp, Artificial Sequence
  Description of Artificial Sequence: Synthetic oligonucleotide
  Target: SCN9A; (+) strand; PAM type: NRG; PAM sequence: GGG
tagctctttttttaaaaaaa

SEQ ID NO: 44453 - DNA, 20 bp, Artificial Sequence
  Description of Artificial Sequence: Synthetic oligonucleotide
  Target: SCN9A; (+) strand; PAM type: NRG; PAM sequence: AAG
tctttttttaaaaaaagggc

SEQ ID NO: 44454 - DNA, 20 bp, Artificial Sequence
  Description of Artificial Sequence: Synthetic oligonucleotide
  Target: SCN9A; (+) strand; PAM type: NRG; PAM sequence: TAG
tatttttctttgtctattgc

SEQ ID NO: 44455 - DNA, 20 bp, Artificial Sequence
  Description of Artificial Sequence: Synthetic oligonucleotide
  Target: SCN9A; (+) strand; PAM type: NRG; PAM sequence: CAG
ttttctttgtctattgctag

SEQ ID NO: 44456 - DNA, 20 bp, Artificial Sequence
  Description of Artificial Sequence: Synthetic oligonucleotide
  Target: SCN9A; (+) strand; PAM type: NRG; PAM sequence: GAG
ttctttgtctattgctagca

SEQ ID NO: 44457 - DNA, 20 bp, Artificial Sequence
  Description of Artificial Sequence: Synthetic oligonucleotide
  Target: SCN9A; (+) strand; PAM type: NRG; PAM sequence: TAG
gctagcagagaaatattgtg

SEQ ID NO: 44458 - DNA, 20 bp, Artificial Sequence
  Description of Artificial Sequence: Synthetic oligonucleotide
  Target: SCN9A; (+) strand; PAM type: NRG; PAM sequence: AGG
ctagcagagaaatattgtgt

SEQ ID NO: 44459 - DNA, 20 bp, Artificial Sequence
  Description of Artificial Sequence: Synthetic oligonucleotide
  Target: SCN9A; (+) strand; PAM type: NRG; PAM sequence: TGG
gagaaatattgtgtaggctc

SEQ ID NO: 44460 - DNA, 20 bp, Artificial Sequence
  Description of Artificial Sequence: Synthetic oligonucleotide
  Target: SCN9A; (+) strand; PAM type: NRG; PAM sequence: GGG
agaaatattgtgtaggctct

SEQ ID NO: 44461 - DNA, 20 bp, Artificial Sequence
  Description of Artificial Sequence: Synthetic oligonucleotide
  Target: SCN9A; (+) strand; PAM type: NRG; PAM sequence: GAG
aaatattgtgtaggctctgg

SEQ ID NO: 44462 - DNA, 20 bp, Artificial Sequence
  Description of Artificial Sequence: Synthetic oligonucleotide
  Target: SCN9A; (+) strand; PAM type: NRG; PAM sequence: AGG
aatattgtgtaggctctggg

SEQ ID NO: 44463 - DNA, 20 bp, Artificial Sequence
  Description of Artificial Sequence: Synthetic oligonucleotide
  Target: SCN9A; (+) strand; PAM type: NRG; PAM sequence: TAG
tgtgtaggctctgggaggaa

SEQ ID NO: 44464 - DNA, 20 bp, Artificial Sequence
  Description of Artificial Sequence: Synthetic oligonucleotide
  Target: SCN9A; (+) strand; PAM type: NRG; PAM sequence: CAG
gggaggaatagctacttatt

SEQ ID NO: 44465 - DNA, 20 bp, Artificial Sequence
  Description of Artificial Sequence: Synthetic oligonucleotide
  Target: SCN9A; (+) strand; PAM type: NRG; PAM sequence: CAG
cttattcagcgtgaaacaca

SEQ ID NO: 44466 - DNA, 20 bp, Artificial Sequence
  Description of Artificial Sequence: Synthetic oligonucleotide
  Target: SCN9A; (+) strand; PAM type: NRG; PAM sequence: AAG
gaaacacacagttccatcac

SEQ ID NO: 44467 - DNA, 20 bp, Artificial Sequence
  Description of Artificial Sequence: Synthetic oligonucleotide
  Target: SCN9A; (+) strand; PAM type: NRG; PAM sequence: AGG
aaacacacagttccatcaca

SEQ ID NO: 44468 - DNA, 20 bp, Artificial Sequence
  Description of Artificial Sequence: Synthetic oligonucleotide
  Target: SCN9A; (+) strand; PAM type: NRG; PAM sequence: TAG
cacaaggtcaacatgatata

SEQ ID NO: 44469 - DNA, 20 bp, Artificial Sequence
  Description of Artificial Sequence: Synthetic oligonucleotide
  Target: SCN9A; (+) strand; PAM type: NRG; PAM sequence: TGG
catgatatatagtattctgt

SEQ ID NO: 44470 - DNA, 20 bp, Artificial Sequence
  Description of Artificial Sequence: Synthetic oligonucleotide
  Target: SCN9A; (+) strand; PAM type: NRG; PAM sequence: GAG
tattctgttggtgaaataat

SEQ ID NO: 44471 - DNA, 20 bp, Artificial Sequence
  Description of Artificial Sequence: Synthetic oligonucleotide
  Target: SCN9A; (+) strand; PAM type: NRG; PAM sequence: AGG
attctgttggtgaaataatg

SEQ ID NO: 44472 - DNA, 20 bp, Artificial Sequence
  Description of Artificial Sequence: Synthetic oligonucleotide
  Target: SCN9A; (+) strand; PAM type: NRG; PAM sequence: CAG
gaaataatgaggtcaaatct

SEQ ID NO: 44473 - DNA, 20 bp, Artificial Sequence
  Description of Artificial Sequence: Synthetic oligonucleotide
  Target: SCN9A; (+) strand; PAM type: NRG; PAM sequence: CAG
ggtcaaatctcagccaccac

SEQ ID NO: 44474 - DNA, 20 bp, Artificial Sequence
  Description of Artificial Sequence: Synthetic oligonucleotide
  Target: SCN9A; (+) strand; PAM type: NRG; PAM sequence: GAG
tcaaatctcagccaccacca

SEQ ID NO: 44475 - DNA, 20 bp, Artificial Sequence
  Description of Artificial Sequence: Synthetic oligonucleotide
  Target: SCN9A; (+) strand; PAM type: NRG; PAM sequence: CAG
cagccaccaccagagaaatt

SEQ ID NO: 44476 - DNA, 20 bp, Artificial Sequence
  Description of Artificial Sequence: Synthetic oligonucleotide
  Target: SCN9A; (+) strand; PAM type: NRG; PAM sequence: CAG
agagaaattcagaataaaac

SEQ ID NO: 44477 - DNA, 20 bp, Artificial Sequence
  Description of Artificial Sequence: Synthetic oligonucleotide
  Target: SCN9A; (+) strand; PAM type: NRG; PAM sequence: CGG
gaataaaaccagtgatttca

SEQ ID NO: 44478 - DNA, 20 bp, Artificial Sequence
  Description of Artificial Sequence: Synthetic oligonucleotide
  Target: SCN9A; (+) strand; PAM type: NRG; PAM sequence: GAG
ataaaaccagtgatttcacg

SEQ ID NO: 44479 - DNA, 20 bp, Artificial Sequence
  Description of Artificial Sequence: Synthetic oligonucleotide
  Target: SCN9A; (+) strand; PAM type: NRG; PAM sequence: CAG
cggagacctcttctttttct

SEQ ID NO: 44480 - DNA, 20 bp, Artificial Sequence
  Description of Artificial Sequence: Synthetic oligonucleotide
  Target: SCN9A; (+) strand; PAM type: NRG; PAM sequence: TAG
ttttctcagaatcttctacc

SEQ ID NO: 44481 - DNA, 20 bp, Artificial Sequence
  Description of Artificial Sequence: Synthetic oligonucleotide
  Target: SCN9A; (+) strand; PAM type: NRG; PAM sequence: AGG
tttctcagaatcttctacct

SEQ ID NO: 44482 - DNA, 20 bp, Artificial Sequence
  Description of Artificial Sequence: Synthetic oligonucleotide
  Target: SCN9A; (+) strand; PAM type: NRG; PAM sequence: GGG
ttctcagaatcttctaccta

SEQ ID NO: 44483 - DNA, 20 bp, Artificial Sequence
  Description of Artificial Sequence: Synthetic oligonucleotide
  Target: SCN9A; (+) strand; PAM type: NRG; PAM sequence: AAG
aacttacgtgactaaatgat

SEQ ID NO: 44484 - DNA, 20 bp, Artificial Sequence
  Description of Artificial Sequence: Synthetic oligonucleotide
  Target: SCN9A; (+) strand; PAM type: NRG; PAM sequence: AAG
aatgataagatatgaatata

SEQ ID NO: 44485 - DNA, 20 bp, Artificial Sequence
  Description of Artificial Sequence: Synthetic oligonucleotide
  Target: SCN9A; (+) strand; PAM type: NRG; PAM sequence: AAG
aatataaagaaatcatataa

SEQ ID NO: 44486 - DNA, 20 bp, Artificial Sequence
  Description of Artificial Sequence: Synthetic oligonucleotide
  Target: SCN9A; (+) strand; PAM type: NRG; PAM sequence: CAG
aaatcatataaaagcaacaa

SEQ ID NO: 44487 - DNA, 20 bp, Artificial Sequence
  Description of Artificial Sequence: Synthetic oligonucleotide
  Target: SCN9A; (+) strand; PAM type: NRG; PAM sequence: TGG
catataaaagcaacaacagt

SEQ ID NO: 44488 - DNA, 20 bp, Artificial Sequence
  Description of Artificial Sequence: Synthetic oligonucleotide
  Target: SCN9A; (+) strand; PAM type: NRG; PAM sequence: AAG
gcaacaacagttggccatgt

SEQ ID NO: 44489 - DNA, 20 bp, Artificial Sequence
  Description of Artificial Sequence: Synthetic oligonucleotide
  Target: SCN9A; (+) strand; PAM type: NRG; PAM sequence: AAG
acaacagttggccatgtaag

SEQ ID NO: 44490 - DNA, 20 bp, Artificial Sequence
  Description of Artificial Sequence: Synthetic oligonucleotide
  Target: SCN9A; (+) strand; PAM type: NRG; PAM sequence: AGG
caacagttggccatgtaaga

SEQ ID NO: 44491 - DNA, 20 bp, Artificial Sequence
  Description of Artificial Sequence: Synthetic oligonucleotide
  Target: SCN9A; (+) strand; PAM type: NRG; PAM sequence: TAG
agttggccatgtaagaaggc

SEQ ID NO: 44492 - DNA, 20 bp, Artificial Sequence
  Description of Artificial Sequence: Synthetic oligonucleotide
  Target: SCN9A; (+) strand; PAM type: NRG; PAM sequence: TGG
gccatgtaagaaggctagac

SEQ ID NO: 44493 - DNA, 20 bp, Artificial Sequence
  Description of Artificial Sequence: Synthetic oligonucleotide
  Target: SCN9A; (+) strand; PAM type: NRG; PAM sequence: CAG
taagaaggctagactggcta

SEQ ID NO: 44494 - DNA, 20 bp, Artificial Sequence
  Description of Artificial Sequence: Synthetic oligonucleotide
  Target: SCN9A; (+) strand; PAM type: NRG; PAM sequence: CAG
tagactggctacagatttct

SEQ ID NO: 44495 - DNA, 20 bp, Artificial Sequence
  Description of Artificial Sequence: Synthetic oligonucleotide
  Target: SCN9A; (+) strand; PAM type: NRG; PAM sequence: CAG
ctggctacagatttctcagc

SEQ ID NO: 44496 - DNA, 20 bp, Artificial Sequence
  Description of Artificial Sequence: Synthetic oligonucleotide
  Target: SCN9A; (+) strand; PAM type: NRG; PAM sequence: AGG
tggctacagatttctcagcc

SEQ ID NO: 44497 - DNA, 20 bp, Artificial Sequence
  Description of Artificial Sequence: Synthetic oligonucleotide
  Target: SCN9A; (+) strand; PAM type: NRG; PAM sequence: TAG
gatttctcagccaggtccta

SEQ ID NO: 44498 - DNA, 20 bp, Artificial Sequence
  Description of Artificial Sequence: Synthetic oligonucleotide
  Target: SCN9A; (+) strand; PAM type: NRG; PAM sequence: AAG
ggtcctatagtatcatcttg

SEQ ID NO: 44499 - DNA, 20 bp, Artificial Sequence
  Description of Artificial Sequence: Synthetic oligonucleotide
  Target: SCN9A; (+) strand; PAM type: NRG; PAM sequence: AAG
tgaagcatctttctaatgaa

SEQ ID NO: 44500 - DNA, 20 bp, Artificial Sequence
  Description of Artificial Sequence: Synthetic oligonucleotide
  Target: SCN9A; (+) strand; PAM type: NRG; PAM sequence: AAG
agcatctttctaatgaaaag

SEQ ID NO: 44501 - DNA, 20 bp, Artificial Sequence
  Description of Artificial Sequence: Synthetic oligonucleotide
  Target: SCN9A; (+) strand; PAM type: NRG; PAM sequence: GAG
catctttctaatgaaaagaa

SEQ ID NO: 44502 - DNA, 20 bp, Artificial Sequence
  Description of Artificial Sequence: Synthetic oligonucleotide
  Target: SCN9A; (+) strand; PAM type: NRG; PAM sequence: AAG
ctttctaatgaaaagaagag

SEQ ID NO: 44503 - DNA, 20 bp, Artificial Sequence
  Description of Artificial Sequence: Synthetic oligonucleotide
  Target: SCN9A; (+) strand; PAM type: NRG; PAM sequence: AAG
taatgaaaagaagagaagca

SEQ ID NO: 44504 - DNA, 20 bp, Artificial Sequence
  Description of Artificial Sequence: Synthetic oligonucleotide
  Target: SCN9A; (+) strand; PAM type: NRG; PAM sequence: GAG
atgaaaagaagagaagcaaa

SEQ ID NO: 44505 - DNA, 20 bp, Artificial Sequence
  Description of Artificial Sequence: Synthetic oligonucleotide
  Target: SCN9A; (+) strand; PAM type: NRG; PAM sequence: TAG
aaagaagagaagcaaagagc

SEQ ID NO: 44506 - DNA, 20 bp, Artificial Sequence
  Description of Artificial Sequence: Synthetic oligonucleotide
  Target: SCN9A; (+) strand; PAM type: NRG; PAM sequence: AGG
aagaagagaagcaaagagct

SEQ ID NO: 44507 - DNA, 20 bp, Artificial Sequence
  Description of Artificial Sequence: Synthetic oligonucleotide
  Target: SCN9A; (+) strand; PAM type: NRG; PAM sequence: GAG
gaagagaagcaaagagctag

SEQ ID NO: 44508 - DNA, 20 bp, Artificial Sequence
  Description of Artificial Sequence: Synthetic oligonucleotide
  Target: SCN9A; (+) strand; PAM type: NRG; PAM sequence: AAG
agcaaagagctaggagtgta

SEQ ID NO: 44509 - DNA, 20 bp, Artificial Sequence
  Description of Artificial Sequence: Synthetic oligonucleotide
  Target: SCN9A; (+) strand; PAM type: NRG; PAM sequence: TGG
aaagagctaggagtgtaaag

SEQ ID NO: 44510 - DNA, 20 bp, Artificial Sequence
  Description of Artificial Sequence: Synthetic oligonucleotide
  Target: SCN9A; (+) strand; PAM type: NRG; PAM sequence: AAG
taaagtggccattgatattc

SEQ ID NO: 44511 - DNA, 20 bp, Artificial Sequence
  Description of Artificial Sequence: Synthetic oligonucleotide
  Target: SCN9A; (+) strand; PAM type: NRG; PAM sequence: AGG
aaagtggccattgatattca

SEQ ID NO: 44512 - DNA, 20 bp, Artificial Sequence
  Description of Artificial Sequence: Synthetic oligonucleotide
  Target: SCN9A; (+) strand; PAM type: NRG; PAM sequence: GGG
aagtggccattgatattcaa

SEQ ID NO: 44513 - DNA, 20 bp, Artificial Sequence
  Description of Artificial Sequence: Synthetic oligonucleotide
  Target: SCN9A; (+) strand; PAM type: NRG; PAM sequence: CAG
gctctctctgtgctctgtca

SEQ ID NO: 44514 - DNA, 20 bp, Artificial Sequence
  Description of Artificial Sequence: Synthetic oligonucleotide
  Target: SCN9A; (+) strand; PAM type: NRG; PAM sequence: CAG
cagaactgctacactgtttg

SEQ ID NO: 44515 - DNA, 20 bp, Artificial Sequence
  Description of Artificial Sequence: Synthetic oligonucleotide
  Target: SCN9A; (+) strand; PAM type: NRG; PAM sequence: GAG
gaactgctacactgtttgca

SEQ ID NO: 44516 - DNA, 20 bp, Artificial Sequence
  Description of Artificial Sequence: Synthetic oligonucleotide
  Target: SCN9A; (+) strand; PAM type: NRG; PAM sequence: AAG
tgctacactgtttgcagaga

SEQ ID NO: 44517 - DNA, 20 bp, Artificial Sequence
  Description of Artificial Sequence: Synthetic oligonucleotide
  Target: SCN9A; (+) strand; PAM type: NRG; PAM sequence: CAG
tacactgtttgcagagaaag

SEQ ID NO: 44518 - DNA, 20 bp, Artificial Sequence
  Description of Artificial Sequence: Synthetic oligonucleotide
  Target: SCN9A; (+) strand; PAM type: NRG; PAM sequence: TGG
ctgtttgcagagaaagcagc

SEQ ID NO: 44519 - DNA, 20 bp, Artificial Sequence
  Description of Artificial Sequence: Synthetic oligonucleotide
  Target: SCN9A; (+) strand; PAM type: NRG; PAM sequence: CAG
cagagaaagcagctggaata

SEQ ID NO: 44520 - DNA, 20 bp, Artificial Sequence
  Description of Artificial Sequence: Synthetic oligonucleotide
  Target: SCN9A; (+) strand; PAM type: NRG; PAM sequence: TGG
agaaagcagctggaatacag

SEQ ID NO: 44521 - DNA, 20 bp, Artificial Sequence
  Description of Artificial Sequence: Synthetic oligonucleotide
  Target: SCN9A; (+) strand; PAM type: NRG; PAM sequence: GGG
gaaagcagctggaatacagt

SEQ ID NO: 44522 - DNA, 20 bp, Artificial Sequence
  Description of Artificial Sequence: Synthetic oligonucleotide
  Target: SCN9A; (+) strand; PAM type: NRG; PAM sequence: AAG
cagctggaatacagtgggtc

SEQ ID NO: 44523 - DNA, 20 bp, Artificial Sequence
  Description of Artificial Sequence: Synthetic oligonucleotide
  Target: SCN9A; (+) strand; PAM type: NRG; PAM sequence: CAG
tggaatacagtgggtcaagt

SEQ ID NO: 44524 - DNA, 20 bp, Artificial Sequence
  Description of Artificial Sequence: Synthetic oligonucleotide
  Target: SCN9A; (+) strand; PAM type: NRG; PAM sequence: GAG
gaatacagtgggtcaagtca

SEQ ID NO: 44525 - DNA, 20 bp, Artificial Sequence
  Description of Artificial Sequence: Synthetic oligonucleotide
  Target: SCN9A; (+) strand; PAM type: NRG; PAM sequence: AAG
ggtcaagtcagagtgtctta

SEQ ID NO: 44526 - DNA, 20 bp, Artificial Sequence
  Description of Artificial Sequence: Synthetic oligonucleotide
  Target: SCN9A; (+) strand; PAM type: NRG; PAM sequence: TAG
tcagagtgtcttaaagtctt

SEQ ID NO: 44527 - DNA, 20 bp, Artificial Sequence
  Description of Artificial Sequence: Synthetic oligonucleotide
  Target: SCN9A; (+) strand; PAM type: NRG; PAM sequence: AAG
gagtgtcttaaagtctttag

SEQ ID NO: 44528 - DNA, 20 bp, Artificial Sequence
  Description of Artificial Sequence: Synthetic oligonucleotide
  Target: SCN9A; (+) strand; PAM type: NRG; PAM sequence: CAG
aacaattttgctatttatgc

SEQ ID NO: 44529 - DNA, 20 bp, Artificial Sequence
  Description of Artificial Sequence: Synthetic oligonucleotide
  Target: SCN9A; (+) strand; PAM type: NRG; PAM sequence: AAG
ccagcttaaaaaaatgcaac

SEQ ID NO: 44530 - DNA, 20 bp, Artificial Sequence
  Description of Artificial Sequence: Synthetic oligonucleotide
  Target: SCN9A; (+) strand; PAM type: NRG; PAM sequence: TAG
gcttaaaaaaatgcaacaag

SEQ ID NO: 44531 - DNA, 20 bp, Artificial Sequence
  Description of Artificial Sequence: Synthetic oligonucleotide
  Target: SCN9A; (+) strand; PAM type: NRG; PAM sequence: AGG
cttaaaaaaatgcaacaagt

SEQ ID NO: 44532 - DNA, 20 bp, Artificial Sequence
  Description of Artificial Sequence: Synthetic oligonucleotide
  Target: SCN9A; (+) strand; PAM type: NRG; PAM sequence: AAG
aaaaatgcaacaagtaggta

SEQ ID NO: 44533 - DNA, 20 bp, Artificial Sequence
  Description of Artificial Sequence: Synthetic oligonucleotide
  Target: SCN9A; (+) strand; PAM type: NRG; PAM sequence: AAG
aatgcaacaagtaggtaaag

SEQ ID NO: 44534 - DNA, 20 bp, Artificial Sequence
  Description of Artificial Sequence: Synthetic oligonucleotide
  Target: SCN9A; (+) strand; PAM type: NRG; PAM sequence: AGG
atgcaacaagtaggtaaaga

SEQ ID NO: 44535 - DNA, 20 bp, Artificial Sequence
  Description of Artificial Sequence: Synthetic oligonucleotide
  Target: SCN9A; (+) strand; PAM type: NRG; PAM sequence: TGG
acaagtaggtaaagaaggat

SEQ ID NO: 44536 - DNA, 20 bp, Artificial Sequence
  Description of Artificial Sequence: Synthetic oligonucleotide
  Target: SCN9A; (+) strand; PAM type: NRG; PAM sequence: TAG
gtaaagaaggattggaacct

SEQ ID NO: 44537 - DNA, 20 bp, Artificial Sequence
  Description of Artificial Sequence: Synthetic oligonucleotide
  Target: SCN9A; (+) strand; PAM type: NRG; PAM sequence: AAG
ttggaaccttagcaaacata

SEQ ID NO: 44538 - DNA, 20 bp, Artificial Sequence
  Description of Artificial Sequence: Synthetic oligonucleotide
  Target: SCN9A; (+) strand; PAM type: NRG; PAM sequence: AGG
tggaaccttagcaaacataa

SEQ ID NO: 44539 - DNA, 20 bp, Artificial Sequence
  Description of Artificial Sequence: Synthetic oligonucleotide
  Target: SCN9A; (+) strand; PAM type: NRG; PAM sequence: AAG
ccttagcaaacataaaggca

SEQ ID NO: 44540 - DNA, 20 bp, Artificial Sequence
  Description of Artificial Sequence: Synthetic oligonucleotide
  Target: SCN9A; (+) strand; PAM type: NRG; PAM sequence: TAG
gcaaacataaaggcaaagtg

SEQ ID NO: 44541 - DNA, 20 bp, Artificial Sequence
  Description of Artificial Sequence: Synthetic oligonucleotide
  Target: SCN9A; (+) strand; PAM type: NRG; PAM sequence: CAG
aaaggcaaagtgtagatacg

SEQ ID NO: 44542 - DNA, 20 bp, Artificial Sequence
  Description of Artificial Sequence: Synthetic oligonucleotide
  Target: SCN9A; (+) strand; PAM type: NRG; PAM sequence: AAG
aagtgtagatacgcagactc

SEQ ID NO: 44543 - DNA, 20 bp, Artificial Sequence
  Description of Artificial Sequence: Synthetic oligonucleotide
  Target: SCN9A; (+) strand; PAM type: NRG; PAM sequence: AAG
tctataattttgaaacaaac

SEQ ID NO: 44544 - DNA, 20 bp, Artificial Sequence
  Description of Artificial Sequence: Synthetic oligonucleotide
  Target: SCN9A; (+) strand; PAM type: NRG; PAM sequence: AAG
aaacaagaatgacaaacaca

SEQ ID NO: 44545 - DNA, 20 bp, Artificial Sequence
  Description of Artificial Sequence: Synthetic oligonucleotide
  Target: SCN9A; (+) strand; PAM type: NRG; PAM sequence: AAG
aagaatgacaaacacaaagt

SEQ ID NO: 44546 - DNA, 20 bp, Artificial Sequence
  Description of Artificial Sequence: Synthetic oligonucleotide
  Target: SCN9A; (+) strand; PAM type: NRG; PAM sequence: TAG
caaacacaaagtaagctacc

SEQ ID NO: 44547 - DNA, 20 bp, Artificial Sequence
  Description of Artificial Sequence: Synthetic oligonucleotide
  Target: SCN9A; (+) strand; PAM type: NRG; PAM sequence: AAG
tactaatactacccacaatg

SEQ ID NO: 44548 - DNA, 20 bp, Artificial Sequence
  Description of Artificial Sequence: Synthetic oligonucleotide
  Target: SCN9A; (+) strand; PAM type: NRG; PAM sequence: AGG
actaatactacccacaatga

SEQ ID NO: 44549 - DNA, 20 bp, Artificial Sequence
  Description of Artificial Sequence: Synthetic oligonucleotide
  Target: SCN9A; (+) strand; PAM type: NRG; PAM sequence: GAG
taatactacccacaatgaag

SEQ ID NO: 44550 - DNA, 20 bp, Artificial Sequence
  Description of Artificial Sequence: Synthetic oligonucleotide
  Target: SCN9A; (+) strand; PAM type: NRG; PAM sequence: AGG
aatactacccacaatgaagg

SEQ ID NO: 44551 - DNA, 20 bp, Artificial Sequence
  Description of Artificial Sequence: Synthetic oligonucleotide
  Target: SCN9A; (+) strand; PAM type: NRG; PAM sequence: GGG
atactacccacaatgaagga

SEQ ID NO: 44552 - DNA, 20 bp, Artificial Sequence
  Description of Artificial Sequence: Synthetic oligonucleotide
  Target: SCN9A; (+) strand; PAM type: NRG; PAM sequence: AAG
tacccacaatgaaggagggc

SEQ ID NO: 44553 - DNA, 20 bp, Artificial Sequence
  Description of Artificial Sequence: Synthetic oligonucleotide
  Target: SCN9A; (+) strand; PAM type: NRG; PAM sequence: AGG
acccacaatgaaggagggca

SEQ ID NO: 44554 - DNA, 20 bp, Artificial Sequence
  Description of Artificial Sequence: Synthetic oligonucleotide
  Target: SCN9A; (+) strand; PAM type: NRG; PAM sequence: AAG
caatgaaggagggcaaggaa

SEQ ID NO: 44555 - DNA, 20 bp, Artificial Sequence
  Description of Artificial Sequence: Synthetic oligonucleotide
  Target: SCN9A; (+) strand; PAM type: NRG; PAM sequence: TGG
gaaaagtgaattttaatgaa

SEQ ID NO: 44556 - DNA, 20 bp, Artificial Sequence
  Description of Artificial Sequence: Synthetic oligonucleotide
  Target: SCN9A; (+) strand; PAM type: NRG; PAM sequence: TAG
ttaatgaatggaataattac

SEQ ID NO: 44557 - DNA, 20 bp, Artificial Sequence
  Description of Artificial Sequence: Synthetic oligonucleotide
  Target: SCN9A; (+) strand; PAM type: NRG; PAM sequence: TGG
ttactagctttttaaacatg

SEQ ID NO: 44558 - DNA, 20 bp, Artificial Sequence
  Description of Artificial Sequence: Synthetic oligonucleotide
  Target: SCN9A; (+) strand; PAM type: NRG; PAM sequence: TAG
tctaatattgaaaatataaa

SEQ ID NO: 44559 - DNA, 20 bp, Artificial Sequence
  Description of Artificial Sequence: Synthetic oligonucleotide
  Target: SCN9A; (+) strand; PAM type: NRG; PAM sequence: TGG
atataaatagaaattttaca

SEQ ID NO: 44560 - DNA, 20 bp, Artificial Sequence
  Description of Artificial Sequence: Synthetic oligonucleotide
  Target: SCN9A; (+) strand; PAM type: NRG; PAM sequence: TAG
aaataactatatcctttatg

SEQ ID NO: 44561 - DNA, 20 bp, Artificial Sequence
  Description of Artificial Sequence: Synthetic oligonucleotide
  Target: SCN9A; (+) strand; PAM type: NRG; PAM sequence: AGG
aataactatatcctttatgt

SEQ ID NO: 44562 - DNA, 20 bp, Artificial Sequence
  Description of Artificial Sequence: Synthetic oligonucleotide
  Target: SCN9A; (+) strand; PAM type: NRG; PAM sequence: CAG
aactatatcctttatgtagg

SEQ ID NO: 44563 - DNA, 20 bp, Artificial Sequence
  Description of Artificial Sequence: Synthetic oligonucleotide
  Target: SCN9A; (+) strand; PAM type: NRG; PAM sequence: AAG
tatgtaggcagcttttgcta

SEQ ID NO: 44564 - DNA, 20 bp, Artificial Sequence
  Description of Artificial Sequence: Synthetic oligonucleotide
  Target: SCN9A; (+) strand; PAM type: NRG; PAM sequence: AAG
ttgctaaagtgccatatttc

SEQ ID NO: 44565 - DNA, 20 bp, Artificial Sequence
  Description of Artificial Sequence: Synthetic oligonucleotide
  Target: SCN9A; (+) strand; PAM type: NRG; PAM sequence: CAG
gtcattcttaactgaatatt

SEQ ID NO: 44566 - DNA, 20 bp, Artificial Sequence
  Description of Artificial Sequence: Synthetic oligonucleotide
  Target: SCN9A; (+) strand; PAM type: NRG; PAM sequence: AAG
gaatattcagtttttttctt

SEQ ID NO: 44567 - DNA, 20 bp, Artificial Sequence
  Description of Artificial Sequence: Synthetic oligonucleotide
  Target: SCN9A; (+) strand; PAM type: NRG; PAM sequence: GAG
atattcagtttttttcttaa

SEQ ID NO: 44568 - DNA, 20 bp, Artificial Sequence
  Description of Artificial Sequence: Synthetic oligonucleotide
  Target: SCN9A; (+) strand; PAM type: NRG; PAM sequence: AGG
tattcagtttttttcttaag

SEQ ID NO: 44569 - DNA, 20 bp, Artificial Sequence
  Description of Artificial Sequence: Synthetic oligonucleotide
  Target: SCN9A; (+) strand; PAM type: NRG; PAM sequence: CAG
atgtacctcatcttttctaa

SEQ ID NO: 44570 - DNA, 20 bp, Artificial Sequence
  Description of Artificial Sequence: Synthetic oligonucleotide
  Target: SCN9A; (+) strand; PAM type: NRG; PAM sequence: TGG
cctcatcttttctaacagct

SEQ ID NO: 44571 - DNA, 20 bp, Artificial Sequence
  Description of Artificial Sequence: Synthetic oligonucleotide
  Target: SCN9A; (+) strand; PAM type: NRG; PAM sequence: AAG
tttctaacagcttggtaaaa

SEQ ID NO: 44572 - DNA, 20 bp, Artificial Sequence
  Description of Artificial Sequence: Synthetic oligonucleotide
  Target: SCN9A; (+) strand; PAM type: NRG; PAM sequence: AAG
cagcttggtaaaaaagtaat

SEQ ID NO: 44573 - DNA, 20 bp, Artificial Sequence
  Description of Artificial Sequence: Synthetic oligonucleotide
  Target: SCN9A; (+) strand; PAM type: NRG; PAM sequence: TAG
tatgcatgtatatatatttc

SEQ ID NO: 44574 - DNA, 20 bp, Artificial Sequence
  Description of Artificial Sequence: Synthetic oligonucleotide
  Target: SCN9A; (+) strand; PAM type: NRG; PAM sequence: TAG
tgtatatatatttctagaaa

SEQ ID NO: 44575 - DNA, 20 bp, Artificial Sequence
  Description of Artificial Sequence: Synthetic oligonucleotide
  Target: SCN9A; (+) strand; PAM type: NRG; PAM sequence: TAG
atgttttatctatacctata

SEQ ID NO: 44576 - DNA, 20 bp, Artificial Sequence
  Description of Artificial Sequence: Synthetic oligonucleotide
  Target: SCN9A; (+) strand; PAM type: NRG; PAM sequence: TGG
tatacctatatagataatat

SEQ ID NO: 44577 - DNA, 20 bp, Artificial Sequence
  Description of Artificial Sequence: Synthetic oligonucleotide
  Target: SCN9A; (+) strand; PAM type: NRG; PAM sequence: GGG
atacctatatagataatatt

SEQ ID NO: 44578 - DNA, 20 bp, Artificial Sequence
  Description of Artificial Sequence: Synthetic oligonucleotide
  Target: SCN9A; (+) strand; PAM type: NRG; PAM sequence: TAG
ggtgtatatgcatccttatt

SEQ ID NO: 44579 - DNA, 20 bp, Artificial Sequence
  Description of Artificial Sequence: Synthetic oligonucleotide
  Target: SCN9A; (+) strand; PAM type: NRG; PAM sequence: AGG
gtgtatatgcatccttattt

SEQ ID NO: 44580 - DNA, 20 bp, Artificial Sequence
  Description of Artificial Sequence: Synthetic oligonucleotide
  Target: SCN9A; (+) strand; PAM type: NRG; PAM sequence: TAG
atgcatccttatttaggctc

SEQ ID NO: 44581 - DNA, 20 bp, Artificial Sequence
  Description of Artificial Sequence: Synthetic oligonucleotide
  Target: SCN9A; (+) strand; PAM type: NRG; PAM sequence: AAG
ccttatttaggctctagttg

SEQ ID NO: 44582 - DNA, 20 bp, Artificial Sequence
  Description of Artificial Sequence: Synthetic oligonucleotide
  Target: SCN9A; (+) strand; PAM type: NRG; PAM sequence: TGG
gaagaaaattcaccatattc

SEQ ID NO: 44583 - DNA, 20 bp, Artificial Sequence
  Description of Artificial Sequence: Synthetic oligonucleotide
  Target: SCN9A; (+) strand; PAM type: NRG; PAM sequence: TAG
caccatattctggaataaaa

SEQ ID NO: 44584 - DNA, 20 bp, Artificial Sequence
  Description of Artificial Sequence: Synthetic oligonucleotide
  Target: SCN9A; (+) strand; PAM type: NRG; PAM sequence: GAG
ggaataaaatagttttctat

SEQ ID NO: 44585 - DNA, 20 bp, Artificial Sequence
  Description of Artificial Sequence: Synthetic oligonucleotide
  Target: SCN9A; (+) strand; PAM type: NRG; PAM sequence: TAG
aatccccaccaaatttgaaa

SEQ ID NO: 44586 - DNA, 20 bp, Artificial Sequence
  Description of Artificial Sequence: Synthetic oligonucleotide
  Target: SCN9A; (+) strand; PAM type: NRG; PAM sequence: TAG
agaaaaatatatcttttact

SEQ ID NO: 44587 - DNA, 20 bp, Artificial Sequence
  Description of Artificial Sequence: Synthetic oligonucleotide
  Target: SCN9A; (+) strand; PAM type: NRG; PAM sequence: AGG
gaaaaatatatcttttactt

SEQ ID NO: 44588 - DNA, 20 bp, Artificial Sequence
  Description of Artificial Sequence: Synthetic oligonucleotide
  Target: SCN9A; (+) strand; PAM type: NRG; PAM sequence: TGG
aaaattatcttcaaataaac

SEQ ID NO: 44589 - DNA, 20 bp, Artificial Sequence
  Description of Artificial Sequence: Synthetic oligonucleotide
  Target: SCN9A; (+) strand; PAM type: NRG; PAM sequence: TAG
aatttttcatttgaaactgt

SEQ ID NO: 44590 - DNA, 20 bp, Artificial Sequence
  Description of Artificial Sequence: Synthetic oligonucleotide
  Target: SCN9A; (+) strand; PAM type: NRG; PAM sequence: AAG
ctgttagcaatattatctct

SEQ ID NO: 44591 - DNA, 20 bp, Artificial Sequence
  Description of Artificial Sequence: Synthetic oligonucleotide
  Target: SCN9A; (+) strand; PAM type: NRG; PAM sequence: AGG
tgttagcaatattatctcta

SEQ ID NO: 44592 - DNA, 20 bp, Artificial Sequence
  Description of Artificial Sequence: Synthetic oligonucleotide
  Target: SCN9A; (+) strand; PAM type: NRG; PAM sequence: CAG
tctctaaggtgtgtcaattt

SEQ ID NO: 44593 - DNA, 20 bp, Artificial Sequence
  Description of Artificial Sequence: Synthetic oligonucleotide
  Target: SCN9A; (+) strand; PAM type: NRG; PAM sequence: AGG
ctctaaggtgtgtcaatttc

SEQ ID NO: 44594 - DNA, 20 bp, Artificial Sequence
  Description of Artificial Sequence: Synthetic oligonucleotide
  Target: SCN9A; (+) strand; PAM type: NRG; PAM sequence: AAG
ggtgtgtcaatttcaggata

SEQ ID NO: 44595 - DNA, 20 bp, Artificial Sequence
  Description of Artificial Sequence: Synthetic oligonucleotide
  Target: SCN9A; (+) strand; PAM type: NRG; PAM sequence: TAG
ttgctttcatcattgcacaa

SEQ ID NO: 44596 - DNA, 20 bp, Artificial Sequence
  Description of Artificial Sequence: Synthetic oligonucleotide
  Target: SCN9A; (+) strand; PAM type: NRG; PAM sequence: CAG
tacaaacatctcaacaatga

SEQ ID NO: 44597 - DNA, 20 bp, Artificial Sequence
  Description of Artificial Sequence: Synthetic oligonucleotide
  Target: SCN9A; (+) strand; PAM type: NRG; PAM sequence: GAG
caaacatctcaacaatgaca

SEQ ID NO: 44598 - DNA, 20 bp, Artificial Sequence
  Description of Artificial Sequence: Synthetic oligonucleotide
  Target: SCN9A; (+) strand; PAM type: NRG; PAM sequence: TAG
gagaaattcaaaatatgaac

SEQ ID NO: 44599 - DNA, 20 bp, Artificial Sequence
  Description of Artificial Sequence: Synthetic oligonucleotide
  Target: SCN9A; (+) strand; PAM type: NRG; PAM sequence: AAG
aatatgaactagattataaa

SEQ ID NO: 44600 - DNA, 20 bp, Artificial Sequence
  Description of Artificial Sequence: Synthetic oligonucleotide
  Target: SCN9A; (+) strand; PAM type: NRG; PAM sequence: AGG
atatgaactagattataaaa

SEQ ID NO: 44601 - DNA, 20 bp, Artificial Sequence
  Description of Artificial Sequence: Synthetic oligonucleotide
  Target: SCN9A; (+) strand; PAM type: NRG; PAM sequence: GAG
atgaactagattataaaaag

SEQ ID NO: 44602 - DNA, 20 bp, Artificial Sequence
  Description of Artificial Sequence: Synthetic oligonucleotide
  Target: SCN9A; (+) strand; PAM type: NRG; PAM sequence: AAG
ctagattataaaaaggagtc

SEQ ID NO: 44603 - DNA, 20 bp, Artificial Sequence
  Description of Artificial Sequence: Synthetic oligonucleotide
  Target: SCN9A; (+) strand; PAM type: NRG; PAM sequence: TGG
aaaggagtcaagattcttat

SEQ ID NO: 44604 - DNA, 20 bp, Artificial Sequence
  Description of Artificial Sequence: Synthetic oligonucleotide
  Target: SCN9A; (+) strand; PAM type: NRG; PAM sequence: CAG
ggagtcaagattcttattgg

SEQ ID NO: 44605 - DNA, 20 bp, Artificial Sequence
  Description of Artificial Sequence: Synthetic oligonucleotide
  Target: SCN9A; (+) strand; PAM type: NRG; PAM sequence: GAG
agtcaagattcttattggca

SEQ ID NO: 44606 - DNA, 20 bp, Artificial Sequence
  Description of Artificial Sequence: Synthetic oligonucleotide
  Target: SCN9A; (+) strand; PAM type: NRG; PAM sequence: TAG
agagattcctgcccccatcc

SEQ ID NO: 44607 - DNA, 20 bp, Artificial Sequence
  Description of Artificial Sequence: Synthetic oligonucleotide
  Target: SCN9A; (+) strand; PAM type: NRG; PAM sequence: AAG
cccccatcctagaactatta

SEQ ID NO: 44608 - DNA, 20 bp, Artificial Sequence
  Description of Artificial Sequence: Synthetic oligonucleotide
  Target: SCN9A; (+) strand; PAM type: NRG; PAM sequence: CAG
atcctagaactattaaagtt

SEQ ID NO: 44609 - DNA, 20 bp, Artificial Sequence
  Description of Artificial Sequence: Synthetic oligonucleotide
  Target: SCN9A; (+) strand; PAM type: NRG; PAM sequence: AAG
taaagttcagtcattcaaca

SEQ ID NO: 44610 - DNA, 20 bp, Artificial Sequence
  Description of Artificial Sequence: Synthetic oligonucleotide
  Target: SCN9A; (+) strand; PAM type: NRG; PAM sequence: TAG
gctaaaattaaaatatatct

SEQ ID NO: 44611 - DNA, 20 bp, Artificial Sequence
  Description of Artificial Sequence: Synthetic oligonucleotide
  Target: SCN9A; (+) strand; PAM type: NRG; PAM sequence: TAG
gtatgtattttaatacattt

SEQ ID NO: 44612 - DNA, 20 bp, Artificial Sequence
  Description of Artificial Sequence: Synthetic oligonucleotide
  Target: SCN9A; (+) strand; PAM type: NRG; PAM sequence: AAG
acattttagaaatattcaat

SEQ ID NO: 44613 - DNA, 20 bp, Artificial Sequence
  Description of Artificial Sequence: Synthetic oligonucleotide
  Target: SCN9A; (+) strand; PAM type: NRG; PAM sequence: AGG
cattttagaaatattcaata

SEQ ID NO: 44614 - DNA, 20 bp, Artificial Sequence
  Description of Artificial Sequence: Synthetic oligonucleotide
  Target: SCN9A; (+) strand; PAM type: NRG; PAM sequence: CAG
tattaatctgtatctaattt

SEQ ID NO: 44615 - DNA, 20 bp, Artificial Sequence
  Description of Artificial Sequence: Synthetic oligonucleotide
  Target: SCN9A; (+) strand; PAM type: NRG; PAM sequence: AAG
tctgtatctaatttcagtaa

SEQ ID NO: 44616 - DNA, 20 bp, Artificial Sequence
  Description of Artificial Sequence: Synthetic oligonucleotide
  Target: SCN9A; (+) strand; PAM type: NRG; PAM sequence: TAG
agtgttctatgtgttattga

SEQ ID NO: 44617 - DNA, 20 bp, Artificial Sequence
  Description of Artificial Sequence: Synthetic oligonucleotide
  Target: SCN9A; (+) strand; PAM type: NRG; PAM sequence: TAG
ttctatgtgttattgataga

SEQ ID NO: 44618 - DNA, 20 bp, Artificial Sequence
  Description of Artificial Sequence: Synthetic oligonucleotide
  Target: SCN9A; (+) strand; PAM type: NRG; PAM sequence: AGG
tctatgtgttattgatagat

SEQ ID NO: 44619 - DNA, 20 bp, Artificial Sequence
  Description of Artificial Sequence: Synthetic oligonucleotide
  Target: SCN9A; (+) strand; PAM type: NRG; PAM sequence: TAG
tatgctctatctaaacctct

SEQ ID NO: 44620 - DNA, 20 bp, Artificial Sequence
  Description of Artificial Sequence: Synthetic oligonucleotide
  Target: SCN9A; (+) strand; PAM type: NRG; PAM sequence: TAG
tatctaaacctcttagtttc

SEQ ID NO: 44621 - DNA, 20 bp, Artificial Sequence
  Description of Artificial Sequence: Synthetic oligonucleotide
  Target: SCN9A; (+) strand; PAM type: NRG; PAM sequence: GAG
tctaaacctcttagtttcta

SEQ ID NO: 44622 - DNA, 20 bp, Artificial Sequence
  Description of Artificial Sequence: Synthetic oligonucleotide
  Target: SCN9A; (+) strand; PAM type: NRG; PAM sequence: CAG
gatctgattatgtatataat

SEQ ID NO: 44623 - DNA, 20 bp, Artificial Sequence
  Description of Artificial Sequence: Synthetic oligonucleotide
  Target: SCN9A; (+) strand; PAM type: NRG; PAM sequence: GAG
agaaacttattcttatcaat

SEQ ID NO: 44624 - DNA, 20 bp, Artificial Sequence
  Description of Artificial Sequence: Synthetic oligonucleotide
  Target: SCN9A; (+) strand; PAM type: NRG; PAM sequence: TGG
tcaatgagtaatattacttc

SEQ ID NO: 44625 - DNA, 20 bp, Artificial Sequence
  Description of Artificial Sequence: Synthetic oligonucleotide
  Target: SCN9A; (+) strand; PAM type: NRG; PAM sequence: TAG
acttatcacttattcattca

SEQ ID NO: 44626 - DNA, 20 bp, Artificial Sequence
  Description of Artificial Sequence: Synthetic oligonucleotide
  Target: SCN9A; (+) strand; PAM type: NRG; PAM sequence: AGG
cttatcacttattcattcat

SEQ ID NO: 44627 - DNA, 20 bp, Artificial Sequence
  Description of Artificial Sequence: Synthetic oligonucleotide
  Target: SCN9A; (+) strand; PAM type: NRG; PAM sequence: AAG
tcacttattcattcataggc

SEQ ID NO: 44628 - DNA, 20 bp, Artificial Sequence
  Description of Artificial Sequence: Synthetic oligonucleotide
  Target: SCN9A; (+) strand; PAM type: NRG; PAM sequence: AGG
cacttattcattcataggca

SEQ ID NO: 44629 - DNA, 20 bp, Artificial Sequence
  Description of Artificial Sequence: Synthetic oligonucleotide
  Target: SCN9A; (+) strand; PAM type: NRG; PAM sequence: TAG
tttaactgatgcattttata

SEQ ID NO: 44630 - DNA, 20 bp, Artificial Sequence
  Description of Artificial Sequence: Synthetic oligonucleotide
  Target: SCN9A; (+) strand; PAM type: NRG; PAM sequence: AGG
ttaactgatgcattttatat

SEQ ID NO: 44631 - DNA, 20 bp, Artificial Sequence
  Description of Artificial Sequence: Synthetic oligonucleotide
  Target: SCN9A; (+) strand; PAM type: NRG; PAM sequence: GAG
aactgatgcattttatatag

SEQ ID NO: 44632 - DNA, 20 bp, Artificial Sequence
  Description of Artificial Sequence: Synthetic oligonucleotide
  Target: SCN9A; (+) strand; PAM type: NRG; PAM sequence: GAG
aaaatcaaatgttaattact

SEQ ID NO: 44633 - DNA, 20 bp, Artificial Sequence
  Description of Artificial Sequence: Synthetic oligonucleotide
  Target: SCN9A; (+) strand; PAM type: NRG; PAM sequence: AAG
tgagttgatttaaaaaaata

SEQ ID NO: 44634 - DNA, 20 bp, Artificial Sequence
  Description of Artificial Sequence: Synthetic oligonucleotide
  Target: SCN9A; (+) strand; PAM type: NRG; PAM sequence: CAG
aaataaagtcccataactaa

SEQ ID NO: 44635 - DNA, 20 bp, Artificial Sequence
  Description of Artificial Sequence: Synthetic oligonucleotide
  Target: SCN9A; (+) strand; PAM type: NRG; PAM sequence: AAG
accatttcaaaatgtattca

SEQ ID NO: 44636 - DNA, 20 bp, Artificial Sequence
  Description of Artificial Sequence: Synthetic oligonucleotide
  Target: SCN9A; (+) strand; PAM type: NRG; PAM sequence: TAG
aatgtattcaaagtttatac

SEQ ID NO: 44637 - DNA, 20 bp, Artificial Sequence
  Description of Artificial Sequence: Synthetic oligonucleotide
  Target: SCN9A; (+) strand; PAM type: NRG; PAM sequence: AAG
gtattcaaagtttatactag

SEQ ID NO: 44638 - DNA, 20 bp, Artificial Sequence
  Description of Artificial Sequence: Synthetic oligonucleotide
  Target: SCN9A; (+) strand; PAM type: NRG; PAM sequence: CAG
ttcaaagtttatactagaag

SEQ ID NO: 44639 - DNA, 20 bp, Artificial Sequence
  Description of Artificial Sequence: Synthetic oligonucleotide
  Target: SCN9A; (+) strand; PAM type: NRG; PAM sequence: AGG
tcaaagtttatactagaagc

SEQ ID NO: 44640 - DNA, 20 bp, Artificial Sequence
  Description of Artificial Sequence: Synthetic oligonucleotide
  Target: SCN9A; (+) strand; PAM type: NRG; PAM sequence: GGG
caaagtttatactagaagca

SEQ ID NO: 44641 - DNA, 20 bp, Artificial Sequence
  Description of Artificial Sequence: Synthetic oligonucleotide
  Target: SCN9A; (+) strand; PAM type: NRG; PAM sequence: TGG
atactagaagcagggtactt

SEQ ID NO: 44642 - DNA, 20 bp, Artificial Sequence
  Description of Artificial Sequence: Synthetic oligonucleotide
  Target: SCN9A; (+) strand; PAM type: NRG; PAM sequence: TAG
tggctttgaccccaactttc

SEQ ID NO: 44643 - DNA, 20 bp, Artificial Sequence
  Description of Artificial Sequence: Synthetic oligonucleotide
  Target: SCN9A; (+) strand; PAM type: NRG; PAM sequence: AAG
caactttctagatgtgtact

SEQ ID NO: 44644 - DNA, 20 bp, Artificial Sequence
  Description of Artificial Sequence: Synthetic oligonucleotide
  Target: SCN9A; (+) strand; PAM type: NRG; PAM sequence: AAG
tttctagatgtgtactaaga

SEQ ID NO: 44645 - DNA, 20 bp, Artificial Sequence
  Description of Artificial Sequence: Synthetic oligonucleotide
  Target: SCN9A; (+) strand; PAM type: NRG; PAM sequence: GAG
gatgtgtactaagaaagcat

SEQ ID NO: 44646 - DNA, 20 bp, Artificial Sequence
  Description of Artificial Sequence: Synthetic oligonucleotide
  Target: SCN9A; (+) strand; PAM type: NRG; PAM sequence: CAG
cttatccataaatacataac

SEQ ID NO: 44647 - DNA, 20 bp, Artificial Sequence
  Description of Artificial Sequence: Synthetic oligonucleotide
  Target: SCN9A; (+) strand; PAM type: NRG; PAM sequence: AAG
aaccagaattattaaataca

SEQ ID NO: 44648 - DNA, 20 bp, Artificial Sequence
  Description of Artificial Sequence: Synthetic oligonucleotide
  Target: SCN9A; (+) strand; PAM type: NRG; PAM sequence: TAG
agaattattaaatacaaagc

SEQ ID NO: 44649 - DNA, 20 bp, Artificial Sequence
  Description of Artificial Sequence: Synthetic oligonucleotide
  Target: SCN9A; (+) strand; PAM type: NRG; PAM sequence: GAG
caatgatcttttcctgctct

SEQ ID NO: 44650 - DNA, 20 bp, Artificial Sequence
  Description of Artificial Sequence: Synthetic oligonucleotide
  Target: SCN9A; (+) strand; PAM type: NRG; PAM sequence: CAG
ctgagattttatatttatgc

SEQ ID NO: 44651 - DNA, 20 bp, Artificial Sequence
  Description of Artificial Sequence: Synthetic oligonucleotide
  Target: SCN9A; (+) strand; PAM type: NRG; PAM sequence: TAG
acacttcttccacaattttt

SEQ ID NO: 44652 - DNA, 20 bp, Artificial Sequence
  Description of Artificial Sequence: Synthetic oligonucleotide
  Target: SCN9A; (+) strand; PAM type: NRG; PAM sequence: GAG
acttcttccacaatttttta

SEQ ID NO: 44653 - DNA, 20 bp, Artificial Sequence
  Description of Artificial Sequence: Synthetic oligonucleotide
  Target: SCN9A; (+) strand; PAM type: NRG; PAM sequence: TAG
catctctccatatttttatg

SEQ ID NO: 44654 - DNA, 20 bp, Artificial Sequence
  Description of Artificial Sequence: Synthetic oligonucleotide
  Target: SCN9A; (+) strand; PAM type: NRG; PAM sequence: CAG
tatttttatgtagattaaat

SEQ ID NO: 44655 - DNA, 20 bp, Artificial Sequence
  Description of Artificial Sequence: Synthetic oligonucleotide
  Target: SCN9A; (+) strand; PAM type: NRG; PAM sequence: AGG
atttttatgtagattaaatc

SEQ ID NO: 44656 - DNA, 20 bp, Artificial Sequence
  Description of Artificial Sequence: Synthetic oligonucleotide
  Target: SCN9A; (+) strand; PAM type: NRG; PAM sequence: AAG
tttatgtagattaaatcagg

SEQ ID NO: 44657 - DNA, 20 bp, Artificial Sequence
  Description of Artificial Sequence: Synthetic oligonucleotide
  Target: SCN9A; (+) strand; PAM type: NRG; PAM sequence: AGG
ttatgtagattaaatcagga

SEQ ID NO: 44658 - DNA, 20 bp, Artificial Sequence
  Description of Artificial Sequence: Synthetic oligonucleotide
  Target: SCN9A; (+) strand; PAM type: NRG; PAM sequence: GGG
tatgtagattaaatcaggaa

SEQ ID NO: 44659 - DNA, 20 bp, Artificial Sequence
  Description of Artificial Sequence: Synthetic oligonucleotide
  Target: SCN9A; (+) strand; PAM type: NRG; PAM sequence: AAG
gtagattaaatcaggaaggg

SEQ ID NO: 44660 - DNA, 20 bp, Artificial Sequence
  Description of Artificial Sequence: Synthetic oligonucleotide
  Target: SCN9A; (+) strand; PAM type: NRG; PAM sequence: TAG
aaatcaggaagggaagttga

SEQ ID NO: 44661 - DNA, 20 bp, Artificial Sequence
  Description of Artificial Sequence: Synthetic oligonucleotide
  Target: SCN9A; (+) strand; PAM type: NRG; PAM sequence: GAG
atcaggaagggaagttgata

SEQ ID NO: 44662 - DNA, 20 bp, Artificial Sequence
  Description of Artificial Sequence: Synthetic oligonucleotide
  Target: SCN9A; (+) strand; PAM type: NRG; PAM sequence: AGG
tcaggaagggaagttgatag

SEQ ID NO: 44663 - DNA, 20 bp, Artificial Sequence
  Description of Artificial Sequence: Synthetic oligonucleotide
  Target: SCN9A; (+) strand; PAM type: NRG; PAM sequence: TAG
agaggttttcaaattaaatg

SEQ ID NO: 44664 - DNA, 20 bp, Artificial Sequence
  Description of Artificial Sequence: Synthetic oligonucleotide
  Target: SCN9A; (+) strand; PAM type: NRG; PAM sequence: TGG
caaattaaatgtagcttcaa

SEQ ID NO: 44665 - DNA, 20 bp, Artificial Sequence
  Description of Artificial Sequence: Synthetic oligonucleotide
  Target: SCN9A; (+) strand; PAM type: NRG; PAM sequence: CAG
atcaattcaataaaaatcta

SEQ ID NO: 44666 - DNA, 20 bp, Artificial Sequence
  Description of Artificial Sequence: Synthetic oligonucleotide
  Target: SCN9A; (+) strand; PAM type: NRG; PAM sequence: AAG
tcatgcacttgaaatcactt

SEQ ID NO: 44667 - DNA, 20 bp, Artificial Sequence
  Description of Artificial Sequence: Synthetic oligonucleotide
  Target: SCN9A; (+) strand; PAM type: NRG; PAM sequence: AAG
tgaaatcacttaagcacatg

SEQ ID NO: 44668 - DNA, 20 bp, Artificial Sequence
  Description of Artificial Sequence: Synthetic oligonucleotide
  Target: SCN9A; (+) strand; PAM type: NRG; PAM sequence: AGG
gaaatcacttaagcacatga

SEQ ID NO: 44669 - DNA, 20 bp, Artificial Sequence
  Description of Artificial Sequence: Synthetic oligonucleotide
  Target: SCN9A; (+) strand; PAM type: NRG; PAM sequence: AAG
aagcacatgaaggttacatc

SEQ ID NO: 44670 - DNA, 20 bp, Artificial Sequence
  Description of Artificial Sequence: Synthetic oligonucleotide
  Target: SCN9A; (+) strand; PAM type: NRG; PAM sequence: AAG
cacatgaaggttacatcaag

SEQ ID NO: 44671 - DNA, 20 bp, Artificial Sequence
  Description of Artificial Sequence: Synthetic oligonucleotide
  Target: SCN9A; (+) strand; PAM type: NRG; PAM sequence: AAG
ggttacatcaagaagtcatc

SEQ ID NO: 44672 - DNA, 20 bp, Artificial Sequence
  Description of Artificial Sequence: Synthetic oligonucleotide
  Target: SCN9A; (+) strand; PAM type: NRG; PAM sequence: GAG
ttacatcaagaagtcatcaa

SEQ ID NO: 44673 - DNA, 20 bp, Artificial Sequence
  Description of Artificial Sequence: Synthetic oligonucleotide
  Target: SCN9A; (+) strand; PAM type: NRG; PAM sequence: TGG
aaaaaataatcaaattgccc

SEQ ID NO: 44674 - DNA, 20 bp, Artificial Sequence
  Description of Artificial Sequence: Synthetic oligonucleotide
  Target: SCN9A; (+) strand; PAM type: NRG; PAM sequence: CAG
tatatgtttctactttcttg

SEQ ID NO: 44675 - DNA, 20 bp, Artificial Sequence
  Description of Artificial Sequence: Synthetic oligonucleotide
  Target: SCN9A; (+) strand; PAM type: NRG; PAM sequence: TGG
atgtttctactttcttgcag

SEQ ID NO: 44676 - DNA, 20 bp, Artificial Sequence
  Description of Artificial Sequence: Synthetic oligonucleotide
  Target: SCN9A; (+) strand; PAM type: NRG; PAM sequence: GGG
tgtttctactttcttgcagt

SEQ ID NO: 44677 - DNA, 20 bp, Artificial Sequence
  Description of Artificial Sequence: Synthetic oligonucleotide
  Target: SCN9A; (+) strand; PAM type: NRG; PAM sequence: CAG
tctactttcttgcagtgggt

SEQ ID NO: 44678 - DNA, 20 bp, Artificial Sequence
  Description of Artificial Sequence: Synthetic oligonucleotide
  Target: SCN9A; (+) strand; PAM type: NRG; PAM sequence: AGG
ctactttcttgcagtgggtc

SEQ ID NO: 44679 - DNA, 20 bp, Artificial Sequence
  Description of Artificial Sequence: Synthetic oligonucleotide
  Target: SCN9A; (+) strand; PAM type: NRG; PAM sequence: CAG
ctttcttgcagtgggtcagg

SEQ ID NO: 44680 - DNA, 20 bp, Artificial Sequence
  Description of Artificial Sequence: Synthetic oligonucleotide
  Target: SCN9A; (+) strand; PAM type: NRG; PAM sequence: AAG
cttgcagtgggtcaggcaga

SEQ ID NO: 44681 - DNA, 20 bp, Artificial Sequence
  Description of Artificial Sequence: Synthetic oligonucleotide
  Target: SCN9A; (+) strand; PAM type: NRG; PAM sequence: AGG
ttgcagtgggtcaggcagaa

SEQ ID NO: 44682 - DNA, 20 bp, Artificial Sequence
  Description of Artificial Sequence: Synthetic oligonucleotide
  Target: SCN9A; (+) strand; PAM type: NRG; PAM sequence: TAG
ggtcaggcagaaaggttttg

SEQ ID NO: 44683 - DNA, 20 bp, Artificial Sequence
  Description of Artificial Sequence: Synthetic oligonucleotide
  Target: SCN9A; (+) strand; PAM type: NRG; PAM sequence: CAG
agaaaggttttgtagctgaa

SEQ ID NO: 44684 - DNA, 20 bp, Artificial Sequence
  Description of Artificial Sequence: Synthetic oligonucleotide
  Target: SCN9A; (+) strand; PAM type: NRG; PAM sequence: AAG
tttgtagctgaacagcatgc

SEQ ID NO: 44685 - DNA, 20 bp, Artificial Sequence
  Description of Artificial Sequence: Synthetic oligonucleotide
  Target: SCN9A; (+) strand; PAM type: NRG; PAM sequence: TAG
tatcgtatgtatgatttttt

SEQ ID NO: 44686 - DNA, 20 bp, Artificial Sequence
  Description of Artificial Sequence: Synthetic oligonucleotide
  Target: SCN9A; (+) strand; PAM type: NRG; PAM sequence: AGG
atcgtatgtatgattttttt

SEQ ID NO: 44687 - DNA, 20 bp, Artificial Sequence
  Description of Artificial Sequence: Synthetic oligonucleotide
  Target: SCN9A; (+) strand; PAM type: NRG; PAM sequence: AAG
tttttaggtaacctgtgtaa

SEQ ID NO: 44688 - DNA, 20 bp, Artificial Sequence
  Description of Artificial Sequence: Synthetic oligonucleotide
  Target: SCN9A; (+) strand; PAM type: NRG; PAM sequence: TGG
ttaggtaacctgtgtaaaag

SEQ ID NO: 44689 - DNA, 20 bp, Artificial Sequence
  Description of Artificial Sequence: Synthetic oligonucleotide
  Target: SCN9A; (+) strand; PAM type: NRG; PAM sequence: TGG
tggtgacatatgtctctgcc

SEQ ID NO: 44690 - DNA, 20 bp, Artificial Sequence
  Description of Artificial Sequence: Synthetic oligonucleotide
  Target: SCN9A; (+) strand; PAM type: NRG; PAM sequence: AAG
atatgtctctgcctggttaa

SEQ ID NO: 44691 - DNA, 20 bp, Artificial Sequence
  Description of Artificial Sequence: Synthetic oligonucleotide
  Target: SCN9A; (+) strand; PAM type: NRG; PAM sequence: CAG
tctctgcctggttaaaagca

SEQ ID NO: 44692 - DNA, 20 bp, Artificial Sequence
  Description of Artificial Sequence: Synthetic oligonucleotide
  Target: SCN9A; (+) strand; PAM type: NRG; PAM sequence: GAG
tctgcctggttaaaagcaca

SEQ ID NO: 44693 - DNA, 20 bp, Artificial Sequence
  Description of Artificial Sequence: Synthetic oligonucleotide
  Target: SCN9A; (+) strand; PAM type: NRG; PAM sequence: CAG
agctgcatccttgactgatc

SEQ ID NO: 44694 - DNA, 20 bp, Artificial Sequence
  Description of Artificial Sequence: Synthetic oligonucleotide
  Target: SCN9A; (+) strand; PAM type: NRG; PAM sequence: GAG
cagtttgatattacccctgt

SEQ ID NO: 44695 - DNA, 20 bp, Artificial Sequence
  Description of Artificial Sequence: Synthetic oligonucleotide
  Target: SCN9A; (+) strand; PAM type: NRG; PAM sequence: AAG
tttgatattacccctgtgag

SEQ ID NO: 44696 - DNA, 20 bp, Artificial Sequence
  Description of Artificial Sequence: Synthetic oligonucleotide
  Target: SCN9A; (+) strand; PAM type: NRG; PAM sequence: AAG
gatattacccctgtgagaag

SEQ ID NO: 44697 - DNA, 20 bp, Artificial Sequence
  Description of Artificial Sequence: Synthetic oligonucleotide
  Target: SCN9A; (+) strand; PAM type: NRG; PAM sequence: AGG
atattacccctgtgagaaga

SEQ ID NO: 44698 - DNA, 20 bp, Artificial Sequence
  Description of Artificial Sequence: Synthetic oligonucleotide
  Target: SCN9A; (+) strand; PAM type: NRG; PAM sequence: TAG
tacccctgtgagaagaaggt

SEQ ID NO: 44699 - DNA, 20 bp, Artificial Sequence
  Description of Artificial Sequence: Synthetic oligonucleotide
  Target: SCN9A; (+) strand; PAM type: NRG; PAM sequence: AGG
acccctgtgagaagaaggtt

SEQ ID NO: 44700 - DNA, 20 bp, Artificial Sequence
  Description of Artificial Sequence: Synthetic oligonucleotide
  Target: SCN9A; (+) strand; PAM type: NRG; PAM sequence: TAG
gaaggttaggtactgaattt

SEQ ID NO: 44701 - DNA, 20 bp, Artificial Sequence
  Description of Artificial Sequence: Synthetic oligonucleotide
  Target: SCN9A; (+) strand; PAM type: NRG; PAM sequence: CAG
ggtactgaattttagaaatg

SEQ ID NO: 44702 - DNA, 20 bp, Artificial Sequence
  Description of Artificial Sequence: Synthetic oligonucleotide
  Target: SCN9A; (+) strand; PAM type: NRG; PAM sequence: AAG
ttagaaatgcagcatgatga

SEQ ID NO: 44703 - DNA, 20 bp, Artificial Sequence
  Description of Artificial Sequence: Synthetic oligonucleotide
  Target: SCN9A; (+) strand; PAM type: NRG; PAM sequence: GAG
agaaatgcagcatgatgaaa

SEQ ID NO: 44704 - DNA, 20 bp, Artificial Sequence
  Description of Artificial Sequence: Synthetic oligonucleotide
  Target: SCN9A; (+) strand; PAM type: NRG; PAM sequence: TAG
tgcagcatgatgaaagagtt

SEQ ID NO: 44705 - DNA, 20 bp, Artificial Sequence
  Description of Artificial Sequence: Synthetic oligonucleotide
  Target: SCN9A; (+) strand; PAM type: NRG; PAM sequence: AAG
actgtgttttaaaatgttta

SEQ ID NO: 44706 - DNA, 20 bp, Artificial Sequence
  Description of Artificial Sequence: Synthetic oligonucleotide
  Target: SCN9A; (+) strand; PAM type: NRG; PAM sequence: AAG
gtttaaagtcatatacctgt

SEQ ID NO: 44707 - DNA, 20 bp, Artificial Sequence
  Description of Artificial Sequence: Synthetic oligonucleotide
  Target: SCN9A; (+) strand; PAM type: NRG; PAM sequence: TAG
taaagtcatatacctgtaag

SEQ ID NO: 44708 - DNA, 20 bp, Artificial Sequence
  Description of Artificial Sequence: Synthetic oligonucleotide
  Target: SCN9A; (+) strand; PAM type: NRG; PAM sequence: TAG
atatacctgtaagtagaaat

SEQ ID NO: 44709 - DNA, 20 bp, Artificial Sequence
  Description of Artificial Sequence: Synthetic oligonucleotide
  Target: SCN9A; (+) strand; PAM type: NRG; PAM sequence: AAG
gaaattagttacatatttga

SEQ ID NO: 44710 - DNA, 20 bp, Artificial Sequence
  Description of Artificial Sequence: Synthetic oligonucleotide
  Target: SCN9A; (+) strand; PAM type: NRG; PAM sequence: AAG
catgctatatactcaacgtt

SEQ ID NO: 44711 - DNA, 20 bp, Artificial Sequence
  Description of Artificial Sequence: Synthetic oligonucleotide
  Target: SCN9A; (+) strand; PAM type: NRG; PAM sequence: CAG
taagcaatatatttgaatca

SEQ ID NO: 44712 - DNA, 20 bp, Artificial Sequence
  Description of Artificial Sequence: Synthetic oligonucleotide
  Target: SCN9A; (+) strand; PAM type: NRG; PAM sequence: AAG
tatatttgaatcacagtact

SEQ ID NO: 44713 - DNA, 20 bp, Artificial Sequence
  Description of Artificial Sequence: Synthetic oligonucleotide
  Target: SCN9A; (+) strand; PAM type: NRG; PAM sequence: CAG
taagattaaatgtcattcaa

SEQ ID NO: 44714 - DNA, 20 bp, Artificial Sequence
  Description of Artificial Sequence: Synthetic oligonucleotide
  Target: SCN9A; (+) strand; PAM type: NRG; PAM sequence: GAG
agattaaatgtcattcaaca

SEQ ID NO: 44715 - DNA, 20 bp, Artificial Sequence
  Description of Artificial Sequence: Synthetic oligonucleotide
  Target: SCN9A; (+) strand; PAM type: NRG; PAM sequence: CAG
cttaaaaacaatcaattaaa

SEQ ID NO: 44716 - DNA, 20 bp, Artificial Sequence
  Description of Artificial Sequence: Synthetic oligonucleotide
  Target: SCN9A; (+) strand; PAM type: NRG; PAM sequence: AAG
ttctatttttccttaaatgc

SEQ ID NO: 44717 - DNA, 20 bp, Artificial Sequence
  Description of Artificial Sequence: Synthetic oligonucleotide
  Target: SCN9A; (+) strand; PAM type: NRG; PAM sequence: AAG
tgcaagcaacatttaaatat

SEQ ID NO: 44718 - DNA, 20 bp, Artificial Sequence
  Description of Artificial Sequence: Synthetic oligonucleotide
  Target: SCN9A; (+) strand; PAM type: NRG; PAM sequence: CAG
atttaaatataagtgattct

SEQ ID NO: 44719 - DNA, 20 bp, Artificial Sequence
  Description of Artificial Sequence: Synthetic oligonucleotide
  Target: SCN9A; (+) strand; PAM type: NRG; PAM sequence: TAG
aatataagtgattctcagta

SEQ ID NO: 44720 - DNA, 20 bp, Artificial Sequence
  Description of Artificial Sequence: Synthetic oligonucleotide
  Target: SCN9A; (+) strand; PAM type: NRG; PAM sequence: AGG
atataagtgattctcagtat

SEQ ID NO: 44721 - DNA, 20 bp, Artificial Sequence
  Description of Artificial Sequence: Synthetic oligonucleotide
  Target: SCN9A; (+) strand; PAM type: NRG; PAM sequence: GGG
tataagtgattctcagtata

SEQ ID NO: 44722 - DNA, 20 bp, Artificial Sequence
  Description of Artificial Sequence: Synthetic oligonucleotide
  Target: SCN9A; (+) strand; PAM type: NRG; PAM sequence: GGG
ataagtgattctcagtatag

SEQ ID NO: 44723 - DNA, 20 bp, Artificial Sequence
  Description of Artificial Sequence: Synthetic oligonucleotide
  Target: SCN9A; (+) strand; PAM type: NRG; PAM sequence: GGG
taagtgattctcagtatagg

SEQ ID NO: 44724 - DNA, 20 bp, Artificial Sequence
  Description of Artificial Sequence: Synthetic oligonucleotide
  Target: SCN9A; (+) strand; PAM type: NRG; PAM sequence: GAG
tgattctcagtatagggggt

SEQ ID NO: 44725 - DNA, 20 bp, Artificial Sequence
  Description of Artificial Sequence: Synthetic oligonucleotide
  Target: SCN9A; (+) strand; PAM type: NRG; PAM sequence: AGG
gattctcagtatagggggtg

SEQ ID NO: 44726 - DNA, 20 bp, Artificial Sequence
  Description of Artificial Sequence: Synthetic oligonucleotide
  Target: SCN9A; (+) strand; PAM type: NRG; PAM sequence: TGG
tctcagtatagggggtgagg

SEQ ID NO: 44727 - DNA, 20 bp, Artificial Sequence
  Description of Artificial Sequence: Synthetic oligonucleotide
  Target: SCN9A; (+) strand; PAM type: NRG; PAM sequence: CAG
cagtatagggggtgaggtgg

SEQ ID NO: 44728 - DNA, 20 bp, Artificial Sequence
  Description of Artificial Sequence: Synthetic oligonucleotide
  Target: SCN9A; (+) strand; PAM type: NRG; PAM sequence: AAG
atagggggtgaggtggcagt

SEQ ID NO: 44729 - DNA, 20 bp, Artificial Sequence
  Description of Artificial Sequence: Synthetic oligonucleotide
  Target: SCN9A; (+) strand; PAM type: NRG; PAM sequence: GAG
agggggtgaggtggcagtaa

SEQ ID NO: 44730 - DNA, 20 bp, Artificial Sequence
  Description of Artificial Sequence: Synthetic oligonucleotide
  Target: SCN9A; (+) strand; PAM type: NRG; PAM sequence: CAG
gaggtggcagtaagagtatg

SEQ ID NO: 44731 - DNA, 20 bp, Artificial Sequence
  Description of Artificial Sequence: Synthetic oligonucleotide
  Target: SCN9A; (+) strand; PAM type: NRG; PAM sequence: AAG
taagagtatgcagctttaaa

SEQ ID NO: 44732 - DNA, 20 bp, Artificial Sequence
  Description of Artificial Sequence: Synthetic oligonucleotide
  Target: SCN9A; (+) strand; PAM type: NRG; PAM sequence: TAG
taaaaagcatattctaaaat

SEQ ID NO: 44733 - DNA, 20 bp, Artificial Sequence
  Description of Artificial Sequence: Synthetic oligonucleotide
  Target: SCN9A; (+) strand; PAM type: NRG; PAM sequence: CAG
attaattttgacattttaaa

SEQ ID NO: 44734 - DNA, 20 bp, Artificial Sequence
  Description of Artificial Sequence: Synthetic oligonucleotide
  Target: SCN9A; (+) strand; PAM type: NRG; PAM sequence: AAG
ttttaaacagcattgcaaaa

SEQ ID NO: 44735 - DNA, 20 bp, Artificial Sequence
  Description of Artificial Sequence: Synthetic oligonucleotide
  Target: SCN9A; (+) strand; PAM type: NRG; PAM sequence: AAG
aacagcattgcaaaaaagtg

SEQ ID NO: 44736 - DNA, 20 bp, Artificial Sequence
  Description of Artificial Sequence: Synthetic oligonucleotide
  Target: SCN9A; (+) strand; PAM type: NRG; PAM sequence: AAG
tccaaatttatcaaaatata

SEQ ID NO: 44737 - DNA, 20 bp, Artificial Sequence
  Description of Artificial Sequence: Synthetic oligonucleotide
  Target: SCN9A; (+) strand; PAM type: NRG; PAM sequence: AAG
tttatcaaaatataaagaat

SEQ ID NO: 44738 - DNA, 20 bp, Artificial Sequence
  Description of Artificial Sequence: Synthetic oligonucleotide
  Target: SCN9A; (+) strand; PAM type: NRG; PAM sequence: CAG
acacattgatttgaatatgt

SEQ ID NO: 44739 - DNA, 20 bp, Artificial Sequence
  Description of Artificial Sequence: Synthetic oligonucleotide
  Target: SCN9A; (+) strand; PAM type: NRG; PAM sequence: TAG
gacaaatatttcattgtttt

SEQ ID NO: 44740 - DNA, 20 bp, Artificial Sequence
  Description of Artificial Sequence: Synthetic oligonucleotide
  Target: SCN9A; (+) strand; PAM type: NRG; PAM sequence: AGG
acaaatatttcattgttttt

SEQ ID NO: 44741 - DNA, 20 bp, Artificial Sequence
  Description of Artificial Sequence: Synthetic oligonucleotide
  Target: SCN9A; (+) strand; PAM type: NRG; PAM sequence: AAG
gcacgtaaacaaatccaatg

SEQ ID NO: 44742 - DNA, 20 bp, Artificial Sequence
  Description of Artificial Sequence: Synthetic oligonucleotide
  Target: SCN9A; (+) strand; PAM type: NRG; PAM sequence: TGG
gtaaacaaatccaatgaaga

SEQ ID NO: 44743 - DNA, 20 bp, Artificial Sequence
  Description of Artificial Sequence: Synthetic oligonucleotide
  Target: SCN9A; (+) strand; PAM type: NRG; PAM sequence: AAG
acaaatccaatgaagatgga

SEQ ID NO: 44744 - DNA, 20 bp, Artificial Sequence
  Description of Artificial Sequence: Synthetic oligonucleotide
  Target: SCN9A; (+) strand; PAM type: NRG; PAM sequence: TGG
gaaagatttttcaaattctt

SEQ ID NO: 44745 - DNA, 20 bp, Artificial Sequence
  Description of Artificial Sequence: Synthetic oligonucleotide
  Target: SCN9A; (+) strand; PAM type: NRG; PAM sequence: TGG
aacaacctgaaaaaaacaaa

SEQ ID NO: 44746 - DNA, 20 bp, Artificial Sequence
  Description of Artificial Sequence: Synthetic oligonucleotide
  Target: SCN9A; (+) strand; PAM type: NRG; PAM sequence: AAG
ctgaaaaaaacaaatggtct

SEQ ID NO: 44747 - DNA, 20 bp, Artificial Sequence
  Description of Artificial Sequence: Synthetic oligonucleotide
  Target: SCN9A; (+) strand; PAM type: NRG; PAM sequence: CAG
atggtctaagtgcaattcta

SEQ ID NO: 44748 - DNA, 20 bp, Artificial Sequence
  Description of Artificial Sequence: Synthetic oligonucleotide
  Target: SCN9A; (+) strand; PAM type: NRG; PAM sequence: AAG
gtctaagtgcaattctacag

SEQ ID NO: 44749 - DNA, 20 bp, Artificial Sequence
  Description of Artificial Sequence: Synthetic oligonucleotide
  Target: SCN9A; (+) strand; PAM type: NRG; PAM sequence: GAG
ctaagtgcaattctacagaa

SEQ ID NO: 44750 - DNA, 20 bp, Artificial Sequence
  Description of Artificial Sequence: Synthetic oligonucleotide
  Target: SCN9A; (+) strand; PAM type: NRG; PAM sequence: TAG
aaaaatctatgcataaaata

SEQ ID NO: 44751 - DNA, 20 bp, Artificial Sequence
  Description of Artificial Sequence: Synthetic oligonucleotide
  Target: SCN9A; (+) strand; PAM type: NRG; PAM sequence: CAG
caaatgccaattttacgaaa

SEQ ID NO: 44752 - DNA, 20 bp, Artificial Sequence
  Description of Artificial Sequence: Synthetic oligonucleotide
  Target: SCN9A; (+) strand; PAM type: NRG; PAM sequence: AAG
actaatccctaaatctttca

SEQ ID NO: 44753 - DNA, 20 bp, Artificial Sequence
  Description of Artificial Sequence: Synthetic oligonucleotide
  Target: SCN9A; (+) strand; PAM type: NRG; PAM sequence: AAG
aaagtcaaatgcatttttaa

SEQ ID NO: 44754 - DNA, 20 bp, Artificial Sequence
  Description of Artificial Sequence: Synthetic oligonucleotide
  Target: SCN9A; (+) strand; PAM type: NRG; PAM sequence: AAG
aaagattattatattttcta

SEQ ID NO: 44755 - DNA, 20 bp, Artificial Sequence
  Description of Artificial Sequence: Synthetic oligonucleotide
  Target: SCN9A; (+) strand; PAM type: NRG; PAM sequence: TAG
ttattatattttctaaagtg

SEQ ID NO: 44756 - DNA, 20 bp, Artificial Sequence
  Description of Artificial Sequence: Synthetic oligonucleotide
  Target: SCN9A; (+) strand; PAM type: NRG; PAM sequence: AAG
attttctaaagtgtagtaat

SEQ ID NO: 44757 - DNA, 20 bp, Artificial Sequence
  Description of Artificial Sequence: Synthetic oligonucleotide
  Target: SCN9A; (+) strand; PAM type: NRG; PAM sequence: CAG
ttctaaagtgtagtaataag

SEQ ID NO: 44758 - DNA, 20 bp, Artificial Sequence
  Description of Artificial Sequence: Synthetic oligonucleotide
  Target: SCN9A; (+) strand; PAM type: NRG; PAM sequence: AAG
taaagtgtagtaataagcag

SEQ ID NO: 44759 - DNA, 20 bp, Artificial Sequence
  Description of Artificial Sequence: Synthetic oligonucleotide
  Target: SCN9A; (+) strand; PAM type: NRG; PAM sequence: AGG
aaagtgtagtaataagcaga

SEQ ID NO: 44760 - DNA, 20 bp, Artificial Sequence
  Description of Artificial Sequence: Synthetic oligonucleotide
  Target: SCN9A; (+) strand; PAM type: NRG; PAM sequence: AAG
aaactttgattaaaaatcta

SEQ ID NO: 44761 - DNA, 20 bp, Artificial Sequence
  Description of Artificial Sequence: Synthetic oligonucleotide
  Target: SCN9A; (+) strand; PAM type: NRG; PAM sequence: GAG
actttgattaaaaatctaaa

SEQ ID NO: 44762 - DNA, 20 bp, Artificial Sequence
  Description of Artificial Sequence: Synthetic oligonucleotide
  Target: SCN9A; (+) strand; PAM type: NRG; PAM sequence: GAG
tttgattaaaaatctaaaga

SEQ ID NO: 44763 - DNA, 20 bp, Artificial Sequence
  Description of Artificial Sequence: Synthetic oligonucleotide
  Target: SCN9A; (+) strand; PAM type: NRG; PAM sequence: AAG
attaaaaatctaaagagaga

SEQ ID NO: 44764 - DNA, 20 bp, Artificial Sequence
  Description of Artificial Sequence: Synthetic oligonucleotide
  Target: SCN9A; (+) strand; PAM type: NRG; PAM sequence: CAG
aagagagaaagtcttgataa

SEQ ID NO: 44765 - DNA, 20 bp, Artificial Sequence
  Description of Artificial Sequence: Synthetic oligonucleotide
  Target: SCN9A; (+) strand; PAM type: NRG; PAM sequence: TAG
gtgtaattaaaaccaccaca

SEQ ID NO: 44766 - DNA, 20 bp, Artificial Sequence
  Description of Artificial Sequence: Synthetic oligonucleotide
  Target: SCN9A; (+) strand; PAM type: NRG; PAM sequence: AAG
ttaaaaccaccacatagtaa

SEQ ID NO: 44767 - DNA, 20 bp, Artificial Sequence
  Description of Artificial Sequence: Synthetic oligonucleotide
  Target: SCN9A; (+) strand; PAM type: NRG; PAM sequence: AGG
taaaaccaccacatagtaaa

SEQ ID NO: 44768 - DNA, 20 bp, Artificial Sequence
  Description of Artificial Sequence: Synthetic oligonucleotide
  Target: SCN9A; (+) strand; PAM type: NRG; PAM sequence: TGG
aggacattaaatatttaatt

SEQ ID NO: 44769 - DNA, 20 bp, Artificial Sequence
  Description of Artificial Sequence: Synthetic oligonucleotide
  Target: SCN9A; (+) strand; PAM type: NRG; PAM sequence: GGG
ggacattaaatatttaattt

SEQ ID NO: 44770 - DNA, 20 bp, Artificial Sequence
  Description of Artificial Sequence: Synthetic oligonucleotide
  Target: SCN9A; (+) strand; PAM type: NRG; PAM sequence: CAG
atattgaaacaactttttat

SEQ ID NO: 44771 - DNA, 20 bp, Artificial Sequence
  Description of Artificial Sequence: Synthetic oligonucleotide
  Target: SCN9A; (+) strand; PAM type: NRG; PAM sequence: AGG
tattgaaacaactttttatc

SEQ ID NO: 44772 - DNA, 20 bp, Artificial Sequence
  Description of Artificial Sequence: Synthetic oligonucleotide
  Target: SCN9A; (+) strand; PAM type: NRG; PAM sequence: AAG
tgactacatttcataataat

SEQ ID NO: 44773 - DNA, 20 bp, Artificial Sequence
  Description of Artificial Sequence: Synthetic oligonucleotide
  Target: SCN9A; (+) strand; PAM type: NRG; PAM sequence: AAG
tcataataataagcatattt

SEQ ID NO: 44774 - DNA, 20 bp, Artificial Sequence
  Description of Artificial Sequence: Synthetic oligonucleotide
  Target: SCN9A; (+) strand; PAM type: NRG; PAM sequence: AAG
agcatatttaagtatctcca

SEQ ID NO: 44775 - DNA, 20 bp, Artificial Sequence
  Description of Artificial Sequence: Synthetic oligonucleotide
  Target: SCN9A; (+) strand; PAM type: NRG; PAM sequence: TAG
tttgtaaactgaacactgaa

SEQ ID NO: 44776 - DNA, 20 bp, Artificial Sequence
  Description of Artificial Sequence: Synthetic oligonucleotide
  Target: SCN9A; (+) strand; PAM type: NRG; PAM sequence: TGG
ctgaacactgaatagatgaa

SEQ ID NO: 44777 - DNA, 20 bp, Artificial Sequence
  Description of Artificial Sequence: Synthetic oligonucleotide
  Target: SCN9A; (+) strand; PAM type: NRG; PAM sequence: GGG
tgaacactgaatagatgaat

SEQ ID NO: 44778 - DNA, 20 bp, Artificial Sequence
  Description of Artificial Sequence: Synthetic oligonucleotide
  Target: SCN9A; (+) strand; PAM type: NRG; PAM sequence: TGG
acactgaatagatgaatggg

SEQ ID NO: 44779 - DNA, 20 bp, Artificial Sequence
  Description of Artificial Sequence: Synthetic oligonucleotide
  Target: SCN9A; (+) strand; PAM type: NRG; PAM sequence: TAG
tgaatagatgaatgggtgga

SEQ ID NO: 44780 - DNA, 20 bp, Artificial Sequence
  Description of Artificial Sequence: Synthetic oligonucleotide
  Target: SCN9A; (+) strand; PAM type: NRG; PAM sequence: GAG
gggtggatagatgaatgaat

SEQ ID NO: 44781 - DNA, 20 bp, Artificial Sequence
  Description of Artificial Sequence: Synthetic oligonucleotide
  Target: SCN9A; (+) strand; PAM type: NRG; PAM sequence: CAG
agatgaatgaatgagtgaat

SEQ ID NO: 44782 - DNA, 20 bp, Artificial Sequence
  Description of Artificial Sequence: Synthetic oligonucleotide
  Target: SCN9A; (+) strand; PAM type: NRG; PAM sequence: AGG
gatgaatgaatgagtgaatc

SEQ ID NO: 44783 - DNA, 20 bp, Artificial Sequence
  Description of Artificial Sequence: Synthetic oligonucleotide
  Target: SCN9A; (+) strand; PAM type: NRG; PAM sequence: GAG
gaatgcttgttcctctgcct

SEQ ID NO: 44784 - DNA, 20 bp, Artificial Sequence
  Description of Artificial Sequence: Synthetic oligonucleotide
  Target: SCN9A; (+) strand; PAM type: NRG; PAM sequence: CAG
ccttctgtaccacatctgcc

SEQ ID NO: 44785 - DNA, 20 bp, Artificial Sequence
  Description of Artificial Sequence: Synthetic oligonucleotide
  Target: SCN9A; (+) strand; PAM type: NRG; PAM sequence: AAG
tgaaattttctccatactgt

SEQ ID NO: 44786 - DNA, 20 bp, Artificial Sequence
  Description of Artificial Sequence: Synthetic oligonucleotide
  Target: SCN9A; (+) strand; PAM type: NRG; PAM sequence: AGG
gaaattttctccatactgta

SEQ ID NO: 44787 - DNA, 20 bp, Artificial Sequence
  Description of Artificial Sequence: Synthetic oligonucleotide
  Target: SCN9A; (+) strand; PAM type: NRG; PAM sequence: TGG
tttctccatactgtaaggtc

SEQ ID NO: 44788 - DNA, 20 bp, Artificial Sequence
  Description of Artificial Sequence: Synthetic oligonucleotide
  Target: SCN9A; (+) strand; PAM type: NRG; PAM sequence: AAG
catactgtaaggtctggtct

SEQ ID NO: 44789 - DNA, 20 bp, Artificial Sequence
  Description of Artificial Sequence: Synthetic oligonucleotide
  Target: SCN9A; (+) strand; PAM type: NRG; PAM sequence: AAG
gtgccacctcctttcatgtg

SEQ ID NO: 44790 - DNA, 20 bp, Artificial Sequence
  Description of Artificial Sequence: Synthetic oligonucleotide
  Target: SCN9A; (+) strand; PAM type: NRG; PAM sequence: CAG
cacctcctttcatgtgaagt

SEQ ID NO: 44791 - DNA, 20 bp, Artificial Sequence
  Description of Artificial Sequence: Synthetic oligonucleotide
  Target: SCN9A; (+) strand; PAM type: NRG; PAM sequence: CAG
tcctttcatgtgaagtcagc

SEQ ID NO: 44792 - DNA, 20 bp, Artificial Sequence
  Description of Artificial Sequence: Synthetic oligonucleotide
  Target: SCN9A; (+) strand; PAM type: NRG; PAM sequence: CAG
catgtgaagtcagccagata

SEQ ID NO: 44793 - DNA, 20 bp, Artificial Sequence
  Description of Artificial Sequence: Synthetic oligonucleotide
  Target: SCN9A; (+) strand; PAM type: NRG; PAM sequence: TGG
cttactcaatgcatcctcaa

SEQ ID NO: 44794 - DNA, 20 bp, Artificial Sequence
  Description of Artificial Sequence: Synthetic oligonucleotide
  Target: SCN9A; (+) strand; PAM type: NRG; PAM sequence: TAG
tcaatgcatcctcaatggac

SEQ ID NO: 44795 - DNA, 20 bp, Artificial Sequence
  Description of Artificial Sequence: Synthetic oligonucleotide
  Target: SCN9A; (+) strand; PAM type: NRG; PAM sequence: TAG
gcatcctcaatggactagtt

SEQ ID NO: 44796 - DNA, 20 bp, Artificial Sequence
  Description of Artificial Sequence: Synthetic oligonucleotide
  Target: SCN9A; (+) strand; PAM type: NRG; PAM sequence: CGG
actagtttagtgtcctgtta

SEQ ID NO: 44797 - DNA, 20 bp, Artificial Sequence
  Description of Artificial Sequence: Synthetic oligonucleotide
  Target: SCN9A; (+) strand; PAM type: NRG; PAM sequence: AAG
aattttttgtatatttacct

SEQ ID NO: 44798 - DNA, 20 bp, Artificial Sequence
  Description of Artificial Sequence: Synthetic oligonucleotide
  Target: SCN9A; (+) strand; PAM type: NRG; PAM sequence: AGG
attttttgtatatttaccta

SEQ ID NO: 44799 - DNA, 20 bp, Artificial Sequence
  Description of Artificial Sequence: Synthetic oligonucleotide
  Target: SCN9A; (+) strand; PAM type: NRG; PAM sequence: AAG
tgtatatttacctaaggtgc

SEQ ID NO: 44800 - DNA, 20 bp, Artificial Sequence
  Description of Artificial Sequence: Synthetic oligonucleotide
  Target: SCN9A; (+) strand; PAM type: NRG; PAM sequence: TAG
ttacctaaggtgcaagctat

SEQ ID NO: 44801 - DNA, 20 bp, Artificial Sequence
  Description of Artificial Sequence: Synthetic oligonucleotide
  Target: SCN9A; (+) strand; PAM type: NRG; PAM sequence: GAG
acctaaggtgcaagctatta

SEQ ID NO: 44802 - DNA, 20 bp, Artificial Sequence
  Description of Artificial Sequence: Synthetic oligonucleotide
  Target: SCN9A; (+) strand; PAM type: NRG; PAM sequence: AAG
tcaatcaccctttacctttg

SEQ ID NO: 44803 - DNA, 20 bp, Artificial Sequence
  Description of Artificial Sequence: Synthetic oligonucleotide
  Target: SCN9A; (+) strand; PAM type: NRG; PAM sequence: AAG
ctttacctttgaagtacatg

SEQ ID NO: 44804 - DNA, 20 bp, Artificial Sequence
  Description of Artificial Sequence: Synthetic oligonucleotide
  Target: SCN9A; (+) strand; PAM type: NRG; PAM sequence: TAG
tttgaagtacatgaagtttt

SEQ ID NO: 44805 - DNA, 20 bp, Artificial Sequence
  Description of Artificial Sequence: Synthetic oligonucleotide
  Target: SCN9A; (+) strand; PAM type: NRG; PAM sequence: TGG
agtacatgaagtttttagtg

SEQ ID NO: 44806 - DNA, 20 bp, Artificial Sequence
  Description of Artificial Sequence: Synthetic oligonucleotide
  Target: SCN9A; (+) strand; PAM type: NRG; PAM sequence: TGG
gaagtttttagtgtggtttt

SEQ ID NO: 44807 - DNA, 20 bp, Artificial Sequence
  Description of Artificial Sequence: Synthetic oligonucleotide
  Target: SCN9A; (+) strand; PAM type: NRG; PAM sequence: GGG
aagtttttagtgtggttttt

SEQ ID NO: 44808 - DNA, 20 bp, Artificial Sequence
  Description of Artificial Sequence: Synthetic oligonucleotide
  Target: SCN9A; (+) strand; PAM type: NRG; PAM sequence: GGG
agtttttagtgtggtttttg

SEQ ID NO: 44809 - DNA, 20 bp, Artificial Sequence
  Description of Artificial Sequence: Synthetic oligonucleotide
  Target: SCN9A; (+) strand; PAM type: NRG; PAM sequence: GGG
gtttttagtgtggtttttgg

SEQ ID NO: 44810 - DNA, 20 bp, Artificial Sequence
  Description of Artificial Sequence: Synthetic oligonucleotide
  Target: SCN9A; (+) strand; PAM type: NRG; PAM sequence: TAG
tttgggggactcaatattta

SEQ ID NO: 44811 - DNA, 20 bp, Artificial Sequence
  Description of Artificial Sequence: Synthetic oligonucleotide
  Target: SCN9A; (+) strand; PAM type: NRG; PAM sequence: AGG
ttgggggactcaatatttat

SEQ ID NO: 44812 - DNA, 20 bp, Artificial Sequence
  Description of Artificial Sequence: Synthetic oligonucleotide
  Target: SCN9A; (+) strand; PAM type: NRG; PAM sequence: GGG
tgggggactcaatatttata

SEQ ID NO: 44813 - DNA, 20 bp, Artificial Sequence
  Description of Artificial Sequence: Synthetic oligonucleotide
  Target: SCN9A; (+) strand; PAM type: NRG; PAM sequence: GGG
gggggactcaatatttatag

SEQ ID NO: 44814 - DNA, 20 bp, Artificial Sequence
  Description of Artificial Sequence: Synthetic oligonucleotide
  Target: SCN9A; (+) strand; PAM type: NRG; PAM sequence: GGG
ggggactcaatatttatagg

SEQ ID NO: 44815 - DNA, 20 bp, Artificial Sequence
  Description of Artificial Sequence: Synthetic oligonucleotide
  Target: SCN9A; (+) strand; PAM type: NRG; PAM sequence: GAG
gggggccaaaaatatttcat

SEQ ID NO: 44816 - DNA, 20 bp, Artificial Sequence
  Description of Artificial Sequence: Synthetic oligonucleotide
  Target: SCN9A; (+) strand; PAM type: NRG; PAM sequence: TAG
aatatttcatgagtgtaatt

SEQ ID NO: 44817 - DNA, 20 bp, Artificial Sequence
  Description of Artificial Sequence: Synthetic oligonucleotide
  Target: SCN9A; (+) strand; PAM type: NRG; PAM sequence: AGG
atatttcatgagtgtaattt

SEQ ID NO: 44818 - DNA, 20 bp, Artificial Sequence
  Description of Artificial Sequence: Synthetic oligonucleotide
  Target: SCN9A; (+) strand; PAM type: NRG; PAM sequence: GAG
atttcatgagtgtaatttag

SEQ ID NO: 44819 - DNA, 20 bp, Artificial Sequence
  Description of Artificial Sequence: Synthetic oligonucleotide
  Target: SCN9A; (+) strand; PAM type: NRG; PAM sequence: GAG
ttcatgagtgtaatttagga

SEQ ID NO: 44820 - DNA, 20 bp, Artificial Sequence
  Description of Artificial Sequence: Synthetic oligonucleotide
  Target: SCN9A; (+) strand; PAM type: NRG; PAM sequence: TGG
ctctatgcctattataattc

SEQ ID NO: 44821 - DNA, 20 bp, Artificial Sequence
  Description of Artificial Sequence: Synthetic oligonucleotide
  Target: SCN9A; (+) strand; PAM type: NRG; PAM sequence: GGG
tctatgcctattataattct

SEQ ID NO: 44822 - DNA, 20 bp, Artificial Sequence
  Description of Artificial Sequence: Synthetic oligonucleotide
  Target: SCN9A; (+) strand; PAM type: NRG; PAM sequence: CAG
atgcctattataattctggg

SEQ ID NO: 44823 - DNA, 20 bp, Artificial Sequence
  Description of Artificial Sequence: Synthetic oligonucleotide
  Target: SCN9A; (+) strand; PAM type: NRG; PAM sequence: GAG
gcctattataattctgggca

SEQ ID NO: 44824 - DNA, 20 bp, Artificial Sequence
  Description of Artificial Sequence: Synthetic oligonucleotide
  Target: SCN9A; (+) strand; PAM type: NRG; PAM sequence: GAG
ctattataattctgggcaga

SEQ ID NO: 44825 - DNA, 20 bp, Artificial Sequence
  Description of Artificial Sequence: Synthetic oligonucleotide
  Target: SCN9A; (+) strand; PAM type: NRG; PAM sequence: TAG
taattctgggcagagagtca

SEQ ID NO: 44826 - DNA, 20 bp, Artificial Sequence
  Description of Artificial Sequence: Synthetic oligonucleotide
  Target: SCN9A; (+) strand; PAM type: NRG; PAM sequence: AAG
tctctactatgcacaaataa

SEQ ID NO: 44827 - DNA, 20 bp, Artificial Sequence
  Description of Artificial Sequence: Synthetic oligonucleotide
  Target: SCN9A; (+) strand; PAM type: NRG; PAM sequence: CAG
atgaataaaatatctgtgtt

SEQ ID NO: 44828 - DNA, 20 bp, Artificial Sequence
  Description of Artificial Sequence: Synthetic oligonucleotide
  Target: SCN9A; (+) strand; PAM type: NRG; PAM sequence: AAG
aacataatatttatgtaatt

SEQ ID NO: 44829 - DNA, 20 bp, Artificial Sequence
  Description of Artificial Sequence: Synthetic oligonucleotide
  Target: SCN9A; (+) strand; PAM type: NRG; PAM sequence: AAG
tatttatgtaattaagaaat

SEQ ID NO: 44830 - DNA, 20 bp, Artificial Sequence
  Description of Artificial Sequence: Synthetic oligonucleotide
  Target: SCN9A; (+) strand; PAM type: NRG; PAM sequence: CAG
aattaagaaataagattata

SEQ ID NO: 44831 - DNA, 20 bp, Artificial Sequence
  Description of Artificial Sequence: Synthetic oligonucleotide
  Target: SCN9A; (+) strand; PAM type: NRG; PAM sequence: AGG
attaagaaataagattatac

SEQ ID NO: 44832 - DNA, 20 bp, Artificial Sequence
  Description of Artificial Sequence: Synthetic oligonucleotide
  Target: SCN9A; (+) strand; PAM type: NRG; PAM sequence: TAG
aagaaataagattatacagg

SEQ ID NO: 44833 - DNA, 20 bp, Artificial Sequence
  Description of Artificial Sequence: Synthetic oligonucleotide
  Target: SCN9A; (+) strand; PAM type: NRG; PAM sequence: AAG
aagattatacaggtagaatg

SEQ ID NO: 44834 - DNA, 20 bp, Artificial Sequence
  Description of Artificial Sequence: Synthetic oligonucleotide
  Target: SCN9A; (+) strand; PAM type: NRG; PAM sequence: GAG
ttatgcctttgtattatgtt

SEQ ID NO: 44835 - DNA, 20 bp, Artificial Sequence
  Description of Artificial Sequence: Synthetic oligonucleotide
  Target: SCN9A; (+) strand; PAM type: NRG; PAM sequence: TAG
gttgagccacatgaaatttc

SEQ ID NO: 44836 - DNA, 20 bp, Artificial Sequence
  Description of Artificial Sequence: Synthetic oligonucleotide
  Target: SCN9A; (+) strand; PAM type: NRG; PAM sequence: CAG
catgaaatttctagtttttg

SEQ ID NO: 44837 - DNA, 20 bp, Artificial Sequence
  Description of Artificial Sequence: Synthetic oligonucleotide
  Target: SCN9A; (+) strand; PAM type: NRG; PAM sequence: TGG
tagtttttgcagattaaaaa

SEQ ID NO: 44838 - DNA, 20 bp, Artificial Sequence
  Description of Artificial Sequence: Synthetic oligonucleotide
  Target: SCN9A; (+) strand; PAM type: NRG; PAM sequence: TGG
ttttgcagattaaaaatggt

SEQ ID NO: 44839 - DNA, 20 bp, Artificial Sequence
  Description of Artificial Sequence: Synthetic oligonucleotide
  Target: SCN9A; (+) strand; PAM type: NRG; PAM sequence: TAG
attaaaaatggttggatatt

SEQ ID NO: 44840 - DNA, 20 bp, Artificial Sequence
  Description of Artificial Sequence: Synthetic oligonucleotide
  Target: SCN9A; (+) strand; PAM type: NRG; PAM sequence: AAG
tatatattttctaattcaat

SEQ ID NO: 44841 - DNA, 20 bp, Artificial Sequence
  Description of Artificial Sequence: Synthetic oligonucleotide
  Target: SCN9A; (+) strand; PAM type: NRG; PAM sequence: TGG
aaaaattaacttttgttttt

SEQ ID NO: 44842 - DNA, 20 bp, Artificial Sequence
  Description of Artificial Sequence: Synthetic oligonucleotide
  Target: SCN9A; (+) strand; PAM type: NRG; PAM sequence: AAG
attttatacaatatgtttca

SEQ ID NO: 44843 - DNA, 20 bp, Artificial Sequence
  Description of Artificial Sequence: Synthetic oligonucleotide
  Target: SCN9A; (+) strand; PAM type: NRG; PAM sequence: TAG
atattattccaaattatgcc

SEQ ID NO: 44844 - DNA, 20 bp, Artificial Sequence
  Description of Artificial Sequence: Synthetic oligonucleotide
  Target: SCN9A; (+) strand; PAM type: NRG; PAM sequence: TAG
agtaactgcatctcttaaaa

SEQ ID NO: 44845 - DNA, 20 bp, Artificial Sequence
  Description of Artificial Sequence: Synthetic oligonucleotide
  Target: SCN9A; (+) strand; PAM type: NRG; PAM sequence: AAG
attcttttgacattttcata

SEQ ID NO: 44846 - DNA, 20 bp, Artificial Sequence
  Description of Artificial Sequence: Synthetic oligonucleotide
  Target: SCN9A; (+) strand; PAM type: NRG; PAM sequence: AGG
ttcttttgacattttcataa

SEQ ID NO: 44847 - DNA, 20 bp, Artificial Sequence
  Description of Artificial Sequence: Synthetic oligonucleotide
  Target: SCN9A; (+) strand; PAM type: NRG; PAM sequence: TAG
cataaaggaataataataat

SEQ ID NO: 44848 - DNA, 20 bp, Artificial Sequence
  Description of Artificial Sequence: Synthetic oligonucleotide
  Target: SCN9A; (+) strand; PAM type: NRG; PAM sequence: TAG
aaaggaataataataattag

SEQ ID NO: 44849 - DNA, 20 bp, Artificial Sequence
  Description of Artificial Sequence: Synthetic oligonucleotide
  Target: SCN9A; (+) strand; PAM type: NRG; PAM sequence: CAG
ggaataataataattagtag

SEQ ID NO: 44850 - DNA, 20 bp, Artificial Sequence
  Description of Artificial Sequence: Synthetic oligonucleotide
  Target: SCN9A; (+) strand; PAM type: NRG; PAM sequence: TAG
ataataataattagtagcag

SEQ ID NO: 44851 - DNA, 20 bp, Artificial Sequence
  Description of Artificial Sequence: Synthetic oligonucleotide
  Target: SCN9A; (+) strand; PAM type: NRG; PAM sequence: TGG
attagtagcagtagtaatat

SEQ ID NO: 44852 - DNA, 20 bp, Artificial Sequence
  Description of Artificial Sequence: Synthetic oligonucleotide
  Target: SCN9A; (+) strand; PAM type: NRG; PAM sequence: GAG
tagtagcagtagtaatattg

SEQ ID NO: 44853 - DNA, 20 bp, Artificial Sequence
  Description of Artificial Sequence: Synthetic oligonucleotide
  Target: SCN9A; (+) strand; PAM type: NRG; PAM sequence: AAG
tagcagtagtaatattggag

SEQ ID NO: 44854 - DNA, 20 bp, Artificial Sequence
  Description of Artificial Sequence: Synthetic oligonucleotide
  Target: SCN9A; (+) strand; PAM type: NRG; PAM sequence: AAG
tgaccttgttaataccttcc

SEQ ID NO: 44855 - DNA, 20 bp, Artificial Sequence
  Description of Artificial Sequence: Synthetic oligonucleotide
  Target: SCN9A; (+) strand; PAM type: NRG; PAM sequence: AGG
gaccttgttaataccttcca

SEQ ID NO: 44856 - DNA, 20 bp, Artificial Sequence
  Description of Artificial Sequence: Synthetic oligonucleotide
  Target: SCN9A; (+) strand; PAM type: NRG; PAM sequence: AAG
accttccaaggtatcttacc

SEQ ID NO: 44857 - DNA, 20 bp, Artificial Sequence
  Description of Artificial Sequence: Synthetic oligonucleotide
  Target: SCN9A; (+) strand; PAM type: NRG; PAM sequence: GAG
cttccaaggtatcttaccaa

SEQ ID NO: 44858 - DNA, 20 bp, Artificial Sequence
  Description of Artificial Sequence: Synthetic oligonucleotide
  Target: SCN9A; (+) strand; PAM type: NRG; PAM sequence: CAG
ggtatcttaccaagagaatc

SEQ ID NO: 44859 - DNA, 20 bp, Artificial Sequence
  Description of Artificial Sequence: Synthetic oligonucleotide
  Target: SCN9A; (+) strand; PAM type: NRG; PAM sequence: CAG
aagagaatccagattttatt

SEQ ID NO: 44860 - DNA, 20 bp, Artificial Sequence
  Description of Artificial Sequence: Synthetic oligonucleotide
  Target: SCN9A; (+) strand; PAM type: NRG; PAM sequence: AGG
agagaatccagattttattc

SEQ ID NO: 44861 - DNA, 20 bp, Artificial Sequence
  Description of Artificial Sequence: Synthetic oligonucleotide
  Target: SCN9A; (+) strand; PAM type: NRG; PAM sequence: GGG
gagaatccagattttattca

SEQ ID NO: 44862 - DNA, 20 bp, Artificial Sequence
  Description of Artificial Sequence: Synthetic oligonucleotide
  Target: SCN9A; (+) strand; PAM type: NRG; PAM sequence: TAG
aatccagattttattcaggg

SEQ ID NO: 44863 - DNA, 20 bp, Artificial Sequence
  Description of Artificial Sequence: Synthetic oligonucleotide
  Target: SCN9A; (+) strand; PAM type: NRG; PAM sequence: CAG
attcagggtagcaatatgcc

SEQ ID NO: 44864 - DNA, 20 bp, Artificial Sequence
  Description of Artificial Sequence: Synthetic oligonucleotide
  Target: SCN9A; (+) strand; PAM type: NRG; PAM sequence: CAG
cccagataaatgtcctgcct

SEQ ID NO: 44865 - DNA, 20 bp, Artificial Sequence
  Description of Artificial Sequence: Synthetic oligonucleotide
  Target: SCN9A; (+) strand; PAM type: NRG; PAM sequence: CAG
gataaatgtcctgcctcagc

SEQ ID NO: 44866 - DNA, 20 bp, Artificial Sequence
  Description of Artificial Sequence: Synthetic oligonucleotide
  Target: SCN9A; (+) strand; PAM type: NRG; PAM sequence: AGG
ataaatgtcctgcctcagcc

SEQ ID NO: 44867 - DNA, 20 bp, Artificial Sequence
  Description of Artificial Sequence: Synthetic oligonucleotide
  Target: SCN9A; (+) strand; PAM type: NRG; PAM sequence: TAG
cagccaggctaccttgttgt

SEQ ID NO: 44868 - DNA, 20 bp, Artificial Sequence
  Description of Artificial Sequence: Synthetic oligonucleotide
  Target: SCN9A; (+) strand; PAM type: NRG; PAM sequence: AGG
agccaggctaccttgttgtt

SEQ ID NO: 44869 - DNA, 20 bp, Artificial Sequence
  Description of Artificial Sequence: Synthetic oligonucleotide
  Target: SCN9A; (+) strand; PAM type: NRG; PAM sequence: GGG
gccaggctaccttgttgtta

SEQ ID NO: 44870 - DNA, 20 bp, Artificial Sequence
  Description of Artificial Sequence: Synthetic oligonucleotide
  Target: SCN9A; (+) strand; PAM type: NRG; PAM sequence: GGG
ccaggctaccttgttgttag

SEQ ID NO: 44871 - DNA, 20 bp, Artificial Sequence
  Description of Artificial Sequence: Synthetic oligonucleotide
  Target: SCN9A; (+) strand; PAM type: NRG; PAM sequence: TGG
ggctaccttgttgttagggg

SEQ ID NO: 44872 - DNA, 20 bp, Artificial Sequence
  Description of Artificial Sequence: Synthetic oligonucleotide
  Target: SCN9A; (+) strand; PAM type: NRG; PAM sequence: AAG
gtcacactgttcttgccaat

SEQ ID NO: 44873 - DNA, 20 bp, Artificial Sequence
  Description of Artificial Sequence: Synthetic oligonucleotide
  Target: SCN9A; (+) strand; PAM type: NRG; PAM sequence: AAG
tgttcttgccaataagacat

SEQ ID NO: 44874 - DNA, 20 bp, Artificial Sequence
  Description of Artificial Sequence: Synthetic oligonucleotide
  Target: SCN9A; (+) strand; PAM type: NRG; PAM sequence: AAG
tgccaataagacataagcca

SEQ ID NO: 44875 - DNA, 20 bp, Artificial Sequence
  Description of Artificial Sequence: Synthetic oligonucleotide
  Target: SCN9A; (+) strand; PAM type: NRG; PAM sequence: TGG
aataagacataagccaaagt

SEQ ID NO: 44876 - DNA, 20 bp, Artificial Sequence
  Description of Artificial Sequence: Synthetic oligonucleotide
  Target: SCN9A; (+) strand; PAM type: NRG; PAM sequence: AAG
gacataagccaaagttggat

SEQ ID NO: 44877 - DNA, 20 bp, Artificial Sequence
  Description of Artificial Sequence: Synthetic oligonucleotide
  Target: SCN9A; (+) strand; PAM type: NRG; PAM sequence: AGG
acataagccaaagttggata

SEQ ID NO: 44878 - DNA, 20 bp, Artificial Sequence
  Description of Artificial Sequence: Synthetic oligonucleotide
  Target: SCN9A; (+) strand; PAM type: NRG; PAM sequence: TGG
caaagttggataaggatctc

SEQ ID NO: 44879 - DNA, 20 bp, Artificial Sequence
  Description of Artificial Sequence: Synthetic oligonucleotide
  Target: SCN9A; (+) strand; PAM type: NRG; PAM sequence: GGG
aaagttggataaggatctct

SEQ ID NO: 44880 - DNA, 20 bp, Artificial Sequence
  Description of Artificial Sequence: Synthetic oligonucleotide
  Target: SCN9A; (+) strand; PAM type: NRG; PAM sequence: AAG
ttggataaggatctctggga

SEQ ID NO: 44881 - DNA, 20 bp, Artificial Sequence
  Description of Artificial Sequence: Synthetic oligonucleotide
  Target: SCN9A; (+) strand; PAM type: NRG; PAM sequence: CAG
gggaaagttttgcccttcct

SEQ ID NO: 44882 - DNA, 20 bp, Artificial Sequence
  Description of Artificial Sequence: Synthetic oligonucleotide
  Target: SCN9A; (+) strand; PAM type: NRG; PAM sequence: AGG
ggaaagttttgcccttcctc

SEQ ID NO: 44883 - DNA, 20 bp, Artificial Sequence
  Description of Artificial Sequence: Synthetic oligonucleotide
  Target: SCN9A; (+) strand; PAM type: NRG; PAM sequence: AAG
agttttgcccttcctcaggc

SEQ ID NO: 44884 - DNA, 20 bp, Artificial Sequence
  Description of Artificial Sequence: Synthetic oligonucleotide
  Target: SCN9A; (+) strand; PAM type: NRG; PAM sequence: TGG
tttgcccttcctcaggcaag

SEQ ID NO: 44885 - DNA, 20 bp, Artificial Sequence
  Description of Artificial Sequence: Synthetic oligonucleotide
  Target: SCN9A; (+) strand; PAM type: NRG; PAM sequence: GGG
ttgcccttcctcaggcaagt

SEQ ID NO: 44886 - DNA, 20 bp, Artificial Sequence
  Description of Artificial Sequence: Synthetic oligonucleotide
  Target: SCN9A; (+) strand; PAM type: NRG; PAM sequence: TAG
ccttcctcaggcaagtggga

SEQ ID NO: 44887 - DNA, 20 bp, Artificial Sequence
  Description of Artificial Sequence: Synthetic oligonucleotide
  Target: SCN9A; (+) strand; PAM type: NRG; PAM sequence: TGG
gttctatttctttctctacc

SEQ ID NO: 44888 - DNA, 20 bp, Artificial Sequence
  Description of Artificial Sequence: Synthetic oligonucleotide
  Target: SCN9A; (+) strand; PAM type: NRG; PAM sequence: GGG
ttctatttctttctctacct

SEQ ID NO: 44889 - DNA, 20 bp, Artificial Sequence
  Description of Artificial Sequence: Synthetic oligonucleotide
  Target: SCN9A; (+) strand; PAM type: NRG; PAM sequence: TGG
ttctttctctacctgggtat

SEQ ID NO: 44890 - DNA, 20 bp, Artificial Sequence
  Description of Artificial Sequence: Synthetic oligonucleotide
  Target: SCN9A; (+) strand; PAM type: NRG; PAM sequence: AAG
ctacctgggtattggatata

SEQ ID NO: 44891 - DNA, 20 bp, Artificial Sequence
  Description of Artificial Sequence: Synthetic oligonucleotide
  Target: SCN9A; (+) strand; PAM type: NRG; PAM sequence: TAG
gggtattggatataaagctg

SEQ ID NO: 44892 - DNA, 20 bp, Artificial Sequence
  Description of Artificial Sequence: Synthetic oligonucleotide
  Target: SCN9A; (+) strand; PAM type: NRG; PAM sequence: AGG
ggtattggatataaagctgt

SEQ ID NO: 44893 - DNA, 20 bp, Artificial Sequence
  Description of Artificial Sequence: Synthetic oligonucleotide
  Target: SCN9A; (+) strand; PAM type: NRG; PAM sequence: TGG
attggatataaagctgtagg

SEQ ID NO: 44894 - DNA, 20 bp, Artificial Sequence
  Description of Artificial Sequence: Synthetic oligonucleotide
  Target: SCN9A; (+) strand; PAM type: NRG; PAM sequence: CAG
atataaagctgtaggtggaa

SEQ ID NO: 44895 - DNA, 20 bp, Artificial Sequence
  Description of Artificial Sequence: Synthetic oligonucleotide
  Target: SCN9A; (+) strand; PAM type: NRG; PAM sequence: TAG
ggaacagtcacctctaatca

SEQ ID NO: 44896 - DNA, 20 bp, Artificial Sequence
  Description of Artificial Sequence: Synthetic oligonucleotide
  Target: SCN9A; (+) strand; PAM type: NRG; PAM sequence: AGG
gaacagtcacctctaatcat

SEQ ID NO: 44897 - DNA, 20 bp, Artificial Sequence
  Description of Artificial Sequence: Synthetic oligonucleotide
  Target: SCN9A; (+) strand; PAM type: NRG; PAM sequence: TAG
tctaatcataggcattaata

SEQ ID NO: 44898 - DNA, 20 bp, Artificial Sequence
  Description of Artificial Sequence: Synthetic oligonucleotide
  Target: SCN9A; (+) strand; PAM type: NRG; PAM sequence: AAG
aatcataggcattaatatag

SEQ ID NO: 44899 - DNA, 20 bp, Artificial Sequence
  Description of Artificial Sequence: Synthetic oligonucleotide
  Target: SCN9A; (+) strand; PAM type: NRG; PAM sequence: AAG
tagaagaaaaaacacatgtg

SEQ ID NO: 44900 - DNA, 20 bp, Artificial Sequence
  Description of Artificial Sequence: Synthetic oligonucleotide
  Target: SCN9A; (+) strand; PAM type: NRG; PAM sequence: TGG
gaaaaaacacatgtgaagat

SEQ ID NO: 44901 - DNA, 20 bp, Artificial Sequence
  Description of Artificial Sequence: Synthetic oligonucleotide
  Target: SCN9A; (+) strand; PAM type: NRG; PAM sequence: CAG
aaaacacatgtgaagattgg

SEQ ID NO: 44902 - DNA, 20 bp, Artificial Sequence
  Description of Artificial Sequence: Synthetic oligonucleotide
  Target: SCN9A; (+) strand; PAM type: NRG; PAM sequence: AAG
acacatgtgaagattggcag

SEQ ID NO: 44903 - DNA, 20 bp, Artificial Sequence
  Description of Artificial Sequence: Synthetic oligonucleotide
  Target: SCN9A; (+) strand; PAM type: NRG; PAM sequence: AGG
cacatgtgaagattggcaga

SEQ ID NO: 44904 - DNA, 20 bp, Artificial Sequence
  Description of Artificial Sequence: Synthetic oligonucleotide
  Target: SCN9A; (+) strand; PAM type: NRG; PAM sequence: GGG
acatgtgaagattggcagaa

SEQ ID NO: 44905 - DNA, 20 bp, Artificial Sequence
  Description of Artificial Sequence: Synthetic oligonucleotide
  Target: SCN9A; (+) strand; PAM type: NRG; PAM sequence: GAG
atgtgaagattggcagaagg

SEQ ID NO: 44906 - DNA, 20 bp, Artificial Sequence
  Description of Artificial Sequence: Synthetic oligonucleotide
  Target: SCN9A; (+) strand; PAM type: NRG; PAM sequence: AAG
tgaagattggcagaagggag

SEQ ID NO: 44907 - DNA, 20 bp, Artificial Sequence
  Description of Artificial Sequence: Synthetic oligonucleotide
  Target: SCN9A; (+) strand; PAM type: NRG; PAM sequence: GAG
aagattggcagaagggagaa

SEQ ID NO: 44908 - DNA, 20 bp, Artificial Sequence
  Description of Artificial Sequence: Synthetic oligonucleotide
  Target: SCN9A; (+) strand; PAM type: NRG; PAM sequence: TGG
ttggcagaagggagaagaga

SEQ ID NO: 44909 - DNA, 20 bp, Artificial Sequence
  Description of Artificial Sequence: Synthetic oligonucleotide
  Target: SCN9A; (+) strand; PAM type: NRG; PAM sequence: GAG
ggcagaagggagaagagatg

SEQ ID NO: 44910 - DNA, 20 bp, Artificial Sequence
  Description of Artificial Sequence: Synthetic oligonucleotide
  Target: SCN9A; (+) strand; PAM type: NRG; PAM sequence: TAG
aagggagaagagatggagcc

SEQ ID NO: 44911 - DNA, 20 bp, Artificial Sequence
  Description of Artificial Sequence: Synthetic oligonucleotide
  Target: SCN9A; (+) strand; PAM type: NRG; PAM sequence: AGG
agggagaagagatggagcct

SEQ ID NO: 44912 - DNA, 20 bp, Artificial Sequence
  Description of Artificial Sequence: Synthetic oligonucleotide
  Target: SCN9A; (+) strand; PAM type: NRG; PAM sequence: TGG
aagagatggagcctaggaca

SEQ ID NO: 44913 - DNA, 20 bp, Artificial Sequence
  Description of Artificial Sequence: Synthetic oligonucleotide
  Target: SCN9A; (+) strand; PAM type: NRG; PAM sequence: GAG
gagatggagcctaggacatg

SEQ ID NO: 44914 - DNA, 20 bp, Artificial Sequence
  Description of Artificial Sequence: Synthetic oligonucleotide
  Target: SCN9A; (+) strand; PAM type: NRG; PAM sequence: AGG
agatggagcctaggacatgg

SEQ ID NO: 44915 - DNA, 20 bp, Artificial Sequence
  Description of Artificial Sequence: Synthetic oligonucleotide
  Target: SCN9A; (+) strand; PAM type: NRG; PAM sequence: TGG
cctaggacatggaggccacg

SEQ ID NO: 44916 - DNA, 20 bp, Artificial Sequence
  Description of Artificial Sequence: Synthetic oligonucleotide
  Target: SCN9A; (+) strand; PAM type: NRG; PAM sequence: TGG
ccacgtggactgctgatctg

SEQ ID NO: 44917 - DNA, 20 bp, Artificial Sequence
  Description of Artificial Sequence: Synthetic oligonucleotide
  Target: SCN9A; (+) strand; PAM type: NRG; PAM sequence: CAG
gatgttttaaaatatgaaaa

SEQ ID NO: 44918 - DNA, 20 bp, Artificial Sequence
  Description of Artificial Sequence: Synthetic oligonucleotide
  Target: SCN9A; (+) strand; PAM type: NRG; PAM sequence: CAG
tgaaaacagaatgttctatc

SEQ ID NO: 44919 - DNA, 20 bp, Artificial Sequence
  Description of Artificial Sequence: Synthetic oligonucleotide
  Target: SCN9A; (+) strand; PAM type: NRG; PAM sequence: TAG
tctatccagttatgccaatg

SEQ ID NO: 44920 - DNA, 20 bp, Artificial Sequence
  Description of Artificial Sequence: Synthetic oligonucleotide
  Target: SCN9A; (+) strand; PAM type: NRG; PAM sequence: AAG
ccagttatgccaatgtagtt

SEQ ID NO: 44921 - DNA, 20 bp, Artificial Sequence
  Description of Artificial Sequence: Synthetic oligonucleotide
  Target: SCN9A; (+) strand; PAM type: NRG; PAM sequence: CAG
agttaagtctctgttgcatg

SEQ ID NO: 44922 - DNA, 20 bp, Artificial Sequence
  Description of Artificial Sequence: Synthetic oligonucleotide
  Target: SCN9A; (+) strand; PAM type: NRG; PAM sequence: CAG
ctctgttgcatgcagttaaa

SEQ ID NO: 44923 - DNA, 20 bp, Artificial Sequence
  Description of Artificial Sequence: Synthetic oligonucleotide
  Target: SCN9A; (+) strand; PAM type: NRG; PAM sequence: GAG
ctgttgcatgcagttaaaca

SEQ ID NO: 44924 - DNA, 20 bp, Artificial Sequence
  Description of Artificial Sequence: Synthetic oligonucleotide
  Target: SCN9A; (+) strand; PAM type: NRG; PAM sequence: CAG
agttaaacagagtcctgact

SEQ ID NO: 44925 - DNA, 20 bp, Artificial Sequence
  Description of Artificial Sequence: Synthetic oligonucleotide
  Target: SCN9A; (+) strand; PAM type: NRG; PAM sequence: TAG
acagagtcctgactcagaaa

SEQ ID NO: 44926 - DNA, 20 bp, Artificial Sequence
  Description of Artificial Sequence: Synthetic oligonucleotide
  Target: SCN9A; (+) strand; PAM type: NRG; PAM sequence: TAG
aaaacacacacacaaaaaaa

SEQ ID NO: 44927 - DNA, 20 bp, Artificial Sequence
  Description of Artificial Sequence: Synthetic oligonucleotide
  Target: SCN9A; (+) strand; PAM type: NRG; PAM sequence: AGG
aaacacacacacaaaaaaat

SEQ ID NO: 44928 - DNA, 20 bp, Artificial Sequence
  Description of Artificial Sequence: Synthetic oligonucleotide
  Target: SCN9A; (+) strand; PAM type: NRG; PAM sequence: GGG
aacacacacacaaaaaaata

SEQ ID NO: 44929 - DNA, 20 bp, Artificial Sequence
  Description of Artificial Sequence: Synthetic oligonucleotide
  Target: SCN9A; (+) strand; PAM type: NRG; PAM sequence: AAG
gggattacccatgtaccctt

SEQ ID NO: 44930 - DNA, 20 bp, Artificial Sequence
  Description of Artificial Sequence: Synthetic oligonucleotide
  Target: SCN9A; (+) strand; PAM type: NRG; PAM sequence: TAG
ccatgtacccttaagtaaaa

SEQ ID NO: 44931 - DNA, 20 bp, Artificial Sequence
  Description of Artificial Sequence: Synthetic oligonucleotide
  Target: SCN9A; (+) strand; PAM type: NRG; PAM sequence: AGG
catgtacccttaagtaaaat

SEQ ID NO: 44932 - DNA, 20 bp, Artificial Sequence
  Description of Artificial Sequence: Synthetic oligonucleotide
  Target: SCN9A; (+) strand; PAM type: NRG; PAM sequence: TAG
gtaaaataggtttattcaaa

SEQ ID NO: 44933 - DNA, 20 bp, Artificial Sequence
  Description of Artificial Sequence: Synthetic oligonucleotide
  Target: SCN9A; (+) strand; PAM type: NRG; PAM sequence: AAG
ataggtttattcaaatagtt

SEQ ID NO: 44934 - DNA, 20 bp, Artificial Sequence
  Description of Artificial Sequence: Synthetic oligonucleotide
  Target: SCN9A; (+) strand; PAM type: NRG; PAM sequence: TGG
agatcttaacatgtgtacct

SEQ ID NO: 44935 - DNA, 20 bp, Artificial Sequence
  Description of Artificial Sequence: Synthetic oligonucleotide
  Target: SCN9A; (+) strand; PAM type: NRG; PAM sequence: TGG
ttaacatgtgtaccttggtg

SEQ ID NO: 44936 - DNA, 20 bp, Artificial Sequence
  Description of Artificial Sequence: Synthetic oligonucleotide
  Target: SCN9A; (+) strand; PAM type: NRG; PAM sequence: CAG
acatgtgtaccttggtgtgg

SEQ ID NO: 44937 - DNA, 20 bp, Artificial Sequence
  Description of Artificial Sequence: Synthetic oligonucleotide
  Target: SCN9A; (+) strand; PAM type: NRG; PAM sequence: AAG
gtgtaccttggtgtggcagt

SEQ ID NO: 44938 - DNA, 20 bp, Artificial Sequence
  Description of Artificial Sequence: Synthetic oligonucleotide
  Target: SCN9A; (+) strand; PAM type: NRG; PAM sequence: TAG
gtggcagtaagtgtactccc

SEQ ID NO: 44939 - DNA, 20 bp, Artificial Sequence
  Description of Artificial Sequence: Synthetic oligonucleotide
  Target: SCN9A; (+) strand; PAM type: NRG; PAM sequence: TAG
gtactccctagcccctaata

SEQ ID NO: 44940 - DNA, 20 bp, Artificial Sequence
  Description of Artificial Sequence: Synthetic oligonucleotide
  Target: SCN9A; (+) strand; PAM type: NRG; PAM sequence: AAG
ctaatatagccttaatgtga

SEQ ID NO: 44941 - DNA, 20 bp, Artificial Sequence
  Description of Artificial Sequence: Synthetic oligonucleotide
  Target: SCN9A; (+) strand; PAM type: NRG; PAM sequence: GAG
tctacttaatacattgtcct

SEQ ID NO: 44942 - DNA, 20 bp, Artificial Sequence
  Description of Artificial Sequence: Synthetic oligonucleotide
  Target: SCN9A; (+) strand; PAM type: NRG; PAM sequence: GAG
tacttaatacattgtcctga

SEQ ID NO: 44943 - DNA, 20 bp, Artificial Sequence
  Description of Artificial Sequence: Synthetic oligonucleotide
  Target: SCN9A; (+) strand; PAM type: NRG; PAM sequence: AAG
cattgtcctgagagaacaca

SEQ ID NO: 44944 - DNA, 20 bp, Artificial Sequence
  Description of Artificial Sequence: Synthetic oligonucleotide
  Target: SCN9A; (+) strand; PAM type: NRG; PAM sequence: AGG
attgtcctgagagaacacaa

SEQ ID NO: 44945 - DNA, 20 bp, Artificial Sequence
  Description of Artificial Sequence: Synthetic oligonucleotide
  Target: SCN9A; (+) strand; PAM type: NRG; PAM sequence: AAG
tgagagaacacaaaggttca

SEQ ID NO: 44946 - DNA, 20 bp, Artificial Sequence
  Description of Artificial Sequence: Synthetic oligonucleotide
  Target: SCN9A; (+) strand; PAM type: NRG; PAM sequence: GAG
agagaacacaaaggttcaaa

SEQ ID NO: 44947 - DNA, 20 bp, Artificial Sequence
  Description of Artificial Sequence: Synthetic oligonucleotide
  Target: SCN9A; (+) strand; PAM type: NRG; PAM sequence: GAG
agaacacaaaggttcaaaga

SEQ ID NO: 44948 - DNA, 20 bp, Artificial Sequence
  Description of Artificial Sequence: Synthetic oligonucleotide
  Target: SCN9A; (+) strand; PAM type: NRG; PAM sequence: AAG
acaaaggttcaaagagagca

SEQ ID NO: 44949 - DNA, 20 bp, Artificial Sequence
  Description of Artificial Sequence: Synthetic oligonucleotide
  Target: SCN9A; (+) strand; PAM type: NRG; PAM sequence: TAG
aaagagagcaaagtgatgtg

SEQ ID NO: 44950 - DNA, 20 bp, Artificial Sequence
  Description of Artificial Sequence: Synthetic oligonucleotide
  Target: SCN9A; (+) strand; PAM type: NRG; PAM sequence: AAG
cttttctgtaataacataat

SEQ ID NO: 44951 - DNA, 20 bp, Artificial Sequence
  Description of Artificial Sequence: Synthetic oligonucleotide
  Target: SCN9A; (+) strand; PAM type: NRG; PAM sequence: AAG
taacataataagtcatgaca

SEQ ID NO: 44952 - DNA, 20 bp, Artificial Sequence
  Description of Artificial Sequence: Synthetic oligonucleotide
  Target: SCN9A; (+) strand; PAM type: NRG; PAM sequence: AGG
aacataataagtcatgacaa

SEQ ID NO: 44953 - DNA, 20 bp, Artificial Sequence
  Description of Artificial Sequence: Synthetic oligonucleotide
  Target: SCN9A; (+) strand; PAM type: NRG; PAM sequence: GAG
cataataagtcatgacaaag

SEQ ID NO: 44954 - DNA, 20 bp, Artificial Sequence
  Description of Artificial Sequence: Synthetic oligonucleotide
  Target: SCN9A; (+) strand; PAM type: NRG; PAM sequence: AAG
atgacaaaggagatgcttta

SEQ ID NO: 44955 - DNA, 20 bp, Artificial Sequence
  Description of Artificial Sequence: Synthetic oligonucleotide
  Target: SCN9A; (+) strand; PAM type: NRG; PAM sequence: AGG
tgacaaaggagatgctttaa

SEQ ID NO: 44956 - DNA, 20 bp, Artificial Sequence
  Description of Artificial Sequence: Synthetic oligonucleotide
  Target: SCN9A; (+) strand; PAM type: NRG; PAM sequence: TGG
atgctttaaaggcaatgatc

SEQ ID NO: 44957 - DNA, 20 bp, Artificial Sequence
  Description of Artificial Sequence: Synthetic oligonucleotide
  Target: SCN9A; (+) strand; PAM type: NRG; PAM sequence: TAG
aaaggcaatgatctggactt

SEQ ID NO: 44958 - DNA, 20 bp, Artificial Sequence
  Description of Artificial Sequence: Synthetic oligonucleotide
  Target: SCN9A; (+) strand; PAM type: NRG; PAM sequence: GAG
tggactttagtgatatttct

SEQ ID NO: 44959 - DNA, 20 bp, Artificial Sequence
  Description of Artificial Sequence: Synthetic oligonucleotide
  Target: SCN9A; (+) strand; PAM type: NRG; PAM sequence: AAG
cacttgccaatttcatcaac

SEQ ID NO: 44960 - DNA, 20 bp, Artificial Sequence
  Description of Artificial Sequence: Synthetic oligonucleotide
  Target: SCN9A; (+) strand; PAM type: NRG; PAM sequence: CAG
tgccaatttcatcaacaagc

SEQ ID NO: 44961 - DNA, 20 bp, Artificial Sequence
  Description of Artificial Sequence: Synthetic oligonucleotide
  Target: SCN9A; (+) strand; PAM type: NRG; PAM sequence: AGG
gccaatttcatcaacaagcc

SEQ ID NO: 44962 - DNA, 20 bp, Artificial Sequence
  Description of Artificial Sequence: Synthetic oligonucleotide
  Target: SCN9A; (+) strand; PAM type: NRG; PAM sequence: GGG
ccaatttcatcaacaagcca

SEQ ID NO: 44963 - DNA, 20 bp, Artificial Sequence
  Description of Artificial Sequence: Synthetic oligonucleotide
  Target: SCN9A; (+) strand; PAM type: NRG; PAM sequence: GAG
aatttcatcaacaagccagg

SEQ ID NO: 44964 - DNA, 20 bp, Artificial Sequence
  Description of Artificial Sequence: Synthetic oligonucleotide
  Target: SCN9A; (+) strand; PAM type: NRG; PAM sequence: GAG
tttcatcaacaagccaggga

SEQ ID NO: 44965 - DNA, 20 bp, Artificial Sequence
  Description of Artificial Sequence: Synthetic oligonucleotide
  Target: SCN9A; (+) strand; PAM type: NRG; PAM sequence: TGG
atcaacaagccagggagagc

SEQ ID NO: 44966 - DNA, 20 bp, Artificial Sequence
  Description of Artificial Sequence: Synthetic oligonucleotide
  Target: SCN9A; (+) strand; PAM type: NRG; PAM sequence: AAG
caagccagggagagctggat

SEQ ID NO: 44967 - DNA, 20 bp, Artificial Sequence
  Description of Artificial Sequence: Synthetic oligonucleotide
  Target: SCN9A; (+) strand; PAM type: NRG; PAM sequence: TAG
agggagagctggataagtct

SEQ ID NO: 44968 - DNA, 20 bp, Artificial Sequence
  Description of Artificial Sequence: Synthetic oligonucleotide
  Target: SCN9A; (+) strand; PAM type: NRG; PAM sequence: TAG
gagagctggataagtcttag

SEQ ID NO: 44969 - DNA, 20 bp, Artificial Sequence
  Description of Artificial Sequence: Synthetic oligonucleotide
  Target: SCN9A; (+) strand; PAM type: NRG; PAM sequence: AAG
ggataagtcttagtagcact

SEQ ID NO: 44970 - DNA, 20 bp, Artificial Sequence
  Description of Artificial Sequence: Synthetic oligonucleotide
  Target: SCN9A; (+) strand; PAM type: NRG; PAM sequence: TAG
tagtagcactaagaacctca

SEQ ID NO: 44971 - DNA, 20 bp, Artificial Sequence
  Description of Artificial Sequence: Synthetic oligonucleotide
  Target: SCN9A; (+) strand; PAM type: NRG; PAM sequence: CAG
taagaacctcatagttacct

SEQ ID NO: 44972 - DNA, 20 bp, Artificial Sequence
  Description of Artificial Sequence: Synthetic oligonucleotide
  Target: SCN9A; (+) strand; PAM type: NRG; PAM sequence: AAG
aacctcatagttacctcagc

SEQ ID NO: 44973 - DNA, 20 bp, Artificial Sequence
  Description of Artificial Sequence: Synthetic oligonucleotide
  Target: SCN9A; (+) strand; PAM type: NRG; PAM sequence: AGG
acctcatagttacctcagca

SEQ ID NO: 44974 - DNA, 20 bp, Artificial Sequence
  Description of Artificial Sequence: Synthetic oligonucleotide
  Target: SCN9A; (+) strand; PAM type: NRG; PAM sequence: TAG
acctcagcaaggttttcacc

SEQ ID NO: 44975 - DNA, 20 bp, Artificial Sequence
  Description of Artificial Sequence: Synthetic oligonucleotide
  Target: SCN9A; (+) strand; PAM type: NRG; PAM sequence: GAG
ctcagcaaggttttcaccta

SEQ ID NO: 44976 - DNA, 20 bp, Artificial Sequence
  Description of Artificial Sequence: Synthetic oligonucleotide
  Target: SCN9A; (+) strand; PAM type: NRG; PAM sequence: AAG
agcaaggttttcacctagag

SEQ ID NO: 44977 - DNA, 20 bp, Artificial Sequence
  Description of Artificial Sequence: Synthetic oligonucleotide
  Target: SCN9A; (+) strand; PAM type: NRG; PAM sequence: CAG
ctagagaagaatgaatgtat

SEQ ID NO: 44978 - DNA, 20 bp, Artificial Sequence
  Description of Artificial Sequence: Synthetic oligonucleotide
  Target: SCN9A; (+) strand; PAM type: NRG; PAM sequence: AGG
tagagaagaatgaatgtatc

SEQ ID NO: 44979 - DNA, 20 bp, Artificial Sequence
  Description of Artificial Sequence: Synthetic oligonucleotide
  Target: SCN9A; (+) strand; PAM type: NRG; PAM sequence: CAG
agaagaatgaatgtatcagg

SEQ ID NO: 44980 - DNA, 20 bp, Artificial Sequence
  Description of Artificial Sequence: Synthetic oligonucleotide
  Target: SCN9A; (+) strand; PAM type: NRG; PAM sequence: AAG
agaatgaatgtatcaggcag

SEQ ID NO: 44981 - DNA, 20 bp, Artificial Sequence
  Description of Artificial Sequence: Synthetic oligonucleotide
  Target: SCN9A; (+) strand; PAM type: NRG; PAM sequence: AAG
atgtatcaggcagaagctac

SEQ ID NO: 44982 - DNA, 20 bp, Artificial Sequence
  Description of Artificial Sequence: Synthetic oligonucleotide
  Target: SCN9A; (+) strand; PAM type: NRG; PAM sequence: TGG
aagctacaagaacttgaatt

SEQ ID NO: 44983 - DNA, 20 bp, Artificial Sequence
  Description of Artificial Sequence: Synthetic oligonucleotide
  Target: SCN9A; (+) strand; PAM type: NRG; PAM sequence: TAG
acaagaacttgaatttggtc

SEQ ID NO: 44984 - DNA, 20 bp, Artificial Sequence
  Description of Artificial Sequence: Synthetic oligonucleotide
  Target: SCN9A; (+) strand; PAM type: NRG; PAM sequence: GAG
aacttgaatttggtctagat

SEQ ID NO: 44985 - DNA, 20 bp, Artificial Sequence
  Description of Artificial Sequence: Synthetic oligonucleotide
  Target: SCN9A; (+) strand; PAM type: NRG; PAM sequence: TAG
caataatttgcatgaaaaaa

SEQ ID NO: 44986 - DNA, 20 bp, Artificial Sequence
  Description of Artificial Sequence: Synthetic oligonucleotide
  Target: SCN9A; (+) strand; PAM type: NRG; PAM sequence: CAG
tatatgcaaaaataaatata

SEQ ID NO: 44987 - DNA, 20 bp, Artificial Sequence
  Description of Artificial Sequence: Synthetic oligonucleotide
  Target: SCN9A; (+) strand; PAM type: NRG; PAM sequence: TGG
tgcatttaatactgaataaa

SEQ ID NO: 44988 - DNA, 20 bp, Artificial Sequence
  Description of Artificial Sequence: Synthetic oligonucleotide
  Target: SCN9A; (+) strand; PAM type: NRG; PAM sequence: AAG
tttaatactgaataaatgga

SEQ ID NO: 44989 - DNA, 20 bp, Artificial Sequence
  Description of Artificial Sequence: Synthetic oligonucleotide
  Target: SCN9A; (+) strand; PAM type: NRG; PAM sequence: AGG
ttaatactgaataaatggaa

SEQ ID NO: 44990 - DNA, 20 bp, Artificial Sequence
  Description of Artificial Sequence: Synthetic oligonucleotide
  Target: SCN9A; (+) strand; PAM type: NRG; PAM sequence: AAG
tactgaataaatggaaagga

SEQ ID NO: 44991 - DNA, 20 bp, Artificial Sequence
  Description of Artificial Sequence: Synthetic oligonucleotide
  Target: SCN9A; (+) strand; PAM type: NRG; PAM sequence: AGG
actgaataaatggaaaggaa

SEQ ID NO: 44992 - DNA, 20 bp, Artificial Sequence
  Description of Artificial Sequence: Synthetic oligonucleotide
  Target: SCN9A; (+) strand; PAM type: NRG; PAM sequence: GGG
ctgaataaatggaaaggaaa

SEQ ID NO: 44993 - DNA, 20 bp, Artificial Sequence
  Description of Artificial Sequence: Synthetic oligonucleotide
  Target: SCN9A; (+) strand; PAM type: NRG; PAM sequence: TAG
atggaaaggaaagggttatg

SEQ ID NO: 44994 - DNA, 20 bp, Artificial Sequence
  Description of Artificial Sequence: Synthetic oligonucleotide
  Target: SCN9A; (+) strand; PAM type: NRG; PAM sequence: GAG
ggaaagggttatgtagtctt

SEQ ID NO: 44995 - DNA, 20 bp, Artificial Sequence
  Description of Artificial Sequence: Synthetic oligonucleotide
  Target: SCN9A; (+) strand; PAM type: NRG; PAM sequence: AAG
agggttatgtagtcttgaga

SEQ ID NO: 44996 - DNA, 20 bp, Artificial Sequence
  Description of Artificial Sequence: Synthetic oligonucleotide
  Target: SCN9A; (+) strand; PAM type: NRG; PAM sequence: TAG
cttgagaaagaaatatattc

SEQ ID NO: 44997 - DNA, 20 bp, Artificial Sequence
  Description of Artificial Sequence: Synthetic oligonucleotide
  Target: SCN9A; (+) strand; PAM type: NRG; PAM sequence: AAG
gagaaagaaatatattctag

SEQ ID NO: 44998 - DNA, 20 bp, Artificial Sequence
  Description of Artificial Sequence: Synthetic oligonucleotide
  Target: SCN9A; (+) strand; PAM type: NRG; PAM sequence: CAG
atatattctagaagtaaaat

SEQ ID NO: 44999 - DNA, 20 bp, Artificial Sequence
  Description of Artificial Sequence: Synthetic oligonucleotide
  Target: SCN9A; (+) strand; PAM type: NRG; PAM sequence: AAG
atcagttttacttttcaata

SEQ ID NO: 45000 - DNA, 20 bp, Artificial Sequence
  Description of Artificial Sequence: Synthetic oligonucleotide
  Target: SCN9A; (+) strand; PAM type: NRG; PAM sequence: AAG
agttttacttttcaataaag

SEQ ID NO: 45001 - DNA, 20 bp, Artificial Sequence
  Description of Artificial Sequence: Synthetic oligonucleotide
  Target: SCN9A; (+) strand; PAM type: NRG; PAM sequence: AGG
gttttacttttcaataaaga

SEQ ID NO: 45002 - DNA, 20 bp, Artificial Sequence
  Description of Artificial Sequence: Synthetic oligonucleotide
  Target: SCN9A; (+) strand; PAM type: NRG; PAM sequence: GGG
ttttacttttcaataaagaa

SEQ ID NO: 45003 - DNA, 20 bp, Artificial Sequence
  Description of Artificial Sequence: Synthetic oligonucleotide
  Target: SCN9A; (+) strand; PAM type: NRG; PAM sequence: AAG
ttttcaataaagaagggaat

SEQ ID NO: 45004 - DNA, 20 bp, Artificial Sequence
  Description of Artificial Sequence: Synthetic oligonucleotide
  Target: SCN9A; (+) strand; PAM type: NRG; PAM sequence: TAG
caataaagaagggaataaga

SEQ ID NO: 45005 - DNA, 20 bp, Artificial Sequence
  Description of Artificial Sequence: Synthetic oligonucleotide
  Target: SCN9A; (+) strand; PAM type: NRG; PAM sequence: AAG
aagggaataagatagttttg

SEQ ID NO: 45006 - DNA, 20 bp, Artificial Sequence
  Description of Artificial Sequence: Synthetic oligonucleotide
  Target: SCN9A; (+) strand; PAM type: NRG; PAM sequence: AAG
aaaaatcacacattattacc

SEQ ID NO: 45007 - DNA, 20 bp, Artificial Sequence
  Description of Artificial Sequence: Synthetic oligonucleotide
  Target: SCN9A; (+) strand; PAM type: NRG; PAM sequence: AGG
aaaatcacacattattacca

SEQ ID NO: 45008 - DNA, 20 bp, Artificial Sequence
  Description of Artificial Sequence: Synthetic oligonucleotide
  Target: SCN9A; (+) strand; PAM type: NRG; PAM sequence: TAG
atcacacattattaccaagg

SEQ ID NO: 45009 - DNA, 20 bp, Artificial Sequence
  Description of Artificial Sequence: Synthetic oligonucleotide
  Target: SCN9A; (+) strand; PAM type: NRG; PAM sequence: CAG
aaggtagactataacctaat

SEQ ID NO: 45010 - DNA, 20 bp, Artificial Sequence
  Description of Artificial Sequence: Synthetic oligonucleotide
  Target: SCN9A; (+) strand; PAM type: NRG; PAM sequence: CAG
tagactataacctaatcagt

SEQ ID NO: 45011 - DNA, 20 bp, Artificial Sequence
  Description of Artificial Sequence: Synthetic oligonucleotide
  Target: SCN9A; (+) strand; PAM type: NRG; PAM sequence: AAG
taacctaatcagtcagcatt

SEQ ID NO: 45012 - DNA, 20 bp, Artificial Sequence
  Description of Artificial Sequence: Synthetic oligonucleotide
  Target: SCN9A; (+) strand; PAM type: NRG; PAM sequence: AGG
aacctaatcagtcagcatta

SEQ ID NO: 45013 - DNA, 20 bp, Artificial Sequence
  Description of Artificial Sequence: Synthetic oligonucleotide
  Target: SCN9A; (+) strand; PAM type: NRG; PAM sequence: TGG
ctaatcagtcagcattaagg

SEQ ID NO: 45014 - DNA, 20 bp, Artificial Sequence
  Description of Artificial Sequence: Synthetic oligonucleotide
  Target: SCN9A; (+) strand; PAM type: NRG; PAM sequence: TAG
cagtcagcattaaggtggat

SEQ ID NO: 45015 - DNA, 20 bp, Artificial Sequence
  Description of Artificial Sequence: Synthetic oligonucleotide
  Target: SCN9A; (+) strand; PAM type: NRG; PAM sequence: AAG
tcagcattaaggtggattag

SEQ ID NO: 45016 - DNA, 20 bp, Artificial Sequence
  Description of Artificial Sequence: Synthetic oligonucleotide
  Target: SCN9A; (+) strand; PAM type: NRG; PAM sequence: CAG
gtggattagaagcacaatat

SEQ ID NO: 45017 - DNA, 20 bp, Artificial Sequence
  Description of Artificial Sequence: Synthetic oligonucleotide
  Target: SCN9A; (+) strand; PAM type: NRG; PAM sequence: CAG
atatcagaatcccaatgaat

SEQ ID NO: 45018 - DNA, 20 bp, Artificial Sequence
  Description of Artificial Sequence: Synthetic oligonucleotide
  Target: SCN9A; (+) strand; PAM type: NRG; PAM sequence: CAG
aatgtacaataccattacaa

SEQ ID NO: 45019 - DNA, 20 bp, Artificial Sequence
  Description of Artificial Sequence: Synthetic oligonucleotide
  Target: SCN9A; (+) strand; PAM type: NRG; PAM sequence: CAG
caccctgaattacaccatta

SEQ ID NO: 45020 - DNA, 20 bp, Artificial Sequence
  Description of Artificial Sequence: Synthetic oligonucleotide
  Target: SCN9A; (+) strand; PAM type: NRG; PAM sequence: GAG
ccctgaattacaccattaca

SEQ ID NO: 45021 - DNA, 20 bp, Artificial Sequence
  Description of Artificial Sequence: Synthetic oligonucleotide
  Target: SCN9A; (+) strand; PAM type: NRG; PAM sequence: AGG
cctgaattacaccattacag

SEQ ID NO: 45022 - DNA, 20 bp, Artificial Sequence
  Description of Artificial Sequence: Synthetic oligonucleotide
  Target: SCN9A; (+) strand; PAM type: NRG; PAM sequence: TAG
attacaccattacagaggta

SEQ ID NO: 45023 - DNA, 20 bp, Artificial Sequence
  Description of Artificial Sequence: Synthetic oligonucleotide
  Target: SCN9A; (+) strand; PAM type: NRG; PAM sequence: CAG
acaccattacagaggtatag

SEQ ID NO: 45024 - DNA, 20 bp, Artificial Sequence
  Description of Artificial Sequence: Synthetic oligonucleotide
  Target: SCN9A; (+) strand; PAM type: NRG; PAM sequence: TGG
ctcattttcttgcctttcta

SEQ ID NO: 45025 - DNA, 20 bp, Artificial Sequence
  Description of Artificial Sequence: Synthetic oligonucleotide
  Target: SCN9A; (+) strand; PAM type: NRG; PAM sequence: TAG
tcttgcctttctatggcatg

SEQ ID NO: 45026 - DNA, 20 bp, Artificial Sequence
  Description of Artificial Sequence: Synthetic oligonucleotide
  Target: SCN9A; (+) strand; PAM type: NRG; PAM sequence: CAG
ggcatgtagtataatgatta

SEQ ID NO: 45027 - DNA, 20 bp, Artificial Sequence
  Description of Artificial Sequence: Synthetic oligonucleotide
  Target: SCN9A; (+) strand; PAM type: NRG; PAM sequence: TGG
gtagtataatgattacagct

SEQ ID NO: 45028 - DNA, 20 bp, Artificial Sequence
  Description of Artificial Sequence: Synthetic oligonucleotide
  Target: SCN9A; (+) strand; PAM type: NRG; PAM sequence: GGG
tagtataatgattacagctt

SEQ ID NO: 45029 - DNA, 20 bp, Artificial Sequence
  Description of Artificial Sequence: Synthetic oligonucleotide
  Target: SCN9A; (+) strand; PAM type: NRG; PAM sequence: GGG
agtataatgattacagcttg

SEQ ID NO: 45030 - DNA, 20 bp, Artificial Sequence
  Description of Artificial Sequence: Synthetic oligonucleotide
  Target: SCN9A; (+) strand; PAM type: NRG; PAM sequence: AAG
gcttggggtttaaatttaaa

SEQ ID NO: 45031 - DNA, 20 bp, Artificial Sequence
  Description of Artificial Sequence: Synthetic oligonucleotide
  Target: SCN9A; (+) strand; PAM type: NRG; PAM sequence: CAG
tttaaatttaaaaagacccc

SEQ ID NO: 45032 - DNA, 20 bp, Artificial Sequence
  Description of Artificial Sequence: Synthetic oligonucleotide
  Target: SCN9A; (+) strand; PAM type: NRG; PAM sequence: TAG
caaatcttttcttaatcttt

SEQ ID NO: 45033 - DNA, 20 bp, Artificial Sequence
  Description of Artificial Sequence: Synthetic oligonucleotide
  Target: SCN9A; (+) strand; PAM type: NRG; PAM sequence: CAG
ttcttaatcttttagaatcg

SEQ ID NO: 45034 - DNA, 20 bp, Artificial Sequence
  Description of Artificial Sequence: Synthetic oligonucleotide
  Target: SCN9A; (+) strand; PAM type: NRG; PAM sequence: TAG
atcgcagtcatctgcaaata

SEQ ID NO: 45035 - DNA, 20 bp, Artificial Sequence
  Description of Artificial Sequence: Synthetic oligonucleotide
  Target: SCN9A; (+) strand; PAM type: NRG; PAM sequence: AAG
atgcattatatttacttcct

SEQ ID NO: 45036 - DNA, 20 bp, Artificial Sequence
  Description of Artificial Sequence: Synthetic oligonucleotide
  Target: SCN9A; (+) strand; PAM type: NRG; PAM sequence: AGG
tgcattatatttacttccta

SEQ ID NO: 45037 - DNA, 20 bp, Artificial Sequence
  Description of Artificial Sequence: Synthetic oligonucleotide
  Target: SCN9A; (+) strand; PAM type: NRG; PAM sequence: GAG
cattatatttacttcctaag

SEQ ID NO: 45038 - DNA, 20 bp, Artificial Sequence
  Description of Artificial Sequence: Synthetic oligonucleotide
  Target: SCN9A; (+) strand; PAM type: NRG; PAM sequence: AGG
attatatttacttcctaagg

SEQ ID NO: 45039 - DNA, 20 bp, Artificial Sequence
  Description of Artificial Sequence: Synthetic oligonucleotide
  Target: SCN9A; (+) strand; PAM type: NRG; PAM sequence: AAG
tacttcctaaggaggtcaca

SEQ ID NO: 45040 - DNA, 20 bp, Artificial Sequence
  Description of Artificial Sequence: Synthetic oligonucleotide
  Target: SCN9A; (+) strand; PAM type: NRG; PAM sequence: AAG
aaaattatataatgtgtgta

SEQ ID NO: 45041 - DNA, 20 bp, Artificial Sequence
  Description of Artificial Sequence: Synthetic oligonucleotide
  Target: SCN9A; (+) strand; PAM type: NRG; PAM sequence: AGG
aaattatataatgtgtgtaa

SEQ ID NO: 45042 - DNA, 20 bp, Artificial Sequence
  Description of Artificial Sequence: Synthetic oligonucleotide
  Target: SCN9A; (+) strand; PAM type: NRG; PAM sequence: GGG
aattatataatgtgtgtaaa

SEQ ID NO: 45043 - DNA, 20 bp, Artificial Sequence
  Description of Artificial Sequence: Synthetic oligonucleotide
  Target: SCN9A; (+) strand; PAM type: NRG; PAM sequence: GGG
attatataatgtgtgtaaag

SEQ ID NO: 45044 - DNA, 20 bp, Artificial Sequence
  Description of Artificial Sequence: Synthetic oligonucleotide
  Target: SCN9A; (+) strand; PAM type: NRG; PAM sequence: CAG
tgtgtttgatccgctgttct

SEQ ID NO: 45045 - DNA, 20 bp, Artificial Sequence
  Description of Artificial Sequence: Synthetic oligonucleotide
  Target: SCN9A; (+) strand; PAM type: NRG; PAM sequence: TGG
ctgttctcagctgctgtctg

SEQ ID NO: 45046 - DNA, 20 bp, Artificial Sequence
  Description of Artificial Sequence: Synthetic oligonucleotide
  Target: SCN9A; (+) strand; PAM type: NRG; PAM sequence: AAG
ctgtctgtggttctgtcatg

SEQ ID NO: 45047 - DNA, 20 bp, Artificial Sequence
  Description of Artificial Sequence: Synthetic oligonucleotide
  Target: SCN9A; (+) strand; PAM type: NRG; PAM sequence: TAG
tctgtggttctgtcatgaag

SEQ ID NO: 45048 - DNA, 20 bp, Artificial Sequence
  Description of Artificial Sequence: Synthetic oligonucleotide
  Target: SCN9A; (+) strand; PAM type: NRG; PAM sequence: AAG
tgtcatgaagtagatgctct

SEQ ID NO: 45049 - DNA, 20 bp, Artificial Sequence
  Description of Artificial Sequence: Synthetic oligonucleotide
  Target: SCN9A; (+) strand; PAM type: NRG; PAM sequence: AGG
gtcatgaagtagatgctcta

SEQ ID NO: 45050 - DNA, 20 bp, Artificial Sequence
  Description of Artificial Sequence: Synthetic oligonucleotide
  Target: SCN9A; (+) strand; PAM type: NRG; PAM sequence: CAG
actgtccacatcctgctttc

SEQ ID NO: 45051 - DNA, 20 bp, Artificial Sequence
  Description of Artificial Sequence: Synthetic oligonucleotide
  Target: SCN9A; (+) strand; PAM type: NRG; PAM sequence: AAG
tccacatcctgctttccagc

SEQ ID NO: 45052 - DNA, 20 bp, Artificial Sequence
  Description of Artificial Sequence: Synthetic oligonucleotide
  Target: SCN9A; (+) strand; PAM type: NRG; PAM sequence: CAG
cagcaagctgctcattcccc

SEQ ID NO: 45053 - DNA, 20 bp, Artificial Sequence
  Description of Artificial Sequence: Synthetic oligonucleotide
  Target: SCN9A; (+) strand; PAM type: NRG; PAM sequence: AAG
ctcattcccccagctgccaa

SEQ ID NO: 45054 - DNA, 20 bp, Artificial Sequence
  Description of Artificial Sequence: Synthetic oligonucleotide
  Target: SCN9A; (+) strand; PAM type: NRG; PAM sequence: TGG
cccccagctgccaaaagtgt

SEQ ID NO: 45055 - DNA, 20 bp, Artificial Sequence
  Description of Artificial Sequence: Synthetic oligonucleotide
  Target: SCN9A; (+) strand; PAM type: NRG; PAM sequence: AAG
gccaaaagtgttggatgctg

SEQ ID NO: 45056 - DNA, 20 bp, Artificial Sequence
  Description of Artificial Sequence: Synthetic oligonucleotide
  Target: SCN9A; (+) strand; PAM type: NRG; PAM sequence: AGG
ccaaaagtgttggatgctga

SEQ ID NO: 45057 - DNA, 20 bp, Artificial Sequence
  Description of Artificial Sequence: Synthetic oligonucleotide
  Target: SCN9A; (+) strand; PAM type: NRG; PAM sequence: TGG
ctcacatctgaatccctctt

SEQ ID NO: 45058 - DNA, 20 bp, Artificial Sequence
  Description of Artificial Sequence: Synthetic oligonucleotide
  Target: SCN9A; (+) strand; PAM type: NRG; PAM sequence: GGG
tcacatctgaatccctcttt

SEQ ID NO: 45059 - DNA, 20 bp, Artificial Sequence
  Description of Artificial Sequence: Synthetic oligonucleotide
  Target: SCN9A; (+) strand; PAM type: NRG; PAM sequence: TGG
tccctctttgggccttatcg

SEQ ID NO: 45060 - DNA, 20 bp, Artificial Sequence
  Description of Artificial Sequence: Synthetic oligonucleotide
  Target: SCN9A; (+) strand; PAM type: NRG; PAM sequence: CAG
ctctttgggccttatcgtgg

SEQ ID NO: 45061 - DNA, 20 bp, Artificial Sequence
  Description of Artificial Sequence: Synthetic oligonucleotide
  Target: SCN9A; (+) strand; PAM type: NRG; PAM sequence: AAG
tttgggccttatcgtggcag

SEQ ID NO: 45062 - DNA, 20 bp, Artificial Sequence
  Description of Artificial Sequence: Synthetic oligonucleotide
  Target: SCN9A; (+) strand; PAM type: NRG; PAM sequence: AGG
ttgggccttatcgtggcaga

SEQ ID NO: 45063 - DNA, 20 bp, Artificial Sequence
  Description of Artificial Sequence: Synthetic oligonucleotide
  Target: SCN9A; (+) strand; PAM type: NRG; PAM sequence: GGG
tgggccttatcgtggcagaa

SEQ ID NO: 45064 - DNA, 20 bp, Artificial Sequence
  Description of Artificial Sequence: Synthetic oligonucleotide
  Target: SCN9A; (+) strand; PAM type: NRG; PAM sequence: GAG
ggccttatcgtggcagaagg

SEQ ID NO: 45065 - DNA, 20 bp, Artificial Sequence
  Description of Artificial Sequence: Synthetic oligonucleotide
  Target: SCN9A; (+) strand; PAM type: NRG; PAM sequence: AGG
gccttatcgtggcagaaggg

SEQ ID NO: 45066 - DNA, 20 bp, Artificial Sequence
  Description of Artificial Sequence: Synthetic oligonucleotide
  Target: SCN9A; (+) strand; PAM type: NRG; PAM sequence: AAG
agaagggaggtgcttccccc

SEQ ID NO: 45067 - DNA, 20 bp, Artificial Sequence
  Description of Artificial Sequence: Synthetic oligonucleotide
  Target: SCN9A; (+) strand; PAM type: NRG; PAM sequence: AGG
gaagggaggtgcttccccca

SEQ ID NO: 45068 - DNA, 20 bp, Artificial Sequence
  Description of Artificial Sequence: Synthetic oligonucleotide
  Target: SCN9A; (+) strand; PAM type: NRG; PAM sequence: TGG
aaggttatacccttctcccc

SEQ ID NO: 45069 - DNA, 20 bp, Artificial Sequence
  Description of Artificial Sequence: Synthetic oligonucleotide
  Target: SCN9A; (+) strand; PAM type: NRG; PAM sequence: AAG
ttatacccttctcccctgga

SEQ ID NO: 45070 - DNA, 20 bp, Artificial Sequence
  Description of Artificial Sequence: Synthetic oligonucleotide
  Target: SCN9A; (+) strand; PAM type: NRG; PAM sequence: AGG
tatacccttctcccctggaa

SEQ ID NO: 45071 - DNA, 20 bp, Artificial Sequence
  Description of Artificial Sequence: Synthetic oligonucleotide
  Target: SCN9A; (+) strand; PAM type: NRG; PAM sequence: AAG
ccttctcccctggaaaggta

SEQ ID NO: 45072 - DNA, 20 bp, Artificial Sequence
  Description of Artificial Sequence: Synthetic oligonucleotide
  Target: SCN9A; (+) strand; PAM type: NRG; PAM sequence: AGG
cttctcccctggaaaggtaa

SEQ ID NO: 45073 - DNA, 20 bp, Artificial Sequence
  Description of Artificial Sequence: Synthetic oligonucleotide
  Target: SCN9A; (+) strand; PAM type: NRG; PAM sequence: GGG
ttctcccctggaaaggtaaa

SEQ ID NO: 45074 - DNA, 20 bp, Artificial Sequence
  Description of Artificial Sequence: Synthetic oligonucleotide
  Target: SCN9A; (+) strand; PAM type: NRG; PAM sequence: GAG
ctcccctggaaaggtaaagg

SEQ ID NO: 45075 - DNA, 20 bp, Artificial Sequence
  Description of Artificial Sequence: Synthetic oligonucleotide
  Target: SCN9A; (+) strand; PAM type: NRG; PAM sequence: GAG
cccctggaaaggtaaaggga

SEQ ID NO: 45076 - DNA, 20 bp, Artificial Sequence
  Description of Artificial Sequence: Synthetic oligonucleotide
  Target: SCN9A; (+) strand; PAM type: NRG; PAM sequence: TGG
gagagcctgcatccaatgaa

SEQ ID NO: 45077 - DNA, 20 bp, Artificial Sequence
  Description of Artificial Sequence: Synthetic oligonucleotide
  Target: SCN9A; (+) strand; PAM type: NRG; PAM sequence: TGG
cctgcatccaatgaatggtg

SEQ ID NO: 45078 - DNA, 20 bp, Artificial Sequence
  Description of Artificial Sequence: Synthetic oligonucleotide
  Target: SCN9A; (+) strand; PAM type: NRG; PAM sequence: GAG
tgcatccaatgaatggtgtg

SEQ ID NO: 45079 - DNA, 20 bp, Artificial Sequence
  Description of Artificial Sequence: Synthetic oligonucleotide
  Target: SCN9A; (+) strand; PAM type: NRG; PAM sequence: AAG
atccaatgaatggtgtggag

SEQ ID NO: 45080 - DNA, 20 bp, Artificial Sequence
  Description of Artificial Sequence: Synthetic oligonucleotide
  Target: SCN9A; (+) strand; PAM type: NRG; PAM sequence: AAG
aatgaatggtgtggagaaga

SEQ ID NO: 45081 - DNA, 20 bp, Artificial Sequence
  Description of Artificial Sequence: Synthetic oligonucleotide
  Target: SCN9A; (+) strand; PAM type: NRG; PAM sequence: AGG
atgaatggtgtggagaagaa

SEQ ID NO: 45082 - DNA, 20 bp, Artificial Sequence
  Description of Artificial Sequence: Synthetic oligonucleotide
  Target: SCN9A; (+) strand; PAM type: NRG; PAM sequence: TGG
ctgaccctcttgctttgttt

SEQ ID NO: 45083 - DNA, 20 bp, Artificial Sequence
  Description of Artificial Sequence: Synthetic oligonucleotide
  Target: SCN9A; (+) strand; PAM type: NRG; PAM sequence: CAG
gctttgttttggaactactc

SEQ ID NO: 45084 - DNA, 20 bp, Artificial Sequence
  Description of Artificial Sequence: Synthetic oligonucleotide
  Target: SCN9A; (+) strand; PAM type: NRG; PAM sequence: GAG
tttgttttggaactactcca

SEQ ID NO: 45085 - DNA, 20 bp, Artificial Sequence
  Description of Artificial Sequence: Synthetic oligonucleotide
  Target: SCN9A; (+) strand; PAM type: NRG; PAM sequence: AGG
ttgttttggaactactccag

SEQ ID NO: 45086 - DNA, 20 bp, Artificial Sequence
  Description of Artificial Sequence: Synthetic oligonucleotide
  Target: SCN9A; (+) strand; PAM type: NRG; PAM sequence: GGG
tgttttggaactactccaga

SEQ ID NO: 45087 - DNA, 20 bp, Artificial Sequence
  Description of Artificial Sequence: Synthetic oligonucleotide
  Target: SCN9A; (+) strand; PAM type: NRG; PAM sequence: CAG
actactccagagggttgtca

SEQ ID NO: 45088 - DNA, 20 bp, Artificial Sequence
  Description of Artificial Sequence: Synthetic oligonucleotide
  Target: SCN9A; (+) strand; PAM type: NRG; PAM sequence: CAG
ccagagggttgtcacagcat

SEQ ID NO: 45089 - DNA, 20 bp, Artificial Sequence
  Description of Artificial Sequence: Synthetic oligonucleotide
  Target: SCN9A; (+) strand; PAM type: NRG; PAM sequence: GAG
agagggttgtcacagcatca

SEQ ID NO: 45090 - DNA, 20 bp, Artificial Sequence
  Description of Artificial Sequence: Synthetic oligonucleotide
  Target: SCN9A; (+) strand; PAM type: NRG; PAM sequence: TAG
cacagcatcagagatgccaa

SEQ ID NO: 45091 - DNA, 20 bp, Artificial Sequence
  Description of Artificial Sequence: Synthetic oligonucleotide
  Target: SCN9A; (+) strand; PAM type: NRG; PAM sequence: AGG
acagcatcagagatgccaat

SEQ ID NO: 45092 - DNA, 20 bp, Artificial Sequence
  Description of Artificial Sequence: Synthetic oligonucleotide
  Target: SCN9A; (+) strand; PAM type: NRG; PAM sequence: CAG
atcagagatgccaataggat

SEQ ID NO: 45093 - DNA, 20 bp, Artificial Sequence
  Description of Artificial Sequence: Synthetic oligonucleotide
  Target: SCN9A; (+) strand; PAM type: NRG; PAM sequence: CAG
aatctctgttgcaattttaa

SEQ ID NO: 45094 - DNA, 20 bp, Artificial Sequence
  Description of Artificial Sequence: Synthetic oligonucleotide
  Target: SCN9A; (+) strand; PAM type: NRG; PAM sequence: CAG
tttgcatgcctcacttttta

SEQ ID NO: 45095 - DNA, 20 bp, Artificial Sequence
  Description of Artificial Sequence: Synthetic oligonucleotide
  Target: SCN9A; (+) strand; PAM type: NRG; PAM sequence: CAG
tcgttcctgaaaacacttct

SEQ ID NO: 45096 - DNA, 20 bp, Artificial Sequence
  Description of Artificial Sequence: Synthetic oligonucleotide
  Target: SCN9A; (+) strand; PAM type: NRG; PAM sequence: CAG
aaacacttctcagtaaatct

SEQ ID NO: 45097 - DNA, 20 bp, Artificial Sequence
  Description of Artificial Sequence: Synthetic oligonucleotide
  Target: SCN9A; (+) strand; PAM type: NRG; PAM sequence: CAG
taaatctcagatttctctct

SEQ ID NO: 45098 - DNA, 20 bp, Artificial Sequence
  Description of Artificial Sequence: Synthetic oligonucleotide
  Target: SCN9A; (+) strand; PAM type: NRG; PAM sequence: AGG
aaatctcagatttctctctc

SEQ ID NO: 45099 - DNA, 20 bp, Artificial Sequence
  Description of Artificial Sequence: Synthetic oligonucleotide
  Target: SCN9A; (+) strand; PAM type: NRG; PAM sequence: TGG
tcagatttctctctcaggat

SEQ ID NO: 45100 - DNA, 20 bp, Artificial Sequence
  Description of Artificial Sequence: Synthetic oligonucleotide
  Target: SCN9A; (+) strand; PAM type: NRG; PAM sequence: CAG
ctctctcaggattggtttcc

SEQ ID NO: 45101 - DNA, 20 bp, Artificial Sequence
  Description of Artificial Sequence: Synthetic oligonucleotide
  Target: SCN9A; (+) strand; PAM type: NRG; PAM sequence: AGG
tctctcaggattggtttccc

SEQ ID NO: 45102 - DNA, 20 bp, Artificial Sequence
  Description of Artificial Sequence: Synthetic oligonucleotide
  Target: SCN9A; (+) strand; PAM type: NRG; PAM sequence: GGG
ctctcaggattggtttccca

SEQ ID NO: 45103 - DNA, 20 bp, Artificial Sequence
  Description of Artificial Sequence: Synthetic oligonucleotide
  Target: SCN9A; (+) strand; PAM type: NRG; PAM sequence: AAG
cacaatcccgtgattaatga

SEQ ID NO: 45104 - DNA, 20 bp, Artificial Sequence
  Description of Artificial Sequence: Synthetic oligonucleotide
  Target: SCN9A; (+) strand; PAM type: NRG; PAM sequence: TAG
atcccgtgattaatgaaagt

SEQ ID NO: 45105 - DNA, 20 bp, Artificial Sequence
  Description of Artificial Sequence: Synthetic oligonucleotide
  Target: SCN9A; (+) strand; PAM type: NRG; PAM sequence: AAG
ctgacttttcttctttcctt

SEQ ID NO: 45106 - DNA, 20 bp, Artificial Sequence
  Description of Artificial Sequence: Synthetic oligonucleotide
  Target: SCN9A; (+) strand; PAM type: NRG; PAM sequence: CAG
ctttccatatacctcctgtt

SEQ ID NO: 45107 - DNA, 20 bp, Artificial Sequence
  Description of Artificial Sequence: Synthetic oligonucleotide
  Target: SCN9A; (+) strand; PAM type: NRG; PAM sequence: AGG
tttccatatacctcctgttc

SEQ ID NO: 45108 - DNA, 20 bp, Artificial Sequence
  Description of Artificial Sequence: Synthetic oligonucleotide
  Target: SCN9A; (+) strand; PAM type: NRG; PAM sequence: AAG
aggttcactgcctgtactgc

SEQ ID NO: 45109 - DNA, 20 bp, Artificial Sequence
  Description of Artificial Sequence: Synthetic oligonucleotide
  Target: SCN9A; (+) strand; PAM type: NRG; PAM sequence: TAG
ttcactgcctgtactgcaag

SEQ ID NO: 45110 - DNA, 20 bp, Artificial Sequence
  Description of Artificial Sequence: Synthetic oligonucleotide
  Target: SCN9A; (+) strand; PAM type: NRG; PAM sequence: CAG
tcctcaattttctcctccat

SEQ ID NO: 45111 - DNA, 20 bp, Artificial Sequence
  Description of Artificial Sequence: Synthetic oligonucleotide
  Target: SCN9A; (+) strand; PAM type: NRG; PAM sequence: TAG
taattgtatcaataaccatc

SEQ ID NO: 45112 - DNA, 20 bp, Artificial Sequence
  Description of Artificial Sequence: Synthetic oligonucleotide
  Target: SCN9A; (+) strand; PAM type: NRG; PAM sequence: AAG
caataaccatctagtcttct

SEQ ID NO: 45113 - DNA, 20 bp, Artificial Sequence
  Description of Artificial Sequence: Synthetic oligonucleotide
  Target: SCN9A; (+) strand; PAM type: NRG; PAM sequence: TGG
taagtcaaaattctttgttg

SEQ ID NO: 45114 - DNA, 20 bp, Artificial Sequence
  Description of Artificial Sequence: Synthetic oligonucleotide
  Target: SCN9A; (+) strand; PAM type: NRG; PAM sequence: GGG
aagtcaaaattctttgttgt

SEQ ID NO: 45115 - DNA, 20 bp, Artificial Sequence
  Description of Artificial Sequence: Synthetic oligonucleotide
  Target: SCN9A; (+) strand; PAM type: NRG; PAM sequence: AAG
gttgaattgtaatcctccaa

SEQ ID NO: 45116 - DNA, 20 bp, Artificial Sequence
  Description of Artificial Sequence: Synthetic oligonucleotide
  Target: SCN9A; (+) strand; PAM type: NRG; PAM sequence: AAG
atcctccaaaagttatgttg

SEQ ID NO: 45117 - DNA, 20 bp, Artificial Sequence
  Description of Artificial Sequence: Synthetic oligonucleotide
  Target: SCN9A; (+) strand; PAM type: NRG; PAM sequence: TGG
ttatgttgaagtcctaaccc

SEQ ID NO: 45118 - DNA, 20 bp, Artificial Sequence
  Description of Artificial Sequence: Synthetic oligonucleotide
  Target: SCN9A; (+) strand; PAM type: NRG; PAM sequence: GAG
gtcctaaccctggcatgttt

SEQ ID NO: 45119 - DNA, 20 bp, Artificial Sequence
  Description of Artificial Sequence: Synthetic oligonucleotide
  Target: SCN9A; (+) strand; PAM type: NRG; PAM sequence: TGG
tgtttgagtgtgatcttatt

SEQ ID NO: 45120 - DNA, 20 bp, Artificial Sequence
  Description of Artificial Sequence: Synthetic oligonucleotide
  Target: SCN9A; (+) strand; PAM type: NRG; PAM sequence: TGG
tgtgatcttatttggaaata

SEQ ID NO: 45121 - DNA, 20 bp, Artificial Sequence
  Description of Artificial Sequence: Synthetic oligonucleotide
  Target: SCN9A; (+) strand; PAM type: NRG; PAM sequence: CAG
atttggaaatatggtctttg

SEQ ID NO: 45122 - DNA, 20 bp, Artificial Sequence
  Description of Artificial Sequence: Synthetic oligonucleotide
  Target: SCN9A; (+) strand; PAM type: NRG; PAM sequence: AAG
tggtctttgcagacacaatg

SEQ ID NO: 45123 - DNA, 20 bp, Artificial Sequence
  Description of Artificial Sequence: Synthetic oligonucleotide
  Target: SCN9A; (+) strand; PAM type: NRG; PAM sequence: GAG
tttgcagacacaatgaagat

SEQ ID NO: 45124 - DNA, 20 bp, Artificial Sequence
  Description of Artificial Sequence: Synthetic oligonucleotide
  Target: SCN9A; (+) strand; PAM type: NRG; PAM sequence: AGG
ttgcagacacaatgaagatg

SEQ ID NO: 45125 - DNA, 20 bp, Artificial Sequence
  Description of Artificial Sequence: Synthetic oligonucleotide
  Target: SCN9A; (+) strand; PAM type: NRG; PAM sequence: TGG
atgaagatgaggtcattgtg

SEQ ID NO: 45126 - DNA, 20 bp, Artificial Sequence
  Description of Artificial Sequence: Synthetic oligonucleotide
  Target: SCN9A; (+) strand; PAM type: NRG; PAM sequence: GGG
tgaagatgaggtcattgtgt

SEQ ID NO: 45127 - DNA, 20 bp, Artificial Sequence
  Description of Artificial Sequence: Synthetic oligonucleotide
  Target: SCN9A; (+) strand; PAM type: NRG; PAM sequence: TGG
gggtccaaatccaatataac

SEQ ID NO: 45128 - DNA, 20 bp, Artificial Sequence
  Description of Artificial Sequence: Synthetic oligonucleotide
  Target: SCN9A; (+) strand; PAM type: NRG; PAM sequence: GGG
ggtccaaatccaatataact

SEQ ID NO: 45129 - DNA, 20 bp, Artificial Sequence
  Description of Artificial Sequence: Synthetic oligonucleotide
  Target: SCN9A; (+) strand; PAM type: NRG; PAM sequence: GGG
gtccaaatccaatataactg

SEQ ID NO: 45130 - DNA, 20 bp, Artificial Sequence
  Description of Artificial Sequence: Synthetic oligonucleotide
  Target: SCN9A; (+) strand; PAM type: NRG; PAM sequence: AAG
aatataactggggtccttat

SEQ ID NO: 45131 - DNA, 20 bp, Artificial Sequence
  Description of Artificial Sequence: Synthetic oligonucleotide
  Target: SCN9A; (+) strand; PAM type: NRG; PAM sequence: AAG
ataactggggtccttataag

SEQ ID NO: 45132 - DNA, 20 bp, Artificial Sequence
  Description of Artificial Sequence: Synthetic oligonucleotide
  Target: SCN9A; (+) strand; PAM type: NRG; PAM sequence: AAG
tggggtccttataagaagaa

SEQ ID NO: 45133 - DNA, 20 bp, Artificial Sequence
  Description of Artificial Sequence: Synthetic oligonucleotide
  Target: SCN9A; (+) strand; PAM type: NRG; PAM sequence: GAG
ccttataagaagaaaagacc

SEQ ID NO: 45134 - DNA, 20 bp, Artificial Sequence
  Description of Artificial Sequence: Synthetic oligonucleotide
  Target: SCN9A; (+) strand; PAM type: NRG; PAM sequence: CAG
gaagaaaagaccgagacaca

SEQ ID NO: 45135 - DNA, 20 bp, Artificial Sequence
  Description of Artificial Sequence: Synthetic oligonucleotide
  Target: SCN9A; (+) strand; PAM type: NRG; PAM sequence: AGG
aagaaaagaccgagacacac

SEQ ID NO: 45136 - DNA, 20 bp, Artificial Sequence
  Description of Artificial Sequence: Synthetic oligonucleotide
  Target: SCN9A; (+) strand; PAM type: NRG; PAM sequence: GGG
agaaaagaccgagacacaca

SEQ ID NO: 45137 - DNA, 20 bp, Artificial Sequence
  Description of Artificial Sequence: Synthetic oligonucleotide
  Target: SCN9A; (+) strand; PAM type: NRG; PAM sequence: GAG
aaaagaccgagacacacagg

SEQ ID NO: 45138 - DNA, 20 bp, Artificial Sequence
  Description of Artificial Sequence: Synthetic oligonucleotide
  Target: SCN9A; (+) strand; PAM type: NRG; PAM sequence: GAG
acacagggagaaaactacgt

SEQ ID NO: 45139 - DNA, 20 bp, Artificial Sequence
  Description of Artificial Sequence: Synthetic oligonucleotide
  Target: SCN9A; (+) strand; PAM type: NRG; PAM sequence: CGG
ggagaaaactacgtgagtac

SEQ ID NO: 45140 - DNA, 20 bp, Artificial Sequence
  Description of Artificial Sequence: Synthetic oligonucleotide
  Target: SCN9A; (+) strand; PAM type: NRG; PAM sequence: GGG
gagaaaactacgtgagtacc

SEQ ID NO: 45141 - DNA, 20 bp, Artificial Sequence
  Description of Artificial Sequence: Synthetic oligonucleotide
  Target: SCN9A; (+) strand; PAM type: NRG; PAM sequence: CAG
aaactacgtgagtaccgggc

SEQ ID NO: 45142 - DNA, 20 bp, Artificial Sequence
  Description of Artificial Sequence: Synthetic oligonucleotide
  Target: SCN9A; (+) strand; PAM type: NRG; PAM sequence: GAG
actacgtgagtaccgggcca

SEQ ID NO: 45143 - DNA, 20 bp, Artificial Sequence
  Description of Artificial Sequence: Synthetic oligonucleotide
  Target: SCN9A; (+) strand; PAM type: NRG; PAM sequence: TGG
gtgagtaccgggccagagat

SEQ ID NO: 45144 - DNA, 20 bp, Artificial Sequence
  Description of Artificial Sequence: Synthetic oligonucleotide
  Target: SCN9A; (+) strand; PAM type: NRG; PAM sequence: GGG
tgagtaccgggccagagatt

SEQ ID NO: 45145 - DNA, 20 bp, Artificial Sequence
  Description of Artificial Sequence: Synthetic oligonucleotide
  Target: SCN9A; (+) strand; PAM type: NRG; PAM sequence: CAG
ggccagagattgggatgatg

SEQ ID NO: 45146 - DNA, 20 bp, Artificial Sequence
  Description of Artificial Sequence: Synthetic oligonucleotide
  Target: SCN9A; (+) strand; PAM type: NRG; PAM sequence: AAG
gattgggatgatgcagctgc

SEQ ID NO: 45147 - DNA, 20 bp, Artificial Sequence
  Description of Artificial Sequence: Synthetic oligonucleotide
  Target: SCN9A; (+) strand; PAM type: NRG; PAM sequence: AAG
atgatgcagctgcaagctgc

SEQ ID NO: 45148 - DNA, 20 bp, Artificial Sequence
  Description of Artificial Sequence: Synthetic oligonucleotide
  Target: SCN9A; (+) strand; PAM type: NRG; PAM sequence: AGG
tgatgcagctgcaagctgca

SEQ ID NO: 45149 - DNA, 20 bp, Artificial Sequence
  Description of Artificial Sequence: Synthetic oligonucleotide
  Target: SCN9A; (+) strand; PAM type: NRG; PAM sequence: AAG
aggattgccaacaacctcca

SEQ ID NO: 45150 - DNA, 20 bp, Artificial Sequence
  Description of Artificial Sequence: Synthetic oligonucleotide
  Target: SCN9A; (+) strand; PAM type: NRG; PAM sequence: TAG
ttgccaacaacctccaaagt

SEQ ID NO: 45151 - DNA, 20 bp, Artificial Sequence
  Description of Artificial Sequence: Synthetic oligonucleotide
  Target: SCN9A; (+) strand; PAM type: NRG; PAM sequence: AAG
caacaacctccaaagttaga

SEQ ID NO: 45152 - DNA, 20 bp, Artificial Sequence
  Description of Artificial Sequence: Synthetic oligonucleotide
  Target: SCN9A; (+) strand; PAM type: NRG; PAM sequence: CAG
caacctccaaagttagaaag

SEQ ID NO: 45153 - DNA, 20 bp, Artificial Sequence
  Description of Artificial Sequence: Synthetic oligonucleotide
  Target: SCN9A; (+) strand; PAM type: NRG; PAM sequence: AAG
ctccaaagttagaaagcagc

SEQ ID NO: 45154 - DNA, 20 bp, Artificial Sequence
  Description of Artificial Sequence: Synthetic oligonucleotide
  Target: SCN9A; (+) strand; PAM type: NRG; PAM sequence: AGG
tccaaagttagaaagcagca

SEQ ID NO: 45155 - DNA, 20 bp, Artificial Sequence
  Description of Artificial Sequence: Synthetic oligonucleotide
  Target: SCN9A; (+) strand; PAM type: NRG; PAM sequence: CAG
aaagttagaaagcagcaagg

SEQ ID NO: 45156 - DNA, 20 bp, Artificial Sequence
  Description of Artificial Sequence: Synthetic oligonucleotide
  Target: SCN9A; (+) strand; PAM type: NRG; PAM sequence: AGG
aagttagaaagcagcaaggc

SEQ ID NO: 45157 - DNA, 20 bp, Artificial Sequence
  Description of Artificial Sequence: Synthetic oligonucleotide
  Target: SCN9A; (+) strand; PAM type: NRG; PAM sequence: TAG
cagcaaggcaggatacttac

SEQ ID NO: 45158 - DNA, 20 bp, Artificial Sequence
  Description of Artificial Sequence: Synthetic oligonucleotide
  Target: SCN9A; (+) strand; PAM type: NRG; PAM sequence: GAG
gcaaggcaggatacttacta

SEQ ID NO: 45159 - DNA, 20 bp, Artificial Sequence
  Description of Artificial Sequence: Synthetic oligonucleotide
  Target: SCN9A; (+) strand; PAM type: NRG; PAM sequence: TAG
aggatacttactagagcctt

SEQ ID NO: 45160 - DNA, 20 bp, Artificial Sequence
  Description of Artificial Sequence: Synthetic oligonucleotide
  Target: SCN9A; (+) strand; PAM type: NRG; PAM sequence: GAG
gatacttactagagccttta

SEQ ID NO: 45161 - DNA, 20 bp, Artificial Sequence
  Description of Artificial Sequence: Synthetic oligonucleotide
  Target: SCN9A; (+) strand; PAM type: NRG; PAM sequence: TGG
tagagcctttagagaaatca

SEQ ID NO: 45162 - DNA, 20 bp, Artificial Sequence
  Description of Artificial Sequence: Synthetic oligonucleotide
  Target: SCN9A; (+) strand; PAM type: NRG; PAM sequence: CAG
agagaaatcatggccttgct

SEQ ID NO: 45163 - DNA, 20 bp, Artificial Sequence
  Description of Artificial Sequence: Synthetic oligonucleotide
  Target: SCN9A; (+) strand; PAM type: NRG; PAM sequence: CAG
ccttgctcagaccttgattt

SEQ ID NO: 45164 - DNA, 20 bp, Artificial Sequence
  Description of Artificial Sequence: Synthetic oligonucleotide
  Target: SCN9A; (+) strand; PAM type: NRG; PAM sequence: TAG
agaccttgatttcagacttc

SEQ ID NO: 45165 - DNA, 20 bp, Artificial Sequence
  Description of Artificial Sequence: Synthetic oligonucleotide
  Target: SCN9A; (+) strand; PAM type: NRG; PAM sequence: CAG
gatttcagacttctagcctc

SEQ ID NO: 45166 - DNA, 20 bp, Artificial Sequence
  Description of Artificial Sequence: Synthetic oligonucleotide
  Target: SCN9A; (+) strand; PAM type: NRG; PAM sequence: TGG
agacttctagcctccagaac

SEQ ID NO: 45167 - DNA, 20 bp, Artificial Sequence
  Description of Artificial Sequence: Synthetic oligonucleotide
  Target: SCN9A; (+) strand; PAM type: NRG; PAM sequence: AAG
ctagcctccagaactggcaa

SEQ ID NO: 45168 - DNA, 20 bp, Artificial Sequence
  Description of Artificial Sequence: Synthetic oligonucleotide
  Target: SCN9A; (+) strand; PAM type: NRG; PAM sequence: AAG
gaataaatttctgttgttgt

SEQ ID NO: 45169 - DNA, 20 bp, Artificial Sequence
  Description of Artificial Sequence: Synthetic oligonucleotide
  Target: SCN9A; (+) strand; PAM type: NRG; PAM sequence: GAG
ttctgttgttgtaagccact

SEQ ID NO: 45170 - DNA, 20 bp, Artificial Sequence
  Description of Artificial Sequence: Synthetic oligonucleotide
  Target: SCN9A; (+) strand; PAM type: NRG; PAM sequence: CAG
gttttgctaatttgttacaa

SEQ ID NO: 45171 - DNA, 20 bp, Artificial Sequence
  Description of Artificial Sequence: Synthetic oligonucleotide
  Target: SCN9A; (+) strand; PAM type: NRG; PAM sequence: AAG
taatttgttacaacagccgt

SEQ ID NO: 45172 - DNA, 20 bp, Artificial Sequence
  Description of Artificial Sequence: Synthetic oligonucleotide
  Target: SCN9A; (+) strand; PAM type: NRG; PAM sequence: TGG
gtaagaaactaatacatcct

SEQ ID NO: 45173 - DNA, 20 bp, Artificial Sequence
  Description of Artificial Sequence: Synthetic oligonucleotide
  Target: SCN9A; (+) strand; PAM type: NRG; PAM sequence: CAG
aaactaatacatccttggat

SEQ ID NO: 45174 - DNA, 20 bp, Artificial Sequence
  Description of Artificial Sequence: Synthetic oligonucleotide
  Target: SCN9A; (+) strand; PAM type: NRG; PAM sequence: TAG
agctcacaatcttatatatc

SEQ ID NO: 45175 - DNA, 20 bp, Artificial Sequence
  Description of Artificial Sequence: Synthetic oligonucleotide
  Target: SCN9A; (+) strand; PAM type: NRG; PAM sequence: GAG
atcttatatatctagaccct

SEQ ID NO: 45176 - DNA, 20 bp, Artificial Sequence
  Description of Artificial Sequence: Synthetic oligonucleotide
  Target: SCN9A; (+) strand; PAM type: NRG; PAM sequence: AAG
gcccttatattttaactttc

SEQ ID NO: 45177 - DNA, 20 bp, Artificial Sequence
  Description of Artificial Sequence: Synthetic oligonucleotide
  Target: SCN9A; (+) strand; PAM type: NRG; PAM sequence: CAG
atcccgatattaaattgttg

SEQ ID NO: 45178 - DNA, 20 bp, Artificial Sequence
  Description of Artificial Sequence: Synthetic oligonucleotide
  Target: SCN9A; (+) strand; PAM type: NRG; PAM sequence: GAG
ttaaattgttgcagctgtgt

SEQ ID NO: 45179 - DNA, 20 bp, Artificial Sequence
  Description of Artificial Sequence: Synthetic oligonucleotide
  Target: SCN9A; (+) strand; PAM type: NRG; PAM sequence: CAG
gaacatgatcttttttccct

SEQ ID NO: 45180 - DNA, 20 bp, Artificial Sequence
  Description of Artificial Sequence: Synthetic oligonucleotide
  Target: SCN9A; (+) strand; PAM type: NRG; PAM sequence: TAG
ttttttccctcagcaattct

SEQ ID NO: 45181 - DNA, 20 bp, Artificial Sequence
  Description of Artificial Sequence: Synthetic oligonucleotide
  Target: SCN9A; (+) strand; PAM type: NRG; PAM sequence: CAG
tccctcagcaattcttagca

SEQ ID NO: 45182 - DNA, 20 bp, Artificial Sequence
  Description of Artificial Sequence: Synthetic oligonucleotide
  Target: SCN9A; (+) strand; PAM type: NRG; PAM sequence: TAG
gcaattcttagcacagtgct

SEQ ID NO: 45183 - DNA, 20 bp, Artificial Sequence
  Description of Artificial Sequence: Synthetic oligonucleotide
  Target: SCN9A; (+) strand; PAM type: NRG; PAM sequence: GAG
aattcttagcacagtgctta

SEQ ID NO: 45184 - DNA, 20 bp, Artificial Sequence
  Description of Artificial Sequence: Synthetic oligonucleotide
  Target: SCN9A; (+) strand; PAM type: NRG; PAM sequence: TAG
ttagcacagtgcttagagca

SEQ ID NO: 45185 - DNA, 20 bp, Artificial Sequence
  Description of Artificial Sequence: Synthetic oligonucleotide
  Target: SCN9A; (+) strand; PAM type: NRG; PAM sequence: AAG
cacagtgcttagagcatagt

SEQ ID NO: 45186 - DNA, 20 bp, Artificial Sequence
  Description of Artificial Sequence: Synthetic oligonucleotide
  Target: SCN9A; (+) strand; PAM type: NRG; PAM sequence: AGG
acagtgcttagagcatagta

SEQ ID NO: 45187 - DNA, 20 bp, Artificial Sequence
  Description of Artificial Sequence: Synthetic oligonucleotide
  Target: SCN9A; (+) strand; PAM type: NRG; PAM sequence: TGG
aataaatatttattgacaaa

SEQ ID NO: 45188 - DNA, 20 bp, Artificial Sequence
  Description of Artificial Sequence: Synthetic oligonucleotide
  Target: SCN9A; (+) strand; PAM type: NRG; PAM sequence: GGG
ataaatatttattgacaaat

SEQ ID NO: 45189 - DNA, 20 bp, Artificial Sequence
  Description of Artificial Sequence: Synthetic oligonucleotide
  Target: SCN9A; (+) strand; PAM type: NRG; PAM sequence: AAG
gtgcatttcatacttccttt

SEQ ID NO: 45190 - DNA, 20 bp, Artificial Sequence
  Description of Artificial Sequence: Synthetic oligonucleotide
  Target: SCN9A; (+) strand; PAM type: NRG; PAM sequence: AGG
tgcatttcatacttccttta

SEQ ID NO: 45191 - DNA, 20 bp, Artificial Sequence
  Description of Artificial Sequence: Synthetic oligonucleotide
  Target: SCN9A; (+) strand; PAM type: NRG; PAM sequence: GAG
cttcctttaaggcttctaat

SEQ ID NO: 45192 - DNA, 20 bp, Artificial Sequence
  Description of Artificial Sequence: Synthetic oligonucleotide
  Target: SCN9A; (+) strand; PAM type: NRG; PAM sequence: AGG
ttcctttaaggcttctaatg

SEQ ID NO: 45193 - DNA, 20 bp, Artificial Sequence
  Description of Artificial Sequence: Synthetic oligonucleotide
  Target: SCN9A; (+) strand; PAM type: NRG; PAM sequence: AAG
ctttaaggcttctaatgagg

SEQ ID NO: 45194 - DNA, 20 bp, Artificial Sequence
  Description of Artificial Sequence: Synthetic oligonucleotide
  Target: SCN9A; (+) strand; PAM type: NRG; PAM sequence: CAG
atgaggaagcacttcactgc

SEQ ID NO: 45195 - DNA, 20 bp, Artificial Sequence
  Description of Artificial Sequence: Synthetic oligonucleotide
  Target: SCN9A; (+) strand; PAM type: NRG; PAM sequence: TGG
aggaagcacttcactgccag

SEQ ID NO: 45196 - DNA, 20 bp, Artificial Sequence
  Description of Artificial Sequence: Synthetic oligonucleotide
  Target: SCN9A; (+) strand; PAM type: NRG; PAM sequence: AAG
cttcactgccagtggtaaaa

SEQ ID NO: 45197 - DNA, 20 bp, Artificial Sequence
  Description of Artificial Sequence: Synthetic oligonucleotide
  Target: SCN9A; (+) strand; PAM type: NRG; PAM sequence: TAG
cagtggtaaaaaagcctgtg

SEQ ID NO: 45198 - DNA, 20 bp, Artificial Sequence
  Description of Artificial Sequence: Synthetic oligonucleotide
  Target: SCN9A; (+) strand; PAM type: NRG; PAM sequence: TGG
tgtagtgtgttgttaatgtt

SEQ ID NO: 45199 - DNA, 20 bp, Artificial Sequence
  Description of Artificial Sequence: Synthetic oligonucleotide
  Target: SCN9A; (+) strand; PAM type: NRG; PAM sequence: GAG
tagtgtgttgttaatgtttg

SEQ ID NO: 45200 - DNA, 20 bp, Artificial Sequence
  Description of Artificial Sequence: Synthetic oligonucleotide
  Target: SCN9A; (+) strand; PAM type: NRG; PAM sequence: TGG
gttaatgtttggagtgtgct

SEQ ID NO: 45201 - DNA, 20 bp, Artificial Sequence
  Description of Artificial Sequence: Synthetic oligonucleotide
  Target: SCN9A; (+) strand; PAM type: NRG; PAM sequence: GAG
taatgtttggagtgtgcttg

SEQ ID NO: 45202 - DNA, 20 bp, Artificial Sequence
  Description of Artificial Sequence: Synthetic oligonucleotide
  Target: SCN9A; (+) strand; PAM type: NRG; PAM sequence: AGG
aatgtttggagtgtgcttgg

SEQ ID NO: 45203 - DNA, 20 bp, Artificial Sequence
  Description of Artificial Sequence: Synthetic oligonucleotide
  Target: SCN9A; (+) strand; PAM type: NRG; PAM sequence: GGG
atgtttggagtgtgcttgga

SEQ ID NO: 45204 - DNA, 20 bp, Artificial Sequence
  Description of Artificial Sequence: Synthetic oligonucleotide
  Target: SCN9A; (+) strand; PAM type: NRG; PAM sequence: CAG
tggagggcttcattgcactt

SEQ ID NO: 45205 - DNA, 20 bp, Artificial Sequence
  Description of Artificial Sequence: Synthetic oligonucleotide
  Target: SCN9A; (+) strand; PAM type: NRG; PAM sequence: AGG
ggagggcttcattgcacttc

SEQ ID NO: 45206 - DNA, 20 bp, Artificial Sequence
  Description of Artificial Sequence: Synthetic oligonucleotide
  Target: SCN9A; (+) strand; PAM type: NRG; PAM sequence: GAG
agggcttcattgcacttcag

SEQ ID NO: 45207 - DNA, 20 bp, Artificial Sequence
  Description of Artificial Sequence: Synthetic oligonucleotide
  Target: SCN9A; (+) strand; PAM type: NRG; PAM sequence: AAG
gcttcattgcacttcaggag

SEQ ID NO: 45208 - DNA, 20 bp, Artificial Sequence
  Description of Artificial Sequence: Synthetic oligonucleotide
  Target: SCN9A; (+) strand; PAM type: NRG; PAM sequence: AGG
cttcattgcacttcaggaga

SEQ ID NO: 45209 - DNA, 20 bp, Artificial Sequence
  Description of Artificial Sequence: Synthetic oligonucleotide
  Target: SCN9A; (+) strand; PAM type: NRG; PAM sequence: GAG
ttcaggagaaggctgactct

SEQ ID NO: 45210 - DNA, 20 bp, Artificial Sequence
  Description of Artificial Sequence: Synthetic oligonucleotide
  Target: SCN9A; (+) strand; PAM type: NRG; PAM sequence: AAG
aggagaaggctgactctgag

SEQ ID NO: 45211 - DNA, 20 bp, Artificial Sequence
  Description of Artificial Sequence: Synthetic oligonucleotide
  Target: SCN9A; (+) strand; PAM type: NRG; PAM sequence: GAG
gagaaggctgactctgagaa

SEQ ID NO: 45212 - DNA, 20 bp, Artificial Sequence
  Description of Artificial Sequence: Synthetic oligonucleotide
  Target: SCN9A; (+) strand; PAM type: NRG; PAM sequence: CAG
ctgactctgagaagagccat

SEQ ID NO: 45213 - DNA, 20 bp, Artificial Sequence
  Description of Artificial Sequence: Synthetic oligonucleotide
  Target: SCN9A; (+) strand; PAM type: NRG; PAM sequence: CAG
tctgagaagagccatcagtt

SEQ ID NO: 45214 - DNA, 20 bp, Artificial Sequence
  Description of Artificial Sequence: Synthetic oligonucleotide
  Target: SCN9A; (+) strand; PAM type: NRG; PAM sequence: TAG
cagttcagtgcctgcattct

SEQ ID NO: 45215 - DNA, 20 bp, Artificial Sequence
  Description of Artificial Sequence: Synthetic oligonucleotide
  Target: SCN9A; (+) strand; PAM type: NRG; PAM sequence: CAG
agtgcctgcattcttagaaa

SEQ ID NO: 45216 - DNA, 20 bp, Artificial Sequence
  Description of Artificial Sequence: Synthetic oligonucleotide
  Target: SCN9A; (+) strand; PAM type: NRG; PAM sequence: AAG
gcattcttagaaacagtgaa

SEQ ID NO: 45217 - DNA, 20 bp, Artificial Sequence
  Description of Artificial Sequence: Synthetic oligonucleotide
  Target: SCN9A; (+) strand; PAM type: NRG; PAM sequence: GAG
attcttagaaacagtgaaaa

SEQ ID NO: 45218 - DNA, 20 bp, Artificial Sequence
  Description of Artificial Sequence: Synthetic oligonucleotide
  Target: SCN9A; (+) strand; PAM type: NRG; PAM sequence: TGG
tgaaaagagtattattctca

SEQ ID NO: 45219 - DNA, 20 bp, Artificial Sequence
  Description of Artificial Sequence: Synthetic oligonucleotide
  Target: SCN9A; (+) strand; PAM type: NRG; PAM sequence: GGG
gaaaagagtattattctcat

SEQ ID NO: 45220 - DNA, 20 bp, Artificial Sequence
  Description of Artificial Sequence: Synthetic oligonucleotide
  Target: SCN9A; (+) strand; PAM type: NRG; PAM sequence: GAG
ttattctcatgggtaccttt

SEQ ID NO: 45221 - DNA, 20 bp, Artificial Sequence
  Description of Artificial Sequence: Synthetic oligonucleotide
  Target: SCN9A; (+) strand; PAM type: NRG; PAM sequence: CAG
catgggtacctttgagataa

SEQ ID NO: 45222 - DNA, 20 bp, Artificial Sequence
  Description of Artificial Sequence: Synthetic oligonucleotide
  Target: SCN9A; (+) strand; PAM type: NRG; PAM sequence: CAG
tctgacactgactatctctt

SEQ ID NO: 45223 - DNA, 20 bp, Artificial Sequence
  Description of Artificial Sequence: Synthetic oligonucleotide
  Target: SCN9A; (+) strand; PAM type: NRG; PAM sequence: GAG
tgacactgactatctcttca

SEQ ID NO: 45224 - DNA, 20 bp, Artificial Sequence
  Description of Artificial Sequence: Synthetic oligonucleotide
  Target: SCN9A; (+) strand; PAM type: NRG; PAM sequence: AAG
cactgactatctcttcagag

SEQ ID NO: 45225 - DNA, 20 bp, Artificial Sequence
  Description of Artificial Sequence: Synthetic oligonucleotide
  Target: SCN9A; (+) strand; PAM type: NRG; PAM sequence: CAG
tctatttccatttgtttcct

SEQ ID NO: 45226 - DNA, 20 bp, Artificial Sequence
  Description of Artificial Sequence: Synthetic oligonucleotide
  Target: SCN9A; (+) strand; PAM type: NRG; PAM sequence: AAG
ttgtttcctcagaactgttt

SEQ ID NO: 45227 - DNA, 20 bp, Artificial Sequence
  Description of Artificial Sequence: Synthetic oligonucleotide
  Target: SCN9A; (+) strand; PAM type: NRG; PAM sequence: TGG
tttgttttaactcatctctt

SEQ ID NO: 45228 - DNA, 20 bp, Artificial Sequence
  Description of Artificial Sequence: Synthetic oligonucleotide
  Target: SCN9A; (+) strand; PAM type: NRG; PAM sequence: AAG
ctctttggttattttctgat

SEQ ID NO: 45229 - DNA, 20 bp, Artificial Sequence
  Description of Artificial Sequence: Synthetic oligonucleotide
  Target: SCN9A; (+) strand; PAM type: NRG; PAM sequence: GAG
ctttggttattttctgataa

SEQ ID NO: 45230 - DNA, 20 bp, Artificial Sequence
  Description of Artificial Sequence: Synthetic oligonucleotide
  Target: SCN9A; (+) strand; PAM type: NRG; PAM sequence: AGG
tttggttattttctgataag

SEQ ID NO: 45231 - DNA, 20 bp, Artificial Sequence
  Description of Artificial Sequence: Synthetic oligonucleotide
  Target: SCN9A; (+) strand; PAM type: NRG; PAM sequence: TGG
aaaatattttgatttgattc

SEQ ID NO: 45232 - DNA, 20 bp, Artificial Sequence
  Description of Artificial Sequence: Synthetic oligonucleotide
  Target: SCN9A; (+) strand; PAM type: NRG; PAM sequence: GAG
aatattttgatttgattctg

SEQ ID NO: 45233 - DNA, 20 bp, Artificial Sequence
  Description of Artificial Sequence: Synthetic oligonucleotide
  Target: SCN9A; (+) strand; PAM type: NRG; PAM sequence: CAG
gtgtatttttaactgtctat

SEQ ID NO: 45234 - DNA, 20 bp, Artificial Sequence
  Description of Artificial Sequence: Synthetic oligonucleotide
  Target: SCN9A; (+) strand; PAM type: NRG; PAM sequence: AGG
tgtatttttaactgtctatc

SEQ ID NO: 45235 - DNA, 20 bp, Artificial Sequence
  Description of Artificial Sequence: Synthetic oligonucleotide
  Target: SCN9A; (+) strand; PAM type: NRG; PAM sequence: GAG
ttttaactgtctatcaggtt

SEQ ID NO: 45236 - DNA, 20 bp, Artificial Sequence
  Description of Artificial Sequence: Synthetic oligonucleotide
  Target: SCN9A; (+) strand; PAM type: NRG; PAM sequence: AGG
tttaactgtctatcaggttg

SEQ ID NO: 45237 - DNA, 20 bp, Artificial Sequence
  Description of Artificial Sequence: Synthetic oligonucleotide
  Target: SCN9A; (+) strand; PAM type: NRG; PAM sequence: TAG
gtcaacctgaaaacttatac

SEQ ID NO: 45238 - DNA, 20 bp, Artificial Sequence
  Description of Artificial Sequence: Synthetic oligonucleotide
  Target: SCN9A; (+) strand; PAM type: NRG; PAM sequence: AGG
tcaacctgaaaacttatact

SEQ ID NO: 45239 - DNA, 20 bp, Artificial Sequence
  Description of Artificial Sequence: Synthetic oligonucleotide
  Target: SCN9A; (+) strand; PAM type: NRG; PAM sequence: GAG
aacctgaaaacttatactag

SEQ ID NO: 45240 - DNA, 20 bp, Artificial Sequence
  Description of Artificial Sequence: Synthetic oligonucleotide
  Target: SCN9A; (+) strand; PAM type: NRG; PAM sequence: GAG
cctgaaaacttatactagga

SEQ ID NO: 45241 - DNA, 20 bp, Artificial Sequence
  Description of Artificial Sequence: Synthetic oligonucleotide
  Target: SCN9A; (+) strand; PAM type: NRG; PAM sequence: GAG
aattctccataaactctgtt

SEQ ID NO: 45242 - DNA, 20 bp, Artificial Sequence
  Description of Artificial Sequence: Synthetic oligonucleotide
  Target: SCN9A; (+) strand; PAM type: NRG; PAM sequence: CAG
cataaactctgttgagaaac

SEQ ID NO: 45243 - DNA, 20 bp, Artificial Sequence
  Description of Artificial Sequence: Synthetic oligonucleotide
  Target: SCN9A; (+) strand; PAM type: NRG; PAM sequence: AGG
ataaactctgttgagaaacc

SEQ ID NO: 45244 - DNA, 20 bp, Artificial Sequence
  Description of Artificial Sequence: Synthetic oligonucleotide
  Target: SCN9A; (+) strand; PAM type: NRG; PAM sequence: TAG
ctgttgagaaaccaggatgc

SEQ ID NO: 45245 - DNA, 20 bp, Artificial Sequence
  Description of Artificial Sequence: Synthetic oligonucleotide
  Target: SCN9A; (+) strand; PAM type: NRG; PAM sequence: AGG
tgttgagaaaccaggatgct

SEQ ID NO: 45246 - DNA, 20 bp, Artificial Sequence
  Description of Artificial Sequence: Synthetic oligonucleotide
  Target: SCN9A; (+) strand; PAM type: NRG; PAM sequence: AAG
accaggatgctaggtcataa

SEQ ID NO: 45247 - DNA, 20 bp, Artificial Sequence
  Description of Artificial Sequence: Synthetic oligonucleotide
  Target: SCN9A; (+) strand; PAM type: NRG; PAM sequence: GAG
caggatgctaggtcataaaa

SEQ ID NO: 45248 - DNA, 20 bp, Artificial Sequence
  Description of Artificial Sequence: Synthetic oligonucleotide
  Target: SCN9A; (+) strand; PAM type: NRG; PAM sequence: GAG
ggatgctaggtcataaaaga

SEQ ID NO: 45249 - DNA, 20 bp, Artificial Sequence
  Description of Artificial Sequence: Synthetic oligonucleotide
  Target: SCN9A; (+) strand; PAM type: NRG; PAM sequence: AGG
gatgctaggtcataaaagag

SEQ ID NO: 45250 - DNA, 20 bp, Artificial Sequence
  Description of Artificial Sequence: Synthetic oligonucleotide
  Target: SCN9A; (+) strand; PAM type: NRG; PAM sequence: GGG
atgctaggtcataaaagaga

SEQ ID NO: 45251 - DNA, 20 bp, Artificial Sequence
  Description of Artificial Sequence: Synthetic oligonucleotide
  Target: SCN9A; (+) strand; PAM type: NRG; PAM sequence: TGG
gtcataaaagagagggtttt

SEQ ID NO: 45252 - DNA, 20 bp, Artificial Sequence
  Description of Artificial Sequence: Synthetic oligonucleotide
  Target: SCN9A; (+) strand; PAM type: NRG; PAM sequence: GGG
tcataaaagagagggttttt

SEQ ID NO: 45253 - DNA, 20 bp, Artificial Sequence
  Description of Artificial Sequence: Synthetic oligonucleotide
  Target: SCN9A; (+) strand; PAM type: NRG; PAM sequence: TAG
taaaagagagggtttttggg

SEQ ID NO: 45254 - DNA, 20 bp, Artificial Sequence
  Description of Artificial Sequence: Synthetic oligonucleotide
  Target: SCN9A; (+) strand; PAM type: NRG; PAM sequence: AGG
aaaagagagggtttttgggt

SEQ ID NO: 45255 - DNA, 20 bp, Artificial Sequence
  Description of Artificial Sequence: Synthetic oligonucleotide
  Target: SCN9A; (+) strand; PAM type: NRG; PAM sequence: GGG
aaagagagggtttttgggta

SEQ ID NO: 45256 - DNA, 20 bp, Artificial Sequence
  Description of Artificial Sequence: Synthetic oligonucleotide
  Target: SCN9A; (+) strand; PAM type: NRG; PAM sequence: GAG
agagagggtttttgggtagg

SEQ ID NO: 45257 - DNA, 20 bp, Artificial Sequence
  Description of Artificial Sequence: Synthetic oligonucleotide
  Target: SCN9A; (+) strand; PAM type: NRG; PAM sequence: AAG
gagggtttttgggtagggag

SEQ ID NO: 45258 - DNA, 20 bp, Artificial Sequence
  Description of Artificial Sequence: Synthetic oligonucleotide
  Target: SCN9A; (+) strand; PAM type: NRG; PAM sequence: GAG
gggtttttgggtagggagaa

SEQ ID NO: 45259 - DNA, 20 bp, Artificial Sequence
  Description of Artificial Sequence: Synthetic oligonucleotide
  Target: SCN9A; (+) strand; PAM type: NRG; PAM sequence: GAG
gtttttgggtagggagaaga

SEQ ID NO: 45260 - DNA, 20 bp, Artificial Sequence
  Description of Artificial Sequence: Synthetic oligonucleotide
  Target: SCN9A; (+) strand; PAM type: NRG; PAM sequence: AGG
tttttgggtagggagaagag

SEQ ID NO: 45261 - DNA, 20 bp, Artificial Sequence
  Description of Artificial Sequence: Synthetic oligonucleotide
  Target: SCN9A; (+) strand; PAM type: NRG; PAM sequence: GGG
ttttgggtagggagaagaga

SEQ ID NO: 45262 - DNA, 20 bp, Artificial Sequence
  Description of Artificial Sequence: Synthetic oligonucleotide
  Target: SCN9A; (+) strand; PAM type: NRG; PAM sequence: GAG
ttgggtagggagaagagagg

SEQ ID NO: 45263 - DNA, 20 bp, Artificial Sequence
  Description of Artificial Sequence: Synthetic oligonucleotide
  Target: SCN9A; (+) strand; PAM type: NRG; PAM sequence: GAG
gggtagggagaagagaggga

SEQ ID NO: 45264 - DNA, 20 bp, Artificial Sequence
  Description of Artificial Sequence: Synthetic oligonucleotide
  Target: SCN9A; (+) strand; PAM type: NRG; PAM sequence: AAG
gaagagagggagagatatca

SEQ ID NO: 45265 - DNA, 20 bp, Artificial Sequence
  Description of Artificial Sequence: Synthetic oligonucleotide
  Target: SCN9A; (+) strand; PAM type: NRG; PAM sequence: AGG
aagagagggagagatatcaa

SEQ ID NO: 45266 - DNA, 20 bp, Artificial Sequence
  Description of Artificial Sequence: Synthetic oligonucleotide
  Target: SCN9A; (+) strand; PAM type: NRG; PAM sequence: CAG
gagggagagatatcaaaggt

SEQ ID NO: 45267 - DNA, 20 bp, Artificial Sequence
  Description of Artificial Sequence: Synthetic oligonucleotide
  Target: SCN9A; (+) strand; PAM type: NRG; PAM sequence: CAG
ttttccccttgctcaaaatg

SEQ ID NO: 45268 - DNA, 20 bp, Artificial Sequence
  Description of Artificial Sequence: Synthetic oligonucleotide
  Target: SCN9A; (+) strand; PAM type: NRG; PAM sequence: AGG
tttccccttgctcaaaatgc

SEQ ID NO: 45269 - DNA, 20 bp, Artificial Sequence
  Description of Artificial Sequence: Synthetic oligonucleotide
  Target: SCN9A; (+) strand; PAM type: NRG; PAM sequence: AAG
caaaatgcaggttcttaaac

SEQ ID NO: 45270 - DNA, 20 bp, Artificial Sequence
  Description of Artificial Sequence: Synthetic oligonucleotide
  Target: SCN9A; (+) strand; PAM type: NRG; PAM sequence: AAG
gcaggttcttaaacaagcaa

SEQ ID NO: 45271 - DNA, 20 bp, Artificial Sequence
  Description of Artificial Sequence: Synthetic oligonucleotide
  Target: SCN9A; (+) strand; PAM type: NRG; PAM sequence: AGG
caggttcttaaacaagcaaa

SEQ ID NO: 45272 - DNA, 20 bp, Artificial Sequence
  Description of Artificial Sequence: Synthetic oligonucleotide
  Target: SCN9A; (+) strand; PAM type: NRG; PAM sequence: GGG
aggttcttaaacaagcaaaa

SEQ ID NO: 45273 - DNA, 20 bp, Artificial Sequence
  Description of Artificial Sequence: Synthetic oligonucleotide
  Target: SCN9A; (+) strand; PAM type: NRG; PAM sequence: GGG
ggttcttaaacaagcaaaag

SEQ ID NO: 45274 - DNA, 20 bp, Artificial Sequence
  Description of Artificial Sequence: Synthetic oligonucleotide
  Target: SCN9A; (+) strand; PAM type: NRG; PAM sequence: TAG
caaaaggggaaatataccca

SEQ ID NO: 45275 - DNA, 20 bp, Artificial Sequence
  Description of Artificial Sequence: Synthetic oligonucleotide
  Target: SCN9A; (+) strand; PAM type: NRG; PAM sequence: AAG
atacccatagcccctgaata

SEQ ID NO: 45276 - DNA, 20 bp, Artificial Sequence
  Description of Artificial Sequence: Synthetic oligonucleotide
  Target: SCN9A; (+) strand; PAM type: NRG; PAM sequence: CAG
gaataaagaaaataatatct

SEQ ID NO: 45277 - DNA, 20 bp, Artificial Sequence
  Description of Artificial Sequence: Synthetic oligonucleotide
  Target: SCN9A; (+) strand; PAM type: NRG; PAM sequence: AAG
tatctcagaaacctgaatcc

SEQ ID NO: 45278 - DNA, 20 bp, Artificial Sequence
  Description of Artificial Sequence: Synthetic oligonucleotide
  Target: SCN9A; (+) strand; PAM type: NRG; PAM sequence: AAG
tcagaaacctgaatccaagt

SEQ ID NO: 45279 - DNA, 20 bp, Artificial Sequence
  Description of Artificial Sequence: Synthetic oligonucleotide
  Target: SCN9A; (+) strand; PAM type: NRG; PAM sequence: TAG
aaacctgaatccaagtaagc

SEQ ID NO: 45280 - DNA, 20 bp, Artificial Sequence
  Description of Artificial Sequence: Synthetic oligonucleotide
  Target: SCN9A; (+) strand; PAM type: NRG; PAM sequence: AGG
aacctgaatccaagtaagct

SEQ ID NO: 45281 - DNA, 20 bp, Artificial Sequence
  Description of Artificial Sequence: Synthetic oligonucleotide
  Target: SCN9A; (+) strand; PAM type: NRG; PAM sequence: GGG
acctgaatccaagtaagcta

SEQ ID NO: 45282 - DNA, 20 bp, Artificial Sequence
  Description of Artificial Sequence: Synthetic oligonucleotide
  Target: SCN9A; (+) strand; PAM type: NRG; PAM sequence: AAG
atccaagtaagctagggatt

SEQ ID NO: 45283 - DNA, 20 bp, Artificial Sequence
  Description of Artificial Sequence: Synthetic oligonucleotide
  Target: SCN9A; (+) strand; PAM type: NRG; PAM sequence: TGG
aagtaagctagggattaagt

SEQ ID NO: 45284 - DNA, 20 bp, Artificial Sequence
  Description of Artificial Sequence: Synthetic oligonucleotide
  Target: SCN9A; (+) strand; PAM type: NRG; PAM sequence: TGG
ataataattgtacatattta

SEQ ID NO: 45285 - DNA, 20 bp, Artificial Sequence
  Description of Artificial Sequence: Synthetic oligonucleotide
  Target: SCN9A; (+) strand; PAM type: NRG; PAM sequence: GGG
taataattgtacatatttat

SEQ ID NO: 45286 - DNA, 20 bp, Artificial Sequence
  Description of Artificial Sequence: Synthetic oligonucleotide
  Target: SCN9A; (+) strand; PAM type: NRG; PAM sequence: GGG
aataattgtacatatttatg

SEQ ID NO: 45287 - DNA, 20 bp, Artificial Sequence
  Description of Artificial Sequence: Synthetic oligonucleotide
  Target: SCN9A; (+) strand; PAM type: NRG; PAM sequence: TAG
tatttatggggtacatgtga

SEQ ID NO: 45288 - DNA, 20 bp, Artificial Sequence
  Description of Artificial Sequence: Synthetic oligonucleotide
  Target: SCN9A; (+) strand; PAM type: NRG; PAM sequence: TAG
tacattatataattatcaaa

SEQ ID NO: 45289 - DNA, 20 bp, Artificial Sequence
  Description of Artificial Sequence: Synthetic oligonucleotide
  Target: SCN9A; (+) strand; PAM type: NRG; PAM sequence: AGG
acattatataattatcaaat

SEQ ID NO: 45290 - DNA, 20 bp, Artificial Sequence
  Description of Artificial Sequence: Synthetic oligonucleotide
  Target: SCN9A; (+) strand; PAM type: NRG; PAM sequence: GGG
cattatataattatcaaata

SEQ ID NO: 45291 - DNA, 20 bp, Artificial Sequence
  Description of Artificial Sequence: Synthetic oligonucleotide
  Target: SCN9A; (+) strand; PAM type: NRG; PAM sequence: TAG
taattatcaaatagggtaac

SEQ ID NO: 45292 - DNA, 20 bp, Artificial Sequence
  Description of Artificial Sequence: Synthetic oligonucleotide
  Target: SCN9A; (+) strand; PAM type: NRG; PAM sequence: CAG
ttatcaaatagggtaactag

SEQ ID NO: 45293 - DNA, 20 bp, Artificial Sequence
  Description of Artificial Sequence: Synthetic oligonucleotide
  Target: SCN9A; (+) strand; PAM type: NRG; PAM sequence: TAG
tagggtaactagcagatcca

SEQ ID NO: 45294 - DNA, 20 bp, Artificial Sequence
  Description of Artificial Sequence: Synthetic oligonucleotide
  Target: SCN9A; (+) strand; PAM type: NRG; PAM sequence: GAG
aacatttaccatttctttgt

SEQ ID NO: 45295 - DNA, 20 bp, Artificial Sequence
  Description of Artificial Sequence: Synthetic oligonucleotide
  Target: SCN9A; (+) strand; PAM type: NRG; PAM sequence: AGG
acatttaccatttctttgtg

SEQ ID NO: 45296 - DNA, 20 bp, Artificial Sequence
  Description of Artificial Sequence: Synthetic oligonucleotide
  Target: SCN9A; (+) strand; PAM type: NRG; PAM sequence: GAG
atttaccatttctttgtgag

SEQ ID NO: 45297 - DNA, 20 bp, Artificial Sequence
  Description of Artificial Sequence: Synthetic oligonucleotide
  Target: SCN9A; (+) strand; PAM type: NRG; PAM sequence: TAG
ggagaccatttaaaaacttc

SEQ ID NO: 45298 - DNA, 20 bp, Artificial Sequence
  Description of Artificial Sequence: Synthetic oligonucleotide
  Target: SCN9A; (+) strand; PAM type: NRG; PAM sequence: TGG
ttgaaatatacaacacatta

SEQ ID NO: 45299 - DNA, 20 bp, Artificial Sequence
  Description of Artificial Sequence: Synthetic oligonucleotide
  Target: SCN9A; (+) strand; PAM type: NRG; PAM sequence: TAG
caacacattatggttaactc

SEQ ID NO: 45300 - DNA, 20 bp, Artificial Sequence
  Description of Artificial Sequence: Synthetic oligonucleotide
  Target: SCN9A; (+) strand; PAM type: NRG; PAM sequence: TAG
ctagtcatccaacgattcaa

SEQ ID NO: 45301 - DNA, 20 bp, Artificial Sequence
  Description of Artificial Sequence: Synthetic oligonucleotide
  Target: SCN9A; (+) strand; PAM type: NRG; PAM sequence: CAG
ccaacgattcaatagaacac

SEQ ID NO: 45302 - DNA, 20 bp, Artificial Sequence
  Description of Artificial Sequence: Synthetic oligonucleotide
  Target: SCN9A; (+) strand; PAM type: NRG; PAM sequence: TAG
ttattctttctatctcactg

SEQ ID NO: 45303 - DNA, 20 bp, Artificial Sequence
  Description of Artificial Sequence: Synthetic oligonucleotide
  Target: SCN9A; (+) strand; PAM type: NRG; PAM sequence: AAG
tccccacacctcgctcctcc

SEQ ID NO: 45304 - DNA, 20 bp, Artificial Sequence
  Description of Artificial Sequence: Synthetic oligonucleotide
  Target: SCN9A; (+) strand; PAM type: NRG; PAM sequence: TAG
ctacttctatgacaaccctt

SEQ ID NO: 45305 - DNA, 20 bp, Artificial Sequence
  Description of Artificial Sequence: Synthetic oligonucleotide
  Target: SCN9A; (+) strand; PAM type: NRG; PAM sequence: GAG
tttagattccacatatgtgt

SEQ ID NO: 45306 - DNA, 20 bp, Artificial Sequence
  Description of Artificial Sequence: Synthetic oligonucleotide
  Target: SCN9A; (+) strand; PAM type: NRG; PAM sequence: TGG
gatatttgactttctgtgcc

SEQ ID NO: 45307 - DNA, 20 bp, Artificial Sequence
  Description of Artificial Sequence: Synthetic oligonucleotide
  Target: SCN9A; (+) strand; PAM type: NRG; PAM sequence: CAG
tcacttaacataatgtcctc

SEQ ID NO: 45308 - DNA, 20 bp, Artificial Sequence
  Description of Artificial Sequence: Synthetic oligonucleotide
  Target: SCN9A; (+) strand; PAM type: NRG; PAM sequence: AGG
cacttaacataatgtcctcc

SEQ ID NO: 45309 - DNA, 20 bp, Artificial Sequence
  Description of Artificial Sequence: Synthetic oligonucleotide
  Target: SCN9A; (+) strand; PAM type: NRG; PAM sequence: CAG
attcatgttgccacaaataa

SEQ ID NO: 45310 - DNA, 20 bp, Artificial Sequence
  Description of Artificial Sequence: Synthetic oligonucleotide
  Target: SCN9A; (+) strand; PAM type: NRG; PAM sequence: AGG
ttcatgttgccacaaataac

SEQ ID NO: 45311 - DNA, 20 bp, Artificial Sequence
  Description of Artificial Sequence: Synthetic oligonucleotide
  Target: SCN9A; (+) strand; PAM type: NRG; PAM sequence: TGG
caggatttcattatttctta

SEQ ID NO: 45312 - DNA, 20 bp, Artificial Sequence
  Description of Artificial Sequence: Synthetic oligonucleotide
  Target: SCN9A; (+) strand; PAM type: NRG; PAM sequence: TGG
cattatttcttatggctgaa

SEQ ID NO: 45313 - DNA, 20 bp, Artificial Sequence
  Description of Artificial Sequence: Synthetic oligonucleotide
  Target: SCN9A; (+) strand; PAM type: NRG; PAM sequence: TAG
tttatttatttacgatcatt

SEQ ID NO: 45314 - DNA, 20 bp, Artificial Sequence
  Description of Artificial Sequence: Synthetic oligonucleotide
  Target: SCN9A; (+) strand; PAM type: NRG; PAM sequence: AGG
ttatttatttacgatcattt

SEQ ID NO: 45315 - DNA, 20 bp, Artificial Sequence
  Description of Artificial Sequence: Synthetic oligonucleotide
  Target: SCN9A; (+) strand; PAM type: NRG; PAM sequence: TGG
tttaggttaatatgataact

SEQ ID NO: 45316 - DNA, 20 bp, Artificial Sequence
  Description of Artificial Sequence: Synthetic oligonucleotide
  Target: SCN9A; (+) strand; PAM type: NRG; PAM sequence: CAG
gataacttggctattgtgaa

SEQ ID NO: 45317 - DNA, 20 bp, Artificial Sequence
  Description of Artificial Sequence: Synthetic oligonucleotide
  Target: SCN9A; (+) strand; PAM type: NRG; PAM sequence: CAG
cttggctattgtgaacagtg

SEQ ID NO: 45318 - DNA, 20 bp, Artificial Sequence
  Description of Artificial Sequence: Synthetic oligonucleotide
  Target: SCN9A; (+) strand; PAM type: NRG; PAM sequence: TAG
acagtgcagcaataaacata

SEQ ID NO: 45319 - DNA, 20 bp, Artificial Sequence
  Description of Artificial Sequence: Synthetic oligonucleotide
  Target: SCN9A; (+) strand; PAM type: NRG; PAM sequence: AGG
cagtgcagcaataaacatat

SEQ ID NO: 45320 - DNA, 20 bp, Artificial Sequence
  Description of Artificial Sequence: Synthetic oligonucleotide
  Target: SCN9A; (+) strand; PAM type: NRG; PAM sequence: GAG
gtgcagcaataaacatatag

SEQ ID NO: 45321 - DNA, 20 bp, Artificial Sequence
  Description of Artificial Sequence: Synthetic oligonucleotide
  Target: SCN9A; (+) strand; PAM type: NRG; PAM sequence: CAG
gcaataaacatataggagta

SEQ ID NO: 45322 - DNA, 20 bp, Artificial Sequence
  Description of Artificial Sequence: Synthetic oligonucleotide
  Target: SCN9A; (+) strand; PAM type: NRG; PAM sequence: TGG
catactgatttcatttcatc

SEQ ID NO: 45323 - DNA, 20 bp, Artificial Sequence
  Description of Artificial Sequence: Synthetic oligonucleotide
  Target: SCN9A; (+) strand; PAM type: NRG; PAM sequence: TAG
atttcatctggatatttact

SEQ ID NO: 45324 - DNA, 20 bp, Artificial Sequence
  Description of Artificial Sequence: Synthetic oligonucleotide
  Target: SCN9A; (+) strand; PAM type: NRG; PAM sequence: TGG
tctggatatttacttagtat

SEQ ID NO: 45325 - DNA, 20 bp, Artificial Sequence
  Description of Artificial Sequence: Synthetic oligonucleotide
  Target: SCN9A; (+) strand; PAM type: NRG; PAM sequence: GGG
ctggatatttacttagtatt

SEQ ID NO: 45326 - DNA, 20 bp, Artificial Sequence
  Description of Artificial Sequence: Synthetic oligonucleotide
  Target: SCN9A; (+) strand; PAM type: NRG; PAM sequence: TGG
ttacttagtattgggactgc

SEQ ID NO: 45327 - DNA, 20 bp, Artificial Sequence
  Description of Artificial Sequence: Synthetic oligonucleotide
  Target: SCN9A; (+) strand; PAM type: NRG; PAM sequence: AAG
attctatttttaatttttta

SEQ ID NO: 45328 - DNA, 20 bp, Artificial Sequence
  Description of Artificial Sequence: Synthetic oligonucleotide
  Target: SCN9A; (+) strand; PAM type: NRG; PAM sequence: TGG
ccccatattactttccataa

SEQ ID NO: 45329 - DNA, 20 bp, Artificial Sequence
  Description of Artificial Sequence: Synthetic oligonucleotide
  Target: SCN9A; (+) strand; PAM type: NRG; PAM sequence: TGG
catattactttccataatgg

SEQ ID NO: 45330 - DNA, 20 bp, Artificial Sequence
  Description of Artificial Sequence: Synthetic oligonucleotide
  Target: SCN9A; (+) strand; PAM type: NRG; PAM sequence: CAG
ctaatttacattctcacaat

SEQ ID NO: 45331 - DNA, 20 bp, Artificial Sequence
  Description of Artificial Sequence: Synthetic oligonucleotide
  Target: SCN9A; (+) strand; PAM type: NRG; PAM sequence: AAG
cattctcacaatcagtgtgt

SEQ ID NO: 45332 - DNA, 20 bp, Artificial Sequence
  Description of Artificial Sequence: Synthetic oligonucleotide
  Target: SCN9A; (+) strand; PAM type: NRG; PAM sequence: AGG
attctcacaatcagtgtgta

SEQ ID NO: 45333 - DNA, 20 bp, Artificial Sequence
  Description of Artificial Sequence: Synthetic oligonucleotide
  Target: SCN9A; (+) strand; PAM type: NRG; PAM sequence: TGG
tatatcttttgattttttga

SEQ ID NO: 45334 - DNA, 20 bp, Artificial Sequence
  Description of Artificial Sequence: Synthetic oligonucleotide
  Target: SCN9A; (+) strand; PAM type: NRG; PAM sequence: TAG
atcttttgattttttgatgg

SEQ ID NO: 45335 - DNA, 20 bp, Artificial Sequence
  Description of Artificial Sequence: Synthetic oligonucleotide
  Target: SCN9A; (+) strand; PAM type: NRG; PAM sequence: TAG
ttgatggtagccattttaac

SEQ ID NO: 45336 - DNA, 20 bp, Artificial Sequence
  Description of Artificial Sequence: Synthetic oligonucleotide
  Target: SCN9A; (+) strand; PAM type: NRG; PAM sequence: AGG
tgatggtagccattttaact

SEQ ID NO: 45337 - DNA, 20 bp, Artificial Sequence
  Description of Artificial Sequence: Synthetic oligonucleotide
  Target: SCN9A; (+) strand; PAM type: NRG; PAM sequence: GGG
gatggtagccattttaacta

SEQ ID NO: 45338 - DNA, 20 bp, Artificial Sequence
  Description of Artificial Sequence: Synthetic oligonucleotide
  Target: SCN9A; (+) strand; PAM type: NRG; PAM sequence: GAG
gtagccattttaactagggt

SEQ ID NO: 45339 - DNA, 20 bp, Artificial Sequence
  Description of Artificial Sequence: Synthetic oligonucleotide
  Target: SCN9A; (+) strand; PAM type: NRG; PAM sequence: AGG
tagccattttaactagggtg

SEQ ID NO: 45340 - DNA, 20 bp, Artificial Sequence
  Description of Artificial Sequence: Synthetic oligonucleotide
  Target: SCN9A; (+) strand; PAM type: NRG; PAM sequence: GAG
gccattttaactagggtgag

SEQ ID NO: 45341 - DNA, 20 bp, Artificial Sequence
  Description of Artificial Sequence: Synthetic oligonucleotide
  Target: SCN9A; (+) strand; PAM type: NRG; PAM sequence: AAG
ctagggtgaggagatacctc

SEQ ID NO: 45342 - DNA, 20 bp, Artificial Sequence
  Description of Artificial Sequence: Synthetic oligonucleotide
  Target: SCN9A; (+) strand; PAM type: NRG; PAM sequence: TAG
ggtgaggagatacctcaaga

SEQ ID NO: 45343 - DNA, 20 bp, Artificial Sequence
  Description of Artificial Sequence: Synthetic oligonucleotide
  Target: SCN9A; (+) strand; PAM type: NRG; PAM sequence: AGG
gtgaggagatacctcaagat

SEQ ID NO: 45344 - DNA, 20 bp, Artificial Sequence
  Description of Artificial Sequence: Synthetic oligonucleotide
  Target: SCN9A; (+) strand; PAM type: NRG; PAM sequence: TGG
aggtttgatttgcatttccc

SEQ ID NO: 45345 - DNA, 20 bp, Artificial Sequence
  Description of Artificial Sequence: Synthetic oligonucleotide
  Target: SCN9A; (+) strand; PAM type: NRG; PAM sequence: TAG
atttgcatttccctggtgat

SEQ ID NO: 45346 - DNA, 20 bp, Artificial Sequence
  Description of Artificial Sequence: Synthetic oligonucleotide
  Target: SCN9A; (+) strand; PAM type: NRG; PAM sequence: GAG
ccctggtgattagtgatgtt

SEQ ID NO: 45347 - DNA, 20 bp, Artificial Sequence
  Description of Artificial Sequence: Synthetic oligonucleotide
  Target: SCN9A; (+) strand; PAM type: NRG; PAM sequence: TGG
gcatattttcatttatctgt

SEQ ID NO: 45348 - DNA, 20 bp, Artificial Sequence
  Description of Artificial Sequence: Synthetic oligonucleotide
  Target: SCN9A; (+) strand; PAM type: NRG; PAM sequence: GAG
gcatttctttgtcttctttt

SEQ ID NO: 45349 - DNA, 20 bp, Artificial Sequence
  Description of Artificial Sequence: Synthetic oligonucleotide
  Target: SCN9A; (+) strand; PAM type: NRG; PAM sequence: CAG
tcttttgagaaatatctatt

SEQ ID NO: 45350 - DNA, 20 bp, Artificial Sequence
  Description of Artificial Sequence: Synthetic oligonucleotide
  Target: SCN9A; (+) strand; PAM type: NRG; PAM sequence: AGG
cttttgagaaatatctattc

SEQ ID NO: 45351 - DNA, 20 bp, Artificial Sequence
  Description of Artificial Sequence: Synthetic oligonucleotide
  Target: SCN9A; (+) strand; PAM type: NRG; PAM sequence: GAG
ttgttttttttgtcgttgtt

SEQ ID NO: 45352 - DNA, 20 bp, Artificial Sequence
  Description of Artificial Sequence: Synthetic oligonucleotide
  Target: SCN9A; (+) strand; PAM type: NRG; PAM sequence: GAG
ttgtcgttgttgagttgttt

SEQ ID NO: 45353 - DNA, 20 bp, Artificial Sequence
  Description of Artificial Sequence: Synthetic oligonucleotide
  Target: SCN9A; (+) strand; PAM type: NRG; PAM sequence: TAG
tttgagttccttgtatgttt

SEQ ID NO: 45354 - DNA, 20 bp, Artificial Sequence
  Description of Artificial Sequence: Synthetic oligonucleotide
  Target: SCN9A; (+) strand; PAM type: NRG; PAM sequence: CAG
tttagatattaacccattat

SEQ ID NO: 45355 - DNA, 20 bp, Artificial Sequence
  Description of Artificial Sequence: Synthetic oligonucleotide
  Target: SCN9A; (+) strand; PAM type: NRG; PAM sequence: TAG
ttaacccattatcagatgca

SEQ ID NO: 45356 - DNA, 20 bp, Artificial Sequence
  Description of Artificial Sequence: Synthetic oligonucleotide
  Target: SCN9A; (+) strand; PAM type: NRG; PAM sequence: TAG
aaatttattttcccattctg

SEQ ID NO: 45357 - DNA, 20 bp, Artificial Sequence
  Description of Artificial Sequence: Synthetic oligonucleotide
  Target: SCN9A; (+) strand; PAM type: NRG; PAM sequence: AGG
aatttattttcccattctgt

SEQ ID NO: 45358 - DNA, 20 bp, Artificial Sequence
  Description of Artificial Sequence: Synthetic oligonucleotide
  Target: SCN9A; (+) strand; PAM type: NRG; PAM sequence: CAG
tgattgtttgccttgctgtg

SEQ ID NO: 45359 - DNA, 20 bp, Artificial Sequence
  Description of Artificial Sequence: Synthetic oligonucleotide
  Target: SCN9A; (+) strand; PAM type: NRG; PAM sequence: AAG
ttgtttgccttgctgtgcag

SEQ ID NO: 45360 - DNA, 20 bp, Artificial Sequence
  Description of Artificial Sequence: Synthetic oligonucleotide
  Target: SCN9A; (+) strand; PAM type: NRG; PAM sequence: TAG
cttgctgtgcagaagctttt

SEQ ID NO: 45361 - DNA, 20 bp, Artificial Sequence
  Description of Artificial Sequence: Synthetic oligonucleotide
  Target: SCN9A; (+) strand; PAM type: NRG; PAM sequence: TAG
cttttgttgcctgtgctttt

SEQ ID NO: 45362 - DNA, 20 bp, Artificial Sequence
  Description of Artificial Sequence: Synthetic oligonucleotide
  Target: SCN9A; (+) strand; PAM type: NRG; PAM sequence: AGG
ttttgttgcctgtgcttttt

SEQ ID NO: 45363 - DNA, 20 bp, Artificial Sequence
  Description of Artificial Sequence: Synthetic oligonucleotide
  Target: SCN9A; (+) strand; PAM type: NRG; PAM sequence: TAG
tatccaaaaaaatccttgcc

SEQ ID NO: 45364 - DNA, 20 bp, Artificial Sequence
  Description of Artificial Sequence: Synthetic oligonucleotide
  Target: SCN9A; (+) strand; PAM type: NRG; PAM sequence: AAG
ttgcctagaacaacatcatg

SEQ ID NO: 45365 - DNA, 20 bp, Artificial Sequence
  Description of Artificial Sequence: Synthetic oligonucleotide
  Target: SCN9A; (+) strand; PAM type: NRG; PAM sequence: TAG
ctgttttttttcttctctaa

SEQ ID NO: 45366 - DNA, 20 bp, Artificial Sequence
  Description of Artificial Sequence: Synthetic oligonucleotide
  Target: SCN9A; (+) strand; PAM type: NRG; PAM sequence: TAG
tttcttctctaatagttgtg

SEQ ID NO: 45367 - DNA, 20 bp, Artificial Sequence
  Description of Artificial Sequence: Synthetic oligonucleotide
  Target: SCN9A; (+) strand; PAM type: NRG; PAM sequence: CAG
tctaatagttgtgtagtttt

SEQ ID NO: 45368 - DNA, 20 bp, Artificial Sequence
  Description of Artificial Sequence: Synthetic oligonucleotide
  Target: SCN9A; (+) strand; PAM type: NRG; PAM sequence: AAG
tagttttcagtcttacattt

SEQ ID NO: 45369 - DNA, 20 bp, Artificial Sequence
  Description of Artificial Sequence: Synthetic oligonucleotide
  Target: SCN9A; (+) strand; PAM type: NRG; PAM sequence: TAG
ttttcagtcttacatttaag

SEQ ID NO: 45370 - DNA, 20 bp, Artificial Sequence
  Description of Artificial Sequence: Synthetic oligonucleotide
  Target: SCN9A; (+) strand; PAM type: NRG; PAM sequence: GAG
acatttaagtagtctatttt

SEQ ID NO: 45371 - DNA, 20 bp, Artificial Sequence
  Description of Artificial Sequence: Synthetic oligonucleotide
  Target: SCN9A; (+) strand; PAM type: NRG; PAM sequence: AAG
tttgagttgacttgtgtata

SEQ ID NO: 45372 - DNA, 20 bp, Artificial Sequence
  Description of Artificial Sequence: Synthetic oligonucleotide
  Target: SCN9A; (+) strand; PAM type: NRG; PAM sequence: AAG
agttgacttgtgtataaagt

SEQ ID NO: 45373 - DNA, 20 bp, Artificial Sequence
  Description of Artificial Sequence: Synthetic oligonucleotide
  Target: SCN9A; (+) strand; PAM type: NRG; PAM sequence: GAG
ttgacttgtgtataaagtaa

SEQ ID NO: 45374 - DNA, 20 bp, Artificial Sequence
  Description of Artificial Sequence: Synthetic oligonucleotide
  Target: SCN9A; (+) strand; PAM type: NRG; PAM sequence: AAG
tgtgtataaagtaagagata

SEQ ID NO: 45375 - DNA, 20 bp, Artificial Sequence
  Description of Artificial Sequence: Synthetic oligonucleotide
  Target: SCN9A; (+) strand; PAM type: NRG; PAM sequence: AGG
gtgtataaagtaagagataa

SEQ ID NO: 45376 - DNA, 20 bp, Artificial Sequence
  Description of Artificial Sequence: Synthetic oligonucleotide
  Target: SCN9A; (+) strand; PAM type: NRG; PAM sequence: TGG
taatttcattcttttgcatg

SEQ ID NO: 45377 - DNA, 20 bp, Artificial Sequence
  Description of Artificial Sequence: Synthetic oligonucleotide
  Target: SCN9A; (+) strand; PAM type: NRG; PAM sequence: CAG
ttcttttgcatgtggctatt

SEQ ID NO: 45378 - DNA, 20 bp, Artificial Sequence
  Description of Artificial Sequence: Synthetic oligonucleotide
  Target: SCN9A; (+) strand; PAM type: NRG; PAM sequence: CAG
atgtggctattcagtttgcc

SEQ ID NO: 45379 - DNA, 20 bp, Artificial Sequence
  Description of Artificial Sequence: Synthetic oligonucleotide
  Target: SCN9A; (+) strand; PAM type: NRG; PAM sequence: AAG
ttgcccagaaccatttacta

SEQ ID NO: 45380 - DNA, 20 bp, Artificial Sequence
  Description of Artificial Sequence: Synthetic oligonucleotide
  Target: SCN9A; (+) strand; PAM type: NRG; PAM sequence: GAG
gcccagaaccatttactaaa

SEQ ID NO: 45381 - DNA, 20 bp, Artificial Sequence
  Description of Artificial Sequence: Synthetic oligonucleotide
  Target: SCN9A; (+) strand; PAM type: NRG; PAM sequence: AGG
cccagaaccatttactaaag

SEQ ID NO: 45382 - DNA, 20 bp, Artificial Sequence
  Description of Artificial Sequence: Synthetic oligonucleotide
  Target: SCN9A; (+) strand; PAM type: NRG; PAM sequence: TAG
aggctgtcctttctctatta

SEQ ID NO: 45383 - DNA, 20 bp, Artificial Sequence
  Description of Artificial Sequence: Synthetic oligonucleotide
  Target: SCN9A; (+) strand; PAM type: NRG; PAM sequence: AGG
ggctgtcctttctctattat

SEQ ID NO: 45384 - DNA, 20 bp, Artificial Sequence
  Description of Artificial Sequence: Synthetic oligonucleotide
  Target: SCN9A; (+) strand; PAM type: NRG; PAM sequence: TGG
ctttctctattataggtact

SEQ ID NO: 45385 - DNA, 20 bp, Artificial Sequence
  Description of Artificial Sequence: Synthetic oligonucleotide
  Target: SCN9A; (+) strand; PAM type: NRG; PAM sequence: CAG
cttggaaccttgtcaaaact

SEQ ID NO: 45386 - DNA, 20 bp, Artificial Sequence
  Description of Artificial Sequence: Synthetic oligonucleotide
  Target: SCN9A; (+) strand; PAM type: NRG; PAM sequence: TAG
ctcagttgactgtatatgtg

SEQ ID NO: 45387 - DNA, 20 bp, Artificial Sequence
  Description of Artificial Sequence: Synthetic oligonucleotide
  Target: SCN9A; (+) strand; PAM type: NRG; PAM sequence: TGG
tatatgtgtagatttatttc

SEQ ID NO: 45388 - DNA, 20 bp, Artificial Sequence
  Description of Artificial Sequence: Synthetic oligonucleotide
  Target: SCN9A; (+) strand; PAM type: NRG; PAM sequence: GGG
atatgtgtagatttatttct

SEQ ID NO: 45389 - DNA, 20 bp, Artificial Sequence
  Description of Artificial Sequence: Synthetic oligonucleotide
  Target: SCN9A; (+) strand; PAM type: NRG; PAM sequence: CAG
tctgtgtgtctgttttatgt

SEQ ID NO: 45390 - DNA, 20 bp, Artificial Sequence
  Description of Artificial Sequence: Synthetic oligonucleotide
  Target: SCN9A; (+) strand; PAM type: NRG; PAM sequence: TGG
tatgtcagtatcattctgtt

SEQ ID NO: 45391 - DNA, 20 bp, Artificial Sequence
  Description of Artificial Sequence: Synthetic oligonucleotide
  Target: SCN9A; (+) strand; PAM type: NRG; PAM sequence: TAG
atcattctgtttggttacta

SEQ ID NO: 45392 - DNA, 20 bp, Artificial Sequence
  Description of Artificial Sequence: Synthetic oligonucleotide
  Target: SCN9A; (+) strand; PAM type: NRG; PAM sequence: TAG
gtttggttactatagcttta

SEQ ID NO: 45393 - DNA, 20 bp, Artificial Sequence
  Description of Artificial Sequence: Synthetic oligonucleotide
  Target: SCN9A; (+) strand; PAM type: NRG; PAM sequence: AAG
tagctttatagtatgttttg

SEQ ID NO: 45394 - DNA, 20 bp, Artificial Sequence
  Description of Artificial Sequence: Synthetic oligonucleotide
  Target: SCN9A; (+) strand; PAM type: NRG; PAM sequence: CAG
tttatagtatgttttgaagt

SEQ ID NO: 45395 - DNA, 20 bp, Artificial Sequence
  Description of Artificial Sequence: Synthetic oligonucleotide
  Target: SCN9A; (+) strand; PAM type: NRG; PAM sequence: TAG
tagtatgttttgaagtcagt

SEQ ID NO: 45396 - DNA, 20 bp, Artificial Sequence
  Description of Artificial Sequence: Synthetic oligonucleotide
  Target: SCN9A; (+) strand; PAM type: NRG; PAM sequence: AAG
ttttgaagtcagttagtgtg

SEQ ID NO: 45397 - DNA, 20 bp, Artificial Sequence
  Description of Artificial Sequence: Synthetic oligonucleotide
  Target: SCN9A; (+) strand; PAM type: NRG; PAM sequence: CAG
gtcagttagtgtgaagccat

SEQ ID NO: 45398 - DNA, 20 bp, Artificial Sequence
  Description of Artificial Sequence: Synthetic oligonucleotide
  Target: SCN9A; (+) strand; PAM type: NRG; PAM sequence: CAG
cagctttgttctttttgttc

SEQ ID NO: 45399 - DNA, 20 bp, Artificial Sequence
  Description of Artificial Sequence: Synthetic oligonucleotide
  Target: SCN9A; (+) strand; PAM type: NRG; PAM sequence: AGG
agctttgttctttttgttcc

SEQ ID NO: 45400 - DNA, 20 bp, Artificial Sequence
  Description of Artificial Sequence: Synthetic oligonucleotide
  Target: SCN9A; (+) strand; PAM type: NRG; PAM sequence: TGG
tctttttgttccaggttact

SEQ ID NO: 45401 - DNA, 20 bp, Artificial Sequence
  Description of Artificial Sequence: Synthetic oligonucleotide
  Target: SCN9A; (+) strand; PAM type: NRG; PAM sequence: GGG
ctttttgttccaggttactt

SEQ ID NO: 45402 - DNA, 20 bp, Artificial Sequence
  Description of Artificial Sequence: Synthetic oligonucleotide
  Target: SCN9A; (+) strand; PAM type: NRG; PAM sequence: TAG
tccaggttacttgggctatt

SEQ ID NO: 45403 - DNA, 20 bp, Artificial Sequence
  Description of Artificial Sequence: Synthetic oligonucleotide
  Target: SCN9A; (+) strand; PAM type: NRG; PAM sequence: AGG
ccaggttacttgggctattt

SEQ ID NO: 45404 - DNA, 20 bp, Artificial Sequence
  Description of Artificial Sequence: Synthetic oligonucleotide
  Target: SCN9A; (+) strand; PAM type: NRG; PAM sequence: GGG
caggttacttgggctattta

SEQ ID NO: 45405 - DNA, 20 bp, Artificial Sequence
  Description of Artificial Sequence: Synthetic oligonucleotide
  Target: SCN9A; (+) strand; PAM type: NRG; PAM sequence: TGG
gggctatttagggtcttttg

SEQ ID NO: 45406 - DNA, 20 bp, Artificial Sequence
  Description of Artificial Sequence: Synthetic oligonucleotide
  Target: SCN9A; (+) strand; PAM type: NRG; PAM sequence: TAG
ttgtggtttcatacaaatgt

SEQ ID NO: 45407 - DNA, 20 bp, Artificial Sequence
  Description of Artificial Sequence: Synthetic oligonucleotide
  Target: SCN9A; (+) strand; PAM type: NRG; PAM sequence: AGG
tgtggtttcatacaaatgtt

SEQ ID NO: 45408 - DNA, 20 bp, Artificial Sequence
  Description of Artificial Sequence: Synthetic oligonucleotide
  Target: SCN9A; (+) strand; PAM type: NRG; PAM sequence: AAG
tttttttttttttttctgta

SEQ ID NO: 45409 - DNA, 20 bp, Artificial Sequence
  Description of Artificial Sequence: Synthetic oligonucleotide
  Target: SCN9A; (+) strand; PAM type: NRG; PAM sequence: TGG
ttttctgtaaagaatgtcac

SEQ ID NO: 45410 - DNA, 20 bp, Artificial Sequence
  Description of Artificial Sequence: Synthetic oligonucleotide
  Target: SCN9A; (+) strand; PAM type: NRG; PAM sequence: TAG
gaatgtcactggtattttga

SEQ ID NO: 45411 - DNA, 20 bp, Artificial Sequence
  Description of Artificial Sequence: Synthetic oligonucleotide
  Target: SCN9A; (+) strand; PAM type: NRG; PAM sequence: AGG
aatgtcactggtattttgat

SEQ ID NO: 45412 - DNA, 20 bp, Artificial Sequence
  Description of Artificial Sequence: Synthetic oligonucleotide
  Target: SCN9A; (+) strand; PAM type: NRG; PAM sequence: GGG
atgtcactggtattttgata

SEQ ID NO: 45413 - DNA, 20 bp, Artificial Sequence
  Description of Artificial Sequence: Synthetic oligonucleotide
  Target: SCN9A; (+) strand; PAM type: NRG; PAM sequence: TAG
tagggattgcattaaacctg

SEQ ID NO: 45414 - DNA, 20 bp, Artificial Sequence
  Description of Artificial Sequence: Synthetic oligonucleotide
  Target: SCN9A; (+) strand; PAM type: NRG; PAM sequence: TGG
attaaacctgtagattgctt

SEQ ID NO: 45415 - DNA, 20 bp, Artificial Sequence
  Description of Artificial Sequence: Synthetic oligonucleotide
  Target: SCN9A; (+) strand; PAM type: NRG; PAM sequence: GGG
ttaaacctgtagattgcttt

SEQ ID NO: 45416 - DNA, 20 bp, Artificial Sequence
  Description of Artificial Sequence: Synthetic oligonucleotide
  Target: SCN9A; (+) strand; PAM type: NRG; PAM sequence: TGG
gtagattgctttgggtaata

SEQ ID NO: 45417 - DNA, 20 bp, Artificial Sequence
  Description of Artificial Sequence: Synthetic oligonucleotide
  Target: SCN9A; (+) strand; PAM type: NRG; PAM sequence: TGG
attattctaatccatgaaca

SEQ ID NO: 45418 - DNA, 20 bp, Artificial Sequence
  Description of Artificial Sequence: Synthetic oligonucleotide
  Target: SCN9A; (+) strand; PAM type: NRG; PAM sequence: TAG
tttctctcaccaatatttta

SEQ ID NO: 45419 - DNA, 20 bp, Artificial Sequence
  Description of Artificial Sequence: Synthetic oligonucleotide
  Target: SCN9A; (+) strand; PAM type: NRG; PAM sequence: TAG
tccttgtttaaatttatttc

SEQ ID NO: 45420 - DNA, 20 bp, Artificial Sequence
  Description of Artificial Sequence: Synthetic oligonucleotide
  Target: SCN9A; (+) strand; PAM type: NRG; PAM sequence: AGG
ccttgtttaaatttatttct

SEQ ID NO: 45421 - DNA, 20 bp, Artificial Sequence
  Description of Artificial Sequence: Synthetic oligonucleotide
  Target: SCN9A; (+) strand; PAM type: NRG; PAM sequence: TAG
tctaggtattttattttttg

SEQ ID NO: 45422 - DNA, 20 bp, Artificial Sequence
  Description of Artificial Sequence: Synthetic oligonucleotide
  Target: SCN9A; (+) strand; PAM type: NRG; PAM sequence: TGG
ttttttgtagctattgtaaa

SEQ ID NO: 45423 - DNA, 20 bp, Artificial Sequence
  Description of Artificial Sequence: Synthetic oligonucleotide
  Target: SCN9A; (+) strand; PAM type: NRG; PAM sequence: GGG
tttttgtagctattgtaaat

SEQ ID NO: 45424 - DNA, 20 bp, Artificial Sequence
  Description of Artificial Sequence: Synthetic oligonucleotide
  Target: SCN9A; (+) strand; PAM type: NRG; PAM sequence: CAG
tgggattgctttcttatttt

SEQ ID NO: 45425 - DNA, 20 bp, Artificial Sequence
  Description of Artificial Sequence: Synthetic oligonucleotide
  Target: SCN9A; (+) strand; PAM type: NRG; PAM sequence: TAG
gattatttgttgttaacata

SEQ ID NO: 45426 - DNA, 20 bp, Artificial Sequence
  Description of Artificial Sequence: Synthetic oligonucleotide
  Target: SCN9A; (+) strand; PAM type: NRG; PAM sequence: TGG
aaatctactactttttttca

SEQ ID NO: 45427 - DNA, 20 bp, Artificial Sequence
  Description of Artificial Sequence: Synthetic oligonucleotide
  Target: SCN9A; (+) strand; PAM type: NRG; PAM sequence: GGG
aatctactactttttttcat

SEQ ID NO: 45428 - DNA, 20 bp, Artificial Sequence
  Description of Artificial Sequence: Synthetic oligonucleotide
  Target: SCN9A; (+) strand; PAM type: NRG; PAM sequence: GGG
atctactactttttttcatg

SEQ ID NO: 45429 - DNA, 20 bp, Artificial Sequence
  Description of Artificial Sequence: Synthetic oligonucleotide
  Target: SCN9A; (+) strand; PAM type: NRG; PAM sequence: TAG
actttttttcatggggtcat

SEQ ID NO: 45430 - DNA, 20 bp, Artificial Sequence
  Description of Artificial Sequence: Synthetic oligonucleotide
  Target: SCN9A; (+) strand; PAM type: NRG; PAM sequence: AAG
cattagaactctctatatct

SEQ ID NO: 45431 - DNA, 20 bp, Artificial Sequence
  Description of Artificial Sequence: Synthetic oligonucleotide
  Target: SCN9A; (+) strand; PAM type: NRG; PAM sequence: CAG
gaactctctatatctaagat

SEQ ID NO: 45432 - DNA, 20 bp, Artificial Sequence
  Description of Artificial Sequence: Synthetic oligonucleotide
  Target: SCN9A; (+) strand; PAM type: NRG; PAM sequence: AAG
gatcagatcatataaaaaca

SEQ ID NO: 45433 - DNA, 20 bp, Artificial Sequence
  Description of Artificial Sequence: Synthetic oligonucleotide
  Target: SCN9A; (+) strand; PAM type: NRG; PAM sequence: GAG
tcagatcatataaaaacaaa

SEQ ID NO: 45434 - DNA, 20 bp, Artificial Sequence
  Description of Artificial Sequence: Synthetic oligonucleotide
  Target: SCN9A; (+) strand; PAM type: NRG; PAM sequence: TGG
tttctcttgcctgattgctc

SEQ ID NO: 45435 - DNA, 20 bp, Artificial Sequence
  Description of Artificial Sequence: Synthetic oligonucleotide
  Target: SCN9A; (+) strand; PAM type: NRG; PAM sequence: TAG
tcttgcctgattgctctggc

SEQ ID NO: 45436 - DNA, 20 bp, Artificial Sequence
  Description of Artificial Sequence: Synthetic oligonucleotide
  Target: SCN9A; (+) strand; PAM type: NRG; PAM sequence: AAG
ttcattactatgttgaataa

SEQ ID NO: 45437 - DNA, 20 bp, Artificial Sequence
  Description of Artificial Sequence: Synthetic oligonucleotide
  Target: SCN9A; (+) strand; PAM type: NRG; PAM sequence: TAG
attactatgttgaataaaag

SEQ ID NO: 45438 - DNA, 20 bp, Artificial Sequence
  Description of Artificial Sequence: Synthetic oligonucleotide
  Target: SCN9A; (+) strand; PAM type: NRG; PAM sequence: AAG
atgttgaataaaagtagtga

SEQ ID NO: 45439 - DNA, 20 bp, Artificial Sequence
  Description of Artificial Sequence: Synthetic oligonucleotide
  Target: SCN9A; (+) strand; PAM type: NRG; PAM sequence: TGG
ttgaataaaagtagtgaaag

SEQ ID NO: 45440 - DNA, 20 bp, Artificial Sequence
  Description of Artificial Sequence: Synthetic oligonucleotide
  Target: SCN9A; (+) strand; PAM type: NRG; PAM sequence: GGG
tgaataaaagtagtgaaagt

SEQ ID NO: 45441 - DNA, 20 bp, Artificial Sequence
  Description of Artificial Sequence: Synthetic oligonucleotide
  Target: SCN9A; (+) strand; PAM type: NRG; PAM sequence: CAG
tgggcatccttatcttgttc

SEQ ID NO: 45442 - DNA, 20 bp, Artificial Sequence
  Description of Artificial Sequence: Synthetic oligonucleotide
  Target: SCN9A; (+) strand; PAM type: NRG; PAM sequence: TGG
ccttatcttgttccagatct

SEQ ID NO: 45443 - DNA, 20 bp, Artificial Sequence
  Description of Artificial Sequence: Synthetic oligonucleotide
  Target: SCN9A; (+) strand; PAM type: NRG; PAM sequence: GAG
ttatcttgttccagatcttg

SEQ ID NO: 45444 - DNA, 20 bp, Artificial Sequence
  Description of Artificial Sequence: Synthetic oligonucleotide
  Target: SCN9A; (+) strand; PAM type: NRG; PAM sequence: GAG
atcttgttccagatcttgga

SEQ ID NO: 45445 - DNA, 20 bp, Artificial Sequence
  Description of Artificial Sequence: Synthetic oligonucleotide
  Target: SCN9A; (+) strand; PAM type: NRG; PAM sequence: AAG
tgttccagatcttggagaga

SEQ ID NO: 45446 - DNA, 20 bp, Artificial Sequence
  Description of Artificial Sequence: Synthetic oligonucleotide
  Target: SCN9A; (+) strand; PAM type: NRG; PAM sequence: CAG
gatcttggagagaaagcttt

SEQ ID NO: 45447 - DNA, 20 bp, Artificial Sequence
  Description of Artificial Sequence: Synthetic oligonucleotide
  Target: SCN9A; (+) strand; PAM type: NRG; PAM sequence: TGG
gaaagctttcagctcttccc

SEQ ID NO: 45448 - DNA, 20 bp, Artificial Sequence
  Description of Artificial Sequence: Synthetic oligonucleotide
  Target: SCN9A; (+) strand; PAM type: NRG; PAM sequence: TAG
gctttcagctcttccctggt

SEQ ID NO: 45449 - DNA, 20 bp, Artificial Sequence
  Description of Artificial Sequence: Synthetic oligonucleotide
  Target: SCN9A; (+) strand; PAM type: NRG; PAM sequence: TAG
ttccctggttagtatcatgt

SEQ ID NO: 45450 - DNA, 20 bp, Artificial Sequence
  Description of Artificial Sequence: Synthetic oligonucleotide
  Target: SCN9A; (+) strand; PAM type: NRG; PAM sequence: TGG
ggttagtatcatgttagctg

SEQ ID NO: 45451 - DNA, 20 bp, Artificial Sequence
  Description of Artificial Sequence: Synthetic oligonucleotide
  Target: SCN9A; (+) strand; PAM type: NRG; PAM sequence: GGG
gttagtatcatgttagctgt

SEQ ID NO: 45452 - DNA, 20 bp, Artificial Sequence
  Description of Artificial Sequence: Synthetic oligonucleotide
  Target: SCN9A; (+) strand; PAM type: NRG; PAM sequence: TGG
agctgtgggtttgttacata

SEQ ID NO: 45453 - DNA, 20 bp, Artificial Sequence
  Description of Artificial Sequence: Synthetic oligonucleotide
  Target: SCN9A; (+) strand; PAM type: NRG; PAM sequence: AAG
catatggccttcattacatt

SEQ ID NO: 45454 - DNA, 20 bp, Artificial Sequence
  Description of Artificial Sequence: Synthetic oligonucleotide
  Target: SCN9A; (+) strand; PAM type: NRG; PAM sequence: AGG
atatggccttcattacatta

SEQ ID NO: 45455 - DNA, 20 bp, Artificial Sequence
  Description of Artificial Sequence: Synthetic oligonucleotide
  Target: SCN9A; (+) strand; PAM type: NRG; PAM sequence: AAG
ttgataatttttatcaaata

SEQ ID NO: 45456 - DNA, 20 bp, Artificial Sequence
  Description of Artificial Sequence: Synthetic oligonucleotide
  Target: SCN9A; (+) strand; PAM type: NRG; PAM sequence: AGG
tgataatttttatcaaataa

SEQ ID NO: 45457 - DNA, 20 bp, Artificial Sequence
  Description of Artificial Sequence: Synthetic oligonucleotide
  Target: SCN9A; (+) strand; PAM type: NRG; PAM sequence: TGG
ttttatcaaataaaggatac

SEQ ID NO: 45458 - DNA, 20 bp, Artificial Sequence
  Description of Artificial Sequence: Synthetic oligonucleotide
  Target: SCN9A; (+) strand; PAM type: NRG; PAM sequence: GAG
atgctttttctctgtctatt

SEQ ID NO: 45459 - DNA, 20 bp, Artificial Sequence
  Description of Artificial Sequence: Synthetic oligonucleotide
  Target: SCN9A; (+) strand; PAM type: NRG; PAM sequence: TGG
tgtctattgagatgattata

SEQ ID NO: 45460 - DNA, 20 bp, Artificial Sequence
  Description of Artificial Sequence: Synthetic oligonucleotide
  Target: SCN9A; (+) strand; PAM type: NRG; PAM sequence: TAG
ttcattctgttgatataata

SEQ ID NO: 45461 - DNA, 20 bp, Artificial Sequence
  Description of Artificial Sequence: Synthetic oligonucleotide
  Target: SCN9A; (+) strand; PAM type: NRG; PAM sequence: AAG
ttctgttgatataatataga

SEQ ID NO: 45462 - DNA, 20 bp, Artificial Sequence
  Description of Artificial Sequence: Synthetic oligonucleotide
  Target: SCN9A; (+) strand; PAM type: NRG; PAM sequence: TGG
ttgaaacatctttgcatccc

SEQ ID NO: 45463 - DNA, 20 bp, Artificial Sequence
  Description of Artificial Sequence: Synthetic oligonucleotide
  Target: SCN9A; (+) strand; PAM type: NRG; PAM sequence: GGG
tgaaacatctttgcatccct

SEQ ID NO: 45464 - DNA, 20 bp, Artificial Sequence
  Description of Artificial Sequence: Synthetic oligonucleotide
  Target: SCN9A; (+) strand; PAM type: NRG; PAM sequence: CAG
tgcatccctgggacgatttc

SEQ ID NO: 45465 - DNA, 20 bp, Artificial Sequence
  Description of Artificial Sequence: Synthetic oligonucleotide
  Target: SCN9A; (+) strand; PAM type: NRG; PAM sequence: GAG
ccctgggacgatttccagtt

SEQ ID NO: 45466 - DNA, 20 bp, Artificial Sequence
  Description of Artificial Sequence: Synthetic oligonucleotide
  Target: SCN9A; (+) strand; PAM type: NRG; PAM sequence: TGG
ggacgatttccagttgagca

SEQ ID NO: 45467 - DNA, 20 bp, Artificial Sequence
  Description of Artificial Sequence: Synthetic oligonucleotide
  Target: SCN9A; (+) strand; PAM type: NRG; PAM sequence: TAG
atggtgaataatctttttga

SEQ ID NO: 45468 - DNA, 20 bp, Artificial Sequence
  Description of Artificial Sequence: Synthetic oligonucleotide
  Target: SCN9A; (+) strand; PAM type: NRG; PAM sequence: AGG
tggtgaataatctttttgat

SEQ ID NO: 45469 - DNA, 20 bp, Artificial Sequence
  Description of Artificial Sequence: Synthetic oligonucleotide
  Target: SCN9A; (+) strand; PAM type: NRG; PAM sequence: TGG
taatctttttgataggctgt

SEQ ID NO: 45470 - DNA, 20 bp, Artificial Sequence
  Description of Artificial Sequence: Synthetic oligonucleotide
  Target: SCN9A; (+) strand; PAM type: NRG; PAM sequence: GAG
tttgataggctgttggattt

SEQ ID NO: 45471 - DNA, 20 bp, Artificial Sequence
  Description of Artificial Sequence: Synthetic oligonucleotide
  Target: SCN9A; (+) strand; PAM type: NRG; PAM sequence: TAG
ggctgttggatttgagttgc

SEQ ID NO: 45472 - DNA, 20 bp, Artificial Sequence
  Description of Artificial Sequence: Synthetic oligonucleotide
  Target: SCN9A; (+) strand; PAM type: NRG; PAM sequence: TGG
ttgagttgctagtattttgt

SEQ ID NO: 45473 - DNA, 20 bp, Artificial Sequence
  Description of Artificial Sequence: Synthetic oligonucleotide
  Target: SCN9A; (+) strand; PAM type: NRG; PAM sequence: GGG
tgagttgctagtattttgtt

SEQ ID NO: 45474 - DNA, 20 bp, Artificial Sequence
  Description of Artificial Sequence: Synthetic oligonucleotide
  Target: SCN9A; (+) strand; PAM type: NRG; PAM sequence: GGG
gagttgctagtattttgttg

SEQ ID NO: 45475 - DNA, 20 bp, Artificial Sequence
  Description of Artificial Sequence: Synthetic oligonucleotide
  Target: SCN9A; (+) strand; PAM type: NRG; PAM sequence: CAG
cattttgcatctgtgttcat

SEQ ID NO: 45476 - DNA, 20 bp, Artificial Sequence
  Description of Artificial Sequence: Synthetic oligonucleotide
  Target: SCN9A; (+) strand; PAM type: NRG; PAM sequence: AGG
attttgcatctgtgttcatc

SEQ ID NO: 45477 - DNA, 20 bp, Artificial Sequence
  Description of Artificial Sequence: Synthetic oligonucleotide
  Target: SCN9A; (+) strand; PAM type: NRG; PAM sequence: GGG
ttttgcatctgtgttcatca

SEQ ID NO: 45478 - DNA, 20 bp, Artificial Sequence
  Description of Artificial Sequence: Synthetic oligonucleotide
  Target: SCN9A; (+) strand; PAM type: NRG; PAM sequence: TAG
gcatctgtgttcatcaggga

SEQ ID NO: 45479 - DNA, 20 bp, Artificial Sequence
  Description of Artificial Sequence: Synthetic oligonucleotide
  Target: SCN9A; (+) strand; PAM type: NRG; PAM sequence: TGG
tctgtgttcatcagggatag

SEQ ID NO: 45480 - DNA, 20 bp, Artificial Sequence
  Description of Artificial Sequence: Synthetic oligonucleotide
  Target: SCN9A; (+) strand; PAM type: NRG; PAM sequence: CAG
tcatcagggatagtggcctt

SEQ ID NO: 45481 - DNA, 20 bp, Artificial Sequence
  Description of Artificial Sequence: Synthetic oligonucleotide
  Target: SCN9A; (+) strand; PAM type: NRG; PAM sequence: TGG
tgtgtgtccctgtcttgttc

SEQ ID NO: 45482 - DNA, 20 bp, Artificial Sequence
  Description of Artificial Sequence: Synthetic oligonucleotide
  Target: SCN9A; (+) strand; PAM type: NRG; PAM sequence: TGG
tccctgtcttgttctggtat

SEQ ID NO: 45483 - DNA, 20 bp, Artificial Sequence
  Description of Artificial Sequence: Synthetic oligonucleotide
  Target: SCN9A; (+) strand; PAM type: NRG; PAM sequence: GGG
ccctgtcttgttctggtatt

SEQ ID NO: 45484 - DNA, 20 bp, Artificial Sequence
  Description of Artificial Sequence: Synthetic oligonucleotide
  Target: SCN9A; (+) strand; PAM type: NRG; PAM sequence: GGG
cctgtcttgttctggtattg

SEQ ID NO: 45485 - DNA, 20 bp, Artificial Sequence
  Description of Artificial Sequence: Synthetic oligonucleotide
  Target: SCN9A; (+) strand; PAM type: NRG; PAM sequence: TGG
ttctggtattggggtaatat

SEQ ID NO: 45486 - DNA, 20 bp, Artificial Sequence
  Description of Artificial Sequence: Synthetic oligonucleotide
  Target: SCN9A; (+) strand; PAM type: NRG; PAM sequence: TAG
ttggggtaatattggccttg

SEQ ID NO: 45487 - DNA, 20 bp, Artificial Sequence
  Description of Artificial Sequence: Synthetic oligonucleotide
  Target: SCN9A; (+) strand; PAM type: NRG; PAM sequence: TAG
ttggccttgtagaatgaatt

SEQ ID NO: 45488 - DNA, 20 bp, Artificial Sequence
  Description of Artificial Sequence: Synthetic oligonucleotide
  Target: SCN9A; (+) strand; PAM type: NRG; PAM sequence: AAG
gccttgtagaatgaatttag

SEQ ID NO: 45489 - DNA, 20 bp, Artificial Sequence
  Description of Artificial Sequence: Synthetic oligonucleotide
  Target: SCN9A; (+) strand; PAM type: NRG; PAM sequence: TGG
tcctttccttttgatttttt

SEQ ID NO: 45490 - DNA, 20 bp, Artificial Sequence
  Description of Artificial Sequence: Synthetic oligonucleotide
  Target: SCN9A; (+) strand; PAM type: NRG; PAM sequence: AAG
tgatttttttggaataattt

SEQ ID NO: 45491 - DNA, 20 bp, Artificial Sequence
  Description of Artificial Sequence: Synthetic oligonucleotide
  Target: SCN9A; (+) strand; PAM type: NRG; PAM sequence: AAG
tttttttggaataatttaag

SEQ ID NO: 45492 - DNA, 20 bp, Artificial Sequence
  Description of Artificial Sequence: Synthetic oligonucleotide
  Target: SCN9A; (+) strand; PAM type: NRG; PAM sequence: TAG
tggaataatttaagaagaat

SEQ ID NO: 45493 - DNA, 20 bp, Artificial Sequence
  Description of Artificial Sequence: Synthetic oligonucleotide
  Target: SCN9A; (+) strand; PAM type: NRG; PAM sequence: TAG
aatttaagaagaattagtat

SEQ ID NO: 45494 - DNA, 20 bp, Artificial Sequence
  Description of Artificial Sequence: Synthetic oligonucleotide
  Target: SCN9A; (+) strand; PAM type: NRG; PAM sequence: TGG
ttagttcttctttaaatgtt

SEQ ID NO: 45495 - DNA, 20 bp, Artificial Sequence
  Description of Artificial Sequence: Synthetic oligonucleotide
  Target: SCN9A; (+) strand; PAM type: NRG; PAM sequence: TAG
gttcttctttaaatgtttgg

SEQ ID NO: 45496 - DNA, 20 bp, Artificial Sequence
  Description of Artificial Sequence: Synthetic oligonucleotide
  Target: SCN9A; (+) strand; PAM type: NRG; PAM sequence: CAG
aaatgtttggtagaattcat

SEQ ID NO: 45497 - DNA, 20 bp, Artificial Sequence
  Description of Artificial Sequence: Synthetic oligonucleotide
  Target: SCN9A; (+) strand; PAM type: NRG; PAM sequence: AAG
tttggtagaattcatcagtg

SEQ ID NO: 45498 - DNA, 20 bp, Artificial Sequence
  Description of Artificial Sequence: Synthetic oligonucleotide
  Target: SCN9A; (+) strand; PAM type: NRG; PAM sequence: TGG
aattcatcagtgaagccatg

SEQ ID NO: 45499 - DNA, 20 bp, Artificial Sequence
  Description of Artificial Sequence: Synthetic oligonucleotide
  Target: SCN9A; (+) strand; PAM type: NRG; PAM sequence: TGG
tcagtgaagccatgtggtcc

SEQ ID NO: 45500 - DNA, 20 bp, Artificial Sequence
  Description of Artificial Sequence: Synthetic oligonucleotide
  Target: SCN9A; (+) strand; PAM type: NRG; PAM sequence: TAG
ggtcctggacttttctttgc

SEQ ID NO: 45501 - DNA, 20 bp, Artificial Sequence
  Description of Artificial Sequence: Synthetic oligonucleotide
  Target: SCN9A; (+) strand; PAM type: NRG; PAM sequence: AGG
gtcctggacttttctttgct

SEQ ID NO: 45502 - DNA, 20 bp, Artificial Sequence
  Description of Artificial Sequence: Synthetic oligonucleotide
  Target: SCN9A; (+) strand; PAM type: NRG; PAM sequence: GAG
cctggacttttctttgctag

SEQ ID NO: 45503 - DNA, 20 bp, Artificial Sequence
  Description of Artificial Sequence: Synthetic oligonucleotide
  Target: SCN9A; (+) strand; PAM type: NRG; PAM sequence: GAG
tggacttttctttgctagga

SEQ ID NO: 45504 - DNA, 20 bp, Artificial Sequence
  Description of Artificial Sequence: Synthetic oligonucleotide
  Target: SCN9A; (+) strand; PAM type: NRG; PAM sequence: TGG
tcaatcttgttactcattat

SEQ ID NO: 45505 - DNA, 20 bp, Artificial Sequence
  Description of Artificial Sequence: Synthetic oligonucleotide
  Target: SCN9A; (+) strand; PAM type: NRG; PAM sequence: GAG
tactcattattggtctgttt

SEQ ID NO: 45506 - DNA, 20 bp, Artificial Sequence
  Description of Artificial Sequence: Synthetic oligonucleotide
  Target: SCN9A; (+) strand; PAM type: NRG; PAM sequence: CAG
ttttccatttcttcatgata

SEQ ID NO: 45507 - DNA, 20 bp, Artificial Sequence
  Description of Artificial Sequence: Synthetic oligonucleotide
  Target: SCN9A; (+) strand; PAM type: NRG; PAM sequence: TGG
atttcttcatgatacagtct

SEQ ID NO: 45508 - DNA, 20 bp, Artificial Sequence
  Description of Artificial Sequence: Synthetic oligonucleotide
  Target: SCN9A; (+) strand; PAM type: NRG; PAM sequence: AAG
cttcatgatacagtcttggc

SEQ ID NO: 45509 - DNA, 20 bp, Artificial Sequence
  Description of Artificial Sequence: Synthetic oligonucleotide
  Target: SCN9A; (+) strand; PAM type: NRG; PAM sequence: GAG
cttggcaagttgtatgtgtt

SEQ ID NO: 45510 - DNA, 20 bp, Artificial Sequence
  Description of Artificial Sequence: Synthetic oligonucleotide
  Target: SCN9A; (+) strand; PAM type: NRG; PAM sequence: TAG
agtaatttatcaatttccat

SEQ ID NO: 45511 - DNA, 20 bp, Artificial Sequence
  Description of Artificial Sequence: Synthetic oligonucleotide
  Target: SCN9A; (+) strand; PAM type: NRG; PAM sequence: AGG
gtaatttatcaatttccatt

SEQ ID NO: 45512 - DNA, 20 bp, Artificial Sequence
  Description of Artificial Sequence: Synthetic oligonucleotide
  Target: SCN9A; (+) strand; PAM type: NRG; PAM sequence: TGG
cattaggttttccaatttgt

SEQ ID NO: 45513 - DNA, 20 bp, Artificial Sequence
  Description of Artificial Sequence: Synthetic oligonucleotide
  Target: SCN9A; (+) strand; PAM type: NRG; PAM sequence: GAG
ttaggttttccaatttgttg

SEQ ID NO: 45514 - DNA, 20 bp, Artificial Sequence
  Description of Artificial Sequence: Synthetic oligonucleotide
  Target: SCN9A; (+) strand; PAM type: NRG; PAM sequence: TAG
tgttggagtatgattgttca

SEQ ID NO: 45515 - DNA, 20 bp, Artificial Sequence
  Description of Artificial Sequence: Synthetic oligonucleotide
  Target: SCN9A; (+) strand; PAM type: NRG; PAM sequence: TAG
tggagtatgattgttcatag

SEQ ID NO: 45516 - DNA, 20 bp, Artificial Sequence
  Description of Artificial Sequence: Synthetic oligonucleotide
  Target: SCN9A; (+) strand; PAM type: NRG; PAM sequence: CAG
tcatagtagtctctattgat

SEQ ID NO: 45517 - DNA, 20 bp, Artificial Sequence
  Description of Artificial Sequence: Synthetic oligonucleotide
  Target: SCN9A; (+) strand; PAM type: NRG; PAM sequence: TAG
tagtagtctctattgatcag

SEQ ID NO: 45518 - DNA, 20 bp, Artificial Sequence
  Description of Artificial Sequence: Synthetic oligonucleotide
  Target: SCN9A; (+) strand; PAM type: NRG; PAM sequence: AAG
aaacgttgttaatgattctg

SEQ ID NO: 45519 - DNA, 20 bp, Artificial Sequence
  Description of Artificial Sequence: Synthetic oligonucleotide
  Target: SCN9A; (+) strand; PAM type: NRG; PAM sequence: TAG
tctgaagttgcatccaaatt

SEQ ID NO: 45520 - DNA, 20 bp, Artificial Sequence
  Description of Artificial Sequence: Synthetic oligonucleotide
  Target: SCN9A; (+) strand; PAM type: NRG; PAM sequence: AGG
ctgaagttgcatccaaattt

SEQ ID NO: 45521 - DNA, 20 bp, Artificial Sequence
  Description of Artificial Sequence: Synthetic oligonucleotide
  Target: SCN9A; (+) strand; PAM type: NRG; PAM sequence: AAG
aaatttaggcaaacaattca

SEQ ID NO: 45522 - DNA, 20 bp, Artificial Sequence
  Description of Artificial Sequence: Synthetic oligonucleotide
  Target: SCN9A; (+) strand; PAM type: NRG; PAM sequence: AGG
aatttaggcaaacaattcaa

SEQ ID NO: 45523 - DNA, 20 bp, Artificial Sequence
  Description of Artificial Sequence: Synthetic oligonucleotide
  Target: SCN9A; (+) strand; PAM type: NRG; PAM sequence: CAG
acaattcaaaggatatgatc

SEQ ID NO: 45524 - DNA, 20 bp, Artificial Sequence
  Description of Artificial Sequence: Synthetic oligonucleotide
  Target: SCN9A; (+) strand; PAM type: NRG; PAM sequence: CAG
tcaaaggatatgatccagaa

SEQ ID NO: 45525 - DNA, 20 bp, Artificial Sequence
  Description of Artificial Sequence: Synthetic oligonucleotide
  Target: SCN9A; (+) strand; PAM type: NRG; PAM sequence: AGG
caaaggatatgatccagaac

SEQ ID NO: 45526 - DNA, 20 bp, Artificial Sequence
  Description of Artificial Sequence: Synthetic oligonucleotide
  Target: SCN9A; (+) strand; PAM type: NRG; PAM sequence: AAG
cagaacaggcatttgtaata

SEQ ID NO: 45527 - DNA, 20 bp, Artificial Sequence
  Description of Artificial Sequence: Synthetic oligonucleotide
  Target: SCN9A; (+) strand; PAM type: NRG; PAM sequence: AAG
gcatttgtaataaagtcccc

SEQ ID NO: 45528 - DNA, 20 bp, Artificial Sequence
  Description of Artificial Sequence: Synthetic oligonucleotide
  Target: SCN9A; (+) strand; PAM type: NRG; PAM sequence: AAG
tttcacacactaaaattctg

SEQ ID NO: 45529 - DNA, 20 bp, Artificial Sequence
  Description of Artificial Sequence: Synthetic oligonucleotide
  Target: SCN9A; (+) strand; PAM type: NRG; PAM sequence: TAG
taaattcaatctgtaaccaa

SEQ ID NO: 45530 - DNA, 20 bp, Artificial Sequence
  Description of Artificial Sequence: Synthetic oligonucleotide
  Target: SCN9A; (+) strand; PAM type: NRG; PAM sequence: CAG
ctgtaaccaatagctactta

SEQ ID NO: 45531 - DNA, 20 bp, Artificial Sequence
  Description of Artificial Sequence: Synthetic oligonucleotide
  Target: SCN9A; (+) strand; PAM type: NRG; PAM sequence: AAG
gctacttacagtgtgtatat

SEQ ID NO: 45532 - DNA, 20 bp, Artificial Sequence
  Description of Artificial Sequence: Synthetic oligonucleotide
  Target: SCN9A; (+) strand; PAM type: NRG; PAM sequence: GAG
acttataataattgtacatt

SEQ ID NO: 45533 - DNA, 20 bp, Artificial Sequence
  Description of Artificial Sequence: Synthetic oligonucleotide
  Target: SCN9A; (+) strand; PAM type: NRG; PAM sequence: AAG
tacattgagcacttttcaat

SEQ ID NO: 45534 - DNA, 20 bp, Artificial Sequence
  Description of Artificial Sequence: Synthetic oligonucleotide
  Target: SCN9A; (+) strand; PAM type: NRG; PAM sequence: GAG
gcatttgtctaattatttat

SEQ ID NO: 45535 - DNA, 20 bp, Artificial Sequence
  Description of Artificial Sequence: Synthetic oligonucleotide
  Target: SCN9A; (+) strand; PAM type: NRG; PAM sequence: AAG
aatgtttttgtaaattgctc

SEQ ID NO: 45536 - DNA, 20 bp, Artificial Sequence
  Description of Artificial Sequence: Synthetic oligonucleotide
  Target: SCN9A; (+) strand; PAM type: NRG; PAM sequence: AGG
atgtttttgtaaattgctca

SEQ ID NO: 45537 - DNA, 20 bp, Artificial Sequence
  Description of Artificial Sequence: Synthetic oligonucleotide
  Target: SCN9A; (+) strand; PAM type: NRG; PAM sequence: AAG
attgctcaaggtcttatcaa

SEQ ID NO: 45538 - DNA, 20 bp, Artificial Sequence
  Description of Artificial Sequence: Synthetic oligonucleotide
  Target: SCN9A; (+) strand; PAM type: NRG; PAM sequence: AAG
tcaaggtcttatcaaaagct

SEQ ID NO: 45539 - DNA, 20 bp, Artificial Sequence
  Description of Artificial Sequence: Synthetic oligonucleotide
  Target: SCN9A; (+) strand; PAM type: NRG; PAM sequence: GAG
cttatcaaaagctaagattt

SEQ ID NO: 45540 - DNA, 20 bp, Artificial Sequence
  Description of Artificial Sequence: Synthetic oligonucleotide
  Target: SCN9A; (+) strand; PAM type: NRG; PAM sequence: AGG
ttatcaaaagctaagatttg

SEQ ID NO: 45541 - DNA, 20 bp, Artificial Sequence
  Description of Artificial Sequence: Synthetic oligonucleotide
  Target: SCN9A; (+) strand; PAM type: NRG; PAM sequence: AAG
ggcaaatattctatcttaaa

SEQ ID NO: 45542 - DNA, 20 bp, Artificial Sequence
  Description of Artificial Sequence: Synthetic oligonucleotide
  Target: SCN9A; (+) strand; PAM type: NRG; PAM sequence: TGG
aaatattctatcttaaaaag

SEQ ID NO: 45543 - DNA, 20 bp, Artificial Sequence
  Description of Artificial Sequence: Synthetic oligonucleotide
  Target: SCN9A; (+) strand; PAM type: NRG; PAM sequence: AAG
ggcattcttaactatatccc

SEQ ID NO: 45544 - DNA, 20 bp, Artificial Sequence
  Description of Artificial Sequence: Synthetic oligonucleotide
  Target: SCN9A; (+) strand; PAM type: NRG; PAM sequence: AGG
gcattcttaactatatccca

SEQ ID NO: 45545 - DNA, 20 bp, Artificial Sequence
  Description of Artificial Sequence: Synthetic oligonucleotide
  Target: SCN9A; (+) strand; PAM type: NRG; PAM sequence: TAG
ttcttaactatatcccaagg

SEQ ID NO: 45546 - DNA, 20 bp, Artificial Sequence
  Description of Artificial Sequence: Synthetic oligonucleotide
  Target: SCN9A; (+) strand; PAM type: NRG; PAM sequence: TGG
ttaactatatcccaaggtag

SEQ ID NO: 45547 - DNA, 20 bp, Artificial Sequence
  Description of Artificial Sequence: Synthetic oligonucleotide
  Target: SCN9A; (+) strand; PAM type: NRG; PAM sequence: AAG
tatatcccaaggtagtggct

SEQ ID NO: 45548 - DNA, 20 bp, Artificial Sequence
  Description of Artificial Sequence: Synthetic oligonucleotide
  Target: SCN9A; (+) strand; PAM type: NRG; PAM sequence: TAG
aatgacataaatatataaat

SEQ ID NO: 45549 - DNA, 20 bp, Artificial Sequence
  Description of Artificial Sequence: Synthetic oligonucleotide
  Target: SCN9A; (+) strand; PAM type: NRG; PAM sequence: AGG
atgacataaatatataaatt

SEQ ID NO: 45550 - DNA, 20 bp, Artificial Sequence
  Description of Artificial Sequence: Synthetic oligonucleotide
  Target: SCN9A; (+) strand; PAM type: NRG; PAM sequence: GAG
gacataaatatataaattag

SEQ ID NO: 45551 - DNA, 20 bp, Artificial Sequence
  Description of Artificial Sequence: Synthetic oligonucleotide
  Target: SCN9A; (+) strand; PAM type: NRG; PAM sequence: TGG
aattaggagttactttctat

SEQ ID NO: 45552 - DNA, 20 bp, Artificial Sequence
  Description of Artificial Sequence: Synthetic oligonucleotide
  Target: SCN9A; (+) strand; PAM type: NRG; PAM sequence: GGG
attaggagttactttctatt

SEQ ID NO: 45553 - DNA, 20 bp, Artificial Sequence
  Description of Artificial Sequence: Synthetic oligonucleotide
  Target: SCN9A; (+) strand; PAM type: NRG; PAM sequence: TGG
ggtaattcaatttgcctctt

SEQ ID NO: 45554 - DNA, 20 bp, Artificial Sequence
  Description of Artificial Sequence: Synthetic oligonucleotide
  Target: SCN9A; (+) strand; PAM type: NRG; PAM sequence: CAG
atttgcctctttggctcatc

SEQ ID NO: 45555 - DNA, 20 bp, Artificial Sequence
  Description of Artificial Sequence: Synthetic oligonucleotide
  Target: SCN9A; (+) strand; PAM type: NRG; PAM sequence: AGG
tttgcctctttggctcatcc

SEQ ID NO: 45556 - DNA, 20 bp, Artificial Sequence
  Description of Artificial Sequence: Synthetic oligonucleotide
  Target: SCN9A; (+) strand; PAM type: NRG; PAM sequence: AAG
acacaaccatcactatttca

SEQ ID NO: 45557 - DNA, 20 bp, Artificial Sequence
  Description of Artificial Sequence: Synthetic oligonucleotide
  Target: SCN9A; (+) strand; PAM type: NRG; PAM sequence: AGG
cacaaccatcactatttcaa

SEQ ID NO: 45558 - DNA, 20 bp, Artificial Sequence
  Description of Artificial Sequence: Synthetic oligonucleotide
  Target: SCN9A; (+) strand; PAM type: NRG; PAM sequence: CAG
tcactatttcaaaggcatct

SEQ ID NO: 45559 - DNA, 20 bp, Artificial Sequence
  Description of Artificial Sequence: Synthetic oligonucleotide
  Target: SCN9A; (+) strand; PAM type: NRG; PAM sequence: AAG
ctcagatacgaaaaaaataa

SEQ ID NO: 45560 - DNA, 20 bp, Artificial Sequence
  Description of Artificial Sequence: Synthetic oligonucleotide
  Target: SCN9A; (+) strand; PAM type: NRG; PAM sequence: AAG
gaaaaaaataaaagttgcaa

SEQ ID NO: 45561 - DNA, 20 bp, Artificial Sequence
  Description of Artificial Sequence: Synthetic oligonucleotide
  Target: SCN9A; (+) strand; PAM type: NRG; PAM sequence: GAG
aaaaaataaaagttgcaaaa

SEQ ID NO: 45562 - DNA, 20 bp, Artificial Sequence
  Description of Artificial Sequence: Synthetic oligonucleotide
  Target: SCN9A; (+) strand; PAM type: NRG; PAM sequence: AGG
aaaaataaaagttgcaaaag

SEQ ID NO: 45563 - DNA, 20 bp, Artificial Sequence
  Description of Artificial Sequence: Synthetic oligonucleotide
  Target: SCN9A; (+) strand; PAM type: NRG; PAM sequence: GGG
aaaataaaagttgcaaaaga

SEQ ID NO: 45564 - DNA, 20 bp, Artificial Sequence
  Description of Artificial Sequence: Synthetic oligonucleotide
  Target: SCN9A; (+) strand; PAM type: NRG; PAM sequence: CAG
gttgcaaaagagggaattca

SEQ ID NO: 45565 - DNA, 20 bp, Artificial Sequence
  Description of Artificial Sequence: Synthetic oligonucleotide
  Target: SCN9A; (+) strand; PAM type: NRG; PAM sequence: AAG
aaagagggaattcacagttc

SEQ ID NO: 45566 - DNA, 20 bp, Artificial Sequence
  Description of Artificial Sequence: Synthetic oligonucleotide
  Target: SCN9A; (+) strand; PAM type: NRG; PAM sequence: TGG
gaattcacagttcaagactc

SEQ ID NO: 45567 - DNA, 20 bp, Artificial Sequence
  Description of Artificial Sequence: Synthetic oligonucleotide
  Target: SCN9A; (+) strand; PAM type: NRG; PAM sequence: GGG
aattcacagttcaagactct

SEQ ID NO: 45568 - DNA, 20 bp, Artificial Sequence
  Description of Artificial Sequence: Synthetic oligonucleotide
  Target: SCN9A; (+) strand; PAM type: NRG; PAM sequence: AAG
gttcaagactctgggaactc

SEQ ID NO: 45569 - DNA, 20 bp, Artificial Sequence
  Description of Artificial Sequence: Synthetic oligonucleotide
  Target: SCN9A; (+) strand; PAM type: NRG; PAM sequence: TGG
caagactctgggaactcaag

SEQ ID NO: 45570 - DNA, 20 bp, Artificial Sequence
  Description of Artificial Sequence: Synthetic oligonucleotide
  Target: SCN9A; (+) strand; PAM type: NRG; PAM sequence: GGG
aagactctgggaactcaagt

SEQ ID NO: 45571 - DNA, 20 bp, Artificial Sequence
  Description of Artificial Sequence: Synthetic oligonucleotide
  Target: SCN9A; (+) strand; PAM type: NRG; PAM sequence: GAG
gactctgggaactcaagtgg

SEQ ID NO: 45572 - DNA, 20 bp, Artificial Sequence
  Description of Artificial Sequence: Synthetic oligonucleotide
  Target: SCN9A; (+) strand; PAM type: NRG; PAM sequence: AAG
gggaactcaagtgggagatg

SEQ ID NO: 45573 - DNA, 20 bp, Artificial Sequence
  Description of Artificial Sequence: Synthetic oligonucleotide
  Target: SCN9A; (+) strand; PAM type: NRG; PAM sequence: GAG
aagtgggagatgaagattat

SEQ ID NO: 45574 - DNA, 20 bp, Artificial Sequence
  Description of Artificial Sequence: Synthetic oligonucleotide
  Target: SCN9A; (+) strand; PAM type: NRG; PAM sequence: TAG
gagatgaagattatgagaat

SEQ ID NO: 45575 - DNA, 20 bp, Artificial Sequence
  Description of Artificial Sequence: Synthetic oligonucleotide
  Target: SCN9A; (+) strand; PAM type: NRG; PAM sequence: GAG
gatgaagattatgagaatta

SEQ ID NO: 45576 - DNA, 20 bp, Artificial Sequence
  Description of Artificial Sequence: Synthetic oligonucleotide
  Target: SCN9A; (+) strand; PAM type: NRG; PAM sequence: CAG
gaagattatgagaattagag

SEQ ID NO: 45577 - DNA, 20 bp, Artificial Sequence
  Description of Artificial Sequence: Synthetic oligonucleotide
  Target: SCN9A; (+) strand; PAM type: NRG; PAM sequence: AGG
aagattatgagaattagagc

SEQ ID NO: 45578 - DNA, 20 bp, Artificial Sequence
  Description of Artificial Sequence: Synthetic oligonucleotide
  Target: SCN9A; (+) strand; PAM type: NRG; PAM sequence: AAG
tatgagaattagagcaggaa

SEQ ID NO: 45579 - DNA, 20 bp, Artificial Sequence
  Description of Artificial Sequence: Synthetic oligonucleotide
  Target: SCN9A; (+) strand; PAM type: NRG; PAM sequence: TAG
agaattagagcaggaaaagt

SEQ ID NO: 45580 - DNA, 20 bp, Artificial Sequence
  Description of Artificial Sequence: Synthetic oligonucleotide
  Target: SCN9A; (+) strand; PAM type: NRG; PAM sequence: TAG
tagagcaggaaaagttagca

SEQ ID NO: 45581 - DNA, 20 bp, Artificial Sequence
  Description of Artificial Sequence: Synthetic oligonucleotide
  Target: SCN9A; (+) strand; PAM type: NRG; PAM sequence: AGG
agagcaggaaaagttagcat

SEQ ID NO: 45582 - DNA, 20 bp, Artificial Sequence
  Description of Artificial Sequence: Synthetic oligonucleotide
  Target: SCN9A; (+) strand; PAM type: NRG; PAM sequence: GAG
agcaggaaaagttagcatag

SEQ ID NO: 45583 - DNA, 20 bp, Artificial Sequence
  Description of Artificial Sequence: Synthetic oligonucleotide
  Target: SCN9A; (+) strand; PAM type: NRG; PAM sequence: AGG
gcaggaaaagttagcatagg

SEQ ID NO: 45584 - DNA, 20 bp, Artificial Sequence
  Description of Artificial Sequence: Synthetic oligonucleotide
  Target: SCN9A; (+) strand; PAM type: NRG; PAM sequence: AAG
aagttagcataggaggatta

SEQ ID NO: 45585 - DNA, 20 bp, Artificial Sequence
  Description of Artificial Sequence: Synthetic oligonucleotide
  Target: SCN9A; (+) strand; PAM type: NRG; PAM sequence: TAG
taggaggattaaagacattt

SEQ ID NO: 45586 - DNA, 20 bp, Artificial Sequence
  Description of Artificial Sequence: Synthetic oligonucleotide
  Target: SCN9A; (+) strand; PAM type: NRG; PAM sequence: TAG
aaataaaatgtacactattt

SEQ ID NO: 45587 - DNA, 20 bp, Artificial Sequence
  Description of Artificial Sequence: Synthetic oligonucleotide
  Target: SCN9A; (+) strand; PAM type: NRG; PAM sequence: TGG
cactattttagtgatctgaa

SEQ ID NO: 45588 - DNA, 20 bp, Artificial Sequence
  Description of Artificial Sequence: Synthetic oligonucleotide
  Target: SCN9A; (+) strand; PAM type: NRG; PAM sequence: GGG
actattttagtgatctgaat

SEQ ID NO: 45589 - DNA, 20 bp, Artificial Sequence
  Description of Artificial Sequence: Synthetic oligonucleotide
  Target: SCN9A; (+) strand; PAM type: NRG; PAM sequence: CAG
acaaaacaaaacaaaaatga

SEQ ID NO: 45590 - DNA, 20 bp, Artificial Sequence
  Description of Artificial Sequence: Synthetic oligonucleotide
  Target: SCN9A; (+) strand; PAM type: NRG; PAM sequence: TGG
aaaaatgacagaatttaaac

SEQ ID NO: 45591 - DNA, 20 bp, Artificial Sequence
  Description of Artificial Sequence: Synthetic oligonucleotide
  Target: SCN9A; (+) strand; PAM type: NRG; PAM sequence: AAG
actggaaacattttaatctg

SEQ ID NO: 45592 - DNA, 20 bp, Artificial Sequence
  Description of Artificial Sequence: Synthetic oligonucleotide
  Target: SCN9A; (+) strand; PAM type: NRG; PAM sequence: GAG
tggaaacattttaatctgaa

SEQ ID NO: 45593 - DNA, 20 bp, Artificial Sequence
  Description of Artificial Sequence: Synthetic oligonucleotide
  Target: SCN9A; (+) strand; PAM type: NRG; PAM sequence: AGG
ggaaacattttaatctgaag

SEQ ID NO: 45594 - DNA, 20 bp, Artificial Sequence
  Description of Artificial Sequence: Synthetic oligonucleotide
  Target: SCN9A; (+) strand; PAM type: NRG; PAM sequence: TGG
acattttaatctgaagaggc

SEQ ID NO: 45595 - DNA, 20 bp, Artificial Sequence
  Description of Artificial Sequence: Synthetic oligonucleotide
  Target: SCN9A; (+) strand; PAM type: NRG; PAM sequence: AAG
tttaatctgaagaggctgga

SEQ ID NO: 45596 - DNA, 20 bp, Artificial Sequence
  Description of Artificial Sequence: Synthetic oligonucleotide
  Target: SCN9A; (+) strand; PAM type: NRG; PAM sequence: AAG
atctgaagaggctggaaaga

SEQ ID NO: 45597 - DNA, 20 bp, Artificial Sequence
  Description of Artificial Sequence: Synthetic oligonucleotide
  Target: SCN9A; (+) strand; PAM type: NRG; PAM sequence: TAG
gaggctggaaagaaagacct

SEQ ID NO: 45598 - DNA, 20 bp, Artificial Sequence
  Description of Artificial Sequence: Synthetic oligonucleotide
  Target: SCN9A; (+) strand; PAM type: NRG; PAM sequence: AAG
gaaagaaagaccttagatgt

SEQ ID NO: 45599 - DNA, 20 bp, Artificial Sequence
  Description of Artificial Sequence: Synthetic oligonucleotide
  Target: SCN9A; (+) strand; PAM type: NRG; PAM sequence: AGG
aaagaaagaccttagatgta

SEQ ID NO: 45600 - DNA, 20 bp, Artificial Sequence
  Description of Artificial Sequence: Synthetic oligonucleotide
  Target: SCN9A; (+) strand; PAM type: NRG; PAM sequence: TAG
ccttagatgtaaggttttta

SEQ ID NO: 45601 - DNA, 20 bp, Artificial Sequence
  Description of Artificial Sequence: Synthetic oligonucleotide
  Target: SCN9A; (+) strand; PAM type: NRG; PAM sequence: CAG
aaggtttttatagttgacca

SEQ ID NO: 45602 - DNA, 20 bp, Artificial Sequence
  Description of Artificial Sequence: Synthetic oligonucleotide
  Target: SCN9A; (+) strand; PAM type: NRG; PAM sequence: TAG
cttatcaaacaaatttcctc

SEQ ID NO: 45603 - DNA, 20 bp, Artificial Sequence
  Description of Artificial Sequence: Synthetic oligonucleotide
  Target: SCN9A; (+) strand; PAM type: NRG; PAM sequence: CAG
tttctcaattcttatatttt

SEQ ID NO: 45604 - DNA, 20 bp, Artificial Sequence
  Description of Artificial Sequence: Synthetic oligonucleotide
  Target: SCN9A; (+) strand; PAM type: NRG; PAM sequence: AGG
ttctcaattcttatattttc

SEQ ID NO: 45605 - DNA, 20 bp, Artificial Sequence
  Description of Artificial Sequence: Synthetic oligonucleotide
  Target: SCN9A; (+) strand; PAM type: NRG; PAM sequence: TAG
tcaattcttatattttcagg

SEQ ID NO: 45606 - DNA, 20 bp, Artificial Sequence
  Description of Artificial Sequence: Synthetic oligonucleotide
  Target: SCN9A; (+) strand; PAM type: NRG; PAM sequence: AGG
caattcttatattttcaggt

SEQ ID NO: 45607 - DNA, 20 bp, Artificial Sequence
  Description of Artificial Sequence: Synthetic oligonucleotide
  Target: SCN9A; (+) strand; PAM type: NRG; PAM sequence: GAG
tacttaatatgacatacttt

SEQ ID NO: 45608 - DNA, 20 bp, Artificial Sequence
  Description of Artificial Sequence: Synthetic oligonucleotide
  Target: SCN9A; (+) strand; PAM type: NRG; PAM sequence: TGG
acatactttgagatacgtca

SEQ ID NO: 45609 - DNA, 20 bp, Artificial Sequence
  Description of Artificial Sequence: Synthetic oligonucleotide
  Target: SCN9A; (+) strand; PAM type: NRG; PAM sequence: AAG
gtcatggaaaattttttatg

SEQ ID NO: 45610 - DNA, 20 bp, Artificial Sequence
  Description of Artificial Sequence: Synthetic oligonucleotide
  Target: SCN9A; (+) strand; PAM type: NRG; PAM sequence: AAG
atggaaaattttttatgaag

SEQ ID NO: 45611 - DNA, 20 bp, Artificial Sequence
  Description of Artificial Sequence: Synthetic oligonucleotide
  Target: SCN9A; (+) strand; PAM type: NRG; PAM sequence: AGG
tggaaaattttttatgaaga

SEQ ID NO: 45612 - DNA, 20 bp, Artificial Sequence
  Description of Artificial Sequence: Synthetic oligonucleotide
  Target: SCN9A; (+) strand; PAM type: NRG; PAM sequence: GGG
ggaaaattttttatgaagaa

SEQ ID NO: 45613 - DNA, 20 bp, Artificial Sequence
  Description of Artificial Sequence: Synthetic oligonucleotide
  Target: SCN9A; (+) strand; PAM type: NRG; PAM sequence: AAG
tgaagaagggtaaactttca

SEQ ID NO: 45614 - DNA, 20 bp, Artificial Sequence
  Description of Artificial Sequence: Synthetic oligonucleotide
  Target: SCN9A; (+) strand; PAM type: NRG; PAM sequence: TAG
aaactttcaaagttcataat

SEQ ID NO: 45615 - DNA, 20 bp, Artificial Sequence
  Description of Artificial Sequence: Synthetic oligonucleotide
  Target: SCN9A; (+) strand; PAM type: NRG; PAM sequence: AAG
ctttcaaagttcataattag

SEQ ID NO: 45616 - DNA, 20 bp, Artificial Sequence
  Description of Artificial Sequence: Synthetic oligonucleotide
  Target: SCN9A; (+) strand; PAM type: NRG; PAM sequence: CAG
caaagttcataattagaagt

SEQ ID NO: 45617 - DNA, 20 bp, Artificial Sequence
  Description of Artificial Sequence: Synthetic oligonucleotide
  Target: SCN9A; (+) strand; PAM type: NRG; PAM sequence: TAG
agttcataattagaagtcag

SEQ ID NO: 45618 - DNA, 20 bp, Artificial Sequence
  Description of Artificial Sequence: Synthetic oligonucleotide
  Target: SCN9A; (+) strand; PAM type: NRG; PAM sequence: AAG
aattagaagtcagtagcact

SEQ ID NO: 45619 - DNA, 20 bp, Artificial Sequence
  Description of Artificial Sequence: Synthetic oligonucleotide
  Target: SCN9A; (+) strand; PAM type: NRG; PAM sequence: GAG
gtcagtagcactaagaacct

SEQ ID NO: 45620 - DNA, 20 bp, Artificial Sequence
  Description of Artificial Sequence: Synthetic oligonucleotide
  Target: SCN9A; (+) strand; PAM type: NRG; PAM sequence: AAG
cactaagaacctgagttctt

SEQ ID NO: 45621 - DNA, 20 bp, Artificial Sequence
  Description of Artificial Sequence: Synthetic oligonucleotide
  Target: SCN9A; (+) strand; PAM type: NRG; PAM sequence: CAG
cttaagtaataataatgatg

SEQ ID NO: 45622 - DNA, 20 bp, Artificial Sequence
  Description of Artificial Sequence: Synthetic oligonucleotide
  Target: SCN9A; (+) strand; PAM type: NRG; PAM sequence: TGG
aacaaacactttttttaaaa

SEQ ID NO: 45623 - DNA, 20 bp, Artificial Sequence
  Description of Artificial Sequence: Synthetic oligonucleotide
  Target: SCN9A; (+) strand; PAM type: NRG; PAM sequence: TAG
gctacatgacttaaaaatac

SEQ ID NO: 45624 - DNA, 20 bp, Artificial Sequence
  Description of Artificial Sequence: Synthetic oligonucleotide
  Target: SCN9A; (+) strand; PAM type: NRG; PAM sequence: AAG
tatctgttactacaacctct

SEQ ID NO: 45625 - DNA, 20 bp, Artificial Sequence
  Description of Artificial Sequence: Synthetic oligonucleotide
  Target: SCN9A; (+) strand; PAM type: NRG; PAM sequence: AGG
atctgttactacaacctcta

SEQ ID NO: 45626 - DNA, 20 bp, Artificial Sequence
  Description of Artificial Sequence: Synthetic oligonucleotide
  Target: SCN9A; (+) strand; PAM type: NRG; PAM sequence: TAG
tgttactacaacctctaagg

SEQ ID NO: 45627 - DNA, 20 bp, Artificial Sequence
  Description of Artificial Sequence: Synthetic oligonucleotide
  Target: SCN9A; (+) strand; PAM type: NRG; PAM sequence: TGG
atatttaattgtgcatacca

SEQ ID NO: 45628 - DNA, 20 bp, Artificial Sequence
  Description of Artificial Sequence: Synthetic oligonucleotide
  Target: SCN9A; (+) strand; PAM type: NRG; PAM sequence: TAG
tgcataccatggaaatgtaa

SEQ ID NO: 45629 - DNA, 20 bp, Artificial Sequence
  Description of Artificial Sequence: Synthetic oligonucleotide
  Target: SCN9A; (+) strand; PAM type: NRG; PAM sequence: GAG
cataccatggaaatgtaata

SEQ ID NO: 45630 - DNA, 20 bp, Artificial Sequence
  Description of Artificial Sequence: Synthetic oligonucleotide
  Target: SCN9A; (+) strand; PAM type: NRG; PAM sequence: AAG
ccatggaaatgtaatagagt

SEQ ID NO: 45631 - DNA, 20 bp, Artificial Sequence
  Description of Artificial Sequence: Synthetic oligonucleotide
  Target: SCN9A; (+) strand; PAM type: NRG; PAM sequence: TAG
atgtacactcttttatcata

SEQ ID NO: 45632 - DNA, 20 bp, Artificial Sequence
  Description of Artificial Sequence: Synthetic oligonucleotide
  Target: SCN9A; (+) strand; PAM type: NRG; PAM sequence: GAG
agatataaccattatgtaat

SEQ ID NO: 45633 - DNA, 20 bp, Artificial Sequence
  Description of Artificial Sequence: Synthetic oligonucleotide
  Target: SCN9A; (+) strand; PAM type: NRG; PAM sequence: TAG
ttatgtaatgagaaaaaaat

SEQ ID NO: 45634 - DNA, 20 bp, Artificial Sequence
  Description of Artificial Sequence: Synthetic oligonucleotide
  Target: SCN9A; (+) strand; PAM type: NRG; PAM sequence: AAG
gaaaaaaattagtgaaaatc

SEQ ID NO: 45635 - DNA, 20 bp, Artificial Sequence
  Description of Artificial Sequence: Synthetic oligonucleotide
  Target: SCN9A; (+) strand; PAM type: NRG; PAM sequence: TAG
ttagtgaaaatcaagaatat

SEQ ID NO: 45636 - DNA, 20 bp, Artificial Sequence
  Description of Artificial Sequence: Synthetic oligonucleotide
  Target: SCN9A; (+) strand; PAM type: NRG; PAM sequence: TAG
tattaacatcaaatgatttt

SEQ ID NO: 45637 - DNA, 20 bp, Artificial Sequence
  Description of Artificial Sequence: Synthetic oligonucleotide
  Target: SCN9A; (+) strand; PAM type: NRG; PAM sequence: CAG
caaatgatttttagacaact

SEQ ID NO: 45638 - DNA, 20 bp, Artificial Sequence
  Description of Artificial Sequence: Synthetic oligonucleotide
  Target: SCN9A; (+) strand; PAM type: NRG; PAM sequence: TAG
tttttagacaactcagttta

SEQ ID NO: 45639 - DNA, 20 bp, Artificial Sequence
  Description of Artificial Sequence: Synthetic oligonucleotide
  Target: SCN9A; (+) strand; PAM type: NRG; PAM sequence: AGG
ttttagacaactcagtttat

SEQ ID NO: 45640 - DNA, 20 bp, Artificial Sequence
  Description of Artificial Sequence: Synthetic oligonucleotide
  Target: SCN9A; (+) strand; PAM type: NRG; PAM sequence: GGG
tttagacaactcagtttata

SEQ ID NO: 45641 - DNA, 20 bp, Artificial Sequence
  Description of Artificial Sequence: Synthetic oligonucleotide
  Target: SCN9A; (+) strand; PAM type: NRG; PAM sequence: TAG
caactcagtttatagggcac

SEQ ID NO: 45642 - DNA, 20 bp, Artificial Sequence
  Description of Artificial Sequence: Synthetic oligonucleotide
  Target: SCN9A; (+) strand; PAM type: NRG; PAM sequence: CGG
cactagatttcatacgcttt

SEQ ID NO: 45643 - DNA, 20 bp, Artificial Sequence
  Description of Artificial Sequence: Synthetic oligonucleotide
  Target: SCN9A; (+) strand; PAM type: NRG; PAM sequence: AAG
tagatttcatacgctttcgg

SEQ ID NO: 45644 - DNA, 20 bp, Artificial Sequence
  Description of Artificial Sequence: Synthetic oligonucleotide
  Target: SCN9A; (+) strand; PAM type: NRG; PAM sequence: AGG
agatttcatacgctttcgga

SEQ ID NO: 45645 - DNA, 20 bp, Artificial Sequence
  Description of Artificial Sequence: Synthetic oligonucleotide
  Target: SCN9A; (+) strand; PAM type: NRG; PAM sequence: GGG
gatttcatacgctttcggaa

SEQ ID NO: 45646 - DNA, 20 bp, Artificial Sequence
  Description of Artificial Sequence: Synthetic oligonucleotide
  Target: SCN9A; (+) strand; PAM type: NRG; PAM sequence: TGG
tacgctttcggaagggctca

SEQ ID NO: 45647 - DNA, 20 bp, Artificial Sequence
  Description of Artificial Sequence: Synthetic oligonucleotide
  Target: SCN9A; (+) strand; PAM type: NRG; PAM sequence: AAG
ttcggaagggctcatggaat

SEQ ID NO: 45648 - DNA, 20 bp, Artificial Sequence
  Description of Artificial Sequence: Synthetic oligonucleotide
  Target: SCN9A; (+) strand; PAM type: NRG; PAM sequence: CAG
agggctcatggaataagtga

SEQ ID NO: 45649 - DNA, 20 bp, Artificial Sequence
  Description of Artificial Sequence: Synthetic oligonucleotide
  Target: SCN9A; (+) strand; PAM type: NRG; PAM sequence: GAG
ggctcatggaataagtgaca

SEQ ID NO: 45650 - DNA, 20 bp, Artificial Sequence
  Description of Artificial Sequence: Synthetic oligonucleotide
  Target: SCN9A; (+) strand; PAM type: NRG; PAM sequence: TGG
tgacagagtaattttatgaa

SEQ ID NO: 45651 - DNA, 20 bp, Artificial Sequence
  Description of Artificial Sequence: Synthetic oligonucleotide
  Target: SCN9A; (+) strand; PAM type: NRG; PAM sequence: CAG
atggttaaaataatctattt

SEQ ID NO: 45652 - DNA, 20 bp, Artificial Sequence
  Description of Artificial Sequence: Synthetic oligonucleotide
  Target: SCN9A; (+) strand; PAM type: NRG; PAM sequence: TAG
taaaatacaaataaaatcac

SEQ ID NO: 45653 - DNA, 20 bp, Artificial Sequence
  Description of Artificial Sequence: Synthetic oligonucleotide
  Target: SCN9A; (+) strand; PAM type: NRG; PAM sequence: AAG
aataaaatcactagttataa

SEQ ID NO: 45654 - DNA, 20 bp, Artificial Sequence
  Description of Artificial Sequence: Synthetic oligonucleotide
  Target: SCN9A; (+) strand; PAM type: NRG; PAM sequence: TAG
aaatcactagttataaaaga

SEQ ID NO: 45655 - DNA, 20 bp, Artificial Sequence
  Description of Artificial Sequence: Synthetic oligonucleotide
  Target: SCN9A; (+) strand; PAM type: NRG; PAM sequence: CAG
acaccttcatctgcatgcca

SEQ ID NO: 45656 - DNA, 20 bp, Artificial Sequence
  Description of Artificial Sequence: Synthetic oligonucleotide
  Target: SCN9A; (+) strand; PAM type: NRG; PAM sequence: TAG
ccacagatatataaattcta

SEQ ID NO: 45657 - DNA, 20 bp, Artificial Sequence
  Description of Artificial Sequence: Synthetic oligonucleotide
  Target: SCN9A; (+) strand; PAM type: NRG; PAM sequence: TGG
atataaattctatagctgca

SEQ ID NO: 45658 - DNA, 20 bp, Artificial Sequence
  Description of Artificial Sequence: Synthetic oligonucleotide
  Target: SCN9A; (+) strand; PAM type: NRG; PAM sequence: CAG
agctgcatggctttataccc

SEQ ID NO: 45659 - DNA, 20 bp, Artificial Sequence
  Description of Artificial Sequence: Synthetic oligonucleotide
  Target: SCN9A; (+) strand; PAM type: NRG; PAM sequence: AGG
gctgcatggctttatacccc

SEQ ID NO: 45660 - DNA, 20 bp, Artificial Sequence
  Description of Artificial Sequence: Synthetic oligonucleotide
  Target: SCN9A; (+) strand; PAM type: NRG; PAM sequence: GGG
ctgcatggctttatacccca

SEQ ID NO: 45661 - DNA, 20 bp, Artificial Sequence
  Description of Artificial Sequence: Synthetic oligonucleotide
  Target: SCN9A; (+) strand; PAM type: NRG; PAM sequence: GGG
tgcatggctttataccccag

SEQ ID NO: 45662 - DNA, 20 bp, Artificial Sequence
  Description of Artificial Sequence: Synthetic oligonucleotide
  Target: SCN9A; (+) strand; PAM type: NRG; PAM sequence: GAG
catggctttataccccaggg

SEQ ID NO: 45663 - DNA, 20 bp, Artificial Sequence
  Description of Artificial Sequence: Synthetic oligonucleotide
  Target: SCN9A; (+) strand; PAM type: NRG; PAM sequence: AAG
cccaggggagacaaattatt

SEQ ID NO: 45664 - DNA, 20 bp, Artificial Sequence
  Description of Artificial Sequence: Synthetic oligonucleotide
  Target: SCN9A; (+) strand; PAM type: NRG; PAM sequence: TAG
agacaaattattaagtccaa

SEQ ID NO: 45665 - DNA, 20 bp, Artificial Sequence
  Description of Artificial Sequence: Synthetic oligonucleotide
  Target: SCN9A; (+) strand; PAM type: NRG; PAM sequence: AGG
gacaaattattaagtccaat

SEQ ID NO: 45666 - DNA, 20 bp, Artificial Sequence
  Description of Artificial Sequence: Synthetic oligonucleotide
  Target: SCN9A; (+) strand; PAM type: NRG; PAM sequence: TGG
tgtttgttttgtgtttcaaa

SEQ ID NO: 45667 - DNA, 20 bp, Artificial Sequence
  Description of Artificial Sequence: Synthetic oligonucleotide
  Target: SCN9A; (+) strand; PAM type: NRG; PAM sequence: AAG
ttttgtgtttcaaatggaca

SEQ ID NO: 45668 - DNA, 20 bp, Artificial Sequence
  Description of Artificial Sequence: Synthetic oligonucleotide
  Target: SCN9A; (+) strand; PAM type: NRG; PAM sequence: GAG
ttgtgtttcaaatggacaaa

SEQ ID NO: 45669 - DNA, 20 bp, Artificial Sequence
  Description of Artificial Sequence: Synthetic oligonucleotide
  Target: SCN9A; (+) strand; PAM type: NRG; PAM sequence: GAG
gtgtttcaaatggacaaaga

SEQ ID NO: 45670 - DNA, 20 bp, Artificial Sequence
  Description of Artificial Sequence: Synthetic oligonucleotide
  Target: SCN9A; (+) strand; PAM type: NRG; PAM sequence: AGG
tgtttcaaatggacaaagag

SEQ ID NO: 45671 - DNA, 20 bp, Artificial Sequence
  Description of Artificial Sequence: Synthetic oligonucleotide
  Target: SCN9A; (+) strand; PAM type: NRG; PAM sequence: AAG
caaatggacaaagagaggac

SEQ ID NO: 45672 - DNA, 20 bp, Artificial Sequence
  Description of Artificial Sequence: Synthetic oligonucleotide
  Target: SCN9A; (+) strand; PAM type: NRG; PAM sequence: GAG
aatggacaaagagaggacaa

SEQ ID NO: 45673 - DNA, 20 bp, Artificial Sequence
  Description of Artificial Sequence: Synthetic oligonucleotide
  Target: SCN9A; (+) strand; PAM type: NRG; PAM sequence: GAG
tggacaaagagaggacaaga

SEQ ID NO: 45674 - DNA, 20 bp, Artificial Sequence
  Description of Artificial Sequence: Synthetic oligonucleotide
  Target: SCN9A; (+) strand; PAM type: NRG; PAM sequence: AGG
ggacaaagagaggacaagag

SEQ ID NO: 45675 - DNA, 20 bp, Artificial Sequence
  Description of Artificial Sequence: Synthetic oligonucleotide
  Target: SCN9A; (+) strand; PAM type: NRG; PAM sequence: TAG
caaagagaggacaagagagg

SEQ ID NO: 45676 - DNA, 20 bp, Artificial Sequence
  Description of Artificial Sequence: Synthetic oligonucleotide
  Target: SCN9A; (+) strand; PAM type: NRG; PAM sequence: GAG
agagaggtagaaattccatt

SEQ ID NO: 45677 - DNA, 20 bp, Artificial Sequence
  Description of Artificial Sequence: Synthetic oligonucleotide
  Target: SCN9A; (+) strand; PAM type: NRG; PAM sequence: AAG
tagaaattccattgagctat

SEQ ID NO: 45678 - DNA, 20 bp, Artificial Sequence
  Description of Artificial Sequence: Synthetic oligonucleotide
  Target: SCN9A; (+) strand; PAM type: NRG; PAM sequence: AAG
tccattgagctataagtcac

SEQ ID NO: 45679 - DNA, 20 bp, Artificial Sequence
  Description of Artificial Sequence: Synthetic oligonucleotide
  Target: SCN9A; (+) strand; PAM type: NRG; PAM sequence: TAG
tgagctataagtcacaagcc

SEQ ID NO: 45680 - DNA, 20 bp, Artificial Sequence
  Description of Artificial Sequence: Synthetic oligonucleotide
  Target: SCN9A; (+) strand; PAM type: NRG; PAM sequence: AGG
gagctataagtcacaagcct

SEQ ID NO: 45681 - DNA, 20 bp, Artificial Sequence
  Description of Artificial Sequence: Synthetic oligonucleotide
  Target: SCN9A; (+) strand; PAM type: NRG; PAM sequence: TGG
caagcctaggactcttgaca

SEQ ID NO: 45682 - DNA, 20 bp, Artificial Sequence
  Description of Artificial Sequence: Synthetic oligonucleotide
  Target: SCN9A; (+) strand; PAM type: NRG; PAM sequence: TAG
actgtataactctataactc

SEQ ID NO: 45683 - DNA, 20 bp, Artificial Sequence
  Description of Artificial Sequence: Synthetic oligonucleotide
  Target: SCN9A; (+) strand; PAM type: NRG; PAM sequence: TAG
gatttataactgtataactc

SEQ ID NO: 45684 - DNA, 20 bp, Artificial Sequence
  Description of Artificial Sequence: Synthetic oligonucleotide
  Target: SCN9A; (+) strand; PAM type: NRG; PAM sequence: GAG
taaaatcacttccttttaat

SEQ ID NO: 45685 - DNA, 20 bp, Artificial Sequence
  Description of Artificial Sequence: Synthetic oligonucleotide
  Target: SCN9A; (+) strand; PAM type: NRG; PAM sequence: CAG
ttttaatgagtctgcttttt

SEQ ID NO: 45686 - DNA, 20 bp, Artificial Sequence
  Description of Artificial Sequence: Synthetic oligonucleotide
  Target: SCN9A; (+) strand; PAM type: NRG; PAM sequence: TAG
aatgagtctgctttttcagt

SEQ ID NO: 45687 - DNA, 20 bp, Artificial Sequence
  Description of Artificial Sequence: Synthetic oligonucleotide
  Target: SCN9A; (+) strand; PAM type: NRG; PAM sequence: AAG
gctttttcagttagaaaatg

SEQ ID NO: 45688 - DNA, 20 bp, Artificial Sequence
  Description of Artificial Sequence: Synthetic oligonucleotide
  Target: SCN9A; (+) strand; PAM type: NRG; PAM sequence: TGG
ttagaaaatgaagtgctaaa

SEQ ID NO: 45689 - DNA, 20 bp, Artificial Sequence
  Description of Artificial Sequence: Synthetic oligonucleotide
  Target: SCN9A; (+) strand; PAM type: NRG; PAM sequence: AAG
aaaatgaagtgctaaatgga

SEQ ID NO: 45690 - DNA, 20 bp, Artificial Sequence
  Description of Artificial Sequence: Synthetic oligonucleotide
  Target: SCN9A; (+) strand; PAM type: NRG; PAM sequence: AAG
tgctaaatggaaagttctat

SEQ ID NO: 45691 - DNA, 20 bp, Artificial Sequence
  Description of Artificial Sequence: Synthetic oligonucleotide
  Target: SCN9A; (+) strand; PAM type: NRG; PAM sequence: AGG
gctaaatggaaagttctata

SEQ ID NO: 45692 - DNA, 20 bp, Artificial Sequence
  Description of Artificial Sequence: Synthetic oligonucleotide
  Target: SCN9A; (+) strand; PAM type: NRG; PAM sequence: AAG
atgttgcaactcaacatact

SEQ ID NO: 45693 - DNA, 20 bp, Artificial Sequence
  Description of Artificial Sequence: Synthetic oligonucleotide
  Target: SCN9A; (+) strand; PAM type: NRG; PAM sequence: AAG
caactcaacatactaagaat

SEQ ID NO: 45694 - DNA, 20 bp, Artificial Sequence
  Description of Artificial Sequence: Synthetic oligonucleotide
  Target: SCN9A; (+) strand; PAM type: NRG; PAM sequence: CAG
actaagaataagaattttgt

SEQ ID NO: 45695 - DNA, 20 bp, Artificial Sequence
  Description of Artificial Sequence: Synthetic oligonucleotide
  Target: SCN9A; (+) strand; PAM type: NRG; PAM sequence: CAG
aagaataagaattttgtcag

SEQ ID NO: 45696 - DNA, 20 bp, Artificial Sequence
  Description of Artificial Sequence: Synthetic oligonucleotide
  Target: SCN9A; (+) strand; PAM type: NRG; PAM sequence: AAG
taagaattttgtcagcagct

SEQ ID NO: 45697 - DNA, 20 bp, Artificial Sequence
  Description of Artificial Sequence: Synthetic oligonucleotide
  Target: SCN9A; (+) strand; PAM type: NRG; PAM sequence: AGG
aagaattttgtcagcagcta

SEQ ID NO: 45698 - DNA, 20 bp, Artificial Sequence
  Description of Artificial Sequence: Synthetic oligonucleotide
  Target: SCN9A; (+) strand; PAM type: NRG; PAM sequence: GAG
gaattttgtcagcagctaag

SEQ ID NO: 45699 - DNA, 20 bp, Artificial Sequence
  Description of Artificial Sequence: Synthetic oligonucleotide
  Target: SCN9A; (+) strand; PAM type: NRG; PAM sequence: AAG
gcagctaaggagatccatga

SEQ ID NO: 45700 - DNA, 20 bp, Artificial Sequence
  Description of Artificial Sequence: Synthetic oligonucleotide
  Target: SCN9A; (+) strand; PAM type: NRG; PAM sequence: AGG
cagctaaggagatccatgaa

SEQ ID NO: 45701 - DNA, 20 bp, Artificial Sequence
  Description of Artificial Sequence: Synthetic oligonucleotide
  Target: SCN9A; (+) strand; PAM type: NRG; PAM sequence: CAG
taaggagatccatgaaaggt

SEQ ID NO: 45702 - DNA, 20 bp, Artificial Sequence
  Description of Artificial Sequence: Synthetic oligonucleotide
  Target: SCN9A; (+) strand; PAM type: NRG; PAM sequence: AAG
cagccattgactttaaatga

SEQ ID NO: 45703 - DNA, 20 bp, Artificial Sequence
  Description of Artificial Sequence: Synthetic oligonucleotide
  Target: SCN9A; (+) strand; PAM type: NRG; PAM sequence: CAG
ttaaatgaaagaaaaatgaa

SEQ ID NO: 45704 - DNA, 20 bp, Artificial Sequence
  Description of Artificial Sequence: Synthetic oligonucleotide
  Target: SCN9A; (+) strand; PAM type: NRG; PAM sequence: AGG
taaatgaaagaaaaatgaac

SEQ ID NO: 45705 - DNA, 20 bp, Artificial Sequence
  Description of Artificial Sequence: Synthetic oligonucleotide
  Target: SCN9A; (+) strand; PAM type: NRG; PAM sequence: AAG
tgaaagaaaaatgaacaggt

SEQ ID NO: 45706 - DNA, 20 bp, Artificial Sequence
  Description of Artificial Sequence: Synthetic oligonucleotide
  Target: SCN9A; (+) strand; PAM type: NRG; PAM sequence: AAG
aataattcctcataaatgtt

SEQ ID NO: 45707 - DNA, 20 bp, Artificial Sequence
  Description of Artificial Sequence: Synthetic oligonucleotide
  Target: SCN9A; (+) strand; PAM type: NRG; PAM sequence: CAG
taaatgttaagaaataattt

SEQ ID NO: 45708 - DNA, 20 bp, Artificial Sequence
  Description of Artificial Sequence: Synthetic oligonucleotide
  Target: SCN9A; (+) strand; PAM type: NRG; PAM sequence: AAG
atgttaagaaataatttcag

SEQ ID NO: 45709 - DNA, 20 bp, Artificial Sequence
  Description of Artificial Sequence: Synthetic oligonucleotide
  Target: SCN9A; (+) strand; PAM type: NRG; PAM sequence: TGG
gaaataatttcagaagtctt

SEQ ID NO: 45710 - DNA, 20 bp, Artificial Sequence
  Description of Artificial Sequence: Synthetic oligonucleotide
  Target: SCN9A; (+) strand; PAM type: NRG; PAM sequence: CAG
agtctttggttgactttccc

SEQ ID NO: 45711 - DNA, 20 bp, Artificial Sequence
  Description of Artificial Sequence: Synthetic oligonucleotide
  Target: SCN9A; (+) strand; PAM type: NRG; PAM sequence: AAG
ttgactttccccagctcctg

SEQ ID NO: 45712 - DNA, 20 bp, Artificial Sequence
  Description of Artificial Sequence: Synthetic oligonucleotide
  Target: SCN9A; (+) strand; PAM type: NRG; PAM sequence: TAG
tcctgaagtgctttaacacc

SEQ ID NO: 45713 - DNA, 20 bp, Artificial Sequence
  Description of Artificial Sequence: Synthetic oligonucleotide
  Target: SCN9A; (+) strand; PAM type: NRG; PAM sequence: AAG
tgctttaacacctagaatcc

SEQ ID NO: 45714 - DNA, 20 bp, Artificial Sequence
  Description of Artificial Sequence: Synthetic oligonucleotide
  Target: SCN9A; (+) strand; PAM type: NRG; PAM sequence: GAG
tagaatccaagttttattct

SEQ ID NO: 45715 - DNA, 20 bp, Artificial Sequence
  Description of Artificial Sequence: Synthetic oligonucleotide
  Target: SCN9A; (+) strand; PAM type: NRG; PAM sequence: GAG
gaatccaagttttattctga

SEQ ID NO: 45716 - DNA, 20 bp, Artificial Sequence
  Description of Artificial Sequence: Synthetic oligonucleotide
  Target: SCN9A; (+) strand; PAM type: NRG; PAM sequence: CAG
ttctgagagcaactgtctgc

SEQ ID NO: 45717 - DNA, 20 bp, Artificial Sequence
  Description of Artificial Sequence: Synthetic oligonucleotide
  Target: SCN9A; (+) strand; PAM type: NRG; PAM sequence: AGG
tctgagagcaactgtctgcc

SEQ ID NO: 45718 - DNA, 20 bp, Artificial Sequence
  Description of Artificial Sequence: Synthetic oligonucleotide
  Target: SCN9A; (+) strand; PAM type: NRG; PAM sequence: TGG
gcaactgtctgccaggcaat

SEQ ID NO: 45719 - DNA, 20 bp, Artificial Sequence
  Description of Artificial Sequence: Synthetic oligonucleotide
  Target: SCN9A; (+) strand; PAM type: NRG; PAM sequence: GAG
aactgtctgccaggcaattg

SEQ ID NO: 45720 - DNA, 20 bp, Artificial Sequence
  Description of Artificial Sequence: Synthetic oligonucleotide
  Target: SCN9A; (+) strand; PAM type: NRG; PAM sequence: TGG
taattttaatcttctttaaa

SEQ ID NO: 45721 - DNA, 20 bp, Artificial Sequence
  Description of Artificial Sequence: Synthetic oligonucleotide
  Target: SCN9A; (+) strand; PAM type: NRG; PAM sequence: GGG
aattttaatcttctttaaat

SEQ ID NO: 45722 - DNA, 20 bp, Artificial Sequence
  Description of Artificial Sequence: Synthetic oligonucleotide
  Target: SCN9A; (+) strand; PAM type: NRG; PAM sequence: CAG
aatcttctttaaatgggtga

SEQ ID NO: 45723 - DNA, 20 bp, Artificial Sequence
  Description of Artificial Sequence: Synthetic oligonucleotide
  Target: SCN9A; (+) strand; PAM type: NRG; PAM sequence: GAG
tcttctttaaatgggtgaca

SEQ ID NO: 45724 - DNA, 20 bp, Artificial Sequence
  Description of Artificial Sequence: Synthetic oligonucleotide
  Target: SCN9A; (+) strand; PAM type: NRG; PAM sequence: TAG
ctttaaatgggtgacagagt

SEQ ID NO: 45725 - DNA, 20 bp, Artificial Sequence
  Description of Artificial Sequence: Synthetic oligonucleotide
  Target: SCN9A; (+) strand; PAM type: NRG; PAM sequence: TAG
aaatgggtgacagagttagt

SEQ ID NO: 45726 - DNA, 20 bp, Artificial Sequence
  Description of Artificial Sequence: Synthetic oligonucleotide
  Target: SCN9A; (+) strand; PAM type: NRG; PAM sequence: TAG
cagagttagttagaaaaaaa

SEQ ID NO: 45727 - DNA, 20 bp, Artificial Sequence
  Description of Artificial Sequence: Synthetic oligonucleotide
  Target: SCN9A; (+) strand; PAM type: NRG; PAM sequence: AGG
agagttagttagaaaaaaat

SEQ ID NO: 45728 - DNA, 20 bp, Artificial Sequence
  Description of Artificial Sequence: Synthetic oligonucleotide
  Target: SCN9A; (+) strand; PAM type: NRG; PAM sequence: GAG
ttagaaaaaaataggtgact

SEQ ID NO: 45729 - DNA, 20 bp, Artificial Sequence
  Description of Artificial Sequence: Synthetic oligonucleotide
  Target: SCN9A; (+) strand; PAM type: NRG; PAM sequence: TAG
aaaaaaataggtgactgagt

SEQ ID NO: 45730 - DNA, 20 bp, Artificial Sequence
  Description of Artificial Sequence: Synthetic oligonucleotide
  Target: SCN9A; (+) strand; PAM type: NRG; PAM sequence: TAG
tttccatatgatactaaacc

SEQ ID NO: 45731 - DNA, 20 bp, Artificial Sequence
  Description of Artificial Sequence: Synthetic oligonucleotide
  Target: SCN9A; (+) strand; PAM type: NRG; PAM sequence: AAG
cctagatgcctgctccttaa

SEQ ID NO: 45732 - DNA, 20 bp, Artificial Sequence
  Description of Artificial Sequence: Synthetic oligonucleotide
  Target: SCN9A; (+) strand; PAM type: NRG; PAM sequence: AGG
ctagatgcctgctccttaaa

SEQ ID NO: 45733 - DNA, 20 bp, Artificial Sequence
  Description of Artificial Sequence: Synthetic oligonucleotide
  Target: SCN9A; (+) strand; PAM type: NRG; PAM sequence: TGG
tgctccttaaaaggcatacg

SEQ ID NO: 45734 - DNA, 20 bp, Artificial Sequence
  Description of Artificial Sequence: Synthetic oligonucleotide
  Target: SCN9A; (+) strand; PAM type: NRG; PAM sequence: AAG
gaatctgattttctaacttt

SEQ ID NO: 45735 - DNA, 20 bp, Artificial Sequence
  Description of Artificial Sequence: Synthetic oligonucleotide
  Target: SCN9A; (+) strand; PAM type: NRG; PAM sequence: CGG
actttaagctgaaatgaaca

SEQ ID NO: 45736 - DNA, 20 bp, Artificial Sequence
  Description of Artificial Sequence: Synthetic oligonucleotide
  Target: SCN9A; (+) strand; PAM type: NRG; PAM sequence: TGG
tgaacacggttttaaaattt

SEQ ID NO: 45737 - DNA, 20 bp, Artificial Sequence
  Description of Artificial Sequence: Synthetic oligonucleotide
  Target: SCN9A; (+) strand; PAM type: NRG; PAM sequence: GGG
gaacacggttttaaaatttt

SEQ ID NO: 45738 - DNA, 20 bp, Artificial Sequence
  Description of Artificial Sequence: Synthetic oligonucleotide
  Target: SCN9A; (+) strand; PAM type: NRG; PAM sequence: GAG
acacggttttaaaattttgg

SEQ ID NO: 45739 - DNA, 20 bp, Artificial Sequence
  Description of Artificial Sequence: Synthetic oligonucleotide
  Target: SCN9A; (+) strand; PAM type: NRG; PAM sequence: TAG
ggagtattacttcttccatg

SEQ ID NO: 45740 - DNA, 20 bp, Artificial Sequence
  Description of Artificial Sequence: Synthetic oligonucleotide
  Target: SCN9A; (+) strand; PAM type: NRG; PAM sequence: CAG
taaaatatacaaataaaata

SEQ ID NO: 45741 - DNA, 20 bp, Artificial Sequence
  Description of Artificial Sequence: Synthetic oligonucleotide
  Target: SCN9A; (+) strand; PAM type: NRG; PAM sequence: TGG
atatacaaataaaatacagc

SEQ ID NO: 45742 - DNA, 20 bp, Artificial Sequence
  Description of Artificial Sequence: Synthetic oligonucleotide
  Target: SCN9A; (+) strand; PAM type: NRG; PAM sequence: TGG
cagctggccttctgtatccc

SEQ ID NO: 45743 - DNA, 20 bp, Artificial Sequence
  Description of Artificial Sequence: Synthetic oligonucleotide
  Target: SCN9A; (+) strand; PAM type: NRG; PAM sequence: GGG
agctggccttctgtatccct

SEQ ID NO: 45744 - DNA, 20 bp, Artificial Sequence
  Description of Artificial Sequence: Synthetic oligonucleotide
  Target: SCN9A; (+) strand; PAM type: NRG; PAM sequence: TAG
atccctgggtcccacatctg

SEQ ID NO: 45745 - DNA, 20 bp, Artificial Sequence
  Description of Artificial Sequence: Synthetic oligonucleotide
  Target: SCN9A; (+) strand; PAM type: NRG; PAM sequence: GAG
ccctgggtcccacatctgta

SEQ ID NO: 45746 - DNA, 20 bp, Artificial Sequence
  Description of Artificial Sequence: Synthetic oligonucleotide
  Target: SCN9A; (+) strand; PAM type: NRG; PAM sequence: CAG
tctgtagagtcaaccaacta

SEQ ID NO: 45747 - DNA, 20 bp, Artificial Sequence
  Description of Artificial Sequence: Synthetic oligonucleotide
  Target: SCN9A; (+) strand; PAM type: NRG; PAM sequence: TGG
tagagtcaaccaactacaga

SEQ ID NO: 45748 - DNA, 20 bp, Artificial Sequence
  Description of Artificial Sequence: Synthetic oligonucleotide
  Target: SCN9A; (+) strand; PAM type: NRG; PAM sequence: TGG
aactacagatggaaaataat

SEQ ID NO: 45749 - DNA, 20 bp, Artificial Sequence
  Description of Artificial Sequence: Synthetic oligonucleotide
  Target: SCN9A; (+) strand; PAM type: NRG; PAM sequence: TAG
taaaaatacaacaataaaaa

SEQ ID NO: 45750 - DNA, 20 bp, Artificial Sequence
  Description of Artificial Sequence: Synthetic oligonucleotide
  Target: SCN9A; (+) strand; PAM type: NRG; PAM sequence: TAG
aatagtacaaataaaaaata

SEQ ID NO: 45751 - DNA, 20 bp, Artificial Sequence
  Description of Artificial Sequence: Synthetic oligonucleotide
  Target: SCN9A; (+) strand; PAM type: NRG; PAM sequence: CAG
aacaaatatttacattgtgt

SEQ ID NO: 45752 - DNA, 20 bp, Artificial Sequence
  Description of Artificial Sequence: Synthetic oligonucleotide
  Target: SCN9A; (+) strand; PAM type: NRG; PAM sequence: AAG
gtgatttacttttacattat

SEQ ID NO: 45753 - DNA, 20 bp, Artificial Sequence
  Description of Artificial Sequence: Synthetic oligonucleotide
  Target: SCN9A; (+) strand; PAM type: NRG; PAM sequence: AAG
tttacattataagtaatctg

SEQ ID NO: 45754 - DNA, 20 bp, Artificial Sequence
  Description of Artificial Sequence: Synthetic oligonucleotide
  Target: SCN9A; (+) strand; PAM type: NRG; PAM sequence: AAG
agtaatctgaagataattta

SEQ ID NO: 45755 - DNA, 20 bp, Artificial Sequence
  Description of Artificial Sequence: Synthetic oligonucleotide
  Target: SCN9A; (+) strand; PAM type: NRG; PAM sequence: GAG
ataatttaaagtgtacatat

SEQ ID NO: 45756 - DNA, 20 bp, Artificial Sequence
  Description of Artificial Sequence: Synthetic oligonucleotide
  Target: SCN9A; (+) strand; PAM type: NRG; PAM sequence: GAG
aatttaaagtgtacatatga

SEQ ID NO: 45757 - DNA, 20 bp, Artificial Sequence
  Description of Artificial Sequence: Synthetic oligonucleotide
  Target: SCN9A; (+) strand; PAM type: NRG; PAM sequence: AGG
atttaaagtgtacatatgag

SEQ ID NO: 45758 - DNA, 20 bp, Artificial Sequence
  Description of Artificial Sequence: Synthetic oligonucleotide
  Target: SCN9A; (+) strand; PAM type: NRG; PAM sequence: TAG
tacatatgagaggatgtgtg

SEQ ID NO: 45759 - DNA, 20 bp, Artificial Sequence
  Description of Artificial Sequence: Synthetic oligonucleotide
  Target: SCN9A; (+) strand; PAM type: NRG; PAM sequence: AGG
acatatgagaggatgtgtgt

SEQ ID NO: 45760 - DNA, 20 bp, Artificial Sequence
  Description of Artificial Sequence: Synthetic oligonucleotide
  Target: SCN9A; (+) strand; PAM type: NRG; PAM sequence: TGG
gaggatgtgtgtaggtttta

SEQ ID NO: 45761 - DNA, 20 bp, Artificial Sequence
  Description of Artificial Sequence: Synthetic oligonucleotide
  Target: SCN9A; (+) strand; PAM type: NRG; PAM sequence: AAG
acattgtgccattttatata

SEQ ID NO: 45762 - DNA, 20 bp, Artificial Sequence
  Description of Artificial Sequence: Synthetic oligonucleotide
  Target: SCN9A; (+) strand; PAM type: NRG; PAM sequence: AGG
cattgtgccattttatataa

SEQ ID NO: 45763 - DNA, 20 bp, Artificial Sequence
  Description of Artificial Sequence: Synthetic oligonucleotide
  Target: SCN9A; (+) strand; PAM type: NRG; PAM sequence: GAG
ccattttatataaaggaatt

SEQ ID NO: 45764 - DNA, 20 bp, Artificial Sequence
  Description of Artificial Sequence: Synthetic oligonucleotide
  Target: SCN9A; (+) strand; PAM type: NRG; PAM sequence: CAG
ataaaggaattgagcatctg

SEQ ID NO: 45765 - DNA, 20 bp, Artificial Sequence
  Description of Artificial Sequence: Synthetic oligonucleotide
  Target: SCN9A; (+) strand; PAM type: NRG; PAM sequence: TAG
aattgagcatctgcagattt

SEQ ID NO: 45766 - DNA, 20 bp, Artificial Sequence
  Description of Artificial Sequence: Synthetic oligonucleotide
  Target: SCN9A; (+) strand; PAM type: NRG; PAM sequence: TGG
tctgcagattttagtctctg

SEQ ID NO: 45767 - DNA, 20 bp, Artificial Sequence
  Description of Artificial Sequence: Synthetic oligonucleotide
  Target: SCN9A; (+) strand; PAM type: NRG; PAM sequence: GGG
ctgcagattttagtctctgt

SEQ ID NO: 45768 - DNA, 20 bp, Artificial Sequence
  Description of Artificial Sequence: Synthetic oligonucleotide
  Target: SCN9A; (+) strand; PAM type: NRG; PAM sequence: GGG
tgcagattttagtctctgtg

SEQ ID NO: 45769 - DNA, 20 bp, Artificial Sequence
  Description of Artificial Sequence: Synthetic oligonucleotide
  Target: SCN9A; (+) strand; PAM type: NRG; PAM sequence: GGG
gcagattttagtctctgtgg

SEQ ID NO: 45770 - DNA, 20 bp, Artificial Sequence
  Description of Artificial Sequence: Synthetic oligonucleotide
  Target: SCN9A; (+) strand; PAM type: NRG; PAM sequence: GGG
cagattttagtctctgtggg

SEQ ID NO: 45771 - DNA, 20 bp, Artificial Sequence
  Description of Artificial Sequence: Synthetic oligonucleotide
  Target: SCN9A; (+) strand; PAM type: NRG; PAM sequence: TAG
gccttcaaactactcgccca

SEQ ID NO: 45772 - DNA, 20 bp, Artificial Sequence
  Description of Artificial Sequence: Synthetic oligonucleotide
  Target: SCN9A; (+) strand; PAM type: NRG; PAM sequence: GAG
actactcgcccatagatatc

SEQ ID NO: 45773 - DNA, 20 bp, Artificial Sequence
  Description of Artificial Sequence: Synthetic oligonucleotide
  Target: SCN9A; (+) strand; PAM type: NRG; PAM sequence: AGG
ctactcgcccatagatatcg

SEQ ID NO: 45774 - DNA, 20 bp, Artificial Sequence
  Description of Artificial Sequence: Synthetic oligonucleotide
  Target: SCN9A; (+) strand; PAM type: NRG; PAM sequence: GGG
tactcgcccatagatatcga

SEQ ID NO: 45775 - DNA, 20 bp, Artificial Sequence
  Description of Artificial Sequence: Synthetic oligonucleotide
  Target: SCN9A; (+) strand; PAM type: NRG; PAM sequence: TAG
catagatatcgagggatgac

SEQ ID NO: 45776 - DNA, 20 bp, Artificial Sequence
  Description of Artificial Sequence: Synthetic oligonucleotide
  Target: SCN9A; (+) strand; PAM type: NRG; PAM sequence: TGG
gattccttactttaccgtct

SEQ ID NO: 45777 - DNA, 20 bp, Artificial Sequence
  Description of Artificial Sequence: Synthetic oligonucleotide
  Target: SCN9A; (+) strand; PAM type: NRG; PAM sequence: TGG
cgtcttggaaaaaatgtcct

SEQ ID NO: 45778 - DNA, 20 bp, Artificial Sequence
  Description of Artificial Sequence: Synthetic oligonucleotide
  Target: SCN9A; (+) strand; PAM type: NRG; PAM sequence: TAG
aaaaaatgtccttggctaca

SEQ ID NO: 45779 - DNA, 20 bp, Artificial Sequence
  Description of Artificial Sequence: Synthetic oligonucleotide
  Target: SCN9A; (+) strand; PAM type: NRG; PAM sequence: TAG
tttattcactcaattaaata

SEQ ID NO: 45780 - DNA, 20 bp, Artificial Sequence
  Description of Artificial Sequence: Synthetic oligonucleotide
  Target: SCN9A; (+) strand; PAM type: NRG; PAM sequence: GAG
tattcactcaattaaatata

SEQ ID NO: 45781 - DNA, 20 bp, Artificial Sequence
  Description of Artificial Sequence: Synthetic oligonucleotide
  Target: SCN9A; (+) strand; PAM type: NRG; PAM sequence: GAG
cttatgtattgatttttttt

SEQ ID NO: 45782 - DNA, 20 bp, Artificial Sequence
  Description of Artificial Sequence: Synthetic oligonucleotide
  Target: SCN9A; (+) strand; PAM type: NRG; PAM sequence: CAG
tgtattgattttttttgaga

SEQ ID NO: 45783 - DNA, 20 bp, Artificial Sequence
  Description of Artificial Sequence: Synthetic oligonucleotide
  Target: SCN9A; (+) strand; PAM type: NRG; PAM sequence: GAG
tattgattttttttgagaca

SEQ ID NO: 45784 - DNA, 20 bp, Artificial Sequence
  Description of Artificial Sequence: Synthetic oligonucleotide
  Target: SCN9A; (+) strand; PAM type: NRG; PAM sequence: TAG
tgagacagagtctcactctg

SEQ ID NO: 45785 - DNA, 20 bp, Artificial Sequence
  Description of Artificial Sequence: Synthetic oligonucleotide
  Target: SCN9A; (+) strand; PAM type: NRG; PAM sequence: AAG
agagtctcactctgtagtcc

SEQ ID NO: 45786 - DNA, 20 bp, Artificial Sequence
  Description of Artificial Sequence: Synthetic oligonucleotide
  Target: SCN9A; (+) strand; PAM type: NRG; PAM sequence: TGG
tctcactctgtagtccaagc

SEQ ID NO: 45787 - DNA, 20 bp, Artificial Sequence
  Description of Artificial Sequence: Synthetic oligonucleotide
  Target: SCN9A; (+) strand; PAM type: NRG; PAM sequence: GAG
tcactctgtagtccaagctg

SEQ ID NO: 45788 - DNA, 20 bp, Artificial Sequence
  Description of Artificial Sequence: Synthetic oligonucleotide
  Target: SCN9A; (+) strand; PAM type: NRG; PAM sequence: CAG
ctgtagtccaagctggagtg

SEQ ID NO: 45789 - DNA, 20 bp, Artificial Sequence
  Description of Artificial Sequence: Synthetic oligonucleotide
  Target: SCN9A; (+) strand; PAM type: NRG; PAM sequence: CGG
tagtccaagctggagtgcag

SEQ ID NO: 45790 - DNA, 20 bp, Artificial Sequence
  Description of Artificial Sequence: Synthetic oligonucleotide
  Target: SCN9A; (+) strand; PAM type: NRG; PAM sequence: TGG
ggagtgcagcggtgcgatct

SEQ ID NO: 45791 - DNA, 20 bp, Artificial Sequence
  Description of Artificial Sequence: Synthetic oligonucleotide
  Target: SCN9A; (+) strand; PAM type: NRG; PAM sequence: TGG
cttactgcaacctccgcctc

SEQ ID NO: 45792 - DNA, 20 bp, Artificial Sequence
  Description of Artificial Sequence: Synthetic oligonucleotide
  Target: SCN9A; (+) strand; PAM type: NRG; PAM sequence: GAG
tactgcaacctccgcctctg

SEQ ID NO: 45793 - DNA, 20 bp, Artificial Sequence
  Description of Artificial Sequence: Synthetic oligonucleotide
  Target: SCN9A; (+) strand; PAM type: NRG; PAM sequence: AAG
aacctccgcctctggagctc

SEQ ID NO: 45794 - DNA, 20 bp, Artificial Sequence
  Description of Artificial Sequence: Synthetic oligonucleotide
  Target: SCN9A; (+) strand; PAM type: NRG; PAM sequence: CAG
ctcaagtgattctcatgcct

SEQ ID NO: 45795 - DNA, 20 bp, Artificial Sequence
  Description of Artificial Sequence: Synthetic oligonucleotide
  Target: SCN9A; (+) strand; PAM type: NRG; PAM sequence: GAG
ttctcatgcctcagcctcct

SEQ ID NO: 45796 - DNA, 20 bp, Artificial Sequence
  Description of Artificial Sequence: Synthetic oligonucleotide
  Target: SCN9A; (+) strand; PAM type: NRG; PAM sequence: CAG
atatatatatatatatatat

SEQ ID NO: 45797 - DNA, 20 bp, Artificial Sequence
  Description of Artificial Sequence: Synthetic oligonucleotide
  Target: SCN9A; (+) strand; PAM type: NRG; PAM sequence: AAG
tccatataatctcgttttcc

SEQ ID NO: 45798 - DNA, 20 bp, Artificial Sequence
  Description of Artificial Sequence: Synthetic oligonucleotide
  Target: SCN9A; (+) strand; PAM type: NRG; PAM sequence: TGG
ccaagtccactataaattca

SEQ ID NO: 45799 - DNA, 20 bp, Artificial Sequence
  Description of Artificial Sequence: Synthetic oligonucleotide
  Target: SCN9A; (+) strand; PAM type: NRG; PAM sequence: GAG
aagtccactataaattcatg

SEQ ID NO: 45800 - DNA, 20 bp, Artificial Sequence
  Description of Artificial Sequence: Synthetic oligonucleotide
  Target: SCN9A; (+) strand; PAM type: NRG; PAM sequence: AGG
agtccactataaattcatgg

SEQ ID NO: 45801 - DNA, 20 bp, Artificial Sequence
  Description of Artificial Sequence: Synthetic oligonucleotide
  Target: SCN9A; (+) strand; PAM type: NRG; PAM sequence: GGG
gtccactataaattcatgga

SEQ ID NO: 45802 - DNA, 20 bp, Artificial Sequence
  Description of Artificial Sequence: Synthetic oligonucleotide
  Target: SCN9A; (+) strand; PAM type: NRG; PAM sequence: TGG
cactataaattcatggaggg

SEQ ID NO: 45803 - DNA, 20 bp, Artificial Sequence
  Description of Artificial Sequence: Synthetic oligonucleotide
  Target: SCN9A; (+) strand; PAM type: NRG; PAM sequence: GAG
ctataaattcatggagggtg

SEQ ID NO: 45804 - DNA, 20 bp, Artificial Sequence
  Description of Artificial Sequence: Synthetic oligonucleotide
  Target: SCN9A; (+) strand; PAM type: NRG; PAM sequence: TAG
attcatggagggtggagtct

SEQ ID NO: 45805 - DNA, 20 bp, Artificial Sequence
  Description of Artificial Sequence: Synthetic oligonucleotide
  Target: SCN9A; (+) strand; PAM type: NRG; PAM sequence: AAG
atggagggtggagtcttagt

SEQ ID NO: 45806 - DNA, 20 bp, Artificial Sequence
  Description of Artificial Sequence: Synthetic oligonucleotide
  Target: SCN9A; (+) strand; PAM type: NRG; PAM sequence: AAG
gggtggagtcttagtaagtt

SEQ ID NO: 45807 - DNA, 20 bp, Artificial Sequence
  Description of Artificial Sequence: Synthetic oligonucleotide
  Target: SCN9A; (+) strand; PAM type: NRG; PAM sequence: AGG
ggtggagtcttagtaagtta

SEQ ID NO: 45808 - DNA, 20 bp, Artificial Sequence
  Description of Artificial Sequence: Synthetic oligonucleotide
  Target: SCN9A; (+) strand; PAM type: NRG; PAM sequence: GAG
tggagtcttagtaagttaag

SEQ ID NO: 45809 - DNA, 20 bp, Artificial Sequence
  Description of Artificial Sequence: Synthetic oligonucleotide
  Target: SCN9A; (+) strand; PAM type: NRG; PAM sequence: TAG
gtcttagtaagttaaggaga

SEQ ID NO: 45810 - DNA, 20 bp, Artificial Sequence
  Description of Artificial Sequence: Synthetic oligonucleotide
  Target: SCN9A; (+) strand; PAM type: NRG; PAM sequence: AAG
ttagtaagttaaggagatag

SEQ ID NO: 45811 - DNA, 20 bp, Artificial Sequence
  Description of Artificial Sequence: Synthetic oligonucleotide
  Target: SCN9A; (+) strand; PAM type: NRG; PAM sequence: TGG
ttaaggagatagaagatatt

SEQ ID NO: 45812 - DNA, 20 bp, Artificial Sequence
  Description of Artificial Sequence: Synthetic oligonucleotide
  Target: SCN9A; (+) strand; PAM type: NRG; PAM sequence: GAG
tgtcaaatactttctaacat

SEQ ID NO: 45813 - DNA, 20 bp, Artificial Sequence
  Description of Artificial Sequence: Synthetic oligonucleotide
  Target: SCN9A; (+) strand; PAM type: NRG; PAM sequence: TAG
aaatactttctaacatgagc

SEQ ID NO: 45814 - DNA, 20 bp, Artificial Sequence
  Description of Artificial Sequence: Synthetic oligonucleotide
  Target: SCN9A; (+) strand; PAM type: NRG; PAM sequence: GAG
atactttctaacatgagcta

SEQ ID NO: 45815 - DNA, 20 bp, Artificial Sequence
  Description of Artificial Sequence: Synthetic oligonucleotide
  Target: SCN9A; (+) strand; PAM type: NRG; PAM sequence: AAG
acatgagctagagaaaacaa

SEQ ID NO: 45816 - DNA, 20 bp, Artificial Sequence
  Description of Artificial Sequence: Synthetic oligonucleotide
  Target: SCN9A; (+) strand; PAM type: NRG; PAM sequence: AAG
ttatttttaaatgatgcctt

SEQ ID NO: 45817 - DNA, 20 bp, Artificial Sequence
  Description of Artificial Sequence: Synthetic oligonucleotide
  Target: SCN9A; (+) strand; PAM type: NRG; PAM sequence: AAG
aatgatgccttaagacttga

SEQ ID NO: 45818 - DNA, 20 bp, Artificial Sequence
  Description of Artificial Sequence: Synthetic oligonucleotide
  Target: SCN9A; (+) strand; PAM type: NRG; PAM sequence: AAG
acttgaaagcaatctcataa

SEQ ID NO: 45819 - DNA, 20 bp, Artificial Sequence
  Description of Artificial Sequence: Synthetic oligonucleotide
  Target: SCN9A; (+) strand; PAM type: NRG; PAM sequence: CGG
cataaaagtaatttgtaata

SEQ ID NO: 45820 - DNA, 20 bp, Artificial Sequence
  Description of Artificial Sequence: Synthetic oligonucleotide
  Target: SCN9A; (+) strand; PAM type: NRG; PAM sequence: TAG
caatacataccttgactcac

SEQ ID NO: 45821 - DNA, 20 bp, Artificial Sequence
  Description of Artificial Sequence: Synthetic oligonucleotide
  Target: SCN9A; (+) strand; PAM type: NRG; PAM sequence: CAG
cttgactcactagaaatatg

SEQ ID NO: 45822 - DNA, 20 bp, Artificial Sequence
  Description of Artificial Sequence: Synthetic oligonucleotide
  Target: SCN9A; (+) strand; PAM type: NRG; PAM sequence: AGG
ttgactcactagaaatatgc

SEQ ID NO: 45823 - DNA, 20 bp, Artificial Sequence
  Description of Artificial Sequence: Synthetic oligonucleotide
  Target: SCN9A; (+) strand; PAM type: NRG; PAM sequence: AAG
ctcactagaaatatgcaggt

SEQ ID NO: 45824 - DNA, 20 bp, Artificial Sequence
  Description of Artificial Sequence: Synthetic oligonucleotide
  Target: SCN9A; (+) strand; PAM type: NRG; PAM sequence: AGG
tcactagaaatatgcaggta

SEQ ID NO: 45825 - DNA, 20 bp, Artificial Sequence
  Description of Artificial Sequence: Synthetic oligonucleotide
  Target: SCN9A; (+) strand; PAM type: NRG; PAM sequence: GGG
cactagaaatatgcaggtaa

SEQ ID NO: 45826 - DNA, 20 bp, Artificial Sequence
  Description of Artificial Sequence: Synthetic oligonucleotide
  Target: SCN9A; (+) strand; PAM type: NRG; PAM sequence: TGG
tagaaatatgcaggtaaggg

SEQ ID NO: 45827 - DNA, 20 bp, Artificial Sequence
  Description of Artificial Sequence: Synthetic oligonucleotide
  Target: SCN9A; (+) strand; PAM type: NRG; PAM sequence: GGG
agaaatatgcaggtaagggt

SEQ ID NO: 45828 - DNA, 20 bp, Artificial Sequence
  Description of Artificial Sequence: Synthetic oligonucleotide
  Target: SCN9A; (+) strand; PAM type: NRG; PAM sequence: GAG
aaatatgcaggtaagggtgg

SEQ ID NO: 45829 - DNA, 20 bp, Artificial Sequence
  Description of Artificial Sequence: Synthetic oligonucleotide
  Target: SCN9A; (+) strand; PAM type: NRG; PAM sequence: GAG
atatgcaggtaagggtggga

SEQ ID NO: 45830 - DNA, 20 bp, Artificial Sequence
  Description of Artificial Sequence: Synthetic oligonucleotide
  Target: SCN9A; (+) strand; PAM type: NRG; PAM sequence: AGG
tatgcaggtaagggtgggag

SEQ ID NO: 45831 - DNA, 20 bp, Artificial Sequence
  Description of Artificial Sequence: Synthetic oligonucleotide
  Target: SCN9A; (+) strand; PAM type: NRG; PAM sequence: GAG
tgcaggtaagggtgggagag

SEQ ID NO: 45832 - DNA, 20 bp, Artificial Sequence
  Description of Artificial Sequence: Synthetic oligonucleotide
  Target: SCN9A; (+) strand; PAM type: NRG; PAM sequence: AGG
gcaggtaagggtgggagagg

SEQ ID NO: 45833 - DNA, 20 bp, Artificial Sequence
  Description of Artificial Sequence: Synthetic oligonucleotide
  Target: SCN9A; (+) strand; PAM type: NRG; PAM sequence: GGG
caggtaagggtgggagagga

SEQ ID NO: 45834 - DNA, 20 bp, Artificial Sequence
  Description of Artificial Sequence: Synthetic oligonucleotide
  Target: SCN9A; (+) strand; PAM type: NRG; PAM sequence: AAG
gggagaggagggcacaaaaa

SEQ ID NO: 45835 - DNA, 20 bp, Artificial Sequence
  Description of Artificial Sequence: Synthetic oligonucleotide
  Target: SCN9A; (+) strand; PAM type: NRG; PAM sequence: AGG
ggagaggagggcacaaaaaa

SEQ ID NO: 45836 - DNA, 20 bp, Artificial Sequence
  Description of Artificial Sequence: Synthetic oligonucleotide
  Target: SCN9A; (+) strand; PAM type: NRG; PAM sequence: AAG
gggcacaaaaaaaggtttta

SEQ ID NO: 45837 - DNA, 20 bp, Artificial Sequence
  Description of Artificial Sequence: Synthetic oligonucleotide
  Target: SCN9A; (+) strand; PAM type: NRG; PAM sequence: GAG
gcacaaaaaaaggttttaaa

SEQ ID NO: 45838 - DNA, 20 bp, Artificial Sequence
  Description of Artificial Sequence: Synthetic oligonucleotide
  Target: SCN9A; (+) strand; PAM type: NRG; PAM sequence: CAG
tcctgttctcaatgaattta

SEQ ID NO: 45839 - DNA, 20 bp, Artificial Sequence
  Description of Artificial Sequence: Synthetic oligonucleotide
  Target: SCN9A; (+) strand; PAM type: NRG; PAM sequence: AAG
ttctcaaaaaattaaaattt

SEQ ID NO: 45840 - DNA, 20 bp, Artificial Sequence
  Description of Artificial Sequence: Synthetic oligonucleotide
  Target: SCN9A; (+) strand; PAM type: NRG; PAM sequence: CAG
aaatttaagattactgaatc

SEQ ID NO: 45841 - DNA, 20 bp, Artificial Sequence
  Description of Artificial Sequence: Synthetic oligonucleotide
  Target: SCN9A; (+) strand; PAM type: NRG; PAM sequence: AGG
aatttaagattactgaatcc

SEQ ID NO: 45842 - DNA, 20 bp, Artificial Sequence
  Description of Artificial Sequence: Synthetic oligonucleotide
  Target: SCN9A; (+) strand; PAM type: NRG; PAM sequence: AAG
ttaagattactgaatccagg

SEQ ID NO: 45843 - DNA, 20 bp, Artificial Sequence
  Description of Artificial Sequence: Synthetic oligonucleotide
  Target: SCN9A; (+) strand; PAM type: NRG; PAM sequence: AAG
agattactgaatccaggaag

SEQ ID NO: 45844 - DNA, 20 bp, Artificial Sequence
  Description of Artificial Sequence: Synthetic oligonucleotide
  Target: SCN9A; (+) strand; PAM type: NRG; PAM sequence: CGG
aagaagtataaaattgtttg

SEQ ID NO: 45845 - DNA, 20 bp, Artificial Sequence
  Description of Artificial Sequence: Synthetic oligonucleotide
  Target: SCN9A; (+) strand; PAM type: NRG; PAM sequence: GAG
attgtttgcggttcaaaaat

SEQ ID NO: 45846 - DNA, 20 bp, Artificial Sequence
  Description of Artificial Sequence: Synthetic oligonucleotide
  Target: SCN9A; (+) strand; PAM type: NRG; PAM sequence: AAG
gtttgcggttcaaaaatgag

SEQ ID NO: 45847 - DNA, 20 bp, Artificial Sequence
  Description of Artificial Sequence: Synthetic oligonucleotide
  Target: SCN9A; (+) strand; PAM type: NRG; PAM sequence: AGG
tttgcggttcaaaaatgaga

SEQ ID NO: 45848 - DNA, 20 bp, Artificial Sequence
  Description of Artificial Sequence: Synthetic oligonucleotide
  Target: SCN9A; (+) strand; PAM type: NRG; PAM sequence: GGG
ttgcggttcaaaaatgagaa

SEQ ID NO: 45849 - DNA, 20 bp, Artificial Sequence
  Description of Artificial Sequence: Synthetic oligonucleotide
  Target: SCN9A; (+) strand; PAM type: NRG; PAM sequence: TGG
gagaagggactacatccatt

SEQ ID NO: 45850 - DNA, 20 bp, Artificial Sequence
  Description of Artificial Sequence: Synthetic oligonucleotide
  Target: SCN9A; (+) strand; PAM type: NRG; PAM sequence: GGG
agaagggactacatccattt

SEQ ID NO: 45851 - DNA, 20 bp, Artificial Sequence
  Description of Artificial Sequence: Synthetic oligonucleotide
  Target: SCN9A; (+) strand; PAM type: NRG; PAM sequence: GGG
gaagggactacatccatttg

SEQ ID NO: 45852 - DNA, 20 bp, Artificial Sequence
  Description of Artificial Sequence: Synthetic oligonucleotide
  Target: SCN9A; (+) strand; PAM type: NRG; PAM sequence: GAG
agggactacatccatttggg

SEQ ID NO: 45853 - DNA, 20 bp, Artificial Sequence
  Description of Artificial Sequence: Synthetic oligonucleotide
  Target: SCN9A; (+) strand; PAM type: NRG; PAM sequence: TAG
acatccatttggggagaaat

SEQ ID NO: 45854 - DNA, 20 bp, Artificial Sequence
  Description of Artificial Sequence: Synthetic oligonucleotide
  Target: SCN9A; (+) strand; PAM type: NRG; PAM sequence: AGG
catccatttggggagaaatt

SEQ ID NO: 45855 - DNA, 20 bp, Artificial Sequence
  Description of Artificial Sequence: Synthetic oligonucleotide
  Target: SCN9A; (+) strand; PAM type: NRG; PAM sequence: GAG
tccatttggggagaaattag

SEQ ID NO: 45856 - DNA, 20 bp, Artificial Sequence
  Description of Artificial Sequence: Synthetic oligonucleotide
  Target: SCN9A; (+) strand; PAM type: NRG; PAM sequence: AGG
ccatttggggagaaattagg

SEQ ID NO: 45857 - DNA, 20 bp, Artificial Sequence
  Description of Artificial Sequence: Synthetic oligonucleotide
  Target: SCN9A; (+) strand; PAM type: NRG; PAM sequence: GGG
catttggggagaaattagga

SEQ ID NO: 45858 - DNA, 20 bp, Artificial Sequence
  Description of Artificial Sequence: Synthetic oligonucleotide
  Target: SCN9A; (+) strand; PAM type: NRG; PAM sequence: GAG
gatgaaataaataacatttt

SEQ ID NO: 45859 - DNA, 20 bp, Artificial Sequence
  Description of Artificial Sequence: Synthetic oligonucleotide
  Target: SCN9A; (+) strand; PAM type: NRG; PAM sequence: GAG
aataacattttgagaacatt

SEQ ID NO: 45860 - DNA, 20 bp, Artificial Sequence
  Description of Artificial Sequence: Synthetic oligonucleotide
  Target: SCN9A; (+) strand; PAM type: NRG; PAM sequence: TGG
cattttgagaacattgagta

SEQ ID NO: 45861 - DNA, 20 bp, Artificial Sequence
  Description of Artificial Sequence: Synthetic oligonucleotide
  Target: SCN9A; (+) strand; PAM type: NRG; PAM sequence: AAG
ccctgacccaactgcgattt

SEQ ID NO: 45862 - DNA, 20 bp, Artificial Sequence
  Description of Artificial Sequence: Synthetic oligonucleotide
  Target: SCN9A; (+) strand; PAM type: NRG; PAM sequence: TAG
tttaagtattaacaatttaa

SEQ ID NO: 45863 - DNA, 20 bp, Artificial Sequence
  Description of Artificial Sequence: Synthetic oligonucleotide
  Target: SCN9A; (+) strand; PAM type: NRG; PAM sequence: AAG
atttaatagatgataaatac

SEQ ID NO: 45864 - DNA, 20 bp, Artificial Sequence
  Description of Artificial Sequence: Synthetic oligonucleotide
  Target: SCN9A; (+) strand; PAM type: NRG; PAM sequence: AGG
tttaatagatgataaataca

SEQ ID NO: 45865 - DNA, 20 bp, Artificial Sequence
  Description of Artificial Sequence: Synthetic oligonucleotide
  Target: SCN9A; (+) strand; PAM type: NRG; PAM sequence: GGG
ttaatagatgataaatacaa

SEQ ID NO: 45866 - DNA, 20 bp, Artificial Sequence
  Description of Artificial Sequence: Synthetic oligonucleotide
  Target: SCN9A; (+) strand; PAM type: NRG; PAM sequence: AAG
aatacaagggtgatgccttg

SEQ ID NO: 45867 - DNA, 20 bp, Artificial Sequence
  Description of Artificial Sequence: Synthetic oligonucleotide
  Target: SCN9A; (+) strand; PAM type: NRG; PAM sequence: AGG
atacaagggtgatgccttga

SEQ ID NO: 45868 - DNA, 20 bp, Artificial Sequence
  Description of Artificial Sequence: Synthetic oligonucleotide
  Target: SCN9A; (+) strand; PAM type: NRG; PAM sequence: TGG
atgccttgaaggattttgac

SEQ ID NO: 45869 - DNA, 20 bp, Artificial Sequence
  Description of Artificial Sequence: Synthetic oligonucleotide
  Target: SCN9A; (+) strand; PAM type: NRG; PAM sequence: GAG
gccttgaaggattttgactg

SEQ ID NO: 45870 - DNA, 20 bp, Artificial Sequence
  Description of Artificial Sequence: Synthetic oligonucleotide
  Target: SCN9A; (+) strand; PAM type: NRG; PAM sequence: AAG
ttgaaggattttgactggag

SEQ ID NO: 45871 - DNA, 20 bp, Artificial Sequence
  Description of Artificial Sequence: Synthetic oligonucleotide
  Target: SCN9A; (+) strand; PAM type: NRG; PAM sequence: AGG
tgaaggattttgactggaga

SEQ ID NO: 45872 - DNA, 20 bp, Artificial Sequence
  Description of Artificial Sequence: Synthetic oligonucleotide
  Target: SCN9A; (+) strand; PAM type: NRG; PAM sequence: AAG
tgactggagaaggaaatccc

SEQ ID NO: 45873 - DNA, 20 bp, Artificial Sequence
  Description of Artificial Sequence: Synthetic oligonucleotide
  Target: SCN9A; (+) strand; PAM type: NRG; PAM sequence: AAG
ggagaaggaaatcccaagca

SEQ ID NO: 45874 - DNA, 20 bp, Artificial Sequence
  Description of Artificial Sequence: Synthetic oligonucleotide
  Target: SCN9A; (+) strand; PAM type: NRG; PAM sequence: TGG
aggaaatcccaagcaaagtg

SEQ ID NO: 45875 - DNA, 20 bp, Artificial Sequence
  Description of Artificial Sequence: Synthetic oligonucleotide
  Target: SCN9A; (+) strand; PAM type: NRG; PAM sequence: GAG
gaaatcccaagcaaagtgtg

SEQ ID NO: 45876 - DNA, 20 bp, Artificial Sequence
  Description of Artificial Sequence: Synthetic oligonucleotide
  Target: SCN9A; (+) strand; PAM type: NRG; PAM sequence: GAG
aatcccaagcaaagtgtgga

SEQ ID NO: 45877 - DNA, 20 bp, Artificial Sequence
  Description of Artificial Sequence: Synthetic oligonucleotide
  Target: SCN9A; (+) strand; PAM type: NRG; PAM sequence: AAG
ggagagtgtttatgacctaa

SEQ ID NO: 45878 - DNA, 20 bp, Artificial Sequence
  Description of Artificial Sequence: Synthetic oligonucleotide
  Target: SCN9A; (+) strand; PAM type: NRG; PAM sequence: AGG
gagagtgtttatgacctaaa

SEQ ID NO: 45879 - DNA, 20 bp, Artificial Sequence
  Description of Artificial Sequence: Synthetic oligonucleotide
  Target: SCN9A; (+) strand; PAM type: NRG; PAM sequence: TGG
tttatgacctaaaaggaaat

SEQ ID NO: 45880 - DNA, 20 bp, Artificial Sequence
  Description of Artificial Sequence: Synthetic oligonucleotide
  Target: SCN9A; (+) strand; PAM type: NRG; PAM sequence: TGG
gacctaaaaggaaattggtt

SEQ ID NO: 45881 - DNA, 20 bp, Artificial Sequence
  Description of Artificial Sequence: Synthetic oligonucleotide
  Target: SCN9A; (+) strand; PAM type: NRG; PAM sequence: CAG
aaaaggaaattggtttggta

SEQ ID NO: 45882 - DNA, 20 bp, Artificial Sequence
  Description of Artificial Sequence: Synthetic oligonucleotide
  Target: SCN9A; (+) strand; PAM type: NRG; PAM sequence: AGG
aaaggaaattggtttggtac

SEQ ID NO: 45883 - DNA, 20 bp, Artificial Sequence
  Description of Artificial Sequence: Synthetic oligonucleotide
  Target: SCN9A; (+) strand; PAM type: NRG; PAM sequence: TGG
ttggtacaggtaaaaatcta

SEQ ID NO: 45884 - DNA, 20 bp, Artificial Sequence
  Description of Artificial Sequence: Synthetic oligonucleotide
  Target: SCN9A; (+) strand; PAM type: NRG; PAM sequence: GGG
tggtacaggtaaaaatctat

SEQ ID NO: 45885 - DNA, 20 bp, Artificial Sequence
  Description of Artificial Sequence: Synthetic oligonucleotide
  Target: SCN9A; (+) strand; PAM type: NRG; PAM sequence: GAG
acaggtaaaaatctatgggt

SEQ ID NO: 45886 - DNA, 20 bp, Artificial Sequence
  Description of Artificial Sequence: Synthetic oligonucleotide
  Target: SCN9A; (+) strand; PAM type: NRG; PAM sequence: TAG
aaaaatctatgggtgagcac

SEQ ID NO: 45887 - DNA, 20 bp, Artificial Sequence
  Description of Artificial Sequence: Synthetic oligonucleotide
  Target: SCN9A; (+) strand; PAM type: NRG; PAM sequence: AGG
aaaatctatgggtgagcact

SEQ ID NO: 45888 - DNA, 20 bp, Artificial Sequence
  Description of Artificial Sequence: Synthetic oligonucleotide
  Target: SCN9A; (+) strand; PAM type: NRG; PAM sequence: GAG
aatctatgggtgagcactag

SEQ ID NO: 45889 - DNA, 20 bp, Artificial Sequence
  Description of Artificial Sequence: Synthetic oligonucleotide
  Target: SCN9A; (+) strand; PAM type: NRG; PAM sequence: TAG
tatgggtgagcactaggaga

SEQ ID NO: 45890 - DNA, 20 bp, Artificial Sequence
  Description of Artificial Sequence: Synthetic oligonucleotide
  Target: SCN9A; (+) strand; PAM type: NRG; PAM sequence: GAG
tgggtgagcactaggagata

SEQ ID NO: 45891 - DNA, 20 bp, Artificial Sequence
  Description of Artificial Sequence: Synthetic oligonucleotide
  Target: SCN9A; (+) strand; PAM type: NRG; PAM sequence: TGG
tgagcactaggagatagagc

SEQ ID NO: 45892 - DNA, 20 bp, Artificial Sequence
  Description of Artificial Sequence: Synthetic oligonucleotide
  Target: SCN9A; (+) strand; PAM type: NRG; PAM sequence: AAG
ctaggagatagagctggtca

SEQ ID NO: 45893 - DNA, 20 bp, Artificial Sequence
  Description of Artificial Sequence: Synthetic oligonucleotide
  Target: SCN9A; (+) strand; PAM type: NRG; PAM sequence: TGG
gagatagagctggtcaaagc

SEQ ID NO: 45894 - DNA, 20 bp, Artificial Sequence
  Description of Artificial Sequence: Synthetic oligonucleotide
  Target: SCN9A; (+) strand; PAM type: NRG; PAM sequence: TAG
tagagctggtcaaagctggt

SEQ ID NO: 45895 - DNA, 20 bp, Artificial Sequence
  Description of Artificial Sequence: Synthetic oligonucleotide
  Target: SCN9A; (+) strand; PAM type: NRG; PAM sequence: AGG
agagctggtcaaagctggtt

SEQ ID NO: 45896 - DNA, 20 bp, Artificial Sequence
  Description of Artificial Sequence: Synthetic oligonucleotide
  Target: SCN9A; (+) strand; PAM type: NRG; PAM sequence: GGG
gagctggtcaaagctggtta

SEQ ID NO: 45897 - DNA, 20 bp, Artificial Sequence
  Description of Artificial Sequence: Synthetic oligonucleotide
  Target: SCN9A; (+) strand; PAM type: NRG; PAM sequence: TAG
gtcaaagctggttagggcca

SEQ ID NO: 45898 - DNA, 20 bp, Artificial Sequence
  Description of Artificial Sequence: Synthetic oligonucleotide
  Target: SCN9A; (+) strand; PAM type: NRG; PAM sequence: AAG
ctggttagggccatagtgtg

SEQ ID NO: 45899 - DNA, 20 bp, Artificial Sequence
  Description of Artificial Sequence: Synthetic oligonucleotide
  Target: SCN9A; (+) strand; PAM type: NRG; PAM sequence: AGG
tggttagggccatagtgtga

SEQ ID NO: 45900 - DNA, 20 bp, Artificial Sequence
  Description of Artificial Sequence: Synthetic oligonucleotide
  Target: SCN9A; (+) strand; PAM type: NRG; PAM sequence: CAG
tagtgtgaaggctttgtgca

SEQ ID NO: 45901 - DNA, 20 bp, Artificial Sequence
  Description of Artificial Sequence: Synthetic oligonucleotide
  Target: SCN9A; (+) strand; PAM type: NRG; PAM sequence: GAG
ttgtgcacagtacataattc

SEQ ID NO: 45902 - DNA, 20 bp, Artificial Sequence
  Description of Artificial Sequence: Synthetic oligonucleotide
  Target: SCN9A; (+) strand; PAM type: NRG; PAM sequence: TGG
cagtacataattcgagactt

SEQ ID NO: 45903 - DNA, 20 bp, Artificial Sequence
  Description of Artificial Sequence: Synthetic oligonucleotide
  Target: SCN9A; (+) strand; PAM type: NRG; PAM sequence: GGG
agtacataattcgagacttt

SEQ ID NO: 45904 - DNA, 20 bp, Artificial Sequence
  Description of Artificial Sequence: Synthetic oligonucleotide
  Target: SCN9A; (+) strand; PAM type: NRG; PAM sequence: GGG
gtacataattcgagactttg

SEQ ID NO: 45905 - DNA, 20 bp, Artificial Sequence
  Description of Artificial Sequence: Synthetic oligonucleotide
  Target: SCN9A; (+) strand; PAM type: NRG; PAM sequence: TGG
ataattcgagactttgggga

SEQ ID NO: 45906 - DNA, 20 bp, Artificial Sequence
  Description of Artificial Sequence: Synthetic oligonucleotide
  Target: SCN9A; (+) strand; PAM type: NRG; PAM sequence: CAG
ttcgagactttggggatggc

SEQ ID NO: 45907 - DNA, 20 bp, Artificial Sequence
  Description of Artificial Sequence: Synthetic oligonucleotide
  Target: SCN9A; (+) strand; PAM type: NRG; PAM sequence: AGG
tcgagactttggggatggcc

SEQ ID NO: 45908 - DNA, 20 bp, Artificial Sequence
  Description of Artificial Sequence: Synthetic oligonucleotide
  Target: SCN9A; (+) strand; PAM type: NRG; PAM sequence: TGG
actttggggatggccaggcg

SEQ ID NO: 45909 - DNA, 20 bp, Artificial Sequence
  Description of Artificial Sequence: Synthetic oligonucleotide
  Target: SCN9A; (+) strand; PAM type: NRG; PAM sequence: TGG
ttggggatggccaggcgtgg

SEQ ID NO: 45910 - DNA, 20 bp, Artificial Sequence
  Description of Artificial Sequence: Synthetic oligonucleotide
  Target: SCN9A; (+) strand; PAM type: NRG; PAM sequence: CAG
gtggctcactcctgtaatct

SEQ ID NO: 45911 - DNA, 20 bp, Artificial Sequence
  Description of Artificial Sequence: Synthetic oligonucleotide
  Target: SCN9A; (+) strand; PAM type: NRG; PAM sequence: TGG
actcctgtaatctcagcaac

SEQ ID NO: 45912 - DNA, 20 bp, Artificial Sequence
  Description of Artificial Sequence: Synthetic oligonucleotide
  Target: SCN9A; (+) strand; PAM type: NRG; PAM sequence: GGG
ctcctgtaatctcagcaact

SEQ ID NO: 45913 - DNA, 20 bp, Artificial Sequence
  Description of Artificial Sequence: Synthetic oligonucleotide
  Target: SCN9A; (+) strand; PAM type: NRG; PAM sequence: GGG
tcctgtaatctcagcaactg

SEQ ID NO: 45914 - DNA, 20 bp, Artificial Sequence
  Description of Artificial Sequence: Synthetic oligonucleotide
  Target: SCN9A; (+) strand; PAM type: NRG; PAM sequence: AAG
aatctcagcaactggggaaa

SEQ ID NO: 45915 - DNA, 20 bp, Artificial Sequence
  Description of Artificial Sequence: Synthetic oligonucleotide
  Target: SCN9A; (+) strand; PAM type: NRG; PAM sequence: AAG
gcaactggggaaaaagtttg

SEQ ID NO: 45916 - DNA, 20 bp, Artificial Sequence
  Description of Artificial Sequence: Synthetic oligonucleotide
  Target: SCN9A; (+) strand; PAM type: NRG; PAM sequence: GAG
aaaagtttgaagaattgcct

SEQ ID NO: 45917 - DNA, 20 bp, Artificial Sequence
  Description of Artificial Sequence: Synthetic oligonucleotide
  Target: SCN9A; (+) strand; PAM type: NRG; PAM sequence: CAG
tttgaagaattgcctgagtc

SEQ ID NO: 45918 - DNA, 20 bp, Artificial Sequence
  Description of Artificial Sequence: Synthetic oligonucleotide
  Target: SCN9A; (+) strand; PAM type: NRG; PAM sequence: TAG
gaagaattgcctgagtccag

SEQ ID NO: 45919 - DNA, 20 bp, Artificial Sequence
  Description of Artificial Sequence: Synthetic oligonucleotide
  Target: SCN9A; (+) strand; PAM type: NRG; PAM sequence: GAG
ttgcctgagtccagtagttt

SEQ ID NO: 45920 - DNA, 20 bp, Artificial Sequence
  Description of Artificial Sequence: Synthetic oligonucleotide
  Target: SCN9A; (+) strand; PAM type: NRG; PAM sequence: CAG
tgagtccagtagtttgagac

SEQ ID NO: 45921 - DNA, 20 bp, Artificial Sequence
  Description of Artificial Sequence: Synthetic oligonucleotide
  Target: SCN9A; (+) strand; PAM type: NRG; PAM sequence: TGG
ccagtagtttgagaccagcc

SEQ ID NO: 45922 - DNA, 20 bp, Artificial Sequence
  Description of Artificial Sequence: Synthetic oligonucleotide
  Target: SCN9A; (+) strand; PAM type: NRG; PAM sequence: GGG
cagtagtttgagaccagcct

SEQ ID NO: 45923 - DNA, 20 bp, Artificial Sequence
  Description of Artificial Sequence: Synthetic oligonucleotide
  Target: SCN9A; (+) strand; PAM type: NRG; PAM sequence: TAG
tgagaccagcctgggaaaca

SEQ ID NO: 45924 - DNA, 20 bp, Artificial Sequence
  Description of Artificial Sequence: Synthetic oligonucleotide
  Target: SCN9A; (+) strand; PAM type: NRG; PAM sequence: TAG
acaaacttttttaaaaaaat

SEQ ID NO: 45925 - DNA, 20 bp, Artificial Sequence
  Description of Artificial Sequence: Synthetic oligonucleotide
  Target: SCN9A; (+) strand; PAM type: NRG; PAM sequence: TGG
acttttttaaaaaaattagc

SEQ ID NO: 45926 - DNA, 20 bp, Artificial Sequence
  Description of Artificial Sequence: Synthetic oligonucleotide
  Target: SCN9A; (+) strand; PAM type: NRG; PAM sequence: GGG
cttttttaaaaaaattagct

SEQ ID NO: 45927 - DNA, 20 bp, Artificial Sequence
  Description of Artificial Sequence: Synthetic oligonucleotide
  Target: SCN9A; (+) strand; PAM type: NRG; PAM sequence: TGG
aaaaaattagctgggtgttg

SEQ ID NO: 45928 - DNA, 20 bp, Artificial Sequence
  Description of Artificial Sequence: Synthetic oligonucleotide
  Target: SCN9A; (+) strand; PAM type: NRG; PAM sequence: TGG
attagctgggtgttgtggca

SEQ ID NO: 45929 - DNA, 20 bp, Artificial Sequence
  Description of Artificial Sequence: Synthetic oligonucleotide
  Target: SCN9A; (+) strand; PAM type: NRG; PAM sequence: GGG
ttagctgggtgttgtggcat

SEQ ID NO: 45930 - DNA, 20 bp, Artificial Sequence
  Description of Artificial Sequence: Synthetic oligonucleotide
  Target: SCN9A; (+) strand; PAM type: NRG; PAM sequence: TAG
ggtgttgtggcatgggtgtg

SEQ ID NO: 45931 - DNA, 20 bp, Artificial Sequence
  Description of Artificial Sequence: Synthetic oligonucleotide
  Target: SCN9A; (+) strand; PAM type: NRG; PAM sequence: CAG
gtggcatgggtgtgtagtcc

SEQ ID NO: 45932 - DNA, 20 bp, Artificial Sequence
  Description of Artificial Sequence: Synthetic oligonucleotide
  Target: SCN9A; (+) strand; PAM type: NRG; PAM sequence: CAG
ggtgtgtagtcccagcaact

SEQ ID NO: 45933 - DNA, 20 bp, Artificial Sequence
  Description of Artificial Sequence: Synthetic oligonucleotide
  Target: SCN9A; (+) strand; PAM type: NRG; PAM sequence: AGG
gtgtgtagtcccagcaactc

SEQ ID NO: 45934 - DNA, 20 bp, Artificial Sequence
  Description of Artificial Sequence: Synthetic oligonucleotide
  Target: SCN9A; (+) strand; PAM type: NRG; PAM sequence: GAG
gtgtagtcccagcaactcag

SEQ ID NO: 45935 - DNA, 20 bp, Artificial Sequence
  Description of Artificial Sequence: Synthetic oligonucleotide
  Target: SCN9A; (+) strand; PAM type: NRG; PAM sequence: AGG
tgtagtcccagcaactcagg

SEQ ID NO: 45936 - DNA, 20 bp, Artificial Sequence
  Description of Artificial Sequence: Synthetic oligonucleotide
  Target: SCN9A; (+) strand; PAM type: NRG; PAM sequence: TGG
agtcccagcaactcaggagg

SEQ ID NO: 45937 - DNA, 20 bp, Artificial Sequence
  Description of Artificial Sequence: Synthetic oligonucleotide
  Target: SCN9A; (+) strand; PAM type: NRG; PAM sequence: GAG
tcccagcaactcaggaggtg

SEQ ID NO: 45938 - DNA, 20 bp, Artificial Sequence
  Description of Artificial Sequence: Synthetic oligonucleotide
  Target: SCN9A; (+) strand; PAM type: NRG; PAM sequence: AGG
cccagcaactcaggaggtgg

SEQ ID NO: 45939 - DNA, 20 bp, Artificial Sequence
  Description of Artificial Sequence: Synthetic oligonucleotide
  Target: SCN9A; (+) strand; PAM type: NRG; PAM sequence: CAG
agcaactcaggaggtggagg

SEQ ID NO: 45940 - DNA, 20 bp, Artificial Sequence
  Description of Artificial Sequence: Synthetic oligonucleotide
  Target: SCN9A; (+) strand; PAM type: NRG; PAM sequence: AGG
gcaactcaggaggtggaggc

SEQ ID NO: 45941 - DNA, 20 bp, Artificial Sequence
  Description of Artificial Sequence: Synthetic oligonucleotide
  Target: SCN9A; (+) strand; PAM type: NRG; PAM sequence: GAG
aactcaggaggtggaggcag

SEQ ID NO: 45942 - DNA, 20 bp, Artificial Sequence
  Description of Artificial Sequence: Synthetic oligonucleotide
  Target: SCN9A; (+) strand; PAM type: NRG; PAM sequence: AGG
actcaggaggtggaggcagg

SEQ ID NO: 45943 - DNA, 20 bp, Artificial Sequence
  Description of Artificial Sequence: Synthetic oligonucleotide
  Target: SCN9A; (+) strand; PAM type: NRG; PAM sequence: GAG
tggaggcaggaggatcactt

SEQ ID NO: 45944 - DNA, 20 bp, Artificial Sequence
  Description of Artificial Sequence: Synthetic oligonucleotide
  Target: SCN9A; (+) strand; PAM type: NRG; PAM sequence: CAG
gcaggaggatcacttgagcc

SEQ ID NO: 45945 - DNA, 20 bp, Artificial Sequence
  Description of Artificial Sequence: Synthetic oligonucleotide
  Target: SCN9A; (+) strand; PAM type: NRG; PAM sequence: AGG
caggaggatcacttgagccc

SEQ ID NO: 45946 - DNA, 20 bp, Artificial Sequence
  Description of Artificial Sequence: Synthetic oligonucleotide
  Target: SCN9A; (+) strand; PAM type: NRG; PAM sequence: GAG
ggaggatcacttgagcccag

SEQ ID NO: 45947 - DNA, 20 bp, Artificial Sequence
  Description of Artificial Sequence: Synthetic oligonucleotide
  Target: SCN9A; (+) strand; PAM type: NRG; PAM sequence: AAG
tcacttgagcccaggagttc

SEQ ID NO: 45948 - DNA, 20 bp, Artificial Sequence
  Description of Artificial Sequence: Synthetic oligonucleotide
  Target: SCN9A; (+) strand; PAM type: NRG; PAM sequence: AGG
cacttgagcccaggagttca

SEQ ID NO: 45949 - DNA, 20 bp, Artificial Sequence
  Description of Artificial Sequence: Synthetic oligonucleotide
  Target: SCN9A; (+) strand; PAM type: NRG; PAM sequence: CAG
agcccaggagttcaaggttg

SEQ ID NO: 45950 - DNA, 20 bp, Artificial Sequence
  Description of Artificial Sequence: Synthetic oligonucleotide
  Target: SCN9A; (+) strand; PAM type: NRG; PAM sequence: AAG
caggagttcaaggttgcagt

SEQ ID NO: 45951 - DNA, 20 bp, Artificial Sequence
  Description of Artificial Sequence: Synthetic oligonucleotide
  Target: SCN9A; (+) strand; PAM type: NRG; PAM sequence: TAG
aaggttgcagtaagctatga

SEQ ID NO: 45952 - DNA, 20 bp, Artificial Sequence
  Description of Artificial Sequence: Synthetic oligonucleotide
  Target: SCN9A; (+) strand; PAM type: NRG; PAM sequence: CAG
atgatagcaccactgtactc

SEQ ID NO: 45953 - DNA, 20 bp, Artificial Sequence
  Description of Artificial Sequence: Synthetic oligonucleotide
  Target: SCN9A; (+) strand; PAM type: NRG; PAM sequence: TGG
agcaccactgtactccagac

SEQ ID NO: 45954 - DNA, 20 bp, Artificial Sequence
  Description of Artificial Sequence: Synthetic oligonucleotide
  Target: SCN9A; (+) strand; PAM type: NRG; PAM sequence: GGG
gcaccactgtactccagact

SEQ ID NO: 45955 - DNA, 20 bp, Artificial Sequence
  Description of Artificial Sequence: Synthetic oligonucleotide
  Target: SCN9A; (+) strand; PAM type: NRG; PAM sequence: CAG
ctgtactccagactgggcaa

SEQ ID NO: 45956 - DNA, 20 bp, Artificial Sequence
  Description of Artificial Sequence: Synthetic oligonucleotide
  Target: SCN9A; (+) strand; PAM type: NRG; PAM sequence: GAG
gtactccagactgggcaaca

SEQ ID NO: 45957 - DNA, 20 bp, Artificial Sequence
  Description of Artificial Sequence: Synthetic oligonucleotide
  Target: SCN9A; (+) strand; PAM type: NRG; PAM sequence: GAG
tccagactgggcaacagagt

SEQ ID NO: 45958 - DNA, 20 bp, Artificial Sequence
  Description of Artificial Sequence: Synthetic oligonucleotide
  Target: SCN9A; (+) strand; PAM type: NRG; PAM sequence: AAG
tgtctccgttttttaaaaaa

SEQ ID NO: 45959 - DNA, 20 bp, Artificial Sequence
  Description of Artificial Sequence: Synthetic oligonucleotide
  Target: SCN9A; (+) strand; PAM type: NRG; PAM sequence: AAG
ctccgttttttaaaaaaaag

SEQ ID NO: 45960 - DNA, 20 bp, Artificial Sequence
  Description of Artificial Sequence: Synthetic oligonucleotide
  Target: SCN9A; (+) strand; PAM type: NRG; PAM sequence: GAG
ccgttttttaaaaaaaagaa

SEQ ID NO: 45961 - DNA, 20 bp, Artificial Sequence
  Description of Artificial Sequence: Synthetic oligonucleotide
  Target: SCN9A; (+) strand; PAM type: NRG; PAM sequence: GAG
gttttttaaaaaaaagaaga

SEQ ID NO: 45962 - DNA, 20 bp, Artificial Sequence
  Description of Artificial Sequence: Synthetic oligonucleotide
  Target: SCN9A; (+) strand; PAM type: NRG; PAM sequence: GAG
tttttaaaaaaaagaagaga

SEQ ID NO: 45963 - DNA, 20 bp, Artificial Sequence
  Description of Artificial Sequence: Synthetic oligonucleotide
  Target: SCN9A; (+) strand; PAM type: NRG; PAM sequence: GAG
tttaaaaaaaagaagagaga

SEQ ID NO: 45964 - DNA, 20 bp, Artificial Sequence
  Description of Artificial Sequence: Synthetic oligonucleotide
  Target: SCN9A; (+) strand; PAM type: NRG; PAM sequence: GAG
taaaaaaaagaagagagaga

SEQ ID NO: 45965 - DNA, 20 bp, Artificial Sequence
  Description of Artificial Sequence: Synthetic oligonucleotide
  Target: SCN9A; (+) strand; PAM type: NRG; PAM sequence: GAG
aaaaaaagaagagagagaga

SEQ ID NO: 45966 - DNA, 20 bp, Artificial Sequence
  Description of Artificial Sequence: Synthetic oligonucleotide
  Target: SCN9A; (+) strand; PAM type: NRG; PAM sequence: GAG
aaaaagaagagagagagaga

SEQ ID NO: 45967 - DNA, 20 bp, Artificial Sequence
  Description of Artificial Sequence: Synthetic oligonucleotide
  Target: SCN9A; (+) strand; PAM type: NRG; PAM sequence: GAG
aaagaagagagagagagaga

SEQ ID NO: 45968 - DNA, 20 bp, Artificial Sequence
  Description of Artificial Sequence: Synthetic oligonucleotide
  Target: SCN9A; (+) strand; PAM type: NRG; PAM sequence: CGG
agagagagagcgatactttg

SEQ ID NO: 45969 - DNA, 20 bp, Artificial Sequence
  Description of Artificial Sequence: Synthetic oligonucleotide
  Target: SCN9A; (+) strand; PAM type: NRG; PAM sequence: TGG
gagcgatactttgcggatca

SEQ ID NO: 45970 - DNA, 20 bp, Artificial Sequence
  Description of Artificial Sequence: Synthetic oligonucleotide
  Target: SCN9A; (+) strand; PAM type: NRG; PAM sequence: GAG
gcggatcatggatacatcat

SEQ ID NO: 45971 - DNA, 20 bp, Artificial Sequence
  Description of Artificial Sequence: Synthetic oligonucleotide
  Target: SCN9A; (+) strand; PAM type: NRG; PAM sequence: GAG
ggatcatggatacatcatga

SEQ ID NO: 45972 - DNA, 20 bp, Artificial Sequence
  Description of Artificial Sequence: Synthetic oligonucleotide
  Target: SCN9A; (+) strand; PAM type: NRG; PAM sequence: TAG
catcatgagagtgaaatgat

SEQ ID NO: 45973 - DNA, 20 bp, Artificial Sequence
  Description of Artificial Sequence: Synthetic oligonucleotide
  Target: SCN9A; (+) strand; PAM type: NRG; PAM sequence: AGG
atcatgagagtgaaatgatt

SEQ ID NO: 45974 - DNA, 20 bp, Artificial Sequence
  Description of Artificial Sequence: Synthetic oligonucleotide
  Target: SCN9A; (+) strand; PAM type: NRG; PAM sequence: GAG
gattaggactgaatctgcat

SEQ ID NO: 45975 - DNA, 20 bp, Artificial Sequence
  Description of Artificial Sequence: Synthetic oligonucleotide
  Target: SCN9A; (+) strand; PAM type: NRG; PAM sequence: AAG
atgagcgaaaataatcaaat

SEQ ID NO: 45976 - DNA, 20 bp, Artificial Sequence
  Description of Artificial Sequence: Synthetic oligonucleotide
  Target: SCN9A; (+) strand; PAM type: NRG; PAM sequence: TAG
aaataatcaaataagtaaac

SEQ ID NO: 45977 - DNA, 20 bp, Artificial Sequence
  Description of Artificial Sequence: Synthetic oligonucleotide
  Target: SCN9A; (+) strand; PAM type: NRG; PAM sequence: GAG
ataatcaaataagtaaacta

SEQ ID NO: 45978 - DNA, 20 bp, Artificial Sequence
  Description of Artificial Sequence: Synthetic oligonucleotide
  Target: SCN9A; (+) strand; PAM type: NRG; PAM sequence: TGG
aaactagagtaaatgcaaaa

SEQ ID NO: 45979 - DNA, 20 bp, Artificial Sequence
  Description of Artificial Sequence: Synthetic oligonucleotide
  Target: SCN9A; (+) strand; PAM type: NRG; PAM sequence: AAG
ctagagtaaatgcaaaatgg

SEQ ID NO: 45980 - DNA, 20 bp, Artificial Sequence
  Description of Artificial Sequence: Synthetic oligonucleotide
  Target: SCN9A; (+) strand; PAM type: NRG; PAM sequence: CAG
gagtaaatgcaaaatggaag

SEQ ID NO: 45981 - DNA, 20 bp, Artificial Sequence
  Description of Artificial Sequence: Synthetic oligonucleotide
  Target: SCN9A; (+) strand; PAM type: NRG; PAM sequence: GAG
gtaaatgcaaaatggaagca

SEQ ID NO: 45982 - DNA, 20 bp, Artificial Sequence
  Description of Artificial Sequence: Synthetic oligonucleotide
  Target: SCN9A; (+) strand; PAM type: NRG; PAM sequence: AGG
taaatgcaaaatggaagcag

SEQ ID NO: 45983 - DNA, 20 bp, Artificial Sequence
  Description of Artificial Sequence: Synthetic oligonucleotide
  Target: SCN9A; (+) strand; PAM type: NRG; PAM sequence: CAG
caaaatggaagcagaggcat

SEQ ID NO: 45984 - DNA, 20 bp, Artificial Sequence
  Description of Artificial Sequence: Synthetic oligonucleotide
  Target: SCN9A; (+) strand; PAM type: NRG; PAM sequence: GAG
tggaagcagaggcatcagtt

SEQ ID NO: 45985 - DNA, 20 bp, Artificial Sequence
  Description of Artificial Sequence: Synthetic oligonucleotide
  Target: SCN9A; (+) strand; PAM type: NRG; PAM sequence: TGG
agttgagactctgcttgaaa

SEQ ID NO: 45986 - DNA, 20 bp, Artificial Sequence
  Description of Artificial Sequence: Synthetic oligonucleotide
  Target: SCN9A; (+) strand; PAM type: NRG; PAM sequence: TAG
agactctgcttgaaatggtt

SEQ ID NO: 45987 - DNA, 20 bp, Artificial Sequence
  Description of Artificial Sequence: Synthetic oligonucleotide
  Target: SCN9A; (+) strand; PAM type: NRG; PAM sequence: AGG
gactctgcttgaaatggttt

SEQ ID NO: 45988 - DNA, 20 bp, Artificial Sequence
  Description of Artificial Sequence: Synthetic oligonucleotide
  Target: SCN9A; (+) strand; PAM type: NRG; PAM sequence: AAG
cttgaaatggtttaggcaaa

SEQ ID NO: 45989 - DNA, 20 bp, Artificial Sequence
  Description of Artificial Sequence: Synthetic oligonucleotide
  Target: SCN9A; (+) strand; PAM type: NRG; PAM sequence: TAG
gaaatggtttaggcaaaaag

SEQ ID NO: 45990 - DNA, 20 bp, Artificial Sequence
  Description of Artificial Sequence: Synthetic oligonucleotide
  Target: SCN9A; (+) strand; PAM type: NRG; PAM sequence: GAG
tggtttaggcaaaaagtagt

SEQ ID NO: 45991 - DNA, 20 bp, Artificial Sequence
  Description of Artificial Sequence: Synthetic oligonucleotide
  Target: SCN9A; (+) strand; PAM type: NRG; PAM sequence: AAG
ggcaaaaagtagtgagtaca

SEQ ID NO: 45992 - DNA, 20 bp, Artificial Sequence
  Description of Artificial Sequence: Synthetic oligonucleotide
  Target: SCN9A; (+) strand; PAM type: NRG; PAM sequence: AGG
gcaaaaagtagtgagtacaa

SEQ ID NO: 45993 - DNA, 20 bp, Artificial Sequence
  Description of Artificial Sequence: Synthetic oligonucleotide
  Target: SCN9A; (+) strand; PAM type: NRG; PAM sequence: AAG
aaagtagtgagtacaaagga

SEQ ID NO: 45994 - DNA, 20 bp, Artificial Sequence
  Description of Artificial Sequence: Synthetic oligonucleotide
  Target: SCN9A; (+) strand; PAM type: NRG; PAM sequence: AGG
aagtagtgagtacaaaggaa

SEQ ID NO: 45995 - DNA, 20 bp, Artificial Sequence
  Description of Artificial Sequence: Synthetic oligonucleotide
  Target: SCN9A; (+) strand; PAM type: NRG; PAM sequence: AAG
tacaaaggaaaggtgatgaa

SEQ ID NO: 45996 - DNA, 20 bp, Artificial Sequence
  Description of Artificial Sequence: Synthetic oligonucleotide
  Target: SCN9A; (+) strand; PAM type: NRG; PAM sequence: AGG
acaaaggaaaggtgatgaaa

SEQ ID NO: 45997 - DNA, 20 bp, Artificial Sequence
  Description of Artificial Sequence: Synthetic oligonucleotide
  Target: SCN9A; (+) strand; PAM type: NRG; PAM sequence: GAG
aaaggaaaggtgatgaaaag

SEQ ID NO: 45998 - DNA, 20 bp, Artificial Sequence
  Description of Artificial Sequence: Synthetic oligonucleotide
  Target: SCN9A; (+) strand; PAM type: NRG; PAM sequence: GAG
aggaaaggtgatgaaaagga

SEQ ID NO: 45999 - DNA, 20 bp, Artificial Sequence
  Description of Artificial Sequence: Synthetic oligonucleotide
  Target: SCN9A; (+) strand; PAM type: NRG; PAM sequence: AGG
ggaaaggtgatgaaaaggag

SEQ ID NO: 46000 - DNA, 20 bp, Artificial Sequence
  Description of Artificial Sequence: Synthetic oligonucleotide
  Target: SCN9A; (+) strand; PAM type: NRG; PAM sequence: TGG
aaggtgatgaaaaggagagg

SEQ ID NO: 46001 - DNA, 20 bp, Artificial Sequence
  Description of Artificial Sequence: Synthetic oligonucleotide
  Target: SCN9A; (+) strand; PAM type: NRG; PAM sequence: CAG
aaaggagaggtggattcaaa

SEQ ID NO: 46002 - DNA, 20 bp, Artificial Sequence
  Description of Artificial Sequence: Synthetic oligonucleotide
  Target: SCN9A; (+) strand; PAM type: NRG; PAM sequence: AGG
aaggagaggtggattcaaac

SEQ ID NO: 46003 - DNA, 20 bp, Artificial Sequence
  Description of Artificial Sequence: Synthetic oligonucleotide
  Target: SCN9A; (+) strand; PAM type: NRG; PAM sequence: TGG
gtggattcaaacaggcactg

SEQ ID NO: 46004 - DNA, 20 bp, Artificial Sequence
  Description of Artificial Sequence: Synthetic oligonucleotide
  Target: SCN9A; (+) strand; PAM type: NRG; PAM sequence: GAG
ggattcaaacaggcactgtg

SEQ ID NO: 46005 - DNA, 20 bp, Artificial Sequence
  Description of Artificial Sequence: Synthetic oligonucleotide
  Target: SCN9A; (+) strand; PAM type: NRG; PAM sequence: AGG
gattcaaacaggcactgtgg

SEQ ID NO: 46006 - DNA, 20 bp, Artificial Sequence
  Description of Artificial Sequence: Synthetic oligonucleotide
  Target: SCN9A; (+) strand; PAM type: NRG; PAM sequence: GGG
attcaaacaggcactgtgga

SEQ ID NO: 46007 - DNA, 20 bp, Artificial Sequence
  Description of Artificial Sequence: Synthetic oligonucleotide
  Target: SCN9A; (+) strand; PAM type: NRG; PAM sequence: GAG
tcaaacaggcactgtggagg

SEQ ID NO: 46008 - DNA, 20 bp, Artificial Sequence
  Description of Artificial Sequence: Synthetic oligonucleotide
  Target: SCN9A; (+) strand; PAM type: NRG; PAM sequence: CAG
ctgtgtaacttttcaactga

SEQ ID NO: 46009 - DNA, 20 bp, Artificial Sequence
  Description of Artificial Sequence: Synthetic oligonucleotide
  Target: SCN9A; (+) strand; PAM type: NRG; PAM sequence: AGG
tgtgtaacttttcaactgac

SEQ ID NO: 46010 - DNA, 20 bp, Artificial Sequence
  Description of Artificial Sequence: Synthetic oligonucleotide
  Target: SCN9A; (+) strand; PAM type: NRG; PAM sequence: TGG
ttttcaactgacaggaaaca

SEQ ID NO: 46011 - DNA, 20 bp, Artificial Sequence
  Description of Artificial Sequence: Synthetic oligonucleotide
  Target: SCN9A; (+) strand; PAM type: NRG; PAM sequence: GGG
tttcaactgacaggaaacat

SEQ ID NO: 46012 - DNA, 20 bp, Artificial Sequence
  Description of Artificial Sequence: Synthetic oligonucleotide
  Target: SCN9A; (+) strand; PAM type: NRG; PAM sequence: AAG
ctgacaggaaacatgggatg

SEQ ID NO: 46013 - DNA, 20 bp, Artificial Sequence
  Description of Artificial Sequence: Synthetic oligonucleotide
  Target: SCN9A; (+) strand; PAM type: NRG; PAM sequence: TGG
aggaaacatgggatgaagca

SEQ ID NO: 46014 - DNA, 20 bp, Artificial Sequence
  Description of Artificial Sequence: Synthetic oligonucleotide
  Target: SCN9A; (+) strand; PAM type: NRG; PAM sequence: GGG
ggaaacatgggatgaagcat

SEQ ID NO: 46015 - DNA, 20 bp, Artificial Sequence
  Description of Artificial Sequence: Synthetic oligonucleotide
  Target: SCN9A; (+) strand; PAM type: NRG; PAM sequence: AAG
aacatgggatgaagcatggg

SEQ ID NO: 46016 - DNA, 20 bp, Artificial Sequence
  Description of Artificial Sequence: Synthetic oligonucleotide
  Target: SCN9A; (+) strand; PAM type: NRG; PAM sequence: AGG
acatgggatgaagcatggga

SEQ ID NO: 46017 - DNA, 20 bp, Artificial Sequence
  Description of Artificial Sequence: Synthetic oligonucleotide
  Target: SCN9A; (+) strand; PAM type: NRG; PAM sequence: AAG
atgaagcatgggaaggctca

SEQ ID NO: 46018 - DNA, 20 bp, Artificial Sequence
  Description of Artificial Sequence: Synthetic oligonucleotide
  Target: SCN9A; (+) strand; PAM type: NRG; PAM sequence: GAG
gaaggctcaaagataccttt

SEQ ID NO: 46019 - DNA, 20 bp, Artificial Sequence
  Description of Artificial Sequence: Synthetic oligonucleotide
  Target: SCN9A; (+) strand; PAM type: NRG; PAM sequence: CAG
tacctttgagctttctcata

SEQ ID NO: 46020 - DNA, 20 bp, Artificial Sequence
  Description of Artificial Sequence: Synthetic oligonucleotide
  Target: SCN9A; (+) strand; PAM type: NRG; PAM sequence: AAG
ttgagctttctcatacagct

SEQ ID NO: 46021 - DNA, 20 bp, Artificial Sequence
  Description of Artificial Sequence: Synthetic oligonucleotide
  Target: SCN9A; (+) strand; PAM type: NRG; PAM sequence: AAG
gctttctcatacagctaagt

SEQ ID NO: 46022 - DNA, 20 bp, Artificial Sequence
  Description of Artificial Sequence: Synthetic oligonucleotide
  Target: SCN9A; (+) strand; PAM type: NRG; PAM sequence: AAG
gtaagattaaatcaattatt

SEQ ID NO: 46023 - DNA, 20 bp, Artificial Sequence
  Description of Artificial Sequence: Synthetic oligonucleotide
  Target: SCN9A; (+) strand; PAM type: NRG; PAM sequence: TAG
ttaaatcaattattaagaac

SEQ ID NO: 46024 - DNA, 20 bp, Artificial Sequence
  Description of Artificial Sequence: Synthetic oligonucleotide
  Target: SCN9A; (+) strand; PAM type: NRG; PAM sequence: AAG
atcaattattaagaactagt

SEQ ID NO: 46025 - DNA, 20 bp, Artificial Sequence
  Description of Artificial Sequence: Synthetic oligonucleotide
  Target: SCN9A; (+) strand; PAM type: NRG; PAM sequence: CAG
aactagtaagaaaactttac

SEQ ID NO: 46026 - DNA, 20 bp, Artificial Sequence
  Description of Artificial Sequence: Synthetic oligonucleotide
  Target: SCN9A; (+) strand; PAM type: NRG; PAM sequence: CAG
aactttaccagatgaatctt

SEQ ID NO: 46027 - DNA, 20 bp, Artificial Sequence
  Description of Artificial Sequence: Synthetic oligonucleotide
  Target: SCN9A; (+) strand; PAM type: NRG; PAM sequence: AGG
actttaccagatgaatcttc

SEQ ID NO: 46028 - DNA, 20 bp, Artificial Sequence
  Description of Artificial Sequence: Synthetic oligonucleotide
  Target: SCN9A; (+) strand; PAM type: NRG; PAM sequence: AAG
ttaccagatgaatcttcagg

SEQ ID NO: 46029 - DNA, 20 bp, Artificial Sequence
  Description of Artificial Sequence: Synthetic oligonucleotide
  Target: SCN9A; (+) strand; PAM type: NRG; PAM sequence: AAG
cttcaggaagctgttgtgta

SEQ ID NO: 46030 - DNA, 20 bp, Artificial Sequence
  Description of Artificial Sequence: Synthetic oligonucleotide
  Target: SCN9A; (+) strand; PAM type: NRG; PAM sequence: AAG
ccatcactacatgcaatgtt

SEQ ID NO: 46031 - DNA, 20 bp, Artificial Sequence
  Description of Artificial Sequence: Synthetic oligonucleotide
  Target: SCN9A; (+) strand; PAM type: NRG; PAM sequence: AAG
tcactacatgcaatgttaag

SEQ ID NO: 46032 - DNA, 20 bp, Artificial Sequence
  Description of Artificial Sequence: Synthetic oligonucleotide
  Target: SCN9A; (+) strand; PAM type: NRG; PAM sequence: TAG
ttaagaagaacttatgacaa

SEQ ID NO: 46033 - DNA, 20 bp, Artificial Sequence
  Description of Artificial Sequence: Synthetic oligonucleotide
  Target: SCN9A; (+) strand; PAM type: NRG; PAM sequence: AAG
aattgttaatatgaaacaca

SEQ ID NO: 46034 - DNA, 20 bp, Artificial Sequence
  Description of Artificial Sequence: Synthetic oligonucleotide
  Target: SCN9A; (+) strand; PAM type: NRG; PAM sequence: AAG
tatgaaacacaaagtatatg

SEQ ID NO: 46035 - DNA, 20 bp, Artificial Sequence
  Description of Artificial Sequence: Synthetic oligonucleotide
  Target: SCN9A; (+) strand; PAM type: NRG; PAM sequence: AAG
tcactatccgaatcactgct

SEQ ID NO: 46036 - DNA, 20 bp, Artificial Sequence
  Description of Artificial Sequence: Synthetic oligonucleotide
  Target: SCN9A; (+) strand; PAM type: NRG; PAM sequence: CAG
cgaatcactgctaagttcct

SEQ ID NO: 46037 - DNA, 20 bp, Artificial Sequence
  Description of Artificial Sequence: Synthetic oligonucleotide
  Target: SCN9A; (+) strand; PAM type: NRG; PAM sequence: CGG
agcattcatattttccaaat

SEQ ID NO: 46038 - DNA, 20 bp, Artificial Sequence
  Description of Artificial Sequence: Synthetic oligonucleotide
  Target: SCN9A; (+) strand; PAM type: NRG; PAM sequence: CAG
attttccaaatcggattccc

SEQ ID NO: 46039 - DNA, 20 bp, Artificial Sequence
  Description of Artificial Sequence: Synthetic oligonucleotide
  Target: SCN9A; (+) strand; PAM type: NRG; PAM sequence: AGG
ttttccaaatcggattcccc

SEQ ID NO: 46040 - DNA, 20 bp, Artificial Sequence
  Description of Artificial Sequence: Synthetic oligonucleotide
  Target: SCN9A; (+) strand; PAM type: NRG; PAM sequence: TGG
tcggattccccaggtgcaat

SEQ ID NO: 46041 - DNA, 20 bp, Artificial Sequence
  Description of Artificial Sequence: Synthetic oligonucleotide
  Target: SCN9A; (+) strand; PAM type: NRG; PAM sequence: GAG
gcaattggcactgtcactgt

SEQ ID NO: 46042 - DNA, 20 bp, Artificial Sequence
  Description of Artificial Sequence: Synthetic oligonucleotide
  Target: SCN9A; (+) strand; PAM type: NRG; PAM sequence: AGG
caattggcactgtcactgtg

SEQ ID NO: 46043 - DNA, 20 bp, Artificial Sequence
  Description of Artificial Sequence: Synthetic oligonucleotide
  Target: SCN9A; (+) strand; PAM type: NRG; PAM sequence: TGG
tggcactgtcactgtgaggc

SEQ ID NO: 46044 - DNA, 20 bp, Artificial Sequence
  Description of Artificial Sequence: Synthetic oligonucleotide
  Target: SCN9A; (+) strand; PAM type: NRG; PAM sequence: GGG
ggcactgtcactgtgaggct

SEQ ID NO: 46045 - DNA, 20 bp, Artificial Sequence
  Description of Artificial Sequence: Synthetic oligonucleotide
  Target: SCN9A; (+) strand; PAM type: NRG; PAM sequence: AAG
gaccatcactgtcttccatc

SEQ ID NO: 46046 - DNA, 20 bp, Artificial Sequence
  Description of Artificial Sequence: Synthetic oligonucleotide
  Target: SCN9A; (+) strand; PAM type: NRG; PAM sequence: GAG
ctgattttatctttttcctt

SEQ ID NO: 46047 - DNA, 20 bp, Artificial Sequence
  Description of Artificial Sequence: Synthetic oligonucleotide
  Target: SCN9A; (+) strand; PAM type: NRG; PAM sequence: AGG
tgattttatctttttccttg

SEQ ID NO: 46048 - DNA, 20 bp, Artificial Sequence
  Description of Artificial Sequence: Synthetic oligonucleotide
  Target: SCN9A; (+) strand; PAM type: NRG; PAM sequence: CAG
attgtgacctttgctcattt

SEQ ID NO: 46049 - DNA, 20 bp, Artificial Sequence
  Description of Artificial Sequence: Synthetic oligonucleotide
  Target: SCN9A; (+) strand; PAM type: NRG; PAM sequence: AAG
tgacctttgctcatttcagc

SEQ ID NO: 46050 - DNA, 20 bp, Artificial Sequence
  Description of Artificial Sequence: Synthetic oligonucleotide
  Target: SCN9A; (+) strand; PAM type: NRG; PAM sequence: TGG
tgctcatttcagcaagtgta

SEQ ID NO: 46051 - DNA, 20 bp, Artificial Sequence
  Description of Artificial Sequence: Synthetic oligonucleotide
  Target: SCN9A; (+) strand; PAM type: NRG; PAM sequence: TAG
catttcagcaagtgtatggt

SEQ ID NO: 46052 - DNA, 20 bp, Artificial Sequence
  Description of Artificial Sequence: Synthetic oligonucleotide
  Target: SCN9A; (+) strand; PAM type: NRG; PAM sequence: TAG
caagtgtatggttagaaata

SEQ ID NO: 46053 - DNA, 20 bp, Artificial Sequence
  Description of Artificial Sequence: Synthetic oligonucleotide
  Target: SCN9A; (+) strand; PAM type: NRG; PAM sequence: TAG
agaaatatagttttccttct

SEQ ID NO: 46054 - DNA, 20 bp, Artificial Sequence
  Description of Artificial Sequence: Synthetic oligonucleotide
  Target: SCN9A; (+) strand; PAM type: NRG; PAM sequence: CAG
tagttttccttcttagtatt

SEQ ID NO: 46055 - DNA, 20 bp, Artificial Sequence
  Description of Artificial Sequence: Synthetic oligonucleotide
  Target: SCN9A; (+) strand; PAM type: NRG; PAM sequence: TGG
ttctgcttgtcttatctccc

SEQ ID NO: 46056 - DNA, 20 bp, Artificial Sequence
  Description of Artificial Sequence: Synthetic oligonucleotide
  Target: SCN9A; (+) strand; PAM type: NRG; PAM sequence: TGG
cttatctccctggaaatctt

SEQ ID NO: 46057 - DNA, 20 bp, Artificial Sequence
  Description of Artificial Sequence: Synthetic oligonucleotide
  Target: SCN9A; (+) strand; PAM type: NRG; PAM sequence: TGG
cctggaaatctttggctttt

SEQ ID NO: 46058 - DNA, 20 bp, Artificial Sequence
  Description of Artificial Sequence: Synthetic oligonucleotide
  Target: SCN9A; (+) strand; PAM type: NRG; PAM sequence: TAG
ggctttttggaaaatgcttt

SEQ ID NO: 46059 - DNA, 20 bp, Artificial Sequence
  Description of Artificial Sequence: Synthetic oligonucleotide
  Target: SCN9A; (+) strand; PAM type: NRG; PAM sequence: AAG
cttttagaataaattcacgt

SEQ ID NO: 46060 - DNA, 20 bp, Artificial Sequence
  Description of Artificial Sequence: Synthetic oligonucleotide
  Target: SCN9A; (+) strand; PAM type: NRG; PAM sequence: AGG
ttttagaataaattcacgta

SEQ ID NO: 46061 - DNA, 20 bp, Artificial Sequence
  Description of Artificial Sequence: Synthetic oligonucleotide
  Target: SCN9A; (+) strand; PAM type: NRG; PAM sequence: TAG
atttattccctttttaattc

SEQ ID NO: 46062 - DNA, 20 bp, Artificial Sequence
  Description of Artificial Sequence: Synthetic oligonucleotide
  Target: SCN9A; (+) strand; PAM type: NRG; PAM sequence: TGG
taattctagtcactgcaatc

SEQ ID NO: 46063 - DNA, 20 bp, Artificial Sequence
  Description of Artificial Sequence: Synthetic oligonucleotide
  Target: SCN9A; (+) strand; PAM type: NRG; PAM sequence: GAG
attctagtcactgcaatctg

SEQ ID NO: 46064 - DNA, 20 bp, Artificial Sequence
  Description of Artificial Sequence: Synthetic oligonucleotide
  Target: SCN9A; (+) strand; PAM type: NRG; PAM sequence: AGG
ttctagtcactgcaatctgg

SEQ ID NO: 46065 - DNA, 20 bp, Artificial Sequence
  Description of Artificial Sequence: Synthetic oligonucleotide
  Target: SCN9A; (+) strand; PAM type: NRG; PAM sequence: CAG
aatctggaggttgtttgcat

SEQ ID NO: 46066 - DNA, 20 bp, Artificial Sequence
  Description of Artificial Sequence: Synthetic oligonucleotide
  Target: SCN9A; (+) strand; PAM type: NRG; PAM sequence: AGG
atctggaggttgtttgcatc

SEQ ID NO: 46067 - DNA, 20 bp, Artificial Sequence
  Description of Artificial Sequence: Synthetic oligonucleotide
  Target: SCN9A; (+) strand; PAM type: NRG; PAM sequence: GGG
tctggaggttgtttgcatca

SEQ ID NO: 46068 - DNA, 20 bp, Artificial Sequence
  Description of Artificial Sequence: Synthetic oligonucleotide
  Target: SCN9A; (+) strand; PAM type: NRG; PAM sequence: AAG
gggtcttcttcaattgctgt

SEQ ID NO: 46069 - DNA, 20 bp, Artificial Sequence
  Description of Artificial Sequence: Synthetic oligonucleotide
  Target: SCN9A; (+) strand; PAM type: NRG; PAM sequence: GAG
taagattgtctgaactaaat

SEQ ID NO: 46070 - DNA, 20 bp, Artificial Sequence
  Description of Artificial Sequence: Synthetic oligonucleotide
  Target: SCN9A; (+) strand; PAM type: NRG; PAM sequence: AAG
aactaaatgagctcaataat

SEQ ID NO: 46071 - DNA, 20 bp, Artificial Sequence
  Description of Artificial Sequence: Synthetic oligonucleotide
  Target: SCN9A; (+) strand; PAM type: NRG; PAM sequence: AGG
actaaatgagctcaataata

SEQ ID NO: 46072 - DNA, 20 bp, Artificial Sequence
  Description of Artificial Sequence: Synthetic oligonucleotide
  Target: SCN9A; (+) strand; PAM type: NRG; PAM sequence: CAG
aatgagctcaataataaggc

SEQ ID NO: 46073 - DNA, 20 bp, Artificial Sequence
  Description of Artificial Sequence: Synthetic oligonucleotide
  Target: SCN9A; (+) strand; PAM type: NRG; PAM sequence: TAG
ctcaataataaggccagaaa

SEQ ID NO: 46074 - DNA, 20 bp, Artificial Sequence
  Description of Artificial Sequence: Synthetic oligonucleotide
  Target: SCN9A; (+) strand; PAM type: NRG; PAM sequence: AGG
tcaataataaggccagaaat

SEQ ID NO: 46075 - DNA, 20 bp, Artificial Sequence
  Description of Artificial Sequence: Synthetic oligonucleotide
  Target: SCN9A; (+) strand; PAM type: NRG; PAM sequence: TAG
aataaggccagaaataggtt

SEQ ID NO: 46076 - DNA, 20 bp, Artificial Sequence
  Description of Artificial Sequence: Synthetic oligonucleotide
  Target: SCN9A; (+) strand; PAM type: NRG; PAM sequence: AGG
ataaggccagaaataggttt

SEQ ID NO: 46077 - DNA, 20 bp, Artificial Sequence
  Description of Artificial Sequence: Synthetic oligonucleotide
  Target: SCN9A; (+) strand; PAM type: NRG; PAM sequence: CAG
aataggtttaggacctatat

SEQ ID NO: 46078 - DNA, 20 bp, Artificial Sequence
  Description of Artificial Sequence: Synthetic oligonucleotide
  Target: SCN9A; (+) strand; PAM type: NRG; PAM sequence: AGG
ataggtttaggacctatatc

SEQ ID NO: 46079 - DNA, 20 bp, Artificial Sequence
  Description of Artificial Sequence: Synthetic oligonucleotide
  Target: SCN9A; (+) strand; PAM type: NRG; PAM sequence: GGG
taggtttaggacctatatca

SEQ ID NO: 46080 - DNA, 20 bp, Artificial Sequence
  Description of Artificial Sequence: Synthetic oligonucleotide
  Target: SCN9A; (+) strand; PAM type: NRG; PAM sequence: TGG
gtttaggacctatatcaggg

SEQ ID NO: 46081 - DNA, 20 bp, Artificial Sequence
  Description of Artificial Sequence: Synthetic oligonucleotide
  Target: SCN9A; (+) strand; PAM type: NRG; PAM sequence: GGG
tttaggacctatatcagggt

SEQ ID NO: 46082 - DNA, 20 bp, Artificial Sequence
  Description of Artificial Sequence: Synthetic oligonucleotide
  Target: SCN9A; (+) strand; PAM type: NRG; PAM sequence: GGG
ttaggacctatatcagggtg

SEQ ID NO: 46083 - DNA, 20 bp, Artificial Sequence
  Description of Artificial Sequence: Synthetic oligonucleotide
  Target: SCN9A; (+) strand; PAM type: NRG; PAM sequence: GAG
aggacctatatcagggtggg

SEQ ID NO: 46084 - DNA, 20 bp, Artificial Sequence
  Description of Artificial Sequence: Synthetic oligonucleotide
  Target: SCN9A; (+) strand; PAM type: NRG; PAM sequence: GAG
gacctatatcagggtgggga

SEQ ID NO: 46085 - DNA, 20 bp, Artificial Sequence
  Description of Artificial Sequence: Synthetic oligonucleotide
  Target: SCN9A; (+) strand; PAM type: NRG; PAM sequence: AGG
acctatatcagggtggggag

SEQ ID NO: 46086 - DNA, 20 bp, Artificial Sequence
  Description of Artificial Sequence: Synthetic oligonucleotide
  Target: SCN9A; (+) strand; PAM type: NRG; PAM sequence: GGG
cctatatcagggtggggaga

SEQ ID NO: 46087 - DNA, 20 bp, Artificial Sequence
  Description of Artificial Sequence: Synthetic oligonucleotide
  Target: SCN9A; (+) strand; PAM type: NRG; PAM sequence: GGG
ctatatcagggtggggagag

SEQ ID NO: 46088 - DNA, 20 bp, Artificial Sequence
  Description of Artificial Sequence: Synthetic oligonucleotide
  Target: SCN9A; (+) strand; PAM type: NRG; PAM sequence: GGG
tatatcagggtggggagagg

SEQ ID NO: 46089 - DNA, 20 bp, Artificial Sequence
  Description of Artificial Sequence: Synthetic oligonucleotide
  Target: SCN9A; (+) strand; PAM type: NRG; PAM sequence: TAG
atcagggtggggagaggggg

SEQ ID NO: 46090 - DNA, 20 bp, Artificial Sequence
  Description of Artificial Sequence: Synthetic oligonucleotide
  Target: SCN9A; (+) strand; PAM type: NRG; PAM sequence: GAG
cagggtggggagagggggta

SEQ ID NO: 46091 - DNA, 20 bp, Artificial Sequence
  Description of Artificial Sequence: Synthetic oligonucleotide
  Target: SCN9A; (+) strand; PAM type: NRG; PAM sequence: TAG
ggggagagggggtagagaaa

SEQ ID NO: 46092 - DNA, 20 bp, Artificial Sequence
  Description of Artificial Sequence: Synthetic oligonucleotide
  Target: SCN9A; (+) strand; PAM type: NRG; PAM sequence: AGG
gggagagggggtagagaaat

SEQ ID NO: 46093 - DNA, 20 bp, Artificial Sequence
  Description of Artificial Sequence: Synthetic oligonucleotide
  Target: SCN9A; (+) strand; PAM type: NRG; PAM sequence: GGG
ggagagggggtagagaaata

SEQ ID NO: 46094 - DNA, 20 bp, Artificial Sequence
  Description of Artificial Sequence: Synthetic oligonucleotide
  Target: SCN9A; (+) strand; PAM type: NRG; PAM sequence: GAG
agagggggtagagaaatagg

SEQ ID NO: 46095 - DNA, 20 bp, Artificial Sequence
  Description of Artificial Sequence: Synthetic oligonucleotide
  Target: SCN9A; (+) strand; PAM type: NRG; PAM sequence: CAG
ggggtagagaaatagggaga

SEQ ID NO: 46096 - DNA, 20 bp, Artificial Sequence
  Description of Artificial Sequence: Synthetic oligonucleotide
  Target: SCN9A; (+) strand; PAM type: NRG; PAM sequence: AGG
gggtagagaaatagggagac

SEQ ID NO: 46097 - DNA, 20 bp, Artificial Sequence
  Description of Artificial Sequence: Synthetic oligonucleotide
  Target: SCN9A; (+) strand; PAM type: NRG; PAM sequence: AAG
tataaaaaataaaataaaat

SEQ ID NO: 46098 - DNA, 20 bp, Artificial Sequence
  Description of Artificial Sequence: Synthetic oligonucleotide
  Target: SCN9A; (+) strand; PAM type: NRG; PAM sequence: TAG
taagtacacttttccgaata

SEQ ID NO: 46099 - DNA, 20 bp, Artificial Sequence
  Description of Artificial Sequence: Synthetic oligonucleotide
  Target: SCN9A; (+) strand; PAM type: NRG; PAM sequence: AGG
aagtacacttttccgaatat

SEQ ID NO: 46100 - DNA, 20 bp, Artificial Sequence
  Description of Artificial Sequence: Synthetic oligonucleotide
  Target: SCN9A; (+) strand; PAM type: NRG; PAM sequence: CAG
atataggccacaatacaaac

SEQ ID NO: 46101 - DNA, 20 bp, Artificial Sequence
  Description of Artificial Sequence: Synthetic oligonucleotide
  Target: SCN9A; (+) strand; PAM type: NRG; PAM sequence: AAG
cacaatacaaaccagcaacg

SEQ ID NO: 46102 - DNA, 20 bp, Artificial Sequence
  Description of Artificial Sequence: Synthetic oligonucleotide
  Target: SCN9A; (+) strand; PAM type: NRG; PAM sequence: CGG
tttctgcaccttttcacaca

SEQ ID NO: 46103 - DNA, 20 bp, Artificial Sequence
  Description of Artificial Sequence: Synthetic oligonucleotide
  Target: SCN9A; (+) strand; PAM type: NRG; PAM sequence: AAG
gcaccttttcacacacggat

SEQ ID NO: 46104 - DNA, 20 bp, Artificial Sequence
  Description of Artificial Sequence: Synthetic oligonucleotide
  Target: SCN9A; (+) strand; PAM type: NRG; PAM sequence: GAG
acacacggataagaccacat

SEQ ID NO: 46105 - DNA, 20 bp, Artificial Sequence
  Description of Artificial Sequence: Synthetic oligonucleotide
  Target: SCN9A; (+) strand; PAM type: NRG; PAM sequence: GAG
acacggataagaccacatga

SEQ ID NO: 46106 - DNA, 20 bp, Artificial Sequence
  Description of Artificial Sequence: Synthetic oligonucleotide
  Target: SCN9A; (+) strand; PAM type: NRG; PAM sequence: GAG
acggataagaccacatgaga

SEQ ID NO: 46107 - DNA, 20 bp, Artificial Sequence
  Description of Artificial Sequence: Synthetic oligonucleotide
  Target: SCN9A; (+) strand; PAM type: NRG; PAM sequence: CAG
ataagaccacatgagagaga

SEQ ID NO: 46108 - DNA, 20 bp, Artificial Sequence
  Description of Artificial Sequence: Synthetic oligonucleotide
  Target: SCN9A; (+) strand; PAM type: NRG; PAM sequence: GAG
aagaccacatgagagagaca

SEQ ID NO: 46109 - DNA, 20 bp, Artificial Sequence
  Description of Artificial Sequence: Synthetic oligonucleotide
  Target: SCN9A; (+) strand; PAM type: NRG; PAM sequence: AGG
agaccacatgagagagacag

SEQ ID NO: 46110 - DNA, 20 bp, Artificial Sequence
  Description of Artificial Sequence: Synthetic oligonucleotide
  Target: SCN9A; (+) strand; PAM type: NRG; PAM sequence: GAG
cacatgagagagacagaggc

SEQ ID NO: 46111 - DNA, 20 bp, Artificial Sequence
  Description of Artificial Sequence: Synthetic oligonucleotide
  Target: SCN9A; (+) strand; PAM type: NRG; PAM sequence: AGG
acatgagagagacagaggcg

SEQ ID NO: 46112 - DNA, 20 bp, Artificial Sequence
  Description of Artificial Sequence: Synthetic oligonucleotide
  Target: SCN9A; (+) strand; PAM type: NRG; PAM sequence: GGG
catgagagagacagaggcga

SEQ ID NO: 46113 - DNA, 20 bp, Artificial Sequence
  Description of Artificial Sequence: Synthetic oligonucleotide
  Target: SCN9A; (+) strand; PAM type: NRG; PAM sequence: TAG
gagagagacagaggcgaggg

SEQ ID NO: 46114 - DNA, 20 bp, Artificial Sequence
  Description of Artificial Sequence: Synthetic oligonucleotide
  Target: SCN9A; (+) strand; PAM type: NRG; PAM sequence: TAG
actcctcatcactgtatccc

SEQ ID NO: 46115 - DNA, 20 bp, Artificial Sequence
  Description of Artificial Sequence: Synthetic oligonucleotide
  Target: SCN9A; (+) strand; PAM type: NRG; PAM sequence: TAG
tcatcactgtatccctagac

SEQ ID NO: 46116 - DNA, 20 bp, Artificial Sequence
  Description of Artificial Sequence: Synthetic oligonucleotide
  Target: SCN9A; (+) strand; PAM type: NRG; PAM sequence: CAG
tatccctagactagcccctg

SEQ ID NO: 46117 - DNA, 20 bp, Artificial Sequence
  Description of Artificial Sequence: Synthetic oligonucleotide
  Target: SCN9A; (+) strand; PAM type: NRG; PAM sequence: CAG
tagactagcccctgcagact

SEQ ID NO: 46118 - DNA, 20 bp, Artificial Sequence
  Description of Artificial Sequence: Synthetic oligonucleotide
  Target: SCN9A; (+) strand; PAM type: NRG; PAM sequence: CAG
actagcccctgcagactcag

SEQ ID NO: 46119 - DNA, 20 bp, Artificial Sequence
  Description of Artificial Sequence: Synthetic oligonucleotide
  Target: SCN9A; (+) strand; PAM type: NRG; PAM sequence: CAG
agcccctgcagactcagcag

SEQ ID NO: 46120 - DNA, 20 bp, Artificial Sequence
  Description of Artificial Sequence: Synthetic oligonucleotide
  Target: SCN9A; (+) strand; PAM type: NRG; PAM sequence: GAG
cccctgcagactcagcagca

SEQ ID NO: 46121 - DNA, 20 bp, Artificial Sequence
  Description of Artificial Sequence: Synthetic oligonucleotide
  Target: SCN9A; (+) strand; PAM type: NRG; PAM sequence: AGG
ccctgcagactcagcagcag

SEQ ID NO: 46122 - DNA, 20 bp, Artificial Sequence
  Description of Artificial Sequence: Synthetic oligonucleotide
  Target: SCN9A; (+) strand; PAM type: NRG; PAM sequence: GGG
cctgcagactcagcagcaga

SEQ ID NO: 46123 - DNA, 20 bp, Artificial Sequence
  Description of Artificial Sequence: Synthetic oligonucleotide
  Target: SCN9A; (+) strand; PAM type: NRG; PAM sequence: CAG
cagactcagcagcagagggt

SEQ ID NO: 46124 - DNA, 20 bp, Artificial Sequence
  Description of Artificial Sequence: Synthetic oligonucleotide
  Target: SCN9A; (+) strand; PAM type: NRG; PAM sequence: CAG
agcagagggtcagccatacc

SEQ ID NO: 46125 - DNA, 20 bp, Artificial Sequence
  Description of Artificial Sequence: Synthetic oligonucleotide
  Target: SCN9A; (+) strand; PAM type: NRG; PAM sequence: AGG
gcagagggtcagccataccc

SEQ ID NO: 46126 - DNA, 20 bp, Artificial Sequence
  Description of Artificial Sequence: Synthetic oligonucleotide
  Target: SCN9A; (+) strand; PAM type: NRG; PAM sequence: AAG
gagggtcagccatacccagg

SEQ ID NO: 46127 - DNA, 20 bp, Artificial Sequence
  Description of Artificial Sequence: Synthetic oligonucleotide
  Target: SCN9A; (+) strand; PAM type: NRG; PAM sequence: TGG
atacccaggaagaattacca

SEQ ID NO: 46128 - DNA, 20 bp, Artificial Sequence
  Description of Artificial Sequence: Synthetic oligonucleotide
  Target: SCN9A; (+) strand; PAM type: NRG; PAM sequence: GGG
tacccaggaagaattaccat

SEQ ID NO: 46129 - DNA, 20 bp, Artificial Sequence
  Description of Artificial Sequence: Synthetic oligonucleotide
  Target: SCN9A; (+) strand; PAM type: NRG; PAM sequence: GGG
acccaggaagaattaccatg

SEQ ID NO: 46130 - DNA, 20 bp, Artificial Sequence
  Description of Artificial Sequence: Synthetic oligonucleotide
  Target: SCN9A; (+) strand; PAM type: NRG; PAM sequence: GAG
ccaggaagaattaccatggg

SEQ ID NO: 46131 - DNA, 20 bp, Artificial Sequence
  Description of Artificial Sequence: Synthetic oligonucleotide
  Target: SCN9A; (+) strand; PAM type: NRG; PAM sequence: CAG
ggaagaattaccatggggag

SEQ ID NO: 46132 - DNA, 20 bp, Artificial Sequence
  Description of Artificial Sequence: Synthetic oligonucleotide
  Target: SCN9A; (+) strand; PAM type: NRG; PAM sequence: GAG
aagaattaccatggggagca

SEQ ID NO: 46133 - DNA, 20 bp, Artificial Sequence
  Description of Artificial Sequence: Synthetic oligonucleotide
  Target: SCN9A; (+) strand; PAM type: NRG; PAM sequence: GAG
gaattaccatggggagcaga

SEQ ID NO: 46134 - DNA, 20 bp, Artificial Sequence
  Description of Artificial Sequence: Synthetic oligonucleotide
  Target: SCN9A; (+) strand; PAM type: NRG; PAM sequence: AAG
attatcattacatcatttct

SEQ ID NO: 46135 - DNA, 20 bp, Artificial Sequence
  Description of Artificial Sequence: Synthetic oligonucleotide
  Target: SCN9A; (+) strand; PAM type: NRG; PAM sequence: TAG
catttctaagttcatttctg

SEQ ID NO: 46136 - DNA, 20 bp, Artificial Sequence
  Description of Artificial Sequence: Synthetic oligonucleotide
  Target: SCN9A; (+) strand; PAM type: NRG; PAM sequence: CAG
ttctaagttcatttctgtag

SEQ ID NO: 46137 - DNA, 20 bp, Artificial Sequence
  Description of Artificial Sequence: Synthetic oligonucleotide
  Target: SCN9A; (+) strand; PAM type: NRG; PAM sequence: TAG
taagttcatttctgtagcag

SEQ ID NO: 46138 - DNA, 20 bp, Artificial Sequence
  Description of Artificial Sequence: Synthetic oligonucleotide
  Target: SCN9A; (+) strand; PAM type: NRG; PAM sequence: AAG
gtagcagtagtgccttaatc

SEQ ID NO: 46139 - DNA, 20 bp, Artificial Sequence
  Description of Artificial Sequence: Synthetic oligonucleotide
  Target: SCN9A; (+) strand; PAM type: NRG; PAM sequence: TAG
atgaacccaaaaaactctcc

SEQ ID NO: 46140 - DNA, 20 bp, Artificial Sequence
  Description of Artificial Sequence: Synthetic oligonucleotide
  Target: SCN9A; (+) strand; PAM type: NRG; PAM sequence: GAG
cattactctttattacctgt

SEQ ID NO: 46141 - DNA, 20 bp, Artificial Sequence
  Description of Artificial Sequence: Synthetic oligonucleotide
  Target: SCN9A; (+) strand; PAM type: NRG; PAM sequence: CAG
tctttattacctgtgagaaa

SEQ ID NO: 46142 - DNA, 20 bp, Artificial Sequence
  Description of Artificial Sequence: Synthetic oligonucleotide
  Target: SCN9A; (+) strand; PAM type: NRG; PAM sequence: AGG
ctttattacctgtgagaaac

SEQ ID NO: 46143 - DNA, 20 bp, Artificial Sequence
  Description of Artificial Sequence: Synthetic oligonucleotide
  Target: SCN9A; (+) strand; PAM type: NRG; PAM sequence: TAG
tattacctgtgagaaacagg

SEQ ID NO: 46144 - DNA, 20 bp, Artificial Sequence
  Description of Artificial Sequence: Synthetic oligonucleotide
  Target: SCN9A; (+) strand; PAM type: NRG; PAM sequence: AAG
gactattttctattgtgcta

SEQ ID NO: 46145 - DNA, 20 bp, Artificial Sequence
  Description of Artificial Sequence: Synthetic oligonucleotide
  Target: SCN9A; (+) strand; PAM type: NRG; PAM sequence: CAG
aagatctttgttcactttac

SEQ ID NO: 46146 - DNA, 20 bp, Artificial Sequence
  Description of Artificial Sequence: Synthetic oligonucleotide
  Target: SCN9A; (+) strand; PAM type: NRG; PAM sequence: AAG
atctttgttcactttaccag

SEQ ID NO: 46147 - DNA, 20 bp, Artificial Sequence
  Description of Artificial Sequence: Synthetic oligonucleotide
  Target: SCN9A; (+) strand; PAM type: NRG; PAM sequence: TGG
atgtcacttgttctaacaaa

SEQ ID NO: 46148 - DNA, 20 bp, Artificial Sequence
  Description of Artificial Sequence: Synthetic oligonucleotide
  Target: SCN9A; (+) strand; PAM type: NRG; PAM sequence: AAG
tggaacacataatacttaca

SEQ ID NO: 46149 - DNA, 20 bp, Artificial Sequence
  Description of Artificial Sequence: Synthetic oligonucleotide
  Target: SCN9A; (+) strand; PAM type: NRG; PAM sequence: AAG
tgtaataaaatattctgtcc

SEQ ID NO: 46150 - DNA, 20 bp, Artificial Sequence
  Description of Artificial Sequence: Synthetic oligonucleotide
  Target: SCN9A; (+) strand; PAM type: NRG; PAM sequence: AAG
aataaaatattctgtccaag

SEQ ID NO: 46151 - DNA, 20 bp, Artificial Sequence
  Description of Artificial Sequence: Synthetic oligonucleotide
  Target: SCN9A; (+) strand; PAM type: NRG; PAM sequence: TAG
attctgtccaagaagcgtgc

SEQ ID NO: 46152 - DNA, 20 bp, Artificial Sequence
  Description of Artificial Sequence: Synthetic oligonucleotide
  Target: SCN9A; (+) strand; PAM type: NRG; PAM sequence: AAG
actgcttaatgtgactttta

SEQ ID NO: 46153 - DNA, 20 bp, Artificial Sequence
  Description of Artificial Sequence: Synthetic oligonucleotide
  Target: SCN9A; (+) strand; PAM type: NRG; PAM sequence: CAG
ttaatgtgacttttaaagca

SEQ ID NO: 46154 - DNA, 20 bp, Artificial Sequence
  Description of Artificial Sequence: Synthetic oligonucleotide
  Target: SCN9A; (+) strand; PAM type: NRG; PAM sequence: AAG
gtgacttttaaagcacagaa

SEQ ID NO: 46155 - DNA, 20 bp, Artificial Sequence
  Description of Artificial Sequence: Synthetic oligonucleotide
  Target: SCN9A; (+) strand; PAM type: NRG; PAM sequence: AGG
tgacttttaaagcacagaaa

SEQ ID NO: 46156 - DNA, 20 bp, Artificial Sequence
  Description of Artificial Sequence: Synthetic oligonucleotide
  Target: SCN9A; (+) strand; PAM type: NRG; PAM sequence: TGG
acctgattcacatgcaataa

SEQ ID NO: 46157 - DNA, 20 bp, Artificial Sequence
  Description of Artificial Sequence: Synthetic oligonucleotide
  Target: SCN9A; (+) strand; PAM type: NRG; PAM sequence: TGG
tgcaataatggcattatgat

SEQ ID NO: 46158 - DNA, 20 bp, Artificial Sequence
  Description of Artificial Sequence: Synthetic oligonucleotide
  Target: SCN9A; (+) strand; PAM type: NRG; PAM sequence: TGG
ataatggcattatgattggc

SEQ ID NO: 46159 - DNA, 20 bp, Artificial Sequence
  Description of Artificial Sequence: Synthetic oligonucleotide
  Target: SCN9A; (+) strand; PAM type: NRG; PAM sequence: TAG
attgcctattatgtttgccc

SEQ ID NO: 46160 - DNA, 20 bp, Artificial Sequence
  Description of Artificial Sequence: Synthetic oligonucleotide
  Target: SCN9A; (+) strand; PAM type: NRG; PAM sequence: AAG
gcctattatgtttgccctag

SEQ ID NO: 46161 - DNA, 20 bp, Artificial Sequence
  Description of Artificial Sequence: Synthetic oligonucleotide
  Target: SCN9A; (+) strand; PAM type: NRG; PAM sequence: GAG
ctattatgtttgccctagaa

SEQ ID NO: 46162 - DNA, 20 bp, Artificial Sequence
  Description of Artificial Sequence: Synthetic oligonucleotide
  Target: SCN9A; (+) strand; PAM type: NRG; PAM sequence: AAG
ccctagaagagattacaaaa

SEQ ID NO: 46163 - DNA, 20 bp, Artificial Sequence
  Description of Artificial Sequence: Synthetic oligonucleotide
  Target: SCN9A; (+) strand; PAM type: NRG; PAM sequence: AGG
cctagaagagattacaaaaa

SEQ ID NO: 46164 - DNA, 20 bp, Artificial Sequence
  Description of Artificial Sequence: Synthetic oligonucleotide
  Target: SCN9A; (+) strand; PAM type: NRG; PAM sequence: CAG
gaagagattacaaaaaaggt

SEQ ID NO: 46165 - DNA, 20 bp, Artificial Sequence
  Description of Artificial Sequence: Synthetic oligonucleotide
  Target: SCN9A; (+) strand; PAM type: NRG; PAM sequence: AGG
aagagattacaaaaaaggtc

SEQ ID NO: 46166 - DNA, 20 bp, Artificial Sequence
  Description of Artificial Sequence: Synthetic oligonucleotide
  Target: SCN9A; (+) strand; PAM type: NRG; PAM sequence: AAG
ggacaatttctattctcttg

SEQ ID NO: 46167 - DNA, 20 bp, Artificial Sequence
  Description of Artificial Sequence: Synthetic oligonucleotide
  Target: SCN9A; (+) strand; PAM type: NRG; PAM sequence: AAG
atttctattctcttgaagca

SEQ ID NO: 46168 - DNA, 20 bp, Artificial Sequence
  Description of Artificial Sequence: Synthetic oligonucleotide
  Target: SCN9A; (+) strand; PAM type: NRG; PAM sequence: GAG
tgaagcaaagttttatttct

SEQ ID NO: 46169 - DNA, 20 bp, Artificial Sequence
  Description of Artificial Sequence: Synthetic oligonucleotide
  Target: SCN9A; (+) strand; PAM type: NRG; PAM sequence: AAG
attatttttttttctcactg

SEQ ID NO: 46170 - DNA, 20 bp, Artificial Sequence
  Description of Artificial Sequence: Synthetic oligonucleotide
  Target: SCN9A; (+) strand; PAM type: NRG; PAM sequence: TAG
atttttttttctcactgaag

SEQ ID NO: 46171 - DNA, 20 bp, Artificial Sequence
  Description of Artificial Sequence: Synthetic oligonucleotide
  Target: SCN9A; (+) strand; PAM type: NRG; PAM sequence: AAG
tttttttctcactgaagtag

SEQ ID NO: 46172 - DNA, 20 bp, Artificial Sequence
  Description of Artificial Sequence: Synthetic oligonucleotide
  Target: SCN9A; (+) strand; PAM type: NRG; PAM sequence: CAG
ttctcactgaagtagaagtg

SEQ ID NO: 46173 - DNA, 20 bp, Artificial Sequence
  Description of Artificial Sequence: Synthetic oligonucleotide
  Target: SCN9A; (+) strand; PAM type: NRG; PAM sequence: AGG
tctcactgaagtagaagtgc

SEQ ID NO: 46174 - DNA, 20 bp, Artificial Sequence
  Description of Artificial Sequence: Synthetic oligonucleotide
  Target: SCN9A; (+) strand; PAM type: NRG; PAM sequence: CAG
gtaaaaaaaaaaaatgttca

SEQ ID NO: 46175 - DNA, 20 bp, Artificial Sequence
  Description of Artificial Sequence: Synthetic oligonucleotide
  Target: SCN9A; (+) strand; PAM type: NRG; PAM sequence: GAG
aaaaaaaaaaaatgttcaca

SEQ ID NO: 46176 - DNA, 20 bp, Artificial Sequence
  Description of Artificial Sequence: Synthetic oligonucleotide
  Target: SCN9A; (+) strand; PAM type: NRG; PAM sequence: AGG
aaaaaaaaaaatgttcacag

SEQ ID NO: 46177 - DNA, 20 bp, Artificial Sequence
  Description of Artificial Sequence: Synthetic oligonucleotide
  Target: SCN9A; (+) strand; PAM type: NRG; PAM sequence: GGG
aaaaaaaaaatgttcacaga

SEQ ID NO: 46178 - DNA, 20 bp, Artificial Sequence
  Description of Artificial Sequence: Synthetic oligonucleotide
  Target: SCN9A; (+) strand; PAM type: NRG; PAM sequence: CAG
aaaaaaatgttcacagaggg

SEQ ID NO: 46179 - DNA, 20 bp, Artificial Sequence
  Description of Artificial Sequence: Synthetic oligonucleotide
  Target: SCN9A; (+) strand; PAM type: NRG; PAM sequence: AGG
aaaaaatgttcacagagggc

SEQ ID NO: 46180 - DNA, 20 bp, Artificial Sequence
  Description of Artificial Sequence: Synthetic oligonucleotide
  Target: SCN9A; (+) strand; PAM type: NRG; PAM sequence: CAG
tatttaaacattgttttatc

SEQ ID NO: 46181 - DNA, 20 bp, Artificial Sequence
  Description of Artificial Sequence: Synthetic oligonucleotide
  Target: SCN9A; (+) strand; PAM type: NRG; PAM sequence: AGG
atttaaacattgttttatcc

SEQ ID NO: 46182 - DNA, 20 bp, Artificial Sequence
  Description of Artificial Sequence: Synthetic oligonucleotide
  Target: SCN9A; (+) strand; PAM type: NRG; PAM sequence: AAG
gttttatccaggaaacaaaa

SEQ ID NO: 46183 - DNA, 20 bp, Artificial Sequence
  Description of Artificial Sequence: Synthetic oligonucleotide
  Target: SCN9A; (+) strand; PAM type: NRG; PAM sequence: AGG
ttttatccaggaaacaaaaa

SEQ ID NO: 46184 - DNA, 20 bp, Artificial Sequence
  Description of Artificial Sequence: Synthetic oligonucleotide
  Target: SCN9A; (+) strand; PAM type: NRG; PAM sequence: TGG
aacaaaaaaggaaattgaat

SEQ ID NO: 46185 - DNA, 20 bp, Artificial Sequence
  Description of Artificial Sequence: Synthetic oligonucleotide
  Target: SCN9A; (+) strand; PAM type: NRG; PAM sequence: AAG
attgaattggcatttgatgt

SEQ ID NO: 46186 - DNA, 20 bp, Artificial Sequence
  Description of Artificial Sequence: Synthetic oligonucleotide
  Target: SCN9A; (+) strand; PAM type: NRG; PAM sequence: TGG
atttgatgtaagtcttttca

SEQ ID NO: 46187 - DNA, 20 bp, Artificial Sequence
  Description of Artificial Sequence: Synthetic oligonucleotide
  Target: SCN9A; (+) strand; PAM type: NRG; PAM sequence: AAG
acctcatgttttaaaaatcg

SEQ ID NO: 46188 - DNA, 20 bp, Artificial Sequence
  Description of Artificial Sequence: Synthetic oligonucleotide
  Target: SCN9A; (+) strand; PAM type: NRG; PAM sequence: AAG
catgttttaaaaatcgaagt

SEQ ID NO: 46189 - DNA, 20 bp, Artificial Sequence
  Description of Artificial Sequence: Synthetic oligonucleotide
  Target: SCN9A; (+) strand; PAM type: NRG; PAM sequence: AAG
atcgaagtaagacctaactg

SEQ ID NO: 46190 - DNA, 20 bp, Artificial Sequence
  Description of Artificial Sequence: Synthetic oligonucleotide
  Target: SCN9A; (+) strand; PAM type: NRG; PAM sequence: GAG
cgaagtaagacctaactgaa

SEQ ID NO: 46191 - DNA, 20 bp, Artificial Sequence
  Description of Artificial Sequence: Synthetic oligonucleotide
  Target: SCN9A; (+) strand; PAM type: NRG; PAM sequence: AAG
agtaagacctaactgaagag

SEQ ID NO: 46192 - DNA, 20 bp, Artificial Sequence
  Description of Artificial Sequence: Synthetic oligonucleotide
  Target: SCN9A; (+) strand; PAM type: NRG; PAM sequence: AGG
gtaagacctaactgaagaga

SEQ ID NO: 46193 - DNA, 20 bp, Artificial Sequence
  Description of Artificial Sequence: Synthetic oligonucleotide
  Target: SCN9A; (+) strand; PAM type: NRG; PAM sequence: TGG
aaggtactcatccctcattt

SEQ ID NO: 46194 - DNA, 20 bp, Artificial Sequence
  Description of Artificial Sequence: Synthetic oligonucleotide
  Target: SCN9A; (+) strand; PAM type: NRG; PAM sequence: GAG
atacctaaaacaatttctct

SEQ ID NO: 46195 - DNA, 20 bp, Artificial Sequence
  Description of Artificial Sequence: Synthetic oligonucleotide
  Target: SCN9A; (+) strand; PAM type: NRG; PAM sequence: AAG
aaacaatttctctgagatgt

SEQ ID NO: 46196 - DNA, 20 bp, Artificial Sequence
  Description of Artificial Sequence: Synthetic oligonucleotide
  Target: SCN9A; (+) strand; PAM type: NRG; PAM sequence: AAG
atttctctgagatgtaagta

SEQ ID NO: 46197 - DNA, 20 bp, Artificial Sequence
  Description of Artificial Sequence: Synthetic oligonucleotide
  Target: SCN9A; (+) strand; PAM type: NRG; PAM sequence: CAG
ctctgagatgtaagtaaaga

SEQ ID NO: 46198 - DNA, 20 bp, Artificial Sequence
  Description of Artificial Sequence: Synthetic oligonucleotide
  Target: SCN9A; (+) strand; PAM type: NRG; PAM sequence: CAG
tgagatgtaagtaaagacag

SEQ ID NO: 46199 - DNA, 20 bp, Artificial Sequence
  Description of Artificial Sequence: Synthetic oligonucleotide
  Target: SCN9A; (+) strand; PAM type: NRG; PAM sequence: AGG
gagatgtaagtaaagacagc

SEQ ID NO: 46200 - DNA, 20 bp, Artificial Sequence
  Description of Artificial Sequence: Synthetic oligonucleotide
  Target: SCN9A; (+) strand; PAM type: NRG; PAM sequence: AAG
ctaaaattgtgtgtctcaat

SEQ ID NO: 46201 - DNA, 20 bp, Artificial Sequence
  Description of Artificial Sequence: Synthetic oligonucleotide
  Target: SCN9A; (+) strand; PAM type: NRG; PAM sequence: TAG
gtgtctcaataagtctgatt

SEQ ID NO: 46202 - DNA, 20 bp, Artificial Sequence
  Description of Artificial Sequence: Synthetic oligonucleotide
  Target: SCN9A; (+) strand; PAM type: NRG; PAM sequence: AGG
tgtctcaataagtctgattt

SEQ ID NO: 46203 - DNA, 20 bp, Artificial Sequence
  Description of Artificial Sequence: Synthetic oligonucleotide
  Target: SCN9A; (+) strand; PAM type: NRG; PAM sequence: GAG
tctcaataagtctgatttag

SEQ ID NO: 46204 - DNA, 20 bp, Artificial Sequence
  Description of Artificial Sequence: Synthetic oligonucleotide
  Target: SCN9A; (+) strand; PAM type: NRG; PAM sequence: TGG
tctgatttaggagaaaattc

SEQ ID NO: 46205 - DNA, 20 bp, Artificial Sequence
  Description of Artificial Sequence: Synthetic oligonucleotide
  Target: SCN9A; (+) strand; PAM type: NRG; PAM sequence: GAG
tgatttaggagaaaattctg

SEQ ID NO: 46206 - DNA, 20 bp, Artificial Sequence
  Description of Artificial Sequence: Synthetic oligonucleotide
  Target: SCN9A; (+) strand; PAM type: NRG; PAM sequence: AGG
gatttaggagaaaattctgg

SEQ ID NO: 46207 - DNA, 20 bp, Artificial Sequence
  Description of Artificial Sequence: Synthetic oligonucleotide
  Target: SCN9A; (+) strand; PAM type: NRG; PAM sequence: CGG
taggagaaaattctggaggt

SEQ ID NO: 46208 - DNA, 20 bp, Artificial Sequence
  Description of Artificial Sequence: Synthetic oligonucleotide
  Target: SCN9A; (+) strand; PAM type: NRG; PAM sequence: GAG
ggagaaaattctggaggtcg

SEQ ID NO: 46209 - DNA, 20 bp, Artificial Sequence
  Description of Artificial Sequence: Synthetic oligonucleotide
  Target: SCN9A; (+) strand; PAM type: NRG; PAM sequence: AGG
gagaaaattctggaggtcgg

SEQ ID NO: 46210 - DNA, 20 bp, Artificial Sequence
  Description of Artificial Sequence: Synthetic oligonucleotide
  Target: SCN9A; (+) strand; PAM type: NRG; PAM sequence: TGG
aattctggaggtcggaggtc

SEQ ID NO: 46211 - DNA, 20 bp, Artificial Sequence
  Description of Artificial Sequence: Synthetic oligonucleotide
  Target: SCN9A; (+) strand; PAM type: NRG; PAM sequence: GGG
attctggaggtcggaggtct

SEQ ID NO: 46212 - DNA, 20 bp, Artificial Sequence
  Description of Artificial Sequence: Synthetic oligonucleotide
  Target: SCN9A; (+) strand; PAM type: NRG; PAM sequence: TAG
ggtcggaggtctgggaatca

SEQ ID NO: 46213 - DNA, 20 bp, Artificial Sequence
  Description of Artificial Sequence: Synthetic oligonucleotide
  Target: SCN9A; (+) strand; PAM type: NRG; PAM sequence: TGG
attgctaaaaatccctgaaa

SEQ ID NO: 46214 - DNA, 20 bp, Artificial Sequence
  Description of Artificial Sequence: Synthetic oligonucleotide
  Target: SCN9A; (+) strand; PAM type: NRG; PAM sequence: TAG
aaatccctgaaatggtttaa

SEQ ID NO: 46215 - DNA, 20 bp, Artificial Sequence
  Description of Artificial Sequence: Synthetic oligonucleotide
  Target: SCN9A; (+) strand; PAM type: NRG; PAM sequence: AAG
tttaatagttgtcaatgaaa

SEQ ID NO: 46216 - DNA, 20 bp, Artificial Sequence
  Description of Artificial Sequence: Synthetic oligonucleotide
  Target: SCN9A; (+) strand; PAM type: NRG; PAM sequence: TAG
tttgtgtatatttgttttaa

SEQ ID NO: 46217 - DNA, 20 bp, Artificial Sequence
  Description of Artificial Sequence: Synthetic oligonucleotide
  Target: SCN9A; (+) strand; PAM type: NRG; PAM sequence: AGG
ttgtgtatatttgttttaat

SEQ ID NO: 46218 - DNA, 20 bp, Artificial Sequence
  Description of Artificial Sequence: Synthetic oligonucleotide
  Target: SCN9A; (+) strand; PAM type: NRG; PAM sequence: TGG
atttgttttaataggaatat

SEQ ID NO: 46219 - DNA, 20 bp, Artificial Sequence
  Description of Artificial Sequence: Synthetic oligonucleotide
  Target: SCN9A; (+) strand; PAM type: NRG; PAM sequence: AAG
ttttaataggaatattggtg

SEQ ID NO: 46220 - DNA, 20 bp, Artificial Sequence
  Description of Artificial Sequence: Synthetic oligonucleotide
  Target: SCN9A; (+) strand; PAM type: NRG; PAM sequence: GAG
aggaatattggtgaagatct

SEQ ID NO: 46221 - DNA, 20 bp, Artificial Sequence
  Description of Artificial Sequence: Synthetic oligonucleotide
  Target: SCN9A; (+) strand; PAM type: NRG; PAM sequence: AGG
ggaatattggtgaagatctg

SEQ ID NO: 46222 - DNA, 20 bp, Artificial Sequence
  Description of Artificial Sequence: Synthetic oligonucleotide
  Target: SCN9A; (+) strand; PAM type: NRG; PAM sequence: GGG
gaatattggtgaagatctga

SEQ ID NO: 46223 - DNA, 20 bp, Artificial Sequence
  Description of Artificial Sequence: Synthetic oligonucleotide
  Target: SCN9A; (+) strand; PAM type: NRG; PAM sequence: TAG
gagggtccattttactgctt

SEQ ID NO: 46224 - DNA, 20 bp, Artificial Sequence
  Description of Artificial Sequence: Synthetic oligonucleotide
  Target: SCN9A; (+) strand; PAM type: NRG; PAM sequence: AAG
ttagtctccttaatctgttc

SEQ ID NO: 46225 - DNA, 20 bp, Artificial Sequence
  Description of Artificial Sequence: Synthetic oligonucleotide
  Target: SCN9A; (+) strand; PAM type: NRG; PAM sequence: CAG
caagcgttaaaccattttaa

SEQ ID NO: 46226 - DNA, 20 bp, Artificial Sequence
  Description of Artificial Sequence: Synthetic oligonucleotide
  Target: SCN9A; (+) strand; PAM type: NRG; PAM sequence: AGG
aagcgttaaaccattttaac

SEQ ID NO: 46227 - DNA, 20 bp, Artificial Sequence
  Description of Artificial Sequence: Synthetic oligonucleotide
  Target: SCN9A; (+) strand; PAM type: NRG; PAM sequence: GGG
agcgttaaaccattttaaca

SEQ ID NO: 46228 - DNA, 20 bp, Artificial Sequence
  Description of Artificial Sequence: Synthetic oligonucleotide
  Target: SCN9A; (+) strand; PAM type: NRG; PAM sequence: CAG
taaaccattttaacagggtg

SEQ ID NO: 46229 - DNA, 20 bp, Artificial Sequence
  Description of Artificial Sequence: Synthetic oligonucleotide
  Target: SCN9A; (+) strand; PAM type: NRG; PAM sequence: TGG
accattttaacagggtgcag

SEQ ID NO: 46230 - DNA, 20 bp, Artificial Sequence
  Description of Artificial Sequence: Synthetic oligonucleotide
  Target: SCN9A; (+) strand; PAM type: NRG; PAM sequence: CGG
acagggtgcagtggctcatg

SEQ ID NO: 46231 - DNA, 20 bp, Artificial Sequence
  Description of Artificial Sequence: Synthetic oligonucleotide
  Target: SCN9A; (+) strand; PAM type: NRG; PAM sequence: GAG
catgcggttctcacttcgtt

SEQ ID NO: 46232 - DNA, 20 bp, Artificial Sequence
  Description of Artificial Sequence: Synthetic oligonucleotide
  Target: SCN9A; (+) strand; PAM type: NRG; PAM sequence: CAG
ggttctcacttcgttgagaa

SEQ ID NO: 46233 - DNA, 20 bp, Artificial Sequence
  Description of Artificial Sequence: Synthetic oligonucleotide
  Target: SCN9A; (+) strand; PAM type: NRG; PAM sequence: AAG
ttctttccttcaaaaatcat

SEQ ID NO: 46234 - DNA, 20 bp, Artificial Sequence
  Description of Artificial Sequence: Synthetic oligonucleotide
  Target: SCN9A; (+) strand; PAM type: NRG; PAM sequence: TAG
tctctaatatttctataacc

SEQ ID NO: 46235 - DNA, 20 bp, Artificial Sequence
  Description of Artificial Sequence: Synthetic oligonucleotide
  Target: SCN9A; (+) strand; PAM type: NRG; PAM sequence: TGG
ctaatatttctataacctag

SEQ ID NO: 46236 - DNA, 20 bp, Artificial Sequence
  Description of Artificial Sequence: Synthetic oligonucleotide
  Target: SCN9A; (+) strand; PAM type: NRG; PAM sequence: GGG
taatatttctataacctagt

SEQ ID NO: 46237 - DNA, 20 bp, Artificial Sequence
  Description of Artificial Sequence: Synthetic oligonucleotide
  Target: SCN9A; (+) strand; PAM type: NRG; PAM sequence: AAG
gggtatcacaaatcaaaata

SEQ ID NO: 46238 - DNA, 20 bp, Artificial Sequence
  Description of Artificial Sequence: Synthetic oligonucleotide
  Target: SCN9A; (+) strand; PAM type: NRG; PAM sequence: AAG
tttgtattatcatgttaaac

SEQ ID NO: 46239 - DNA, 20 bp, Artificial Sequence
  Description of Artificial Sequence: Synthetic oligonucleotide
  Target: SCN9A; (+) strand; PAM type: NRG; PAM sequence: GAG
tgtattatcatgttaaacaa

SEQ ID NO: 46240 - DNA, 20 bp, Artificial Sequence
  Description of Artificial Sequence: Synthetic oligonucleotide
  Target: SCN9A; (+) strand; PAM type: NRG; PAM sequence: AAG
attatcatgttaaacaagag

SEQ ID NO: 46241 - DNA, 20 bp, Artificial Sequence
  Description of Artificial Sequence: Synthetic oligonucleotide
  Target: SCN9A; (+) strand; PAM type: NRG; PAM sequence: AAG
taaaatgtatacttgattca

SEQ ID NO: 46242 - DNA, 20 bp, Artificial Sequence
  Description of Artificial Sequence: Synthetic oligonucleotide
  Target: SCN9A; (+) strand; PAM type: NRG; PAM sequence: TGG
caaagtctcattttgattaa

SEQ ID NO: 46243 - DNA, 20 bp, Artificial Sequence
  Description of Artificial Sequence: Synthetic oligonucleotide
  Target: SCN9A; (+) strand; PAM type: NRG; PAM sequence: AAG
ttttgattaatggtcttcgc

SEQ ID NO: 46244 - DNA, 20 bp, Artificial Sequence
  Description of Artificial Sequence: Synthetic oligonucleotide
  Target: SCN9A; (+) strand; PAM type: NRG; PAM sequence: TAG
tcttcgcaagtttcctgata

SEQ ID NO: 46245 - DNA, 20 bp, Artificial Sequence
  Description of Artificial Sequence: Synthetic oligonucleotide
  Target: SCN9A; (+) strand; PAM type: NRG; PAM sequence: GAG
aagtttcctgatatagaccc

SEQ ID NO: 46246 - DNA, 20 bp, Artificial Sequence
  Description of Artificial Sequence: Synthetic oligonucleotide
  Target: SCN9A; (+) strand; PAM type: NRG; PAM sequence: TGG
caaatgttttcctaaaccta

SEQ ID NO: 46247 - DNA, 20 bp, Artificial Sequence
  Description of Artificial Sequence: Synthetic oligonucleotide
  Target: SCN9A; (+) strand; PAM type: NRG; PAM sequence: TGG
ccttaaccatttcaattaac

SEQ ID NO: 46248 - DNA, 20 bp, Artificial Sequence
  Description of Artificial Sequence: Synthetic oligonucleotide
  Target: SCN9A; (+) strand; PAM type: NRG; PAM sequence: AAG
actggcaataaaatgatcaa

SEQ ID NO: 46249 - DNA, 20 bp, Artificial Sequence
  Description of Artificial Sequence: Synthetic oligonucleotide
  Target: SCN9A; (+) strand; PAM type: NRG; PAM sequence: TAG
aaatgatcaaaagaataaat

SEQ ID NO: 46250 - DNA, 20 bp, Artificial Sequence
  Description of Artificial Sequence: Synthetic oligonucleotide
  Target: SCN9A; (+) strand; PAM type: NRG; PAM sequence: GAG
atgatcaaaagaataaatta

SEQ ID NO: 46251 - DNA, 20 bp, Artificial Sequence
  Description of Artificial Sequence: Synthetic oligonucleotide
  Target: SCN9A; (+) strand; PAM type: NRG; PAM sequence: AAG
aaattagagaaatataaaaa

SEQ ID NO: 46252 - DNA, 20 bp, Artificial Sequence
  Description of Artificial Sequence: Synthetic oligonucleotide
  Target: SCN9A; (+) strand; PAM type: NRG; PAM sequence: GAG
attagagaaatataaaaaaa

SEQ ID NO: 46253 - DNA, 20 bp, Artificial Sequence
  Description of Artificial Sequence: Synthetic oligonucleotide
  Target: SCN9A; (+) strand; PAM type: NRG; PAM sequence: AAG
agagaaatataaaaaaagag

SEQ ID NO: 46254 - DNA, 20 bp, Artificial Sequence
  Description of Artificial Sequence: Synthetic oligonucleotide
  Target: SCN9A; (+) strand; PAM type: NRG; PAM sequence: CAG
aaatataaaaaaagagaagc

SEQ ID NO: 46255 - DNA, 20 bp, Artificial Sequence
  Description of Artificial Sequence: Synthetic oligonucleotide
  Target: SCN9A; (+) strand; PAM type: NRG; PAM sequence: TAG
taaaaaaagagaagccagtt

SEQ ID NO: 46256 - DNA, 20 bp, Artificial Sequence
  Description of Artificial Sequence: Synthetic oligonucleotide
  Target: SCN9A; (+) strand; PAM type: NRG; PAM sequence: TGG
tttagcatataactctaatg

SEQ ID NO: 46257 - DNA, 20 bp, Artificial Sequence
  Description of Artificial Sequence: Synthetic oligonucleotide
  Target: SCN9A; (+) strand; PAM type: NRG; PAM sequence: AAG
agcatataactctaatgtgg

SEQ ID NO: 46258 - DNA, 20 bp, Artificial Sequence
  Description of Artificial Sequence: Synthetic oligonucleotide
  Target: SCN9A; (+) strand; PAM type: NRG; PAM sequence: AGG
gcatataactctaatgtgga

SEQ ID NO: 46259 - DNA, 20 bp, Artificial Sequence
  Description of Artificial Sequence: Synthetic oligonucleotide
  Target: SCN9A; (+) strand; PAM type: NRG; PAM sequence: CAG
tctaatgtggaaggctatat

SEQ ID NO: 46260 - DNA, 20 bp, Artificial Sequence
  Description of Artificial Sequence: Synthetic oligonucleotide
  Target: SCN9A; (+) strand; PAM type: NRG; PAM sequence: AGG
ctaatgtggaaggctatatc

SEQ ID NO: 46261 - DNA, 20 bp, Artificial Sequence
  Description of Artificial Sequence: Synthetic oligonucleotide
  Target: SCN9A; (+) strand; PAM type: NRG; PAM sequence: TGG
aaattttaattctatgatat

SEQ ID NO: 46262 - DNA, 20 bp, Artificial Sequence
  Description of Artificial Sequence: Synthetic oligonucleotide
  Target: SCN9A; (+) strand; PAM type: NRG; PAM sequence: TAG
ttttaattctatgatattgg

SEQ ID NO: 46263 - DNA, 20 bp, Artificial Sequence
  Description of Artificial Sequence: Synthetic oligonucleotide
  Target: SCN9A; (+) strand; PAM type: NRG; PAM sequence: TAG
gatattggtagttcctccat

SEQ ID NO: 46264 - DNA, 20 bp, Artificial Sequence
  Description of Artificial Sequence: Synthetic oligonucleotide
  Target: SCN9A; (+) strand; PAM type: NRG; PAM sequence: AAG
tggtagttcctccattagtc

SEQ ID NO: 46265 - DNA, 20 bp, Artificial Sequence
  Description of Artificial Sequence: Synthetic oligonucleotide
  Target: SCN9A; (+) strand; PAM type: NRG; PAM sequence: GAG
gtagttcctccattagtcaa

SEQ ID NO: 46266 - DNA, 20 bp, Artificial Sequence
  Description of Artificial Sequence: Synthetic oligonucleotide
  Target: SCN9A; (+) strand; PAM type: NRG; PAM sequence: TGG
ttcctccattagtcaagagt

SEQ ID NO: 46267 - DNA, 20 bp, Artificial Sequence
  Description of Artificial Sequence: Synthetic oligonucleotide
  Target: SCN9A; (+) strand; PAM type: NRG; PAM sequence: AAG
ttctgtatactttctttgcc

SEQ ID NO: 46268 - DNA, 20 bp, Artificial Sequence
  Description of Artificial Sequence: Synthetic oligonucleotide
  Target: SCN9A; (+) strand; PAM type: NRG; PAM sequence: AAG
ttgccaagaattaataatta

SEQ ID NO: 46269 - DNA, 20 bp, Artificial Sequence
  Description of Artificial Sequence: Synthetic oligonucleotide
  Target: SCN9A; (+) strand; PAM type: NRG; PAM sequence: GAG
taattaaagaataataatat

SEQ ID NO: 46270 - DNA, 20 bp, Artificial Sequence
  Description of Artificial Sequence: Synthetic oligonucleotide
  Target: SCN9A; (+) strand; PAM type: NRG; PAM sequence: TAG
taaagaataataatatgagt

SEQ ID NO: 46271 - DNA, 20 bp, Artificial Sequence
  Description of Artificial Sequence: Synthetic oligonucleotide
  Target: SCN9A; (+) strand; PAM type: NRG; PAM sequence: AAG
taaatctatattgcctttca

SEQ ID NO: 46272 - DNA, 20 bp, Artificial Sequence
  Description of Artificial Sequence: Synthetic oligonucleotide
  Target: SCN9A; (+) strand; PAM type: NRG; PAM sequence: AGG
aaatctatattgcctttcaa

SEQ ID NO: 46273 - DNA, 20 bp, Artificial Sequence
  Description of Artificial Sequence: Synthetic oligonucleotide
  Target: SCN9A; (+) strand; PAM type: NRG; PAM sequence: CAG
ggaaaacataactctcacac

SEQ ID NO: 46274 - DNA, 20 bp, Artificial Sequence
  Description of Artificial Sequence: Synthetic oligonucleotide
  Target: SCN9A; (+) strand; PAM type: NRG; PAM sequence: AAG
attatattatccattgttca

SEQ ID NO: 46275 - DNA, 20 bp, Artificial Sequence
  Description of Artificial Sequence: Synthetic oligonucleotide
  Target: SCN9A; (+) strand; PAM type: NRG; PAM sequence: AGG
ttatattatccattgttcaa

SEQ ID NO: 46276 - DNA, 20 bp, Artificial Sequence
  Description of Artificial Sequence: Synthetic oligonucleotide
  Target: SCN9A; (+) strand; PAM type: NRG; PAM sequence: AAG
ccacttcaaaaacctccctt

SEQ ID NO: 46277 - DNA, 20 bp, Artificial Sequence
  Description of Artificial Sequence: Synthetic oligonucleotide
  Target: SCN9A; (+) strand; PAM type: NRG; PAM sequence: TAG
acctcccttaagtctcaatc

SEQ ID NO: 46278 - DNA, 20 bp, Artificial Sequence
  Description of Artificial Sequence: Synthetic oligonucleotide
  Target: SCN9A; (+) strand; PAM type: NRG; PAM sequence: AAG
caatctagaactctttcttt

SEQ ID NO: 46279 - DNA, 20 bp, Artificial Sequence
  Description of Artificial Sequence: Synthetic oligonucleotide
  Target: SCN9A; (+) strand; PAM type: NRG; PAM sequence: CAG
agaactctttctttaagtgt

SEQ ID NO: 46280 - DNA, 20 bp, Artificial Sequence
  Description of Artificial Sequence: Synthetic oligonucleotide
  Target: SCN9A; (+) strand; PAM type: NRG; PAM sequence: AAG
actctttctttaagtgtcag

SEQ ID NO: 46281 - DNA, 20 bp, Artificial Sequence
  Description of Artificial Sequence: Synthetic oligonucleotide
  Target: SCN9A; (+) strand; PAM type: NRG; PAM sequence: TGG
agcattttatttaaccttat

SEQ ID NO: 46282 - DNA, 20 bp, Artificial Sequence
  Description of Artificial Sequence: Synthetic oligonucleotide
  Target: SCN9A; (+) strand; PAM type: NRG; PAM sequence: TAG
attttatttaaccttattgg

SEQ ID NO: 46283 - DNA, 20 bp, Artificial Sequence
  Description of Artificial Sequence: Synthetic oligonucleotide
  Target: SCN9A; (+) strand; PAM type: NRG; PAM sequence: AAG
ccacttttctgtgccctaat

SEQ ID NO: 46284 - DNA, 20 bp, Artificial Sequence
  Description of Artificial Sequence: Synthetic oligonucleotide
  Target: SCN9A; (+) strand; PAM type: NRG; PAM sequence: AAG
ctaataagcatcttaaaaac

SEQ ID NO: 46285 - DNA, 20 bp, Artificial Sequence
  Description of Artificial Sequence: Synthetic oligonucleotide
  Target: SCN9A; (+) strand; PAM type: NRG; PAM sequence: AGG
taataagcatcttaaaaaca

SEQ ID NO: 46286 - DNA, 20 bp, Artificial Sequence
  Description of Artificial Sequence: Synthetic oligonucleotide
  Target: SCN9A; (+) strand; PAM type: NRG; PAM sequence: TAG
agcatcttaaaaacaaggat

SEQ ID NO: 46287 - DNA, 20 bp, Artificial Sequence
  Description of Artificial Sequence: Synthetic oligonucleotide
  Target: SCN9A; (+) strand; PAM type: NRG; PAM sequence: TGG
taaaaacaaggattagacca

SEQ ID NO: 46288 - DNA, 20 bp, Artificial Sequence
  Description of Artificial Sequence: Synthetic oligonucleotide
  Target: SCN9A; (+) strand; PAM type: NRG; PAM sequence: GGG
aaaaacaaggattagaccat

SEQ ID NO: 46289 - DNA, 20 bp, Artificial Sequence
  Description of Artificial Sequence: Synthetic oligonucleotide
  Target: SCN9A; (+) strand; PAM type: NRG; PAM sequence: TGG
aggattagaccatgggtaat

SEQ ID NO: 46290 - DNA, 20 bp, Artificial Sequence
  Description of Artificial Sequence: Synthetic oligonucleotide
  Target: SCN9A; (+) strand; PAM type: NRG; PAM sequence: TGG
agaccatgggtaattggttt

SEQ ID NO: 46291 - DNA, 20 bp, Artificial Sequence
  Description of Artificial Sequence: Synthetic oligonucleotide
  Target: SCN9A; (+) strand; PAM type: NRG; PAM sequence: CAG
cctaaatacctttcttttca

SEQ ID NO: 46292 - DNA, 20 bp, Artificial Sequence
  Description of Artificial Sequence: Synthetic oligonucleotide
  Target: SCN9A; (+) strand; PAM type: NRG; PAM sequence: GAG
taaatacctttcttttcaca

SEQ ID NO: 46293 - DNA, 20 bp, Artificial Sequence
  Description of Artificial Sequence: Synthetic oligonucleotide
  Target: SCN9A; (+) strand; PAM type: NRG; PAM sequence: AAG
atacctttcttttcacagag

SEQ ID NO: 46294 - DNA, 20 bp, Artificial Sequence
  Description of Artificial Sequence: Synthetic oligonucleotide
  Target: SCN9A; (+) strand; PAM type: NRG; PAM sequence: GAG
agaagatactaaaaaatatt

SEQ ID NO: 46295 - DNA, 20 bp, Artificial Sequence
  Description of Artificial Sequence: Synthetic oligonucleotide
  Target: SCN9A; (+) strand; PAM type: NRG; PAM sequence: TGG
agatactaaaaaatattgag

SEQ ID NO: 46296 - DNA, 20 bp, Artificial Sequence
  Description of Artificial Sequence: Synthetic oligonucleotide
  Target: SCN9A; (+) strand; PAM type: NRG; PAM sequence: TGG
aaaatattgagtggaaaatg

SEQ ID NO: 46297 - DNA, 20 bp, Artificial Sequence
  Description of Artificial Sequence: Synthetic oligonucleotide
  Target: SCN9A; (+) strand; PAM type: NRG; PAM sequence: GAG
tattgagtggaaaatgtggt

SEQ ID NO: 46298 - DNA, 20 bp, Artificial Sequence
  Description of Artificial Sequence: Synthetic oligonucleotide
  Target: SCN9A; (+) strand; PAM type: NRG; PAM sequence: GAG
ttgagtggaaaatgtggtga

SEQ ID NO: 46299 - DNA, 20 bp, Artificial Sequence
  Description of Artificial Sequence: Synthetic oligonucleotide
  Target: SCN9A; (+) strand; PAM type: NRG; PAM sequence: AAG
tggaaaatgtggtgagagcc

SEQ ID NO: 46300 - DNA, 20 bp, Artificial Sequence
  Description of Artificial Sequence: Synthetic oligonucleotide
  Target: SCN9A; (+) strand; PAM type: NRG; PAM sequence: AGG
ggaaaatgtggtgagagcca

SEQ ID NO: 46301 - DNA, 20 bp, Artificial Sequence
  Description of Artificial Sequence: Synthetic oligonucleotide
  Target: SCN9A; (+) strand; PAM type: NRG; PAM sequence: GGG
gaaaatgtggtgagagccaa

SEQ ID NO: 46302 - DNA, 20 bp, Artificial Sequence
  Description of Artificial Sequence: Synthetic oligonucleotide
  Target: SCN9A; (+) strand; PAM type: NRG; PAM sequence: TGG
tttaaattatttgtgattat

SEQ ID NO: 46303 - DNA, 20 bp, Artificial Sequence
  Description of Artificial Sequence: Synthetic oligonucleotide
  Target: SCN9A; (+) strand; PAM type: NRG; PAM sequence: TGG
tgtgattattggctttgatg

SEQ ID NO: 46304 - DNA, 20 bp, Artificial Sequence
  Description of Artificial Sequence: Synthetic oligonucleotide
  Target: SCN9A; (+) strand; PAM type: NRG; PAM sequence: AAG
ttgatgtggcatgttttcac

SEQ ID NO: 46305 - DNA, 20 bp, Artificial Sequence
  Description of Artificial Sequence: Synthetic oligonucleotide
  Target: SCN9A; (+) strand; PAM type: NRG; PAM sequence: AAG
attttatgtcaaaattttgt

SEQ ID NO: 46306 - DNA, 20 bp, Artificial Sequence
  Description of Artificial Sequence: Synthetic oligonucleotide
  Target: SCN9A; (+) strand; PAM type: NRG; PAM sequence: AAG
ttatgtcaaaattttgtaag

SEQ ID NO: 46307 - DNA, 20 bp, Artificial Sequence
  Description of Artificial Sequence: Synthetic oligonucleotide
  Target: SCN9A; (+) strand; PAM type: NRG; PAM sequence: CAG
attttgtaagaagaaatgca

SEQ ID NO: 46308 - DNA, 20 bp, Artificial Sequence
  Description of Artificial Sequence: Synthetic oligonucleotide
  Target: SCN9A; (+) strand; PAM type: NRG; PAM sequence: TGG
tgtaagaagaaatgcacagc

SEQ ID NO: 46309 - DNA, 20 bp, Artificial Sequence
  Description of Artificial Sequence: Synthetic oligonucleotide
  Target: SCN9A; (+) strand; PAM type: NRG; PAM sequence: GGG
gtaagaagaaatgcacagct

SEQ ID NO: 46310 - DNA, 20 bp, Artificial Sequence
  Description of Artificial Sequence: Synthetic oligonucleotide
  Target: SCN9A; (+) strand; PAM type: NRG; PAM sequence: CAG
aagaaatgcacagctgggcg

SEQ ID NO: 46311 - DNA, 20 bp, Artificial Sequence
  Description of Artificial Sequence: Synthetic oligonucleotide
  Target: SCN9A; (+) strand; PAM type: NRG; PAM sequence: TAG
aaatgcacagctgggcgcag

SEQ ID NO: 46312 - DNA, 20 bp, Artificial Sequence
  Description of Artificial Sequence: Synthetic oligonucleotide
  Target: SCN9A; (+) strand; PAM type: NRG; PAM sequence: TAG
gtagctcacgcctgtaattc

SEQ ID NO: 46313 - DNA, 20 bp, Artificial Sequence
  Description of Artificial Sequence: Synthetic oligonucleotide
  Target: SCN9A; (+) strand; PAM type: NRG; PAM sequence: TGG
cgcctgtaattctagcactt

SEQ ID NO: 46314 - DNA, 20 bp, Artificial Sequence
  Description of Artificial Sequence: Synthetic oligonucleotide
  Target: SCN9A; (+) strand; PAM type: NRG; PAM sequence: GGG
gcctgtaattctagcacttt

SEQ ID NO: 46315 - DNA, 20 bp, Artificial Sequence
  Description of Artificial Sequence: Synthetic oligonucleotide
  Target: SCN9A; (+) strand; PAM type: NRG; PAM sequence: GAG
ctgtaattctagcactttgg

SEQ ID NO: 46316 - DNA, 20 bp, Artificial Sequence
  Description of Artificial Sequence: Synthetic oligonucleotide
  Target: SCN9A; (+) strand; PAM type: NRG; PAM sequence: AGG
tgtaattctagcactttggg

SEQ ID NO: 46317 - DNA, 20 bp, Artificial Sequence
  Description of Artificial Sequence: Synthetic oligonucleotide
  Target: SCN9A; (+) strand; PAM type: NRG; PAM sequence: CGG
tctagcactttgggaggcga

SEQ ID NO: 46318 - DNA, 20 bp, Artificial Sequence
  Description of Artificial Sequence: Synthetic oligonucleotide
  Target: SCN9A; (+) strand; PAM type: NRG; PAM sequence: GAG
tagcactttgggaggcgacg

SEQ ID NO: 46319 - DNA, 20 bp, Artificial Sequence
  Description of Artificial Sequence: Synthetic oligonucleotide
  Target: SCN9A; (+) strand; PAM type: NRG; PAM sequence: AGG
agcactttgggaggcgacgg

SEQ ID NO: 46320 - DNA, 20 bp, Artificial Sequence
  Description of Artificial Sequence: Synthetic oligonucleotide
  Target: SCN9A; (+) strand; PAM type: NRG; PAM sequence: TGG
ctttgggaggcgacggaggc

SEQ ID NO: 46321 - DNA, 20 bp, Artificial Sequence
  Description of Artificial Sequence: Synthetic oligonucleotide
  Target: SCN9A; (+) strand; PAM type: NRG; PAM sequence: GAG
cgacggaggctggatcacct

SEQ ID NO: 46322 - DNA, 20 bp, Artificial Sequence
  Description of Artificial Sequence: Synthetic oligonucleotide
  Target: SCN9A; (+) strand; PAM type: NRG; PAM sequence: AGG
gacggaggctggatcacctg

SEQ ID NO: 46323 - DNA, 20 bp, Artificial Sequence
  Description of Artificial Sequence: Synthetic oligonucleotide
  Target: SCN9A; (+) strand; PAM type: NRG; PAM sequence: CAG
gaggctggatcacctgaggt

SEQ ID NO: 46324 - DNA, 20 bp, Artificial Sequence
  Description of Artificial Sequence: Synthetic oligonucleotide
  Target: SCN9A; (+) strand; PAM type: NRG; PAM sequence: AGG
aggctggatcacctgaggtc

SEQ ID NO: 46325 - DNA, 20 bp, Artificial Sequence
  Description of Artificial Sequence: Synthetic oligonucleotide
  Target: SCN9A; (+) strand; PAM type: NRG; PAM sequence: GAG
gctggatcacctgaggtcag

SEQ ID NO: 46326 - DNA, 20 bp, Artificial Sequence
  Description of Artificial Sequence: Synthetic oligonucleotide
  Target: SCN9A; (+) strand; PAM type: NRG; PAM sequence: GAG
tcacctgaggtcaggagttc

SEQ ID NO: 46327 - DNA, 20 bp, Artificial Sequence
  Description of Artificial Sequence: Synthetic oligonucleotide
  Target: SCN9A; (+) strand; PAM type: NRG; PAM sequence: CAG
tgaggtcaggagttcgagac

SEQ ID NO: 46328 - DNA, 20 bp, Artificial Sequence
  Description of Artificial Sequence: Synthetic oligonucleotide
  Target: SCN9A; (+) strand; PAM type: NRG; PAM sequence: TGG
tcaggagttcgagaccagcc

SEQ ID NO: 46329 - DNA, 20 bp, Artificial Sequence
  Description of Artificial Sequence: Synthetic oligonucleotide
  Target: SCN9A; (+) strand; PAM type: NRG; PAM sequence: TAG
tctactaaaaatacaaaaat

SEQ ID NO: 46330 - DNA, 20 bp, Artificial Sequence
  Description of Artificial Sequence: Synthetic oligonucleotide
  Target: SCN9A; (+) strand; PAM type: NRG; PAM sequence: TGG
ctaaaaatacaaaaattagc

SEQ ID NO: 46331 - DNA, 20 bp, Artificial Sequence
  Description of Artificial Sequence: Synthetic oligonucleotide
  Target: SCN9A; (+) strand; PAM type: NRG; PAM sequence: CGG
aatacaaaaattagctggca

SEQ ID NO: 46332 - DNA, 20 bp, Artificial Sequence
  Description of Artificial Sequence: Synthetic oligonucleotide
  Target: SCN9A; (+) strand; PAM type: NRG; PAM sequence: TAG
acaaaaattagctggcacgg

SEQ ID NO: 46333 - DNA, 20 bp, Artificial Sequence
  Description of Artificial Sequence: Synthetic oligonucleotide
  Target: SCN9A; (+) strand; PAM type: NRG; PAM sequence: CAG
gtagcatgcacctgtaatct

SEQ ID NO: 46334 - DNA, 20 bp, Artificial Sequence
  Description of Artificial Sequence: Synthetic oligonucleotide
  Target: SCN9A; (+) strand; PAM type: NRG; PAM sequence: CAG
cacctgtaatctcagctact

SEQ ID NO: 46335 - DNA, 20 bp, Artificial Sequence
  Description of Artificial Sequence: Synthetic oligonucleotide
  Target: SCN9A; (+) strand; PAM type: NRG; PAM sequence: AGG
acctgtaatctcagctactc

SEQ ID NO: 46336 - DNA, 20 bp, Artificial Sequence
  Description of Artificial Sequence: Synthetic oligonucleotide
  Target: SCN9A; (+) strand; PAM type: NRG; PAM sequence: GAG
ctgtaatctcagctactcag

SEQ ID NO: 46337 - DNA, 20 bp, Artificial Sequence
  Description of Artificial Sequence: Synthetic oligonucleotide
  Target: SCN9A; (+) strand; PAM type: NRG; PAM sequence: AGG
tgtaatctcagctactcagg

SEQ ID NO: 46338 - DNA, 20 bp, Artificial Sequence
  Description of Artificial Sequence: Synthetic oligonucleotide
  Target: SCN9A; (+) strand; PAM type: NRG; PAM sequence: GAG
tctcagctactcaggaggct

SEQ ID NO: 46339 - DNA, 20 bp, Artificial Sequence
  Description of Artificial Sequence: Synthetic oligonucleotide
  Target: SCN9A; (+) strand; PAM type: NRG; PAM sequence: AGG
ctcagctactcaggaggctg

SEQ ID NO: 46340 - DNA, 20 bp, Artificial Sequence
  Description of Artificial Sequence: Synthetic oligonucleotide
  Target: SCN9A; (+) strand; PAM type: NRG; PAM sequence: CAG
agctactcaggaggctgagg

SEQ ID NO: 46341 - DNA, 20 bp, Artificial Sequence
  Description of Artificial Sequence: Synthetic oligonucleotide
  Target: SCN9A; (+) strand; PAM type: NRG; PAM sequence: AAG
tactcaggaggctgaggcag

SEQ ID NO: 46342 - DNA, 20 bp, Artificial Sequence
  Description of Artificial Sequence: Synthetic oligonucleotide
  Target: SCN9A; (+) strand; PAM type: NRG; PAM sequence: TGG
gcagaagaattgcttgaacc

SEQ ID NO: 46343 - DNA, 20 bp, Artificial Sequence
  Description of Artificial Sequence: Synthetic oligonucleotide
  Target: SCN9A; (+) strand; PAM type: NRG; PAM sequence: GGG
cagaagaattgcttgaacct

SEQ ID NO: 46344 - DNA, 20 bp, Artificial Sequence
  Description of Artificial Sequence: Synthetic oligonucleotide
  Target: SCN9A; (+) strand; PAM type: NRG; PAM sequence: GAG
gaagaattgcttgaacctgg

SEQ ID NO: 46345 - DNA, 20 bp, Artificial Sequence
  Description of Artificial Sequence: Synthetic oligonucleotide
  Target: SCN9A; (+) strand; PAM type: NRG; PAM sequence: AGG
aagaattgcttgaacctggg

SEQ ID NO: 46346 - DNA, 20 bp, Artificial Sequence
  Description of Artificial Sequence: Synthetic oligonucleotide
  Target: SCN9A; (+) strand; PAM type: NRG; PAM sequence: TGG
aattgcttgaacctgggagg

SEQ ID NO: 46347 - DNA, 20 bp, Artificial Sequence
  Description of Artificial Sequence: Synthetic oligonucleotide
  Target: SCN9A; (+) strand; PAM type: NRG; PAM sequence: GAG
ttgcttgaacctgggaggtg

SEQ ID NO: 46348 - DNA, 20 bp, Artificial Sequence
  Description of Artificial Sequence: Synthetic oligonucleotide
  Target: SCN9A; (+) strand; PAM type: NRG; PAM sequence: AGG
tgcttgaacctgggaggtgg

SEQ ID NO: 46349 - DNA, 20 bp, Artificial Sequence
  Description of Artificial Sequence: Synthetic oligonucleotide
  Target: SCN9A; (+) strand; PAM type: NRG; PAM sequence: TGG
tgaacctgggaggtggaggt

SEQ ID NO: 46350 - DNA, 20 bp, Artificial Sequence
  Description of Artificial Sequence: Synthetic oligonucleotide
  Target: SCN9A; (+) strand; PAM type: NRG; PAM sequence: GGG
gaacctgggaggtggaggtt

SEQ ID NO: 46351 - DNA, 20 bp, Artificial Sequence
  Description of Artificial Sequence: Synthetic oligonucleotide
  Target: SCN9A; (+) strand; PAM type: NRG; PAM sequence: GGG
aacctgggaggtggaggttg

SEQ ID NO: 46352 - DNA, 20 bp, Artificial Sequence
  Description of Artificial Sequence: Synthetic oligonucleotide
  Target: SCN9A; (+) strand; PAM type: NRG; PAM sequence: GAG
tgggaggtggaggttggggt

SEQ ID NO: 46353 - DNA, 20 bp, Artificial Sequence
  Description of Artificial Sequence: Synthetic oligonucleotide
  Target: SCN9A; (+) strand; PAM type: NRG; PAM sequence: GAG
ggtggaggttggggtgagcc

SEQ ID NO: 46354 - DNA, 20 bp, Artificial Sequence
  Description of Artificial Sequence: Synthetic oligonucleotide
  Target: SCN9A; (+) strand; PAM type: NRG; PAM sequence: CAG
gagatcacatcattgcactc

SEQ ID NO: 46355 - DNA, 20 bp, Artificial Sequence
  Description of Artificial Sequence: Synthetic oligonucleotide
  Target: SCN9A; (+) strand; PAM type: NRG; PAM sequence: TGG
cacatcattgcactccagcc

SEQ ID NO: 46356 - DNA, 20 bp, Artificial Sequence
  Description of Artificial Sequence: Synthetic oligonucleotide
  Target: SCN9A; (+) strand; PAM type: NRG; PAM sequence: GGG
acatcattgcactccagcct

SEQ ID NO: 46357 - DNA, 20 bp, Artificial Sequence
  Description of Artificial Sequence: Synthetic oligonucleotide
  Target: SCN9A; (+) strand; PAM type: NRG; PAM sequence: AAG
gcactccagcctgggcaaca

SEQ ID NO: 46358 - DNA, 20 bp, Artificial Sequence
  Description of Artificial Sequence: Synthetic oligonucleotide
  Target: SCN9A; (+) strand; PAM type: NRG; PAM sequence: GAG
tccagcctgggcaacaaagc

SEQ ID NO: 46359 - DNA, 20 bp, Artificial Sequence
  Description of Artificial Sequence: Synthetic oligonucleotide
  Target: SCN9A; (+) strand; PAM type: NRG; PAM sequence: AAG
caaaaaaaaaaaaaatacac

SEQ ID NO: 46360 - DNA, 20 bp, Artificial Sequence
  Description of Artificial Sequence: Synthetic oligonucleotide
  Target: SCN9A; (+) strand; PAM type: NRG; PAM sequence: TAG
tacacaagcaaatcctgcta

SEQ ID NO: 46361 - DNA, 20 bp, Artificial Sequence
  Description of Artificial Sequence: Synthetic oligonucleotide
  Target: SCN9A; (+) strand; PAM type: NRG; PAM sequence: AGG
acacaagcaaatcctgctat

SEQ ID NO: 46362 - DNA, 20 bp, Artificial Sequence
  Description of Artificial Sequence: Synthetic oligonucleotide
  Target: SCN9A; (+) strand; PAM type: NRG; PAM sequence: GAG
acaagcaaatcctgctatag

SEQ ID NO: 46363 - DNA, 20 bp, Artificial Sequence
  Description of Artificial Sequence: Synthetic oligonucleotide
  Target: SCN9A; (+) strand; PAM type: NRG; PAM sequence: CAG
aggagcttataaatacaaaa

SEQ ID NO: 46364 - DNA, 20 bp, Artificial Sequence
  Description of Artificial Sequence: Synthetic oligonucleotide
  Target: SCN9A; (+) strand; PAM type: NRG; PAM sequence: GAG
gagcttataaatacaaaaca

SEQ ID NO: 46365 - DNA, 20 bp, Artificial Sequence
  Description of Artificial Sequence: Synthetic oligonucleotide
  Target: SCN9A; (+) strand; PAM type: NRG; PAM sequence: AAG
cttataaatacaaaacagag

SEQ ID NO: 46366 - DNA, 20 bp, Artificial Sequence
  Description of Artificial Sequence: Synthetic oligonucleotide
  Target: SCN9A; (+) strand; PAM type: NRG; PAM sequence: AAG
ataaatacaaaacagagaag

SEQ ID NO: 46367 - DNA, 20 bp, Artificial Sequence
  Description of Artificial Sequence: Synthetic oligonucleotide
  Target: SCN9A; (+) strand; PAM type: NRG; PAM sequence: AAG
aaaacagagaagaagaaaca

SEQ ID NO: 46368 - DNA, 20 bp, Artificial Sequence
  Description of Artificial Sequence: Synthetic oligonucleotide
  Target: SCN9A; (+) strand; PAM type: NRG; PAM sequence: GAG
aacagagaagaagaaacaaa

SEQ ID NO: 46369 - DNA, 20 bp, Artificial Sequence
  Description of Artificial Sequence: Synthetic oligonucleotide
  Target: SCN9A; (+) strand; PAM type: NRG; PAM sequence: TGG
atgtgcatttcattccatat

SEQ ID NO: 46370 - DNA, 20 bp, Artificial Sequence
  Description of Artificial Sequence: Synthetic oligonucleotide
  Target: SCN9A; (+) strand; PAM type: NRG; PAM sequence: AAG
tgcatttcattccatattgg

SEQ ID NO: 46371 - DNA, 20 bp, Artificial Sequence
  Description of Artificial Sequence: Synthetic oligonucleotide
  Target: SCN9A; (+) strand; PAM type: NRG; PAM sequence: AGG
gcatttcattccatattgga

SEQ ID NO: 46372 - DNA, 20 bp, Artificial Sequence
  Description of Artificial Sequence: Synthetic oligonucleotide
  Target: SCN9A; (+) strand; PAM type: NRG; PAM sequence: AAG
ccatattggaaggaatttgt

SEQ ID NO: 46373 - DNA, 20 bp, Artificial Sequence
  Description of Artificial Sequence: Synthetic oligonucleotide
  Target: SCN9A; (+) strand; PAM type: NRG; PAM sequence: AGG
catattggaaggaatttgta

SEQ ID NO: 46374 - DNA, 20 bp, Artificial Sequence
  Description of Artificial Sequence: Synthetic oligonucleotide
  Target: SCN9A; (+) strand; PAM type: NRG; PAM sequence: TAG
tttgtaaggctatataaaac

SEQ ID NO: 46375 - DNA, 20 bp, Artificial Sequence
  Description of Artificial Sequence: Synthetic oligonucleotide
  Target: SCN9A; (+) strand; PAM type: NRG; PAM sequence: AGG
ttgtaaggctatataaaact

SEQ ID NO: 46376 - DNA, 20 bp, Artificial Sequence
  Description of Artificial Sequence: Synthetic oligonucleotide
  Target: SCN9A; (+) strand; PAM type: NRG; PAM sequence: AAG
taaggctatataaaactagg

SEQ ID NO: 46377 - DNA, 20 bp, Artificial Sequence
  Description of Artificial Sequence: Synthetic oligonucleotide
  Target: SCN9A; (+) strand; PAM type: NRG; PAM sequence: GAG
cttatttattactacaactt

SEQ ID NO: 46378 - DNA, 20 bp, Artificial Sequence
  Description of Artificial Sequence: Synthetic oligonucleotide
  Target: SCN9A; (+) strand; PAM type: NRG; PAM sequence: AGG
ttatttattactacaacttg

SEQ ID NO: 46379 - DNA, 20 bp, Artificial Sequence
  Description of Artificial Sequence: Synthetic oligonucleotide
  Target: SCN9A; (+) strand; PAM type: NRG; PAM sequence: GGG
tatttattactacaacttga

SEQ ID NO: 46380 - DNA, 20 bp, Artificial Sequence
  Description of Artificial Sequence: Synthetic oligonucleotide
  Target: SCN9A; (+) strand; PAM type: NRG; PAM sequence: TAG
ttgagggtgatcaacaatta

SEQ ID NO: 46381 - DNA, 20 bp, Artificial Sequence
  Description of Artificial Sequence: Synthetic oligonucleotide
  Target: SCN9A; (+) strand; PAM type: NRG; PAM sequence: TGG
ggtgatcaacaattatagaa

SEQ ID NO: 46382 - DNA, 20 bp, Artificial Sequence
  Description of Artificial Sequence: Synthetic oligonucleotide
  Target: SCN9A; (+) strand; PAM type: NRG; PAM sequence: CAG
acaattatagaatggtaatc

SEQ ID NO: 46383 - DNA, 20 bp, Artificial Sequence
  Description of Artificial Sequence: Synthetic oligonucleotide
  Target: SCN9A; (+) strand; PAM type: NRG; PAM sequence: AGG
caattatagaatggtaatcc

SEQ ID NO: 46384 - DNA, 20 bp, Artificial Sequence
  Description of Artificial Sequence: Synthetic oligonucleotide
  Target: SCN9A; (+) strand; PAM type: NRG; PAM sequence: CAG
caggatgtatattttttgtg

SEQ ID NO: 46385 - DNA, 20 bp, Artificial Sequence
  Description of Artificial Sequence: Synthetic oligonucleotide
  Target: SCN9A; (+) strand; PAM type: NRG; PAM sequence: TAG
ttttttgtgcagtaaaaatc

SEQ ID NO: 46386 - DNA, 20 bp, Artificial Sequence
  Description of Artificial Sequence: Synthetic oligonucleotide
  Target: SCN9A; (+) strand; PAM type: NRG; PAM sequence: TGG
taaatgcctttgtgtatgtc

SEQ ID NO: 46387 - DNA, 20 bp, Artificial Sequence
  Description of Artificial Sequence: Synthetic oligonucleotide
  Target: SCN9A; (+) strand; PAM type: NRG; PAM sequence: CAG
gcctttgtgtatgtctggca

SEQ ID NO: 46388 - DNA, 20 bp, Artificial Sequence
  Description of Artificial Sequence: Synthetic oligonucleotide
  Target: SCN9A; (+) strand; PAM type: NRG; PAM sequence: TAG
atgtctggcacagtatcatt

SEQ ID NO: 46389 - DNA, 20 bp, Artificial Sequence
  Description of Artificial Sequence: Synthetic oligonucleotide
  Target: SCN9A; (+) strand; PAM type: NRG; PAM sequence: TGG
agtatcatttagtgtgtgac

SEQ ID NO: 46390 - DNA, 20 bp, Artificial Sequence
  Description of Artificial Sequence: Synthetic oligonucleotide
  Target: SCN9A; (+) strand; PAM type: NRG; PAM sequence: AAG
gtgtgtgactggatgaatgt

SEQ ID NO: 46391 - DNA, 20 bp, Artificial Sequence
  Description of Artificial Sequence: Synthetic oligonucleotide
  Target: SCN9A; (+) strand; PAM type: NRG; PAM sequence: TGG
acttctgaatcctcttttta

SEQ ID NO: 46392 - DNA, 20 bp, Artificial Sequence
  Description of Artificial Sequence: Synthetic oligonucleotide
  Target: SCN9A; (+) strand; PAM type: NRG; PAM sequence: TGG
tctgaatcctctttttatgg

SEQ ID NO: 46393 - DNA, 20 bp, Artificial Sequence
  Description of Artificial Sequence: Synthetic oligonucleotide
  Target: SCN9A; (+) strand; PAM type: NRG; PAM sequence: AAG
cctctttttatggtggttac

SEQ ID NO: 46394 - DNA, 20 bp, Artificial Sequence
  Description of Artificial Sequence: Synthetic oligonucleotide
  Target: SCN9A; (+) strand; PAM type: NRG; PAM sequence: AGG
ctctttttatggtggttaca

SEQ ID NO: 46395 - DNA, 20 bp, Artificial Sequence
  Description of Artificial Sequence: Synthetic oligonucleotide
  Target: SCN9A; (+) strand; PAM type: NRG; PAM sequence: TAG
ttacaaggacaacaatattt

SEQ ID NO: 46396 - DNA, 20 bp, Artificial Sequence
  Description of Artificial Sequence: Synthetic oligonucleotide
  Target: SCN9A; (+) strand; PAM type: NRG; PAM sequence: CAG
tttagtaatttttttcaact

SEQ ID NO: 46397 - DNA, 20 bp, Artificial Sequence
  Description of Artificial Sequence: Synthetic oligonucleotide
  Target: SCN9A; (+) strand; PAM type: NRG; PAM sequence: TGG
agtaatttttttcaactcag

SEQ ID NO: 46398 - DNA, 20 bp, Artificial Sequence
  Description of Artificial Sequence: Synthetic oligonucleotide
  Target: SCN9A; (+) strand; PAM type: NRG; PAM sequence: GGG
gtaatttttttcaactcagt

SEQ ID NO: 46399 - DNA, 20 bp, Artificial Sequence
  Description of Artificial Sequence: Synthetic oligonucleotide
  Target: SCN9A; (+) strand; PAM type: NRG; PAM sequence: AAG
atttttttcaactcagtggg

SEQ ID NO: 46400 - DNA, 20 bp, Artificial Sequence
  Description of Artificial Sequence: Synthetic oligonucleotide
  Target: SCN9A; (+) strand; PAM type: NRG; PAM sequence: AAG
tttcaactcagtgggaagtg

SEQ ID NO: 46401 - DNA, 20 bp, Artificial Sequence
  Description of Artificial Sequence: Synthetic oligonucleotide
  Target: SCN9A; (+) strand; PAM type: NRG; PAM sequence: AGG
ttcaactcagtgggaagtga

SEQ ID NO: 46402 - DNA, 20 bp, Artificial Sequence
  Description of Artificial Sequence: Synthetic oligonucleotide
  Target: SCN9A; (+) strand; PAM type: NRG; PAM sequence: TGG
aagtgaaggcacttaccata

SEQ ID NO: 46403 - DNA, 20 bp, Artificial Sequence
  Description of Artificial Sequence: Synthetic oligonucleotide
  Target: SCN9A; (+) strand; PAM type: NRG; PAM sequence: TGG
tgttaccatatcccaccttc

SEQ ID NO: 46404 - DNA, 20 bp, Artificial Sequence
  Description of Artificial Sequence: Synthetic oligonucleotide
  Target: SCN9A; (+) strand; PAM type: NRG; PAM sequence: GAG
ccaccttctggatacctgat

SEQ ID NO: 46405 - DNA, 20 bp, Artificial Sequence
  Description of Artificial Sequence: Synthetic oligonucleotide
  Target: SCN9A; (+) strand; PAM type: NRG; PAM sequence: GAG
accttctggatacctgatga

SEQ ID NO: 46406 - DNA, 20 bp, Artificial Sequence
  Description of Artificial Sequence: Synthetic oligonucleotide
  Target: SCN9A; (+) strand; PAM type: NRG; PAM sequence: AAG
ctgatgagagatttgatgtc

SEQ ID NO: 46407 - DNA, 20 bp, Artificial Sequence
  Description of Artificial Sequence: Synthetic oligonucleotide
  Target: SCN9A; (+) strand; PAM type: NRG; PAM sequence: AAG
tcaagctgaccaactgtgac

SEQ ID NO: 46408 - DNA, 20 bp, Artificial Sequence
  Description of Artificial Sequence: Synthetic oligonucleotide
  Target: SCN9A; (+) strand; PAM type: NRG; PAM sequence: TGG
ccaactgtgacaagtcaacg

SEQ ID NO: 46409 - DNA, 20 bp, Artificial Sequence
  Description of Artificial Sequence: Synthetic oligonucleotide
  Target: SCN9A; (+) strand; PAM type: NRG; PAM sequence: CAG
actgtgacaagtcaacgtgg

SEQ ID NO: 46410 - DNA, 20 bp, Artificial Sequence
  Description of Artificial Sequence: Synthetic oligonucleotide
  Target: SCN9A; (+) strand; PAM type: NRG; PAM sequence: GAG
caagtcaacgtggcagattt

SEQ ID NO: 46411 - DNA, 20 bp, Artificial Sequence
  Description of Artificial Sequence: Synthetic oligonucleotide
  Target: SCN9A; (+) strand; PAM type: NRG; PAM sequence: GAG
acgtggcagatttgagaatt

SEQ ID NO: 46412 - DNA, 20 bp, Artificial Sequence
  Description of Artificial Sequence: Synthetic oligonucleotide
  Target: SCN9A; (+) strand; PAM type: NRG; PAM sequence: GAG
gcagatttgagaattgagat

SEQ ID NO: 46413 - DNA, 20 bp, Artificial Sequence
  Description of Artificial Sequence: Synthetic oligonucleotide
  Target: SCN9A; (+) strand; PAM type: NRG; PAM sequence: TGG
gatttgagaattgagatgag

SEQ ID NO: 46414 - DNA, 20 bp, Artificial Sequence
  Description of Artificial Sequence: Synthetic oligonucleotide
  Target: SCN9A; (+) strand; PAM type: NRG; PAM sequence: TAG
gaattgagatgagtggctca

SEQ ID NO: 46415 - DNA, 20 bp, Artificial Sequence
  Description of Artificial Sequence: Synthetic oligonucleotide
  Target: SCN9A; (+) strand; PAM type: NRG; PAM sequence: AAG
ttgagatgagtggctcatag

SEQ ID NO: 46416 - DNA, 20 bp, Artificial Sequence
  Description of Artificial Sequence: Synthetic oligonucleotide
  Target: SCN9A; (+) strand; PAM type: NRG; PAM sequence: GAG
gagatgagtggctcatagaa

SEQ ID NO: 46417 - DNA, 20 bp, Artificial Sequence
  Description of Artificial Sequence: Synthetic oligonucleotide
  Target: SCN9A; (+) strand; PAM type: NRG; PAM sequence: AAG
cccaattttctcctgcttgt

SEQ ID NO: 46418 - DNA, 20 bp, Artificial Sequence
  Description of Artificial Sequence: Synthetic oligonucleotide
  Target: SCN9A; (+) strand; PAM type: NRG; PAM sequence: AAG
tctcctgcttgtaagcttga

SEQ ID NO: 46419 - DNA, 20 bp, Artificial Sequence
  Description of Artificial Sequence: Synthetic oligonucleotide
  Target: SCN9A; (+) strand; PAM type: NRG; PAM sequence: CAG
gcttgaaagttttcactaat

SEQ ID NO: 46420 - DNA, 20 bp, Artificial Sequence
  Description of Artificial Sequence: Synthetic oligonucleotide
  Target: SCN9A; (+) strand; PAM type: NRG; PAM sequence: AAG
aagttttcactaatcagtat

SEQ ID NO: 46421 - DNA, 20 bp, Artificial Sequence
  Description of Artificial Sequence: Synthetic oligonucleotide
  Target: SCN9A; (+) strand; PAM type: NRG; PAM sequence: AGG
agttttcactaatcagtata

SEQ ID NO: 46422 - DNA, 20 bp, Artificial Sequence
  Description of Artificial Sequence: Synthetic oligonucleotide
  Target: SCN9A; (+) strand; PAM type: NRG; PAM sequence: AAG
tttcactaatcagtataagg

SEQ ID NO: 46423 - DNA, 20 bp, Artificial Sequence
  Description of Artificial Sequence: Synthetic oligonucleotide
  Target: SCN9A; (+) strand; PAM type: NRG; PAM sequence: AAG
gaagaaaaaaaataaaaaaa

SEQ ID NO: 46424 - DNA, 20 bp, Artificial Sequence
  Description of Artificial Sequence: Synthetic oligonucleotide
  Target: SCN9A; (+) strand; PAM type: NRG; PAM sequence: AAG
aaaaaataaaaaaaaagtac

SEQ ID NO: 46425 - DNA, 20 bp, Artificial Sequence
  Description of Artificial Sequence: Synthetic oligonucleotide
  Target: SCN9A; (+) strand; PAM type: NRG; PAM sequence: AAG
ataaaaaaaaagtacaagcc

SEQ ID NO: 46426 - DNA, 20 bp, Artificial Sequence
  Description of Artificial Sequence: Synthetic oligonucleotide
  Target: SCN9A; (+) strand; PAM type: NRG; PAM sequence: AAG
caagaaaacactaattcaaa

SEQ ID NO: 46427 - DNA, 20 bp, Artificial Sequence
  Description of Artificial Sequence: Synthetic oligonucleotide
  Target: SCN9A; (+) strand; PAM type: NRG; PAM sequence: TAG
gaaaacactaattcaaaaag

SEQ ID NO: 46428 - DNA, 20 bp, Artificial Sequence
  Description of Artificial Sequence: Synthetic oligonucleotide
  Target: SCN9A; (+) strand; PAM type: NRG; PAM sequence: AGG
aaaacactaattcaaaaagt

SEQ ID NO: 46429 - DNA, 20 bp, Artificial Sequence
  Description of Artificial Sequence: Synthetic oligonucleotide
  Target: SCN9A; (+) strand; PAM type: NRG; PAM sequence: CAG
acactaattcaaaaagtagg

SEQ ID NO: 46430 - DNA, 20 bp, Artificial Sequence
  Description of Artificial Sequence: Synthetic oligonucleotide
  Target: SCN9A; (+) strand; PAM type: NRG; PAM sequence: TAG
gctatgtccacgcgatgcta

SEQ ID NO: 46431 - DNA, 20 bp, Artificial Sequence
  Description of Artificial Sequence: Synthetic oligonucleotide
  Target: SCN9A; (+) strand; PAM type: NRG; PAM sequence: AGG
ctatgtccacgcgatgctat

SEQ ID NO: 46432 - DNA, 20 bp, Artificial Sequence
  Description of Artificial Sequence: Synthetic oligonucleotide
  Target: SCN9A; (+) strand; PAM type: NRG; PAM sequence: CAG
gtccacgcgatgctataggc

SEQ ID NO: 46433 - DNA, 20 bp, Artificial Sequence
  Description of Artificial Sequence: Synthetic oligonucleotide
  Target: SCN9A; (+) strand; PAM type: NRG; PAM sequence: TGG
cacgcgatgctataggccag

SEQ ID NO: 46434 - DNA, 20 bp, Artificial Sequence
  Description of Artificial Sequence: Synthetic oligonucleotide
  Target: SCN9A; (+) strand; PAM type: NRG; PAM sequence: TGG
cgatgctataggccagtggc

SEQ ID NO: 46435 - DNA, 20 bp, Artificial Sequence
  Description of Artificial Sequence: Synthetic oligonucleotide
  Target: SCN9A; (+) strand; PAM type: NRG; PAM sequence: AAG
ggctggaaaactttttcgta

SEQ ID NO: 46436 - DNA, 20 bp, Artificial Sequence
  Description of Artificial Sequence: Synthetic oligonucleotide
  Target: SCN9A; (+) strand; PAM type: NRG; PAM sequence: AGG
gctggaaaactttttcgtaa

SEQ ID NO: 46437 - DNA, 20 bp, Artificial Sequence
  Description of Artificial Sequence: Synthetic oligonucleotide
  Target: SCN9A; (+) strand; PAM type: NRG; PAM sequence: GGG
ctggaaaactttttcgtaaa

SEQ ID NO: 46438 - DNA, 20 bp, Artificial Sequence
  Description of Artificial Sequence: Synthetic oligonucleotide
  Target: SCN9A; (+) strand; PAM type: NRG; PAM sequence: TAG
gggccaaatgataaatattt

SEQ ID NO: 46439 - DNA, 20 bp, Artificial Sequence
  Description of Artificial Sequence: Synthetic oligonucleotide
  Target: SCN9A; (+) strand; PAM type: NRG; PAM sequence: TGG
ataaatattttagactttat

SEQ ID NO: 46440 - DNA, 20 bp, Artificial Sequence
  Description of Artificial Sequence: Synthetic oligonucleotide
  Target: SCN9A; (+) strand; PAM type: NRG; PAM sequence: GGG
taaatattttagactttatt

SEQ ID NO: 46441 - DNA, 20 bp, Artificial Sequence
  Description of Artificial Sequence: Synthetic oligonucleotide
  Target: SCN9A; (+) strand; PAM type: NRG; PAM sequence: TGG
tattgggcatacgatttcta

SEQ ID NO: 46442 - DNA, 20 bp, Artificial Sequence
  Description of Artificial Sequence: Synthetic oligonucleotide
  Target: SCN9A; (+) strand; PAM type: NRG; PAM sequence: CAG
tgggcatacgatttctatgg

SEQ ID NO: 46443 - DNA, 20 bp, Artificial Sequence
  Description of Artificial Sequence: Synthetic oligonucleotide
  Target: SCN9A; (+) strand; PAM type: NRG; PAM sequence: AAG
cctctgccactgtaatgtaa

SEQ ID NO: 46444 - DNA, 20 bp, Artificial Sequence
  Description of Artificial Sequence: Synthetic oligonucleotide
  Target: SCN9A; (+) strand; PAM type: NRG; PAM sequence: CAG
ctgccactgtaatgtaaaag

SEQ ID NO: 46445 - DNA, 20 bp, Artificial Sequence
  Description of Artificial Sequence: Synthetic oligonucleotide
  Target: SCN9A; (+) strand; PAM type: NRG; PAM sequence: TAG
ctgtaatgtaaaagcagtca

SEQ ID NO: 46446 - DNA, 20 bp, Artificial Sequence
  Description of Artificial Sequence: Synthetic oligonucleotide
  Target: SCN9A; (+) strand; PAM type: NRG; PAM sequence: AAG
taatgtaaaagcagtcatag

SEQ ID NO: 46447 - DNA, 20 bp, Artificial Sequence
  Description of Artificial Sequence: Synthetic oligonucleotide
  Target: SCN9A; (+) strand; PAM type: NRG; PAM sequence: AAG
gacattcctatgtttgaata

SEQ ID NO: 46448 - DNA, 20 bp, Artificial Sequence
  Description of Artificial Sequence: Synthetic oligonucleotide
  Target: SCN9A; (+) strand; PAM type: NRG; PAM sequence: TAG
aaaaatgtaaaaatcattct

SEQ ID NO: 46449 - DNA, 20 bp, Artificial Sequence
  Description of Artificial Sequence: Synthetic oligonucleotide
  Target: SCN9A; (+) strand; PAM type: NRG; PAM sequence: CAG
taaaaatcattcttagctcc

SEQ ID NO: 46450 - DNA, 20 bp, Artificial Sequence
  Description of Artificial Sequence: Synthetic oligonucleotide
  Target: SCN9A; (+) strand; PAM type: NRG; PAM sequence: AGG
aaaaatcattcttagctccc

SEQ ID NO: 46451 - DNA, 20 bp, Artificial Sequence
  Description of Artificial Sequence: Synthetic oligonucleotide
  Target: SCN9A; (+) strand; PAM type: NRG; PAM sequence: GGG
aaaatcattcttagctccca

SEQ ID NO: 46452 - DNA, 20 bp, Artificial Sequence
  Description of Artificial Sequence: Synthetic oligonucleotide
  Target: SCN9A; (+) strand; PAM type: NRG; PAM sequence: CAG
ctcccagggccacacaataa

SEQ ID NO: 46453 - DNA, 20 bp, Artificial Sequence
  Description of Artificial Sequence: Synthetic oligonucleotide
  Target: SCN9A; (+) strand; PAM type: NRG; PAM sequence: AGG
tcccagggccacacaataac

SEQ ID NO: 46454 - DNA, 20 bp, Artificial Sequence
  Description of Artificial Sequence: Synthetic oligonucleotide
  Target: SCN9A; (+) strand; PAM type: NRG; PAM sequence: TGG
ggccacacaataacaggcat

SEQ ID NO: 46455 - DNA, 20 bp, Artificial Sequence
  Description of Artificial Sequence: Synthetic oligonucleotide
  Target: SCN9A; (+) strand; PAM type: NRG; PAM sequence: TGG
cacaataacaggcattggac

SEQ ID NO: 46456 - DNA, 20 bp, Artificial Sequence
  Description of Artificial Sequence: Synthetic oligonucleotide
  Target: SCN9A; (+) strand; PAM type: NRG; PAM sequence: TGG
aacaggcattggactggctt

SEQ ID NO: 46457 - DNA, 20 bp, Artificial Sequence
  Description of Artificial Sequence: Synthetic oligonucleotide
  Target: SCN9A; (+) strand; PAM type: NRG; PAM sequence: TGG
attggactggctttggtctg

SEQ ID NO: 46458 - DNA, 20 bp, Artificial Sequence
  Description of Artificial Sequence: Synthetic oligonucleotide
  Target: SCN9A; (+) strand; PAM type: NRG; PAM sequence: GGG
ttggactggctttggtctgt

SEQ ID NO: 46459 - DNA, 20 bp, Artificial Sequence
  Description of Artificial Sequence: Synthetic oligonucleotide
  Target: SCN9A; (+) strand; PAM type: NRG; PAM sequence: GGG
tggactggctttggtctgtg

SEQ ID NO: 46460 - DNA, 20 bp, Artificial Sequence
  Description of Artificial Sequence: Synthetic oligonucleotide
  Target: SCN9A; (+) strand; PAM type: NRG; PAM sequence: TAG
tggctttggtctgtggggca

SEQ ID NO: 46461 - DNA, 20 bp, Artificial Sequence
  Description of Artificial Sequence: Synthetic oligonucleotide
  Target: SCN9A; (+) strand; PAM type: NRG; PAM sequence: AGG
ggctttggtctgtggggcat

SEQ ID NO: 46462 - DNA, 20 bp, Artificial Sequence
  Description of Artificial Sequence: Synthetic oligonucleotide
  Target: SCN9A; (+) strand; PAM type: NRG; PAM sequence: TAG
ataggtgctgatccttgcta

SEQ ID NO: 46463 - DNA, 20 bp, Artificial Sequence
  Description of Artificial Sequence: Synthetic oligonucleotide
  Target: SCN9A; (+) strand; PAM type: NRG; PAM sequence: GAG
aggtgctgatccttgctata

SEQ ID NO: 46464 - DNA, 20 bp, Artificial Sequence
  Description of Artificial Sequence: Synthetic oligonucleotide
  Target: SCN9A; (+) strand; PAM type: NRG; PAM sequence: AGG
ggtgctgatccttgctatag

SEQ ID NO: 46465 - DNA, 20 bp, Artificial Sequence
  Description of Artificial Sequence: Synthetic oligonucleotide
  Target: SCN9A; (+) strand; PAM type: NRG; PAM sequence: TAG
ctgatccttgctatagaggc

SEQ ID NO: 46466 - DNA, 20 bp, Artificial Sequence
  Description of Artificial Sequence: Synthetic oligonucleotide
  Target: SCN9A; (+) strand; PAM type: NRG; PAM sequence: TGG
atagaggctagtcttacaca

SEQ ID NO: 46467 - DNA, 20 bp, Artificial Sequence
  Description of Artificial Sequence: Synthetic oligonucleotide
  Target: SCN9A; (+) strand; PAM type: NRG; PAM sequence: AAG
ctagtcttacacatggctat

SEQ ID NO: 46468 - DNA, 20 bp, Artificial Sequence
  Description of Artificial Sequence: Synthetic oligonucleotide
  Target: SCN9A; (+) strand; PAM type: NRG; PAM sequence: AGG
tagtcttacacatggctata

SEQ ID NO: 46469 - DNA, 20 bp, Artificial Sequence
  Description of Artificial Sequence: Synthetic oligonucleotide
  Target: SCN9A; (+) strand; PAM type: NRG; PAM sequence: CGG
ttacacatggctataaggtg

SEQ ID NO: 46470 - DNA, 20 bp, Artificial Sequence
  Description of Artificial Sequence: Synthetic oligonucleotide
  Target: SCN9A; (+) strand; PAM type: NRG; PAM sequence: GGG
tacacatggctataaggtgc

SEQ ID NO: 46471 - DNA, 20 bp, Artificial Sequence
  Description of Artificial Sequence: Synthetic oligonucleotide
  Target: SCN9A; (+) strand; PAM type: NRG; PAM sequence: CAG
atggctataaggtgcgggac

SEQ ID NO: 46472 - DNA, 20 bp, Artificial Sequence
  Description of Artificial Sequence: Synthetic oligonucleotide
  Target: SCN9A; (+) strand; PAM type: NRG; PAM sequence: TGG
accagtcctttcatttgcct

SEQ ID NO: 46473 - DNA, 20 bp, Artificial Sequence
  Description of Artificial Sequence: Synthetic oligonucleotide
  Target: SCN9A; (+) strand; PAM type: NRG; PAM sequence: TAG
cttaattatattttatttac

SEQ ID NO: 46474 - DNA, 20 bp, Artificial Sequence
  Description of Artificial Sequence: Synthetic oligonucleotide
  Target: SCN9A; (+) strand; PAM type: NRG; PAM sequence: TAG
ttatattttatttactagta

SEQ ID NO: 46475 - DNA, 20 bp, Artificial Sequence
  Description of Artificial Sequence: Synthetic oligonucleotide
  Target: SCN9A; (+) strand; PAM type: NRG; PAM sequence: AAG
ttatttactagtatagcttc

SEQ ID NO: 46476 - DNA, 20 bp, Artificial Sequence
  Description of Artificial Sequence: Synthetic oligonucleotide
  Target: SCN9A; (+) strand; PAM type: NRG; PAM sequence: GAG
atttactagtatagcttcaa

SEQ ID NO: 46477 - DNA, 20 bp, Artificial Sequence
  Description of Artificial Sequence: Synthetic oligonucleotide
  Target: SCN9A; (+) strand; PAM type: NRG; PAM sequence: GAG
ttactagtatagcttcaaga

SEQ ID NO: 46478 - DNA, 20 bp, Artificial Sequence
  Description of Artificial Sequence: Synthetic oligonucleotide
  Target: SCN9A; (+) strand; PAM type: NRG; PAM sequence: TAG
tatgccatcactttcaaaat

SEQ ID NO: 46479 - DNA, 20 bp, Artificial Sequence
  Description of Artificial Sequence: Synthetic oligonucleotide
  Target: SCN9A; (+) strand; PAM type: NRG; PAM sequence: GAG
tgccatcactttcaaaatta

SEQ ID NO: 46480 - DNA, 20 bp, Artificial Sequence
  Description of Artificial Sequence: Synthetic oligonucleotide
  Target: SCN9A; (+) strand; PAM type: NRG; PAM sequence: AAG
cactttcaaaattagagaaa

SEQ ID NO: 46481 - DNA, 20 bp, Artificial Sequence
  Description of Artificial Sequence: Synthetic oligonucleotide
  Target: SCN9A; (+) strand; PAM type: NRG; PAM sequence: TAG
ttcaaaattagagaaaaaga

SEQ ID NO: 46482 - DNA, 20 bp, Artificial Sequence
  Description of Artificial Sequence: Synthetic oligonucleotide
  Target: SCN9A; (+) strand; PAM type: NRG; PAM sequence: TAG
aacctttgccttaaaatgaa

SEQ ID NO: 46483 - DNA, 20 bp, Artificial Sequence
  Description of Artificial Sequence: Synthetic oligonucleotide
  Target: SCN9A; (+) strand; PAM type: NRG; PAM sequence: AGG
acctttgccttaaaatgaat

SEQ ID NO: 46484 - DNA, 20 bp, Artificial Sequence
  Description of Artificial Sequence: Synthetic oligonucleotide
  Target: SCN9A; (+) strand; PAM type: NRG; PAM sequence: CAG
tttgccttaaaatgaatagg

SEQ ID NO: 46485 - DNA, 20 bp, Artificial Sequence
  Description of Artificial Sequence: Synthetic oligonucleotide
  Target: SCN9A; (+) strand; PAM type: NRG; PAM sequence: TGG
gattttgaaaaatataaata

SEQ ID NO: 46486 - DNA, 20 bp, Artificial Sequence
  Description of Artificial Sequence: Synthetic oligonucleotide
  Target: SCN9A; (+) strand; PAM type: NRG; PAM sequence: GGG
attttgaaaaatataaatat

SEQ ID NO: 46487 - DNA, 20 bp, Artificial Sequence
  Description of Artificial Sequence: Synthetic oligonucleotide
  Target: SCN9A; (+) strand; PAM type: NRG; PAM sequence: TGG
aaatataaatatgggttatt

SEQ ID NO: 46488 - DNA, 20 bp, Artificial Sequence
  Description of Artificial Sequence: Synthetic oligonucleotide
  Target: SCN9A; (+) strand; PAM type: NRG; PAM sequence: TAG
ataaatatgggttatttggc

SEQ ID NO: 46489 - DNA, 20 bp, Artificial Sequence
  Description of Artificial Sequence: Synthetic oligonucleotide
  Target: SCN9A; (+) strand; PAM type: NRG; PAM sequence: AGG
taaatatgggttatttggct

SEQ ID NO: 46490 - DNA, 20 bp, Artificial Sequence
  Description of Artificial Sequence: Synthetic oligonucleotide
  Target: SCN9A; (+) strand; PAM type: NRG; PAM sequence: TAG
tcttttgcaattaataattg

SEQ ID NO: 46491 - DNA, 20 bp, Artificial Sequence
  Description of Artificial Sequence: Synthetic oligonucleotide
  Target: SCN9A; (+) strand; PAM type: NRG; PAM sequence: TAG
ttataaaattataaaaataa

SEQ ID NO: 46492 - DNA, 20 bp, Artificial Sequence
  Description of Artificial Sequence: Synthetic oligonucleotide
  Target: SCN9A; (+) strand; PAM type: NRG; PAM sequence: CAG
tcatcacaaaataatttcca

SEQ ID NO: 46493 - DNA, 20 bp, Artificial Sequence
  Description of Artificial Sequence: Synthetic oligonucleotide
  Target: SCN9A; (+) strand; PAM type: NRG; PAM sequence: GAG
atcacaaaataatttccaca

SEQ ID NO: 46494 - DNA, 20 bp, Artificial Sequence
  Description of Artificial Sequence: Synthetic oligonucleotide
  Target: SCN9A; (+) strand; PAM type: NRG; PAM sequence: TGG
aattaaaatgcatgaacatc

SEQ ID NO: 46495 - DNA, 20 bp, Artificial Sequence
  Description of Artificial Sequence: Synthetic oligonucleotide
  Target: SCN9A; (+) strand; PAM type: NRG; PAM sequence: CAG
aacatctggttacataccac

SEQ ID NO: 46496 - DNA, 20 bp, Artificial Sequence
  Description of Artificial Sequence: Synthetic oligonucleotide
  Target: SCN9A; (+) strand; PAM type: NRG; PAM sequence: AGG
acatctggttacataccacc

SEQ ID NO: 46497 - DNA, 20 bp, Artificial Sequence
  Description of Artificial Sequence: Synthetic oligonucleotide
  Target: SCN9A; (+) strand; PAM type: NRG; PAM sequence: AAG
atgaccatcatgtaaacaat

SEQ ID NO: 46498 - DNA, 20 bp, Artificial Sequence
  Description of Artificial Sequence: Synthetic oligonucleotide
  Target: SCN9A; (+) strand; PAM type: NRG; PAM sequence: AGG
tgaccatcatgtaaacaata

SEQ ID NO: 46499 - DNA, 20 bp, Artificial Sequence
  Description of Artificial Sequence: Synthetic oligonucleotide
  Target: SCN9A; (+) strand; PAM type: NRG; PAM sequence: TAG
catgtaaacaataaggcaca

SEQ ID NO: 46500 - DNA, 20 bp, Artificial Sequence
  Description of Artificial Sequence: Synthetic oligonucleotide
  Target: SCN9A; (+) strand; PAM type: NRG; PAM sequence: CAG
aataaggcacatagcttgac

SEQ ID NO: 46501 - DNA, 20 bp, Artificial Sequence
  Description of Artificial Sequence: Synthetic oligonucleotide
  Target: SCN9A; (+) strand; PAM type: NRG; PAM sequence: CAG
cttgaccagcgacctccata

SEQ ID NO: 46502 - DNA, 20 bp, Artificial Sequence
  Description of Artificial Sequence: Synthetic oligonucleotide
  Target: SCN9A; (+) strand; PAM type: NRG; PAM sequence: TGG
gacctccatacagtcccaca

SEQ ID NO: 46503 - DNA, 20 bp, Artificial Sequence
  Description of Artificial Sequence: Synthetic oligonucleotide
  Target: SCN9A; (+) strand; PAM type: NRG; PAM sequence: CAG
gtctctatccactctccaca

SEQ ID NO: 46504 - DNA, 20 bp, Artificial Sequence
  Description of Artificial Sequence: Synthetic oligonucleotide
  Target: SCN9A; (+) strand; PAM type: NRG; PAM sequence: CGG
tccactctccacacagcacg

SEQ ID NO: 46505 - DNA, 20 bp, Artificial Sequence
  Description of Artificial Sequence: Synthetic oligonucleotide
  Target: SCN9A; (+) strand; PAM type: NRG; PAM sequence: CAG
cacagcacgcggaacacaat

SEQ ID NO: 46506 - DNA, 20 bp, Artificial Sequence
  Description of Artificial Sequence: Synthetic oligonucleotide
  Target: SCN9A; (+) strand; PAM type: NRG; PAM sequence: AGG
acagcacgcggaacacaatc

SEQ ID NO: 46507 - DNA, 20 bp, Artificial Sequence
  Description of Artificial Sequence: Synthetic oligonucleotide
  Target: SCN9A; (+) strand; PAM type: NRG; PAM sequence: AAG
gcacgcggaacacaatcagg

SEQ ID NO: 46508 - DNA, 20 bp, Artificial Sequence
  Description of Artificial Sequence: Synthetic oligonucleotide
  Target: SCN9A; (+) strand; PAM type: NRG; PAM sequence: AGG
cacgcggaacacaatcagga

SEQ ID NO: 46509 - DNA, 20 bp, Artificial Sequence
  Description of Artificial Sequence: Synthetic oligonucleotide
  Target: SCN9A; (+) strand; PAM type: NRG; PAM sequence: GAG
cgcggaacacaatcaggaag

SEQ ID NO: 46510 - DNA, 20 bp, Artificial Sequence
  Description of Artificial Sequence: Synthetic oligonucleotide
  Target: SCN9A; (+) strand; PAM type: NRG; PAM sequence: TGG
ggaacacaatcaggaaggag

SEQ ID NO: 46511 - DNA, 20 bp, Artificial Sequence
  Description of Artificial Sequence: Synthetic oligonucleotide
  Target: SCN9A; (+) strand; PAM type: NRG; PAM sequence: AAG
acacaatcaggaaggagtgg

SEQ ID NO: 46512 - DNA, 20 bp, Artificial Sequence
  Description of Artificial Sequence: Synthetic oligonucleotide
  Target: SCN9A; (+) strand; PAM type: NRG; PAM sequence: AAG
caatcaggaaggagtggaag

SEQ ID NO: 46513 - DNA, 20 bp, Artificial Sequence
  Description of Artificial Sequence: Synthetic oligonucleotide
  Target: SCN9A; (+) strand; PAM type: NRG; PAM sequence: TGG
aagtcgttcatgtgccaccg

SEQ ID NO: 46514 - DNA, 20 bp, Artificial Sequence
  Description of Artificial Sequence: Synthetic oligonucleotide
  Target: SCN9A; (+) strand; PAM type: NRG; PAM sequence: GGG
agtcgttcatgtgccaccgt

SEQ ID NO: 46515 - DNA, 20 bp, Artificial Sequence
  Description of Artificial Sequence: Synthetic oligonucleotide
  Target: SCN9A; (+) strand; PAM type: NRG; PAM sequence: GAG
tcgttcatgtgccaccgtgg

SEQ ID NO: 46516 - DNA, 20 bp, Artificial Sequence
  Description of Artificial Sequence: Synthetic oligonucleotide
  Target: SCN9A; (+) strand; PAM type: NRG; PAM sequence: CAG
tgtgccaccgtgggagcgta

SEQ ID NO: 46517 - DNA, 20 bp, Artificial Sequence
  Description of Artificial Sequence: Synthetic oligonucleotide
  Target: SCN9A; (+) strand; PAM type: NRG; PAM sequence: CAG
tacagtcatcattgatcttg

SEQ ID NO: 46518 - DNA, 20 bp, Artificial Sequence
  Description of Artificial Sequence: Synthetic oligonucleotide
  Target: SCN9A; (+) strand; PAM type: NRG; PAM sequence: TAG
tcttgcagacacattctttg

SEQ ID NO: 46519 - DNA, 20 bp, Artificial Sequence
  Description of Artificial Sequence: Synthetic oligonucleotide
  Target: SCN9A; (+) strand; PAM type: NRG; PAM sequence: AAG
attctttgtagctcttacca

SEQ ID NO: 46520 - DNA, 20 bp, Artificial Sequence
  Description of Artificial Sequence: Synthetic oligonucleotide
  Target: SCN9A; (+) strand; PAM type: NRG; PAM sequence: GAG
tctttgtagctcttaccaaa

SEQ ID NO: 46521 - DNA, 20 bp, Artificial Sequence
  Description of Artificial Sequence: Synthetic oligonucleotide
  Target: SCN9A; (+) strand; PAM type: NRG; PAM sequence: CAG
aaagagctgcatgccgacca

SEQ ID NO: 46522 - DNA, 20 bp, Artificial Sequence
  Description of Artificial Sequence: Synthetic oligonucleotide
  Target: SCN9A; (+) strand; PAM type: NRG; PAM sequence: AAG
tgccgaccacagcaaaaatg

SEQ ID NO: 46523 - DNA, 20 bp, Artificial Sequence
  Description of Artificial Sequence: Synthetic oligonucleotide
  Target: SCN9A; (+) strand; PAM type: NRG; PAM sequence: TGG
agcaaaaatgaagacgatga

SEQ ID NO: 46524 - DNA, 20 bp, Artificial Sequence
  Description of Artificial Sequence: Synthetic oligonucleotide
  Target: SCN9A; (+) strand; PAM type: NRG; PAM sequence: AAG
agacgatgatggccaacact

SEQ ID NO: 46525 - DNA, 20 bp, Artificial Sequence
  Description of Artificial Sequence: Synthetic oligonucleotide
  Target: SCN9A; (+) strand; PAM type: NRG; PAM sequence: AGG
gacgatgatggccaacacta

SEQ ID NO: 46526 - DNA, 20 bp, Artificial Sequence
  Description of Artificial Sequence: Synthetic oligonucleotide
  Target: SCN9A; (+) strand; PAM type: NRG; PAM sequence: GAG
atgatggccaacactaaggt

SEQ ID NO: 46527 - DNA, 20 bp, Artificial Sequence
  Description of Artificial Sequence: Synthetic oligonucleotide
  Target: SCN9A; (+) strand; PAM type: NRG; PAM sequence: AGG
tgatggccaacactaaggtg

SEQ ID NO: 46528 - DNA, 20 bp, Artificial Sequence
  Description of Artificial Sequence: Synthetic oligonucleotide
  Target: SCN9A; (+) strand; PAM type: NRG; PAM sequence: TAG
aacactaaggtgaggttacc

SEQ ID NO: 46529 - DNA, 20 bp, Artificial Sequence
  Description of Artificial Sequence: Synthetic oligonucleotide
  Target: SCN9A; (+) strand; PAM type: NRG; PAM sequence: GAG
cactaaggtgaggttaccta

SEQ ID NO: 46530 - DNA, 20 bp, Artificial Sequence
  Description of Artificial Sequence: Synthetic oligonucleotide
  Target: SCN9A; (+) strand; PAM type: NRG; PAM sequence: GAG
ggttacctagagcccctact

SEQ ID NO: 46531 - DNA, 20 bp, Artificial Sequence
  Description of Artificial Sequence: Synthetic oligonucleotide
  Target: SCN9A; (+) strand; PAM type: NRG; PAM sequence: CAG
gagttaccaatgatcttaat

SEQ ID NO: 46532 - DNA, 20 bp, Artificial Sequence
  Description of Artificial Sequence: Synthetic oligonucleotide
  Target: SCN9A; (+) strand; PAM type: NRG; PAM sequence: TGG
ttaatcagcatgttcaatgt

SEQ ID NO: 46533 - DNA, 20 bp, Artificial Sequence
  Description of Artificial Sequence: Synthetic oligonucleotide
  Target: SCN9A; (+) strand; PAM type: NRG; PAM sequence: CAG
tcagcatgttcaatgttggc

SEQ ID NO: 46534 - DNA, 20 bp, Artificial Sequence
  Description of Artificial Sequence: Synthetic oligonucleotide
  Target: SCN9A; (+) strand; PAM type: NRG; PAM sequence: AGG
cagcatgttcaatgttggcc

SEQ ID NO: 46535 - DNA, 20 bp, Artificial Sequence
  Description of Artificial Sequence: Synthetic oligonucleotide
  Target: SCN9A; (+) strand; PAM type: NRG; PAM sequence: AAG
gccaggattttgccaacttg

SEQ ID NO: 46536 - DNA, 20 bp, Artificial Sequence
  Description of Artificial Sequence: Synthetic oligonucleotide
  Target: SCN9A; (+) strand; PAM type: NRG; PAM sequence: CGG
attttgccaacttgaagact

SEQ ID NO: 46537 - DNA, 20 bp, Artificial Sequence
  Description of Artificial Sequence: Synthetic oligonucleotide
  Target: SCN9A; (+) strand; PAM type: NRG; PAM sequence: GAG
tttgccaacttgaagactcg

SEQ ID NO: 46538 - DNA, 20 bp, Artificial Sequence
  Description of Artificial Sequence: Synthetic oligonucleotide
  Target: SCN9A; (+) strand; PAM type: NRG; PAM sequence: AAG
acttgaagactcggagctaa

SEQ ID NO: 46539 - DNA, 20 bp, Artificial Sequence
  Description of Artificial Sequence: Synthetic oligonucleotide
  Target: SCN9A; (+) strand; PAM type: NRG; PAM sequence: AAG
cggagctaaaagcaaatata

SEQ ID NO: 46540 - DNA, 20 bp, Artificial Sequence
  Description of Artificial Sequence: Synthetic oligonucleotide
  Target: SCN9A; (+) strand; PAM type: NRG; PAM sequence: AAG
ccaatcttgatttttgttca

SEQ ID NO: 46541 - DNA, 20 bp, Artificial Sequence
  Description of Artificial Sequence: Synthetic oligonucleotide
  Target: SCN9A; (+) strand; PAM type: NRG; PAM sequence: AGG
caatcttgatttttgttcaa

SEQ ID NO: 46542 - DNA, 20 bp, Artificial Sequence
  Description of Artificial Sequence: Synthetic oligonucleotide
  Target: SCN9A; (+) strand; PAM type: NRG; PAM sequence: GGG
aatcttgatttttgttcaaa

SEQ ID NO: 46543 - DNA, 20 bp, Artificial Sequence
  Description of Artificial Sequence: Synthetic oligonucleotide
  Target: SCN9A; (+) strand; PAM type: NRG; PAM sequence: AAG
tgatttttgttcaaagggta

SEQ ID NO: 46544 - DNA, 20 bp, Artificial Sequence
  Description of Artificial Sequence: Synthetic oligonucleotide
  Target: SCN9A; (+) strand; PAM type: NRG; PAM sequence: CAG
tttttgttcaaagggtaaag

SEQ ID NO: 46545 - DNA, 20 bp, Artificial Sequence
  Description of Artificial Sequence: Synthetic oligonucleotide
  Target: SCN9A; (+) strand; PAM type: NRG; PAM sequence: AAG
caaagggtaaagcagacttt

SEQ ID NO: 46546 - DNA, 20 bp, Artificial Sequence
  Description of Artificial Sequence: Synthetic oligonucleotide
  Target: SCN9A; (+) strand; PAM type: NRG; PAM sequence: CAG
ataatattgtcattattatc

SEQ ID NO: 46547 - DNA, 20 bp, Artificial Sequence
  Description of Artificial Sequence: Synthetic oligonucleotide
  Target: SCN9A; (+) strand; PAM type: NRG; PAM sequence: AAG
aaattacaacacatattatg

SEQ ID NO: 46548 - DNA, 20 bp, Artificial Sequence
  Description of Artificial Sequence: Synthetic oligonucleotide
  Target: SCN9A; (+) strand; PAM type: NRG; PAM sequence: TAG
atgaagaaactatgtacttt

SEQ ID NO: 46549 - DNA, 20 bp, Artificial Sequence
  Description of Artificial Sequence: Synthetic oligonucleotide
  Target: SCN9A; (+) strand; PAM type: NRG; PAM sequence: CAG
gaaactatgtacttttagtt

SEQ ID NO: 46550 - DNA, 20 bp, Artificial Sequence
  Description of Artificial Sequence: Synthetic oligonucleotide
  Target: SCN9A; (+) strand; PAM type: NRG; PAM sequence: AGG
aaactatgtacttttagttc

SEQ ID NO: 46551 - DNA, 20 bp, Artificial Sequence
  Description of Artificial Sequence: Synthetic oligonucleotide
  Target: SCN9A; (+) strand; PAM type: NRG; PAM sequence: TAG
cttttagttcaggattgcta

SEQ ID NO: 46552 - DNA, 20 bp, Artificial Sequence
  Description of Artificial Sequence: Synthetic oligonucleotide
  Target: SCN9A; (+) strand; PAM type: NRG; PAM sequence: TAG
aatttgtgatatttttcttt

SEQ ID NO: 46553 - DNA, 20 bp, Artificial Sequence
  Description of Artificial Sequence: Synthetic oligonucleotide
  Target: SCN9A; (+) strand; PAM type: NRG; PAM sequence: TAG
cattttctcatgccgacact

SEQ ID NO: 46554 - DNA, 20 bp, Artificial Sequence
  Description of Artificial Sequence: Synthetic oligonucleotide
  Target: SCN9A; (+) strand; PAM type: NRG; PAM sequence: TAG
gccgacacttagataaaatc

SEQ ID NO: 46555 - DNA, 20 bp, Artificial Sequence
  Description of Artificial Sequence: Synthetic oligonucleotide
  Target: SCN9A; (+) strand; PAM type: NRG; PAM sequence: TAG
ttagataaaatctagcatat

SEQ ID NO: 46556 - DNA, 20 bp, Artificial Sequence
  Description of Artificial Sequence: Synthetic oligonucleotide
  Target: SCN9A; (+) strand; PAM type: NRG; PAM sequence: GAG
agataaaatctagcatatta

SEQ ID NO: 46557 - DNA, 20 bp, Artificial Sequence
  Description of Artificial Sequence: Synthetic oligonucleotide
  Target: SCN9A; (+) strand; PAM type: NRG; PAM sequence: AGG
gataaaatctagcatattag

SEQ ID NO: 46558 - DNA, 20 bp, Artificial Sequence
  Description of Artificial Sequence: Synthetic oligonucleotide
  Target: SCN9A; (+) strand; PAM type: NRG; PAM sequence: AAG
ttagaggaatgtgctttaaa

SEQ ID NO: 46559 - DNA, 20 bp, Artificial Sequence
  Description of Artificial Sequence: Synthetic oligonucleotide
  Target: SCN9A; (+) strand; PAM type: NRG; PAM sequence: AAG
ttatttgtttttatattgtt

SEQ ID NO: 46560 - DNA, 20 bp, Artificial Sequence
  Description of Artificial Sequence: Synthetic oligonucleotide
  Target: SCN9A; (+) strand; PAM type: NRG; PAM sequence: CAG
tgtttttatattgttaagat

SEQ ID NO: 46561 - DNA, 20 bp, Artificial Sequence
  Description of Artificial Sequence: Synthetic oligonucleotide
  Target: SCN9A; (+) strand; PAM type: NRG; PAM sequence: TGG
agatcagacaacaattgttt

SEQ ID NO: 46562 - DNA, 20 bp, Artificial Sequence
  Description of Artificial Sequence: Synthetic oligonucleotide
  Target: SCN9A; (+) strand; PAM type: NRG; PAM sequence: GGG
gatcagacaacaattgtttt

SEQ ID NO: 46563 - DNA, 20 bp, Artificial Sequence
  Description of Artificial Sequence: Synthetic oligonucleotide
  Target: SCN9A; (+) strand; PAM type: NRG; PAM sequence: GGG
atcagacaacaattgttttg

SEQ ID NO: 46564 - DNA, 20 bp, Artificial Sequence
  Description of Artificial Sequence: Synthetic oligonucleotide
  Target: SCN9A; (+) strand; PAM type: NRG; PAM sequence: GGG
tcagacaacaattgttttgg

SEQ ID NO: 46565 - DNA, 20 bp, Artificial Sequence
  Description of Artificial Sequence: Synthetic oligonucleotide
  Target: SCN9A; (+) strand; PAM type: NRG; PAM sequence: AAG
ctttaattaccaaattcata

SEQ ID NO: 46566 - DNA, 20 bp, Artificial Sequence
  Description of Artificial Sequence: Synthetic oligonucleotide
  Target: SCN9A; (+) strand; PAM type: NRG; PAM sequence: AAG
tataatcattgaaattctgt

SEQ ID NO: 46567 - DNA, 20 bp, Artificial Sequence
  Description of Artificial Sequence: Synthetic oligonucleotide
  Target: SCN9A; (+) strand; PAM type: NRG; PAM sequence: AAG
attgaaattctgtaagccac

SEQ ID NO: 46568 - DNA, 20 bp, Artificial Sequence
  Description of Artificial Sequence: Synthetic oligonucleotide
  Target: SCN9A; (+) strand; PAM type: NRG; PAM sequence: TAG
aaattattgtactatattaa

SEQ ID NO: 46569 - DNA, 20 bp, Artificial Sequence
  Description of Artificial Sequence: Synthetic oligonucleotide
  Target: SCN9A; (+) strand; PAM type: NRG; PAM sequence: TAG
agaaaatatttatattatat

SEQ ID NO: 46570 - DNA, 20 bp, Artificial Sequence
  Description of Artificial Sequence: Synthetic oligonucleotide
  Target: SCN9A; (+) strand; PAM type: NRG; PAM sequence: TAG
tattagcgtgtacttcaaat

SEQ ID NO: 46571 - DNA, 20 bp, Artificial Sequence
  Description of Artificial Sequence: Synthetic oligonucleotide
  Target: SCN9A; (+) strand; PAM type: NRG; PAM sequence: GAG
gtgtacttcaaattagaatt

SEQ ID NO: 46572 - DNA, 20 bp, Artificial Sequence
  Description of Artificial Sequence: Synthetic oligonucleotide
  Target: SCN9A; (+) strand; PAM type: NRG; PAM sequence: TGG
aaattgtaaaaatattcatg

SEQ ID NO: 46573 - DNA, 20 bp, Artificial Sequence
  Description of Artificial Sequence: Synthetic oligonucleotide
  Target: SCN9A; (+) strand; PAM type: NRG; PAM sequence: TAG
taaaaatattcatgtggttt

SEQ ID NO: 46574 - DNA, 20 bp, Artificial Sequence
  Description of Artificial Sequence: Synthetic oligonucleotide
  Target: SCN9A; (+) strand; PAM type: NRG; PAM sequence: AAG
tcatgtggttttagttcttt

SEQ ID NO: 46575 - DNA, 20 bp, Artificial Sequence
  Description of Artificial Sequence: Synthetic oligonucleotide
  Target: SCN9A; (+) strand; PAM type: NRG; PAM sequence: TGG
taagtgcatttgtcaatgaa

SEQ ID NO: 46576 - DNA, 20 bp, Artificial Sequence
  Description of Artificial Sequence: Synthetic oligonucleotide
  Target: SCN9A; (+) strand; PAM type: NRG; PAM sequence: TAG
atgaatggattttattttac

SEQ ID NO: 46577 - DNA, 20 bp, Artificial Sequence
  Description of Artificial Sequence: Synthetic oligonucleotide
  Target: SCN9A; (+) strand; PAM type: NRG; PAM sequence: AAG
attttattttactagatatc

SEQ ID NO: 46578 - DNA, 20 bp, Artificial Sequence
  Description of Artificial Sequence: Synthetic oligonucleotide
  Target: SCN9A; (+) strand; PAM type: NRG; PAM sequence: AAG
cttttgattcaaattcccaa

SEQ ID NO: 46579 - DNA, 20 bp, Artificial Sequence
  Description of Artificial Sequence: Synthetic oligonucleotide
  Target: SCN9A; (+) strand; PAM type: NRG; PAM sequence: AAG
ttaaaaataatgcaaaacca

SEQ ID NO: 46580 - DNA, 20 bp, Artificial Sequence
  Description of Artificial Sequence: Synthetic oligonucleotide
  Target: SCN9A; (+) strand; PAM type: NRG; PAM sequence: TAG
aaagaaatacccctttatta

SEQ ID NO: 46581 - DNA, 20 bp, Artificial Sequence
  Description of Artificial Sequence: Synthetic oligonucleotide
  Target: SCN9A; (+) strand; PAM type: NRG; PAM sequence: TGG
ccctttattatagaatataa

SEQ ID NO: 46582 - DNA, 20 bp, Artificial Sequence
  Description of Artificial Sequence: Synthetic oligonucleotide
  Target: SCN9A; (+) strand; PAM type: NRG; PAM sequence: TAG
atagaatataatggcaacct

SEQ ID NO: 46583 - DNA, 20 bp, Artificial Sequence
  Description of Artificial Sequence: Synthetic oligonucleotide
  Target: SCN9A; (+) strand; PAM type: NRG; PAM sequence: CAG
caaccttagtttatgtttac

SEQ ID NO: 46584 - DNA, 20 bp, Artificial Sequence
  Description of Artificial Sequence: Synthetic oligonucleotide
  Target: SCN9A; (+) strand; PAM type: NRG; PAM sequence: CAG
tttaccagtctgaatgatcg

SEQ ID NO: 46585 - DNA, 20 bp, Artificial Sequence
  Description of Artificial Sequence: Synthetic oligonucleotide
  Target: SCN9A; (+) strand; PAM type: NRG; PAM sequence: TAG
gacaatccttccacatctgc

SEQ ID NO: 46586 - DNA, 20 bp, Artificial Sequence
  Description of Artificial Sequence: Synthetic oligonucleotide
  Target: SCN9A; (+) strand; PAM type: NRG; PAM sequence: AAG
atccttccacatctgctaga

SEQ ID NO: 46587 - DNA, 20 bp, Artificial Sequence
  Description of Artificial Sequence: Synthetic oligonucleotide
  Target: SCN9A; (+) strand; PAM type: NRG; PAM sequence: GAG
ccttccacatctgctagaaa

SEQ ID NO: 46588 - DNA, 20 bp, Artificial Sequence
  Description of Artificial Sequence: Synthetic oligonucleotide
  Target: SCN9A; (+) strand; PAM type: NRG; PAM sequence: AAG
aaagagctccactaaactta

SEQ ID NO: 46589 - DNA, 20 bp, Artificial Sequence
  Description of Artificial Sequence: Synthetic oligonucleotide
  Target: SCN9A; (+) strand; PAM type: NRG; PAM sequence: AAG
actaaacttaaagtcacaat

SEQ ID NO: 46590 - DNA, 20 bp, Artificial Sequence
  Description of Artificial Sequence: Synthetic oligonucleotide
  Target: SCN9A; (+) strand; PAM type: NRG; PAM sequence: AGG
ctaaacttaaagtcacaata

SEQ ID NO: 46591 - DNA, 20 bp, Artificial Sequence
  Description of Artificial Sequence: Synthetic oligonucleotide
  Target: SCN9A; (+) strand; PAM type: NRG; PAM sequence: CAG
taaggctgtcaaaaatattc

SEQ ID NO: 46592 - DNA, 20 bp, Artificial Sequence
  Description of Artificial Sequence: Synthetic oligonucleotide
  Target: SCN9A; (+) strand; PAM type: NRG; PAM sequence: TGG
caaaaatattccagcctact

SEQ ID NO: 46593 - DNA, 20 bp, Artificial Sequence
  Description of Artificial Sequence: Synthetic oligonucleotide
  Target: SCN9A; (+) strand; PAM type: NRG; PAM sequence: TGG
cctacttggaaatactcata

SEQ ID NO: 46594 - DNA, 20 bp, Artificial Sequence
  Description of Artificial Sequence: Synthetic oligonucleotide
  Target: SCN9A; (+) strand; PAM type: NRG; PAM sequence: TGG
gaaatactcatatggatcca

SEQ ID NO: 46595 - DNA, 20 bp, Artificial Sequence
  Description of Artificial Sequence: Synthetic oligonucleotide
  Target: SCN9A; (+) strand; PAM type: NRG; PAM sequence: CAG
tcatatggatccatggcaat

SEQ ID NO: 46596 - DNA, 20 bp, Artificial Sequence
  Description of Artificial Sequence: Synthetic oligonucleotide
  Target: SCN9A; (+) strand; PAM type: NRG; PAM sequence: CAG
aatcagttttaataccattt

SEQ ID NO: 46597 - DNA, 20 bp, Artificial Sequence
  Description of Artificial Sequence: Synthetic oligonucleotide
  Target: SCN9A; (+) strand; PAM type: NRG; PAM sequence: AAG
ttaataccatttcagctgca

SEQ ID NO: 46598 - DNA, 20 bp, Artificial Sequence
  Description of Artificial Sequence: Synthetic oligonucleotide
  Target: SCN9A; (+) strand; PAM type: NRG; PAM sequence: CAG
catttcagctgcaaagattc

SEQ ID NO: 46599 - DNA, 20 bp, Artificial Sequence
  Description of Artificial Sequence: Synthetic oligonucleotide
  Target: SCN9A; (+) strand; PAM type: NRG; PAM sequence: AAG
cagctgcaaagattccagta

SEQ ID NO: 46600 - DNA, 20 bp, Artificial Sequence
  Description of Artificial Sequence: Synthetic oligonucleotide
  Target: SCN9A; (+) strand; PAM type: NRG; PAM sequence: AAG
aaagattccagtaaagacct

SEQ ID NO: 46601 - DNA, 20 bp, Artificial Sequence
  Description of Artificial Sequence: Synthetic oligonucleotide
  Target: SCN9A; (+) strand; PAM type: NRG; PAM sequence: GAG
attccagtaaagacctaagt

SEQ ID NO: 46602 - DNA, 20 bp, Artificial Sequence
  Description of Artificial Sequence: Synthetic oligonucleotide
  Target: SCN9A; (+) strand; PAM type: NRG; PAM sequence: TAG
taatgtttttctgttaatat

SEQ ID NO: 46603 - DNA, 20 bp, Artificial Sequence
  Description of Artificial Sequence: Synthetic oligonucleotide
  Target: SCN9A; (+) strand; PAM type: NRG; PAM sequence: CAG
tttctgttaatattagaaaa

SEQ ID NO: 46604 - DNA, 20 bp, Artificial Sequence
  Description of Artificial Sequence: Synthetic oligonucleotide
  Target: SCN9A; (+) strand; PAM type: NRG; PAM sequence: AGG
ttctgttaatattagaaaac

SEQ ID NO: 46605 - DNA, 20 bp, Artificial Sequence
  Description of Artificial Sequence: Synthetic oligonucleotide
  Target: SCN9A; (+) strand; PAM type: NRG; PAM sequence: TAG
gataataatcactgtttgct

SEQ ID NO: 46606 - DNA, 20 bp, Artificial Sequence
  Description of Artificial Sequence: Synthetic oligonucleotide
  Target: SCN9A; (+) strand; PAM type: NRG; PAM sequence: CAG
gcttagcatttactgtgttc

SEQ ID NO: 46607 - DNA, 20 bp, Artificial Sequence
  Description of Artificial Sequence: Synthetic oligonucleotide
  Target: SCN9A; (+) strand; PAM type: NRG; PAM sequence: CAG
agcatttactgtgttccaga

SEQ ID NO: 46608 - DNA, 20 bp, Artificial Sequence
  Description of Artificial Sequence: Synthetic oligonucleotide
  Target: SCN9A; (+) strand; PAM type: NRG; PAM sequence: TGG
tttgctaaatactttataaa

SEQ ID NO: 46609 - DNA, 20 bp, Artificial Sequence
  Description of Artificial Sequence: Synthetic oligonucleotide
  Target: SCN9A; (+) strand; PAM type: NRG; PAM sequence: TAG
atggatattcttatctaact

SEQ ID NO: 46610 - DNA, 20 bp, Artificial Sequence
  Description of Artificial Sequence: Synthetic oligonucleotide
  Target: SCN9A; (+) strand; PAM type: NRG; PAM sequence: TAG
tctaacttagtcctgtaaat

SEQ ID NO: 46611 - DNA, 20 bp, Artificial Sequence
  Description of Artificial Sequence: Synthetic oligonucleotide
  Target: SCN9A; (+) strand; PAM type: NRG; PAM sequence: AGG
ctaacttagtcctgtaaatt

SEQ ID NO: 46612 - DNA, 20 bp, Artificial Sequence
  Description of Artificial Sequence: Synthetic oligonucleotide
  Target: SCN9A; (+) strand; PAM type: NRG; PAM sequence: TGG
aattaggtattgctcttccc

SEQ ID NO: 46613 - DNA, 20 bp, Artificial Sequence
  Description of Artificial Sequence: Synthetic oligonucleotide
  Target: SCN9A; (+) strand; PAM type: NRG; PAM sequence: CAG
ctcttccctggctcccatat

SEQ ID NO: 46614 - DNA, 20 bp, Artificial Sequence
  Description of Artificial Sequence: Synthetic oligonucleotide
  Target: SCN9A; (+) strand; PAM type: NRG; PAM sequence: AAG
ggctcccatatcagcatcaa

SEQ ID NO: 46615 - DNA, 20 bp, Artificial Sequence
  Description of Artificial Sequence: Synthetic oligonucleotide
  Target: SCN9A; (+) strand; PAM type: NRG; PAM sequence: AGG
gctcccatatcagcatcaaa

SEQ ID NO: 46616 - DNA, 20 bp, Artificial Sequence
  Description of Artificial Sequence: Synthetic oligonucleotide
  Target: SCN9A; (+) strand; PAM type: NRG; PAM sequence: AAG
atcagcatcaaaaggttgaa

SEQ ID NO: 46617 - DNA, 20 bp, Artificial Sequence
  Description of Artificial Sequence: Synthetic oligonucleotide
  Target: SCN9A; (+) strand; PAM type: NRG; PAM sequence: CAG
aaaagctctaactgtcctgt

SEQ ID NO: 46618 - DNA, 20 bp, Artificial Sequence
  Description of Artificial Sequence: Synthetic oligonucleotide
  Target: SCN9A; (+) strand; PAM type: NRG; PAM sequence: TAG
ctgtcagtgctcatcatttt

SEQ ID NO: 46619 - DNA, 20 bp, Artificial Sequence
  Description of Artificial Sequence: Synthetic oligonucleotide
  Target: SCN9A; (+) strand; PAM type: NRG; PAM sequence: CAG
cagtgctcatcatttttaga

SEQ ID NO: 46620 - DNA, 20 bp, Artificial Sequence
  Description of Artificial Sequence: Synthetic oligonucleotide
  Target: SCN9A; (+) strand; PAM type: NRG; PAM sequence: TAG
atcatttttagacagcattt

SEQ ID NO: 46621 - DNA, 20 bp, Artificial Sequence
  Description of Artificial Sequence: Synthetic oligonucleotide
  Target: SCN9A; (+) strand; PAM type: NRG; PAM sequence: TAG
ttttagacagcattttagaa

SEQ ID NO: 46622 - DNA, 20 bp, Artificial Sequence
  Description of Artificial Sequence: Synthetic oligonucleotide
  Target: SCN9A; (+) strand; PAM type: NRG; PAM sequence: CAG
agaatagcatattaaaattt

SEQ ID NO: 46623 - DNA, 20 bp, Artificial Sequence
  Description of Artificial Sequence: Synthetic oligonucleotide
  Target: SCN9A; (+) strand; PAM type: NRG; PAM sequence: AAG
atagcatattaaaatttcag

SEQ ID NO: 46624 - DNA, 20 bp, Artificial Sequence
  Description of Artificial Sequence: Synthetic oligonucleotide
  Target: SCN9A; (+) strand; PAM type: NRG; PAM sequence: GAG
agcatattaaaatttcagaa

SEQ ID NO: 46625 - DNA, 20 bp, Artificial Sequence
  Description of Artificial Sequence: Synthetic oligonucleotide
  Target: SCN9A; (+) strand; PAM type: NRG; PAM sequence: TGG
tttcagaagagtaaaacatt

SEQ ID NO: 46626 - DNA, 20 bp, Artificial Sequence
  Description of Artificial Sequence: Synthetic oligonucleotide
  Target: SCN9A; (+) strand; PAM type: NRG; PAM sequence: CAG
aaaacatttggtaattgaca

SEQ ID NO: 46627 - DNA, 20 bp, Artificial Sequence
  Description of Artificial Sequence: Synthetic oligonucleotide
  Target: SCN9A; (+) strand; PAM type: NRG; PAM sequence: AAG
tgacacagtcactattttca

SEQ ID NO: 46628 - DNA, 20 bp, Artificial Sequence
  Description of Artificial Sequence: Synthetic oligonucleotide
  Target: SCN9A; (+) strand; PAM type: NRG; PAM sequence: TGG
ctattttcaaagaatttatg

SEQ ID NO: 46629 - DNA, 20 bp, Artificial Sequence
  Description of Artificial Sequence: Synthetic oligonucleotide
  Target: SCN9A; (+) strand; PAM type: NRG; PAM sequence: GGG
tattttcaaagaatttatgt

SEQ ID NO: 46630 - DNA, 20 bp, Artificial Sequence
  Description of Artificial Sequence: Synthetic oligonucleotide
  Target: SCN9A; (+) strand; PAM type: NRG; PAM sequence: AAG
aagaatttatgtgggtcaaa

SEQ ID NO: 46631 - DNA, 20 bp, Artificial Sequence
  Description of Artificial Sequence: Synthetic oligonucleotide
  Target: SCN9A; (+) strand; PAM type: NRG; PAM sequence: TGG
tgtgggtcaaaaagttgttc

SEQ ID NO: 46632 - DNA, 20 bp, Artificial Sequence
  Description of Artificial Sequence: Synthetic oligonucleotide
  Target: SCN9A; (+) strand; PAM type: NRG; PAM sequence: AAG
gggtcaaaaagttgttctgg

SEQ ID NO: 46633 - DNA, 20 bp, Artificial Sequence
  Description of Artificial Sequence: Synthetic oligonucleotide
  Target: SCN9A; (+) strand; PAM type: NRG; PAM sequence: AAG
tcaaaaagttgttctggaag

SEQ ID NO: 46634 - DNA, 20 bp, Artificial Sequence
  Description of Artificial Sequence: Synthetic oligonucleotide
  Target: SCN9A; (+) strand; PAM type: NRG; PAM sequence: AAG
ttgttctggaagaagataaa

SEQ ID NO: 46635 - DNA, 20 bp, Artificial Sequence
  Description of Artificial Sequence: Synthetic oligonucleotide
  Target: SCN9A; (+) strand; PAM type: NRG; PAM sequence: AAG
agaagataaaaagaaaacat

SEQ ID NO: 46636 - DNA, 20 bp, Artificial Sequence
  Description of Artificial Sequence: Synthetic oligonucleotide
  Target: SCN9A; (+) strand; PAM type: NRG; PAM sequence: GAG
taagttgatactgaaatttt

SEQ ID NO: 46637 - DNA, 20 bp, Artificial Sequence
  Description of Artificial Sequence: Synthetic oligonucleotide
  Target: SCN9A; (+) strand; PAM type: NRG; PAM sequence: CAG
ttgatactgaaattttgagc

SEQ ID NO: 46638 - DNA, 20 bp, Artificial Sequence
  Description of Artificial Sequence: Synthetic oligonucleotide
  Target: SCN9A; (+) strand; PAM type: NRG; PAM sequence: TAG
ttttctgatctgactactgt

SEQ ID NO: 46639 - DNA, 20 bp, Artificial Sequence
  Description of Artificial Sequence: Synthetic oligonucleotide
  Target: SCN9A; (+) strand; PAM type: NRG; PAM sequence: GAG
ttctgatctgactactgtta

SEQ ID NO: 46640 - DNA, 20 bp, Artificial Sequence
  Description of Artificial Sequence: Synthetic oligonucleotide
  Target: SCN9A; (+) strand; PAM type: NRG; PAM sequence: AAG
tgactactgttagagtaata

SEQ ID NO: 46641 - DNA, 20 bp, Artificial Sequence
  Description of Artificial Sequence: Synthetic oligonucleotide
  Target: SCN9A; (+) strand; PAM type: NRG; PAM sequence: AAG
acatgttgactcactcttta

SEQ ID NO: 46642 - DNA, 20 bp, Artificial Sequence
  Description of Artificial Sequence: Synthetic oligonucleotide
  Target: SCN9A; (+) strand; PAM type: NRG; PAM sequence: CAG
ctcactctttaaagatttat

SEQ ID NO: 46643 - DNA, 20 bp, Artificial Sequence
  Description of Artificial Sequence: Synthetic oligonucleotide
  Target: SCN9A; (+) strand; PAM type: NRG; PAM sequence: CAG
actctttaaagatttatcag

SEQ ID NO: 46644 - DNA, 20 bp, Artificial Sequence
  Description of Artificial Sequence: Synthetic oligonucleotide
  Target: SCN9A; (+) strand; PAM type: NRG; PAM sequence: AAG
ctttaaagatttatcagcag

SEQ ID NO: 46645 - DNA, 20 bp, Artificial Sequence
  Description of Artificial Sequence: Synthetic oligonucleotide
  Target: SCN9A; (+) strand; PAM type: NRG; PAM sequence: GAG
ttaaagatttatcagcagaa

SEQ ID NO: 46646 - DNA, 20 bp, Artificial Sequence
  Description of Artificial Sequence: Synthetic oligonucleotide
  Target: SCN9A; (+) strand; PAM type: NRG; PAM sequence: AAG
tttatcagcagaagagaaaa

SEQ ID NO: 46647 - DNA, 20 bp, Artificial Sequence
  Description of Artificial Sequence: Synthetic oligonucleotide
  Target: SCN9A; (+) strand; PAM type: NRG; PAM sequence: TGG
aaagtatttaattgacaatg

SEQ ID NO: 46648 - DNA, 20 bp, Artificial Sequence
  Description of Artificial Sequence: Synthetic oligonucleotide
  Target: SCN9A; (+) strand; PAM type: NRG; PAM sequence: CAG
gtatttaattgacaatgtgg

SEQ ID NO: 46649 - DNA, 20 bp, Artificial Sequence
  Description of Artificial Sequence: Synthetic oligonucleotide
  Target: SCN9A; (+) strand; PAM type: NRG; PAM sequence: AAG
aattgacaatgtggcagcta

SEQ ID NO: 46650 - DNA, 20 bp, Artificial Sequence
  Description of Artificial Sequence: Synthetic oligonucleotide
  Target: SCN9A; (+) strand; PAM type: NRG; PAM sequence: AAG
cagctaaagtaatacttcta

SEQ ID NO: 46651 - DNA, 20 bp, Artificial Sequence
  Description of Artificial Sequence: Synthetic oligonucleotide
  Target: SCN9A; (+) strand; PAM type: NRG; PAM sequence: AAG
cttctaaagctttgacacaa

SEQ ID NO: 46652 - DNA, 20 bp, Artificial Sequence
  Description of Artificial Sequence: Synthetic oligonucleotide
  Target: SCN9A; (+) strand; PAM type: NRG; PAM sequence: TGG
atatcattaattcatgatac

SEQ ID NO: 46653 - DNA, 20 bp, Artificial Sequence
  Description of Artificial Sequence: Synthetic oligonucleotide
  Target: SCN9A; (+) strand; PAM type: NRG; PAM sequence: AAG
aattcatgatactggtatca

SEQ ID NO: 46654 - DNA, 20 bp, Artificial Sequence
  Description of Artificial Sequence: Synthetic oligonucleotide
  Target: SCN9A; (+) strand; PAM type: NRG; PAM sequence: AGG
attcatgatactggtatcaa

SEQ ID NO: 46655 - DNA, 20 bp, Artificial Sequence
  Description of Artificial Sequence: Synthetic oligonucleotide
  Target: SCN9A; (+) strand; PAM type: NRG; PAM sequence: AAG
tatcaaaggactcacttaaa

SEQ ID NO: 46656 - DNA, 20 bp, Artificial Sequence
  Description of Artificial Sequence: Synthetic oligonucleotide
  Target: SCN9A; (+) strand; PAM type: NRG; PAM sequence: AGG
atcaaaggactcacttaaaa

SEQ ID NO: 46657 - DNA, 20 bp, Artificial Sequence
  Description of Artificial Sequence: Synthetic oligonucleotide
  Target: SCN9A; (+) strand; PAM type: NRG; PAM sequence: TGG
caacaccgaaatgaatcctt

SEQ ID NO: 46658 - DNA, 20 bp, Artificial Sequence
  Description of Artificial Sequence: Synthetic oligonucleotide
  Target: SCN9A; (+) strand; PAM type: NRG; PAM sequence: GGG
aacaccgaaatgaatccttt

SEQ ID NO: 46659 - DNA, 20 bp, Artificial Sequence
  Description of Artificial Sequence: Synthetic oligonucleotide
  Target: SCN9A; (+) strand; PAM type: NRG; PAM sequence: AAG
ctttgggtacactttgactc

SEQ ID NO: 46660 - DNA, 20 bp, Artificial Sequence
  Description of Artificial Sequence: Synthetic oligonucleotide
  Target: SCN9A; (+) strand; PAM type: NRG; PAM sequence: AGG
tttgggtacactttgactca

SEQ ID NO: 46661 - DNA, 20 bp, Artificial Sequence
  Description of Artificial Sequence: Synthetic oligonucleotide
  Target: SCN9A; (+) strand; PAM type: NRG; PAM sequence: AAG
tgactcaaggaatctgacca

SEQ ID NO: 46662 - DNA, 20 bp, Artificial Sequence
  Description of Artificial Sequence: Synthetic oligonucleotide
  Target: SCN9A; (+) strand; PAM type: NRG; PAM sequence: AAG
ctcaaggaatctgaccaaag

SEQ ID NO: 46663 - DNA, 20 bp, Artificial Sequence
  Description of Artificial Sequence: Synthetic oligonucleotide
  Target: SCN9A; (+) strand; PAM type: NRG; PAM sequence: AAG
atctgaccaaagaagattct

SEQ ID NO: 46664 - DNA, 20 bp, Artificial Sequence
  Description of Artificial Sequence: Synthetic oligonucleotide
  Target: SCN9A; (+) strand; PAM type: NRG; PAM sequence: AGG
tctgaccaaagaagattcta

SEQ ID NO: 46665 - DNA, 20 bp, Artificial Sequence
  Description of Artificial Sequence: Synthetic oligonucleotide
  Target: SCN9A; (+) strand; PAM type: NRG; PAM sequence: GGG
ctgaccaaagaagattctaa

SEQ ID NO: 46666 - DNA, 20 bp, Artificial Sequence
  Description of Artificial Sequence: Synthetic oligonucleotide
  Target: SCN9A; (+) strand; PAM type: NRG; PAM sequence: TAG
aagattctaagggaaatgtt

SEQ ID NO: 46667 - DNA, 20 bp, Artificial Sequence
  Description of Artificial Sequence: Synthetic oligonucleotide
  Target: SCN9A; (+) strand; PAM type: NRG; PAM sequence: AGG
agattctaagggaaatgttt

SEQ ID NO: 46668 - DNA, 20 bp, Artificial Sequence
  Description of Artificial Sequence: Synthetic oligonucleotide
  Target: SCN9A; (+) strand; PAM type: NRG; PAM sequence: CAG
aatgtttaggtctataactg

SEQ ID NO: 46669 - DNA, 20 bp, Artificial Sequence
  Description of Artificial Sequence: Synthetic oligonucleotide
  Target: SCN9A; (+) strand; PAM type: NRG; PAM sequence: AGG
atgtttaggtctataactgc

SEQ ID NO: 46670 - DNA, 20 bp, Artificial Sequence
  Description of Artificial Sequence: Synthetic oligonucleotide
  Target: SCN9A; (+) strand; PAM type: NRG; PAM sequence: GAG
gtttaggtctataactgcag

SEQ ID NO: 46671 - DNA, 20 bp, Artificial Sequence
  Description of Artificial Sequence: Synthetic oligonucleotide
  Target: SCN9A; (+) strand; PAM type: NRG; PAM sequence: CAG
gagtcaattttcaaataatg

SEQ ID NO: 46672 - DNA, 20 bp, Artificial Sequence
  Description of Artificial Sequence: Synthetic oligonucleotide
  Target: SCN9A; (+) strand; PAM type: NRG; PAM sequence: AGG
agtcaattttcaaataatgc

SEQ ID NO: 46673 - DNA, 20 bp, Artificial Sequence
  Description of Artificial Sequence: Synthetic oligonucleotide
  Target: SCN9A; (+) strand; PAM type: NRG; PAM sequence: AAG
ttttcaaataatgcaggatc

SEQ ID NO: 46674 - DNA, 20 bp, Artificial Sequence
  Description of Artificial Sequence: Synthetic oligonucleotide
  Target: SCN9A; (+) strand; PAM type: NRG; PAM sequence: AAG
tcaaataatgcaggatcaag

SEQ ID NO: 46675 - DNA, 20 bp, Artificial Sequence
  Description of Artificial Sequence: Synthetic oligonucleotide
  Target: SCN9A; (+) strand; PAM type: NRG; PAM sequence: TGG
taatgcaggatcaagaagat

SEQ ID NO: 46676 - DNA, 20 bp, Artificial Sequence
  Description of Artificial Sequence: Synthetic oligonucleotide
  Target: SCN9A; (+) strand; PAM type: NRG; PAM sequence: CAG
tgcaggatcaagaagattgg

SEQ ID NO: 46677 - DNA, 20 bp, Artificial Sequence
  Description of Artificial Sequence: Synthetic oligonucleotide
  Target: SCN9A; (+) strand; PAM type: NRG; PAM sequence: AGG
gcaggatcaagaagattggc

SEQ ID NO: 46678 - DNA, 20 bp, Artificial Sequence
  Description of Artificial Sequence: Synthetic oligonucleotide
  Target: SCN9A; (+) strand; PAM type: NRG; PAM sequence: GGG
caggatcaagaagattggca

SEQ ID NO: 46679 - DNA, 20 bp, Artificial Sequence
  Description of Artificial Sequence: Synthetic oligonucleotide
  Target: SCN9A; (+) strand; PAM type: NRG; PAM sequence: GAG
ggatcaagaagattggcagg

SEQ ID NO: 46680 - DNA, 20 bp, Artificial Sequence
  Description of Artificial Sequence: Synthetic oligonucleotide
  Target: SCN9A; (+) strand; PAM type: NRG; PAM sequence: CAG
tcaagaagattggcagggag

SEQ ID NO: 46681 - DNA, 20 bp, Artificial Sequence
  Description of Artificial Sequence: Synthetic oligonucleotide
  Target: SCN9A; (+) strand; PAM type: NRG; PAM sequence: TGG
gaagattggcagggagcagc

SEQ ID NO: 46682 - DNA, 20 bp, Artificial Sequence
  Description of Artificial Sequence: Synthetic oligonucleotide
  Target: SCN9A; (+) strand; PAM type: NRG; PAM sequence: GAG
ggcagggagcagctggactt

SEQ ID NO: 46683 - DNA, 20 bp, Artificial Sequence
  Description of Artificial Sequence: Synthetic oligonucleotide
  Target: SCN9A; (+) strand; PAM type: NRG; PAM sequence: AGG
gcagggagcagctggacttg

SEQ ID NO: 46684 - DNA, 20 bp, Artificial Sequence
  Description of Artificial Sequence: Synthetic oligonucleotide
  Target: SCN9A; (+) strand; PAM type: NRG; PAM sequence: TGG
agcagctggacttgaggttg

SEQ ID NO: 46685 - DNA, 20 bp, Artificial Sequence
  Description of Artificial Sequence: Synthetic oligonucleotide
  Target: SCN9A; (+) strand; PAM type: NRG; PAM sequence: TAG
tggacttgaggttgtggtaa

SEQ ID NO: 46686 - DNA, 20 bp, Artificial Sequence
  Description of Artificial Sequence: Synthetic oligonucleotide
  Target: SCN9A; (+) strand; PAM type: NRG; PAM sequence: CAG
gttgtggtaatagctgtgac

SEQ ID NO: 46687 - DNA, 20 bp, Artificial Sequence
  Description of Artificial Sequence: Synthetic oligonucleotide
  Target: SCN9A; (+) strand; PAM type: NRG; PAM sequence: AGG
ttgtggtaatagctgtgacc

SEQ ID NO: 46688 - DNA, 20 bp, Artificial Sequence
  Description of Artificial Sequence: Synthetic oligonucleotide
  Target: SCN9A; (+) strand; PAM type: NRG; PAM sequence: GAG
tgaccaggtaaatcctttct

SEQ ID NO: 46689 - DNA, 20 bp, Artificial Sequence
  Description of Artificial Sequence: Synthetic oligonucleotide
  Target: SCN9A; (+) strand; PAM type: NRG; PAM sequence: CAG
gtaaatcctttctgagttca

SEQ ID NO: 46690 - DNA, 20 bp, Artificial Sequence
  Description of Artificial Sequence: Synthetic oligonucleotide
  Target: SCN9A; (+) strand; PAM type: NRG; PAM sequence: AGG
taaatcctttctgagttcac

SEQ ID NO: 46691 - DNA, 20 bp, Artificial Sequence
  Description of Artificial Sequence: Synthetic oligonucleotide
  Target: SCN9A; (+) strand; PAM type: NRG; PAM sequence: GGG
aaatcctttctgagttcaca

SEQ ID NO: 46692 - DNA, 20 bp, Artificial Sequence
  Description of Artificial Sequence: Synthetic oligonucleotide
  Target: SCN9A; (+) strand; PAM type: NRG; PAM sequence: CAG
tttctgagttcacagggatg

SEQ ID NO: 46693 - DNA, 20 bp, Artificial Sequence
  Description of Artificial Sequence: Synthetic oligonucleotide
  Target: SCN9A; (+) strand; PAM type: NRG; PAM sequence: CAG
tcacagggatgcagtcgtct

SEQ ID NO: 46694 - DNA, 20 bp, Artificial Sequence
  Description of Artificial Sequence: Synthetic oligonucleotide
  Target: SCN9A; (+) strand; PAM type: NRG; PAM sequence: GAG
agggatgcagtcgtctcagt

SEQ ID NO: 46695 - DNA, 20 bp, Artificial Sequence
  Description of Artificial Sequence: Synthetic oligonucleotide
  Target: SCN9A; (+) strand; PAM type: NRG; PAM sequence: AAG
gatgcagtcgtctcagtgag

SEQ ID NO: 46696 - DNA, 20 bp, Artificial Sequence
  Description of Artificial Sequence: Synthetic oligonucleotide
  Target: SCN9A; (+) strand; PAM type: NRG; PAM sequence: AGG
atgcagtcgtctcagtgaga

SEQ ID NO: 46697 - DNA, 20 bp, Artificial Sequence
  Description of Artificial Sequence: Synthetic oligonucleotide
  Target: SCN9A; (+) strand; PAM type: NRG; PAM sequence: AAG
gtgagaaggtacttatttgc

SEQ ID NO: 46698 - DNA, 20 bp, Artificial Sequence
  Description of Artificial Sequence: Synthetic oligonucleotide
  Target: SCN9A; (+) strand; PAM type: NRG; PAM sequence: CGG
aggtacttatttgcaagatc

SEQ ID NO: 46699 - DNA, 20 bp, Artificial Sequence
  Description of Artificial Sequence: Synthetic oligonucleotide
  Target: SCN9A; (+) strand; PAM type: NRG; PAM sequence: TAG
tccggatctccaccaacaat

SEQ ID NO: 46700 - DNA, 20 bp, Artificial Sequence
  Description of Artificial Sequence: Synthetic oligonucleotide
  Target: SCN9A; (+) strand; PAM type: NRG; PAM sequence: TAG
ctccaccaacaattagaaac

SEQ ID NO: 46701 - DNA, 20 bp, Artificial Sequence
  Description of Artificial Sequence: Synthetic oligonucleotide
  Target: SCN9A; (+) strand; PAM type: NRG; PAM sequence: AAG
gatattcctgcctttttcca

SEQ ID NO: 46702 - DNA, 20 bp, Artificial Sequence
  Description of Artificial Sequence: Synthetic oligonucleotide
  Target: SCN9A; (+) strand; PAM type: NRG; PAM sequence: TAG
tgcctttttccaaagataaa

SEQ ID NO: 46703 - DNA, 20 bp, Artificial Sequence
  Description of Artificial Sequence: Synthetic oligonucleotide
  Target: SCN9A; (+) strand; PAM type: NRG; PAM sequence: AAG
ctttttccaaagataaatag

SEQ ID NO: 46704 - DNA, 20 bp, Artificial Sequence
  Description of Artificial Sequence: Synthetic oligonucleotide
  Target: SCN9A; (+) strand; PAM type: NRG; PAM sequence: AGG
tttttccaaagataaataga

SEQ ID NO: 46705 - DNA, 20 bp, Artificial Sequence
  Description of Artificial Sequence: Synthetic oligonucleotide
  Target: SCN9A; (+) strand; PAM type: NRG; PAM sequence: GGG
ttttccaaagataaatagaa

SEQ ID NO: 46706 - DNA, 20 bp, Artificial Sequence
  Description of Artificial Sequence: Synthetic oligonucleotide
  Target: SCN9A; (+) strand; PAM type: NRG; PAM sequence: AAG
tccaaagataaatagaaggg

SEQ ID NO: 46707 - DNA, 20 bp, Artificial Sequence
  Description of Artificial Sequence: Synthetic oligonucleotide
  Target: SCN9A; (+) strand; PAM type: NRG; PAM sequence: AAG
aaagataaatagaagggaag

SEQ ID NO: 46708 - DNA, 20 bp, Artificial Sequence
  Description of Artificial Sequence: Synthetic oligonucleotide
  Target: SCN9A; (+) strand; PAM type: NRG; PAM sequence: CAG
agggaagaagaatgctaact

SEQ ID NO: 46709 - DNA, 20 bp, Artificial Sequence
  Description of Artificial Sequence: Synthetic oligonucleotide
  Target: SCN9A; (+) strand; PAM type: NRG; PAM sequence: GAG
aagaagaatgctaactcagc

SEQ ID NO: 46710 - DNA, 20 bp, Artificial Sequence
  Description of Artificial Sequence: Synthetic oligonucleotide
  Target: SCN9A; (+) strand; PAM type: NRG; PAM sequence: TGG
atgctaactcagcgagcaca

SEQ ID NO: 46711 - DNA, 20 bp, Artificial Sequence
  Description of Artificial Sequence: Synthetic oligonucleotide
  Target: SCN9A; (+) strand; PAM type: NRG; PAM sequence: GGG
tgctaactcagcgagcacat

SEQ ID NO: 46712 - DNA, 20 bp, Artificial Sequence
  Description of Artificial Sequence: Synthetic oligonucleotide
  Target: SCN9A; (+) strand; PAM type: NRG; PAM sequence: GGG
gctaactcagcgagcacatg

SEQ ID NO: 46713 - DNA, 20 bp, Artificial Sequence
  Description of Artificial Sequence: Synthetic oligonucleotide
  Target: SCN9A; (+) strand; PAM type: NRG; PAM sequence: TGG
gagcacatggggaaaaacat

SEQ ID NO: 46714 - DNA, 20 bp, Artificial Sequence
  Description of Artificial Sequence: Synthetic oligonucleotide
  Target: SCN9A; (+) strand; PAM type: NRG; PAM sequence: GGG
agcacatggggaaaaacatt

SEQ ID NO: 46715 - DNA, 20 bp, Artificial Sequence
  Description of Artificial Sequence: Synthetic oligonucleotide
  Target: SCN9A; (+) strand; PAM type: NRG; PAM sequence: TAG
aaaaacattgggaatatttg

SEQ ID NO: 46716 - DNA, 20 bp, Artificial Sequence
  Description of Artificial Sequence: Synthetic oligonucleotide
  Target: SCN9A; (+) strand; PAM type: NRG; PAM sequence: TAG
gggaatatttgtagacaatt

SEQ ID NO: 46717 - DNA, 20 bp, Artificial Sequence
  Description of Artificial Sequence: Synthetic oligonucleotide
  Target: SCN9A; (+) strand; PAM type: NRG; PAM sequence: AAG
aatatttgtagacaatttag

SEQ ID NO: 46718 - DNA, 20 bp, Artificial Sequence
  Description of Artificial Sequence: Synthetic oligonucleotide
  Target: SCN9A; (+) strand; PAM type: NRG; PAM sequence: AAG
ttgtagacaatttagaagaa

SEQ ID NO: 46719 - DNA, 20 bp, Artificial Sequence
  Description of Artificial Sequence: Synthetic oligonucleotide
  Target: SCN9A; (+) strand; PAM type: NRG; PAM sequence: CAG
agacaatttagaagaaaaga

SEQ ID NO: 46720 - DNA, 20 bp, Artificial Sequence
  Description of Artificial Sequence: Synthetic oligonucleotide
  Target: SCN9A; (+) strand; PAM type: NRG; PAM sequence: CAG
tttagaagaaaagacagact

SEQ ID NO: 46721 - DNA, 20 bp, Artificial Sequence
  Description of Artificial Sequence: Synthetic oligonucleotide
  Target: SCN9A; (+) strand; PAM type: NRG; PAM sequence: AAG
aagaaaagacagactcagaa

SEQ ID NO: 46722 - DNA, 20 bp, Artificial Sequence
  Description of Artificial Sequence: Synthetic oligonucleotide
  Target: SCN9A; (+) strand; PAM type: NRG; PAM sequence: TGG
cagactcagaaaagaacttc

SEQ ID NO: 46723 - DNA, 20 bp, Artificial Sequence
  Description of Artificial Sequence: Synthetic oligonucleotide
  Target: SCN9A; (+) strand; PAM type: NRG; PAM sequence: TGG
tcttcaaatgtcaatttgtt

SEQ ID NO: 46724 - DNA, 20 bp, Artificial Sequence
  Description of Artificial Sequence: Synthetic oligonucleotide
  Target: SCN9A; (+) strand; PAM type: NRG; PAM sequence: GGG
cttcaaatgtcaatttgttt

SEQ ID NO: 46725 - DNA, 20 bp, Artificial Sequence
  Description of Artificial Sequence: Synthetic oligonucleotide
  Target: SCN9A; (+) strand; PAM type: NRG; PAM sequence: CAG
tgtcaatttgtttgggacca

SEQ ID NO: 46726 - DNA, 20 bp, Artificial Sequence
  Description of Artificial Sequence: Synthetic oligonucleotide
  Target: SCN9A; (+) strand; PAM type: NRG; PAM sequence: AAG
tttgtttgggaccacagcaa

SEQ ID NO: 46727 - DNA, 20 bp, Artificial Sequence
  Description of Artificial Sequence: Synthetic oligonucleotide
  Target: SCN9A; (+) strand; PAM type: NRG; PAM sequence: TAG
aaaagcaaaattatcttata

SEQ ID NO: 46728 - DNA, 20 bp, Artificial Sequence
  Description of Artificial Sequence: Synthetic oligonucleotide
  Target: SCN9A; (+) strand; PAM type: NRG; PAM sequence: AAG
atcttatatagacattgaca

SEQ ID NO: 46729 - DNA, 20 bp, Artificial Sequence
  Description of Artificial Sequence: Synthetic oligonucleotide
  Target: SCN9A; (+) strand; PAM type: NRG; PAM sequence: AAG
gacattgacaaagataccca

SEQ ID NO: 46730 - DNA, 20 bp, Artificial Sequence
  Description of Artificial Sequence: Synthetic oligonucleotide
  Target: SCN9A; (+) strand; PAM type: NRG; PAM sequence: TGG
aagatacccaaagttattca

SEQ ID NO: 46731 - DNA, 20 bp, Artificial Sequence
  Description of Artificial Sequence: Synthetic oligonucleotide
  Target: SCN9A; (+) strand; PAM type: NRG; PAM sequence: AAG
aaagttattcatggtttatg

SEQ ID NO: 46732 - DNA, 20 bp, Artificial Sequence
  Description of Artificial Sequence: Synthetic oligonucleotide
  Target: SCN9A; (+) strand; PAM type: NRG; PAM sequence: GAG
agttattcatggtttatgaa

SEQ ID NO: 46733 - DNA, 20 bp, Artificial Sequence
  Description of Artificial Sequence: Synthetic oligonucleotide
  Target: SCN9A; (+) strand; PAM type: NRG; PAM sequence: AAG
catggtttatgaagagtcat

SEQ ID NO: 46734 - DNA, 20 bp, Artificial Sequence
  Description of Artificial Sequence: Synthetic oligonucleotide
  Target: SCN9A; (+) strand; PAM type: NRG; PAM sequence: GAG
tttatgaagagtcataagct

SEQ ID NO: 46735 - DNA, 20 bp, Artificial Sequence
  Description of Artificial Sequence: Synthetic oligonucleotide
  Target: SCN9A; (+) strand; PAM type: NRG; PAM sequence: TGG
agtcataagctgagattctc

SEQ ID NO: 46736 - DNA, 20 bp, Artificial Sequence
  Description of Artificial Sequence: Synthetic oligonucleotide
  Target: SCN9A; (+) strand; PAM type: NRG; PAM sequence: TGG
ctctggccctaaaaatgaac

SEQ ID NO: 46737 - DNA, 20 bp, Artificial Sequence
  Description of Artificial Sequence: Synthetic oligonucleotide
  Target: SCN9A; (+) strand; PAM type: NRG; PAM sequence: TAG
tggtgcctgcctcacatcca

SEQ ID NO: 46738 - DNA, 20 bp, Artificial Sequence
  Description of Artificial Sequence: Synthetic oligonucleotide
  Target: SCN9A; (+) strand; PAM type: NRG; PAM sequence: TGG
tcacatccatagtcaaaaac

SEQ ID NO: 46739 - DNA, 20 bp, Artificial Sequence
  Description of Artificial Sequence: Synthetic oligonucleotide
  Target: SCN9A; (+) strand; PAM type: NRG; PAM sequence: GAG
actggcattttgtttaccct

SEQ ID NO: 46740 - DNA, 20 bp, Artificial Sequence
  Description of Artificial Sequence: Synthetic oligonucleotide
  Target: SCN9A; (+) strand; PAM type: NRG; PAM sequence: TAG
gcattttgtttaccctgagt

SEQ ID NO: 46741 - DNA, 20 bp, Artificial Sequence
  Description of Artificial Sequence: Synthetic oligonucleotide
  Target: SCN9A; (+) strand; PAM type: NRG; PAM sequence: CAG
ttaccctgagttagtgtgac

SEQ ID NO: 46742 - DNA, 20 bp, Artificial Sequence
  Description of Artificial Sequence: Synthetic oligonucleotide
  Target: SCN9A; (+) strand; PAM type: NRG; PAM sequence: TAG
gtgaccagcactgtacattt

SEQ ID NO: 46743 - DNA, 20 bp, Artificial Sequence
  Description of Artificial Sequence: Synthetic oligonucleotide
  Target: SCN9A; (+) strand; PAM type: NRG; PAM sequence: GAG
gaccagcactgtacatttta

SEQ ID NO: 46744 - DNA, 20 bp, Artificial Sequence
  Description of Artificial Sequence: Synthetic oligonucleotide
  Target: SCN9A; (+) strand; PAM type: NRG; PAM sequence: TGG
gtacattttagagatcactc

SEQ ID NO: 46745 - DNA, 20 bp, Artificial Sequence
  Description of Artificial Sequence: Synthetic oligonucleotide
  Target: SCN9A; (+) strand; PAM type: NRG; PAM sequence: TGG
ctggcatcaattttactaat

SEQ ID NO: 46746 - DNA, 20 bp, Artificial Sequence
  Description of Artificial Sequence: Synthetic oligonucleotide
  Target: SCN9A; (+) strand; PAM type: NRG; PAM sequence: CAG
taattggatcttatatcttc

SEQ ID NO: 46747 - DNA, 20 bp, Artificial Sequence
  Description of Artificial Sequence: Synthetic oligonucleotide
  Target: SCN9A; (+) strand; PAM type: NRG; PAM sequence: AAG
ttggatcttatatcttccag

SEQ ID NO: 46748 - DNA, 20 bp, Artificial Sequence
  Description of Artificial Sequence: Synthetic oligonucleotide
  Target: SCN9A; (+) strand; PAM type: NRG; PAM sequence: GAG
tcaccttcttgcctatcctt

SEQ ID NO: 46749 - DNA, 20 bp, Artificial Sequence
  Description of Artificial Sequence: Synthetic oligonucleotide
  Target: SCN9A; (+) strand; PAM type: NRG; PAM sequence: CAG
atccttgagtcttctatgtc

SEQ ID NO: 46750 - DNA, 20 bp, Artificial Sequence
  Description of Artificial Sequence: Synthetic oligonucleotide
  Target: SCN9A; (+) strand; PAM type: NRG; PAM sequence: TGG
tatgtccagttcaaccattt

SEQ ID NO: 46751 - DNA, 20 bp, Artificial Sequence
  Description of Artificial Sequence: Synthetic oligonucleotide
  Target: SCN9A; (+) strand; PAM type: NRG; PAM sequence: TAG
accattttggtttctcaaaa

SEQ ID NO: 46752 - DNA, 20 bp, Artificial Sequence
  Description of Artificial Sequence: Synthetic oligonucleotide
  Target: SCN9A; (+) strand; PAM type: NRG; PAM sequence: AAG
tctcaaaatagttgttttta

SEQ ID NO: 46753 - DNA, 20 bp, Artificial Sequence
  Description of Artificial Sequence: Synthetic oligonucleotide
  Target: SCN9A; (+) strand; PAM type: NRG; PAM sequence: AAG
tttttaaagcttgtttcatt

SEQ ID NO: 46754 - DNA, 20 bp, Artificial Sequence
  Description of Artificial Sequence: Synthetic oligonucleotide
  Target: SCN9A; (+) strand; PAM type: NRG; PAM sequence: AAG
cttgtttcattaagtctttg

SEQ ID NO: 46755 - DNA, 20 bp, Artificial Sequence
  Description of Artificial Sequence: Synthetic oligonucleotide
  Target: SCN9A; (+) strand; PAM type: NRG; PAM sequence: TAG
aatgatgttgatgatgatga

SEQ ID NO: 46756 - DNA, 20 bp, Artificial Sequence
  Description of Artificial Sequence: Synthetic oligonucleotide
  Target: SCN9A; (+) strand; PAM type: NRG; PAM sequence: CAG
attgtgtatttactatatgc

SEQ ID NO: 46757 - DNA, 20 bp, Artificial Sequence
  Description of Artificial Sequence: Synthetic oligonucleotide
  Target: SCN9A; (+) strand; PAM type: NRG; PAM sequence: AGG
ttgtgtatttactatatgcc

SEQ ID NO: 46758 - DNA, 20 bp, Artificial Sequence
  Description of Artificial Sequence: Synthetic oligonucleotide
  Target: SCN9A; (+) strand; PAM type: NRG; PAM sequence: AAG
ttactatatgccaggctaat

SEQ ID NO: 46759 - DNA, 20 bp, Artificial Sequence
  Description of Artificial Sequence: Synthetic oligonucleotide
  Target: SCN9A; (+) strand; PAM type: NRG; PAM sequence: CAG
ctatatgccaggctaataag

SEQ ID NO: 46760 - DNA, 20 bp, Artificial Sequence
  Description of Artificial Sequence: Synthetic oligonucleotide
  Target: SCN9A; (+) strand; PAM type: NRG; PAM sequence: AAG
atgccaggctaataagcaga

SEQ ID NO: 46761 - DNA, 20 bp, Artificial Sequence
  Description of Artificial Sequence: Synthetic oligonucleotide
  Target: SCN9A; (+) strand; PAM type: NRG; PAM sequence: AAG
agaaagcatttaatcctccc

SEQ ID NO: 46762 - DNA, 20 bp, Artificial Sequence
  Description of Artificial Sequence: Synthetic oligonucleotide
  Target: SCN9A; (+) strand; PAM type: NRG; PAM sequence: CAG
agaatatgataaatgaaata

SEQ ID NO: 46763 - DNA, 20 bp, Artificial Sequence
  Description of Artificial Sequence: Synthetic oligonucleotide
  Target: SCN9A; (+) strand; PAM type: NRG; PAM sequence: AAG
taaataattattttataatg

SEQ ID NO: 46764 - DNA, 20 bp, Artificial Sequence
  Description of Artificial Sequence: Synthetic oligonucleotide
  Target: SCN9A; (+) strand; PAM type: NRG; PAM sequence: CAG
aatgataaaattaaatacta

SEQ ID NO: 46765 - DNA, 20 bp, Artificial Sequence
  Description of Artificial Sequence: Synthetic oligonucleotide
  Target: SCN9A; (+) strand; PAM type: NRG; PAM sequence: GAG
tgataaaattaaatactaca

SEQ ID NO: 46766 - DNA, 20 bp, Artificial Sequence
  Description of Artificial Sequence: Synthetic oligonucleotide
  Target: SCN9A; (+) strand; PAM type: NRG; PAM sequence: AAG
cagagttaaaatatttgtcc

SEQ ID NO: 46767 - DNA, 20 bp, Artificial Sequence
  Description of Artificial Sequence: Synthetic oligonucleotide
  Target: SCN9A; (+) strand; PAM type: NRG; PAM sequence: AGG
agagttaaaatatttgtcca

SEQ ID NO: 46768 - DNA, 20 bp, Artificial Sequence
  Description of Artificial Sequence: Synthetic oligonucleotide
  Target: SCN9A; (+) strand; PAM type: NRG; PAM sequence: GGG
gagttaaaatatttgtccaa

SEQ ID NO: 46769 - DNA, 20 bp, Artificial Sequence
  Description of Artificial Sequence: Synthetic oligonucleotide
  Target: SCN9A; (+) strand; PAM type: NRG; PAM sequence: CAG
ggcatatcactcatataatg

SEQ ID NO: 46770 - DNA, 20 bp, Artificial Sequence
  Description of Artificial Sequence: Synthetic oligonucleotide
  Target: SCN9A; (+) strand; PAM type: NRG; PAM sequence: CAG
tcactcatataatgcagaat

SEQ ID NO: 46771 - DNA, 20 bp, Artificial Sequence
  Description of Artificial Sequence: Synthetic oligonucleotide
  Target: SCN9A; (+) strand; PAM type: NRG; PAM sequence: CAG
gcagaatcagcattcaaacc

SEQ ID NO: 46772 - DNA, 20 bp, Artificial Sequence
  Description of Artificial Sequence: Synthetic oligonucleotide
  Target: SCN9A; (+) strand; PAM type: NRG; PAM sequence: AGG
cagaatcagcattcaaaccc

SEQ ID NO: 46773 - DNA, 20 bp, Artificial Sequence
  Description of Artificial Sequence: Synthetic oligonucleotide
  Target: SCN9A; (+) strand; PAM type: NRG; PAM sequence: TGG
agcattcaaacccaggactt

SEQ ID NO: 46774 - DNA, 20 bp, Artificial Sequence
  Description of Artificial Sequence: Synthetic oligonucleotide
  Target: SCN9A; (+) strand; PAM type: NRG; PAM sequence: GGG
gcattcaaacccaggacttt

SEQ ID NO: 46775 - DNA, 20 bp, Artificial Sequence
  Description of Artificial Sequence: Synthetic oligonucleotide
  Target: SCN9A; (+) strand; PAM type: NRG; PAM sequence: GAG
acccaggactttgggactct

SEQ ID NO: 46776 - DNA, 20 bp, Artificial Sequence
  Description of Artificial Sequence: Synthetic oligonucleotide
  Target: SCN9A; (+) strand; PAM type: NRG; PAM sequence: AGG
cccaggactttgggactctg

SEQ ID NO: 46777 - DNA, 20 bp, Artificial Sequence
  Description of Artificial Sequence: Synthetic oligonucleotide
  Target: SCN9A; (+) strand; PAM type: NRG; PAM sequence: AAG
acttcactactattatgtca

SEQ ID NO: 46778 - DNA, 20 bp, Artificial Sequence
  Description of Artificial Sequence: Synthetic oligonucleotide
  Target: SCN9A; (+) strand; PAM type: NRG; PAM sequence: TAG
atgtcaaagcaatacatcca

SEQ ID NO: 46779 - DNA, 20 bp, Artificial Sequence
  Description of Artificial Sequence: Synthetic oligonucleotide
  Target: SCN9A; (+) strand; PAM type: NRG; PAM sequence: AGG
tgtcaaagcaatacatccat

SEQ ID NO: 46780 - DNA, 20 bp, Artificial Sequence
  Description of Artificial Sequence: Synthetic oligonucleotide
  Target: SCN9A; (+) strand; PAM type: NRG; PAM sequence: GAG
taggttttctgaaaatatgt

SEQ ID NO: 46781 - DNA, 20 bp, Artificial Sequence
  Description of Artificial Sequence: Synthetic oligonucleotide
  Target: SCN9A; (+) strand; PAM type: NRG; PAM sequence: AGG
aggttttctgaaaatatgtg

SEQ ID NO: 46782 - DNA, 20 bp, Artificial Sequence
  Description of Artificial Sequence: Synthetic oligonucleotide
  Target: SCN9A; (+) strand; PAM type: NRG; PAM sequence: AAG
tatgtgaggtgtgtacttac

SEQ ID NO: 46783 - DNA, 20 bp, Artificial Sequence
  Description of Artificial Sequence: Synthetic oligonucleotide
  Target: SCN9A; (+) strand; PAM type: NRG; PAM sequence: AAG
tgaggtgtgtacttacaaga

SEQ ID NO: 46784 - DNA, 20 bp, Artificial Sequence
  Description of Artificial Sequence: Synthetic oligonucleotide
  Target: SCN9A; (+) strand; PAM type: NRG; PAM sequence: CAG
ggtgtgtacttacaagaaag

SEQ ID NO: 46785 - DNA, 20 bp, Artificial Sequence
  Description of Artificial Sequence: Synthetic oligonucleotide
  Target: SCN9A; (+) strand; PAM type: NRG; PAM sequence: TAG
caagaaagcagcaatgtaat

SEQ ID NO: 46786 - DNA, 20 bp, Artificial Sequence
  Description of Artificial Sequence: Synthetic oligonucleotide
  Target: SCN9A; (+) strand; PAM type: NRG; PAM sequence: AGG
aagaaagcagcaatgtaatt

SEQ ID NO: 46787 - DNA, 20 bp, Artificial Sequence
  Description of Artificial Sequence: Synthetic oligonucleotide
  Target: SCN9A; (+) strand; PAM type: NRG; PAM sequence: AAG
aaagcagcaatgtaattagg

SEQ ID NO: 46788 - DNA, 20 bp, Artificial Sequence
  Description of Artificial Sequence: Synthetic oligonucleotide
  Target: SCN9A; (+) strand; PAM type: NRG; PAM sequence: AGG
aagcagcaatgtaattagga

SEQ ID NO: 46789 - DNA, 20 bp, Artificial Sequence
  Description of Artificial Sequence: Synthetic oligonucleotide
  Target: SCN9A; (+) strand; PAM type: NRG; PAM sequence: GAG
caatgtaattaggaaggtgt

SEQ ID NO: 46790 - DNA, 20 bp, Artificial Sequence
  Description of Artificial Sequence: Synthetic oligonucleotide
  Target: SCN9A; (+) strand; PAM type: NRG; PAM sequence: AAG
gtaattaggaaggtgtgaga

SEQ ID NO: 46791 - DNA, 20 bp, Artificial Sequence
  Description of Artificial Sequence: Synthetic oligonucleotide
  Target: SCN9A; (+) strand; PAM type: NRG; PAM sequence: AAG
gagaaagaaccaaaaatgtt

SEQ ID NO: 46792 - DNA, 20 bp, Artificial Sequence
  Description of Artificial Sequence: Synthetic oligonucleotide
  Target: SCN9A; (+) strand; PAM type: NRG; PAM sequence: AAG
aaatgttaagtgttgctccc

SEQ ID NO: 46793 - DNA, 20 bp, Artificial Sequence
  Description of Artificial Sequence: Synthetic oligonucleotide
  Target: SCN9A; (+) strand; PAM type: NRG; PAM sequence: TGG
gttgctcccaagaaatatgc

SEQ ID NO: 46794 - DNA, 20 bp, Artificial Sequence
  Description of Artificial Sequence: Synthetic oligonucleotide
  Target: SCN9A; (+) strand; PAM type: NRG; PAM sequence: CAG
gctcccaagaaatatgctgg

SEQ ID NO: 46795 - DNA, 20 bp, Artificial Sequence
  Description of Artificial Sequence: Synthetic oligonucleotide
  Target: SCN9A; (+) strand; PAM type: NRG; PAM sequence: AAG
aaaaatcattatcaactccc

SEQ ID NO: 46796 - DNA, 20 bp, Artificial Sequence
  Description of Artificial Sequence: Synthetic oligonucleotide
  Target: SCN9A; (+) strand; PAM type: NRG; PAM sequence: TGG
atcattatcaactcccaaga

SEQ ID NO: 46797 - DNA, 20 bp, Artificial Sequence
  Description of Artificial Sequence: Synthetic oligonucleotide
  Target: SCN9A; (+) strand; PAM type: NRG; PAM sequence: TAG
cccaagatggtaacctttta

SEQ ID NO: 46798 - DNA, 20 bp, Artificial Sequence
  Description of Artificial Sequence: Synthetic oligonucleotide
  Target: SCN9A; (+) strand; PAM type: NRG; PAM sequence: TAG
atggtaaccttttatagaaa

SEQ ID NO: 46799 - DNA, 20 bp, Artificial Sequence
  Description of Artificial Sequence: Synthetic oligonucleotide
  Target: SCN9A; (+) strand; PAM type: NRG; PAM sequence: TAG
agaaatagtattgttatttg

SEQ ID NO: 46800 - DNA, 20 bp, Artificial Sequence
  Description of Artificial Sequence: Synthetic oligonucleotide
  Target: SCN9A; (+) strand; PAM type: NRG; PAM sequence: CAG
ttgttatttgtagacctcaa

SEQ ID NO: 46801 - DNA, 20 bp, Artificial Sequence
  Description of Artificial Sequence: Synthetic oligonucleotide
  Target: SCN9A; (+) strand; PAM type: NRG; PAM sequence: AAG
gtactgcacaattattttaa

SEQ ID NO: 46802 - DNA, 20 bp, Artificial Sequence
  Description of Artificial Sequence: Synthetic oligonucleotide
  Target: SCN9A; (+) strand; PAM type: NRG; PAM sequence: CAG
attattttaaaagacataac

SEQ ID NO: 46803 - DNA, 20 bp, Artificial Sequence
  Description of Artificial Sequence: Synthetic oligonucleotide
  Target: SCN9A; (+) strand; PAM type: NRG; PAM sequence: TGG
actctacacatccattcata

SEQ ID NO: 46804 - DNA, 20 bp, Artificial Sequence
  Description of Artificial Sequence: Synthetic oligonucleotide
  Target: SCN9A; (+) strand; PAM type: NRG; PAM sequence: AAG
tacacatccattcatatgga

SEQ ID NO: 46805 - DNA, 20 bp, Artificial Sequence
  Description of Artificial Sequence: Synthetic oligonucleotide
  Target: SCN9A; (+) strand; PAM type: NRG; PAM sequence: TGG
tccattcatatggaaagttc

SEQ ID NO: 46806 - DNA, 20 bp, Artificial Sequence
  Description of Artificial Sequence: Synthetic oligonucleotide
  Target: SCN9A; (+) strand; PAM type: NRG; PAM sequence: GAG
ttctggatatgcataattct

SEQ ID NO: 46807 - DNA, 20 bp, Artificial Sequence
  Description of Artificial Sequence: Synthetic oligonucleotide
  Target: SCN9A; (+) strand; PAM type: NRG; PAM sequence: AGG
tctggatatgcataattctg

SEQ ID NO: 46808 - DNA, 20 bp, Artificial Sequence
  Description of Artificial Sequence: Synthetic oligonucleotide
  Target: SCN9A; (+) strand; PAM type: NRG; PAM sequence: CAG
tatgcataattctgaggctg

SEQ ID NO: 46809 - DNA, 20 bp, Artificial Sequence
  Description of Artificial Sequence: Synthetic oligonucleotide
  Target: SCN9A; (+) strand; PAM type: NRG; PAM sequence: AAG
tgacaatgatgacaactaaa

SEQ ID NO: 46810 - DNA, 20 bp, Artificial Sequence
  Description of Artificial Sequence: Synthetic oligonucleotide
  Target: SCN9A; (+) strand; PAM type: NRG; PAM sequence: GAG
acaatgatgacaactaaaaa

SEQ ID NO: 46811 - DNA, 20 bp, Artificial Sequence
  Description of Artificial Sequence: Synthetic oligonucleotide
  Target: SCN9A; (+) strand; PAM type: NRG; PAM sequence: GAG
caactaaaaagagaaactat

SEQ ID NO: 46812 - DNA, 20 bp, Artificial Sequence
  Description of Artificial Sequence: Synthetic oligonucleotide
  Target: SCN9A; (+) strand; PAM type: NRG; PAM sequence: AAG
atgagtacataacacacaat

SEQ ID NO: 46813 - DNA, 20 bp, Artificial Sequence
  Description of Artificial Sequence: Synthetic oligonucleotide
  Target: SCN9A; (+) strand; PAM type: NRG; PAM sequence: GAG
gagtacataacacacaataa

SEQ ID NO: 46814 - DNA, 20 bp, Artificial Sequence
  Description of Artificial Sequence: Synthetic oligonucleotide
  Target: SCN9A; (+) strand; PAM type: NRG; PAM sequence: TAG
gagacttaccaaatttccta

SEQ ID NO: 46815 - DNA, 20 bp, Artificial Sequence
  Description of Artificial Sequence: Synthetic oligonucleotide
  Target: SCN9A; (+) strand; PAM type: NRG; PAM sequence: AAG
cttaccaaatttcctatagc

SEQ ID NO: 46816 - DNA, 20 bp, Artificial Sequence
  Description of Artificial Sequence: Synthetic oligonucleotide
  Target: SCN9A; (+) strand; PAM type: NRG; PAM sequence: CAG
aagtacatttttgaattcct

SEQ ID NO: 46817 - DNA, 20 bp, Artificial Sequence
  Description of Artificial Sequence: Synthetic oligonucleotide
  Target: SCN9A; (+) strand; PAM type: NRG; PAM sequence: TGG
tttttgaattcctcagtcat

SEQ ID NO: 46818 - DNA, 20 bp, Artificial Sequence
  Description of Artificial Sequence: Synthetic oligonucleotide
  Target: SCN9A; (+) strand; PAM type: NRG; PAM sequence: GGG
ttttgaattcctcagtcatt

SEQ ID NO: 46819 - DNA, 20 bp, Artificial Sequence
  Description of Artificial Sequence: Synthetic oligonucleotide
  Target: SCN9A; (+) strand; PAM type: NRG; PAM sequence: TGG
tgaattcctcagtcattggg

SEQ ID NO: 46820 - DNA, 20 bp, Artificial Sequence
  Description of Artificial Sequence: Synthetic oligonucleotide
  Target: SCN9A; (+) strand; PAM type: NRG; PAM sequence: TAG
agtcattgggtggtgttcca

SEQ ID NO: 46821 - DNA, 20 bp, Artificial Sequence
  Description of Artificial Sequence: Synthetic oligonucleotide
  Target: SCN9A; (+) strand; PAM type: NRG; PAM sequence: TGG
tgtgtttaaaactatgcaaa

SEQ ID NO: 46822 - DNA, 20 bp, Artificial Sequence
  Description of Artificial Sequence: Synthetic oligonucleotide
  Target: SCN9A; (+) strand; PAM type: NRG; PAM sequence: AAG
actatgcaaatggtaattgc

SEQ ID NO: 46823 - DNA, 20 bp, Artificial Sequence
  Description of Artificial Sequence: Synthetic oligonucleotide
  Target: SCN9A; (+) strand; PAM type: NRG; PAM sequence: AAG
ggtaattgcaagatctacaa

SEQ ID NO: 46824 - DNA, 20 bp, Artificial Sequence
  Description of Artificial Sequence: Synthetic oligonucleotide
  Target: SCN9A; (+) strand; PAM type: NRG; PAM sequence: AGG
gtaattgcaagatctacaaa

SEQ ID NO: 46825 - DNA, 20 bp, Artificial Sequence
  Description of Artificial Sequence: Synthetic oligonucleotide
  Target: SCN9A; (+) strand; PAM type: NRG; PAM sequence: TAG
aaggatccattacaataaaa

SEQ ID NO: 46826 - DNA, 20 bp, Artificial Sequence
  Description of Artificial Sequence: Synthetic oligonucleotide
  Target: SCN9A; (+) strand; PAM type: NRG; PAM sequence: TGG
tttttgaattttatccaata

SEQ ID NO: 46827 - DNA, 20 bp, Artificial Sequence
  Description of Artificial Sequence: Synthetic oligonucleotide
  Target: SCN9A; (+) strand; PAM type: NRG; PAM sequence: GAG
tttgaattttatccaatatg

SEQ ID NO: 46828 - DNA, 20 bp, Artificial Sequence
  Description of Artificial Sequence: Synthetic oligonucleotide
  Target: SCN9A; (+) strand; PAM type: NRG; PAM sequence: GAG
tgaattttatccaatatgga

SEQ ID NO: 46829 - DNA, 20 bp, Artificial Sequence
  Description of Artificial Sequence: Synthetic oligonucleotide
  Target: SCN9A; (+) strand; PAM type: NRG; PAM sequence: CAG
tccaatatggagagcaattc

SEQ ID NO: 46830 - DNA, 20 bp, Artificial Sequence
  Description of Artificial Sequence: Synthetic oligonucleotide
  Target: SCN9A; (+) strand; PAM type: NRG; PAM sequence: AAG
atggagagcaattccagatc

SEQ ID NO: 46831 - DNA, 20 bp, Artificial Sequence
  Description of Artificial Sequence: Synthetic oligonucleotide
  Target: SCN9A; (+) strand; PAM type: NRG; PAM sequence: AAG
gtgtgcaaatctgtaccacc

SEQ ID NO: 46832 - DNA, 20 bp, Artificial Sequence
  Description of Artificial Sequence: Synthetic oligonucleotide
  Target: SCN9A; (+) strand; PAM type: NRG; PAM sequence: AGG
tgtgcaaatctgtaccacca

SEQ ID NO: 46833 - DNA, 20 bp, Artificial Sequence
  Description of Artificial Sequence: Synthetic oligonucleotide
  Target: SCN9A; (+) strand; PAM type: NRG; PAM sequence: TGG
gcaaatctgtaccaccaagg

SEQ ID NO: 46834 - DNA, 20 bp, Artificial Sequence
  Description of Artificial Sequence: Synthetic oligonucleotide
  Target: SCN9A; (+) strand; PAM type: NRG; PAM sequence: TGG
ccaaggtggacatttttgtc

SEQ ID NO: 46835 - DNA, 20 bp, Artificial Sequence
  Description of Artificial Sequence: Synthetic oligonucleotide
  Target: SCN9A; (+) strand; PAM type: NRG; PAM sequence: AAG
catttttgtctggactcttc

SEQ ID NO: 46836 - DNA, 20 bp, Artificial Sequence
  Description of Artificial Sequence: Synthetic oligonucleotide
  Target: SCN9A; (+) strand; PAM type: NRG; PAM sequence: TGG
tgtctggactcttcaagttc

SEQ ID NO: 46837 - DNA, 20 bp, Artificial Sequence
  Description of Artificial Sequence: Synthetic oligonucleotide
  Target: SCN9A; (+) strand; PAM type: NRG; PAM sequence: GGG
gtctggactcttcaagttct

SEQ ID NO: 46838 - DNA, 20 bp, Artificial Sequence
  Description of Artificial Sequence: Synthetic oligonucleotide
  Target: SCN9A; (+) strand; PAM type: NRG; PAM sequence: GAG
ctggactcttcaagttctgg

SEQ ID NO: 46839 - DNA, 20 bp, Artificial Sequence
  Description of Artificial Sequence: Synthetic oligonucleotide
  Target: SCN9A; (+) strand; PAM type: NRG; PAM sequence: AAG
cttcaagttctgggagaaaa

SEQ ID NO: 46840 - DNA, 20 bp, Artificial Sequence
  Description of Artificial Sequence: Synthetic oligonucleotide
  Target: SCN9A; (+) strand; PAM type: NRG; PAM sequence: CAG
caagttctgggagaaaaaag

SEQ ID NO: 46841 - DNA, 20 bp, Artificial Sequence
  Description of Artificial Sequence: Synthetic oligonucleotide
  Target: SCN9A; (+) strand; PAM type: NRG; PAM sequence: GAG
agttctgggagaaaaaagca

SEQ ID NO: 46842 - DNA, 20 bp, Artificial Sequence
  Description of Artificial Sequence: Synthetic oligonucleotide
  Target: SCN9A; (+) strand; PAM type: NRG; PAM sequence: TGG
ggagaaaaaagcagagaaca

SEQ ID NO: 46843 - DNA, 20 bp, Artificial Sequence
  Description of Artificial Sequence: Synthetic oligonucleotide
  Target: SCN9A; (+) strand; PAM type: NRG; PAM sequence: GAG
agaaaaaagcagagaacatg

SEQ ID NO: 46844 - DNA, 20 bp, Artificial Sequence
  Description of Artificial Sequence: Synthetic oligonucleotide
  Target: SCN9A; (+) strand; PAM type: NRG; PAM sequence: CAG
aaaagcagagaacatggagt

SEQ ID NO: 46845 - DNA, 20 bp, Artificial Sequence
  Description of Artificial Sequence: Synthetic oligonucleotide
  Target: SCN9A; (+) strand; PAM type: NRG; PAM sequence: CAG
ttgtctgtttcactcctaac

SEQ ID NO: 46846 - DNA, 20 bp, Artificial Sequence
  Description of Artificial Sequence: Synthetic oligonucleotide
  Target: SCN9A; (+) strand; PAM type: NRG; PAM sequence: CAG
actcctaaccagatacaaat

SEQ ID NO: 46847 - DNA, 20 bp, Artificial Sequence
  Description of Artificial Sequence: Synthetic oligonucleotide
  Target: SCN9A; (+) strand; PAM type: NRG; PAM sequence: CAG
ctaaccagatacaaatcagt

SEQ ID NO: 46848 - DNA, 20 bp, Artificial Sequence
  Description of Artificial Sequence: Synthetic oligonucleotide
  Target: SCN9A; (+) strand; PAM type: NRG; PAM sequence: AGG
taaccagatacaaatcagtc

SEQ ID NO: 46849 - DNA, 20 bp, Artificial Sequence
  Description of Artificial Sequence: Synthetic oligonucleotide
  Target: SCN9A; (+) strand; PAM type: NRG; PAM sequence: AAG
aggcattctaatattgaaac

SEQ ID NO: 46850 - DNA, 20 bp, Artificial Sequence
  Description of Artificial Sequence: Synthetic oligonucleotide
  Target: SCN9A; (+) strand; PAM type: NRG; PAM sequence: AGG
ggcattctaatattgaaaca

SEQ ID NO: 46851 - DNA, 20 bp, Artificial Sequence
  Description of Artificial Sequence: Synthetic oligonucleotide
  Target: SCN9A; (+) strand; PAM type: NRG; PAM sequence: TAG
taatattgaaacaaggttta

SEQ ID NO: 46852 - DNA, 20 bp, Artificial Sequence
  Description of Artificial Sequence: Synthetic oligonucleotide
  Target: SCN9A; (+) strand; PAM type: NRG; PAM sequence: TAG
ttgaaacaaggtttatagtt

SEQ ID NO: 46853 - DNA, 20 bp, Artificial Sequence
  Description of Artificial Sequence: Synthetic oligonucleotide
  Target: SCN9A; (+) strand; PAM type: NRG; PAM sequence: CAG
tttagattttgaaaatttaa

SEQ ID NO: 46854 - DNA, 20 bp, Artificial Sequence
  Description of Artificial Sequence: Synthetic oligonucleotide
  Target: SCN9A; (+) strand; PAM type: NRG; PAM sequence: AAG
taacagtactatttcaatga

SEQ ID NO: 46855 - DNA, 20 bp, Artificial Sequence
  Description of Artificial Sequence: Synthetic oligonucleotide
  Target: SCN9A; (+) strand; PAM type: NRG; PAM sequence: TAG
gtactatttcaatgaaagca

SEQ ID NO: 46856 - DNA, 20 bp, Artificial Sequence
  Description of Artificial Sequence: Synthetic oligonucleotide
  Target: SCN9A; (+) strand; PAM type: NRG; PAM sequence: AAG
gaaagcatagcctcttatgt

SEQ ID NO: 46857 - DNA, 20 bp, Artificial Sequence
  Description of Artificial Sequence: Synthetic oligonucleotide
  Target: SCN9A; (+) strand; PAM type: NRG; PAM sequence: TAG
attatgacatgttcgttgcc

SEQ ID NO: 46858 - DNA, 20 bp, Artificial Sequence
  Description of Artificial Sequence: Synthetic oligonucleotide
  Target: SCN9A; (+) strand; PAM type: NRG; PAM sequence: AAG
acatgttcgttgcctagatg

SEQ ID NO: 46859 - DNA, 20 bp, Artificial Sequence
  Description of Artificial Sequence: Synthetic oligonucleotide
  Target: SCN9A; (+) strand; PAM type: NRG; PAM sequence: AAG
tcgttgcctagatgaagcat

SEQ ID NO: 46860 - DNA, 20 bp, Artificial Sequence
  Description of Artificial Sequence: Synthetic oligonucleotide
  Target: SCN9A; (+) strand; PAM type: NRG; PAM sequence: GAG
gttgcctagatgaagcataa

SEQ ID NO: 46861 - DNA, 20 bp, Artificial Sequence
  Description of Artificial Sequence: Synthetic oligonucleotide
  Target: SCN9A; (+) strand; PAM type: NRG; PAM sequence: GAG
tgcctagatgaagcataaga

SEQ ID NO: 46862 - DNA, 20 bp, Artificial Sequence
  Description of Artificial Sequence: Synthetic oligonucleotide
  Target: SCN9A; (+) strand; PAM type: NRG; PAM sequence: AGG
gcctagatgaagcataagag

SEQ ID NO: 46863 - DNA, 20 bp, Artificial Sequence
  Description of Artificial Sequence: Synthetic oligonucleotide
  Target: SCN9A; (+) strand; PAM type: NRG; PAM sequence: GGG
cctagatgaagcataagaga

SEQ ID NO: 46864 - DNA, 20 bp, Artificial Sequence
  Description of Artificial Sequence: Synthetic oligonucleotide
  Target: SCN9A; (+) strand; PAM type: NRG; PAM sequence: AAG
gatgaagcataagagagggt

SEQ ID NO: 46865 - DNA, 20 bp, Artificial Sequence
  Description of Artificial Sequence: Synthetic oligonucleotide
  Target: SCN9A; (+) strand; PAM type: NRG; PAM sequence: AGG
atgaagcataagagagggta

SEQ ID NO: 46866 - DNA, 20 bp, Artificial Sequence
  Description of Artificial Sequence: Synthetic oligonucleotide
  Target: SCN9A; (+) strand; PAM type: NRG; PAM sequence: AAG
aagcataagagagggtaagg

SEQ ID NO: 46867 - DNA, 20 bp, Artificial Sequence
  Description of Artificial Sequence: Synthetic oligonucleotide
  Target: SCN9A; (+) strand; PAM type: NRG; PAM sequence: AAG
gaagtgaaatttatgactgc

SEQ ID NO: 46868 - DNA, 20 bp, Artificial Sequence
  Description of Artificial Sequence: Synthetic oligonucleotide
  Target: SCN9A; (+) strand; PAM type: NRG; PAM sequence: TGG
tatgactgcaagcacatatg

SEQ ID NO: 46869 - DNA, 20 bp, Artificial Sequence
  Description of Artificial Sequence: Synthetic oligonucleotide
  Target: SCN9A; (+) strand; PAM type: NRG; PAM sequence: GGG
atgactgcaagcacatatgt

SEQ ID NO: 46870 - DNA, 20 bp, Artificial Sequence
  Description of Artificial Sequence: Synthetic oligonucleotide
  Target: SCN9A; (+) strand; PAM type: NRG; PAM sequence: CAG
gcacatatgtgggcatcttt

SEQ ID NO: 46871 - DNA, 20 bp, Artificial Sequence
  Description of Artificial Sequence: Synthetic oligonucleotide
  Target: SCN9A; (+) strand; PAM type: NRG; PAM sequence: GAG
acatatgtgggcatctttca

SEQ ID NO: 46872 - DNA, 20 bp, Artificial Sequence
  Description of Artificial Sequence: Synthetic oligonucleotide
  Target: SCN9A; (+) strand; PAM type: NRG; PAM sequence: TGG
aaaatgcacctaacatgtga

SEQ ID NO: 46873 - DNA, 20 bp, Artificial Sequence
  Description of Artificial Sequence: Synthetic oligonucleotide
  Target: SCN9A; (+) strand; PAM type: NRG; PAM sequence: CAG
acctaacatgtgatggtaaa

SEQ ID NO: 46874 - DNA, 20 bp, Artificial Sequence
  Description of Artificial Sequence: Synthetic oligonucleotide
  Target: SCN9A; (+) strand; PAM type: NRG; PAM sequence: AGG
cctaacatgtgatggtaaac

SEQ ID NO: 46875 - DNA, 20 bp, Artificial Sequence
  Description of Artificial Sequence: Synthetic oligonucleotide
  Target: SCN9A; (+) strand; PAM type: NRG; PAM sequence: GAG
taacatgtgatggtaaacag

SEQ ID NO: 46876 - DNA, 20 bp, Artificial Sequence
  Description of Artificial Sequence: Synthetic oligonucleotide
  Target: SCN9A; (+) strand; PAM type: NRG; PAM sequence: CAG
ggagaactatgtttccttaa

SEQ ID NO: 46877 - DNA, 20 bp, Artificial Sequence
  Description of Artificial Sequence: Synthetic oligonucleotide
  Target: SCN9A; (+) strand; PAM type: NRG; PAM sequence: GAG
agaactatgtttccttaaca

SEQ ID NO: 46878 - DNA, 20 bp, Artificial Sequence
  Description of Artificial Sequence: Synthetic oligonucleotide
  Target: SCN9A; (+) strand; PAM type: NRG; PAM sequence: TAG
atatttttcacctgtgtttt

SEQ ID NO: 46879 - DNA, 20 bp, Artificial Sequence
  Description of Artificial Sequence: Synthetic oligonucleotide
  Target: SCN9A; (+) strand; PAM type: NRG; PAM sequence: AAG
tttagtcccatgacaacaat

SEQ ID NO: 46880 - DNA, 20 bp, Artificial Sequence
  Description of Artificial Sequence: Synthetic oligonucleotide
  Target: SCN9A; (+) strand; PAM type: NRG; PAM sequence: GAG
tcccatgacaacaataagat

SEQ ID NO: 46881 - DNA, 20 bp, Artificial Sequence
  Description of Artificial Sequence: Synthetic oligonucleotide
  Target: SCN9A; (+) strand; PAM type: NRG; PAM sequence: CAG
taagatgagactattctgtc

SEQ ID NO: 46882 - DNA, 20 bp, Artificial Sequence
  Description of Artificial Sequence: Synthetic oligonucleotide
  Target: SCN9A; (+) strand; PAM type: NRG; PAM sequence: TAG
agaaaaaactcttgctgtaa

SEQ ID NO: 46883 - DNA, 20 bp, Artificial Sequence
  Description of Artificial Sequence: Synthetic oligonucleotide
  Target: SCN9A; (+) strand; PAM type: NRG; PAM sequence: CAG
actcttgctgtaatagttca

SEQ ID NO: 46884 - DNA, 20 bp, Artificial Sequence
  Description of Artificial Sequence: Synthetic oligonucleotide
  Target: SCN9A; (+) strand; PAM type: NRG; PAM sequence: AGG
ctcttgctgtaatagttcac

SEQ ID NO: 46885 - DNA, 20 bp, Artificial Sequence
  Description of Artificial Sequence: Synthetic oligonucleotide
  Target: SCN9A; (+) strand; PAM type: NRG; PAM sequence: TAG
ttcacaggtgaaaacaatcc

SEQ ID NO: 46886 - DNA, 20 bp, Artificial Sequence
  Description of Artificial Sequence: Synthetic oligonucleotide
  Target: SCN9A; (+) strand; PAM type: NRG; PAM sequence: AAG
gtgaaaacaatcctagaacc

SEQ ID NO: 46887 - DNA, 20 bp, Artificial Sequence
  Description of Artificial Sequence: Synthetic oligonucleotide
  Target: SCN9A; (+) strand; PAM type: NRG; PAM sequence: TAG
caatcctagaaccaagcaac

SEQ ID NO: 46888 - DNA, 20 bp, Artificial Sequence
  Description of Artificial Sequence: Synthetic oligonucleotide
  Target: SCN9A; (+) strand; PAM type: NRG; PAM sequence: TGG
aagcaactagaaataattta

SEQ ID NO: 46889 - DNA, 20 bp, Artificial Sequence
  Description of Artificial Sequence: Synthetic oligonucleotide
  Target: SCN9A; (+) strand; PAM type: NRG; PAM sequence: GAG
gcaactagaaataatttatg

SEQ ID NO: 46890 - DNA, 20 bp, Artificial Sequence
  Description of Artificial Sequence: Synthetic oligonucleotide
  Target: SCN9A; (+) strand; PAM type: NRG; PAM sequence: AGG
caactagaaataatttatgg

SEQ ID NO: 46891 - DNA, 20 bp, Artificial Sequence
  Description of Artificial Sequence: Synthetic oligonucleotide
  Target: SCN9A; (+) strand; PAM type: NRG; PAM sequence: TAG
tttatggaggactcatgaaa

SEQ ID NO: 46892 - DNA, 20 bp, Artificial Sequence
  Description of Artificial Sequence: Synthetic oligonucleotide
  Target: SCN9A; (+) strand; PAM type: NRG; PAM sequence: TAG
aaatagacatttcacaccat

SEQ ID NO: 46893 - DNA, 20 bp, Artificial Sequence
  Description of Artificial Sequence: Synthetic oligonucleotide
  Target: SCN9A; (+) strand; PAM type: NRG; PAM sequence: TAG
tttacttctcaccatttatt

SEQ ID NO: 46894 - DNA, 20 bp, Artificial Sequence
  Description of Artificial Sequence: Synthetic oligonucleotide
  Target: SCN9A; (+) strand; PAM type: NRG; PAM sequence: AGG
ttacttctcaccatttattt

SEQ ID NO: 46895 - DNA, 20 bp, Artificial Sequence
  Description of Artificial Sequence: Synthetic oligonucleotide
  Target: SCN9A; (+) strand; PAM type: NRG; PAM sequence: GAG
acttctcaccatttatttag

SEQ ID NO: 46896 - DNA, 20 bp, Artificial Sequence
  Description of Artificial Sequence: Synthetic oligonucleotide
  Target: SCN9A; (+) strand; PAM type: NRG; PAM sequence: GAG
tcaccatttatttaggagat

SEQ ID NO: 46897 - DNA, 20 bp, Artificial Sequence
  Description of Artificial Sequence: Synthetic oligonucleotide
  Target: SCN9A; (+) strand; PAM type: NRG; PAM sequence: TAG
ccatttatttaggagatgag

SEQ ID NO: 46898 - DNA, 20 bp, Artificial Sequence
  Description of Artificial Sequence: Synthetic oligonucleotide
  Target: SCN9A; (+) strand; PAM type: NRG; PAM sequence: TGG
tagacactttgcccccacaa

SEQ ID NO: 46899 - DNA, 20 bp, Artificial Sequence
  Description of Artificial Sequence: Synthetic oligonucleotide
  Target: SCN9A; (+) strand; PAM type: NRG; PAM sequence: GGG
agacactttgcccccacaat

SEQ ID NO: 46900 - DNA, 20 bp, Artificial Sequence
  Description of Artificial Sequence: Synthetic oligonucleotide
  Target: SCN9A; (+) strand; PAM type: NRG; PAM sequence: TGG
ttgcccccacaatgggaatg

SEQ ID NO: 46901 - DNA, 20 bp, Artificial Sequence
  Description of Artificial Sequence: Synthetic oligonucleotide
  Target: SCN9A; (+) strand; PAM type: NRG; PAM sequence: GGG
tgcccccacaatgggaatgt

SEQ ID NO: 46902 - DNA, 20 bp, Artificial Sequence
  Description of Artificial Sequence: Synthetic oligonucleotide
  Target: SCN9A; (+) strand; PAM type: NRG; PAM sequence: GGG
gcccccacaatgggaatgtg

SEQ ID NO: 46903 - DNA, 20 bp, Artificial Sequence
  Description of Artificial Sequence: Synthetic oligonucleotide
  Target: SCN9A; (+) strand; PAM type: NRG; PAM sequence: GGG
cccccacaatgggaatgtgg

SEQ ID NO: 46904 - DNA, 20 bp, Artificial Sequence
  Description of Artificial Sequence: Synthetic oligonucleotide
  Target: SCN9A; (+) strand; PAM type: NRG; PAM sequence: GGG
ccccacaatgggaatgtggg

SEQ ID NO: 46905 - DNA, 20 bp, Artificial Sequence
  Description of Artificial Sequence: Synthetic oligonucleotide
  Target: SCN9A; (+) strand; PAM type: NRG; PAM sequence: AAG
caatgggaatgtggggggtg

SEQ ID NO: 46906 - DNA, 20 bp, Artificial Sequence
  Description of Artificial Sequence: Synthetic oligonucleotide
  Target: SCN9A; (+) strand; PAM type: NRG; PAM sequence: TAG
gaatgtggggggtgaagtgt

SEQ ID NO: 46907 - DNA, 20 bp, Artificial Sequence
  Description of Artificial Sequence: Synthetic oligonucleotide
  Target: SCN9A; (+) strand; PAM type: NRG; PAM sequence: CAG
ggggggtgaagtgttagacc

SEQ ID NO: 46908 - DNA, 20 bp, Artificial Sequence
  Description of Artificial Sequence: Synthetic oligonucleotide
  Target: SCN9A; (+) strand; PAM type: NRG; PAM sequence: AGG
gggggtgaagtgttagaccc

SEQ ID NO: 46909 - DNA, 20 bp, Artificial Sequence
  Description of Artificial Sequence: Synthetic oligonucleotide
  Target: SCN9A; (+) strand; PAM type: NRG; PAM sequence: GGG
ggggtgaagtgttagaccca

SEQ ID NO: 46910 - DNA, 20 bp, Artificial Sequence
  Description of Artificial Sequence: Synthetic oligonucleotide
  Target: SCN9A; (+) strand; PAM type: NRG; PAM sequence: CAG
gaagtgttagacccagggac

SEQ ID NO: 46911 - DNA, 20 bp, Artificial Sequence
  Description of Artificial Sequence: Synthetic oligonucleotide
  Target: SCN9A; (+) strand; PAM type: NRG; PAM sequence: AGG
aagtgttagacccagggacc

SEQ ID NO: 46912 - DNA, 20 bp, Artificial Sequence
  Description of Artificial Sequence: Synthetic oligonucleotide
  Target: SCN9A; (+) strand; PAM type: NRG; PAM sequence: TGG
tgttagacccagggaccagg

SEQ ID NO: 46913 - DNA, 20 bp, Artificial Sequence
  Description of Artificial Sequence: Synthetic oligonucleotide
  Target: SCN9A; (+) strand; PAM type: NRG; PAM sequence: GGG
gttagacccagggaccaggt

SEQ ID NO: 46914 - DNA, 20 bp, Artificial Sequence
  Description of Artificial Sequence: Synthetic oligonucleotide
  Target: SCN9A; (+) strand; PAM type: NRG; PAM sequence: TGG
cccagggaccaggtgggacc

SEQ ID NO: 46915 - DNA, 20 bp, Artificial Sequence
  Description of Artificial Sequence: Synthetic oligonucleotide
  Target: SCN9A; (+) strand; PAM type: NRG; PAM sequence: GGG
ccagggaccaggtgggacct

SEQ ID NO: 46916 - DNA, 20 bp, Artificial Sequence
  Description of Artificial Sequence: Synthetic oligonucleotide
  Target: SCN9A; (+) strand; PAM type: NRG; PAM sequence: GGG
cagggaccaggtgggacctg

SEQ ID NO: 46917 - DNA, 20 bp, Artificial Sequence
  Description of Artificial Sequence: Synthetic oligonucleotide
  Target: SCN9A; (+) strand; PAM type: NRG; PAM sequence: CAG
tgggacctggggcatattgt

SEQ ID NO: 46918 - DNA, 20 bp, Artificial Sequence
  Description of Artificial Sequence: Synthetic oligonucleotide
  Target: SCN9A; (+) strand; PAM type: NRG; PAM sequence: AGG
gggacctggggcatattgtc

SEQ ID NO: 46919 - DNA, 20 bp, Artificial Sequence
  Description of Artificial Sequence: Synthetic oligonucleotide
  Target: SCN9A; (+) strand; PAM type: NRG; PAM sequence: GGG
ggacctggggcatattgtca

SEQ ID NO: 46920 - DNA, 20 bp, Artificial Sequence
  Description of Artificial Sequence: Synthetic oligonucleotide
  Target: SCN9A; (+) strand; PAM type: NRG; PAM sequence: GGG
gacctggggcatattgtcag

SEQ ID NO: 46921 - DNA, 20 bp, Artificial Sequence
  Description of Artificial Sequence: Synthetic oligonucleotide
  Target: SCN9A; (+) strand; PAM type: NRG; PAM sequence: GAG
cctggggcatattgtcaggg

SEQ ID NO: 46922 - DNA, 20 bp, Artificial Sequence
  Description of Artificial Sequence: Synthetic oligonucleotide
  Target: SCN9A; (+) strand; PAM type: NRG; PAM sequence: GAG
tggggcatattgtcagggga

SEQ ID NO: 46923 - DNA, 20 bp, Artificial Sequence
  Description of Artificial Sequence: Synthetic oligonucleotide
  Target: SCN9A; (+) strand; PAM type: NRG; PAM sequence: AGG
ggggcatattgtcaggggag

SEQ ID NO: 46924 - DNA, 20 bp, Artificial Sequence
  Description of Artificial Sequence: Synthetic oligonucleotide
  Target: SCN9A; (+) strand; PAM type: NRG; PAM sequence: GGG
gggcatattgtcaggggaga

SEQ ID NO: 46925 - DNA, 20 bp, Artificial Sequence
  Description of Artificial Sequence: Synthetic oligonucleotide
  Target: SCN9A; (+) strand; PAM type: NRG; PAM sequence: TAG
catattgtcaggggagaggg

SEQ ID NO: 46926 - DNA, 20 bp, Artificial Sequence
  Description of Artificial Sequence: Synthetic oligonucleotide
  Target: SCN9A; (+) strand; PAM type: NRG; PAM sequence: AAG
attgtcaggggagagggtag

SEQ ID NO: 46927 - DNA, 20 bp, Artificial Sequence
  Description of Artificial Sequence: Synthetic oligonucleotide
  Target: SCN9A; (+) strand; PAM type: NRG; PAM sequence: CAG
tcaggggagagggtagaagc

SEQ ID NO: 46928 - DNA, 20 bp, Artificial Sequence
  Description of Artificial Sequence: Synthetic oligonucleotide
  Target: SCN9A; (+) strand; PAM type: NRG; PAM sequence: CAG
ggagagggtagaagccagca

SEQ ID NO: 46929 - DNA, 20 bp, Artificial Sequence
  Description of Artificial Sequence: Synthetic oligonucleotide
  Target: SCN9A; (+) strand; PAM type: NRG; PAM sequence: AAG
agaagccagcacagtttgta

SEQ ID NO: 46930 - DNA, 20 bp, Artificial Sequence
  Description of Artificial Sequence: Synthetic oligonucleotide
  Target: SCN9A; (+) strand; PAM type: NRG; PAM sequence: TAG
ctttgactatctttgcttat

SEQ ID NO: 46931 - DNA, 20 bp, Artificial Sequence
  Description of Artificial Sequence: Synthetic oligonucleotide
  Target: SCN9A; (+) strand; PAM type: NRG; PAM sequence: AAG
tgactatctttgcttattag

SEQ ID NO: 46932 - DNA, 20 bp, Artificial Sequence
  Description of Artificial Sequence: Synthetic oligonucleotide
  Target: SCN9A; (+) strand; PAM type: NRG; PAM sequence: GAG
actatctttgcttattagaa

SEQ ID NO: 46933 - DNA, 20 bp, Artificial Sequence
  Description of Artificial Sequence: Synthetic oligonucleotide
  Target: SCN9A; (+) strand; PAM type: NRG; PAM sequence: GAG
tattagaagagacaattttt

SEQ ID NO: 46934 - DNA, 20 bp, Artificial Sequence
  Description of Artificial Sequence: Synthetic oligonucleotide
  Target: SCN9A; (+) strand; PAM type: NRG; PAM sequence: AAG
tgagcgaatatgtaatttgt

SEQ ID NO: 46935 - DNA, 20 bp, Artificial Sequence
  Description of Artificial Sequence: Synthetic oligonucleotide
  Target: SCN9A; (+) strand; PAM type: NRG; PAM sequence: TAG
atgtaatttgtaagattata

SEQ ID NO: 46936 - DNA, 20 bp, Artificial Sequence
  Description of Artificial Sequence: Synthetic oligonucleotide
  Target: SCN9A; (+) strand; PAM type: NRG; PAM sequence: CAG
tttgtaagattatatagtga

SEQ ID NO: 46937 - DNA, 20 bp, Artificial Sequence
  Description of Artificial Sequence: Synthetic oligonucleotide
  Target: SCN9A; (+) strand; PAM type: NRG; PAM sequence: TAG
tatatagtgacagaatcacg

SEQ ID NO: 46938 - DNA, 20 bp, Artificial Sequence
  Description of Artificial Sequence: Synthetic oligonucleotide
  Target: SCN9A; (+) strand; PAM type: NRG; PAM sequence: TGG
gtgacagaatcacgtagctc

SEQ ID NO: 46939 - DNA, 20 bp, Artificial Sequence
  Description of Artificial Sequence: Synthetic oligonucleotide
  Target: SCN9A; (+) strand; PAM type: NRG; PAM sequence: GGG
tgacagaatcacgtagctct

SEQ ID NO: 46940 - DNA, 20 bp, Artificial Sequence
  Description of Artificial Sequence: Synthetic oligonucleotide
  Target: SCN9A; (+) strand; PAM type: NRG; PAM sequence: AAG
attaaatcacttatctttga

SEQ ID NO: 46941 - DNA, 20 bp, Artificial Sequence
  Description of Artificial Sequence: Synthetic oligonucleotide
  Target: SCN9A; (+) strand; PAM type: NRG; PAM sequence: AGG
ttaaatcacttatctttgaa

SEQ ID NO: 46942 - DNA, 20 bp, Artificial Sequence
  Description of Artificial Sequence: Synthetic oligonucleotide
  Target: SCN9A; (+) strand; PAM type: NRG; PAM sequence: CAG
atcacttatctttgaaaggt

SEQ ID NO: 46943 - DNA, 20 bp, Artificial Sequence
  Description of Artificial Sequence: Synthetic oligonucleotide
  Target: SCN9A; (+) strand; PAM type: NRG; PAM sequence: TGG
tcacccaacatctgtctttg

SEQ ID NO: 46944 - DNA, 20 bp, Artificial Sequence
  Description of Artificial Sequence: Synthetic oligonucleotide
  Target: SCN9A; (+) strand; PAM type: NRG; PAM sequence: GGG
cacccaacatctgtctttgt

SEQ ID NO: 46945 - DNA, 20 bp, Artificial Sequence
  Description of Artificial Sequence: Synthetic oligonucleotide
  Target: SCN9A; (+) strand; PAM type: NRG; PAM sequence: AAG
tttctttttttcattttgca

SEQ ID NO: 46946 - DNA, 20 bp, Artificial Sequence
  Description of Artificial Sequence: Synthetic oligonucleotide
  Target: SCN9A; (+) strand; PAM type: NRG; PAM sequence: TAG
ttatcaatgtctgtgtttaa

SEQ ID NO: 46947 - DNA, 20 bp, Artificial Sequence
  Description of Artificial Sequence: Synthetic oligonucleotide
  Target: SCN9A; (+) strand; PAM type: NRG; PAM sequence: AAG
aaataattttatccattttt

SEQ ID NO: 46948 - DNA, 20 bp, Artificial Sequence
  Description of Artificial Sequence: Synthetic oligonucleotide
  Target: SCN9A; (+) strand; PAM type: NRG; PAM sequence: CAG
gcacataaaaacaattccat

SEQ ID NO: 46949 - DNA, 20 bp, Artificial Sequence
  Description of Artificial Sequence: Synthetic oligonucleotide
  Target: SCN9A; (+) strand; PAM type: NRG; PAM sequence: TGG
acaattccatcagtatccat

SEQ ID NO: 46950 - DNA, 20 bp, Artificial Sequence
  Description of Artificial Sequence: Synthetic oligonucleotide
  Target: SCN9A; (+) strand; PAM type: NRG; PAM sequence: TGG
catcatttaaaaccatttta

SEQ ID NO: 46951 - DNA, 20 bp, Artificial Sequence
  Description of Artificial Sequence: Synthetic oligonucleotide
  Target: SCN9A; (+) strand; PAM type: NRG; PAM sequence: AAG
atggtctctgaattcttcct

SEQ ID NO: 46952 - DNA, 20 bp, Artificial Sequence
  Description of Artificial Sequence: Synthetic oligonucleotide
  Target: SCN9A; (+) strand; PAM type: NRG; PAM sequence: AAG
agaatttcatgtgcctattt

SEQ ID NO: 46953 - DNA, 20 bp, Artificial Sequence
  Description of Artificial Sequence: Synthetic oligonucleotide
  Target: SCN9A; (+) strand; PAM type: NRG; PAM sequence: AGG
gaatttcatgtgcctattta

SEQ ID NO: 46954 - DNA, 20 bp, Artificial Sequence
  Description of Artificial Sequence: Synthetic oligonucleotide
  Target: SCN9A; (+) strand; PAM type: NRG; PAM sequence: CAG
tgtgcctatttaaggttgac

SEQ ID NO: 46955 - DNA, 20 bp, Artificial Sequence
  Description of Artificial Sequence: Synthetic oligonucleotide
  Target: SCN9A; (+) strand; PAM type: NRG; PAM sequence: AAG
gatttatgttaattttattt

SEQ ID NO: 46956 - DNA, 20 bp, Artificial Sequence
  Description of Artificial Sequence: Synthetic oligonucleotide
  Target: SCN9A; (+) strand; PAM type: NRG; PAM sequence: CAG
attttatttaagaatctgta

SEQ ID NO: 46957 - DNA, 20 bp, Artificial Sequence
  Description of Artificial Sequence: Synthetic oligonucleotide
  Target: SCN9A; (+) strand; PAM type: NRG; PAM sequence: AAG
tttaagaatctgtacagtaa

SEQ ID NO: 46958 - DNA, 20 bp, Artificial Sequence
  Description of Artificial Sequence: Synthetic oligonucleotide
  Target: SCN9A; (+) strand; PAM type: NRG; PAM sequence: AAG
aagaatctgtacagtaaaag

SEQ ID NO: 46959 - DNA, 20 bp, Artificial Sequence
  Description of Artificial Sequence: Synthetic oligonucleotide
  Target: SCN9A; (+) strand; PAM type: NRG; PAM sequence: CAG
agattattacataccttcca

SEQ ID NO: 46960 - DNA, 20 bp, Artificial Sequence
  Description of Artificial Sequence: Synthetic oligonucleotide
  Target: SCN9A; (+) strand; PAM type: NRG; PAM sequence: GAG
ctactcattgctctctgtct

SEQ ID NO: 46961 - DNA, 20 bp, Artificial Sequence
  Description of Artificial Sequence: Synthetic oligonucleotide
  Target: SCN9A; (+) strand; PAM type: NRG; PAM sequence: AGG
tactcattgctctctgtctg

SEQ ID NO: 46962 - DNA, 20 bp, Artificial Sequence
  Description of Artificial Sequence: Synthetic oligonucleotide
  Target: SCN9A; (+) strand; PAM type: NRG; PAM sequence: TGG
cattgctctctgtctgaggt

SEQ ID NO: 46963 - DNA, 20 bp, Artificial Sequence
  Description of Artificial Sequence: Synthetic oligonucleotide
  Target: SCN9A; (+) strand; PAM type: NRG; PAM sequence: GGG
attgctctctgtctgaggtt

SEQ ID NO: 46964 - DNA, 20 bp, Artificial Sequence
  Description of Artificial Sequence: Synthetic oligonucleotide
  Target: SCN9A; (+) strand; PAM type: NRG; PAM sequence: CAG
tgtctgaggttgggatcatt

SEQ ID NO: 46965 - DNA, 20 bp, Artificial Sequence
  Description of Artificial Sequence: Synthetic oligonucleotide
  Target: SCN9A; (+) strand; PAM type: NRG; PAM sequence: AAG
tcattcagcatatcctctga

SEQ ID NO: 46966 - DNA, 20 bp, Artificial Sequence
  Description of Artificial Sequence: Synthetic oligonucleotide
  Target: SCN9A; (+) strand; PAM type: NRG; PAM sequence: AGG
cattcagcatatcctctgaa

SEQ ID NO: 46967 - DNA, 20 bp, Artificial Sequence
  Description of Artificial Sequence: Synthetic oligonucleotide
  Target: SCN9A; (+) strand; PAM type: NRG; PAM sequence: GAG
ttcagcatatcctctgaaag

SEQ ID NO: 46968 - DNA, 20 bp, Artificial Sequence
  Description of Artificial Sequence: Synthetic oligonucleotide
  Target: SCN9A; (+) strand; PAM type: NRG; PAM sequence: TAG
gcatatcctctgaaaggaga

SEQ ID NO: 46969 - DNA, 20 bp, Artificial Sequence
  Description of Artificial Sequence: Synthetic oligonucleotide
  Target: SCN9A; (+) strand; PAM type: NRG; PAM sequence: AGG
catatcctctgaaaggagat

SEQ ID NO: 46970 - DNA, 20 bp, Artificial Sequence
  Description of Artificial Sequence: Synthetic oligonucleotide
  Target: SCN9A; (+) strand; PAM type: NRG; PAM sequence: TGG
ccttttcttgtgtatttgat

SEQ ID NO: 46971 - DNA, 20 bp, Artificial Sequence
  Description of Artificial Sequence: Synthetic oligonucleotide
  Target: SCN9A; (+) strand; PAM type: NRG; PAM sequence: AAG
aaaaaatcaattaatgtctt

SEQ ID NO: 46972 - DNA, 20 bp, Artificial Sequence
  Description of Artificial Sequence: Synthetic oligonucleotide
  Target: SCN9A; (+) strand; PAM type: NRG; PAM sequence: CAG
atcaattaatgtcttaagaa

SEQ ID NO: 46973 - DNA, 20 bp, Artificial Sequence
  Description of Artificial Sequence: Synthetic oligonucleotide
  Target: SCN9A; (+) strand; PAM type: NRG; PAM sequence: TAG
aacagaatcctaataaattg

SEQ ID NO: 46974 - DNA, 20 bp, Artificial Sequence
  Description of Artificial Sequence: Synthetic oligonucleotide
  Target: SCN9A; (+) strand; PAM type: NRG; PAM sequence: AGG
acagaatcctaataaattgt

SEQ ID NO: 46975 - DNA, 20 bp, Artificial Sequence
  Description of Artificial Sequence: Synthetic oligonucleotide
  Target: SCN9A; (+) strand; PAM type: NRG; PAM sequence: AAG
tcctaataaattgtaggtat

SEQ ID NO: 46976 - DNA, 20 bp, Artificial Sequence
  Description of Artificial Sequence: Synthetic oligonucleotide
  Target: SCN9A; (+) strand; PAM type: NRG; PAM sequence: TAG
aagataaaatcttgcttata

SEQ ID NO: 46977 - DNA, 20 bp, Artificial Sequence
  Description of Artificial Sequence: Synthetic oligonucleotide
  Target: SCN9A; (+) strand; PAM type: NRG; PAM sequence: TAG
aaatcttgcttatatagctg

SEQ ID NO: 46978 - DNA, 20 bp, Artificial Sequence
  Description of Artificial Sequence: Synthetic oligonucleotide
  Target: SCN9A; (+) strand; PAM type: NRG; PAM sequence: GAG
cttgcttatatagctgtagt

SEQ ID NO: 46979 - DNA, 20 bp, Artificial Sequence
  Description of Artificial Sequence: Synthetic oligonucleotide
  Target: SCN9A; (+) strand; PAM type: NRG; PAM sequence: AAG
tagctgtagtgagtaattaa

SEQ ID NO: 46980 - DNA, 20 bp, Artificial Sequence
  Description of Artificial Sequence: Synthetic oligonucleotide
  Target: SCN9A; (+) strand; PAM type: NRG; PAM sequence: TAG
ctgtagtgagtaattaaaag

SEQ ID NO: 46981 - DNA, 20 bp, Artificial Sequence
  Description of Artificial Sequence: Synthetic oligonucleotide
  Target: SCN9A; (+) strand; PAM type: NRG; PAM sequence: GAG
gtagtgagtaattaaaagta

SEQ ID NO: 46982 - DNA, 20 bp, Artificial Sequence
  Description of Artificial Sequence: Synthetic oligonucleotide
  Target: SCN9A; (+) strand; PAM type: NRG; PAM sequence: TAG
gagtaattaaaagtagagcc

SEQ ID NO: 46983 - DNA, 20 bp, Artificial Sequence
  Description of Artificial Sequence: Synthetic oligonucleotide
  Target: SCN9A; (+) strand; PAM type: NRG; PAM sequence: TGG
aaaagtagagcctagattgc

SEQ ID NO: 46984 - DNA, 20 bp, Artificial Sequence
  Description of Artificial Sequence: Synthetic oligonucleotide
  Target: SCN9A; (+) strand; PAM type: NRG; PAM sequence: GGG
aaagtagagcctagattgct

SEQ ID NO: 46985 - DNA, 20 bp, Artificial Sequence
  Description of Artificial Sequence: Synthetic oligonucleotide
  Target: SCN9A; (+) strand; PAM type: NRG; PAM sequence: TGG
agattgctgggttcaaatta

SEQ ID NO: 46986 - DNA, 20 bp, Artificial Sequence
  Description of Artificial Sequence: Synthetic oligonucleotide
  Target: SCN9A; (+) strand; PAM type: NRG; PAM sequence: TGG
attatggctctgctacttac

SEQ ID NO: 46987 - DNA, 20 bp, Artificial Sequence
  Description of Artificial Sequence: Synthetic oligonucleotide
  Target: SCN9A; (+) strand; PAM type: NRG; PAM sequence: TAG
tacttactggctgtatatca

SEQ ID NO: 46988 - DNA, 20 bp, Artificial Sequence
  Description of Artificial Sequence: Synthetic oligonucleotide
  Target: SCN9A; (+) strand; PAM type: NRG; PAM sequence: AGG
acttactggctgtatatcat

SEQ ID NO: 46989 - DNA, 20 bp, Artificial Sequence
  Description of Artificial Sequence: Synthetic oligonucleotide
  Target: SCN9A; (+) strand; PAM type: NRG; PAM sequence: GAG
ttactggctgtatatcatag

SEQ ID NO: 46990 - DNA, 20 bp, Artificial Sequence
  Description of Artificial Sequence: Synthetic oligonucleotide
  Target: SCN9A; (+) strand; PAM type: NRG; PAM sequence: GAG
actggctgtatatcatagga

SEQ ID NO: 46991 - DNA, 20 bp, Artificial Sequence
  Description of Artificial Sequence: Synthetic oligonucleotide
  Target: SCN9A; (+) strand; PAM type: NRG; PAM sequence: CAG
ggagagctacttaactgtct

SEQ ID NO: 46992 - DNA, 20 bp, Artificial Sequence
  Description of Artificial Sequence: Synthetic oligonucleotide
  Target: SCN9A; (+) strand; PAM type: NRG; PAM sequence: TGG
taactgtctcagttttatat

SEQ ID NO: 46993 - DNA, 20 bp, Artificial Sequence
  Description of Artificial Sequence: Synthetic oligonucleotide
  Target: SCN9A; (+) strand; PAM type: NRG; PAM sequence: TGG
tcagttttatattggtaaaa

SEQ ID NO: 46994 - DNA, 20 bp, Artificial Sequence
  Description of Artificial Sequence: Synthetic oligonucleotide
  Target: SCN9A; (+) strand; PAM type: NRG; PAM sequence: GGG
cagttttatattggtaaaat

SEQ ID NO: 46995 - DNA, 20 bp, Artificial Sequence
  Description of Artificial Sequence: Synthetic oligonucleotide
  Target: SCN9A; (+) strand; PAM type: NRG; PAM sequence: GGG
agttttatattggtaaaatg

SEQ ID NO: 46996 - DNA, 20 bp, Artificial Sequence
  Description of Artificial Sequence: Synthetic oligonucleotide
  Target: SCN9A; (+) strand; PAM type: NRG; PAM sequence: TAG
tggtaaaatggggataatca

SEQ ID NO: 46997 - DNA, 20 bp, Artificial Sequence
  Description of Artificial Sequence: Synthetic oligonucleotide
  Target: SCN9A; (+) strand; PAM type: NRG; PAM sequence: GAG
tgcttgcttcatattcttgt

SEQ ID NO: 46998 - DNA, 20 bp, Artificial Sequence
  Description of Artificial Sequence: Synthetic oligonucleotide
  Target: SCN9A; (+) strand; PAM type: NRG; PAM sequence: AGG
gcttgcttcatattcttgtg

SEQ ID NO: 46999 - DNA, 20 bp, Artificial Sequence
  Description of Artificial Sequence: Synthetic oligonucleotide
  Target: SCN9A; (+) strand; PAM type: NRG; PAM sequence: AAG
tcatattcttgtgaggatta

SEQ ID NO: 47000 - DNA, 20 bp, Artificial Sequence
  Description of Artificial Sequence: Synthetic oligonucleotide
  Target: SCN9A; (+) strand; PAM type: NRG; PAM sequence: AGG
catattcttgtgaggattaa

SEQ ID NO: 47001 - DNA, 20 bp, Artificial Sequence
  Description of Artificial Sequence: Synthetic oligonucleotide
  Target: SCN9A; (+) strand; PAM type: NRG; PAM sequence: GAG
ttaaaggaattaatatttat

SEQ ID NO: 47002 - DNA, 20 bp, Artificial Sequence
  Description of Artificial Sequence: Synthetic oligonucleotide
  Target: SCN9A; (+) strand; PAM type: NRG; PAM sequence: AAG
tatttatgagataaaaaata

SEQ ID NO: 47003 - DNA, 20 bp, Artificial Sequence
  Description of Artificial Sequence: Synthetic oligonucleotide
  Target: SCN9A; (+) strand; PAM type: NRG; PAM sequence: TAG
tatgagataaaaaataaagc

SEQ ID NO: 47004 - DNA, 20 bp, Artificial Sequence
  Description of Artificial Sequence: Synthetic oligonucleotide
  Target: SCN9A; (+) strand; PAM type: NRG; PAM sequence: GAG
catcacctctctgcctttct

SEQ ID NO: 47005 - DNA, 20 bp, Artificial Sequence
  Description of Artificial Sequence: Synthetic oligonucleotide
  Target: SCN9A; (+) strand; PAM type: NRG; PAM sequence: CAG
ttctgagtgttcaatttatt

SEQ ID NO: 47006 - DNA, 20 bp, Artificial Sequence
  Description of Artificial Sequence: Synthetic oligonucleotide
  Target: SCN9A; (+) strand; PAM type: NRG; PAM sequence: TAG
gagtgttcaatttattcaga

SEQ ID NO: 47007 - DNA, 20 bp, Artificial Sequence
  Description of Artificial Sequence: Synthetic oligonucleotide
  Target: SCN9A; (+) strand; PAM type: NRG; PAM sequence: CAG
tcagatagtttgtcatgtga

SEQ ID NO: 47008 - DNA, 20 bp, Artificial Sequence
  Description of Artificial Sequence: Synthetic oligonucleotide
  Target: SCN9A; (+) strand; PAM type: NRG; PAM sequence: CAG
gtgacagtcctacatgaaaa

SEQ ID NO: 47009 - DNA, 20 bp, Artificial Sequence
  Description of Artificial Sequence: Synthetic oligonucleotide
  Target: SCN9A; (+) strand; PAM type: NRG; PAM sequence: AAG
gtcctacatgaaaacagtga

SEQ ID NO: 47010 - DNA, 20 bp, Artificial Sequence
  Description of Artificial Sequence: Synthetic oligonucleotide
  Target: SCN9A; (+) strand; PAM type: NRG; PAM sequence: TAG
tgaaaacagtgaaagtgctg

SEQ ID NO: 47011 - DNA, 20 bp, Artificial Sequence
  Description of Artificial Sequence: Synthetic oligonucleotide
  Target: SCN9A; (+) strand; PAM type: NRG; PAM sequence: AAG
gctgtagtgctgtgtatcta

SEQ ID NO: 47012 - DNA, 20 bp, Artificial Sequence
  Description of Artificial Sequence: Synthetic oligonucleotide
  Target: SCN9A; (+) strand; PAM type: NRG; PAM sequence: AGG
ctgtagtgctgtgtatctaa

SEQ ID NO: 47013 - DNA, 20 bp, Artificial Sequence
  Description of Artificial Sequence: Synthetic oligonucleotide
  Target: SCN9A; (+) strand; PAM type: NRG; PAM sequence: GGG
tgtagtgctgtgtatctaaa

SEQ ID NO: 47014 - DNA, 20 bp, Artificial Sequence
  Description of Artificial Sequence: Synthetic oligonucleotide
  Target: SCN9A; (+) strand; PAM type: NRG; PAM sequence: GGG
gtagtgctgtgtatctaaag

SEQ ID NO: 47015 - DNA, 20 bp, Artificial Sequence
  Description of Artificial Sequence: Synthetic oligonucleotide
  Target: SCN9A; (+) strand; PAM type: NRG; PAM sequence: TAG
gtgctgtgtatctaaagggg

SEQ ID NO: 47016 - DNA, 20 bp, Artificial Sequence
  Description of Artificial Sequence: Synthetic oligonucleotide
  Target: SCN9A; (+) strand; PAM type: NRG; PAM sequence: CAG
tatctaaaggggtagaatct

SEQ ID NO: 47017 - DNA, 20 bp, Artificial Sequence
  Description of Artificial Sequence: Synthetic oligonucleotide
  Target: SCN9A; (+) strand; PAM type: NRG; PAM sequence: TGG
agtattctctgataaatttc

SEQ ID NO: 47018 - DNA, 20 bp, Artificial Sequence
  Description of Artificial Sequence: Synthetic oligonucleotide
  Target: SCN9A; (+) strand; PAM type: NRG; PAM sequence: GAG
ttctggaattactttttatt

SEQ ID NO: 47019 - DNA, 20 bp, Artificial Sequence
  Description of Artificial Sequence: Synthetic oligonucleotide
  Target: SCN9A; (+) strand; PAM type: NRG; PAM sequence: AGG
tctggaattactttttattg

SEQ ID NO: 47020 - DNA, 20 bp, Artificial Sequence
  Description of Artificial Sequence: Synthetic oligonucleotide
  Target: SCN9A; (+) strand; PAM type: NRG; PAM sequence: GGG
ctggaattactttttattga

SEQ ID NO: 47021 - DNA, 20 bp, Artificial Sequence
  Description of Artificial Sequence: Synthetic oligonucleotide
  Target: SCN9A; (+) strand; PAM type: NRG; PAM sequence: AAG
ttgagggaacaacattaatg

SEQ ID NO: 47022 - DNA, 20 bp, Artificial Sequence
  Description of Artificial Sequence: Synthetic oligonucleotide
  Target: SCN9A; (+) strand; PAM type: NRG; PAM sequence: TGG
cattaatgaagctcctgtaa

SEQ ID NO: 47023 - DNA, 20 bp, Artificial Sequence
  Description of Artificial Sequence: Synthetic oligonucleotide
  Target: SCN9A; (+) strand; PAM type: NRG; PAM sequence: AAG
aatggttgtctcttactgcc

SEQ ID NO: 47024 - DNA, 20 bp, Artificial Sequence
  Description of Artificial Sequence: Synthetic oligonucleotide
  Target: SCN9A; (+) strand; PAM type: NRG; PAM sequence: AGG
atggttgtctcttactgcca

SEQ ID NO: 47025 - DNA, 20 bp, Artificial Sequence
  Description of Artificial Sequence: Synthetic oligonucleotide
  Target: SCN9A; (+) strand; PAM type: NRG; PAM sequence: AAG
gttgtctcttactgccaagg

SEQ ID NO: 47026 - DNA, 20 bp, Artificial Sequence
  Description of Artificial Sequence: Synthetic oligonucleotide
  Target: SCN9A; (+) strand; PAM type: NRG; PAM sequence: GAG
caaggaagacctcatgaact

SEQ ID NO: 47027 - DNA, 20 bp, Artificial Sequence
  Description of Artificial Sequence: Synthetic oligonucleotide
  Target: SCN9A; (+) strand; PAM type: NRG; PAM sequence: CAG
ggaagacctcatgaactgag

SEQ ID NO: 47028 - DNA, 20 bp, Artificial Sequence
  Description of Artificial Sequence: Synthetic oligonucleotide
  Target: SCN9A; (+) strand; PAM type: NRG; PAM sequence: GAG
aagacctcatgaactgagca

SEQ ID NO: 47029 - DNA, 20 bp, Artificial Sequence
  Description of Artificial Sequence: Synthetic oligonucleotide
  Target: SCN9A; (+) strand; PAM type: NRG; PAM sequence: CAG
gcatatgatgataaatgact

SEQ ID NO: 47030 - DNA, 20 bp, Artificial Sequence
  Description of Artificial Sequence: Synthetic oligonucleotide
  Target: SCN9A; (+) strand; PAM type: NRG; PAM sequence: AAG
tgataaatgactcagtttga

SEQ ID NO: 47031 - DNA, 20 bp, Artificial Sequence
  Description of Artificial Sequence: Synthetic oligonucleotide
  Target: SCN9A; (+) strand; PAM type: NRG; PAM sequence: AGG
gataaatgactcagtttgaa

SEQ ID NO: 47032 - DNA, 20 bp, Artificial Sequence
  Description of Artificial Sequence: Synthetic oligonucleotide
  Target: SCN9A; (+) strand; PAM type: NRG; PAM sequence: TAG
ctcagtttgaaaggaacaat

SEQ ID NO: 47033 - DNA, 20 bp, Artificial Sequence
  Description of Artificial Sequence: Synthetic oligonucleotide
  Target: SCN9A; (+) strand; PAM type: NRG; PAM sequence: TGG
gaaaggaacaattagtgaaa

SEQ ID NO: 47034 - DNA, 20 bp, Artificial Sequence
  Description of Artificial Sequence: Synthetic oligonucleotide
  Target: SCN9A; (+) strand; PAM type: NRG; PAM sequence: GAG
aaggaacaattagtgaaatg

SEQ ID NO: 47035 - DNA, 20 bp, Artificial Sequence
  Description of Artificial Sequence: Synthetic oligonucleotide
  Target: SCN9A; (+) strand; PAM type: NRG; PAM sequence: AAG
attagtgaaatggagaatgc

SEQ ID NO: 47036 - DNA, 20 bp, Artificial Sequence
  Description of Artificial Sequence: Synthetic oligonucleotide
  Target: SCN9A; (+) strand; PAM type: NRG; PAM sequence: AAG
agaatgcaagctacatctga

SEQ ID NO: 47037 - DNA, 20 bp, Artificial Sequence
  Description of Artificial Sequence: Synthetic oligonucleotide
  Target: SCN9A; (+) strand; PAM type: NRG; PAM sequence: GAG
aatgcaagctacatctgaaa

SEQ ID NO: 47038 - DNA, 20 bp, Artificial Sequence
  Description of Artificial Sequence: Synthetic oligonucleotide
  Target: SCN9A; (+) strand; PAM type: NRG; PAM sequence: AGG
atgcaagctacatctgaaag

SEQ ID NO: 47039 - DNA, 20 bp, Artificial Sequence
  Description of Artificial Sequence: Synthetic oligonucleotide
  Target: SCN9A; (+) strand; PAM type: NRG; PAM sequence: CAG
tgaaagaggtgacctctctt

SEQ ID NO: 47040 - DNA, 20 bp, Artificial Sequence
  Description of Artificial Sequence: Synthetic oligonucleotide
  Target: SCN9A; (+) strand; PAM type: NRG; PAM sequence: TAG
aggtgacctctcttcagctc

SEQ ID NO: 47041 - DNA, 20 bp, Artificial Sequence
  Description of Artificial Sequence: Synthetic oligonucleotide
  Target: SCN9A; (+) strand; PAM type: NRG; PAM sequence: AAG
aacatgaactcatgcataac

SEQ ID NO: 47042 - DNA, 20 bp, Artificial Sequence
  Description of Artificial Sequence: Synthetic oligonucleotide
  Target: SCN9A; (+) strand; PAM type: NRG; PAM sequence: GAG
acaagtgtatttatttttgt

SEQ ID NO: 47043 - DNA, 20 bp, Artificial Sequence
  Description of Artificial Sequence: Synthetic oligonucleotide
  Target: SCN9A; (+) strand; PAM type: NRG; PAM sequence: TGG
aatgtcttatttttaaaact

SEQ ID NO: 47044 - DNA, 20 bp, Artificial Sequence
  Description of Artificial Sequence: Synthetic oligonucleotide
  Target: SCN9A; (+) strand; PAM type: NRG; PAM sequence: TGG
tcaaatttaaaacactatgt

SEQ ID NO: 47045 - DNA, 20 bp, Artificial Sequence
  Description of Artificial Sequence: Synthetic oligonucleotide
  Target: SCN9A; (+) strand; PAM type: NRG; PAM sequence: CAG
aacactatgttggttccatg

SEQ ID NO: 47046 - DNA, 20 bp, Artificial Sequence
  Description of Artificial Sequence: Synthetic oligonucleotide
  Target: SCN9A; (+) strand; PAM type: NRG; PAM sequence: AGG
acactatgttggttccatgc

SEQ ID NO: 47047 - DNA, 20 bp, Artificial Sequence
  Description of Artificial Sequence: Synthetic oligonucleotide
  Target: SCN9A; (+) strand; PAM type: NRG; PAM sequence: CAG
tatgttggttccatgcaggc

SEQ ID NO: 47048 - DNA, 20 bp, Artificial Sequence
  Description of Artificial Sequence: Synthetic oligonucleotide
  Target: SCN9A; (+) strand; PAM type: NRG; PAM sequence: TAG
cacaaacaactatacaactc

SEQ ID NO: 47049 - DNA, 20 bp, Artificial Sequence
  Description of Artificial Sequence: Synthetic oligonucleotide
  Target: SCN9A; (+) strand; PAM type: NRG; PAM sequence: TGG
catgtttgtctgcttgtgtg

SEQ ID NO: 47050 - DNA, 20 bp, Artificial Sequence
  Description of Artificial Sequence: Synthetic oligonucleotide
  Target: SCN9A; (+) strand; PAM type: NRG; PAM sequence: TGG
gtctgcttgtgtgtggtatg

SEQ ID NO: 47051 - DNA, 20 bp, Artificial Sequence
  Description of Artificial Sequence: Synthetic oligonucleotide
  Target: SCN9A; (+) strand; PAM type: NRG; PAM sequence: TAG
atattttaaatatatatttc

SEQ ID NO: 47052 - DNA, 20 bp, Artificial Sequence
  Description of Artificial Sequence: Synthetic oligonucleotide
  Target: SCN9A; (+) strand; PAM type: NRG; PAM sequence: AAG
tatatatttctagatttgta

SEQ ID NO: 47053 - DNA, 20 bp, Artificial Sequence
  Description of Artificial Sequence: Synthetic oligonucleotide
  Target: SCN9A; (+) strand; PAM type: NRG; PAM sequence: TAG
tctagatttgtaaagttgta

SEQ ID NO: 47054 - DNA, 20 bp, Artificial Sequence
  Description of Artificial Sequence: Synthetic oligonucleotide
  Target: SCN9A; (+) strand; PAM type: NRG; PAM sequence: TAG
tgtaaagttgtatagttgta

SEQ ID NO: 47055 - DNA, 20 bp, Artificial Sequence
  Description of Artificial Sequence: Synthetic oligonucleotide
  Target: SCN9A; (+) strand; PAM type: NRG; PAM sequence: AGG
gtaaagttgtatagttgtat

SEQ ID NO: 47056 - DNA, 20 bp, Artificial Sequence
  Description of Artificial Sequence: Synthetic oligonucleotide
  Target: SCN9A; (+) strand; PAM type: NRG; PAM sequence: TAG
gttgtatagttgtataggta

SEQ ID NO: 47057 - DNA, 20 bp, Artificial Sequence
  Description of Artificial Sequence: Synthetic oligonucleotide
  Target: SCN9A; (+) strand; PAM type: NRG; PAM sequence: CAG
catgtatgtgtatcaaaaca

SEQ ID NO: 47058 - DNA, 20 bp, Artificial Sequence
  Description of Artificial Sequence: Synthetic oligonucleotide
  Target: SCN9A; (+) strand; PAM type: NRG; PAM sequence: CAG
tgtatcaaaacacagacata

SEQ ID NO: 47059 - DNA, 20 bp, Artificial Sequence
  Description of Artificial Sequence: Synthetic oligonucleotide
  Target: SCN9A; (+) strand; PAM type: NRG; PAM sequence: AGG
gtatcaaaacacagacatac

SEQ ID NO: 47060 - DNA, 20 bp, Artificial Sequence
  Description of Artificial Sequence: Synthetic oligonucleotide
  Target: SCN9A; (+) strand; PAM type: NRG; PAM sequence: TAG
aaaacacagacatacaggca

SEQ ID NO: 47061 - DNA, 20 bp, Artificial Sequence
  Description of Artificial Sequence: Synthetic oligonucleotide
  Target: SCN9A; (+) strand; PAM type: NRG; PAM sequence: TGG
tacaggcatagatatgtgca

SEQ ID NO: 47062 - DNA, 20 bp, Artificial Sequence
  Description of Artificial Sequence: Synthetic oligonucleotide
  Target: SCN9A; (+) strand; PAM type: NRG; PAM sequence: GGG
acaggcatagatatgtgcat

SEQ ID NO: 47063 - DNA, 20 bp, Artificial Sequence
  Description of Artificial Sequence: Synthetic oligonucleotide
  Target: SCN9A; (+) strand; PAM type: NRG; PAM sequence: CAG
tgcatctatgtgtatgtgaa

SEQ ID NO: 47064 - DNA, 20 bp, Artificial Sequence
  Description of Artificial Sequence: Synthetic oligonucleotide
  Target: SCN9A; (+) strand; PAM type: NRG; PAM sequence: GAG
gtgaacagacacacccattt

SEQ ID NO: 47065 - DNA, 20 bp, Artificial Sequence
  Description of Artificial Sequence: Synthetic oligonucleotide
  Target: SCN9A; (+) strand; PAM type: NRG; PAM sequence: GAG
gaacagacacacccatttga

SEQ ID NO: 47066 - DNA, 20 bp, Artificial Sequence
  Description of Artificial Sequence: Synthetic oligonucleotide
  Target: SCN9A; (+) strand; PAM type: NRG; PAM sequence: AAG
atttgagagatctctgtaaa

SEQ ID NO: 47067 - DNA, 20 bp, Artificial Sequence
  Description of Artificial Sequence: Synthetic oligonucleotide
  Target: SCN9A; (+) strand; PAM type: NRG; PAM sequence: AAG
taaaaagtcaactttttgaa

SEQ ID NO: 47068 - DNA, 20 bp, Artificial Sequence
  Description of Artificial Sequence: Synthetic oligonucleotide
  Target: SCN9A; (+) strand; PAM type: NRG; PAM sequence: CAG
ttttgaaaagtctcgaaaac

SEQ ID NO: 47069 - DNA, 20 bp, Artificial Sequence
  Description of Artificial Sequence: Synthetic oligonucleotide
  Target: SCN9A; (+) strand; PAM type: NRG; PAM sequence: AGG
tttgaaaagtctcgaaaacc

SEQ ID NO: 47070 - DNA, 20 bp, Artificial Sequence
  Description of Artificial Sequence: Synthetic oligonucleotide
  Target: SCN9A; (+) strand; PAM type: NRG; PAM sequence: TAG
aaaccaggttttctgtgcta

SEQ ID NO: 47071 - DNA, 20 bp, Artificial Sequence
  Description of Artificial Sequence: Synthetic oligonucleotide
  Target: SCN9A; (+) strand; PAM type: NRG; PAM sequence: AAG
tgtgctatagtctgtcaaac

SEQ ID NO: 47072 - DNA, 20 bp, Artificial Sequence
  Description of Artificial Sequence: Synthetic oligonucleotide
  Target: SCN9A; (+) strand; PAM type: NRG; PAM sequence: CAG
tctgtcaaacaagaatttgt

SEQ ID NO: 47073 - DNA, 20 bp, Artificial Sequence
  Description of Artificial Sequence: Synthetic oligonucleotide
  Target: SCN9A; (+) strand; PAM type: NRG; PAM sequence: TAG
taaacaaattattttccatg

SEQ ID NO: 47074 - DNA, 20 bp, Artificial Sequence
  Description of Artificial Sequence: Synthetic oligonucleotide
  Target: SCN9A; (+) strand; PAM type: NRG; PAM sequence: CAG
ttttccatgtagacatgttt

SEQ ID NO: 47075 - DNA, 20 bp, Artificial Sequence
  Description of Artificial Sequence: Synthetic oligonucleotide
  Target: SCN9A; (+) strand; PAM type: NRG; PAM sequence: AGG
tttccatgtagacatgtttc

SEQ ID NO: 47076 - DNA, 20 bp, Artificial Sequence
  Description of Artificial Sequence: Synthetic oligonucleotide
  Target: SCN9A; (+) strand; PAM type: NRG; PAM sequence: TAG
atgtagacatgtttcaggta

SEQ ID NO: 47077 - DNA, 20 bp, Artificial Sequence
  Description of Artificial Sequence: Synthetic oligonucleotide
  Target: SCN9A; (+) strand; PAM type: NRG; PAM sequence: GAG
gtagacatgtttcaggtata

SEQ ID NO: 47078 - DNA, 20 bp, Artificial Sequence
  Description of Artificial Sequence: Synthetic oligonucleotide
  Target: SCN9A; (+) strand; PAM type: NRG; PAM sequence: TAG
aggtatagagatgacgttat

SEQ ID NO: 47079 - DNA, 20 bp, Artificial Sequence
  Description of Artificial Sequence: Synthetic oligonucleotide
  Target: SCN9A; (+) strand; PAM type: NRG; PAM sequence: CAG
agatgacgttattagttatg

SEQ ID NO: 47080 - DNA, 20 bp, Artificial Sequence
  Description of Artificial Sequence: Synthetic oligonucleotide
  Target: SCN9A; (+) strand; PAM type: NRG; PAM sequence: AAG
gtatttccattgtatcttat

SEQ ID NO: 47081 - DNA, 20 bp, Artificial Sequence
  Description of Artificial Sequence: Synthetic oligonucleotide
  Target: SCN9A; (+) strand; PAM type: NRG; PAM sequence: TAG
taagtatccactaattcctc

SEQ ID NO: 47082 - DNA, 20 bp, Artificial Sequence
  Description of Artificial Sequence: Synthetic oligonucleotide
  Target: SCN9A; (+) strand; PAM type: NRG; PAM sequence: TAG
cactaattcctctagttttg

SEQ ID NO: 47083 - DNA, 20 bp, Artificial Sequence
  Description of Artificial Sequence: Synthetic oligonucleotide
  Target: SCN9A; (+) strand; PAM type: NRG; PAM sequence: TAG
tagttttgtagttttcactt

SEQ ID NO: 47084 - DNA, 20 bp, Artificial Sequence
  Description of Artificial Sequence: Synthetic oligonucleotide
  Target: SCN9A; (+) strand; PAM type: NRG; PAM sequence: AGG
agttttgtagttttcacttt

SEQ ID NO: 47085 - DNA, 20 bp, Artificial Sequence
  Description of Artificial Sequence: Synthetic oligonucleotide
  Target: SCN9A; (+) strand; PAM type: NRG; PAM sequence: TGG
ttgtgatactgatttttcta

SEQ ID NO: 47086 - DNA, 20 bp, Artificial Sequence
  Description of Artificial Sequence: Synthetic oligonucleotide
  Target: SCN9A; (+) strand; PAM type: NRG; PAM sequence: AAG
ggtgaaaaaactcttaaatg

SEQ ID NO: 47087 - DNA, 20 bp, Artificial Sequence
  Description of Artificial Sequence: Synthetic oligonucleotide
  Target: SCN9A; (+) strand; PAM type: NRG; PAM sequence: TAG
ctaatctgatataaattata

SEQ ID NO: 47088 - DNA, 20 bp, Artificial Sequence
  Description of Artificial Sequence: Synthetic oligonucleotide
  Target: SCN9A; (+) strand; PAM type: NRG; PAM sequence: AAG
ataattgcaaaacaaaatgc

SEQ ID NO: 47089 - DNA, 20 bp, Artificial Sequence
  Description of Artificial Sequence: Synthetic oligonucleotide
  Target: SCN9A; (+) strand; PAM type: NRG; PAM sequence: AAG
tgcaaaacaaaatgcaagca

SEQ ID NO: 47090 - DNA, 20 bp, Artificial Sequence
  Description of Artificial Sequence: Synthetic oligonucleotide
  Target: SCN9A; (+) strand; PAM type: NRG; PAM sequence: CAG
gcaagcaaagtttgattcca

SEQ ID NO: 47091 - DNA, 20 bp, Artificial Sequence
  Description of Artificial Sequence: Synthetic oligonucleotide
  Target: SCN9A; (+) strand; PAM type: NRG; PAM sequence: CAG
caataatgaaaaataccttg

SEQ ID NO: 47092 - DNA, 20 bp, Artificial Sequence
  Description of Artificial Sequence: Synthetic oligonucleotide
  Target: SCN9A; (+) strand; PAM type: NRG; PAM sequence: AAG
taatgaaaaataccttgcag

SEQ ID NO: 47093 - DNA, 20 bp, Artificial Sequence
  Description of Artificial Sequence: Synthetic oligonucleotide
  Target: SCN9A; (+) strand; PAM type: NRG; PAM sequence: AGG
aatgaaaaataccttgcaga

SEQ ID NO: 47094 - DNA, 20 bp, Artificial Sequence
  Description of Artificial Sequence: Synthetic oligonucleotide
  Target: SCN9A; (+) strand; PAM type: NRG; PAM sequence: GGG
atgaaaaataccttgcagaa

SEQ ID NO: 47095 - DNA, 20 bp, Artificial Sequence
  Description of Artificial Sequence: Synthetic oligonucleotide
  Target: SCN9A; (+) strand; PAM type: NRG; PAM sequence: AAG
aataccttgcagaagggctt

SEQ ID NO: 47096 - DNA, 20 bp, Artificial Sequence
  Description of Artificial Sequence: Synthetic oligonucleotide
  Target: SCN9A; (+) strand; PAM type: NRG; PAM sequence: TAG
taagctgtatcatgcacaca

SEQ ID NO: 47097 - DNA, 20 bp, Artificial Sequence
  Description of Artificial Sequence: Synthetic oligonucleotide
  Target: SCN9A; (+) strand; PAM type: NRG; PAM sequence: GAG
agctgtatcatgcacacata

SEQ ID NO: 47098 - DNA, 20 bp, Artificial Sequence
  Description of Artificial Sequence: Synthetic oligonucleotide
  Target: SCN9A; (+) strand; PAM type: NRG; PAM sequence: AGG
gctgtatcatgcacacatag

SEQ ID NO: 47099 - DNA, 20 bp, Artificial Sequence
  Description of Artificial Sequence: Synthetic oligonucleotide
  Target: SCN9A; (+) strand; PAM type: NRG; PAM sequence: AAG
agaggtcacatgttacctaa

SEQ ID NO: 47100 - DNA, 20 bp, Artificial Sequence
  Description of Artificial Sequence: Synthetic oligonucleotide
  Target: SCN9A; (+) strand; PAM type: NRG; PAM sequence: TGG
ttcaaattgaaatatatgtg

SEQ ID NO: 47101 - DNA, 20 bp, Artificial Sequence
  Description of Artificial Sequence: Synthetic oligonucleotide
  Target: SCN9A; (+) strand; PAM type: NRG; PAM sequence: TGG
ttgaaatatatgtgtggcca

SEQ ID NO: 47102 - DNA, 20 bp, Artificial Sequence
  Description of Artificial Sequence: Synthetic oligonucleotide
  Target: SCN9A; (+) strand; PAM type: NRG; PAM sequence: TGG
atgtgtggccatggatttga

SEQ ID NO: 47103 - DNA, 20 bp, Artificial Sequence
  Description of Artificial Sequence: Synthetic oligonucleotide
  Target: SCN9A; (+) strand; PAM type: NRG; PAM sequence: AAG
gtctgcaaatataaatatat

SEQ ID NO: 47104 - DNA, 20 bp, Artificial Sequence
  Description of Artificial Sequence: Synthetic oligonucleotide
  Target: SCN9A; (+) strand; PAM type: NRG; PAM sequence: TAG
aatataaatatataagcatg

SEQ ID NO: 47105 - DNA, 20 bp, Artificial Sequence
  Description of Artificial Sequence: Synthetic oligonucleotide
  Target: SCN9A; (+) strand; PAM type: NRG; PAM sequence: AAG
aagcatgtagcatatgtttg

SEQ ID NO: 47106 - DNA, 20 bp, Artificial Sequence
  Description of Artificial Sequence: Synthetic oligonucleotide
  Target: SCN9A; (+) strand; PAM type: NRG; PAM sequence: TGG
agcatatgtttgaagcttat

SEQ ID NO: 47107 - DNA, 20 bp, Artificial Sequence
  Description of Artificial Sequence: Synthetic oligonucleotide
  Target: SCN9A; (+) strand; PAM type: NRG; PAM sequence: GGG
gcatatgtttgaagcttatt

SEQ ID NO: 47108 - DNA, 20 bp, Artificial Sequence
  Description of Artificial Sequence: Synthetic oligonucleotide
  Target: SCN9A; (+) strand; PAM type: NRG; PAM sequence: TAG
atgtttgaagcttattgggt

SEQ ID NO: 47109 - DNA, 20 bp, Artificial Sequence
  Description of Artificial Sequence: Synthetic oligonucleotide
  Target: SCN9A; (+) strand; PAM type: NRG; PAM sequence: AAG
gaagcttattgggttagtca

SEQ ID NO: 47110 - DNA, 20 bp, Artificial Sequence
  Description of Artificial Sequence: Synthetic oligonucleotide
  Target: SCN9A; (+) strand; PAM type: NRG; PAM sequence: TGG
gtcaaagcccttgctgatat

SEQ ID NO: 47111 - DNA, 20 bp, Artificial Sequence
  Description of Artificial Sequence: Synthetic oligonucleotide
  Target: SCN9A; (+) strand; PAM type: NRG; PAM sequence: CAG
ccttgctgatattggtaatg

SEQ ID NO: 47112 - DNA, 20 bp, Artificial Sequence
  Description of Artificial Sequence: Synthetic oligonucleotide
  Target: SCN9A; (+) strand; PAM type: NRG; PAM sequence: TAG
ctgatattggtaatgcagca

SEQ ID NO: 47113 - DNA, 20 bp, Artificial Sequence
  Description of Artificial Sequence: Synthetic oligonucleotide
  Target: SCN9A; (+) strand; PAM type: NRG; PAM sequence: TAG
attggtaatgcagcatagca

SEQ ID NO: 47114 - DNA, 20 bp, Artificial Sequence
  Description of Artificial Sequence: Synthetic oligonucleotide
  Target: SCN9A; (+) strand; PAM type: NRG; PAM sequence: GAG
gtaatgcagcatagcatagt

SEQ ID NO: 47115 - DNA, 20 bp, Artificial Sequence
  Description of Artificial Sequence: Synthetic oligonucleotide
  Target: SCN9A; (+) strand; PAM type: NRG; PAM sequence: TGG
atgcagcatagcatagtgag

SEQ ID NO: 47116 - DNA, 20 bp, Artificial Sequence
  Description of Artificial Sequence: Synthetic oligonucleotide
  Target: SCN9A; (+) strand; PAM type: NRG; PAM sequence: GGG
tgcagcatagcatagtgagt

SEQ ID NO: 47117 - DNA, 20 bp, Artificial Sequence
  Description of Artificial Sequence: Synthetic oligonucleotide
  Target: SCN9A; (+) strand; PAM type: NRG; PAM sequence: AAG
atagcatagtgagtgggcta

SEQ ID NO: 47118 - DNA, 20 bp, Artificial Sequence
  Description of Artificial Sequence: Synthetic oligonucleotide
  Target: SCN9A; (+) strand; PAM type: NRG; PAM sequence: GAG
agcatagtgagtgggctaaa

SEQ ID NO: 47119 - DNA, 20 bp, Artificial Sequence
  Description of Artificial Sequence: Synthetic oligonucleotide
  Target: SCN9A; (+) strand; PAM type: NRG; PAM sequence: TGG
agtgggctaaagagatatcc

SEQ ID NO: 47120 - DNA, 20 bp, Artificial Sequence
  Description of Artificial Sequence: Synthetic oligonucleotide
  Target: SCN9A; (+) strand; PAM type: NRG; PAM sequence: CAG
aagagatatcctggaaactc

SEQ ID NO: 47121 - DNA, 20 bp, Artificial Sequence
  Description of Artificial Sequence: Synthetic oligonucleotide
  Target: SCN9A; (+) strand; PAM type: NRG; PAM sequence: AGG
agagatatcctggaaactcc

SEQ ID NO: 47122 - DNA, 20 bp, Artificial Sequence
  Description of Artificial Sequence: Synthetic oligonucleotide
  Target: SCN9A; (+) strand; PAM type: NRG; PAM sequence: GAG
atcctggaaactccaggaat

SEQ ID NO: 47123 - DNA, 20 bp, Artificial Sequence
  Description of Artificial Sequence: Synthetic oligonucleotide
  Target: SCN9A; (+) strand; PAM type: NRG; PAM sequence: AAG
tggaaactccaggaatgaga

SEQ ID NO: 47124 - DNA, 20 bp, Artificial Sequence
  Description of Artificial Sequence: Synthetic oligonucleotide
  Target: SCN9A; (+) strand; PAM type: NRG; PAM sequence: AAG
atgagaaagatctcactttc

SEQ ID NO: 47125 - DNA, 20 bp, Artificial Sequence
  Description of Artificial Sequence: Synthetic oligonucleotide
  Target: SCN9A; (+) strand; PAM type: NRG; PAM sequence: CAG
atctcactttcaagcctaat

SEQ ID NO: 47126 - DNA, 20 bp, Artificial Sequence
  Description of Artificial Sequence: Synthetic oligonucleotide
  Target: SCN9A; (+) strand; PAM type: NRG; PAM sequence: TAG
gacacctttctctaaccact

SEQ ID NO: 47127 - DNA, 20 bp, Artificial Sequence
  Description of Artificial Sequence: Synthetic oligonucleotide
  Target: SCN9A; (+) strand; PAM type: NRG; PAM sequence: TAG
tctaaccacttagtgactcg

SEQ ID NO: 47128 - DNA, 20 bp, Artificial Sequence
  Description of Artificial Sequence: Synthetic oligonucleotide
  Target: SCN9A; (+) strand; PAM type: NRG; PAM sequence: TGG
cttagtgactcgtagacctt

SEQ ID NO: 47129 - DNA, 20 bp, Artificial Sequence
  Description of Artificial Sequence: Synthetic oligonucleotide
  Target: SCN9A; (+) strand; PAM type: NRG; PAM sequence: CAG
ttgtgtcaatgcttgcattt

SEQ ID NO: 47130 - DNA, 20 bp, Artificial Sequence
  Description of Artificial Sequence: Synthetic oligonucleotide
  Target: SCN9A; (+) strand; PAM type: NRG; PAM sequence: TAG
agatattttgttttgattca

SEQ ID NO: 47131 - DNA, 20 bp, Artificial Sequence
  Description of Artificial Sequence: Synthetic oligonucleotide
  Target: SCN9A; (+) strand; PAM type: NRG; PAM sequence: CAG
ttgttttgattcatagactc

SEQ ID NO: 47132 - DNA, 20 bp, Artificial Sequence
  Description of Artificial Sequence: Synthetic oligonucleotide
  Target: SCN9A; (+) strand; PAM type: NRG; PAM sequence: CAG
atattttttaaaaatgaaaa

SEQ ID NO: 47133 - DNA, 20 bp, Artificial Sequence
  Description of Artificial Sequence: Synthetic oligonucleotide
  Target: SCN9A; (+) strand; PAM type: NRG; PAM sequence: TGG
acagttatgtttcatttata

SEQ ID NO: 47134 - DNA, 20 bp, Artificial Sequence
  Description of Artificial Sequence: Synthetic oligonucleotide
  Target: SCN9A; (+) strand; PAM type: NRG; PAM sequence: GAG
agttatgtttcatttatatg

SEQ ID NO: 47135 - DNA, 20 bp, Artificial Sequence
  Description of Artificial Sequence: Synthetic oligonucleotide
  Target: SCN9A; (+) strand; PAM type: NRG; PAM sequence: AGG
gttatgtttcatttatatgg

SEQ ID NO: 47136 - DNA, 20 bp, Artificial Sequence
  Description of Artificial Sequence: Synthetic oligonucleotide
  Target: SCN9A; (+) strand; PAM type: NRG; PAM sequence: TAG
tatatggaggacctaataca

SEQ ID NO: 47137 - DNA, 20 bp, Artificial Sequence
  Description of Artificial Sequence: Synthetic oligonucleotide
  Target: SCN9A; (+) strand; PAM type: NRG; PAM sequence: AAG
tagccattctaaattttttc

SEQ ID NO: 47138 - DNA, 20 bp, Artificial Sequence
  Description of Artificial Sequence: Synthetic oligonucleotide
  Target: SCN9A; (+) strand; PAM type: NRG; PAM sequence: AAG
attctaaattttttcaagat

SEQ ID NO: 47139 - DNA, 20 bp, Artificial Sequence
  Description of Artificial Sequence: Synthetic oligonucleotide
  Target: SCN9A; (+) strand; PAM type: NRG; PAM sequence: AAG
ctaaattttttcaagataag

SEQ ID NO: 47140 - DNA, 20 bp, Artificial Sequence
  Description of Artificial Sequence: Synthetic oligonucleotide
  Target: SCN9A; (+) strand; PAM type: NRG; PAM sequence: TGG
ataagaagcctactgcacat

SEQ ID NO: 47141 - DNA, 20 bp, Artificial Sequence
  Description of Artificial Sequence: Synthetic oligonucleotide
  Target: SCN9A; (+) strand; PAM type: NRG; PAM sequence: GAG
aagaagcctactgcacattg

SEQ ID NO: 47142 - DNA, 20 bp, Artificial Sequence
  Description of Artificial Sequence: Synthetic oligonucleotide
  Target: SCN9A; (+) strand; PAM type: NRG; PAM sequence: GAG
gaagcctactgcacattgga

SEQ ID NO: 47143 - DNA, 20 bp, Artificial Sequence
  Description of Artificial Sequence: Synthetic oligonucleotide
  Target: SCN9A; (+) strand; PAM type: NRG; PAM sequence: TAG
cctactgcacattggagaga

SEQ ID NO: 47144 - DNA, 20 bp, Artificial Sequence
  Description of Artificial Sequence: Synthetic oligonucleotide
  Target: SCN9A; (+) strand; PAM type: NRG; PAM sequence: CAG
actgcacattggagagatag

SEQ ID NO: 47145 - DNA, 20 bp, Artificial Sequence
  Description of Artificial Sequence: Synthetic oligonucleotide
  Target: SCN9A; (+) strand; PAM type: NRG; PAM sequence: GAG
tgcacattggagagatagca

SEQ ID NO: 47146 - DNA, 20 bp, Artificial Sequence
  Description of Artificial Sequence: Synthetic oligonucleotide
  Target: SCN9A; (+) strand; PAM type: NRG; PAM sequence: GAG
cattggagagatagcagagt

SEQ ID NO: 47147 - DNA, 20 bp, Artificial Sequence
  Description of Artificial Sequence: Synthetic oligonucleotide
  Target: SCN9A; (+) strand; PAM type: NRG; PAM sequence: TGG
tggagagatagcagagtgag

SEQ ID NO: 47148 - DNA, 20 bp, Artificial Sequence
  Description of Artificial Sequence: Synthetic oligonucleotide
  Target: SCN9A; (+) strand; PAM type: NRG; PAM sequence: AAG
agatagcagagtgagtggtt

SEQ ID NO: 47149 - DNA, 20 bp, Artificial Sequence
  Description of Artificial Sequence: Synthetic oligonucleotide
  Target: SCN9A; (+) strand; PAM type: NRG; PAM sequence: GAG
atagcagagtgagtggttaa

SEQ ID NO: 47150 - DNA, 20 bp, Artificial Sequence
  Description of Artificial Sequence: Synthetic oligonucleotide
  Target: SCN9A; (+) strand; PAM type: NRG; PAM sequence: AAG
gagtgagtggttaagagcac

SEQ ID NO: 47151 - DNA, 20 bp, Artificial Sequence
  Description of Artificial Sequence: Synthetic oligonucleotide
  Target: SCN9A; (+) strand; PAM type: NRG; PAM sequence: CAG
taagagcacaagatctgaaa

SEQ ID NO: 47152 - DNA, 20 bp, Artificial Sequence
  Description of Artificial Sequence: Synthetic oligonucleotide
  Target: SCN9A; (+) strand; PAM type: NRG; PAM sequence: CAG
agcacaagatctgaaacaga

SEQ ID NO: 47153 - DNA, 20 bp, Artificial Sequence
  Description of Artificial Sequence: Synthetic oligonucleotide
  Target: SCN9A; (+) strand; PAM type: NRG; PAM sequence: TAG
agacagcctccgtttcaact

SEQ ID NO: 47154 - DNA, 20 bp, Artificial Sequence
  Description of Artificial Sequence: Synthetic oligonucleotide
  Target: SCN9A; (+) strand; PAM type: NRG; PAM sequence: AGG
gacagcctccgtttcaactt

SEQ ID NO: 47155 - DNA, 20 bp, Artificial Sequence
  Description of Artificial Sequence: Synthetic oligonucleotide
  Target: SCN9A; (+) strand; PAM type: NRG; PAM sequence: GAG
cagcctccgtttcaacttag

SEQ ID NO: 47156 - DNA, 20 bp, Artificial Sequence
  Description of Artificial Sequence: Synthetic oligonucleotide
  Target: SCN9A; (+) strand; PAM type: NRG; PAM sequence: TAG
acttaggagctaccatttat

SEQ ID NO: 47157 - DNA, 20 bp, Artificial Sequence
  Description of Artificial Sequence: Synthetic oligonucleotide
  Target: SCN9A; (+) strand; PAM type: NRG; PAM sequence: GAG
ggagctaccatttattagct

SEQ ID NO: 47158 - DNA, 20 bp, Artificial Sequence
  Description of Artificial Sequence: Synthetic oligonucleotide
  Target: SCN9A; (+) strand; PAM type: NRG; PAM sequence: TGG
catttattagctgagtaaat

SEQ ID NO: 47159 - DNA, 20 bp, Artificial Sequence
  Description of Artificial Sequence: Synthetic oligonucleotide
  Target: SCN9A; (+) strand; PAM type: NRG; PAM sequence: GGG
atttattagctgagtaaatt

SEQ ID NO: 47160 - DNA, 20 bp, Artificial Sequence
  Description of Artificial Sequence: Synthetic oligonucleotide
  Target: SCN9A; (+) strand; PAM type: NRG; PAM sequence: GGG
tttattagctgagtaaattg

SEQ ID NO: 47161 - DNA, 20 bp, Artificial Sequence
  Description of Artificial Sequence: Synthetic oligonucleotide
  Target: SCN9A; (+) strand; PAM type: NRG; PAM sequence: AAG
ttagctgagtaaattggggc

SEQ ID NO: 47162 - DNA, 20 bp, Artificial Sequence
  Description of Artificial Sequence: Synthetic oligonucleotide
  Target: SCN9A; (+) strand; PAM type: NRG; PAM sequence: CAG
caattttcccatttgtaaaa

SEQ ID NO: 47163 - DNA, 20 bp, Artificial Sequence
  Description of Artificial Sequence: Synthetic oligonucleotide
  Target: SCN9A; (+) strand; PAM type: NRG; PAM sequence: GAG
attttcccatttgtaaaaca

SEQ ID NO: 47164 - DNA, 20 bp, Artificial Sequence
  Description of Artificial Sequence: Synthetic oligonucleotide
  Target: SCN9A; (+) strand; PAM type: NRG; PAM sequence: TGG
gataataatgtatcatctca

SEQ ID NO: 47165 - DNA, 20 bp, Artificial Sequence
  Description of Artificial Sequence: Synthetic oligonucleotide
  Target: SCN9A; (+) strand; PAM type: NRG; PAM sequence: GGG
ataataatgtatcatctcat

SEQ ID NO: 47166 - DNA, 20 bp, Artificial Sequence
  Description of Artificial Sequence: Synthetic oligonucleotide
  Target: SCN9A; (+) strand; PAM type: NRG; PAM sequence: GGG
taataatgtatcatctcatg

SEQ ID NO: 47167 - DNA, 20 bp, Artificial Sequence
  Description of Artificial Sequence: Synthetic oligonucleotide
  Target: SCN9A; (+) strand; PAM type: NRG; PAM sequence: AAG
ctgttattaacaactcaaat

SEQ ID NO: 47168 - DNA, 20 bp, Artificial Sequence
  Description of Artificial Sequence: Synthetic oligonucleotide
  Target: SCN9A; (+) strand; PAM type: NRG; PAM sequence: TGG
acaactcaaataagattcct

SEQ ID NO: 47169 - DNA, 20 bp, Artificial Sequence
  Description of Artificial Sequence: Synthetic oligonucleotide
  Target: SCN9A; (+) strand; PAM type: NRG; PAM sequence: TAG
tcaaataagattccttggaa

SEQ ID NO: 47170 - DNA, 20 bp, Artificial Sequence
  Description of Artificial Sequence: Synthetic oligonucleotide
  Target: SCN9A; (+) strand; PAM type: NRG; PAM sequence: AGG
caaataagattccttggaat

SEQ ID NO: 47171 - DNA, 20 bp, Artificial Sequence
  Description of Artificial Sequence: Synthetic oligonucleotide
  Target: SCN9A; (+) strand; PAM type: NRG; PAM sequence: AAG
ccttggaataggtacatatt

SEQ ID NO: 47172 - DNA, 20 bp, Artificial Sequence
  Description of Artificial Sequence: Synthetic oligonucleotide
  Target: SCN9A; (+) strand; PAM type: NRG; PAM sequence: AAG
tattaagctgtgacctgaaa

SEQ ID NO: 47173 - DNA, 20 bp, Artificial Sequence
  Description of Artificial Sequence: Synthetic oligonucleotide
  Target: SCN9A; (+) strand; PAM type: NRG; PAM sequence: TAG
aagctgtgacctgaaaaaga

SEQ ID NO: 47174 - DNA, 20 bp, Artificial Sequence
  Description of Artificial Sequence: Synthetic oligonucleotide
  Target: SCN9A; (+) strand; PAM type: NRG; PAM sequence: CAG
ctgtgacctgaaaaagatag

SEQ ID NO: 47175 - DNA, 20 bp, Artificial Sequence
  Description of Artificial Sequence: Synthetic oligonucleotide
  Target: SCN9A; (+) strand; PAM type: NRG; PAM sequence: TAG
tgacctgaaaaagatagcag

SEQ ID NO: 47176 - DNA, 20 bp, Artificial Sequence
  Description of Artificial Sequence: Synthetic oligonucleotide
  Target: SCN9A; (+) strand; PAM type: NRG; PAM sequence: TGG
ctgaaaaagatagcagtagc

SEQ ID NO: 47177 - DNA, 20 bp, Artificial Sequence
  Description of Artificial Sequence: Synthetic oligonucleotide
  Target: SCN9A; (+) strand; PAM type: NRG; PAM sequence: AAG
aaaagatagcagtagctggc

SEQ ID NO: 47178 - DNA, 20 bp, Artificial Sequence
  Description of Artificial Sequence: Synthetic oligonucleotide
  Target: SCN9A; (+) strand; PAM type: NRG; PAM sequence: TAG
aagtaatccaaatttcttca

SEQ ID NO: 47179 - DNA, 20 bp, Artificial Sequence
  Description of Artificial Sequence: Synthetic oligonucleotide
  Target: SCN9A; (+) strand; PAM type: NRG; PAM sequence: TGG
tccaaatttcttcatagaaa

SEQ ID NO: 47180 - DNA, 20 bp, Artificial Sequence
  Description of Artificial Sequence: Synthetic oligonucleotide
  Target: SCN9A; (+) strand; PAM type: NRG; PAM sequence: GGG
ccaaatttcttcatagaaat

SEQ ID NO: 47181 - DNA, 20 bp, Artificial Sequence
  Description of Artificial Sequence: Synthetic oligonucleotide
  Target: SCN9A; (+) strand; PAM type: NRG; PAM sequence: CAG
gatctattattaactaatat

SEQ ID NO: 47182 - DNA, 20 bp, Artificial Sequence
  Description of Artificial Sequence: Synthetic oligonucleotide
  Target: SCN9A; (+) strand; PAM type: NRG; PAM sequence: AAG
ccgtcataaattgttctcta

SEQ ID NO: 47183 - DNA, 20 bp, Artificial Sequence
  Description of Artificial Sequence: Synthetic oligonucleotide
  Target: SCN9A; (+) strand; PAM type: NRG; PAM sequence: GAG
gtcataaattgttctctaaa

SEQ ID NO: 47184 - DNA, 20 bp, Artificial Sequence
  Description of Artificial Sequence: Synthetic oligonucleotide
  Target: SCN9A; (+) strand; PAM type: NRG; PAM sequence: TAG
atcttcaattataaaattaa

SEQ ID NO: 47185 - DNA, 20 bp, Artificial Sequence
  Description of Artificial Sequence: Synthetic oligonucleotide
  Target: SCN9A; (+) strand; PAM type: NRG; PAM sequence: AAG
caattataaaattaatagac

SEQ ID NO: 47186 - DNA, 20 bp, Artificial Sequence
  Description of Artificial Sequence: Synthetic oligonucleotide
  Target: SCN9A; (+) strand; PAM type: NRG; PAM sequence: TGG
caagtacctttttacaaaaa

SEQ ID NO: 47187 - DNA, 20 bp, Artificial Sequence
  Description of Artificial Sequence: Synthetic oligonucleotide
  Target: SCN9A; (+) strand; PAM type: NRG; PAM sequence: GGG
aagtacctttttacaaaaat

SEQ ID NO: 47188 - DNA, 20 bp, Artificial Sequence
  Description of Artificial Sequence: Synthetic oligonucleotide
  Target: SCN9A; (+) strand; PAM type: NRG; PAM sequence: GAG
aaaaatgggattttatcttt

SEQ ID NO: 47189 - DNA, 20 bp, Artificial Sequence
  Description of Artificial Sequence: Synthetic oligonucleotide
  Target: SCN9A; (+) strand; PAM type: NRG; PAM sequence: TAG
atgggattttatctttgagt

SEQ ID NO: 47190 - DNA, 20 bp, Artificial Sequence
  Description of Artificial Sequence: Synthetic oligonucleotide
  Target: SCN9A; (+) strand; PAM type: NRG; PAM sequence: TAG
agttagatgcctacaacaca

SEQ ID NO: 47191 - DNA, 20 bp, Artificial Sequence
  Description of Artificial Sequence: Synthetic oligonucleotide
  Target: SCN9A; (+) strand; PAM type: NRG; PAM sequence: GAG
atgcctacaacacatagaat

SEQ ID NO: 47192 - DNA, 20 bp, Artificial Sequence
  Description of Artificial Sequence: Synthetic oligonucleotide
  Target: SCN9A; (+) strand; PAM type: NRG; PAM sequence: AGG
tgcctacaacacatagaatg

SEQ ID NO: 47193 - DNA, 20 bp, Artificial Sequence
  Description of Artificial Sequence: Synthetic oligonucleotide
  Target: SCN9A; (+) strand; PAM type: NRG; PAM sequence: TAG
acaacacatagaatgaggat

SEQ ID NO: 47194 - DNA, 20 bp, Artificial Sequence
  Description of Artificial Sequence: Synthetic oligonucleotide
  Target: SCN9A; (+) strand; PAM type: NRG; PAM sequence: AGG
caacacatagaatgaggatt

SEQ ID NO: 47195 - DNA, 20 bp, Artificial Sequence
  Description of Artificial Sequence: Synthetic oligonucleotide
  Target: SCN9A; (+) strand; PAM type: NRG; PAM sequence: AAG
aggattaggctaatgaatca

SEQ ID NO: 47196 - DNA, 20 bp, Artificial Sequence
  Description of Artificial Sequence: Synthetic oligonucleotide
  Target: SCN9A; (+) strand; PAM type: NRG; PAM sequence: AGG
ggattaggctaatgaatcaa

SEQ ID NO: 47197 - DNA, 20 bp, Artificial Sequence
  Description of Artificial Sequence: Synthetic oligonucleotide
  Target: SCN9A; (+) strand; PAM type: NRG; PAM sequence: TAG
gaatcaaaggtgtgttccta

SEQ ID NO: 47198 - DNA, 20 bp, Artificial Sequence
  Description of Artificial Sequence: Synthetic oligonucleotide
  Target: SCN9A; (+) strand; PAM type: NRG; PAM sequence: AAG
aaggtgtgttcctatagaaa

SEQ ID NO: 47199 - DNA, 20 bp, Artificial Sequence
  Description of Artificial Sequence: Synthetic oligonucleotide
  Target: SCN9A; (+) strand; PAM type: NRG; PAM sequence: CAG
agaaaaagtattgcaaaatg

SEQ ID NO: 47200 - DNA, 20 bp, Artificial Sequence
  Description of Artificial Sequence: Synthetic oligonucleotide
  Target: SCN9A; (+) strand; PAM type: NRG; PAM sequence: GAG
aaaaagtattgcaaaatgca

SEQ ID NO: 47201 - DNA, 20 bp, Artificial Sequence
  Description of Artificial Sequence: Synthetic oligonucleotide
  Target: SCN9A; (+) strand; PAM type: NRG; PAM sequence: AAG
caaaatgcagagccattcac

SEQ ID NO: 47202 - DNA, 20 bp, Artificial Sequence
  Description of Artificial Sequence: Synthetic oligonucleotide
  Target: SCN9A; (+) strand; PAM type: NRG; PAM sequence: CAG
tgcagagccattcacaagac

SEQ ID NO: 47203 - DNA, 20 bp, Artificial Sequence
  Description of Artificial Sequence: Synthetic oligonucleotide
  Target: SCN9A; (+) strand; PAM type: NRG; PAM sequence: GAG
cagagccattcacaagacca

SEQ ID NO: 47204 - DNA, 20 bp, Artificial Sequence
  Description of Artificial Sequence: Synthetic oligonucleotide
  Target: SCN9A; (+) strand; PAM type: NRG; PAM sequence: AAG
agccattcacaagaccagag

SEQ ID NO: 47205 - DNA, 20 bp, Artificial Sequence
  Description of Artificial Sequence: Synthetic oligonucleotide
  Target: SCN9A; (+) strand; PAM type: NRG; PAM sequence: AGG
gccattcacaagaccagaga

SEQ ID NO: 47206 - DNA, 20 bp, Artificial Sequence
  Description of Artificial Sequence: Synthetic oligonucleotide
  Target: SCN9A; (+) strand; PAM type: NRG; PAM sequence: CAG
caagaccagagaaggccctt

SEQ ID NO: 47207 - DNA, 20 bp, Artificial Sequence
  Description of Artificial Sequence: Synthetic oligonucleotide
  Target: SCN9A; (+) strand; PAM type: NRG; PAM sequence: CAG
gaccagagaaggcccttcag

SEQ ID NO: 47208 - DNA, 20 bp, Artificial Sequence
  Description of Artificial Sequence: Synthetic oligonucleotide
  Target: SCN9A; (+) strand; PAM type: NRG; PAM sequence: GAG
ccagagaaggcccttcagca

SEQ ID NO: 47209 - DNA, 20 bp, Artificial Sequence
  Description of Artificial Sequence: Synthetic oligonucleotide
  Target: SCN9A; (+) strand; PAM type: NRG; PAM sequence: GAG
agagaaggcccttcagcaga

SEQ ID NO: 47210 - DNA, 20 bp, Artificial Sequence
  Description of Artificial Sequence: Synthetic oligonucleotide
  Target: SCN9A; (+) strand; PAM type: NRG; PAM sequence: CAG
agcagagagactgactgatg

SEQ ID NO: 47211 - DNA, 20 bp, Artificial Sequence
  Description of Artificial Sequence: Synthetic oligonucleotide
  Target: SCN9A; (+) strand; PAM type: NRG; PAM sequence: AGG
gcagagagactgactgatgc

SEQ ID NO: 47212 - DNA, 20 bp, Artificial Sequence
  Description of Artificial Sequence: Synthetic oligonucleotide
  Target: SCN9A; (+) strand; PAM type: NRG; PAM sequence: AAG
agactgactgatgcaggaac

SEQ ID NO: 47213 - DNA, 20 bp, Artificial Sequence
  Description of Artificial Sequence: Synthetic oligonucleotide
  Target: SCN9A; (+) strand; PAM type: NRG; PAM sequence: AGG
gactgactgatgcaggaaca

SEQ ID NO: 47214 - DNA, 20 bp, Artificial Sequence
  Description of Artificial Sequence: Synthetic oligonucleotide
  Target: SCN9A; (+) strand; PAM type: NRG; PAM sequence: GGG
actgactgatgcaggaacaa

SEQ ID NO: 47215 - DNA, 20 bp, Artificial Sequence
  Description of Artificial Sequence: Synthetic oligonucleotide
  Target: SCN9A; (+) strand; PAM type: NRG; PAM sequence: CAG
ctgatgcaggaacaagggcc

SEQ ID NO: 47216 - DNA, 20 bp, Artificial Sequence
  Description of Artificial Sequence: Synthetic oligonucleotide
  Target: SCN9A; (+) strand; PAM type: NRG; PAM sequence: GAG
acaagggcccagccatgcct

SEQ ID NO: 47217 - DNA, 20 bp, Artificial Sequence
  Description of Artificial Sequence: Synthetic oligonucleotide
  Target: SCN9A; (+) strand; PAM type: NRG; PAM sequence: CAG
aaacgtccttacgctgtcat

SEQ ID NO: 47218 - DNA, 20 bp, Artificial Sequence
  Description of Artificial Sequence: Synthetic oligonucleotide
  Target: SCN9A; (+) strand; PAM type: NRG; PAM sequence: AAG
cgtccttacgctgtcatcag

SEQ ID NO: 47219 - DNA, 20 bp, Artificial Sequence
  Description of Artificial Sequence: Synthetic oligonucleotide
  Target: SCN9A; (+) strand; PAM type: NRG; PAM sequence: TGG
gccttatctattatcacctc

SEQ ID NO: 47220 - DNA, 20 bp, Artificial Sequence
  Description of Artificial Sequence: Synthetic oligonucleotide
  Target: SCN9A; (+) strand; PAM type: NRG; PAM sequence: CAG
ttatctattatcacctctgg

SEQ ID NO: 47221 - DNA, 20 bp, Artificial Sequence
  Description of Artificial Sequence: Synthetic oligonucleotide
  Target: SCN9A; (+) strand; PAM type: NRG; PAM sequence: AAG
tctattatcacctctggcag

SEQ ID NO: 47222 - DNA, 20 bp, Artificial Sequence
  Description of Artificial Sequence: Synthetic oligonucleotide
  Target: SCN9A; (+) strand; PAM type: NRG; PAM sequence: TGG
ctctggcagaagctgtccat

SEQ ID NO: 47223 - DNA, 20 bp, Artificial Sequence
  Description of Artificial Sequence: Synthetic oligonucleotide
  Target: SCN9A; (+) strand; PAM type: NRG; PAM sequence: GGG
tctggcagaagctgtccatt

SEQ ID NO: 47224 - DNA, 20 bp, Artificial Sequence
  Description of Artificial Sequence: Synthetic oligonucleotide
  Target: SCN9A; (+) strand; PAM type: NRG; PAM sequence: GGG
ctggcagaagctgtccattg

SEQ ID NO: 47225 - DNA, 20 bp, Artificial Sequence
  Description of Artificial Sequence: Synthetic oligonucleotide
  Target: SCN9A; (+) strand; PAM type: NRG; PAM sequence: GAG
ggcagaagctgtccattggg

SEQ ID NO: 47226 - DNA, 20 bp, Artificial Sequence
  Description of Artificial Sequence: Synthetic oligonucleotide
  Target: SCN9A; (+) strand; PAM type: NRG; PAM sequence: GAG
agctgtccattggggagcat

SEQ ID NO: 47227 - DNA, 20 bp, Artificial Sequence
  Description of Artificial Sequence: Synthetic oligonucleotide
  Target: SCN9A; (+) strand; PAM type: NRG; PAM sequence: AGG
gctgtccattggggagcatg

SEQ ID NO: 47228 - DNA, 20 bp, Artificial Sequence
  Description of Artificial Sequence: Synthetic oligonucleotide
  Target: SCN9A; (+) strand; PAM type: NRG; PAM sequence: GGG
ctgtccattggggagcatga

SEQ ID NO: 47229 - DNA, 20 bp, Artificial Sequence
  Description of Artificial Sequence: Synthetic oligonucleotide
  Target: SCN9A; (+) strand; PAM type: NRG; PAM sequence: GAG
cattggggagcatgagggct

SEQ ID NO: 47230 - DNA, 20 bp, Artificial Sequence
  Description of Artificial Sequence: Synthetic oligonucleotide
  Target: SCN9A; (+) strand; PAM type: NRG; PAM sequence: CAG
agggctgagcgtccatcaac

SEQ ID NO: 47231 - DNA, 20 bp, Artificial Sequence
  Description of Artificial Sequence: Synthetic oligonucleotide
  Target: SCN9A; (+) strand; PAM type: NRG; PAM sequence: AGG
gggctgagcgtccatcaacc

SEQ ID NO: 47232 - DNA, 20 bp, Artificial Sequence
  Description of Artificial Sequence: Synthetic oligonucleotide
  Target: SCN9A; (+) strand; PAM type: NRG; PAM sequence: GGG
ggctgagcgtccatcaacca

SEQ ID NO: 47233 - DNA, 20 bp, Artificial Sequence
  Description of Artificial Sequence: Synthetic oligonucleotide
  Target: SCN9A; (+) strand; PAM type: NRG; PAM sequence: GAG
ctgagcgtccatcaaccagg

SEQ ID NO: 47234 - DNA, 20 bp, Artificial Sequence
  Description of Artificial Sequence: Synthetic oligonucleotide
  Target: SCN9A; (+) strand; PAM type: NRG; PAM sequence: CAG
ccagggagaccacaccgttg

SEQ ID NO: 47235 - DNA, 20 bp, Artificial Sequence
  Description of Artificial Sequence: Synthetic oligonucleotide
  Target: SCN9A; (+) strand; PAM type: NRG; PAM sequence: CAG
gaccacaccgttgcagtcca

SEQ ID NO: 47236 - DNA, 20 bp, Artificial Sequence
  Description of Artificial Sequence: Synthetic oligonucleotide
  Target: SCN9A; (+) strand; PAM type: NRG; PAM sequence: CGG
ctgtgcattttcccgttcac

SEQ ID NO: 47237 - DNA, 20 bp, Artificial Sequence
  Description of Artificial Sequence: Synthetic oligonucleotide
  Target: SCN9A; (+) strand; PAM type: NRG; PAM sequence: CAG
tgcattttcccgttcaccgg

SEQ ID NO: 47238 - DNA, 20 bp, Artificial Sequence
  Description of Artificial Sequence: Synthetic oligonucleotide
  Target: SCN9A; (+) strand; PAM type: NRG; PAM sequence: TGG
ttcccgttcaccggcagcat

SEQ ID NO: 47239 - DNA, 20 bp, Artificial Sequence
  Description of Artificial Sequence: Synthetic oligonucleotide
  Target: SCN9A; (+) strand; PAM type: NRG; PAM sequence: TGG
ccgttcaccggcagcattgg

SEQ ID NO: 47240 - DNA, 20 bp, Artificial Sequence
  Description of Artificial Sequence: Synthetic oligonucleotide
  Target: SCN9A; (+) strand; PAM type: NRG; PAM sequence: GGG
cgttcaccggcagcattggt

SEQ ID NO: 47241 - DNA, 20 bp, Artificial Sequence
  Description of Artificial Sequence: Synthetic oligonucleotide
  Target: SCN9A; (+) strand; PAM type: NRG; PAM sequence: GGG
gttcaccggcagcattggtg

SEQ ID NO: 47242 - DNA, 20 bp, Artificial Sequence
  Description of Artificial Sequence: Synthetic oligonucleotide
  Target: SCN9A; (+) strand; PAM type: NRG; PAM sequence: TGG
cagcattggtggggacctac

SEQ ID NO: 47243 - DNA, 20 bp, Artificial Sequence
  Description of Artificial Sequence: Synthetic oligonucleotide
  Target: SCN9A; (+) strand; PAM type: NRG; PAM sequence: TGG
ttggtggggacctactggct

SEQ ID NO: 47244 - DNA, 20 bp, Artificial Sequence
  Description of Artificial Sequence: Synthetic oligonucleotide
  Target: SCN9A; (+) strand; PAM type: NRG; PAM sequence: TGG
tgttactgctgcgtcgctcc

SEQ ID NO: 47245 - DNA, 20 bp, Artificial Sequence
  Description of Artificial Sequence: Synthetic oligonucleotide
  Target: SCN9A; (+) strand; PAM type: NRG; PAM sequence: GGG
gttactgctgcgtcgctcct

SEQ ID NO: 47246 - DNA, 20 bp, Artificial Sequence
  Description of Artificial Sequence: Synthetic oligonucleotide
  Target: SCN9A; (+) strand; PAM type: NRG; PAM sequence: GGG
ttactgctgcgtcgctcctg

SEQ ID NO: 47247 - DNA, 20 bp, Artificial Sequence
  Description of Artificial Sequence: Synthetic oligonucleotide
  Target: SCN9A; (+) strand; PAM type: NRG; PAM sequence: TGG
tgcgtcgctcctggggtctg

SEQ ID NO: 47248 - DNA, 20 bp, Artificial Sequence
  Description of Artificial Sequence: Synthetic oligonucleotide
  Target: SCN9A; (+) strand; PAM type: NRG; PAM sequence: GGG
gcgtcgctcctggggtctgt

SEQ ID NO: 47249 - DNA, 20 bp, Artificial Sequence
  Description of Artificial Sequence: Synthetic oligonucleotide
  Target: SCN9A; (+) strand; PAM type: NRG; PAM sequence: GGG
cgtcgctcctggggtctgtg

SEQ ID NO: 47250 - DNA, 20 bp, Artificial Sequence
  Description of Artificial Sequence: Synthetic oligonucleotide
  Target: SCN9A; (+) strand; PAM type: NRG; PAM sequence: CAG
tggggtctgtggggcacaaa

SEQ ID NO: 47251 - DNA, 20 bp, Artificial Sequence
  Description of Artificial Sequence: Synthetic oligonucleotide
  Target: SCN9A; (+) strand; PAM type: NRG; PAM sequence: GAG
gtctgtggggcacaaacagt

SEQ ID NO: 47252 - DNA, 20 bp, Artificial Sequence
  Description of Artificial Sequence: Synthetic oligonucleotide
  Target: SCN9A; (+) strand; PAM type: NRG; PAM sequence: CGG
aaaaatgctgtgctcatcat

SEQ ID NO: 47253 - DNA, 20 bp, Artificial Sequence
  Description of Artificial Sequence: Synthetic oligonucleotide
  Target: SCN9A; (+) strand; PAM type: NRG; PAM sequence: CAG
gtgctcatcatcggcaaatt

SEQ ID NO: 47254 - DNA, 20 bp, Artificial Sequence
  Description of Artificial Sequence: Synthetic oligonucleotide
  Target: SCN9A; (+) strand; PAM type: NRG; PAM sequence: CAG
atcatcggcaaattcagtct

SEQ ID NO: 47255 - DNA, 20 bp, Artificial Sequence
  Description of Artificial Sequence: Synthetic oligonucleotide
  Target: SCN9A; (+) strand; PAM type: NRG; PAM sequence: AAG
cctctgcctttgaaactaaa

SEQ ID NO: 47256 - DNA, 20 bp, Artificial Sequence
  Description of Artificial Sequence: Synthetic oligonucleotide
  Target: SCN9A; (+) strand; PAM type: NRG; PAM sequence: CAG
tgttctgctgcttcgccttg

SEQ ID NO: 47257 - DNA, 20 bp, Artificial Sequence
  Description of Artificial Sequence: Synthetic oligonucleotide
  Target: SCN9A; (+) strand; PAM type: NRG; PAM sequence: AAG
tgcttcgccttgcagaaaac

SEQ ID NO: 47258 - DNA, 20 bp, Artificial Sequence
  Description of Artificial Sequence: Synthetic oligonucleotide
  Target: SCN9A; (+) strand; PAM type: NRG; PAM sequence: AGG
gcttcgccttgcagaaaaca

SEQ ID NO: 47259 - DNA, 20 bp, Artificial Sequence
  Description of Artificial Sequence: Synthetic oligonucleotide
  Target: SCN9A; (+) strand; PAM type: NRG; PAM sequence: GAG
ttcgccttgcagaaaacaag

SEQ ID NO: 47260 - DNA, 20 bp, Artificial Sequence
  Description of Artificial Sequence: Synthetic oligonucleotide
  Target: SCN9A; (+) strand; PAM type: NRG; PAM sequence: GAG
aacaaggagccacgaatgct

SEQ ID NO: 47261 - DNA, 20 bp, Artificial Sequence
  Description of Artificial Sequence: Synthetic oligonucleotide
  Target: SCN9A; (+) strand; PAM type: NRG; PAM sequence: TGG
aaggagccacgaatgctgag

SEQ ID NO: 47262 - DNA, 20 bp, Artificial Sequence
  Description of Artificial Sequence: Synthetic oligonucleotide
  Target: SCN9A; (+) strand; PAM type: NRG; PAM sequence: CAG
cgaatgctgagtggtgactg

SEQ ID NO: 47263 - DNA, 20 bp, Artificial Sequence
  Description of Artificial Sequence: Synthetic oligonucleotide
  Target: SCN9A; (+) strand; PAM type: NRG; PAM sequence: TGG
cagaaaaattaaaaaaaacg

SEQ ID NO: 47264 - DNA, 20 bp, Artificial Sequence
  Description of Artificial Sequence: Synthetic oligonucleotide
  Target: SCN9A; (+) strand; PAM type: NRG; PAM sequence: AAG
taaaaaaaacgtggttgctg

SEQ ID NO: 47265 - DNA, 20 bp, Artificial Sequence
  Description of Artificial Sequence: Synthetic oligonucleotide
  Target: SCN9A; (+) strand; PAM type: NRG; PAM sequence: TAG
gttgctgaagcacctactga

SEQ ID NO: 47266 - DNA, 20 bp, Artificial Sequence
  Description of Artificial Sequence: Synthetic oligonucleotide
  Target: SCN9A; (+) strand; PAM type: NRG; PAM sequence: AAG
gctgaagcacctactgatag

SEQ ID NO: 47267 - DNA, 20 bp, Artificial Sequence
  Description of Artificial Sequence: Synthetic oligonucleotide
  Target: SCN9A; (+) strand; PAM type: NRG; PAM sequence: TGG
ataaataccactgaacccac

SEQ ID NO: 47268 - DNA, 20 bp, Artificial Sequence
  Description of Artificial Sequence: Synthetic oligonucleotide
  Target: SCN9A; (+) strand; PAM type: NRG; PAM sequence: GAG
accactgaacccactggcct

SEQ ID NO: 47269 - DNA, 20 bp, Artificial Sequence
  Description of Artificial Sequence: Synthetic oligonucleotide
  Target: SCN9A; (+) strand; PAM type: NRG; PAM sequence: AGG
ccactgaacccactggcctg

SEQ ID NO: 47270 - DNA, 20 bp, Artificial Sequence
  Description of Artificial Sequence: Synthetic oligonucleotide
  Target: SCN9A; (+) strand; PAM type: NRG; PAM sequence: GGG
cactgaacccactggcctga

SEQ ID NO: 47271 - DNA, 20 bp, Artificial Sequence
  Description of Artificial Sequence: Synthetic oligonucleotide
  Target: SCN9A; (+) strand; PAM type: NRG; PAM sequence: CAG
tgaacccactggcctgaggg

SEQ ID NO: 47272 - DNA, 20 bp, Artificial Sequence
  Description of Artificial Sequence: Synthetic oligonucleotide
  Target: SCN9A; (+) strand; PAM type: NRG; PAM sequence: AGG
gaacccactggcctgagggc

SEQ ID NO: 47273 - DNA, 20 bp, Artificial Sequence
  Description of Artificial Sequence: Synthetic oligonucleotide
  Target: SCN9A; (+) strand; PAM type: NRG; PAM sequence: TGG
cccactggcctgagggcagg

SEQ ID NO: 47274 - DNA, 20 bp, Artificial Sequence
  Description of Artificial Sequence: Synthetic oligonucleotide
  Target: SCN9A; (+) strand; PAM type: NRG; PAM sequence: AAG
gtggctctgtactgacttaa

SEQ ID NO: 47275 - DNA, 20 bp, Artificial Sequence
  Description of Artificial Sequence: Synthetic oligonucleotide
  Target: SCN9A; (+) strand; PAM type: NRG; PAM sequence: AAG
aagaaacatacttaaaaacg

SEQ ID NO: 47276 - DNA, 20 bp, Artificial Sequence
  Description of Artificial Sequence: Synthetic oligonucleotide
  Target: SCN9A; (+) strand; PAM type: NRG; PAM sequence: CAG
tacttaaaaacgaagcaatt

SEQ ID NO: 47277 - DNA, 20 bp, Artificial Sequence
  Description of Artificial Sequence: Synthetic oligonucleotide
  Target: SCN9A; (+) strand; PAM type: NRG; PAM sequence: GAG
taaaaacgaagcaattcagt

SEQ ID NO: 47278 - DNA, 20 bp, Artificial Sequence
  Description of Artificial Sequence: Synthetic oligonucleotide
  Target: SCN9A; (+) strand; PAM type: NRG; PAM sequence: AAG
aaacgaagcaattcagtgag

SEQ ID NO: 47279 - DNA, 20 bp, Artificial Sequence
  Description of Artificial Sequence: Synthetic oligonucleotide
  Target: SCN9A; (+) strand; PAM type: NRG; PAM sequence: AAG
gaagaaaacttcttccactt

SEQ ID NO: 47280 - DNA, 20 bp, Artificial Sequence
  Description of Artificial Sequence: Synthetic oligonucleotide
  Target: SCN9A; (+) strand; PAM type: NRG; PAM sequence: AGG
aagaaaacttcttccactta

SEQ ID NO: 47281 - DNA, 20 bp, Artificial Sequence
  Description of Artificial Sequence: Synthetic oligonucleotide
  Target: SCN9A; (+) strand; PAM type: NRG; PAM sequence: GGG
agaaaacttcttccacttaa

SEQ ID NO: 47282 - DNA, 20 bp, Artificial Sequence
  Description of Artificial Sequence: Synthetic oligonucleotide
  Target: SCN9A; (+) strand; PAM type: NRG; PAM sequence: TAG
ttaagggatgaaacaatttg

SEQ ID NO: 47283 - DNA, 20 bp, Artificial Sequence
  Description of Artificial Sequence: Synthetic oligonucleotide
  Target: SCN9A; (+) strand; PAM type: NRG; PAM sequence: CAG
atttgtagaattcatccttt

SEQ ID NO: 47284 - DNA, 20 bp, Artificial Sequence
  Description of Artificial Sequence: Synthetic oligonucleotide
  Target: SCN9A; (+) strand; PAM type: NRG; PAM sequence: AGG
tttgtagaattcatcctttc

SEQ ID NO: 47285 - DNA, 20 bp, Artificial Sequence
  Description of Artificial Sequence: Synthetic oligonucleotide
  Target: SCN9A; (+) strand; PAM type: NRG; PAM sequence: CAG
agaattcatcctttcaggac

SEQ ID NO: 47286 - DNA, 20 bp, Artificial Sequence
  Description of Artificial Sequence: Synthetic oligonucleotide
  Target: SCN9A; (+) strand; PAM type: NRG; PAM sequence: AGG
gaattcatcctttcaggacc

SEQ ID NO: 47287 - DNA, 20 bp, Artificial Sequence
  Description of Artificial Sequence: Synthetic oligonucleotide
  Target: SCN9A; (+) strand; PAM type: NRG; PAM sequence: CAG
gtaaattatttgttgctata

SEQ ID NO: 47288 - DNA, 20 bp, Artificial Sequence
  Description of Artificial Sequence: Synthetic oligonucleotide
  Target: SCN9A; (+) strand; PAM type: NRG; PAM sequence: TGG
tatacagctctctaatattc

SEQ ID NO: 47289 - DNA, 20 bp, Artificial Sequence
  Description of Artificial Sequence: Synthetic oligonucleotide
  Target: SCN9A; (+) strand; PAM type: NRG; PAM sequence: TAG
agctctctaatattctggcc

SEQ ID NO: 47290 - DNA, 20 bp, Artificial Sequence
  Description of Artificial Sequence: Synthetic oligonucleotide
  Target: SCN9A; (+) strand; PAM type: NRG; PAM sequence: GAG
ctctctaatattctggccta

SEQ ID NO: 47291 - DNA, 20 bp, Artificial Sequence
  Description of Artificial Sequence: Synthetic oligonucleotide
  Target: SCN9A; (+) strand; PAM type: NRG; PAM sequence: CAG
atgccattcattttgctgca

SEQ ID NO: 47292 - DNA, 20 bp, Artificial Sequence
  Description of Artificial Sequence: Synthetic oligonucleotide
  Target: SCN9A; (+) strand; PAM type: NRG; PAM sequence: AAG
cagaacttataacttaaaaa

SEQ ID NO: 47293 - DNA, 20 bp, Artificial Sequence
  Description of Artificial Sequence: Synthetic oligonucleotide
  Target: SCN9A; (+) strand; PAM type: NRG; PAM sequence: TAG
tataacttaaaaaaagaact

SEQ ID NO: 47294 - DNA, 20 bp, Artificial Sequence
  Description of Artificial Sequence: Synthetic oligonucleotide
  Target: SCN9A; (+) strand; PAM type: NRG; PAM sequence: TGG
aaagaacttagtattgctac

SEQ ID NO: 47295 - DNA, 20 bp, Artificial Sequence
  Description of Artificial Sequence: Synthetic oligonucleotide
  Target: SCN9A; (+) strand; PAM type: NRG; PAM sequence: CAG
actttttatatatcaatccc

SEQ ID NO: 47296 - DNA, 20 bp, Artificial Sequence
  Description of Artificial Sequence: Synthetic oligonucleotide
  Target: SCN9A; (+) strand; PAM type: NRG; PAM sequence: AGG
ctttttatatatcaatcccc

SEQ ID NO: 47297 - DNA, 20 bp, Artificial Sequence
  Description of Artificial Sequence: Synthetic oligonucleotide
  Target: SCN9A; (+) strand; PAM type: NRG; PAM sequence: TGG
cccaggcttcacaaaaaaat

SEQ ID NO: 47298 - DNA, 20 bp, Artificial Sequence
  Description of Artificial Sequence: Synthetic oligonucleotide
  Target: SCN9A; (+) strand; PAM type: NRG; PAM sequence: TGG
aaattggaaatcatgctgta

SEQ ID NO: 47299 - DNA, 20 bp, Artificial Sequence
  Description of Artificial Sequence: Synthetic oligonucleotide
  Target: SCN9A; (+) strand; PAM type: NRG; PAM sequence: AAG
gaaaatccaccttacatact

SEQ ID NO: 47300 - DNA, 20 bp, Artificial Sequence
  Description of Artificial Sequence: Synthetic oligonucleotide
  Target: SCN9A; (+) strand; PAM type: NRG; PAM sequence: GAG
aaatccaccttacatactaa

SEQ ID NO: 47301 - DNA, 20 bp, Artificial Sequence
  Description of Artificial Sequence: Synthetic oligonucleotide
  Target: SCN9A; (+) strand; PAM type: NRG; PAM sequence: CAG
caccttacatactaagagct

SEQ ID NO: 47302 - DNA, 20 bp, Artificial Sequence
  Description of Artificial Sequence: Synthetic oligonucleotide
  Target: SCN9A; (+) strand; PAM type: NRG; PAM sequence: AAG
acatactaagagctcagtta

SEQ ID NO: 47303 - DNA, 20 bp, Artificial Sequence
  Description of Artificial Sequence: Synthetic oligonucleotide
  Target: SCN9A; (+) strand; PAM type: NRG; PAM sequence: AAG
gctcagttaaagtgtattta

SEQ ID NO: 47304 - DNA, 20 bp, Artificial Sequence
  Description of Artificial Sequence: Synthetic oligonucleotide
  Target: SCN9A; (+) strand; PAM type: NRG; PAM sequence: GAG
tcagttaaagtgtatttaaa

SEQ ID NO: 47305 - DNA, 20 bp, Artificial Sequence
  Description of Artificial Sequence: Synthetic oligonucleotide
  Target: SCN9A; (+) strand; PAM type: NRG; PAM sequence: GAG
agttaaagtgtatttaaaga

SEQ ID NO: 47306 - DNA, 20 bp, Artificial Sequence
  Description of Artificial Sequence: Synthetic oligonucleotide
  Target: SCN9A; (+) strand; PAM type: NRG; PAM sequence: TAG
gtgtatttaaagagagcttt

SEQ ID NO: 47307 - DNA, 20 bp, Artificial Sequence
  Description of Artificial Sequence: Synthetic oligonucleotide
  Target: SCN9A; (+) strand; PAM type: NRG; PAM sequence: CAG
ttaaagagagcttttagcac

SEQ ID NO: 47308 - DNA, 20 bp, Artificial Sequence
  Description of Artificial Sequence: Synthetic oligonucleotide
  Target: SCN9A; (+) strand; PAM type: NRG; PAM sequence: AAG
ttagcaccagttaatttata

SEQ ID NO: 47309 - DNA, 20 bp, Artificial Sequence
  Description of Artificial Sequence: Synthetic oligonucleotide
  Target: SCN9A; (+) strand; PAM type: NRG; PAM sequence: AAG
aaagtcattaaatatttaaa

SEQ ID NO: 47310 - DNA, 20 bp, Artificial Sequence
  Description of Artificial Sequence: Synthetic oligonucleotide
  Target: SCN9A; (+) strand; PAM type: NRG; PAM sequence: AAG
gtcattaaatatttaaaaag

SEQ ID NO: 47311 - DNA, 20 bp, Artificial Sequence
  Description of Artificial Sequence: Synthetic oligonucleotide
  Target: SCN9A; (+) strand; PAM type: NRG; PAM sequence: AAG
aaagaagttgcccaatacca

SEQ ID NO: 47312 - DNA, 20 bp, Artificial Sequence
  Description of Artificial Sequence: Synthetic oligonucleotide
  Target: SCN9A; (+) strand; PAM type: NRG; PAM sequence: GAG
agaagttgcccaataccaaa

SEQ ID NO: 47313 - DNA, 20 bp, Artificial Sequence
  Description of Artificial Sequence: Synthetic oligonucleotide
  Target: SCN9A; (+) strand; PAM type: NRG; PAM sequence: AGG
gaagttgcccaataccaaag

SEQ ID NO: 47314 - DNA, 20 bp, Artificial Sequence
  Description of Artificial Sequence: Synthetic oligonucleotide
  Target: SCN9A; (+) strand; PAM type: NRG; PAM sequence: GAG
agttgcccaataccaaagag

SEQ ID NO: 47315 - DNA, 20 bp, Artificial Sequence
  Description of Artificial Sequence: Synthetic oligonucleotide
  Target: SCN9A; (+) strand; PAM type: NRG; PAM sequence: AGG
gttgcccaataccaaagagg

SEQ ID NO: 47316 - DNA, 20 bp, Artificial Sequence
  Description of Artificial Sequence: Synthetic oligonucleotide
  Target: SCN9A; (+) strand; PAM type: NRG; PAM sequence: CAG
atgcttatatgactcatgtc

SEQ ID NO: 47317 - DNA, 20 bp, Artificial Sequence
  Description of Artificial Sequence: Synthetic oligonucleotide
  Target: SCN9A; (+) strand; PAM type: NRG; PAM sequence: AGG
tgcttatatgactcatgtcc

SEQ ID NO: 47318 - DNA, 20 bp, Artificial Sequence
  Description of Artificial Sequence: Synthetic oligonucleotide
  Target: SCN9A; (+) strand; PAM type: NRG; PAM sequence: GGG
gcttatatgactcatgtcca

SEQ ID NO: 47319 - DNA, 20 bp, Artificial Sequence
  Description of Artificial Sequence: Synthetic oligonucleotide
  Target: SCN9A; (+) strand; PAM type: NRG; PAM sequence: TGG
tgtccagggtgtaaatcctt

SEQ ID NO: 47320 - DNA, 20 bp, Artificial Sequence
  Description of Artificial Sequence: Synthetic oligonucleotide
  Target: SCN9A; (+) strand; PAM type: NRG; PAM sequence: AAG
ccagggtgtaaatcctttgg

SEQ ID NO: 47321 - DNA, 20 bp, Artificial Sequence
  Description of Artificial Sequence: Synthetic oligonucleotide
  Target: SCN9A; (+) strand; PAM type: NRG; PAM sequence: AGG
cagggtgtaaatcctttgga

SEQ ID NO: 47322 - DNA, 20 bp, Artificial Sequence
  Description of Artificial Sequence: Synthetic oligonucleotide
  Target: SCN9A; (+) strand; PAM type: NRG; PAM sequence: TAG
gtaaatcctttggaaggatc

SEQ ID NO: 47323 - DNA, 20 bp, Artificial Sequence
  Description of Artificial Sequence: Synthetic oligonucleotide
  Target: SCN9A; (+) strand; PAM type: NRG; PAM sequence: TAG
tttggaaggatctagttcaa

SEQ ID NO: 47324 - DNA, 20 bp, Artificial Sequence
  Description of Artificial Sequence: Synthetic oligonucleotide
  Target: SCN9A; (+) strand; PAM type: NRG; PAM sequence: TAG
ggatctagttcaatagacat

SEQ ID NO: 47325 - DNA, 20 bp, Artificial Sequence
  Description of Artificial Sequence: Synthetic oligonucleotide
  Target: SCN9A; (+) strand; PAM type: NRG; PAM sequence: AAG
acattagtgcttactatgta

SEQ ID NO: 47326 - DNA, 20 bp, Artificial Sequence
  Description of Artificial Sequence: Synthetic oligonucleotide
  Target: SCN9A; (+) strand; PAM type: NRG; PAM sequence: AAG
tgcttactatgtaaagaaca

SEQ ID NO: 47327 - DNA, 20 bp, Artificial Sequence
  Description of Artificial Sequence: Synthetic oligonucleotide
  Target: SCN9A; (+) strand; PAM type: NRG; PAM sequence: TGG
ttactatgtaaagaacaaag

SEQ ID NO: 47328 - DNA, 20 bp, Artificial Sequence
  Description of Artificial Sequence: Synthetic oligonucleotide
  Target: SCN9A; (+) strand; PAM type: NRG; PAM sequence: TGG
gtggcaactattgtgaacaa

SEQ ID NO: 47329 - DNA, 20 bp, Artificial Sequence
  Description of Artificial Sequence: Synthetic oligonucleotide
  Target: SCN9A; (+) strand; PAM type: NRG; PAM sequence: AAG
actattgtgaacaatggaaa

SEQ ID NO: 47330 - DNA, 20 bp, Artificial Sequence
  Description of Artificial Sequence: Synthetic oligonucleotide
  Target: SCN9A; (+) strand; PAM type: NRG; PAM sequence: TGG
tgtgaacaatggaaaaagta

SEQ ID NO: 47331 - DNA, 20 bp, Artificial Sequence
  Description of Artificial Sequence: Synthetic oligonucleotide
  Target: SCN9A; (+) strand; PAM type: NRG; PAM sequence: AAG
aacaatggaaaaagtatggt

SEQ ID NO: 47332 - DNA, 20 bp, Artificial Sequence
  Description of Artificial Sequence: Synthetic oligonucleotide
  Target: SCN9A; (+) strand; PAM type: NRG; PAM sequence: AGG
acaatggaaaaagtatggta

SEQ ID NO: 47333 - DNA, 20 bp, Artificial Sequence
  Description of Artificial Sequence: Synthetic oligonucleotide
  Target: SCN9A; (+) strand; PAM type: NRG; PAM sequence: CAG
taaggtctttgcctcaaaac

SEQ ID NO: 47334 - DNA, 20 bp, Artificial Sequence
  Description of Artificial Sequence: Synthetic oligonucleotide
  Target: SCN9A; (+) strand; PAM type: NRG; PAM sequence: TGG
tctttgcctcaaaaccagct

SEQ ID NO: 47335 - DNA, 20 bp, Artificial Sequence
  Description of Artificial Sequence: Synthetic oligonucleotide
  Target: SCN9A; (+) strand; PAM type: NRG; PAM sequence: AAG
ttttattgatatatgtgtcc

SEQ ID NO: 47336 - DNA, 20 bp, Artificial Sequence
  Description of Artificial Sequence: Synthetic oligonucleotide
  Target: SCN9A; (+) strand; PAM type: NRG; PAM sequence: TAG
ccaagttctgtatcatcacc

SEQ ID NO: 47337 - DNA, 20 bp, Artificial Sequence
  Description of Artificial Sequence: Synthetic oligonucleotide
  Target: SCN9A; (+) strand; PAM type: NRG; PAM sequence: AGG
caagttctgtatcatcacct

SEQ ID NO: 47338 - DNA, 20 bp, Artificial Sequence
  Description of Artificial Sequence: Synthetic oligonucleotide
  Target: SCN9A; (+) strand; PAM type: NRG; PAM sequence: AAG
ctgtatcatcacctaggttc

SEQ ID NO: 47339 - DNA, 20 bp, Artificial Sequence
  Description of Artificial Sequence: Synthetic oligonucleotide
  Target: SCN9A; (+) strand; PAM type: NRG; PAM sequence: AAG
taggttcaagtgaaattttg

SEQ ID NO: 47340 - DNA, 20 bp, Artificial Sequence
  Description of Artificial Sequence: Synthetic oligonucleotide
  Target: SCN9A; (+) strand; PAM type: NRG; PAM sequence: AGG
aggttcaagtgaaattttga

SEQ ID NO: 47341 - DNA, 20 bp, Artificial Sequence
  Description of Artificial Sequence: Synthetic oligonucleotide
  Target: SCN9A; (+) strand; PAM type: NRG; PAM sequence: CAG
ttcaagtgaaattttgaagg

SEQ ID NO: 47342 - DNA, 20 bp, Artificial Sequence
  Description of Artificial Sequence: Synthetic oligonucleotide
  Target: SCN9A; (+) strand; PAM type: NRG; PAM sequence: AGG
tcaagtgaaattttgaaggc

SEQ ID NO: 47343 - DNA, 20 bp, Artificial Sequence
  Description of Artificial Sequence: Synthetic oligonucleotide
  Target: SCN9A; (+) strand; PAM type: NRG; PAM sequence: GGG
caagtgaaattttgaaggca

SEQ ID NO: 47344 - DNA, 20 bp, Artificial Sequence
  Description of Artificial Sequence: Synthetic oligonucleotide
  Target: SCN9A; (+) strand; PAM type: NRG; PAM sequence: CAG
tctttttttactgtgtatat

SEQ ID NO: 47345 - DNA, 20 bp, Artificial Sequence
  Description of Artificial Sequence: Synthetic oligonucleotide
  Target: SCN9A; (+) strand; PAM type: NRG; PAM sequence: AGG
ctttttttactgtgtatatc

SEQ ID NO: 47346 - DNA, 20 bp, Artificial Sequence
  Description of Artificial Sequence: Synthetic oligonucleotide
  Target: SCN9A; (+) strand; PAM type: NRG; PAM sequence: GAG
ttttttactgtgtatatcag

SEQ ID NO: 47347 - DNA, 20 bp, Artificial Sequence
  Description of Artificial Sequence: Synthetic oligonucleotide
  Target: SCN9A; (+) strand; PAM type: NRG; PAM sequence: TAG
tgtatatcaggagaatcttg

SEQ ID NO: 47348 - DNA, 20 bp, Artificial Sequence
  Description of Artificial Sequence: Synthetic oligonucleotide
  Target: SCN9A; (+) strand; PAM type: NRG; PAM sequence: TAG
gaatcttgtagatttttaac

SEQ ID NO: 47349 - DNA, 20 bp, Artificial Sequence
  Description of Artificial Sequence: Synthetic oligonucleotide
  Target: SCN9A; (+) strand; PAM type: NRG; PAM sequence: TAG
tagatttttaactagatttt

SEQ ID NO: 47350 - DNA, 20 bp, Artificial Sequence
  Description of Artificial Sequence: Synthetic oligonucleotide
  Target: SCN9A; (+) strand; PAM type: NRG; PAM sequence: TAG
ttttaactagatttttagtt

SEQ ID NO: 47351 - DNA, 20 bp, Artificial Sequence
  Description of Artificial Sequence: Synthetic oligonucleotide
  Target: SCN9A; (+) strand; PAM type: NRG; PAM sequence: AAG
actagatttttagtttagaa

SEQ ID NO: 47352 - DNA, 20 bp, Artificial Sequence
  Description of Artificial Sequence: Synthetic oligonucleotide
  Target: SCN9A; (+) strand; PAM type: NRG; PAM sequence: TGG
tagtttagaaaagtgatttg

SEQ ID NO: 47353 - DNA, 20 bp, Artificial Sequence
  Description of Artificial Sequence: Synthetic oligonucleotide
  Target: SCN9A; (+) strand; PAM type: NRG; PAM sequence: GGG
agtttagaaaagtgatttgt

SEQ ID NO: 47354 - DNA, 20 bp, Artificial Sequence
  Description of Artificial Sequence: Synthetic oligonucleotide
  Target: SCN9A; (+) strand; PAM type: NRG; PAM sequence: GGG
gtttagaaaagtgatttgtg

SEQ ID NO: 47355 - DNA, 20 bp, Artificial Sequence
  Description of Artificial Sequence: Synthetic oligonucleotide
  Target: SCN9A; (+) strand; PAM type: NRG; PAM sequence: TGG
tgatttgtggggttgtgtga

SEQ ID NO: 47356 - DNA, 20 bp, Artificial Sequence
  Description of Artificial Sequence: Synthetic oligonucleotide
  Target: SCN9A; (+) strand; PAM type: NRG; PAM sequence: CAG
tggggttgtgtgatggaaaa

SEQ ID NO: 47357 - DNA, 20 bp, Artificial Sequence
  Description of Artificial Sequence: Synthetic oligonucleotide
  Target: SCN9A; (+) strand; PAM type: NRG; PAM sequence: AGG
ggggttgtgtgatggaaaac

SEQ ID NO: 47358 - DNA, 20 bp, Artificial Sequence
  Description of Artificial Sequence: Synthetic oligonucleotide
  Target: SCN9A; (+) strand; PAM type: NRG; PAM sequence: GGG
gggttgtgtgatggaaaaca

SEQ ID NO: 47359 - DNA, 20 bp, Artificial Sequence
  Description of Artificial Sequence: Synthetic oligonucleotide
  Target: SCN9A; (+) strand; PAM type: NRG; PAM sequence: AAG
ttgtgtgatggaaaacaggg

SEQ ID NO: 47360 - DNA, 20 bp, Artificial Sequence
  Description of Artificial Sequence: Synthetic oligonucleotide
  Target: SCN9A; (+) strand; PAM type: NRG; PAM sequence: AAG
atggaaaacagggaagacct

SEQ ID NO: 47361 - DNA, 20 bp, Artificial Sequence
  Description of Artificial Sequence: Synthetic oligonucleotide
  Target: SCN9A; (+) strand; PAM type: NRG; PAM sequence: AGG
tggaaaacagggaagaccta

SEQ ID NO: 47362 - DNA, 20 bp, Artificial Sequence
  Description of Artificial Sequence: Synthetic oligonucleotide
  Target: SCN9A; (+) strand; PAM type: NRG; PAM sequence: CAG
cagggaagacctaaggaaaa

SEQ ID NO: 47363 - DNA, 20 bp, Artificial Sequence
  Description of Artificial Sequence: Synthetic oligonucleotide
  Target: SCN9A; (+) strand; PAM type: NRG; PAM sequence: AAG
ggaagacctaaggaaaacag

SEQ ID NO: 47364 - DNA, 20 bp, Artificial Sequence
  Description of Artificial Sequence: Synthetic oligonucleotide
  Target: SCN9A; (+) strand; PAM type: NRG; PAM sequence: TGG
cctaaggaaaacagaagcaa

SEQ ID NO: 47365 - DNA, 20 bp, Artificial Sequence
  Description of Artificial Sequence: Synthetic oligonucleotide
  Target: SCN9A; (+) strand; PAM type: NRG; PAM sequence: TGG
acagaagcaatggttcatct

SEQ ID NO: 47366 - DNA, 20 bp, Artificial Sequence
  Description of Artificial Sequence: Synthetic oligonucleotide
  Target: SCN9A; (+) strand; PAM type: NRG; PAM sequence: GGG
cagaagcaatggttcatctt

SEQ ID NO: 47367 - DNA, 20 bp, Artificial Sequence
  Description of Artificial Sequence: Synthetic oligonucleotide
  Target: SCN9A; (+) strand; PAM type: NRG; PAM sequence: GGG
agaagcaatggttcatcttg

SEQ ID NO: 47368 - DNA, 20 bp, Artificial Sequence
  Description of Artificial Sequence: Synthetic oligonucleotide
  Target: SCN9A; (+) strand; PAM type: NRG; PAM sequence: CAG
gttcatcttggggatttgtg

SEQ ID NO: 47369 - DNA, 20 bp, Artificial Sequence
  Description of Artificial Sequence: Synthetic oligonucleotide
  Target: SCN9A; (+) strand; PAM type: NRG; PAM sequence: AAG
ggggatttgtgcagaattat

SEQ ID NO: 47370 - DNA, 20 bp, Artificial Sequence
  Description of Artificial Sequence: Synthetic oligonucleotide
  Target: SCN9A; (+) strand; PAM type: NRG; PAM sequence: CAG
gatttgtgcagaattataag

SEQ ID NO: 47371 - DNA, 20 bp, Artificial Sequence
  Description of Artificial Sequence: Synthetic oligonucleotide
  Target: SCN9A; (+) strand; PAM type: NRG; PAM sequence: AGG
atttgtgcagaattataagc

SEQ ID NO: 47372 - DNA, 20 bp, Artificial Sequence
  Description of Artificial Sequence: Synthetic oligonucleotide
  Target: SCN9A; (+) strand; PAM type: NRG; PAM sequence: GGG
tttgtgcagaattataagca

SEQ ID NO: 47373 - DNA, 20 bp, Artificial Sequence
  Description of Artificial Sequence: Synthetic oligonucleotide
  Target: SCN9A; (+) strand; PAM type: NRG; PAM sequence: GAG
tgtgcagaattataagcagg

SEQ ID NO: 47374 - DNA, 20 bp, Artificial Sequence
  Description of Artificial Sequence: Synthetic oligonucleotide
  Target: SCN9A; (+) strand; PAM type: NRG; PAM sequence: AGG
gtgcagaattataagcaggg

SEQ ID NO: 47375 - DNA, 20 bp, Artificial Sequence
  Description of Artificial Sequence: Synthetic oligonucleotide
  Target: SCN9A; (+) strand; PAM type: NRG; PAM sequence: GAG
aattataagcagggaggcct

SEQ ID NO: 47376 - DNA, 20 bp, Artificial Sequence
  Description of Artificial Sequence: Synthetic oligonucleotide
  Target: SCN9A; (+) strand; PAM type: NRG; PAM sequence: GAG
ttataagcagggaggcctga

SEQ ID NO: 47377 - DNA, 20 bp, Artificial Sequence
  Description of Artificial Sequence: Synthetic oligonucleotide
  Target: SCN9A; (+) strand; PAM type: NRG; PAM sequence: AAG
gcagggaggcctgagagatg

SEQ ID NO: 47378 - DNA, 20 bp, Artificial Sequence
  Description of Artificial Sequence: Synthetic oligonucleotide
  Target: SCN9A; (+) strand; PAM type: NRG; PAM sequence: AGG
cagggaggcctgagagatga

SEQ ID NO: 47379 - DNA, 20 bp, Artificial Sequence
  Description of Artificial Sequence: Synthetic oligonucleotide
  Target: SCN9A; (+) strand; PAM type: NRG; PAM sequence: CAG
ggcctgagagatgaaggttt

SEQ ID NO: 47380 - DNA, 20 bp, Artificial Sequence
  Description of Artificial Sequence: Synthetic oligonucleotide
  Target: SCN9A; (+) strand; PAM type: NRG; PAM sequence: AAG
gagatgaaggtttcagtgaa

SEQ ID NO: 47381 - DNA, 20 bp, Artificial Sequence
  Description of Artificial Sequence: Synthetic oligonucleotide
  Target: SCN9A; (+) strand; PAM type: NRG; PAM sequence: GAG
gatgaaggtttcagtgaaaa

SEQ ID NO: 47382 - DNA, 20 bp, Artificial Sequence
  Description of Artificial Sequence: Synthetic oligonucleotide
  Target: SCN9A; (+) strand; PAM type: NRG; PAM sequence: AAG
aaggtttcagtgaaaagaga

SEQ ID NO: 47383 - DNA, 20 bp, Artificial Sequence
  Description of Artificial Sequence: Synthetic oligonucleotide
  Target: SCN9A; (+) strand; PAM type: NRG; PAM sequence: AGG
aggtttcagtgaaaagagaa

SEQ ID NO: 47384 - DNA, 20 bp, Artificial Sequence
  Description of Artificial Sequence: Synthetic oligonucleotide
  Target: SCN9A; (+) strand; PAM type: NRG; PAM sequence: GGG
ggtttcagtgaaaagagaaa

SEQ ID NO: 47385 - DNA, 20 bp, Artificial Sequence
  Description of Artificial Sequence: Synthetic oligonucleotide
  Target: SCN9A; (+) strand; PAM type: NRG; PAM sequence: AAG
tcagtgaaaagagaaaggga

SEQ ID NO: 47386 - DNA, 20 bp, Artificial Sequence
  Description of Artificial Sequence: Synthetic oligonucleotide
  Target: SCN9A; (+) strand; PAM type: NRG; PAM sequence: GAG
agtgaaaagagaaagggaaa

SEQ ID NO: 47387 - DNA, 20 bp, Artificial Sequence
  Description of Artificial Sequence: Synthetic oligonucleotide
  Target: SCN9A; (+) strand; PAM type: NRG; PAM sequence: CAG
aaagagaacttccacataaa

SEQ ID NO: 47388 - DNA, 20 bp, Artificial Sequence
  Description of Artificial Sequence: Synthetic oligonucleotide
  Target: SCN9A; (+) strand; PAM type: NRG; PAM sequence: CAG
ttccacataaacagaattaa

SEQ ID NO: 47389 - DNA, 20 bp, Artificial Sequence
  Description of Artificial Sequence: Synthetic oligonucleotide
  Target: SCN9A; (+) strand; PAM type: NRG; PAM sequence: TGG
taaacagaattaacagacta

SEQ ID NO: 47390 - DNA, 20 bp, Artificial Sequence
  Description of Artificial Sequence: Synthetic oligonucleotide
  Target: SCN9A; (+) strand; PAM type: NRG; PAM sequence: TAG
cagactatggcactacatat

SEQ ID NO: 47391 - DNA, 20 bp, Artificial Sequence
  Description of Artificial Sequence: Synthetic oligonucleotide
  Target: SCN9A; (+) strand; PAM type: NRG; PAM sequence: TAG
actatggcactacatattag

SEQ ID NO: 47392 - DNA, 20 bp, Artificial Sequence
  Description of Artificial Sequence: Synthetic oligonucleotide
  Target: SCN9A; (+) strand; PAM type: NRG; PAM sequence: TGG
ctacatattagtagttgatg

SEQ ID NO: 47393 - DNA, 20 bp, Artificial Sequence
  Description of Artificial Sequence: Synthetic oligonucleotide
  Target: SCN9A; (+) strand; PAM type: NRG; PAM sequence: TGG
atattagtagttgatgtggt

SEQ ID NO: 47394 - DNA, 20 bp, Artificial Sequence
  Description of Artificial Sequence: Synthetic oligonucleotide
  Target: SCN9A; (+) strand; PAM type: NRG; PAM sequence: GGG
tattagtagttgatgtggtt

SEQ ID NO: 47395 - DNA, 20 bp, Artificial Sequence
  Description of Artificial Sequence: Synthetic oligonucleotide
  Target: SCN9A; (+) strand; PAM type: NRG; PAM sequence: GGG
attagtagttgatgtggttg

SEQ ID NO: 47396 - DNA, 20 bp, Artificial Sequence
  Description of Artificial Sequence: Synthetic oligonucleotide
  Target: SCN9A; (+) strand; PAM type: NRG; PAM sequence: GGG
ttagtagttgatgtggttgg

SEQ ID NO: 47397 - DNA, 20 bp, Artificial Sequence
  Description of Artificial Sequence: Synthetic oligonucleotide
  Target: SCN9A; (+) strand; PAM type: NRG; PAM sequence: TGG
gtagttgatgtggttggggg

SEQ ID NO: 47398 - DNA, 20 bp, Artificial Sequence
  Description of Artificial Sequence: Synthetic oligonucleotide
  Target: SCN9A; (+) strand; PAM type: NRG; PAM sequence: GAG
agttgatgtggttgggggtg

SEQ ID NO: 47399 - DNA, 20 bp, Artificial Sequence
  Description of Artificial Sequence: Synthetic oligonucleotide
  Target: SCN9A; (+) strand; PAM type: NRG; PAM sequence: AGG
gttgatgtggttgggggtgg

SEQ ID NO: 47400 - DNA, 20 bp, Artificial Sequence
  Description of Artificial Sequence: Synthetic oligonucleotide
  Target: SCN9A; (+) strand; PAM type: NRG; PAM sequence: AAG
gttgggggtggaggatatca

SEQ ID NO: 47401 - DNA, 20 bp, Artificial Sequence
  Description of Artificial Sequence: Synthetic oligonucleotide
  Target: SCN9A; (+) strand; PAM type: NRG; PAM sequence: AGG
ttgggggtggaggatatcaa

SEQ ID NO: 47402 - DNA, 20 bp, Artificial Sequence
  Description of Artificial Sequence: Synthetic oligonucleotide
  Target: SCN9A; (+) strand; PAM type: NRG; PAM sequence: AAG
ggatatcaaaggcttctcca

SEQ ID NO: 47403 - DNA, 20 bp, Artificial Sequence
  Description of Artificial Sequence: Synthetic oligonucleotide
  Target: SCN9A; (+) strand; PAM type: NRG; PAM sequence: TGG
ggcttctccaaagttccaaa

SEQ ID NO: 47404 - DNA, 20 bp, Artificial Sequence
  Description of Artificial Sequence: Synthetic oligonucleotide
  Target: SCN9A; (+) strand; PAM type: NRG; PAM sequence: GGG
gcttctccaaagttccaaat

SEQ ID NO: 47405 - DNA, 20 bp, Artificial Sequence
  Description of Artificial Sequence: Synthetic oligonucleotide
  Target: SCN9A; (+) strand; PAM type: NRG; PAM sequence: GAG
ctccaaagttccaaatgggt

SEQ ID NO: 47406 - DNA, 20 bp, Artificial Sequence
  Description of Artificial Sequence: Synthetic oligonucleotide
  Target: SCN9A; (+) strand; PAM type: NRG; PAM sequence: AAG
tactattacctatactgttt

SEQ ID NO: 47407 - DNA, 20 bp, Artificial Sequence
  Description of Artificial Sequence: Synthetic oligonucleotide
  Target: SCN9A; (+) strand; PAM type: NRG; PAM sequence: AAG
attacctatactgtttaaga

SEQ ID NO: 47408 - DNA, 20 bp, Artificial Sequence
  Description of Artificial Sequence: Synthetic oligonucleotide
  Target: SCN9A; (+) strand; PAM type: NRG; PAM sequence: AAG
acctatactgtttaagaaag

SEQ ID NO: 47409 - DNA, 20 bp, Artificial Sequence
  Description of Artificial Sequence: Synthetic oligonucleotide
  Target: SCN9A; (+) strand; PAM type: NRG; PAM sequence: GAG
ctatactgtttaagaaagaa

SEQ ID NO: 47410 - DNA, 20 bp, Artificial Sequence
  Description of Artificial Sequence: Synthetic oligonucleotide
  Target: SCN9A; (+) strand; PAM type: NRG; PAM sequence: TAG
gtttaagaaagaagagaaac

SEQ ID NO: 47411 - DNA, 20 bp, Artificial Sequence
  Description of Artificial Sequence: Synthetic oligonucleotide
  Target: SCN9A; (+) strand; PAM type: NRG; PAM sequence: AAG
gaaagaagagaaactagtct

SEQ ID NO: 47412 - DNA, 20 bp, Artificial Sequence
  Description of Artificial Sequence: Synthetic oligonucleotide
  Target: SCN9A; (+) strand; PAM type: NRG; PAM sequence: TAG
aagagaaactagtctaagat

SEQ ID NO: 47413 - DNA, 20 bp, Artificial Sequence
  Description of Artificial Sequence: Synthetic oligonucleotide
  Target: SCN9A; (+) strand; PAM type: NRG; PAM sequence: AAG
agattagtttttaaccaatg

SEQ ID NO: 47414 - DNA, 20 bp, Artificial Sequence
  Description of Artificial Sequence: Synthetic oligonucleotide
  Target: SCN9A; (+) strand; PAM type: NRG; PAM sequence: CAG
caatgaagcattacaaaaca

SEQ ID NO: 47415 - DNA, 20 bp, Artificial Sequence
  Description of Artificial Sequence: Synthetic oligonucleotide
  Target: SCN9A; (+) strand; PAM type: NRG; PAM sequence: AAG
cagactaaatacaaatataa

SEQ ID NO: 47416 - DNA, 20 bp, Artificial Sequence
  Description of Artificial Sequence: Synthetic oligonucleotide
  Target: SCN9A; (+) strand; PAM type: NRG; PAM sequence: TAG
caaatataaaagttattcta

SEQ ID NO: 47417 - DNA, 20 bp, Artificial Sequence
  Description of Artificial Sequence: Synthetic oligonucleotide
  Target: SCN9A; (+) strand; PAM type: NRG; PAM sequence: TGG
aagttattctatagtgtgaa

SEQ ID NO: 47418 - DNA, 20 bp, Artificial Sequence
  Description of Artificial Sequence: Synthetic oligonucleotide
  Target: SCN9A; (+) strand; PAM type: NRG; PAM sequence: TGG
tggtctctttatttctacaa

SEQ ID NO: 47419 - DNA, 20 bp, Artificial Sequence
  Description of Artificial Sequence: Synthetic oligonucleotide
  Target: SCN9A; (+) strand; PAM type: NRG; PAM sequence: CAG
tttatttctacaatggttct

SEQ ID NO: 47420 - DNA, 20 bp, Artificial Sequence
  Description of Artificial Sequence: Synthetic oligonucleotide
  Target: SCN9A; (+) strand; PAM type: NRG; PAM sequence: AGG
ttatttctacaatggttctc

SEQ ID NO: 47421 - DNA, 20 bp, Artificial Sequence
  Description of Artificial Sequence: Synthetic oligonucleotide
  Target: SCN9A; (+) strand; PAM type: NRG; PAM sequence: TAG
aacattttgcttctgaaaat

SEQ ID NO: 47422 - DNA, 20 bp, Artificial Sequence
  Description of Artificial Sequence: Synthetic oligonucleotide
  Target: SCN9A; (+) strand; PAM type: NRG; PAM sequence: TAG
gcttctgaaaattagtttat

SEQ ID NO: 47423 - DNA, 20 bp, Artificial Sequence
  Description of Artificial Sequence: Synthetic oligonucleotide
  Target: SCN9A; (+) strand; PAM type: NRG; PAM sequence: GAG
ttctgaaaattagtttatta

SEQ ID NO: 47424 - DNA, 20 bp, Artificial Sequence
  Description of Artificial Sequence: Synthetic oligonucleotide
  Target: SCN9A; (+) strand; PAM type: NRG; PAM sequence: AAG
attgacaattctgaaactat

SEQ ID NO: 47425 - DNA, 20 bp, Artificial Sequence
  Description of Artificial Sequence: Synthetic oligonucleotide
  Target: SCN9A; (+) strand; PAM type: NRG; PAM sequence: AGG
ttgacaattctgaaactata

SEQ ID NO: 47426 - DNA, 20 bp, Artificial Sequence
  Description of Artificial Sequence: Synthetic oligonucleotide
  Target: SCN9A; (+) strand; PAM type: NRG; PAM sequence: TGG
caaaaatgattgaacccaaa

SEQ ID NO: 47427 - DNA, 20 bp, Artificial Sequence
  Description of Artificial Sequence: Synthetic oligonucleotide
  Target: SCN9A; (+) strand; PAM type: NRG; PAM sequence: TAG
tacatctttccataaatgcc

SEQ ID NO: 47428 - DNA, 20 bp, Artificial Sequence
  Description of Artificial Sequence: Synthetic oligonucleotide
  Target: SCN9A; (+) strand; PAM type: NRG; PAM sequence: TAG
ccataaatgcctagcgatac

SEQ ID NO: 47429 - DNA, 20 bp, Artificial Sequence
  Description of Artificial Sequence: Synthetic oligonucleotide
  Target: SCN9A; (+) strand; PAM type: NRG; PAM sequence: AGG
cataaatgcctagcgatact

SEQ ID NO: 47430 - DNA, 20 bp, Artificial Sequence
  Description of Artificial Sequence: Synthetic oligonucleotide
  Target: SCN9A; (+) strand; PAM type: NRG; PAM sequence: GAG
atcactcactatcctctccc

SEQ ID NO: 47431 - DNA, 20 bp, Artificial Sequence
  Description of Artificial Sequence: Synthetic oligonucleotide
  Target: SCN9A; (+) strand; PAM type: NRG; PAM sequence: AAG
gagttctcttaccctaaaat

SEQ ID NO: 47432 - DNA, 20 bp, Artificial Sequence
  Description of Artificial Sequence: Synthetic oligonucleotide
  Target: SCN9A; (+) strand; PAM type: NRG; PAM sequence: TAG
taaaataagacatttttctc

SEQ ID NO: 47433 - DNA, 20 bp, Artificial Sequence
  Description of Artificial Sequence: Synthetic oligonucleotide
  Target: SCN9A; (+) strand; PAM type: NRG; PAM sequence: CGG
ttttctctagcattctgcct

SEQ ID NO: 47434 - DNA, 20 bp, Artificial Sequence
  Description of Artificial Sequence: Synthetic oligonucleotide
  Target: SCN9A; (+) strand; PAM type: NRG; PAM sequence: GGG
tttctctagcattctgcctc

SEQ ID NO: 47435 - DNA, 20 bp, Artificial Sequence
  Description of Artificial Sequence: Synthetic oligonucleotide
  Target: SCN9A; (+) strand; PAM type: NRG; PAM sequence: TAG
tgcctcgggtgatacacatt

SEQ ID NO: 47436 - DNA, 20 bp, Artificial Sequence
  Description of Artificial Sequence: Synthetic oligonucleotide
  Target: SCN9A; (+) strand; PAM type: NRG; PAM sequence: TGG
gtgatacacatttagcaatt

SEQ ID NO: 47437 - DNA, 20 bp, Artificial Sequence
  Description of Artificial Sequence: Synthetic oligonucleotide
  Target: SCN9A; (+) strand; PAM type: NRG; PAM sequence: GGG
tgatacacatttagcaattt

SEQ ID NO: 47438 - DNA, 20 bp, Artificial Sequence
  Description of Artificial Sequence: Synthetic oligonucleotide
  Target: SCN9A; (+) strand; PAM type: NRG; PAM sequence: TGG
tacacatttagcaatttggg

SEQ ID NO: 47439 - DNA, 20 bp, Artificial Sequence
  Description of Artificial Sequence: Synthetic oligonucleotide
  Target: SCN9A; (+) strand; PAM type: NRG; PAM sequence: TGG
caatttgggtggtacctgat

SEQ ID NO: 47440 - DNA, 20 bp, Artificial Sequence
  Description of Artificial Sequence: Synthetic oligonucleotide
  Target: SCN9A; (+) strand; PAM type: NRG; PAM sequence: GGG
aatttgggtggtacctgatt

SEQ ID NO: 47441 - DNA, 20 bp, Artificial Sequence
  Description of Artificial Sequence: Synthetic oligonucleotide
  Target: SCN9A; (+) strand; PAM type: NRG; PAM sequence: GGG
atttgggtggtacctgattg

SEQ ID NO: 47442 - DNA, 20 bp, Artificial Sequence
  Description of Artificial Sequence: Synthetic oligonucleotide
  Target: SCN9A; (+) strand; PAM type: NRG; PAM sequence: GGG
tttgggtggtacctgattgg

SEQ ID NO: 47443 - DNA, 20 bp, Artificial Sequence
  Description of Artificial Sequence: Synthetic oligonucleotide
  Target: SCN9A; (+) strand; PAM type: NRG; PAM sequence: TAG
gggtggtacctgattggggg

SEQ ID NO: 47444 - DNA, 20 bp, Artificial Sequence
  Description of Artificial Sequence: Synthetic oligonucleotide
  Target: SCN9A; (+) strand; PAM type: NRG; PAM sequence: AAG
cgcctatgcccttcgacacc

SEQ ID NO: 47445 - DNA, 20 bp, Artificial Sequence
  Description of Artificial Sequence: Synthetic oligonucleotide
  Target: SCN9A; (+) strand; PAM type: NRG; PAM sequence: AGG
gcctatgcccttcgacacca

SEQ ID NO: 47446 - DNA, 20 bp, Artificial Sequence
  Description of Artificial Sequence: Synthetic oligonucleotide
  Target: SCN9A; (+) strand; PAM type: NRG; PAM sequence: TGG
tatgcccttcgacaccaagg

SEQ ID NO: 47447 - DNA, 20 bp, Artificial Sequence
  Description of Artificial Sequence: Synthetic oligonucleotide
  Target: SCN9A; (+) strand; PAM type: NRG; PAM sequence: CAG
ttctgatttcgacaatttct

SEQ ID NO: 47448 - DNA, 20 bp, Artificial Sequence
  Description of Artificial Sequence: Synthetic oligonucleotide
  Target: SCN9A; (+) strand; PAM type: NRG; PAM sequence: TGG
atctcccttttcctctccac

SEQ ID NO: 47449 - DNA, 20 bp, Artificial Sequence
  Description of Artificial Sequence: Synthetic oligonucleotide
  Target: SCN9A; (+) strand; PAM type: NRG; PAM sequence: GAG
ctcccttttcctctccactg

SEQ ID NO: 47450 - DNA, 20 bp, Artificial Sequence
  Description of Artificial Sequence: Synthetic oligonucleotide
  Target: SCN9A; (+) strand; PAM type: NRG; PAM sequence: GAG
cccttttcctctccactgga

SEQ ID NO: 47451 - DNA, 20 bp, Artificial Sequence
  Description of Artificial Sequence: Synthetic oligonucleotide
  Target: SCN9A; (+) strand; PAM type: NRG; PAM sequence: TAG
tcttctgtttcttctttctt

SEQ ID NO: 47452 - DNA, 20 bp, Artificial Sequence
  Description of Artificial Sequence: Synthetic oligonucleotide
  Target: SCN9A; (+) strand; PAM type: NRG; PAM sequence: TAG
tcttctttctttagcacttt

SEQ ID NO: 47453 - DNA, 20 bp, Artificial Sequence
  Description of Artificial Sequence: Synthetic oligonucleotide
  Target: SCN9A; (+) strand; PAM type: NRG; PAM sequence: GAG
ttctttctttagcactttta

SEQ ID NO: 47454 - DNA, 20 bp, Artificial Sequence
  Description of Artificial Sequence: Synthetic oligonucleotide
  Target: SCN9A; (+) strand; PAM type: NRG; PAM sequence: CAG
tctttagcacttttagagct

SEQ ID NO: 47455 - DNA, 20 bp, Artificial Sequence
  Description of Artificial Sequence: Synthetic oligonucleotide
  Target: SCN9A; (+) strand; PAM type: NRG; PAM sequence: TGG
agcacttttagagctcagtt

SEQ ID NO: 47456 - DNA, 20 bp, Artificial Sequence
  Description of Artificial Sequence: Synthetic oligonucleotide
  Target: SCN9A; (+) strand; PAM type: NRG; PAM sequence: CAG
agagctcagtttggatgttt

SEQ ID NO: 47457 - DNA, 20 bp, Artificial Sequence
  Description of Artificial Sequence: Synthetic oligonucleotide
  Target: SCN9A; (+) strand; PAM type: NRG; PAM sequence: AAG
gctcagtttggatgtttcag

SEQ ID NO: 47458 - DNA, 20 bp, Artificial Sequence
  Description of Artificial Sequence: Synthetic oligonucleotide
  Target: SCN9A; (+) strand; PAM type: NRG; PAM sequence: GAG
atgtttcagaagaactctct

SEQ ID NO: 47459 - DNA, 20 bp, Artificial Sequence
  Description of Artificial Sequence: Synthetic oligonucleotide
  Target: SCN9A; (+) strand; PAM type: NRG; PAM sequence: GAG
gtttcagaagaactctctga

SEQ ID NO: 47460 - DNA, 20 bp, Artificial Sequence
  Description of Artificial Sequence: Synthetic oligonucleotide
  Target: SCN9A; (+) strand; PAM type: NRG; PAM sequence: AGG
tttcagaagaactctctgag

SEQ ID NO: 47461 - DNA, 20 bp, Artificial Sequence
  Description of Artificial Sequence: Synthetic oligonucleotide
  Target: SCN9A; (+) strand; PAM type: NRG; PAM sequence: CAG
tctcctaatacttgtatatt

SEQ ID NO: 47462 - DNA, 20 bp, Artificial Sequence
  Description of Artificial Sequence: Synthetic oligonucleotide
  Target: SCN9A; (+) strand; PAM type: NRG; PAM sequence: TGG
ccgctgccgctgcaattgcc

SEQ ID NO: 47463 - DNA, 20 bp, Artificial Sequence
  Description of Artificial Sequence: Synthetic oligonucleotide
  Target: SCN9A; (+) strand; PAM type: NRG; PAM sequence: TGG
tgccgctgcaattgcctggt

SEQ ID NO: 47464 - DNA, 20 bp, Artificial Sequence
  Description of Artificial Sequence: Synthetic oligonucleotide
  Target: SCN9A; (+) strand; PAM type: NRG; PAM sequence: GGG
gccgctgcaattgcctggtt

SEQ ID NO: 47465 - DNA, 20 bp, Artificial Sequence
  Description of Artificial Sequence: Synthetic oligonucleotide
  Target: SCN9A; (+) strand; PAM type: NRG; PAM sequence: AAG
tgcaattgcctggttgggcc

SEQ ID NO: 47466 - DNA, 20 bp, Artificial Sequence
  Description of Artificial Sequence: Synthetic oligonucleotide
  Target: SCN9A; (+) strand; PAM type: NRG; PAM sequence: GAG
caagacgttaacacttaaat

SEQ ID NO: 47467 - DNA, 20 bp, Artificial Sequence
  Description of Artificial Sequence: Synthetic oligonucleotide
  Target: SCN9A; (+) strand; PAM type: NRG; PAM sequence: TAG
aatgagtcatttccaaatcc

SEQ ID NO: 47468 - DNA, 20 bp, Artificial Sequence
  Description of Artificial Sequence: Synthetic oligonucleotide
  Target: SCN9A; (+) strand; PAM type: NRG; PAM sequence: AGG
atgagtcatttccaaatcct

SEQ ID NO: 47469 - DNA, 20 bp, Artificial Sequence
  Description of Artificial Sequence: Synthetic oligonucleotide
  Target: SCN9A; (+) strand; PAM type: NRG; PAM sequence: TAG
ttccaaatcctaggaaaccc

SEQ ID NO: 47470 - DNA, 20 bp, Artificial Sequence
  Description of Artificial Sequence: Synthetic oligonucleotide
  Target: SCN9A; (+) strand; PAM type: NRG; PAM sequence: AGG
tccaaatcctaggaaaccct

SEQ ID NO: 47471 - DNA, 20 bp, Artificial Sequence
  Description of Artificial Sequence: Synthetic oligonucleotide
  Target: SCN9A; (+) strand; PAM type: NRG; PAM sequence: CAG
aatcctaggaaaccctagga

SEQ ID NO: 47472 - DNA, 20 bp, Artificial Sequence
  Description of Artificial Sequence: Synthetic oligonucleotide
  Target: SCN9A; (+) strand; PAM type: NRG; PAM sequence: AGG
atcctaggaaaccctaggac

SEQ ID NO: 47473 - DNA, 20 bp, Artificial Sequence
  Description of Artificial Sequence: Synthetic oligonucleotide
  Target: SCN9A; (+) strand; PAM type: NRG; PAM sequence: TAG
acaggacatctttcacctat

SEQ ID NO: 47474 - DNA, 20 bp, Artificial Sequence
  Description of Artificial Sequence: Synthetic oligonucleotide
  Target: SCN9A; (+) strand; PAM type: NRG; PAM sequence: TGG
cacctattagcataacaaca

SEQ ID NO: 47475 - DNA, 20 bp, Artificial Sequence
  Description of Artificial Sequence: Synthetic oligonucleotide
  Target: SCN9A; (+) strand; PAM type: NRG; PAM sequence: CAG
cgttttctttacacaatgat

SEQ ID NO: 47476 - DNA, 20 bp, Artificial Sequence
  Description of Artificial Sequence: Synthetic oligonucleotide
  Target: SCN9A; (+) strand; PAM type: NRG; PAM sequence: AAG
caatgatcagaatgcttaca

SEQ ID NO: 47477 - DNA, 20 bp, Artificial Sequence
  Description of Artificial Sequence: Synthetic oligonucleotide
  Target: SCN9A; (+) strand; PAM type: NRG; PAM sequence: TGG
atgcttacaaagtatatatt

SEQ ID NO: 47478 - DNA, 20 bp, Artificial Sequence
  Description of Artificial Sequence: Synthetic oligonucleotide
  Target: SCN9A; (+) strand; PAM type: NRG; PAM sequence: CAG
tatatatttggtttttgtct

SEQ ID NO: 47479 - DNA, 20 bp, Artificial Sequence
  Description of Artificial Sequence: Synthetic oligonucleotide
  Target: SCN9A; (+) strand; PAM type: NRG; PAM sequence: AGG
atatatttggtttttgtctc

SEQ ID NO: 47480 - DNA, 20 bp, Artificial Sequence
  Description of Artificial Sequence: Synthetic oligonucleotide
  Target: SCN9A; (+) strand; PAM type: NRG; PAM sequence: AAG
ttttgtctcaggttgaaata

SEQ ID NO: 47481 - DNA, 20 bp, Artificial Sequence
  Description of Artificial Sequence: Synthetic oligonucleotide
  Target: SCN9A; (+) strand; PAM type: NRG; PAM sequence: TAG
aataaagctctattgtattt

SEQ ID NO: 47482 - DNA, 20 bp, Artificial Sequence
  Description of Artificial Sequence: Synthetic oligonucleotide
  Target: SCN9A; (+) strand; PAM type: NRG; PAM sequence: CAG
acatgttattaatttgctta

SEQ ID NO: 47483 - DNA, 20 bp, Artificial Sequence
  Description of Artificial Sequence: Synthetic oligonucleotide
  Target: SCN9A; (+) strand; PAM type: NRG; PAM sequence: AAG
ttattaatttgcttacagta

SEQ ID NO: 47484 - DNA, 20 bp, Artificial Sequence
  Description of Artificial Sequence: Synthetic oligonucleotide
  Target: SCN9A; (+) strand; PAM type: NRG; PAM sequence: AAG
aaattaaatattatatgtta

SEQ ID NO: 47485 - DNA, 20 bp, Artificial Sequence
  Description of Artificial Sequence: Synthetic oligonucleotide
  Target: SCN9A; (+) strand; PAM type: NRG; PAM sequence: AAG
attatatgttaaagttttac

SEQ ID NO: 47486 - DNA, 20 bp, Artificial Sequence
  Description of Artificial Sequence: Synthetic oligonucleotide
  Target: SCN9A; (+) strand; PAM type: NRG; PAM sequence: AGG
ttatatgttaaagttttaca

SEQ ID NO: 47487 - DNA, 20 bp, Artificial Sequence
  Description of Artificial Sequence: Synthetic oligonucleotide
  Target: SCN9A; (+) strand; PAM type: NRG; PAM sequence: TGG
aaagttttacaaggtaattt

SEQ ID NO: 47488 - DNA, 20 bp, Artificial Sequence
  Description of Artificial Sequence: Synthetic oligonucleotide
  Target: SCN9A; (+) strand; PAM type: NRG; PAM sequence: AAG
actcgcataaaccatgcaat

SEQ ID NO: 47489 - DNA, 20 bp, Artificial Sequence
  Description of Artificial Sequence: Synthetic oligonucleotide
  Target: SCN9A; (+) strand; PAM type: NRG; PAM sequence: CAG
gcataaaccatgcaataaga

SEQ ID NO: 47490 - DNA, 20 bp, Artificial Sequence
  Description of Artificial Sequence: Synthetic oligonucleotide
  Target: SCN9A; (+) strand; PAM type: NRG; PAM sequence: CAG
aagacagacaatttgattat

SEQ ID NO: 47491 - DNA, 20 bp, Artificial Sequence
  Description of Artificial Sequence: Synthetic oligonucleotide
  Target: SCN9A; (+) strand; PAM type: NRG; PAM sequence: AGG
agacagacaatttgattatc

SEQ ID NO: 47492 - DNA, 20 bp, Artificial Sequence
  Description of Artificial Sequence: Synthetic oligonucleotide
  Target: SCN9A; (+) strand; PAM type: NRG; PAM sequence: TAG
aattaactccatatcatcaa

SEQ ID NO: 47493 - DNA, 20 bp, Artificial Sequence
  Description of Artificial Sequence: Synthetic oligonucleotide
  Target: SCN9A; (+) strand; PAM type: NRG; PAM sequence: CAG
ctccatatcatcaatagaat

SEQ ID NO: 47494 - DNA, 20 bp, Artificial Sequence
  Description of Artificial Sequence: Synthetic oligonucleotide
  Target: SCN9A; (+) strand; PAM type: NRG; PAM sequence: AGG
tccatatcatcaatagaatc

SEQ ID NO: 47495 - DNA, 20 bp, Artificial Sequence
  Description of Artificial Sequence: Synthetic oligonucleotide
  Target: SCN9A; (+) strand; PAM type: NRG; PAM sequence: TGG
caatagaatcaggcactcta

SEQ ID NO: 47496 - DNA, 20 bp, Artificial Sequence
  Description of Artificial Sequence: Synthetic oligonucleotide
  Target: SCN9A; (+) strand; PAM type: NRG; PAM sequence: AAG
aggcactctatggtttaata

SEQ ID NO: 47497 - DNA, 20 bp, Artificial Sequence
  Description of Artificial Sequence: Synthetic oligonucleotide
  Target: SCN9A; (+) strand; PAM type: NRG; PAM sequence: GAG
tctatggtttaataaagatt

SEQ ID NO: 47498 - DNA, 20 bp, Artificial Sequence
  Description of Artificial Sequence: Synthetic oligonucleotide
  Target: SCN9A; (+) strand; PAM type: NRG; PAM sequence: AAG
gaaaaataaatgaattatta

SEQ ID NO: 47499 - DNA, 20 bp, Artificial Sequence
  Description of Artificial Sequence: Synthetic oligonucleotide
  Target: SCN9A; (+) strand; PAM type: NRG; PAM sequence: AAG
ttattaaagcataatattgt

SEQ ID NO: 47500 - DNA, 20 bp, Artificial Sequence
  Description of Artificial Sequence: Synthetic oligonucleotide
  Target: SCN9A; (+) strand; PAM type: NRG; PAM sequence: AAG
taaagcataatattgtaaga

SEQ ID NO: 47501 - DNA, 20 bp, Artificial Sequence
  Description of Artificial Sequence: Synthetic oligonucleotide
  Target: SCN9A; (+) strand; PAM type: NRG; PAM sequence: TGG
agcataatattgtaagaaag

SEQ ID NO: 47502 - DNA, 20 bp, Artificial Sequence
  Description of Artificial Sequence: Synthetic oligonucleotide
  Target: SCN9A; (+) strand; PAM type: NRG; PAM sequence: AAG
taatattgtaagaaagtggt

SEQ ID NO: 47503 - DNA, 20 bp, Artificial Sequence
  Description of Artificial Sequence: Synthetic oligonucleotide
  Target: SCN9A; (+) strand; PAM type: NRG; PAM sequence: AGG
aatattgtaagaaagtggta

SEQ ID NO: 47504 - DNA, 20 bp, Artificial Sequence
  Description of Artificial Sequence: Synthetic oligonucleotide
  Target: SCN9A; (+) strand; PAM type: NRG; PAM sequence: TGG
gtggtaaggtcaatgactat

SEQ ID NO: 47505 - DNA, 20 bp, Artificial Sequence
  Description of Artificial Sequence: Synthetic oligonucleotide
  Target: SCN9A; (+) strand; PAM type: NRG; PAM sequence: TGG
attggcctaaatgaaacttc

SEQ ID NO: 47506 - DNA, 20 bp, Artificial Sequence
  Description of Artificial Sequence: Synthetic oligonucleotide
  Target: SCN9A; (+) strand; PAM type: NRG; PAM sequence: GGG
ttggcctaaatgaaacttct

SEQ ID NO: 47507 - DNA, 20 bp, Artificial Sequence
  Description of Artificial Sequence: Synthetic oligonucleotide
  Target: SCN9A; (+) strand; PAM type: NRG; PAM sequence: TAG
tgaaacttctgggaattccc

SEQ ID NO: 47508 - DNA, 20 bp, Artificial Sequence
  Description of Artificial Sequence: Synthetic oligonucleotide
  Target: SCN9A; (+) strand; PAM type: NRG; PAM sequence: AGG
gaaacttctgggaattccct

SEQ ID NO: 47509 - DNA, 20 bp, Artificial Sequence
  Description of Artificial Sequence: Synthetic oligonucleotide
  Target: SCN9A; (+) strand; PAM type: NRG; PAM sequence: TAG
acttctgggaattccctagg

SEQ ID NO: 47510 - DNA, 20 bp, Artificial Sequence
  Description of Artificial Sequence: Synthetic oligonucleotide
  Target: SCN9A; (+) strand; PAM type: NRG; PAM sequence: TGG
ggaattccctaggtagtacc

SEQ ID NO: 47511 - DNA, 20 bp, Artificial Sequence
  Description of Artificial Sequence: Synthetic oligonucleotide
  Target: SCN9A; (+) strand; PAM type: NRG; PAM sequence: GGG
gaattccctaggtagtacct

SEQ ID NO: 47512 - DNA, 20 bp, Artificial Sequence
  Description of Artificial Sequence: Synthetic oligonucleotide
  Target: SCN9A; (+) strand; PAM type: NRG; PAM sequence: TAG
aggtagtacctgggataacc

SEQ ID NO: 47513 - DNA, 20 bp, Artificial Sequence
  Description of Artificial Sequence: Synthetic oligonucleotide
  Target: SCN9A; (+) strand; PAM type: NRG; PAM sequence: TGG
aaaaaattcttgtaaaaaca

SEQ ID NO: 47514 - DNA, 20 bp, Artificial Sequence
  Description of Artificial Sequence: Synthetic oligonucleotide
  Target: SCN9A; (+) strand; PAM type: NRG; PAM sequence: GGG
aaaaattcttgtaaaaacat

SEQ ID NO: 47515 - DNA, 20 bp, Artificial Sequence
  Description of Artificial Sequence: Synthetic oligonucleotide
  Target: SCN9A; (+) strand; PAM type: NRG; PAM sequence: AAG
ttgtaaaaacatgggaaata

SEQ ID NO: 47516 - DNA, 20 bp, Artificial Sequence
  Description of Artificial Sequence: Synthetic oligonucleotide
  Target: SCN9A; (+) strand; PAM type: NRG; PAM sequence: CAG
ataaagatataaatgaaaaa

SEQ ID NO: 47517 - DNA, 20 bp, Artificial Sequence
  Description of Artificial Sequence: Synthetic oligonucleotide
  Target: SCN9A; (+) strand; PAM type: NRG; PAM sequence: AAG
ataaatgaaaaacagaaaaa

SEQ ID NO: 47518 - DNA, 20 bp, Artificial Sequence
  Description of Artificial Sequence: Synthetic oligonucleotide
  Target: SCN9A; (+) strand; PAM type: NRG; PAM sequence: CAG
aaaaaagtcatcttacctcc

SEQ ID NO: 47519 - DNA, 20 bp, Artificial Sequence
  Description of Artificial Sequence: Synthetic oligonucleotide
  Target: SCN9A; (+) strand; PAM type: NRG; PAM sequence: TGG
tcttacctcccagaaataat

SEQ ID NO: 47520 - DNA, 20 bp, Artificial Sequence
  Description of Artificial Sequence: Synthetic oligonucleotide
  Target: SCN9A; (+) strand; PAM type: NRG; PAM sequence: GAG
gtatgtataattttaaaatt

SEQ ID NO: 47521 - DNA, 20 bp, Artificial Sequence
  Description of Artificial Sequence: Synthetic oligonucleotide
  Target: SCN9A; (+) strand; PAM type: NRG; PAM sequence: CGG
ttttaaaattgagattgtat

SEQ ID NO: 47522 - DNA, 20 bp, Artificial Sequence
  Description of Artificial Sequence: Synthetic oligonucleotide
  Target: SCN9A; (+) strand; PAM type: NRG; PAM sequence: AAG
ttaatccatcattattctaa

SEQ ID NO: 47523 - DNA, 20 bp, Artificial Sequence
  Description of Artificial Sequence: Synthetic oligonucleotide
  Target: SCN9A; (+) strand; PAM type: NRG; PAM sequence: TAG
aataattttaaaaaaacaca

SEQ ID NO: 47524 - DNA, 20 bp, Artificial Sequence
  Description of Artificial Sequence: Synthetic oligonucleotide
  Target: SCN9A; (+) strand; PAM type: NRG; PAM sequence: TGG
taaaaaaacacatagttcta

SEQ ID NO: 47525 - DNA, 20 bp, Artificial Sequence
  Description of Artificial Sequence: Synthetic oligonucleotide
  Target: SCN9A; (+) strand; PAM type: NRG; PAM sequence: AAG
ctatggcaaaataatacttt

SEQ ID NO: 47526 - DNA, 20 bp, Artificial Sequence
  Description of Artificial Sequence: Synthetic oligonucleotide
  Target: SCN9A; (+) strand; PAM type: NRG; PAM sequence: TAG
tacaattttcataattttct

SEQ ID NO: 47527 - DNA, 20 bp, Artificial Sequence
  Description of Artificial Sequence: Synthetic oligonucleotide
  Target: SCN9A; (+) strand; PAM type: NRG; PAM sequence: CAG
tgcactgaatatttgtgcat

SEQ ID NO: 47528 - DNA, 20 bp, Artificial Sequence
  Description of Artificial Sequence: Synthetic oligonucleotide
  Target: SCN9A; (+) strand; PAM type: NRG; PAM sequence: CAG
atcagaatttatctgcattg

SEQ ID NO: 47529 - DNA, 20 bp, Artificial Sequence
  Description of Artificial Sequence: Synthetic oligonucleotide
  Target: SCN9A; (+) strand; PAM type: NRG; PAM sequence: TAG
attgccctcccctaatacat

SEQ ID NO: 47530 - DNA, 20 bp, Artificial Sequence
  Description of Artificial Sequence: Synthetic oligonucleotide
  Target: SCN9A; (+) strand; PAM type: NRG; PAM sequence: AAG
ctaatacattagactccttg

SEQ ID NO: 47531 - DNA, 20 bp, Artificial Sequence
  Description of Artificial Sequence: Synthetic oligonucleotide
  Target: SCN9A; (+) strand; PAM type: NRG; PAM sequence: GAG
aatacattagactccttgaa

SEQ ID NO: 47532 - DNA, 20 bp, Artificial Sequence
  Description of Artificial Sequence: Synthetic oligonucleotide
  Target: SCN9A; (+) strand; PAM type: NRG; PAM sequence: TAG
actccttgaagagatttaac

SEQ ID NO: 47533 - DNA, 20 bp, Artificial Sequence
  Description of Artificial Sequence: Synthetic oligonucleotide
  Target: SCN9A; (+) strand; PAM type: NRG; PAM sequence: AGG
ctccttgaagagatttaact

SEQ ID NO: 47534 - DNA, 20 bp, Artificial Sequence
  Description of Artificial Sequence: Synthetic oligonucleotide
  Target: SCN9A; (+) strand; PAM type: NRG; PAM sequence: CAG
atttaactaggtgaaacctt

SEQ ID NO: 47535 - DNA, 20 bp, Artificial Sequence
  Description of Artificial Sequence: Synthetic oligonucleotide
  Target: SCN9A; (+) strand; PAM type: NRG; PAM sequence: AAG
gaaaccttcagacaaatgtt

SEQ ID NO: 47536 - DNA, 20 bp, Artificial Sequence
  Description of Artificial Sequence: Synthetic oligonucleotide
  Target: SCN9A; (+) strand; PAM type: NRG; PAM sequence: AGG
aaaccttcagacaaatgtta

SEQ ID NO: 47537 - DNA, 20 bp, Artificial Sequence
  Description of Artificial Sequence: Synthetic oligonucleotide
  Target: SCN9A; (+) strand; PAM type: NRG; PAM sequence: CAG
gacaaatgttaaggcaactg

SEQ ID NO: 47538 - DNA, 20 bp, Artificial Sequence
  Description of Artificial Sequence: Synthetic oligonucleotide
  Target: SCN9A; (+) strand; PAM type: NRG; PAM sequence: TAG
atttgaaattatgtttctct

SEQ ID NO: 47539 - DNA, 20 bp, Artificial Sequence
  Description of Artificial Sequence: Synthetic oligonucleotide
  Target: SCN9A; (+) strand; PAM type: NRG; PAM sequence: AAG
aattatgtttctcttagtac

SEQ ID NO: 47540 - DNA, 20 bp, Artificial Sequence
  Description of Artificial Sequence: Synthetic oligonucleotide
  Target: SCN9A; (+) strand; PAM type: NRG; PAM sequence: AAG
cttctcaaacatttacactg

SEQ ID NO: 47541 - DNA, 20 bp, Artificial Sequence
  Description of Artificial Sequence: Synthetic oligonucleotide
  Target: SCN9A; (+) strand; PAM type: NRG; PAM sequence: TGG
tttacactgaagaatctctc

SEQ ID NO: 47542 - DNA, 20 bp, Artificial Sequence
  Description of Artificial Sequence: Synthetic oligonucleotide
  Target: SCN9A; (+) strand; PAM type: NRG; PAM sequence: AAG
cactgaagaatctctctgga

SEQ ID NO: 47543 - DNA, 20 bp, Artificial Sequence
  Description of Artificial Sequence: Synthetic oligonucleotide
  Target: SCN9A; (+) strand; PAM type: NRG; PAM sequence: GAG
ctgaagaatctctctggaaa

SEQ ID NO: 47544 - DNA, 20 bp, Artificial Sequence
  Description of Artificial Sequence: Synthetic oligonucleotide
  Target: SCN9A; (+) strand; PAM type: NRG; PAM sequence: AGG
tgaagaatctctctggaaag

SEQ ID NO: 47545 - DNA, 20 bp, Artificial Sequence
  Description of Artificial Sequence: Synthetic oligonucleotide
  Target: SCN9A; (+) strand; PAM type: NRG; PAM sequence: AAG
atctctctggaaagaggatt

SEQ ID NO: 47546 - DNA, 20 bp, Artificial Sequence
  Description of Artificial Sequence: Synthetic oligonucleotide
  Target: SCN9A; (+) strand; PAM type: NRG; PAM sequence: AGG
tctctctggaaagaggatta

SEQ ID NO: 47547 - DNA, 20 bp, Artificial Sequence
  Description of Artificial Sequence: Synthetic oligonucleotide
  Target: SCN9A; (+) strand; PAM type: NRG; PAM sequence: GAG
tctctggaaagaggattaag

SEQ ID NO: 47548 - DNA, 20 bp, Artificial Sequence
  Description of Artificial Sequence: Synthetic oligonucleotide
  Target: SCN9A; (+) strand; PAM type: NRG; PAM sequence: AGG
ctctggaaagaggattaagg

SEQ ID NO: 47549 - DNA, 20 bp, Artificial Sequence
  Description of Artificial Sequence: Synthetic oligonucleotide
  Target: SCN9A; (+) strand; PAM type: NRG; PAM sequence: GAG
ggattaaggaggaaactttc

SEQ ID NO: 47550 - DNA, 20 bp, Artificial Sequence
  Description of Artificial Sequence: Synthetic oligonucleotide
  Target: SCN9A; (+) strand; PAM type: NRG; PAM sequence: TAG
gaatctatgacaacctaaat

SEQ ID NO: 47551 - DNA, 20 bp, Artificial Sequence
  Description of Artificial Sequence: Synthetic oligonucleotide
  Target: SCN9A; (+) strand; PAM type: NRG; PAM sequence: TAG
caaaacatgatgcactgttt

SEQ ID NO: 47552 - DNA, 20 bp, Artificial Sequence
  Description of Artificial Sequence: Synthetic oligonucleotide
  Target: SCN9A; (+) strand; PAM type: NRG; PAM sequence: TAG
actgttttagtcatacccca

SEQ ID NO: 47553 - DNA, 20 bp, Artificial Sequence
  Description of Artificial Sequence: Synthetic oligonucleotide
  Target: SCN9A; (+) strand; PAM type: NRG; PAM sequence: AAG
gttttagtcataccccatag

SEQ ID NO: 47554 - DNA, 20 bp, Artificial Sequence
  Description of Artificial Sequence: Synthetic oligonucleotide
  Target: SCN9A; (+) strand; PAM type: NRG; PAM sequence: GAG
tttagtcataccccatagaa

SEQ ID NO: 47555 - DNA, 20 bp, Artificial Sequence
  Description of Artificial Sequence: Synthetic oligonucleotide
  Target: SCN9A; (+) strand; PAM type: NRG; PAM sequence: TGG
atgaaaccactgtatacaat

SEQ ID NO: 47556 - DNA, 20 bp, Artificial Sequence
  Description of Artificial Sequence: Synthetic oligonucleotide
  Target: SCN9A; (+) strand; PAM type: NRG; PAM sequence: TGG
actgtatacaattggtactc

SEQ ID NO: 47557 - DNA, 20 bp, Artificial Sequence
  Description of Artificial Sequence: Synthetic oligonucleotide
  Target: SCN9A; (+) strand; PAM type: NRG; PAM sequence: GGG
ctgtatacaattggtactct

SEQ ID NO: 47558 - DNA, 20 bp, Artificial Sequence
  Description of Artificial Sequence: Synthetic oligonucleotide
  Target: SCN9A; (+) strand; PAM type: NRG; PAM sequence: GGG
tgtatacaattggtactctg

SEQ ID NO: 47559 - DNA, 20 bp, Artificial Sequence
  Description of Artificial Sequence: Synthetic oligonucleotide
  Target: SCN9A; (+) strand; PAM type: NRG; PAM sequence: GAG
attgtatatatatataaatt

SEQ ID NO: 47560 - DNA, 20 bp, Artificial Sequence
  Description of Artificial Sequence: Synthetic oligonucleotide
  Target: SCN9A; (+) strand; PAM type: NRG; PAM sequence: AAG
tatttaatcaattattctaa

SEQ ID NO: 47561 - DNA, 20 bp, Artificial Sequence
  Description of Artificial Sequence: Synthetic oligonucleotide
  Target: SCN9A; (+) strand; PAM type: NRG; PAM sequence: TAG
taataatttaaaaaaacaca

SEQ ID NO: 47562 - DNA, 20 bp, Artificial Sequence
  Description of Artificial Sequence: Synthetic oligonucleotide
  Target: SCN9A; (+) strand; PAM type: NRG; PAM sequence: TAG
tgtatatgtgtatgtatata

SEQ ID NO: 47563 - DNA, 20 bp, Artificial Sequence
  Description of Artificial Sequence: Synthetic oligonucleotide
  Target: SCN9A; (+) strand; PAM type: NRG; PAM sequence: AAG
gacatacacacacacacact

SEQ ID NO: 47564 - DNA, 20 bp, Artificial Sequence
  Description of Artificial Sequence: Synthetic oligonucleotide
  Target: SCN9A; (+) strand; PAM type: NRG; PAM sequence: TAG
acacacacactaagtcattg

SEQ ID NO: 47565 - DNA, 20 bp, Artificial Sequence
  Description of Artificial Sequence: Synthetic oligonucleotide
  Target: SCN9A; (+) strand; PAM type: NRG; PAM sequence: AGG
cacacacactaagtcattgt

SEQ ID NO: 47566 - DNA, 20 bp, Artificial Sequence
  Description of Artificial Sequence: Synthetic oligonucleotide
  Target: SCN9A; (+) strand; PAM type: NRG; PAM sequence: AAG
cactaagtcattgtaggtaa

SEQ ID NO: 47567 - DNA, 20 bp, Artificial Sequence
  Description of Artificial Sequence: Synthetic oligonucleotide
  Target: SCN9A; (+) strand; PAM type: NRG; PAM sequence: AGG
actaagtcattgtaggtaaa

SEQ ID NO: 47568 - DNA, 20 bp, Artificial Sequence
  Description of Artificial Sequence: Synthetic oligonucleotide
  Target: SCN9A; (+) strand; PAM type: NRG; PAM sequence: AAG
tcattgtaggtaaaaggttt

SEQ ID NO: 47569 - DNA, 20 bp, Artificial Sequence
  Description of Artificial Sequence: Synthetic oligonucleotide
  Target: SCN9A; (+) strand; PAM type: NRG; PAM sequence: GAG
attgtaggtaaaaggtttaa

SEQ ID NO: 47570 - DNA, 20 bp, Artificial Sequence
  Description of Artificial Sequence: Synthetic oligonucleotide
  Target: SCN9A; (+) strand; PAM type: NRG; PAM sequence: AGG
ttgtaggtaaaaggtttaag

SEQ ID NO: 47571 - DNA, 20 bp, Artificial Sequence
  Description of Artificial Sequence: Synthetic oligonucleotide
  Target: SCN9A; (+) strand; PAM type: NRG; PAM sequence: CAG
ggtaaaaggtttaagaggaa

SEQ ID NO: 47572 - DNA, 20 bp, Artificial Sequence
  Description of Artificial Sequence: Synthetic oligonucleotide
  Target: SCN9A; (+) strand; PAM type: NRG; PAM sequence: TAG
aggtttaagaggaacagcct

SEQ ID NO: 47573 - DNA, 20 bp, Artificial Sequence
  Description of Artificial Sequence: Synthetic oligonucleotide
  Target: SCN9A; (+) strand; PAM type: NRG; PAM sequence: CAG
gccttagatcacttttcatg

SEQ ID NO: 47574 - DNA, 20 bp, Artificial Sequence
  Description of Artificial Sequence: Synthetic oligonucleotide
  Target: SCN9A; (+) strand; PAM type: NRG; PAM sequence: GAG
tagatcacttttcatgcagt

SEQ ID NO: 47575 - DNA, 20 bp, Artificial Sequence
  Description of Artificial Sequence: Synthetic oligonucleotide
  Target: SCN9A; (+) strand; PAM type: NRG; PAM sequence: TGG
ttcatgcagtgagatgatta

SEQ ID NO: 47576 - DNA, 20 bp, Artificial Sequence
  Description of Artificial Sequence: Synthetic oligonucleotide
  Target: SCN9A; (+) strand; PAM type: NRG; PAM sequence: GGG
tcatgcagtgagatgattat

SEQ ID NO: 47577 - DNA, 20 bp, Artificial Sequence
  Description of Artificial Sequence: Synthetic oligonucleotide
  Target: SCN9A; (+) strand; PAM type: NRG; PAM sequence: GGG
catgcagtgagatgattatg

SEQ ID NO: 47578 - DNA, 20 bp, Artificial Sequence
  Description of Artificial Sequence: Synthetic oligonucleotide
  Target: SCN9A; (+) strand; PAM type: NRG; PAM sequence: AAG
cagtgagatgattatgggga

SEQ ID NO: 47579 - DNA, 20 bp, Artificial Sequence
  Description of Artificial Sequence: Synthetic oligonucleotide
  Target: SCN9A; (+) strand; PAM type: NRG; PAM sequence: TAG
tatggggaaagtatcaattc

SEQ ID NO: 47580 - DNA, 20 bp, Artificial Sequence
  Description of Artificial Sequence: Synthetic oligonucleotide
  Target: SCN9A; (+) strand; PAM type: NRG; PAM sequence: CAG
ggaaagtatcaattctagct

SEQ ID NO: 47581 - DNA, 20 bp, Artificial Sequence
  Description of Artificial Sequence: Synthetic oligonucleotide
  Target: SCN9A; (+) strand; PAM type: NRG; PAM sequence: CAG
gtatcaattctagctcagcc

SEQ ID NO: 47582 - DNA, 20 bp, Artificial Sequence
  Description of Artificial Sequence: Synthetic oligonucleotide
  Target: SCN9A; (+) strand; PAM type: NRG; PAM sequence: TGG
attctagctcagcccagaat

SEQ ID NO: 47583 - DNA, 20 bp, Artificial Sequence
  Description of Artificial Sequence: Synthetic oligonucleotide
  Target: SCN9A; (+) strand; PAM type: NRG; PAM sequence: CAG
attggttcctttttccacac

SEQ ID NO: 47584 - DNA, 20 bp, Artificial Sequence
  Description of Artificial Sequence: Synthetic oligonucleotide
  Target: SCN9A; (+) strand; PAM type: NRG; PAM sequence: GAG
cctttttccacaccagaaat

SEQ ID NO: 47585 - DNA, 20 bp, Artificial Sequence
  Description of Artificial Sequence: Synthetic oligonucleotide
  Target: SCN9A; (+) strand; PAM type: NRG; PAM sequence: AGG
ctttttccacaccagaaatg

SEQ ID NO: 47586 - DNA, 20 bp, Artificial Sequence
  Description of Artificial Sequence: Synthetic oligonucleotide
  Target: SCN9A; (+) strand; PAM type: NRG; PAM sequence: CAG
ccacaccagaaatgaggata

SEQ ID NO: 47587 - DNA, 20 bp, Artificial Sequence
  Description of Artificial Sequence: Synthetic oligonucleotide
  Target: SCN9A; (+) strand; PAM type: NRG; PAM sequence: AAG
ttatacacaaaaattcatta

SEQ ID NO: 47588 - DNA, 20 bp, Artificial Sequence
  Description of Artificial Sequence: Synthetic oligonucleotide
  Target: SCN9A; (+) strand; PAM type: NRG; PAM sequence: TAG
aaaattcattaaagaaaatc

SEQ ID NO: 47589 - DNA, 20 bp, Artificial Sequence
  Description of Artificial Sequence: Synthetic oligonucleotide
  Target: SCN9A; (+) strand; PAM type: NRG; PAM sequence: TGG
ttcattaaagaaaatctagc

SEQ ID NO: 47590 - DNA, 20 bp, Artificial Sequence
  Description of Artificial Sequence: Synthetic oligonucleotide
  Target: SCN9A; (+) strand; PAM type: NRG; PAM sequence: GAG
cattaaagaaaatctagctg

SEQ ID NO: 47591 - DNA, 20 bp, Artificial Sequence
  Description of Artificial Sequence: Synthetic oligonucleotide
  Target: SCN9A; (+) strand; PAM type: NRG; PAM sequence: AAG
taaagaaaatctagctggag

SEQ ID NO: 47592 - DNA, 20 bp, Artificial Sequence
  Description of Artificial Sequence: Synthetic oligonucleotide
  Target: SCN9A; (+) strand; PAM type: NRG; PAM sequence: AGG
aaagaaaatctagctggaga

SEQ ID NO: 47593 - DNA, 20 bp, Artificial Sequence
  Description of Artificial Sequence: Synthetic oligonucleotide
  Target: SCN9A; (+) strand; PAM type: NRG; PAM sequence: AAG
aaatctagctggagaaggcc

SEQ ID NO: 47594 - DNA, 20 bp, Artificial Sequence
  Description of Artificial Sequence: Synthetic oligonucleotide
  Target: SCN9A; (+) strand; PAM type: NRG; PAM sequence: CAG
agaaggccaagcatataccg

SEQ ID NO: 47595 - DNA, 20 bp, Artificial Sequence
  Description of Artificial Sequence: Synthetic oligonucleotide
  Target: SCN9A; (+) strand; PAM type: NRG; PAM sequence: GAG
aaggccaagcatataccgca

SEQ ID NO: 47596 - DNA, 20 bp, Artificial Sequence
  Description of Artificial Sequence: Synthetic oligonucleotide
  Target: SCN9A; (+) strand; PAM type: NRG; PAM sequence: TAG
accgtttgcatttctacctc

SEQ ID NO: 47597 - DNA, 20 bp, Artificial Sequence
  Description of Artificial Sequence: Synthetic oligonucleotide
  Target: SCN9A; (+) strand; PAM type: NRG; PAM sequence: AGG
ccgtttgcatttctacctct

SEQ ID NO: 47598 - DNA, 20 bp, Artificial Sequence
  Description of Artificial Sequence: Synthetic oligonucleotide
  Target: SCN9A; (+) strand; PAM type: NRG; PAM sequence: AAG
tttgcatttctacctctagg

SEQ ID NO: 47599 - DNA, 20 bp, Artificial Sequence
  Description of Artificial Sequence: Synthetic oligonucleotide
  Target: SCN9A; (+) strand; PAM type: NRG; PAM sequence: CAG
aagaattttaaatcaaataa

SEQ ID NO: 47600 - DNA, 20 bp, Artificial Sequence
  Description of Artificial Sequence: Synthetic oligonucleotide
  Target: SCN9A; (+) strand; PAM type: NRG; PAM sequence: CAG
taaatcaaataacagtacct

SEQ ID NO: 47601 - DNA, 20 bp, Artificial Sequence
  Description of Artificial Sequence: Synthetic oligonucleotide
  Target: SCN9A; (+) strand; PAM type: NRG; PAM sequence: AAG
gcttcttcttgctctttttt

SEQ ID NO: 47602 - DNA, 20 bp, Artificial Sequence
  Description of Artificial Sequence: Synthetic oligonucleotide
  Target: SCN9A; (+) strand; PAM type: NRG; PAM sequence: CGG
cttcttgctcttttttaaga

SEQ ID NO: 47603 - DNA, 20 bp, Artificial Sequence
  Description of Artificial Sequence: Synthetic oligonucleotide
  Target: SCN9A; (+) strand; PAM type: NRG; PAM sequence: TAG
aaattctaattctttctgtt

SEQ ID NO: 47604 - DNA, 20 bp, Artificial Sequence
  Description of Artificial Sequence: Synthetic oligonucleotide
  Target: SCN9A; (+) strand; PAM type: NRG; PAM sequence: TGG
tagcttcttcaatgtttgcc

SEQ ID NO: 47605 - DNA, 20 bp, Artificial Sequence
  Description of Artificial Sequence: Synthetic oligonucleotide
  Target: SCN9A; (+) strand; PAM type: NRG; PAM sequence: TGG
gttctgttcttcatatgcca

SEQ ID NO: 47606 - DNA, 20 bp, Artificial Sequence
  Description of Artificial Sequence: Synthetic oligonucleotide
  Target: SCN9A; (+) strand; PAM type: NRG; PAM sequence: CAG
ttcatatgccatggcaacca

SEQ ID NO: 47607 - DNA, 20 bp, Artificial Sequence
  Description of Artificial Sequence: Synthetic oligonucleotide
  Target: SCN9A; (+) strand; PAM type: NRG; PAM sequence: CAG
tatgccatggcaaccacagc

SEQ ID NO: 47608 - DNA, 20 bp, Artificial Sequence
  Description of Artificial Sequence: Synthetic oligonucleotide
  Target: SCN9A; (+) strand; PAM type: NRG; PAM sequence: AGG
atgccatggcaaccacagcc

SEQ ID NO: 47609 - DNA, 20 bp, Artificial Sequence
  Description of Artificial Sequence: Synthetic oligonucleotide
  Target: SCN9A; (+) strand; PAM type: NRG; PAM sequence: AAG
tggcaaccacagccaggatc

SEQ ID NO: 47610 - DNA, 20 bp, Artificial Sequence
  Description of Artificial Sequence: Synthetic oligonucleotide
  Target: SCN9A; (+) strand; PAM type: NRG; PAM sequence: TAG
acagccaggatcaagtttat

SEQ ID NO: 47611 - DNA, 20 bp, Artificial Sequence
  Description of Artificial Sequence: Synthetic oligonucleotide
  Target: SCN9A; (+) strand; PAM type: NRG; PAM sequence: AAG
ggatcaagtttattagataa

SEQ ID NO: 47612 - DNA, 20 bp, Artificial Sequence
  Description of Artificial Sequence: Synthetic oligonucleotide
  Target: SCN9A; (+) strand; PAM type: NRG; PAM sequence: AGG
gatcaagtttattagataaa

SEQ ID NO: 47613 - DNA, 20 bp, Artificial Sequence
  Description of Artificial Sequence: Synthetic oligonucleotide
  Target: SCN9A; (+) strand; PAM type: NRG; PAM sequence: GAG
tcaagtttattagataaaag

SEQ ID NO: 47614 - DNA, 20 bp, Artificial Sequence
  Description of Artificial Sequence: Synthetic oligonucleotide
  Target: SCN9A; (+) strand; PAM type: NRG; PAM sequence: CAG
tttattagataaaaggagcc

SEQ ID NO: 47615 - DNA, 20 bp, Artificial Sequence
  Description of Artificial Sequence: Synthetic oligonucleotide
  Target: SCN9A; (+) strand; PAM type: NRG; PAM sequence: AGG
ttattagataaaaggagccc

SEQ ID NO: 47616 - DNA, 20 bp, Artificial Sequence
  Description of Artificial Sequence: Synthetic oligonucleotide
  Target: SCN9A; (+) strand; PAM type: NRG; PAM sequence: AAG
ccaggaaaatcactacgaca

SEQ ID NO: 47617 - DNA, 20 bp, Artificial Sequence
  Description of Artificial Sequence: Synthetic oligonucleotide
  Target: SCN9A; (+) strand; PAM type: NRG; PAM sequence: AAG
ggaaaatcactacgacaaag

SEQ ID NO: 47618 - DNA, 20 bp, Artificial Sequence
  Description of Artificial Sequence: Synthetic oligonucleotide
  Target: SCN9A; (+) strand; PAM type: NRG; PAM sequence: TAG
ctacgacaaagaagatcatg

SEQ ID NO: 47619 - DNA, 20 bp, Artificial Sequence
  Description of Artificial Sequence: Synthetic oligonucleotide
  Target: SCN9A; (+) strand; PAM type: NRG; PAM sequence: AGG
tacgacaaagaagatcatgt

SEQ ID NO: 47620 - DNA, 20 bp, Artificial Sequence
  Description of Artificial Sequence: Synthetic oligonucleotide
  Target: SCN9A; (+) strand; PAM type: NRG; PAM sequence: CAG
gaagatcatgtaggttttgc

SEQ ID NO: 47621 - DNA, 20 bp, Artificial Sequence
  Description of Artificial Sequence: Synthetic oligonucleotide
  Target: SCN9A; (+) strand; PAM type: NRG; PAM sequence: CAG
gatcatgtaggttttgccag

SEQ ID NO: 47622 - DNA, 20 bp, Artificial Sequence
  Description of Artificial Sequence: Synthetic oligonucleotide
  Target: SCN9A; (+) strand; PAM type: NRG; PAM sequence: CAG
taggttttgccagcagcacg

SEQ ID NO: 47623 - DNA, 20 bp, Artificial Sequence
  Description of Artificial Sequence: Synthetic oligonucleotide
  Target: SCN9A; (+) strand; PAM type: NRG; PAM sequence: TAG
tgccagcagcacgcagcgtc

SEQ ID NO: 47624 - DNA, 20 bp, Artificial Sequence
  Description of Artificial Sequence: Synthetic oligonucleotide
  Target: SCN9A; (+) strand; PAM type: NRG; PAM sequence: AGG
gccagcagcacgcagcgtct

SEQ ID NO: 47625 - DNA, 20 bp, Artificial Sequence
  Description of Artificial Sequence: Synthetic oligonucleotide
  Target: SCN9A; (+) strand; PAM type: NRG; PAM sequence: GGG
ccagcagcacgcagcgtcta

SEQ ID NO: 47626 - DNA, 20 bp, Artificial Sequence
  Description of Artificial Sequence: Synthetic oligonucleotide
  Target: SCN9A; (+) strand; PAM type: NRG; PAM sequence: TGG
acgcagcgtctagggaaaaa

SEQ ID NO: 47627 - DNA, 20 bp, Artificial Sequence
  Description of Artificial Sequence: Synthetic oligonucleotide
  Target: SCN9A; (+) strand; PAM type: NRG; PAM sequence: AAG
attgtcatttgaacaataaa

SEQ ID NO: 47628 - DNA, 20 bp, Artificial Sequence
  Description of Artificial Sequence: Synthetic oligonucleotide
  Target: SCN9A; (+) strand; PAM type: NRG; PAM sequence: TAG
tgaacaataaaaagtttttt

SEQ ID NO: 47629 - DNA, 20 bp, Artificial Sequence
  Description of Artificial Sequence: Synthetic oligonucleotide
  Target: SCN9A; (+) strand; PAM type: NRG; PAM sequence: CAG
agtaaattatttcaatttga

SEQ ID NO: 47630 - DNA, 20 bp, Artificial Sequence
  Description of Artificial Sequence: Synthetic oligonucleotide
  Target: SCN9A; (+) strand; PAM type: NRG; PAM sequence: AGG
gtaaattatttcaatttgac

SEQ ID NO: 47631 - DNA, 20 bp, Artificial Sequence
  Description of Artificial Sequence: Synthetic oligonucleotide
  Target: SCN9A; (+) strand; PAM type: NRG; PAM sequence: GAG
tatttcaatttgacaggcat

SEQ ID NO: 47632 - DNA, 20 bp, Artificial Sequence
  Description of Artificial Sequence: Synthetic oligonucleotide
  Target: SCN9A; (+) strand; PAM type: NRG; PAM sequence: CAG
acaggcatgagcaaatctga

SEQ ID NO: 47633 - DNA, 20 bp, Artificial Sequence
  Description of Artificial Sequence: Synthetic oligonucleotide
  Target: SCN9A; (+) strand; PAM type: NRG; PAM sequence: TGG
catgagcaaatctgacagtt

SEQ ID NO: 47634 - DNA, 20 bp, Artificial Sequence
  Description of Artificial Sequence: Synthetic oligonucleotide
  Target: SCN9A; (+) strand; PAM type: NRG; PAM sequence: AAG
ctcatgttatcaaaaatata

SEQ ID NO: 47635 - DNA, 20 bp, Artificial Sequence
  Description of Artificial Sequence: Synthetic oligonucleotide
  Target: SCN9A; (+) strand; PAM type: NRG; PAM sequence: GAG
catgttatcaaaaatataaa

SEQ ID NO: 47636 - DNA, 20 bp, Artificial Sequence
  Description of Artificial Sequence: Synthetic oligonucleotide
  Target: SCN9A; (+) strand; PAM type: NRG; PAM sequence: AAG
tatcaaaaatataaagagaa

SEQ ID NO: 47637 - DNA, 20 bp, Artificial Sequence
  Description of Artificial Sequence: Synthetic oligonucleotide
  Target: SCN9A; (+) strand; PAM type: NRG; PAM sequence: TGG
agagaaaagttatatcttca

SEQ ID NO: 47638 - DNA, 20 bp, Artificial Sequence
  Description of Artificial Sequence: Synthetic oligonucleotide
  Target: SCN9A; (+) strand; PAM type: NRG; PAM sequence: CAG
acaaatattaaacacatttt

SEQ ID NO: 47639 - DNA, 20 bp, Artificial Sequence
  Description of Artificial Sequence: Synthetic oligonucleotide
  Target: SCN9A; (+) strand; PAM type: NRG; PAM sequence: AAG
ttaaacacattttcagtacg

SEQ ID NO: 47640 - DNA, 20 bp, Artificial Sequence
  Description of Artificial Sequence: Synthetic oligonucleotide
  Target: SCN9A; (+) strand; PAM type: NRG; PAM sequence: TAG
cattttcagtacgaagaata

SEQ ID NO: 47641 - DNA, 20 bp, Artificial Sequence
  Description of Artificial Sequence: Synthetic oligonucleotide
  Target: SCN9A; (+) strand; PAM type: NRG; PAM sequence: AAG
aatgtaatatgcttgtacta

SEQ ID NO: 47642 - DNA, 20 bp, Artificial Sequence
  Description of Artificial Sequence: Synthetic oligonucleotide
  Target: SCN9A; (+) strand; PAM type: NRG; PAM sequence: AAG
tgcttgtactaaagtcatgt

SEQ ID NO: 47643 - DNA, 20 bp, Artificial Sequence
  Description of Artificial Sequence: Synthetic oligonucleotide
  Target: SCN9A; (+) strand; PAM type: NRG; PAM sequence: AAG
atgtaagattcttgattatt

SEQ ID NO: 47644 - DNA, 20 bp, Artificial Sequence
  Description of Artificial Sequence: Synthetic oligonucleotide
  Target: SCN9A; (+) strand; PAM type: NRG; PAM sequence: TAG
agattcttgattattaagtg

SEQ ID NO: 47645 - DNA, 20 bp, Artificial Sequence
  Description of Artificial Sequence: Synthetic oligonucleotide
  Target: SCN9A; (+) strand; PAM type: NRG; PAM sequence: TAG
ttcttgattattaagtgtag

SEQ ID NO: 47646 - DNA, 20 bp, Artificial Sequence
  Description of Artificial Sequence: Synthetic oligonucleotide
  Target: SCN9A; (+) strand; PAM type: NRG; PAM sequence: CAG
aaatcatgcattttttccta

SEQ ID NO: 47647 - DNA, 20 bp, Artificial Sequence
  Description of Artificial Sequence: Synthetic oligonucleotide
  Target: SCN9A; (+) strand; PAM type: NRG; PAM sequence: TAG
ctttgctcactttcaaattt

SEQ ID NO: 47648 - DNA, 20 bp, Artificial Sequence
  Description of Artificial Sequence: Synthetic oligonucleotide
  Target: SCN9A; (+) strand; PAM type: NRG; PAM sequence: AGG
tttgctcactttcaaatttt

SEQ ID NO: 47649 - DNA, 20 bp, Artificial Sequence
  Description of Artificial Sequence: Synthetic oligonucleotide
  Target: SCN9A; (+) strand; PAM type: NRG; PAM sequence: CAG
tcactttcaaattttaggaa

SEQ ID NO: 47650 - DNA, 20 bp, Artificial Sequence
  Description of Artificial Sequence: Synthetic oligonucleotide
  Target: SCN9A; (+) strand; PAM type: NRG; PAM sequence: AGG
cactttcaaattttaggaac

SEQ ID NO: 47651 - DNA, 20 bp, Artificial Sequence
  Description of Artificial Sequence: Synthetic oligonucleotide
  Target: SCN9A; (+) strand; PAM type: NRG; PAM sequence: TAG
ttaggaacaggtgatatcca

SEQ ID NO: 47652 - DNA, 20 bp, Artificial Sequence
  Description of Artificial Sequence: Synthetic oligonucleotide
  Target: SCN9A; (+) strand; PAM type: NRG; PAM sequence: TAG
atatcattgaatgttaacac

SEQ ID NO: 47653 - DNA, 20 bp, Artificial Sequence
  Description of Artificial Sequence: Synthetic oligonucleotide
  Target: SCN9A; (+) strand; PAM type: NRG; PAM sequence: AGG
tatcattgaatgttaacact

SEQ ID NO: 47654 - DNA, 20 bp, Artificial Sequence
  Description of Artificial Sequence: Synthetic oligonucleotide
  Target: SCN9A; (+) strand; PAM type: NRG; PAM sequence: CAG
cattgaatgttaacactagg

SEQ ID NO: 47655 - DNA, 20 bp, Artificial Sequence
  Description of Artificial Sequence: Synthetic oligonucleotide
  Target: SCN9A; (+) strand; PAM type: NRG; PAM sequence: TGG
gaatgttaacactaggcaga

SEQ ID NO: 47656 - DNA, 20 bp, Artificial Sequence
  Description of Artificial Sequence: Synthetic oligonucleotide
  Target: SCN9A; (+) strand; PAM type: NRG; PAM sequence: TAG
taattactttattcatctca

SEQ ID NO: 47657 - DNA, 20 bp, Artificial Sequence
  Description of Artificial Sequence: Synthetic oligonucleotide
  Target: SCN9A; (+) strand; PAM type: NRG; PAM sequence: AGG
aattactttattcatctcat

SEQ ID NO: 47658 - DNA, 20 bp, Artificial Sequence
  Description of Artificial Sequence: Synthetic oligonucleotide
  Target: SCN9A; (+) strand; PAM type: NRG; PAM sequence: TAG
gctttctttgctttttaaaa

SEQ ID NO: 47659 - DNA, 20 bp, Artificial Sequence
  Description of Artificial Sequence: Synthetic oligonucleotide
  Target: SCN9A; (+) strand; PAM type: NRG; PAM sequence: TAG
aatagaattttttttcaaaa

SEQ ID NO: 47660 - DNA, 20 bp, Artificial Sequence
  Description of Artificial Sequence: Synthetic oligonucleotide
  Target: SCN9A; (+) strand; PAM type: NRG; PAM sequence: TAG
attttttttcaaaatagttt

SEQ ID NO: 47661 - DNA, 20 bp, Artificial Sequence
  Description of Artificial Sequence: Synthetic oligonucleotide
  Target: SCN9A; (+) strand; PAM type: NRG; PAM sequence: AGG
ttttttttcaaaatagtttt

SEQ ID NO: 47662 - DNA, 20 bp, Artificial Sequence
  Description of Artificial Sequence: Synthetic oligonucleotide
  Target: SCN9A; (+) strand; PAM type: NRG; PAM sequence: TAG
tttcaaaatagttttaggat

SEQ ID NO: 47663 - DNA, 20 bp, Artificial Sequence
  Description of Artificial Sequence: Synthetic oligonucleotide
  Target: SCN9A; (+) strand; PAM type: NRG; PAM sequence: GAG
tcaaaatagttttaggatta

SEQ ID NO: 47664 - DNA, 20 bp, Artificial Sequence
  Description of Artificial Sequence: Synthetic oligonucleotide
  Target: SCN9A; (+) strand; PAM type: NRG; PAM sequence: AGG
caaaatagttttaggattag

SEQ ID NO: 47665 - DNA, 20 bp, Artificial Sequence
  Description of Artificial Sequence: Synthetic oligonucleotide
  Target: SCN9A; (+) strand; PAM type: NRG; PAM sequence: AAG
attagaggaaaattaaactg

SEQ ID NO: 47666 - DNA, 20 bp, Artificial Sequence
  Description of Artificial Sequence: Synthetic oligonucleotide
  Target: SCN9A; (+) strand; PAM type: NRG; PAM sequence: AGG
ttagaggaaaattaaactga

SEQ ID NO: 47667 - DNA, 20 bp, Artificial Sequence
  Description of Artificial Sequence: Synthetic oligonucleotide
  Target: SCN9A; (+) strand; PAM type: NRG; PAM sequence: CAG
ggaaaattaaactgaaggta

SEQ ID NO: 47668 - DNA, 20 bp, Artificial Sequence
  Description of Artificial Sequence: Synthetic oligonucleotide
  Target: SCN9A; (+) strand; PAM type: NRG; PAM sequence: GAG
aaaattaaactgaaggtaca

SEQ ID NO: 47669 - DNA, 20 bp, Artificial Sequence
  Description of Artificial Sequence: Synthetic oligonucleotide
  Target: SCN9A; (+) strand; PAM type: NRG; PAM sequence: TGG
ttttctttttttcttttttt

SEQ ID NO: 47670 - DNA, 20 bp, Artificial Sequence
  Description of Artificial Sequence: Synthetic oligonucleotide
  Target: SCN9A; (+) strand; PAM type: NRG; PAM sequence: CAG
cttttttttggcataacgtg

SEQ ID NO: 47671 - DNA, 20 bp, Artificial Sequence
  Description of Artificial Sequence: Synthetic oligonucleotide
  Target: SCN9A; (+) strand; PAM type: NRG; PAM sequence: AGG
ttttttttggcataacgtgc

SEQ ID NO: 47672 - DNA, 20 bp, Artificial Sequence
  Description of Artificial Sequence: Synthetic oligonucleotide
  Target: SCN9A; (+) strand; PAM type: NRG; PAM sequence: TGG
taacgtgcaggtttgttaca

SEQ ID NO: 47673 - DNA, 20 bp, Artificial Sequence
  Description of Artificial Sequence: Synthetic oligonucleotide
  Target: SCN9A; (+) strand; PAM type: NRG; PAM sequence: GGG
aacgtgcaggtttgttacat

SEQ ID NO: 47674 - DNA, 20 bp, Artificial Sequence
  Description of Artificial Sequence: Synthetic oligonucleotide
  Target: SCN9A; (+) strand; PAM type: NRG; PAM sequence: TAG
gtgcaggtttgttacatggg

SEQ ID NO: 47675 - DNA, 20 bp, Artificial Sequence
  Description of Artificial Sequence: Synthetic oligonucleotide
  Target: SCN9A; (+) strand; PAM type: NRG; PAM sequence: TGG
acatgggtagacacgtgcca

SEQ ID NO: 47676 - DNA, 20 bp, Artificial Sequence
  Description of Artificial Sequence: Synthetic oligonucleotide
  Target: SCN9A; (+) strand; PAM type: NRG; PAM sequence: TGG
tgggtagacacgtgccatgg

SEQ ID NO: 47677 - DNA, 20 bp, Artificial Sequence
  Description of Artificial Sequence: Synthetic oligonucleotide
  Target: SCN9A; (+) strand; PAM type: NRG; PAM sequence: TAG
catcaacctgttacctacat

SEQ ID NO: 47678 - DNA, 20 bp, Artificial Sequence
  Description of Artificial Sequence: Synthetic oligonucleotide
  Target: SCN9A; (+) strand; PAM type: NRG; PAM sequence: AGG
atcaacctgttacctacatt

SEQ ID NO: 47679 - DNA, 20 bp, Artificial Sequence
  Description of Artificial Sequence: Synthetic oligonucleotide
  Target: SCN9A; (+) strand; PAM type: NRG; PAM sequence: CAG
cctttgccccccaccaccga

SEQ ID NO: 47680 - DNA, 20 bp, Artificial Sequence
  Description of Artificial Sequence: Synthetic oligonucleotide
  Target: SCN9A; (+) strand; PAM type: NRG; PAM sequence: AGG
ctttgccccccaccaccgac

SEQ ID NO: 47681 - DNA, 20 bp, Artificial Sequence
  Description of Artificial Sequence: Synthetic oligonucleotide
  Target: SCN9A; (+) strand; PAM type: NRG; PAM sequence: CAG
cccccaccaccgacaggccc

SEQ ID NO: 47682 - DNA, 20 bp, Artificial Sequence
  Description of Artificial Sequence: Synthetic oligonucleotide
  Target: SCN9A; (+) strand; PAM type: NRG; PAM sequence: GAG
attgcccacctctcactcat

SEQ ID NO: 47683 - DNA, 20 bp, Artificial Sequence
  Description of Artificial Sequence: Synthetic oligonucleotide
  Target: SCN9A; (+) strand; PAM type: NRG; PAM sequence: GAG
cccacctctcactcatgagt

SEQ ID NO: 47684 - DNA, 20 bp, Artificial Sequence
  Description of Artificial Sequence: Synthetic oligonucleotide
  Target: SCN9A; (+) strand; PAM type: NRG; PAM sequence: TGG
gagtgagaacatgcgttgtt

SEQ ID NO: 47685 - DNA, 20 bp, Artificial Sequence
  Description of Artificial Sequence: Synthetic oligonucleotide
  Target: SCN9A; (+) strand; PAM type: NRG; PAM sequence: TAG
ttggttttctgttcctgttt

SEQ ID NO: 47686 - DNA, 20 bp, Artificial Sequence
  Description of Artificial Sequence: Synthetic oligonucleotide
  Target: SCN9A; (+) strand; PAM type: NRG; PAM sequence: GAG
tgttcctgttttagtttgct

SEQ ID NO: 47687 - DNA, 20 bp, Artificial Sequence
  Description of Artificial Sequence: Synthetic oligonucleotide
  Target: SCN9A; (+) strand; PAM type: NRG; PAM sequence: TGG
ttttagtttgctgagaatga

SEQ ID NO: 47688 - DNA, 20 bp, Artificial Sequence
  Description of Artificial Sequence: Synthetic oligonucleotide
  Target: SCN9A; (+) strand; PAM type: NRG; PAM sequence: TAG
ttgctgagaatgatggtttc

SEQ ID NO: 47689 - DNA, 20 bp, Artificial Sequence
  Description of Artificial Sequence: Synthetic oligonucleotide
  Target: SCN9A; (+) strand; PAM type: NRG; PAM sequence: AAG
gcttcatccatgtccctgca

SEQ ID NO: 47690 - DNA, 20 bp, Artificial Sequence
  Description of Artificial Sequence: Synthetic oligonucleotide
  Target: SCN9A; (+) strand; PAM type: NRG; PAM sequence: AGG
cttcatccatgtccctgcaa

SEQ ID NO: 47691 - DNA, 20 bp, Artificial Sequence
  Description of Artificial Sequence: Synthetic oligonucleotide
  Target: SCN9A; (+) strand; PAM type: NRG; PAM sequence: TGG
catgaacttattctttttta

SEQ ID NO: 47692 - DNA, 20 bp, Artificial Sequence
  Description of Artificial Sequence: Synthetic oligonucleotide
  Target: SCN9A; (+) strand; PAM type: NRG; PAM sequence: TAG
tattcttttttatggctgca

SEQ ID NO: 47693 - DNA, 20 bp, Artificial Sequence
  Description of Artificial Sequence: Synthetic oligonucleotide
  Target: SCN9A; (+) strand; PAM type: NRG; PAM sequence: TGG
tatggctgcatagtattcca

SEQ ID NO: 47694 - DNA, 20 bp, Artificial Sequence
  Description of Artificial Sequence: Synthetic oligonucleotide
  Target: SCN9A; (+) strand; PAM type: NRG; PAM sequence: CAG
tgtgccacattttctttatc

SEQ ID NO: 47695 - DNA, 20 bp, Artificial Sequence
  Description of Artificial Sequence: Synthetic oligonucleotide
  Target: SCN9A; (+) strand; PAM type: NRG; PAM sequence: TGG
tttatccagtctatcattga

SEQ ID NO: 47696 - DNA, 20 bp, Artificial Sequence
  Description of Artificial Sequence: Synthetic oligonucleotide
  Target: SCN9A; (+) strand; PAM type: NRG; PAM sequence: GGG
ttatccagtctatcattgat

SEQ ID NO: 47697 - DNA, 20 bp, Artificial Sequence
  Description of Artificial Sequence: Synthetic oligonucleotide
  Target: SCN9A; (+) strand; PAM type: NRG; PAM sequence: TGG
gtctatcattgatgggcatt

SEQ ID NO: 47698 - DNA, 20 bp, Artificial Sequence
  Description of Artificial Sequence: Synthetic oligonucleotide
  Target: SCN9A; (+) strand; PAM type: NRG; PAM sequence: GGG
tctatcattgatgggcattt

SEQ ID NO: 47699 - DNA, 20 bp, Artificial Sequence
  Description of Artificial Sequence: Synthetic oligonucleotide
  Target: SCN9A; (+) strand; PAM type: NRG; PAM sequence: TGG
tcattgatgggcatttgggt

SEQ ID NO: 47700 - DNA, 20 bp, Artificial Sequence
  Description of Artificial Sequence: Synthetic oligonucleotide
  Target: SCN9A; (+) strand; PAM type: NRG; PAM sequence: CAG
tgggcatttgggttggttcc

SEQ ID NO: 47701 - DNA, 20 bp, Artificial Sequence
  Description of Artificial Sequence: Synthetic oligonucleotide
  Target: SCN9A; (+) strand; PAM type: NRG; PAM sequence: TAG
ccagtctttgctattgtgaa

SEQ ID NO: 47702 - DNA, 20 bp, Artificial Sequence
  Description of Artificial Sequence: Synthetic oligonucleotide
  Target: SCN9A; (+) strand; PAM type: NRG; PAM sequence: TAG
gtgtgcatgtgtctttacca

SEQ ID NO: 47703 - DNA, 20 bp, Artificial Sequence
  Description of Artificial Sequence: Synthetic oligonucleotide
  Target: SCN9A; (+) strand; PAM type: NRG; PAM sequence: TGG
tagaatgatatgtaatcttt

SEQ ID NO: 47704 - DNA, 20 bp, Artificial Sequence
  Description of Artificial Sequence: Synthetic oligonucleotide
  Target: SCN9A; (+) strand; PAM type: NRG; PAM sequence: GGG
agaatgatatgtaatctttt

SEQ ID NO: 47705 - DNA, 20 bp, Artificial Sequence
  Description of Artificial Sequence: Synthetic oligonucleotide
  Target: SCN9A; (+) strand; PAM type: NRG; PAM sequence: CAG
taatcttttgggtatatacc

SEQ ID NO: 47706 - DNA, 20 bp, Artificial Sequence
  Description of Artificial Sequence: Synthetic oligonucleotide
  Target: SCN9A; (+) strand; PAM type: NRG; PAM sequence: TGG
tttgggtatatacccagtaa

SEQ ID NO: 47707 - DNA, 20 bp, Artificial Sequence
  Description of Artificial Sequence: Synthetic oligonucleotide
  Target: SCN9A; (+) strand; PAM type: NRG; PAM sequence: GGG
ttgggtatatacccagtaat

SEQ ID NO: 47708 - DNA, 20 bp, Artificial Sequence
  Description of Artificial Sequence: Synthetic oligonucleotide
  Target: SCN9A; (+) strand; PAM type: NRG; PAM sequence: TGG
atacccagtaatgggattgc

SEQ ID NO: 47709 - DNA, 20 bp, Artificial Sequence
  Description of Artificial Sequence: Synthetic oligonucleotide
  Target: SCN9A; (+) strand; PAM type: NRG; PAM sequence: GGG
tacccagtaatgggattgct

SEQ ID NO: 47710 - DNA, 20 bp, Artificial Sequence
  Description of Artificial Sequence: Synthetic oligonucleotide
  Target: SCN9A; (+) strand; PAM type: NRG; PAM sequence: TGG
tgggtcactgtcttccacac

SEQ ID NO: 47711 - DNA, 20 bp, Artificial Sequence
  Description of Artificial Sequence: Synthetic oligonucleotide
  Target: SCN9A; (+) strand; PAM type: NRG; PAM sequence: CAG
ctaatttacactcctaccaa

SEQ ID NO: 47712 - DNA, 20 bp, Artificial Sequence
  Description of Artificial Sequence: Synthetic oligonucleotide
  Target: SCN9A; (+) strand; PAM type: NRG; PAM sequence: AAG
cactcctaccaacagtttaa

SEQ ID NO: 47713 - DNA, 20 bp, Artificial Sequence
  Description of Artificial Sequence: Synthetic oligonucleotide
  Target: SCN9A; (+) strand; PAM type: NRG; PAM sequence: CAG
ctatttctccacattttctc

SEQ ID NO: 47714 - DNA, 20 bp, Artificial Sequence
  Description of Artificial Sequence: Synthetic oligonucleotide
  Target: SCN9A; (+) strand; PAM type: NRG; PAM sequence: TGG
ttaattatcaccattctaac

SEQ ID NO: 47715 - DNA, 20 bp, Artificial Sequence
  Description of Artificial Sequence: Synthetic oligonucleotide
  Target: SCN9A; (+) strand; PAM type: NRG; PAM sequence: GAG
atcaccattctaactggcat

SEQ ID NO: 47716 - DNA, 20 bp, Artificial Sequence
  Description of Artificial Sequence: Synthetic oligonucleotide
  Target: SCN9A; (+) strand; PAM type: NRG; PAM sequence: TGG
ccattctaactggcatgaga

SEQ ID NO: 47717 - DNA, 20 bp, Artificial Sequence
  Description of Artificial Sequence: Synthetic oligonucleotide
  Target: SCN9A; (+) strand; PAM type: NRG; PAM sequence: TGG
catgagatggtatctcattg

SEQ ID NO: 47718 - DNA, 20 bp, Artificial Sequence
  Description of Artificial Sequence: Synthetic oligonucleotide
  Target: SCN9A; (+) strand; PAM type: NRG; PAM sequence: TGG
tttgaattgcatttctctaa

SEQ ID NO: 47719 - DNA, 20 bp, Artificial Sequence
  Description of Artificial Sequence: Synthetic oligonucleotide
  Target: SCN9A; (+) strand; PAM type: NRG; PAM sequence: CAG
aattgcatttctctaatggc

SEQ ID NO: 47720 - DNA, 20 bp, Artificial Sequence
  Description of Artificial Sequence: Synthetic oligonucleotide
  Target: SCN9A; (+) strand; PAM type: NRG; PAM sequence: GAG
ctctaatggccagtgatgat

SEQ ID NO: 47721 - DNA, 20 bp, Artificial Sequence
  Description of Artificial Sequence: Synthetic oligonucleotide
  Target: SCN9A; (+) strand; PAM type: NRG; PAM sequence: AAG
gagctttttttcatatgttt

SEQ ID NO: 47722 - DNA, 20 bp, Artificial Sequence
  Description of Artificial Sequence: Synthetic oligonucleotide
  Target: SCN9A; (+) strand; PAM type: NRG; PAM sequence: TGG
tttttcatatgtttaagtta

SEQ ID NO: 47723 - DNA, 20 bp, Artificial Sequence
  Description of Artificial Sequence: Synthetic oligonucleotide
  Target: SCN9A; (+) strand; PAM type: NRG; PAM sequence: GGG
ttttcatatgtttaagttat

SEQ ID NO: 47724 - DNA, 20 bp, Artificial Sequence
  Description of Artificial Sequence: Synthetic oligonucleotide
  Target: SCN9A; (+) strand; PAM type: NRG; PAM sequence: AAG
taagttatgggatacatgtg

SEQ ID NO: 47725 - DNA, 20 bp, Artificial Sequence
  Description of Artificial Sequence: Synthetic oligonucleotide
  Target: SCN9A; (+) strand; PAM type: NRG; PAM sequence: CAG
ggatacatgtgaagaacatg

SEQ ID NO: 47726 - DNA, 20 bp, Artificial Sequence
  Description of Artificial Sequence: Synthetic oligonucleotide
  Target: SCN9A; (+) strand; PAM type: NRG; PAM sequence: AGG
gatacatgtgaagaacatgc

SEQ ID NO: 47727 - DNA, 20 bp, Artificial Sequence
  Description of Artificial Sequence: Synthetic oligonucleotide
  Target: SCN9A; (+) strand; PAM type: NRG; PAM sequence: TGG
catgtgaagaacatgcaggt

SEQ ID NO: 47728 - DNA, 20 bp, Artificial Sequence
  Description of Artificial Sequence: Synthetic oligonucleotide
  Target: SCN9A; (+) strand; PAM type: NRG; PAM sequence: CAG
gaacatgcaggttggttaca

SEQ ID NO: 47729 - DNA, 20 bp, Artificial Sequence
  Description of Artificial Sequence: Synthetic oligonucleotide
  Target: SCN9A; (+) strand; PAM type: NRG; PAM sequence: AGG
aacatgcaggttggttacac

SEQ ID NO: 47730 - DNA, 20 bp, Artificial Sequence
  Description of Artificial Sequence: Synthetic oligonucleotide
  Target: SCN9A; (+) strand; PAM type: NRG; PAM sequence: TGG
acacaggtatacatgtgcta

SEQ ID NO: 47731 - DNA, 20 bp, Artificial Sequence
  Description of Artificial Sequence: Synthetic oligonucleotide
  Target: SCN9A; (+) strand; PAM type: NRG; PAM sequence: TGG
caggtatacatgtgctatgg

SEQ ID NO: 47732 - DNA, 20 bp, Artificial Sequence
  Description of Artificial Sequence: Synthetic oligonucleotide
  Target: SCN9A; (+) strand; PAM type: NRG; PAM sequence: TAG
ccacctatcaacccattatc

SEQ ID NO: 47733 - DNA, 20 bp, Artificial Sequence
  Description of Artificial Sequence: Synthetic oligonucleotide
  Target: SCN9A; (+) strand; PAM type: NRG; PAM sequence: AGG
cacctatcaacccattatct

SEQ ID NO: 47734 - DNA, 20 bp, Artificial Sequence
  Description of Artificial Sequence: Synthetic oligonucleotide
  Target: SCN9A; (+) strand; PAM type: NRG; PAM sequence: AAG
caacccattatctaggtttt

SEQ ID NO: 47735 - DNA, 20 bp, Artificial Sequence
  Description of Artificial Sequence: Synthetic oligonucleotide
  Target: SCN9A; (+) strand; PAM type: NRG; PAM sequence: TAG
gttttaagacctgcatgcat

SEQ ID NO: 47736 - DNA, 20 bp, Artificial Sequence
  Description of Artificial Sequence: Synthetic oligonucleotide
  Target: SCN9A; (+) strand; PAM type: NRG; PAM sequence: AGG
ttttaagacctgcatgcatt

SEQ ID NO: 47737 - DNA, 20 bp, Artificial Sequence
  Description of Artificial Sequence: Synthetic oligonucleotide
  Target: SCN9A; (+) strand; PAM type: NRG; PAM sequence: TAG
taagacctgcatgcattagg

SEQ ID NO: 47738 - DNA, 20 bp, Artificial Sequence
  Description of Artificial Sequence: Synthetic oligonucleotide
  Target: SCN9A; (+) strand; PAM type: NRG; PAM sequence: CAG
ccttgcctcccaccccccaa

SEQ ID NO: 47739 - DNA, 20 bp, Artificial Sequence
  Description of Artificial Sequence: Synthetic oligonucleotide
  Target: SCN9A; (+) strand; PAM type: NRG; PAM sequence: AGG
cttgcctcccaccccccaac

SEQ ID NO: 47740 - DNA, 20 bp, Artificial Sequence
  Description of Artificial Sequence: Synthetic oligonucleotide
  Target: SCN9A; (+) strand; PAM type: NRG; PAM sequence: CGG
tcccaccccccaacaggccc

SEQ ID NO: 47741 - DNA, 20 bp, Artificial Sequence
  Description of Artificial Sequence: Synthetic oligonucleotide
  Target: SCN9A; (+) strand; PAM type: NRG; PAM sequence: GAG
attgttcaactcccacttat

SEQ ID NO: 47742 - DNA, 20 bp, Artificial Sequence
  Description of Artificial Sequence: Synthetic oligonucleotide
  Target: SCN9A; (+) strand; PAM type: NRG; PAM sequence: GAG
ttcaactcccacttatgagt

SEQ ID NO: 47743 - DNA, 20 bp, Artificial Sequence
  Description of Artificial Sequence: Synthetic oligonucleotide
  Target: SCN9A; (+) strand; PAM type: NRG; PAM sequence: CAG
cacttatgagtgagaacatg

SEQ ID NO: 47744 - DNA, 20 bp, Artificial Sequence
  Description of Artificial Sequence: Synthetic oligonucleotide
  Target: SCN9A; (+) strand; PAM type: NRG; PAM sequence: TGG
gagtgagaacatgcagtgtt

SEQ ID NO: 47745 - DNA, 20 bp, Artificial Sequence
  Description of Artificial Sequence: Synthetic oligonucleotide
  Target: SCN9A; (+) strand; PAM type: NRG; PAM sequence: TAG
ttggttttctcttcctgtat

SEQ ID NO: 47746 - DNA, 20 bp, Artificial Sequence
  Description of Artificial Sequence: Synthetic oligonucleotide
  Target: SCN9A; (+) strand; PAM type: NRG; PAM sequence: GAG
tcttcctgtattagtttgct

SEQ ID NO: 47747 - DNA, 20 bp, Artificial Sequence
  Description of Artificial Sequence: Synthetic oligonucleotide
  Target: SCN9A; (+) strand; PAM type: NRG; PAM sequence: AGG
cttcctgtattagtttgctg

SEQ ID NO: 47748 - DNA, 20 bp, Artificial Sequence
  Description of Artificial Sequence: Synthetic oligonucleotide
  Target: SCN9A; (+) strand; PAM type: NRG; PAM sequence: TGG
tattagtttgctgaggatga

SEQ ID NO: 47749 - DNA, 20 bp, Artificial Sequence
  Description of Artificial Sequence: Synthetic oligonucleotide
  Target: SCN9A; (+) strand; PAM type: NRG; PAM sequence: CAG
ttgctgaggatgatggcttc

SEQ ID NO: 47750 - DNA, 20 bp, Artificial Sequence
  Description of Artificial Sequence: Synthetic oligonucleotide
  Target: SCN9A; (+) strand; PAM type: NRG; PAM sequence: AAG
gcttcatccatgtccctgta

SEQ ID NO: 47751 - DNA, 20 bp, Artificial Sequence
  Description of Artificial Sequence: Synthetic oligonucleotide
  Target: SCN9A; (+) strand; PAM type: NRG; PAM sequence: AGG
cttcatccatgtccctgtaa

SEQ ID NO: 47752 - DNA, 20 bp, Artificial Sequence
  Description of Artificial Sequence: Synthetic oligonucleotide
  Target: SCN9A; (+) strand; PAM type: NRG; PAM sequence: TGG
atgatctcattcttttttaa

SEQ ID NO: 47753 - DNA, 20 bp, Artificial Sequence
  Description of Artificial Sequence: Synthetic oligonucleotide
  Target: SCN9A; (+) strand; PAM type: NRG; PAM sequence: TAG
attcttttttaatggctgca

SEQ ID NO: 47754 - DNA, 20 bp, Artificial Sequence
  Description of Artificial Sequence: Synthetic oligonucleotide
  Target: SCN9A; (+) strand; PAM type: NRG; PAM sequence: TGG
aatggctgcatagtattcca

SEQ ID NO: 47755 - DNA, 20 bp, Artificial Sequence
  Description of Artificial Sequence: Synthetic oligonucleotide
  Target: SCN9A; (+) strand; PAM type: NRG; PAM sequence: TGG
tttatacaatttaacattga

SEQ ID NO: 47756 - DNA, 20 bp, Artificial Sequence
  Description of Artificial Sequence: Synthetic oligonucleotide
  Target: SCN9A; (+) strand; PAM type: NRG; PAM sequence: GGG
ttatacaatttaacattgat

SEQ ID NO: 47757 - DNA, 20 bp, Artificial Sequence
  Description of Artificial Sequence: Synthetic oligonucleotide
  Target: SCN9A; (+) strand; PAM type: NRG; PAM sequence: GAG
tttaacattgatgggcattt

SEQ ID NO: 47758 - DNA, 20 bp, Artificial Sequence
  Description of Artificial Sequence: Synthetic oligonucleotide
  Target: SCN9A; (+) strand; PAM type: NRG; PAM sequence: TAG
catctctttgctattgtaaa

SEQ ID NO: 47759 - DNA, 20 bp, Artificial Sequence
  Description of Artificial Sequence: Synthetic oligonucleotide
  Target: SCN9A; (+) strand; PAM type: NRG; PAM sequence: TAG
tatgtgtgcatgtgtctttg

SEQ ID NO: 47760 - DNA, 20 bp, Artificial Sequence
  Description of Artificial Sequence: Synthetic oligonucleotide
  Target: SCN9A; (+) strand; PAM type: NRG; PAM sequence: TAG
gtgtgcatgtgtctttgtag

SEQ ID NO: 47761 - DNA, 20 bp, Artificial Sequence
  Description of Artificial Sequence: Synthetic oligonucleotide
  Target: SCN9A; (+) strand; PAM type: NRG; PAM sequence: CGG
agaatgatttatattcgttt

SEQ ID NO: 47762 - DNA, 20 bp, Artificial Sequence
  Description of Artificial Sequence: Synthetic oligonucleotide
  Target: SCN9A; (+) strand; PAM type: NRG; PAM sequence: CAG
tattcgtttcggtatatacc

SEQ ID NO: 47763 - DNA, 20 bp, Artificial Sequence
  Description of Artificial Sequence: Synthetic oligonucleotide
  Target: SCN9A; (+) strand; PAM type: NRG; PAM sequence: TGG
tttcggtatatacccagtaa

SEQ ID NO: 47764 - DNA, 20 bp, Artificial Sequence
  Description of Artificial Sequence: Synthetic oligonucleotide
  Target: SCN9A; (+) strand; PAM type: NRG; PAM sequence: GGG
ttcggtatatacccagtaat

SEQ ID NO: 47765 - DNA, 20 bp, Artificial Sequence
  Description of Artificial Sequence: Synthetic oligonucleotide
  Target: SCN9A; (+) strand; PAM type: NRG; PAM sequence: TAG
atacccagtaatgggattgc

SEQ ID NO: 47766 - DNA, 20 bp, Artificial Sequence
  Description of Artificial Sequence: Synthetic oligonucleotide
  Target: SCN9A; (+) strand; PAM type: NRG; PAM sequence: AGG
tacccagtaatgggattgct

SEQ ID NO: 47767 - DNA, 20 bp, Artificial Sequence
  Description of Artificial Sequence: Synthetic oligonucleotide
  Target: SCN9A; (+) strand; PAM type: NRG; PAM sequence: TGG
aatgggattgctaggtcaaa

SEQ ID NO: 47768 - DNA, 20 bp, Artificial Sequence
  Description of Artificial Sequence: Synthetic oligonucleotide
  Target: SCN9A; (+) strand; PAM type: NRG; PAM sequence: TGG
gctaggtcaaatggtatttc

SEQ ID NO: 47769 - DNA, 20 bp, Artificial Sequence
  Description of Artificial Sequence: Synthetic oligonucleotide
  Target: SCN9A; (+) strand; PAM type: NRG; PAM sequence: TAG
tcaaatggtatttctggttc

SEQ ID NO: 47770 - DNA, 20 bp, Artificial Sequence
  Description of Artificial Sequence: Synthetic oligonucleotide
  Target: SCN9A; (+) strand; PAM type: NRG; PAM sequence: AGG
caaatggtatttctggttct

SEQ ID NO: 47771 - DNA, 20 bp, Artificial Sequence
  Description of Artificial Sequence: Synthetic oligonucleotide
  Target: SCN9A; (+) strand; PAM type: NRG; PAM sequence: AAG
atttctggttctaggtcctt

SEQ ID NO: 47772 - DNA, 20 bp, Artificial Sequence
  Description of Artificial Sequence: Synthetic oligonucleotide
  Target: SCN9A; (+) strand; PAM type: NRG; PAM sequence: AGG
tttctggttctaggtcctta

SEQ ID NO: 47773 - DNA, 20 bp, Artificial Sequence
  Description of Artificial Sequence: Synthetic oligonucleotide
  Target: SCN9A; (+) strand; PAM type: NRG; PAM sequence: CAG
ctaatttacactcccaccaa

SEQ ID NO: 47774 - DNA, 20 bp, Artificial Sequence
  Description of Artificial Sequence: Synthetic oligonucleotide
  Target: SCN9A; (+) strand; PAM type: NRG; PAM sequence: AAG
cactcccaccaacagtgtaa

SEQ ID NO: 47775 - DNA, 20 bp, Artificial Sequence
  Description of Artificial Sequence: Synthetic oligonucleotide
  Target: SCN9A; (+) strand; PAM type: NRG; PAM sequence: TAG
aaagtgctactatttcttca

SEQ ID NO: 47776 - DNA, 20 bp, Artificial Sequence
  Description of Artificial Sequence: Synthetic oligonucleotide
  Target: SCN9A; (+) strand; PAM type: NRG; PAM sequence: CAG
ctatttcttcatagcctcac

SEQ ID NO: 47777 - DNA, 20 bp, Artificial Sequence
  Description of Artificial Sequence: Synthetic oligonucleotide
  Target: SCN9A; (+) strand; PAM type: NRG; PAM sequence: GAG
atcaccattctgactgactt

SEQ ID NO: 47778 - DNA, 20 bp, Artificial Sequence
  Description of Artificial Sequence: Synthetic oligonucleotide
  Target: SCN9A; (+) strand; PAM type: NRG; PAM sequence: TGG
ccattctgactgacttgaga

SEQ ID NO: 47779 - DNA, 20 bp, Artificial Sequence
  Description of Artificial Sequence: Synthetic oligonucleotide
  Target: SCN9A; (+) strand; PAM type: NRG; PAM sequence: TGG
cttgagatggtatctcattg

SEQ ID NO: 47780 - DNA, 20 bp, Artificial Sequence
  Description of Artificial Sequence: Synthetic oligonucleotide
  Target: SCN9A; (+) strand; PAM type: NRG; PAM sequence: GAG
tcttaatgatcactgatgtt

SEQ ID NO: 47781 - DNA, 20 bp, Artificial Sequence
  Description of Artificial Sequence: Synthetic oligonucleotide
  Target: SCN9A; (+) strand; PAM type: NRG; PAM sequence: TGG
gagctttttttcatgttttt

SEQ ID NO: 47782 - DNA, 20 bp, Artificial Sequence
  Description of Artificial Sequence: Synthetic oligonucleotide
  Target: SCN9A; (+) strand; PAM type: NRG; PAM sequence: GAG
ccgcataaatgtcttctttt

SEQ ID NO: 47783 - DNA, 20 bp, Artificial Sequence
  Description of Artificial Sequence: Synthetic oligonucleotide
  Target: SCN9A; (+) strand; PAM type: NRG; PAM sequence: AAG
cataaatgtcttcttttgag

SEQ ID NO: 47784 - DNA, 20 bp, Artificial Sequence
  Description of Artificial Sequence: Synthetic oligonucleotide
  Target: SCN9A; (+) strand; PAM type: NRG; PAM sequence: TGG
atcctttgcccactttttga

SEQ ID NO: 47785 - DNA, 20 bp, Artificial Sequence
  Description of Artificial Sequence: Synthetic oligonucleotide
  Target: SCN9A; (+) strand; PAM type: NRG; PAM sequence: GGG
tcctttgcccactttttgat

SEQ ID NO: 47786 - DNA, 20 bp, Artificial Sequence
  Description of Artificial Sequence: Synthetic oligonucleotide
  Target: SCN9A; (+) strand; PAM type: NRG; PAM sequence: AAG
cccactttttgatgggatgc

SEQ ID NO: 47787 - DNA, 20 bp, Artificial Sequence
  Description of Artificial Sequence: Synthetic oligonucleotide
  Target: SCN9A; (+) strand; PAM type: NRG; PAM sequence: AGG
ccactttttgatgggatgca

SEQ ID NO: 47788 - DNA, 20 bp, Artificial Sequence
  Description of Artificial Sequence: Synthetic oligonucleotide
  Target: SCN9A; (+) strand; PAM type: NRG; PAM sequence: TGG
tttttgatgggatgcaaggc

SEQ ID NO: 47789 - DNA, 20 bp, Artificial Sequence
  Description of Artificial Sequence: Synthetic oligonucleotide
  Target: SCN9A; (+) strand; PAM type: NRG; PAM sequence: CAG
aatgtaatccatcacataaa

SEQ ID NO: 47790 - DNA, 20 bp, Artificial Sequence
  Description of Artificial Sequence: Synthetic oligonucleotide
  Target: SCN9A; (+) strand; PAM type: NRG; PAM sequence: TAG
aaaccacatgattatctcaa

SEQ ID NO: 47791 - DNA, 20 bp, Artificial Sequence
  Description of Artificial Sequence: Synthetic oligonucleotide
  Target: SCN9A; (+) strand; PAM type: NRG; PAM sequence: CAG
catgattatctcaatagatg

SEQ ID NO: 47792 - DNA, 20 bp, Artificial Sequence
  Description of Artificial Sequence: Synthetic oligonucleotide
  Target: SCN9A; (+) strand; PAM type: NRG; PAM sequence: GAG
tgattatctcaatagatgca

SEQ ID NO: 47793 - DNA, 20 bp, Artificial Sequence
  Description of Artificial Sequence: Synthetic oligonucleotide
  Target: SCN9A; (+) strand; PAM type: NRG; PAM sequence: AAG
ttatctcaatagatgcagag

SEQ ID NO: 47794 - DNA, 20 bp, Artificial Sequence
  Description of Artificial Sequence: Synthetic oligonucleotide
  Target: SCN9A; (+) strand; PAM type: NRG; PAM sequence: AGG
tatctcaatagatgcagaga

SEQ ID NO: 47795 - DNA, 20 bp, Artificial Sequence
  Description of Artificial Sequence: Synthetic oligonucleotide
  Target: SCN9A; (+) strand; PAM type: NRG; PAM sequence: TAG
gttaaaaactatcaataaac

SEQ ID NO: 47796 - DNA, 20 bp, Artificial Sequence
  Description of Artificial Sequence: Synthetic oligonucleotide
  Target: SCN9A; (+) strand; PAM type: NRG; PAM sequence: AGG
ttaaaaactatcaataaact

SEQ ID NO: 47797 - DNA, 20 bp, Artificial Sequence
  Description of Artificial Sequence: Synthetic oligonucleotide
  Target: SCN9A; (+) strand; PAM type: NRG; PAM sequence: TGG
atcaataaactaggtattga

SEQ ID NO: 47798 - DNA, 20 bp, Artificial Sequence
  Description of Artificial Sequence: Synthetic oligonucleotide
  Target: SCN9A; (+) strand; PAM type: NRG; PAM sequence: AAG
ggaacatatctcaaaataat

SEQ ID NO: 47799 - DNA, 20 bp, Artificial Sequence
  Description of Artificial Sequence: Synthetic oligonucleotide
  Target: SCN9A; (+) strand; PAM type: NRG; PAM sequence: GAG
aacatatctcaaaataataa

SEQ ID NO: 47800 - DNA, 20 bp, Artificial Sequence
  Description of Artificial Sequence: Synthetic oligonucleotide
  Target: SCN9A; (+) strand; PAM type: NRG; PAM sequence: TAG
agctatttatgaaaactcca

SEQ ID NO: 47801 - DNA, 20 bp, Artificial Sequence
  Description of Artificial Sequence: Synthetic oligonucleotide
  Target: SCN9A; (+) strand; PAM type: NRG; PAM sequence: TGG
atagccaatatcatactgaa

SEQ ID NO: 47802 - DNA, 20 bp, Artificial Sequence
  Description of Artificial Sequence: Synthetic oligonucleotide
  Target: SCN9A; (+) strand; PAM type: NRG; PAM sequence: GGG
tagccaatatcatactgaat

SEQ ID NO: 47803 - DNA, 20 bp, Artificial Sequence
  Description of Artificial Sequence: Synthetic oligonucleotide
  Target: SCN9A; (+) strand; PAM type: NRG; PAM sequence: AAG
atatcatactgaatgggaaa

SEQ ID NO: 47804 - DNA, 20 bp, Artificial Sequence
  Description of Artificial Sequence: Synthetic oligonucleotide
  Target: SCN9A; (+) strand; PAM type: NRG; PAM sequence: TGG
catactgaatgggaaaaagc

SEQ ID NO: 47805 - DNA, 20 bp, Artificial Sequence
  Description of Artificial Sequence: Synthetic oligonucleotide
  Target: SCN9A; (+) strand; PAM type: NRG; PAM sequence: AAG
actgaatgggaaaaagctgg

SEQ ID NO: 47806 - DNA, 20 bp, Artificial Sequence
  Description of Artificial Sequence: Synthetic oligonucleotide
  Target: SCN9A; (+) strand; PAM type: NRG; PAM sequence: TGG
gaagcattccctttaaaaac

SEQ ID NO: 47807 - DNA, 20 bp, Artificial Sequence
  Description of Artificial Sequence: Synthetic oligonucleotide
  Target: SCN9A; (+) strand; PAM type: NRG; PAM sequence: AAG
ttccctttaaaaactggcac

SEQ ID NO: 47808 - DNA, 20 bp, Artificial Sequence
  Description of Artificial Sequence: Synthetic oligonucleotide
  Target: SCN9A; (+) strand; PAM type: NRG; PAM sequence: AAG
tttaaaaactggcacaagac

SEQ ID NO: 47809 - DNA, 20 bp, Artificial Sequence
  Description of Artificial Sequence: Synthetic oligonucleotide
  Target: SCN9A; (+) strand; PAM type: NRG; PAM sequence: AGG
ttaaaaactggcacaagaca

SEQ ID NO: 47810 - DNA, 20 bp, Artificial Sequence
  Description of Artificial Sequence: Synthetic oligonucleotide
  Target: SCN9A; (+) strand; PAM type: NRG; PAM sequence: TAG
ctcaccactgctattcaata

SEQ ID NO: 47811 - DNA, 20 bp, Artificial Sequence
  Description of Artificial Sequence: Synthetic oligonucleotide
  Target: SCN9A; (+) strand; PAM type: NRG; PAM sequence: TGG
actgctattcaatatagtgt

SEQ ID NO: 47812 - DNA, 20 bp, Artificial Sequence
  Description of Artificial Sequence: Synthetic oligonucleotide
  Target: SCN9A; (+) strand; PAM type: NRG; PAM sequence: TGG
caatatagtgttggaatttc

SEQ ID NO: 47813 - DNA, 20 bp, Artificial Sequence
  Description of Artificial Sequence: Synthetic oligonucleotide
  Target: SCN9A; (+) strand; PAM type: NRG; PAM sequence: CAG
atagtgttggaatttctggc

SEQ ID NO: 47814 - DNA, 20 bp, Artificial Sequence
  Description of Artificial Sequence: Synthetic oligonucleotide
  Target: SCN9A; (+) strand; PAM type: NRG; PAM sequence: AGG
tagtgttggaatttctggcc

SEQ ID NO: 47815 - DNA, 20 bp, Artificial Sequence
  Description of Artificial Sequence: Synthetic oligonucleotide
  Target: SCN9A; (+) strand; PAM type: NRG; PAM sequence: GGG
agtgttggaatttctggcca

SEQ ID NO: 47816 - DNA, 20 bp, Artificial Sequence
  Description of Artificial Sequence: Synthetic oligonucleotide
  Target: SCN9A; (+) strand; PAM type: NRG; PAM sequence: CAG
gaatttctggccagggcaat

SEQ ID NO: 47817 - DNA, 20 bp, Artificial Sequence
  Description of Artificial Sequence: Synthetic oligonucleotide
  Target: SCN9A; (+) strand; PAM type: NRG; PAM sequence: AAG
tctggccagggcaatcagac

SEQ ID NO: 47818 - DNA, 20 bp, Artificial Sequence
  Description of Artificial Sequence: Synthetic oligonucleotide
  Target: SCN9A; (+) strand; PAM type: NRG; PAM sequence: GAG
tggccagggcaatcagacaa

SEQ ID NO: 47819 - DNA, 20 bp, Artificial Sequence
  Description of Artificial Sequence: Synthetic oligonucleotide
  Target: SCN9A; (+) strand; PAM type: NRG; PAM sequence: AAG
cagggcaatcagacaagaga

SEQ ID NO: 47820 - DNA, 20 bp, Artificial Sequence
  Description of Artificial Sequence: Synthetic oligonucleotide
  Target: SCN9A; (+) strand; PAM type: NRG; PAM sequence: AAG
tcagacaagagaaagaaata

SEQ ID NO: 47821 - DNA, 20 bp, Artificial Sequence
  Description of Artificial Sequence: Synthetic oligonucleotide
  Target: SCN9A; (+) strand; PAM type: NRG; PAM sequence: AGG
cagacaagagaaagaaataa

SEQ ID NO: 47822 - DNA, 20 bp, Artificial Sequence
  Description of Artificial Sequence: Synthetic oligonucleotide
  Target: SCN9A; (+) strand; PAM type: NRG; PAM sequence: GGG
agacaagagaaagaaataaa

SEQ ID NO: 47823 - DNA, 20 bp, Artificial Sequence
  Description of Artificial Sequence: Synthetic oligonucleotide
  Target: SCN9A; (+) strand; PAM type: NRG; PAM sequence: TAG
agaaataaagggtattcaaa

SEQ ID NO: 47824 - DNA, 20 bp, Artificial Sequence
  Description of Artificial Sequence: Synthetic oligonucleotide
  Target: SCN9A; (+) strand; PAM type: NRG; PAM sequence: AGG
gaaataaagggtattcaaat

SEQ ID NO: 47825 - DNA, 20 bp, Artificial Sequence
  Description of Artificial Sequence: Synthetic oligonucleotide
  Target: SCN9A; (+) strand; PAM type: NRG; PAM sequence: AAG
ataaagggtattcaaatagg

SEQ ID NO: 47826 - DNA, 20 bp, Artificial Sequence
  Description of Artificial Sequence: Synthetic oligonucleotide
  Target: SCN9A; (+) strand; PAM type: NRG; PAM sequence: CGG
gggtattcaaataggaagac

SEQ ID NO: 47827 - DNA, 20 bp, Artificial Sequence
  Description of Artificial Sequence: Synthetic oligonucleotide
  Target: SCN9A; (+) strand; PAM type: NRG; PAM sequence: AAG
tattcaaataggaagaccgg

SEQ ID NO: 47828 - DNA, 20 bp, Artificial Sequence
  Description of Artificial Sequence: Synthetic oligonucleotide
  Target: SCN9A; (+) strand; PAM type: NRG; PAM sequence: TAG
aaatgacatgattctatatt

SEQ ID NO: 47829 - DNA, 20 bp, Artificial Sequence
  Description of Artificial Sequence: Synthetic oligonucleotide
  Target: SCN9A; (+) strand; PAM type: NRG; PAM sequence: CAG
tttagaaaacccgatcatct

SEQ ID NO: 47830 - DNA, 20 bp, Artificial Sequence
  Description of Artificial Sequence: Synthetic oligonucleotide
  Target: SCN9A; (+) strand; PAM type: NRG; PAM sequence: AAG
ccaaaactctttaaactgat

SEQ ID NO: 47831 - DNA, 20 bp, Artificial Sequence
  Description of Artificial Sequence: Synthetic oligonucleotide
  Target: SCN9A; (+) strand; PAM type: NRG; PAM sequence: CAG
tttaaactgataagcaactt

SEQ ID NO: 47832 - DNA, 20 bp, Artificial Sequence
  Description of Artificial Sequence: Synthetic oligonucleotide
  Target: SCN9A; (+) strand; PAM type: NRG; PAM sequence: AAG
aactgataagcaacttcagc

SEQ ID NO: 47833 - DNA, 20 bp, Artificial Sequence
  Description of Artificial Sequence: Synthetic oligonucleotide
  Target: SCN9A; (+) strand; PAM type: NRG; PAM sequence: AGG
actgataagcaacttcagca

SEQ ID NO: 47834 - DNA, 20 bp, Artificial Sequence
  Description of Artificial Sequence: Synthetic oligonucleotide
  Target: SCN9A; (+) strand; PAM type: NRG; PAM sequence: CAG
aagcaacttcagcaaggtat

SEQ ID NO: 47835 - DNA, 20 bp, Artificial Sequence
  Description of Artificial Sequence: Synthetic oligonucleotide
  Target: SCN9A; (+) strand; PAM type: NRG; PAM sequence: AGG
agcaacttcagcaaggtatc

SEQ ID NO: 47836 - DNA, 20 bp, Artificial Sequence
  Description of Artificial Sequence: Synthetic oligonucleotide
  Target: SCN9A; (+) strand; PAM type: NRG; PAM sequence: CAG
aaatcaatgtgcaaaaatca

SEQ ID NO: 47837 - DNA, 20 bp, Artificial Sequence
  Description of Artificial Sequence: Synthetic oligonucleotide
  Target: SCN9A; (+) strand; PAM type: NRG; PAM sequence: AGG
aatcaatgtgcaaaaatcac

SEQ ID NO: 47838 - DNA, 20 bp, Artificial Sequence
  Description of Artificial Sequence: Synthetic oligonucleotide
  Target: SCN9A; (+) strand; PAM type: NRG; PAM sequence: TAG
gcattcctatacaccaacaa

SEQ ID NO: 47839 - DNA, 20 bp, Artificial Sequence
  Description of Artificial Sequence: Synthetic oligonucleotide
  Target: SCN9A; (+) strand; PAM type: NRG; PAM sequence: AAG
cctatacaccaacaatagac

SEQ ID NO: 47840 - DNA, 20 bp, Artificial Sequence
  Description of Artificial Sequence: Synthetic oligonucleotide
  Target: SCN9A; (+) strand; PAM type: NRG; PAM sequence: CAG
atacaccaacaatagacaag

SEQ ID NO: 47841 - DNA, 20 bp, Artificial Sequence
  Description of Artificial Sequence: Synthetic oligonucleotide
  Target: SCN9A; (+) strand; PAM type: NRG; PAM sequence: GAG
acaccaacaatagacaagca

SEQ ID NO: 47842 - DNA, 20 bp, Artificial Sequence
  Description of Artificial Sequence: Synthetic oligonucleotide
  Target: SCN9A; (+) strand; PAM type: NRG; PAM sequence: GAG
accaacaatagacaagcaga

SEQ ID NO: 47843 - DNA, 20 bp, Artificial Sequence
  Description of Artificial Sequence: Synthetic oligonucleotide
  Target: SCN9A; (+) strand; PAM type: NRG; PAM sequence: AAG
tcccatttgcaattgctata

SEQ ID NO: 47844 - DNA, 20 bp, Artificial Sequence
  Description of Artificial Sequence: Synthetic oligonucleotide
  Target: SCN9A; (+) strand; PAM type: NRG; PAM sequence: GAG
ccatttgcaattgctataaa

SEQ ID NO: 47845 - DNA, 20 bp, Artificial Sequence
  Description of Artificial Sequence: Synthetic oligonucleotide
  Target: SCN9A; (+) strand; PAM type: NRG; PAM sequence: TAG
tataaagagaataaaatacc

SEQ ID NO: 47846 - DNA, 20 bp, Artificial Sequence
  Description of Artificial Sequence: Synthetic oligonucleotide
  Target: SCN9A; (+) strand; PAM type: NRG; PAM sequence: AGG
ataaagagaataaaatacct

SEQ ID NO: 47847 - DNA, 20 bp, Artificial Sequence
  Description of Artificial Sequence: Synthetic oligonucleotide
  Target: SCN9A; (+) strand; PAM type: NRG; PAM sequence: CAG
gaataaaatacctaggaata

SEQ ID NO: 47848 - DNA, 20 bp, Artificial Sequence
  Description of Artificial Sequence: Synthetic oligonucleotide
  Target: SCN9A; (+) strand; PAM type: NRG; PAM sequence: AAG
acctaggaatacagcttaca

SEQ ID NO: 47849 - DNA, 20 bp, Artificial Sequence
  Description of Artificial Sequence: Synthetic oligonucleotide
  Target: SCN9A; (+) strand; PAM type: NRG; PAM sequence: AGG
cctaggaatacagcttacaa

SEQ ID NO: 47850 - DNA, 20 bp, Artificial Sequence
  Description of Artificial Sequence: Synthetic oligonucleotide
  Target: SCN9A; (+) strand; PAM type: NRG; PAM sequence: AAG
acagcttacaaaggatatga

SEQ ID NO: 47851 - DNA, 20 bp, Artificial Sequence
  Description of Artificial Sequence: Synthetic oligonucleotide
  Target: SCN9A; (+) strand; PAM type: NRG; PAM sequence: AAG
aggatatgaaagacctcttc

SEQ ID NO: 47852 - DNA, 20 bp, Artificial Sequence
  Description of Artificial Sequence: Synthetic oligonucleotide
  Target: SCN9A; (+) strand; PAM type: NRG; PAM sequence: AAG
aagacctcttcaagaactac

SEQ ID NO: 47853 - DNA, 20 bp, Artificial Sequence
  Description of Artificial Sequence: Synthetic oligonucleotide
  Target: SCN9A; (+) strand; PAM type: NRG; PAM sequence: AAG
agaactacaagccactactc

SEQ ID NO: 47854 - DNA, 20 bp, Artificial Sequence
  Description of Artificial Sequence: Synthetic oligonucleotide
  Target: SCN9A; (+) strand; PAM type: NRG; PAM sequence: AGG
gaactacaagccactactca

SEQ ID NO: 47855 - DNA, 20 bp, Artificial Sequence
  Description of Artificial Sequence: Synthetic oligonucleotide
  Target: SCN9A; (+) strand; PAM type: NRG; PAM sequence: AAG
aagccactactcaaggaaac

SEQ ID NO: 47856 - DNA, 20 bp, Artificial Sequence
  Description of Artificial Sequence: Synthetic oligonucleotide
  Target: SCN9A; (+) strand; PAM type: NRG; PAM sequence: GAG
gccactactcaaggaaacaa

SEQ ID NO: 47857 - DNA, 20 bp, Artificial Sequence
  Description of Artificial Sequence: Synthetic oligonucleotide
  Target: SCN9A; (+) strand; PAM type: NRG; PAM sequence: GAG
cactactcaaggaaacaaga

SEQ ID NO: 47858 - DNA, 20 bp, Artificial Sequence
  Description of Artificial Sequence: Synthetic oligonucleotide
  Target: SCN9A; (+) strand; PAM type: NRG; PAM sequence: AGG
actactcaaggaaacaagag

SEQ ID NO: 47859 - DNA, 20 bp, Artificial Sequence
  Description of Artificial Sequence: Synthetic oligonucleotide
  Target: SCN9A; (+) strand; PAM type: NRG; PAM sequence: TGG
caagagaggacacaaacaaa

SEQ ID NO: 47860 - DNA, 20 bp, Artificial Sequence
  Description of Artificial Sequence: Synthetic oligonucleotide
  Target: SCN9A; (+) strand; PAM type: NRG; PAM sequence: TGG
ggaaaaacattccatactca

SEQ ID NO: 47861 - DNA, 20 bp, Artificial Sequence
  Description of Artificial Sequence: Synthetic oligonucleotide
  Target: SCN9A; (+) strand; PAM type: NRG; PAM sequence: TAG
aaacattccatactcatgga

SEQ ID NO: 47862 - DNA, 20 bp, Artificial Sequence
  Description of Artificial Sequence: Synthetic oligonucleotide
  Target: SCN9A; (+) strand; PAM type: NRG; PAM sequence: AGG
aacattccatactcatggat

SEQ ID NO: 47863 - DNA, 20 bp, Artificial Sequence
  Description of Artificial Sequence: Synthetic oligonucleotide
  Target: SCN9A; (+) strand; PAM type: NRG; PAM sequence: AAG
attccatactcatggatagg

SEQ ID NO: 47864 - DNA, 20 bp, Artificial Sequence
  Description of Artificial Sequence: Synthetic oligonucleotide
  Target: SCN9A; (+) strand; PAM type: NRG; PAM sequence: TGG
aagaatcaatgtcatgtaaa

SEQ ID NO: 47865 - DNA, 20 bp, Artificial Sequence
  Description of Artificial Sequence: Synthetic oligonucleotide
  Target: SCN9A; (+) strand; PAM type: NRG; PAM sequence: AAG
gtaaatggccatactgccga

SEQ ID NO: 47866 - DNA, 20 bp, Artificial Sequence
  Description of Artificial Sequence: Synthetic oligonucleotide
  Target: SCN9A; (+) strand; PAM type: NRG; PAM sequence: TAG
atactgccgaaagtaattta

SEQ ID NO: 47867 - DNA, 20 bp, Artificial Sequence
  Description of Artificial Sequence: Synthetic oligonucleotide
  Target: SCN9A; (+) strand; PAM type: NRG; PAM sequence: TAG
gtaatttatagattcaatgc

SEQ ID NO: 47868 - DNA, 20 bp, Artificial Sequence
  Description of Artificial Sequence: Synthetic oligonucleotide
  Target: SCN9A; (+) strand; PAM type: NRG; PAM sequence: CAG
aattaccattgacatcttca

SEQ ID NO: 47869 - DNA, 20 bp, Artificial Sequence
  Description of Artificial Sequence: Synthetic oligonucleotide
  Target: SCN9A; (+) strand; PAM type: NRG; PAM sequence: TAG
cattgacatcttcacagaat

SEQ ID NO: 47870 - DNA, 20 bp, Artificial Sequence
  Description of Artificial Sequence: Synthetic oligonucleotide
  Target: SCN9A; (+) strand; PAM type: NRG; PAM sequence: CAG
ctttaaatttcatatgaaac

SEQ ID NO: 47871 - DNA, 20 bp, Artificial Sequence
  Description of Artificial Sequence: Synthetic oligonucleotide
  Target: SCN9A; (+) strand; PAM type: NRG; PAM sequence: AGG
tttaaatttcatatgaaacc

SEQ ID NO: 47872 - DNA, 20 bp, Artificial Sequence
  Description of Artificial Sequence: Synthetic oligonucleotide
  Target: SCN9A; (+) strand; PAM type: NRG; PAM sequence: AAG
aatttcatatgaaaccagga

SEQ ID NO: 47873 - DNA, 20 bp, Artificial Sequence
  Description of Artificial Sequence: Synthetic oligonucleotide
  Target: SCN9A; (+) strand; PAM type: NRG; PAM sequence: GAG
tttcatatgaaaccaggaaa

SEQ ID NO: 47874 - DNA, 20 bp, Artificial Sequence
  Description of Artificial Sequence: Synthetic oligonucleotide
  Target: SCN9A; (+) strand; PAM type: NRG; PAM sequence: TAG
aaaccaggaaagagcacata

SEQ ID NO: 47875 - DNA, 20 bp, Artificial Sequence
  Description of Artificial Sequence: Synthetic oligonucleotide
  Target: SCN9A; (+) strand; PAM type: NRG; PAM sequence: AAG
aggaaagagcacatatagca

SEQ ID NO: 47876 - DNA, 20 bp, Artificial Sequence
  Description of Artificial Sequence: Synthetic oligonucleotide
  Target: SCN9A; (+) strand; PAM type: NRG; PAM sequence: AAG
catatagcaaagacaattct

SEQ ID NO: 47877 - DNA, 20 bp, Artificial Sequence
  Description of Artificial Sequence: Synthetic oligonucleotide
  Target: SCN9A; (+) strand; PAM type: NRG; PAM sequence: AAG
caaagacaattctaagcaaa

SEQ ID NO: 47878 - DNA, 20 bp, Artificial Sequence
  Description of Artificial Sequence: Synthetic oligonucleotide
  Target: SCN9A; (+) strand; PAM type: NRG; PAM sequence: AAG
aattctaagcaaaaagaaca

SEQ ID NO: 47879 - DNA, 20 bp, Artificial Sequence
  Description of Artificial Sequence: Synthetic oligonucleotide
  Target: SCN9A; (+) strand; PAM type: NRG; PAM sequence: TGG
ctaagcaaaaagaacaaagc

SEQ ID NO: 47880 - DNA, 20 bp, Artificial Sequence
  Description of Artificial Sequence: Synthetic oligonucleotide
  Target: SCN9A; (+) strand; PAM type: NRG; PAM sequence: GAG
aagcaaaaagaacaaagctg

SEQ ID NO: 47881 - DNA, 20 bp, Artificial Sequence
  Description of Artificial Sequence: Synthetic oligonucleotide
  Target: SCN9A; (+) strand; PAM type: NRG; PAM sequence: AGG
agcaaaaagaacaaagctgg

SEQ ID NO: 47882 - DNA, 20 bp, Artificial Sequence
  Description of Artificial Sequence: Synthetic oligonucleotide
  Target: SCN9A; (+) strand; PAM type: NRG; PAM sequence: CAG
aagaacaaagctggaggcat

SEQ ID NO: 47883 - DNA, 20 bp, Artificial Sequence
  Description of Artificial Sequence: Synthetic oligonucleotide
  Target: SCN9A; (+) strand; PAM type: NRG; PAM sequence: GAG
ctgacttcaaactatactat

SEQ ID NO: 47884 - DNA, 20 bp, Artificial Sequence
  Description of Artificial Sequence: Synthetic oligonucleotide
  Target: SCN9A; (+) strand; PAM type: NRG; PAM sequence: AGG
tgacttcaaactatactatg

SEQ ID NO: 47885 - DNA, 20 bp, Artificial Sequence
  Description of Artificial Sequence: Synthetic oligonucleotide
  Target: SCN9A; (+) strand; PAM type: NRG; PAM sequence: CAG
caaactatactatgaggtta

SEQ ID NO: 47886 - DNA, 20 bp, Artificial Sequence
  Description of Artificial Sequence: Synthetic oligonucleotide
  Target: SCN9A; (+) strand; PAM type: NRG; PAM sequence: CAG
tgaggttacagtaaccaaaa

SEQ ID NO: 47887 - DNA, 20 bp, Artificial Sequence
  Description of Artificial Sequence: Synthetic oligonucleotide
  Target: SCN9A; (+) strand; PAM type: NRG; PAM sequence: TGG
ttacagtaaccaaaacagca

SEQ ID NO: 47888 - DNA, 20 bp, Artificial Sequence
  Description of Artificial Sequence: Synthetic oligonucleotide
  Target: SCN9A; (+) strand; PAM type: NRG; PAM sequence: TAG
cagtaaccaaaacagcatgg

SEQ ID NO: 47889 - DNA, 20 bp, Artificial Sequence
  Description of Artificial Sequence: Synthetic oligonucleotide
  Target: SCN9A; (+) strand; PAM type: NRG; PAM sequence: TGG
taaccaaaacagcatggtag

SEQ ID NO: 47890 - DNA, 20 bp, Artificial Sequence
  Description of Artificial Sequence: Synthetic oligonucleotide
  Target: SCN9A; (+) strand; PAM type: NRG; PAM sequence: CAG
gcatggtagtggtacccaaa

SEQ ID NO: 47891 - DNA, 20 bp, Artificial Sequence
  Description of Artificial Sequence: Synthetic oligonucleotide
  Target: SCN9A; (+) strand; PAM type: NRG; PAM sequence: TAG
gtggtacccaaacagacata

SEQ ID NO: 47892 - DNA, 20 bp, Artificial Sequence
  Description of Artificial Sequence: Synthetic oligonucleotide
  Target: SCN9A; (+) strand; PAM type: NRG; PAM sequence: AGG
tggtacccaaacagacatat

SEQ ID NO: 47893 - DNA, 20 bp, Artificial Sequence
  Description of Artificial Sequence: Synthetic oligonucleotide
  Target: SCN9A; (+) strand; PAM type: NRG; PAM sequence: TGG
caaacagacatataggccaa

SEQ ID NO: 47894 - DNA, 20 bp, Artificial Sequence
  Description of Artificial Sequence: Synthetic oligonucleotide
  Target: SCN9A; (+) strand; PAM type: NRG; PAM sequence: TAG
agacatataggccaatggaa

SEQ ID NO: 47895 - DNA, 20 bp, Artificial Sequence
  Description of Artificial Sequence: Synthetic oligonucleotide
  Target: SCN9A; (+) strand; PAM type: NRG; PAM sequence: TAG
tataggccaatggaatagaa

SEQ ID NO: 47896 - DNA, 20 bp, Artificial Sequence
  Description of Artificial Sequence: Synthetic oligonucleotide
  Target: SCN9A; (+) strand; PAM type: NRG; PAM sequence: GAG
taggccaatggaatagaata

SEQ ID NO: 47897 - DNA, 20 bp, Artificial Sequence
  Description of Artificial Sequence: Synthetic oligonucleotide
  Target: SCN9A; (+) strand; PAM type: NRG; PAM sequence: CAG
atggaatagaatagagacct

SEQ ID NO: 47898 - DNA, 20 bp, Artificial Sequence
  Description of Artificial Sequence: Synthetic oligonucleotide
  Target: SCN9A; (+) strand; PAM type: NRG; PAM sequence: AAG
aaataacaccacacttctac

SEQ ID NO: 47899 - DNA, 20 bp, Artificial Sequence
  Description of Artificial Sequence: Synthetic oligonucleotide
  Target: SCN9A; (+) strand; PAM type: NRG; PAM sequence: AAG
tcgacaaacctgacaaaaac

SEQ ID NO: 47900 - DNA, 20 bp, Artificial Sequence
  Description of Artificial Sequence: Synthetic oligonucleotide
  Target: SCN9A; (+) strand; PAM type: NRG; PAM sequence: TGG
cctgacaaaaacaagcaatg

SEQ ID NO: 47901 - DNA, 20 bp, Artificial Sequence
  Description of Artificial Sequence: Synthetic oligonucleotide
  Target: SCN9A; (+) strand; PAM type: NRG; PAM sequence: AAG
acaaaaacaagcaatgtgga

SEQ ID NO: 47902 - DNA, 20 bp, Artificial Sequence
  Description of Artificial Sequence: Synthetic oligonucleotide
  Target: SCN9A; (+) strand; PAM type: NRG; PAM sequence: AGG
caaaaacaagcaatgtggaa

SEQ ID NO: 47903 - DNA, 20 bp, Artificial Sequence
  Description of Artificial Sequence: Synthetic oligonucleotide
  Target: SCN9A; (+) strand; PAM type: NRG; PAM sequence: TGG
aggattccctatataataaa

SEQ ID NO: 47904 - DNA, 20 bp, Artificial Sequence
  Description of Artificial Sequence: Synthetic oligonucleotide
  Target: SCN9A; (+) strand; PAM type: NRG; PAM sequence: TGG
ccctatataataaatggtgc

SEQ ID NO: 47905 - DNA, 20 bp, Artificial Sequence
  Description of Artificial Sequence: Synthetic oligonucleotide
  Target: SCN9A; (+) strand; PAM type: NRG; PAM sequence: GGG
cctatataataaatggtgct

SEQ ID NO: 47906 - DNA, 20 bp, Artificial Sequence
  Description of Artificial Sequence: Synthetic oligonucleotide
  Target: SCN9A; (+) strand; PAM type: NRG; PAM sequence: GGG
ctatataataaatggtgctg

SEQ ID NO: 47907 - DNA, 20 bp, Artificial Sequence
  Description of Artificial Sequence: Synthetic oligonucleotide
  Target: SCN9A; (+) strand; PAM type: NRG; PAM sequence: AAG
tataataaatggtgctgggg

SEQ ID NO: 47908 - DNA, 20 bp, Artificial Sequence
  Description of Artificial Sequence: Synthetic oligonucleotide
  Target: SCN9A; (+) strand; PAM type: NRG; PAM sequence: TGG
ataaatggtgctggggaagc

SEQ ID NO: 47909 - DNA, 20 bp, Artificial Sequence
  Description of Artificial Sequence: Synthetic oligonucleotide
  Target: SCN9A; (+) strand; PAM type: NRG; PAM sequence: TAG
atggtgctggggaagctggc

SEQ ID NO: 47910 - DNA, 20 bp, Artificial Sequence
  Description of Artificial Sequence: Synthetic oligonucleotide
  Target: SCN9A; (+) strand; PAM type: NRG; PAM sequence: CAG
ggaagctggctagccatatg

SEQ ID NO: 47911 - DNA, 20 bp, Artificial Sequence
  Description of Artificial Sequence: Synthetic oligonucleotide
  Target: SCN9A; (+) strand; PAM type: NRG; PAM sequence: TGG
catatgcagaaaactgaaac

SEQ ID NO: 47912 - DNA, 20 bp, Artificial Sequence
  Description of Artificial Sequence: Synthetic oligonucleotide
  Target: SCN9A; (+) strand; PAM type: NRG; PAM sequence: GGG
atatgcagaaaactgaaact

SEQ ID NO: 47913 - DNA, 20 bp, Artificial Sequence
  Description of Artificial Sequence: Synthetic oligonucleotide
  Target: SCN9A; (+) strand; PAM type: NRG; PAM sequence: AAG
ccttatacaaaaattaactc

SEQ ID NO: 47914 - DNA, 20 bp, Artificial Sequence
  Description of Artificial Sequence: Synthetic oligonucleotide
  Target: SCN9A; (+) strand; PAM type: NRG; PAM sequence: TGG
atacaaaaattaactcaaga

SEQ ID NO: 47915 - DNA, 20 bp, Artificial Sequence
  Description of Artificial Sequence: Synthetic oligonucleotide
  Target: SCN9A; (+) strand; PAM type: NRG; PAM sequence: AAG
aattaactcaagatggatta

SEQ ID NO: 47916 - DNA, 20 bp, Artificial Sequence
  Description of Artificial Sequence: Synthetic oligonucleotide
  Target: SCN9A; (+) strand; PAM type: NRG; PAM sequence: TAG
accccaaaccatgaaaaccc

SEQ ID NO: 47917 - DNA, 20 bp, Artificial Sequence
  Description of Artificial Sequence: Synthetic oligonucleotide
  Target: SCN9A; (+) strand; PAM type: NRG; PAM sequence: AAG
ccaaaccatgaaaaccctag

SEQ ID NO: 47918 - DNA, 20 bp, Artificial Sequence
  Description of Artificial Sequence: Synthetic oligonucleotide
  Target: SCN9A; (+) strand; PAM type: NRG; PAM sequence: TAG
gaaaaccctagaagaaaacc

SEQ ID NO: 47919 - DNA, 20 bp, Artificial Sequence
  Description of Artificial Sequence: Synthetic oligonucleotide
  Target: SCN9A; (+) strand; PAM type: NRG; PAM sequence: AGG
aaaaccctagaagaaaacct

SEQ ID NO: 47920 - DNA, 20 bp, Artificial Sequence
  Description of Artificial Sequence: Synthetic oligonucleotide
  Target: SCN9A; (+) strand; PAM type: NRG; PAM sequence: CAG
aaaacctaggcaacaccatt

SEQ ID NO: 47921 - DNA, 20 bp, Artificial Sequence
  Description of Artificial Sequence: Synthetic oligonucleotide
  Target: SCN9A; (+) strand; PAM type: NRG; PAM sequence: AGG
aaacctaggcaacaccattc

SEQ ID NO: 47922 - DNA, 20 bp, Artificial Sequence
  Description of Artificial Sequence: Synthetic oligonucleotide
  Target: SCN9A; (+) strand; PAM type: NRG; PAM sequence: TAG
aggcaacaccattcaggaaa

SEQ ID NO: 47923 - DNA, 20 bp, Artificial Sequence
  Description of Artificial Sequence: Synthetic oligonucleotide
  Target: SCN9A; (+) strand; PAM type: NRG; PAM sequence: AGG
ggcaacaccattcaggaaat

SEQ ID NO: 47924 - DNA, 20 bp, Artificial Sequence
  Description of Artificial Sequence: Synthetic oligonucleotide
  Target: SCN9A; (+) strand; PAM type: NRG; PAM sequence: TGG
caccattcaggaaataggca

SEQ ID NO: 47925 - DNA, 20 bp, Artificial Sequence
  Description of Artificial Sequence: Synthetic oligonucleotide
  Target: SCN9A; (+) strand; PAM type: NRG; PAM sequence: GGG
accattcaggaaataggcat

SEQ ID NO: 47926 - DNA, 20 bp, Artificial Sequence
  Description of Artificial Sequence: Synthetic oligonucleotide
  Target: SCN9A; (+) strand; PAM type: NRG; PAM sequence: AAG
tcaggaaataggcatgggca

SEQ ID NO: 47927 - DNA, 20 bp, Artificial Sequence
  Description of Artificial Sequence: Synthetic oligonucleotide
  Target: SCN9A; (+) strand; PAM type: NRG; PAM sequence: AAG
cttcatgacaaaaataccaa

SEQ ID NO: 47928 - DNA, 20 bp, Artificial Sequence
  Description of Artificial Sequence: Synthetic oligonucleotide
  Target: SCN9A; (+) strand; PAM type: NRG; PAM sequence: AAG
accaaaagcaattgcaacca

SEQ ID NO: 47929 - DNA, 20 bp, Artificial Sequence
  Description of Artificial Sequence: Synthetic oligonucleotide
  Target: SCN9A; (+) strand; PAM type: NRG; PAM sequence: TGG
ccaaagccaaaattgacaaa

SEQ ID NO: 47930 - DNA, 20 bp, Artificial Sequence
  Description of Artificial Sequence: Synthetic oligonucleotide
  Target: SCN9A; (+) strand; PAM type: NRG; PAM sequence: GGG
caaagccaaaattgacaaat

SEQ ID NO: 47931 - DNA, 20 bp, Artificial Sequence
  Description of Artificial Sequence: Synthetic oligonucleotide
  Target: SCN9A; (+) strand; PAM type: NRG; PAM sequence: AAG
aatgggatataactaaacta

SEQ ID NO: 47932 - DNA, 20 bp, Artificial Sequence
  Description of Artificial Sequence: Synthetic oligonucleotide
  Target: SCN9A; (+) strand; PAM type: NRG; PAM sequence: GAG
tgggatataactaaactaaa

SEQ ID NO: 47933 - DNA, 20 bp, Artificial Sequence
  Description of Artificial Sequence: Synthetic oligonucleotide
  Target: SCN9A; (+) strand; PAM type: NRG; PAM sequence: CAG
taaactaaagagcttctgca

SEQ ID NO: 47934 - DNA, 20 bp, Artificial Sequence
  Description of Artificial Sequence: Synthetic oligonucleotide
  Target: SCN9A; (+) strand; PAM type: NRG; PAM sequence: AAG
aaagagcttctgcacagcaa

SEQ ID NO: 47935 - DNA, 20 bp, Artificial Sequence
  Description of Artificial Sequence: Synthetic oligonucleotide
  Target: SCN9A; (+) strand; PAM type: NRG; PAM sequence: CAG
acagcaaaagaaactaacat

SEQ ID NO: 47936 - DNA, 20 bp, Artificial Sequence
  Description of Artificial Sequence: Synthetic oligonucleotide
  Target: SCN9A; (+) strand; PAM type: NRG; PAM sequence: GAG
agcaaaagaaactaacatca

SEQ ID NO: 47937 - DNA, 20 bp, Artificial Sequence
  Description of Artificial Sequence: Synthetic oligonucleotide
  Target: SCN9A; (+) strand; PAM type: NRG; PAM sequence: CAG
gaaactaacatcagagtgaa

SEQ ID NO: 47938 - DNA, 20 bp, Artificial Sequence
  Description of Artificial Sequence: Synthetic oligonucleotide
  Target: SCN9A; (+) strand; PAM type: NRG; PAM sequence: AGG
aaactaacatcagagtgaac

SEQ ID NO: 47939 - DNA, 20 bp, Artificial Sequence
  Description of Artificial Sequence: Synthetic oligonucleotide
  Target: SCN9A; (+) strand; PAM type: NRG; PAM sequence: TAG
cagagtgaacaggcaaacta

SEQ ID NO: 47940 - DNA, 20 bp, Artificial Sequence
  Description of Artificial Sequence: Synthetic oligonucleotide
  Target: SCN9A; (+) strand; PAM type: NRG; PAM sequence: TGG
tgaacaggcaaactatagaa

SEQ ID NO: 47941 - DNA, 20 bp, Artificial Sequence
  Description of Artificial Sequence: Synthetic oligonucleotide
  Target: SCN9A; (+) strand; PAM type: NRG; PAM sequence: GGG
gaacaggcaaactatagaat

SEQ ID NO: 47942 - DNA, 20 bp, Artificial Sequence
  Description of Artificial Sequence: Synthetic oligonucleotide
  Target: SCN9A; (+) strand; PAM type: NRG; PAM sequence: GAG
acaggcaaactatagaatgg

SEQ ID NO: 47943 - DNA, 20 bp, Artificial Sequence
  Description of Artificial Sequence: Synthetic oligonucleotide
  Target: SCN9A; (+) strand; PAM type: NRG; PAM sequence: TGG
tatagaatgggagaaaaatt

SEQ ID NO: 47944 - DNA, 20 bp, Artificial Sequence
  Description of Artificial Sequence: Synthetic oligonucleotide
  Target: SCN9A; (+) strand; PAM type: NRG; PAM sequence: AAG
ggcaatctacccatctgaca

SEQ ID NO: 47945 - DNA, 20 bp, Artificial Sequence
  Description of Artificial Sequence: Synthetic oligonucleotide
  Target: SCN9A; (+) strand; PAM type: NRG; PAM sequence: AGG
gcaatctacccatctgacaa

SEQ ID NO: 47946 - DNA, 20 bp, Artificial Sequence
  Description of Artificial Sequence: Synthetic oligonucleotide
  Target: SCN9A; (+) strand; PAM type: NRG; PAM sequence: AAG
tctgacaaaggtctaatatt

SEQ ID NO: 47947 - DNA, 20 bp, Artificial Sequence
  Description of Artificial Sequence: Synthetic oligonucleotide
  Target: SCN9A; (+) strand; PAM type: NRG; PAM sequence: AAG
gtctaatattaagaatctac

SEQ ID NO: 47948 - DNA, 20 bp, Artificial Sequence
  Description of Artificial Sequence: Synthetic oligonucleotide
  Target: SCN9A; (+) strand; PAM type: NRG; PAM sequence: AAG
agtaacttaaacaaatttat

SEQ ID NO: 47949 - DNA, 20 bp, Artificial Sequence
  Description of Artificial Sequence: Synthetic oligonucleotide
  Target: SCN9A; (+) strand; PAM type: NRG; PAM sequence: AAG
taatatacttttatcataca

SEQ ID NO: 47950 - DNA, 20 bp, Artificial Sequence
  Description of Artificial Sequence: Synthetic oligonucleotide
  Target: SCN9A; (+) strand; PAM type: NRG; PAM sequence: AAG
ttatcatacaaagcatttta

SEQ ID NO: 47951 - DNA, 20 bp, Artificial Sequence
  Description of Artificial Sequence: Synthetic oligonucleotide
  Target: SCN9A; (+) strand; PAM type: NRG; PAM sequence: TAG
aaagcattttaaagtgaatt

SEQ ID NO: 47952 - DNA, 20 bp, Artificial Sequence
  Description of Artificial Sequence: Synthetic oligonucleotide
  Target: SCN9A; (+) strand; PAM type: NRG; PAM sequence: AGG
aagcattttaaagtgaattt

SEQ ID NO: 47953 - DNA, 20 bp, Artificial Sequence
  Description of Artificial Sequence: Synthetic oligonucleotide
  Target: SCN9A; (+) strand; PAM type: NRG; PAM sequence: TAG
attttaaagtgaatttagga

SEQ ID NO: 47954 - DNA, 20 bp, Artificial Sequence
  Description of Artificial Sequence: Synthetic oligonucleotide
  Target: SCN9A; (+) strand; PAM type: NRG; PAM sequence: AAG
actgatattaaatgaaaaat

SEQ ID NO: 47955 - DNA, 20 bp, Artificial Sequence
  Description of Artificial Sequence: Synthetic oligonucleotide
  Target: SCN9A; (+) strand; PAM type: NRG; PAM sequence: GAG
atttgtgtttctttaatttt

SEQ ID NO: 47956 - DNA, 20 bp, Artificial Sequence
  Description of Artificial Sequence: Synthetic oligonucleotide
  Target: SCN9A; (+) strand; PAM type: NRG; PAM sequence: AAG
tgtttctttaattttgagta

SEQ ID NO: 47957 - DNA, 20 bp, Artificial Sequence
  Description of Artificial Sequence: Synthetic oligonucleotide
  Target: SCN9A; (+) strand; PAM type: NRG; PAM sequence: AGG
gtttctttaattttgagtaa

SEQ ID NO: 47958 - DNA, 20 bp, Artificial Sequence
  Description of Artificial Sequence: Synthetic oligonucleotide
  Target: SCN9A; (+) strand; PAM type: NRG; PAM sequence: AAG
gcattcccatttttgctgta

SEQ ID NO: 47959 - DNA, 20 bp, Artificial Sequence
  Description of Artificial Sequence: Synthetic oligonucleotide
  Target: SCN9A; (+) strand; PAM type: NRG; PAM sequence: CGG
gaattcatttataatattct

SEQ ID NO: 47960 - DNA, 20 bp, Artificial Sequence
  Description of Artificial Sequence: Synthetic oligonucleotide
  Target: SCN9A; (+) strand; PAM type: NRG; PAM sequence: AAG
ttataatattctcggaaata

SEQ ID NO: 47961 - DNA, 20 bp, Artificial Sequence
  Description of Artificial Sequence: Synthetic oligonucleotide
  Target: SCN9A; (+) strand; PAM type: NRG; PAM sequence: TAG
gaaataaagtaaatataaaa

SEQ ID NO: 47962 - DNA, 20 bp, Artificial Sequence
  Description of Artificial Sequence: Synthetic oligonucleotide
  Target: SCN9A; (+) strand; PAM type: NRG; PAM sequence: AGG
aaataaagtaaatataaaat

SEQ ID NO: 47963 - DNA, 20 bp, Artificial Sequence
  Description of Artificial Sequence: Synthetic oligonucleotide
  Target: SCN9A; (+) strand; PAM type: NRG; PAM sequence: AAG
aaatataaaataggccaaaa

SEQ ID NO: 47964 - DNA, 20 bp, Artificial Sequence
  Description of Artificial Sequence: Synthetic oligonucleotide
  Target: SCN9A; (+) strand; PAM type: NRG; PAM sequence: CAG
ggccaaaaaagaaaaaaaaa

SEQ ID NO: 47965 - DNA, 20 bp, Artificial Sequence
  Description of Artificial Sequence: Synthetic oligonucleotide
  Target: SCN9A; (+) strand; PAM type: NRG; PAM sequence: CAG
aagaaaaaaaaacagatctg

SEQ ID NO: 47966 - DNA, 20 bp, Artificial Sequence
  Description of Artificial Sequence: Synthetic oligonucleotide
  Target: SCN9A; (+) strand; PAM type: NRG; PAM sequence: GAG
aacagatctgcagctattct

SEQ ID NO: 47967 - DNA, 20 bp, Artificial Sequence
  Description of Artificial Sequence: Synthetic oligonucleotide
  Target: SCN9A; (+) strand; PAM type: NRG; PAM sequence: AAG
atctgcagctattctgagaa

SEQ ID NO: 47968 - DNA, 20 bp, Artificial Sequence
  Description of Artificial Sequence: Synthetic oligonucleotide
  Target: SCN9A; (+) strand; PAM type: NRG; PAM sequence: TAG
aatcattgttatgtgtacta

SEQ ID NO: 47969 - DNA, 20 bp, Artificial Sequence
  Description of Artificial Sequence: Synthetic oligonucleotide
  Target: SCN9A; (+) strand; PAM type: NRG; PAM sequence: TGG
gtactatagaataatcattt

SEQ ID NO: 47970 - DNA, 20 bp, Artificial Sequence
  Description of Artificial Sequence: Synthetic oligonucleotide
  Target: SCN9A; (+) strand; PAM type: NRG; PAM sequence: TGG
cattttggtctccttccttt

SEQ ID NO: 47971 - DNA, 20 bp, Artificial Sequence
  Description of Artificial Sequence: Synthetic oligonucleotide
  Target: SCN9A; (+) strand; PAM type: NRG; PAM sequence: TGG
tggtctccttccttttggct

SEQ ID NO: 47972 - DNA, 20 bp, Artificial Sequence
  Description of Artificial Sequence: Synthetic oligonucleotide
  Target: SCN9A; (+) strand; PAM type: NRG; PAM sequence: GAG
ttccttttggcttggctgct

SEQ ID NO: 47973 - DNA, 20 bp, Artificial Sequence
  Description of Artificial Sequence: Synthetic oligonucleotide
  Target: SCN9A; (+) strand; PAM type: NRG; PAM sequence: AAG
cttggctgctgagactatac

SEQ ID NO: 47974 - DNA, 20 bp, Artificial Sequence
  Description of Artificial Sequence: Synthetic oligonucleotide
  Target: SCN9A; (+) strand; PAM type: NRG; PAM sequence: TGG
gctgagactatacaagtaaa

SEQ ID NO: 47975 - DNA, 20 bp, Artificial Sequence
  Description of Artificial Sequence: Synthetic oligonucleotide
  Target: SCN9A; (+) strand; PAM type: NRG; PAM sequence: GAG
tgagactatacaagtaaatg

SEQ ID NO: 47976 - DNA, 20 bp, Artificial Sequence
  Description of Artificial Sequence: Synthetic oligonucleotide
  Target: SCN9A; (+) strand; PAM type: NRG; PAM sequence: CAG
atacaagtaaatggagacca

SEQ ID NO: 47977 - DNA, 20 bp, Artificial Sequence
  Description of Artificial Sequence: Synthetic oligonucleotide
  Target: SCN9A; (+) strand; PAM type: NRG; PAM sequence: AAG
taaatggagaccacagcccc

SEQ ID NO: 47978 - DNA, 20 bp, Artificial Sequence
  Description of Artificial Sequence: Synthetic oligonucleotide
  Target: SCN9A; (+) strand; PAM type: NRG; PAM sequence: GAG
aatggagaccacagccccaa

SEQ ID NO: 47979 - DNA, 20 bp, Artificial Sequence
  Description of Artificial Sequence: Synthetic oligonucleotide
  Target: SCN9A; (+) strand; PAM type: NRG; PAM sequence: AGG
atggagaccacagccccaag

SEQ ID NO: 47980 - DNA, 20 bp, Artificial Sequence
  Description of Artificial Sequence: Synthetic oligonucleotide
  Target: SCN9A; (+) strand; PAM type: NRG; PAM sequence: AAG
gccccaagaggttcacattc

SEQ ID NO: 47981 - DNA, 20 bp, Artificial Sequence
  Description of Artificial Sequence: Synthetic oligonucleotide
  Target: SCN9A; (+) strand; PAM type: NRG; PAM sequence: TAG
caagaggttcacattcaagt

SEQ ID NO: 47982 - DNA, 20 bp, Artificial Sequence
  Description of Artificial Sequence: Synthetic oligonucleotide
  Target: SCN9A; (+) strand; PAM type: NRG; PAM sequence: GAG
agaggttcacattcaagtta

SEQ ID NO: 47983 - DNA, 20 bp, Artificial Sequence
  Description of Artificial Sequence: Synthetic oligonucleotide
  Target: SCN9A; (+) strand; PAM type: NRG; PAM sequence: AGG
gaggttcacattcaagttag

SEQ ID NO: 47984 - DNA, 20 bp, Artificial Sequence
  Description of Artificial Sequence: Synthetic oligonucleotide
  Target: SCN9A; (+) strand; PAM type: NRG; PAM sequence: TAG
cacattcaagttagaggaaa

SEQ ID NO: 47985 - DNA, 20 bp, Artificial Sequence
  Description of Artificial Sequence: Synthetic oligonucleotide
  Target: SCN9A; (+) strand; PAM type: NRG; PAM sequence: AAG
tgaattaccacttgcaatac

SEQ ID NO: 47986 - DNA, 20 bp, Artificial Sequence
  Description of Artificial Sequence: Synthetic oligonucleotide
  Target: SCN9A; (+) strand; PAM type: NRG; PAM sequence: GAG
aattaccacttgcaatacaa

SEQ ID NO: 47987 - DNA, 20 bp, Artificial Sequence
  Description of Artificial Sequence: Synthetic oligonucleotide
  Target: SCN9A; (+) strand; PAM type: NRG; PAM sequence: TGG
caagagatcaatgatataaa

SEQ ID NO: 47988 - DNA, 20 bp, Artificial Sequence
  Description of Artificial Sequence: Synthetic oligonucleotide
  Target: SCN9A; (+) strand; PAM type: NRG; PAM sequence: AAG
gagatcaatgatataaatgg

SEQ ID NO: 47989 - DNA, 20 bp, Artificial Sequence
  Description of Artificial Sequence: Synthetic oligonucleotide
  Target: SCN9A; (+) strand; PAM type: NRG; PAM sequence: TGG
gaagaaaatacaaaaaatca

SEQ ID NO: 47990 - DNA, 20 bp, Artificial Sequence
  Description of Artificial Sequence: Synthetic oligonucleotide
  Target: SCN9A; (+) strand; PAM type: NRG; PAM sequence: AAG
gaaaatacaaaaaatcatgg

SEQ ID NO: 47991 - DNA, 20 bp, Artificial Sequence
  Description of Artificial Sequence: Synthetic oligonucleotide
  Target: SCN9A; (+) strand; PAM type: NRG; PAM sequence: CAG
caaaaaatcatggaagtcta

SEQ ID NO: 47992 - DNA, 20 bp, Artificial Sequence
  Description of Artificial Sequence: Synthetic oligonucleotide
  Target: SCN9A; (+) strand; PAM type: NRG; PAM sequence: TGG
aaatcatggaagtctacagt

SEQ ID NO: 47993 - DNA, 20 bp, Artificial Sequence
  Description of Artificial Sequence: Synthetic oligonucleotide
  Target: SCN9A; (+) strand; PAM type: NRG; PAM sequence: GGG
aatcatggaagtctacagtt

SEQ ID NO: 47994 - DNA, 20 bp, Artificial Sequence
  Description of Artificial Sequence: Synthetic oligonucleotide
  Target: SCN9A; (+) strand; PAM type: NRG; PAM sequence: GAG
tcatggaagtctacagttgg

SEQ ID NO: 47995 - DNA, 20 bp, Artificial Sequence
  Description of Artificial Sequence: Synthetic oligonucleotide
  Target: SCN9A; (+) strand; PAM type: NRG; PAM sequence: TGG
acagttgggagcaattgatt

SEQ ID NO: 47996 - DNA, 20 bp, Artificial Sequence
  Description of Artificial Sequence: Synthetic oligonucleotide
  Target: SCN9A; (+) strand; PAM type: NRG; PAM sequence: GGG
cagttgggagcaattgattt

SEQ ID NO: 47997 - DNA, 20 bp, Artificial Sequence
  Description of Artificial Sequence: Synthetic oligonucleotide
  Target: SCN9A; (+) strand; PAM type: NRG; PAM sequence: GAG
gttgggagcaattgatttgg

SEQ ID NO: 47998 - DNA, 20 bp, Artificial Sequence
  Description of Artificial Sequence: Synthetic oligonucleotide
  Target: SCN9A; (+) strand; PAM type: NRG; PAM sequence: GAG
tgggagcaattgatttggga

SEQ ID NO: 47999 - DNA, 20 bp, Artificial Sequence
  Description of Artificial Sequence: Synthetic oligonucleotide
  Target: SCN9A; (+) strand; PAM type: NRG; PAM sequence: TAG
tgatttgggagagaaaaact

SEQ ID NO: 48000 - DNA, 20 bp, Artificial Sequence
  Description of Artificial Sequence: Synthetic oligonucleotide
  Target: SCN9A; (+) strand; PAM type: NRG; PAM sequence: GAG
atttgggagagaaaaactta

SEQ ID NO: 48001 - DNA, 20 bp, Artificial Sequence
  Description of Artificial Sequence: Synthetic oligonucleotide
  Target: SCN9A; (+) strand; PAM type: NRG; PAM sequence: TAG
attgcatctttaactttaaa

SEQ ID NO: 48002 - DNA, 20 bp, Artificial Sequence
  Description of Artificial Sequence: Synthetic oligonucleotide
  Target: SCN9A; (+) strand; PAM type: NRG; PAM sequence: AGG
ttgcatctttaactttaaat

SEQ ID NO: 48003 - DNA, 20 bp, Artificial Sequence
  Description of Artificial Sequence: Synthetic oligonucleotide
  Target: SCN9A; (+) strand; PAM type: NRG; PAM sequence: GAG
gcatctttaactttaaatag

SEQ ID NO: 48004 - DNA, 20 bp, Artificial Sequence
  Description of Artificial Sequence: Synthetic oligonucleotide
  Target: SCN9A; (+) strand; PAM type: NRG; PAM sequence: TGG
aggagttcaaaaataaaaca

SEQ ID NO: 48005 - DNA, 20 bp, Artificial Sequence
  Description of Artificial Sequence: Synthetic oligonucleotide
  Target: SCN9A; (+) strand; PAM type: NRG; PAM sequence: GAG
gttcaaaaataaaacatggt

SEQ ID NO: 48006 - DNA, 20 bp, Artificial Sequence
  Description of Artificial Sequence: Synthetic oligonucleotide
  Target: SCN9A; (+) strand; PAM type: NRG; PAM sequence: CAG
caaaaataaaacatggtgag

SEQ ID NO: 48007 - DNA, 20 bp, Artificial Sequence
  Description of Artificial Sequence: Synthetic oligonucleotide
  Target: SCN9A; (+) strand; PAM type: NRG; PAM sequence: AGG
aaaaataaaacatggtgagc

SEQ ID NO: 48008 - DNA, 20 bp, Artificial Sequence
  Description of Artificial Sequence: Synthetic oligonucleotide
  Target: SCN9A; (+) strand; PAM type: NRG; PAM sequence: CAG
catggtgagcaggtgaacat

SEQ ID NO: 48009 - DNA, 20 bp, Artificial Sequence
  Description of Artificial Sequence: Synthetic oligonucleotide
  Target: SCN9A; (+) strand; PAM type: NRG; PAM sequence: GAG
tggtgagcaggtgaacatca

SEQ ID NO: 48010 - DNA, 20 bp, Artificial Sequence
  Description of Artificial Sequence: Synthetic oligonucleotide
  Target: SCN9A; (+) strand; PAM type: NRG; PAM sequence: GAG
gtgagcaggtgaacatcaga

SEQ ID NO: 48011 - DNA, 20 bp, Artificial Sequence
  Description of Artificial Sequence: Synthetic oligonucleotide
  Target: SCN9A; (+) strand; PAM type: NRG; PAM sequence: CAG
atcagagagcctcttctctt

SEQ ID NO: 48012 - DNA, 20 bp, Artificial Sequence
  Description of Artificial Sequence: Synthetic oligonucleotide
  Target: SCN9A; (+) strand; PAM type: NRG; PAM sequence: AGG
tcagagagcctcttctcttc

SEQ ID NO: 48013 - DNA, 20 bp, Artificial Sequence
  Description of Artificial Sequence: Synthetic oligonucleotide
  Target: SCN9A; (+) strand; PAM type: NRG; PAM sequence: AAG
tcttctcttcaggccatccc

SEQ ID NO: 48014 - DNA, 20 bp, Artificial Sequence
  Description of Artificial Sequence: Synthetic oligonucleotide
  Target: SCN9A; (+) strand; PAM type: NRG; PAM sequence: TGG
caggccatcccaagcacgca

SEQ ID NO: 48015 - DNA, 20 bp, Artificial Sequence
  Description of Artificial Sequence: Synthetic oligonucleotide
  Target: SCN9A; (+) strand; PAM type: NRG; PAM sequence: CAG
tcccaagcacgcatggaaaa

SEQ ID NO: 48016 - DNA, 20 bp, Artificial Sequence
  Description of Artificial Sequence: Synthetic oligonucleotide
  Target: SCN9A; (+) strand; PAM type: NRG; PAM sequence: CAG
catggaaaacagtccatgtg

SEQ ID NO: 48017 - DNA, 20 bp, Artificial Sequence
  Description of Artificial Sequence: Synthetic oligonucleotide
  Target: SCN9A; (+) strand; PAM type: NRG; PAM sequence: AGG
atggaaaacagtccatgtgc

SEQ ID NO: 48018 - DNA, 20 bp, Artificial Sequence
  Description of Artificial Sequence: Synthetic oligonucleotide
  Target: SCN9A; (+) strand; PAM type: NRG; PAM sequence: GAG
ggaaaacagtccatgtgcag

SEQ ID NO: 48019 - DNA, 20 bp, Artificial Sequence
  Description of Artificial Sequence: Synthetic oligonucleotide
  Target: SCN9A; (+) strand; PAM type: NRG; PAM sequence: CAG
aaacagtccatgtgcaggag

SEQ ID NO: 48020 - DNA, 20 bp, Artificial Sequence
  Description of Artificial Sequence: Synthetic oligonucleotide
  Target: SCN9A; (+) strand; PAM type: NRG; PAM sequence: GAG
tccatgtgcaggagcagctt

SEQ ID NO: 48021 - DNA, 20 bp, Artificial Sequence
  Description of Artificial Sequence: Synthetic oligonucleotide
  Target: SCN9A; (+) strand; PAM type: NRG; PAM sequence: CAG
agcagcttgagaaaacatta

SEQ ID NO: 48022 - DNA, 20 bp, Artificial Sequence
  Description of Artificial Sequence: Synthetic oligonucleotide
  Target: SCN9A; (+) strand; PAM type: NRG; PAM sequence: TGG
gaaaacattacagtatgtcc

SEQ ID NO: 48023 - DNA, 20 bp, Artificial Sequence
  Description of Artificial Sequence: Synthetic oligonucleotide
  Target: SCN9A; (+) strand; PAM type: NRG; PAM sequence: TAG
agtatgtcctggtacttaac

SEQ ID NO: 48024 - DNA, 20 bp, Artificial Sequence
  Description of Artificial Sequence: Synthetic oligonucleotide
  Target: SCN9A; (+) strand; PAM type: NRG; PAM sequence: AGG
gtatgtcctggtacttaact

SEQ ID NO: 48025 - DNA, 20 bp, Artificial Sequence
  Description of Artificial Sequence: Synthetic oligonucleotide
  Target: SCN9A; (+) strand; PAM type: NRG; PAM sequence: TGG
ggtacttaactaggacccca

SEQ ID NO: 48026 - DNA, 20 bp, Artificial Sequence
  Description of Artificial Sequence: Synthetic oligonucleotide
  Target: SCN9A; (+) strand; PAM type: NRG; PAM sequence: GGG
gtacttaactaggaccccat

SEQ ID NO: 48027 - DNA, 20 bp, Artificial Sequence
  Description of Artificial Sequence: Synthetic oligonucleotide
  Target: SCN9A; (+) strand; PAM type: NRG; PAM sequence: CAG
accccatgggatgatatact

SEQ ID NO: 48028 - DNA, 20 bp, Artificial Sequence
  Description of Artificial Sequence: Synthetic oligonucleotide
  Target: SCN9A; (+) strand; PAM type: NRG; PAM sequence: AGG
ccccatgggatgatatactc

SEQ ID NO: 48029 - DNA, 20 bp, Artificial Sequence
  Description of Artificial Sequence: Synthetic oligonucleotide
  Target: SCN9A; (+) strand; PAM type: NRG; PAM sequence: AAG
catgggatgatatactcagg

SEQ ID NO: 48030 - DNA, 20 bp, Artificial Sequence
  Description of Artificial Sequence: Synthetic oligonucleotide
  Target: SCN9A; (+) strand; PAM type: NRG; PAM sequence: AGG
atgggatgatatactcagga

SEQ ID NO: 48031 - DNA, 20 bp, Artificial Sequence
  Description of Artificial Sequence: Synthetic oligonucleotide
  Target: SCN9A; (+) strand; PAM type: NRG; PAM sequence: GAG
gatgatatactcaggaaggc

SEQ ID NO: 48032 - DNA, 20 bp, Artificial Sequence
  Description of Artificial Sequence: Synthetic oligonucleotide
  Target: SCN9A; (+) strand; PAM type: NRG; PAM sequence: GAG
tgatatactcaggaaggcga

SEQ ID NO: 48033 - DNA, 20 bp, Artificial Sequence
  Description of Artificial Sequence: Synthetic oligonucleotide
  Target: SCN9A; (+) strand; PAM type: NRG; PAM sequence: TAG
actcaggaaggcgagagatc

SEQ ID NO: 48034 - DNA, 20 bp, Artificial Sequence
  Description of Artificial Sequence: Synthetic oligonucleotide
  Target: SCN9A; (+) strand; PAM type: NRG; PAM sequence: GAG
tcaggaaggcgagagatcta

SEQ ID NO: 48035 - DNA, 20 bp, Artificial Sequence
  Description of Artificial Sequence: Synthetic oligonucleotide
  Target: SCN9A; (+) strand; PAM type: NRG; PAM sequence: CAG
atctagagattaaatatgcc

SEQ ID NO: 48036 - DNA, 20 bp, Artificial Sequence
  Description of Artificial Sequence: Synthetic oligonucleotide
  Target: SCN9A; (+) strand; PAM type: NRG; PAM sequence: AAG
gagattaaatatgcccagaa

SEQ ID NO: 48037 - DNA, 20 bp, Artificial Sequence
  Description of Artificial Sequence: Synthetic oligonucleotide
  Target: SCN9A; (+) strand; PAM type: NRG; PAM sequence: AAG
taaatatgcccagaaaagat

SEQ ID NO: 48038 - DNA, 20 bp, Artificial Sequence
  Description of Artificial Sequence: Synthetic oligonucleotide
  Target: SCN9A; (+) strand; PAM type: NRG; PAM sequence: GAG
aagaaaattatttatgattc

SEQ ID NO: 48039 - DNA, 20 bp, Artificial Sequence
  Description of Artificial Sequence: Synthetic oligonucleotide
  Target: SCN9A; (+) strand; PAM type: NRG; PAM sequence: TAG
tcgagaactacccatattat

SEQ ID NO: 48040 - DNA, 20 bp, Artificial Sequence
  Description of Artificial Sequence: Synthetic oligonucleotide
  Target: SCN9A; (+) strand; PAM type: NRG; PAM sequence: TGG
actacccatattattagtga

SEQ ID NO: 48041 - DNA, 20 bp, Artificial Sequence
  Description of Artificial Sequence: Synthetic oligonucleotide
  Target: SCN9A; (+) strand; PAM type: NRG; PAM sequence: GGG
ctacccatattattagtgat

SEQ ID NO: 48042 - DNA, 20 bp, Artificial Sequence
  Description of Artificial Sequence: Synthetic oligonucleotide
  Target: SCN9A; (+) strand; PAM type: NRG; PAM sequence: GAG
acccatattattagtgatgg

SEQ ID NO: 48043 - DNA, 20 bp, Artificial Sequence
  Description of Artificial Sequence: Synthetic oligonucleotide
  Target: SCN9A; (+) strand; PAM type: NRG; PAM sequence: TGG
gagtaaaacacttataattt

SEQ ID NO: 48044 - DNA, 20 bp, Artificial Sequence
  Description of Artificial Sequence: Synthetic oligonucleotide
  Target: SCN9A; (+) strand; PAM type: NRG; PAM sequence: AAG
acacttataattttggtaat

SEQ ID NO: 48045 - DNA, 20 bp, Artificial Sequence
  Description of Artificial Sequence: Synthetic oligonucleotide
  Target: SCN9A; (+) strand; PAM type: NRG; PAM sequence: TAG
taattttggtaataagataa

SEQ ID NO: 48046 - DNA, 20 bp, Artificial Sequence
  Description of Artificial Sequence: Synthetic oligonucleotide
  Target: SCN9A; (+) strand; PAM type: NRG; PAM sequence: GAG
attttggtaataagataata

SEQ ID NO: 48047 - DNA, 20 bp, Artificial Sequence
  Description of Artificial Sequence: Synthetic oligonucleotide
  Target: SCN9A; (+) strand; PAM type: NRG; PAM sequence: CAG
aaataaaaaacctcctaata

SEQ ID NO: 48048 - DNA, 20 bp, Artificial Sequence
  Description of Artificial Sequence: Synthetic oligonucleotide
  Target: SCN9A; (+) strand; PAM type: NRG; PAM sequence: AGG
aataaaaaacctcctaatac

SEQ ID NO: 48049 - DNA, 20 bp, Artificial Sequence
  Description of Artificial Sequence: Synthetic oligonucleotide
  Target: SCN9A; (+) strand; PAM type: NRG; PAM sequence: CAG
tacaggctcttaacatacac

SEQ ID NO: 48050 - DNA, 20 bp, Artificial Sequence
  Description of Artificial Sequence: Synthetic oligonucleotide
  Target: SCN9A; (+) strand; PAM type: NRG; PAM sequence: AGG
acaggctcttaacatacacc

SEQ ID NO: 48051 - DNA, 20 bp, Artificial Sequence
  Description of Artificial Sequence: Synthetic oligonucleotide
  Target: SCN9A; (+) strand; PAM type: NRG; PAM sequence: TGG
aatacaatgcatgtttctct

SEQ ID NO: 48052 - DNA, 20 bp, Artificial Sequence
  Description of Artificial Sequence: Synthetic oligonucleotide
  Target: SCN9A; (+) strand; PAM type: NRG; PAM sequence: TGG
ttctcttggtactcacctgt

SEQ ID NO: 48053 - DNA, 20 bp, Artificial Sequence
  Description of Artificial Sequence: Synthetic oligonucleotide
  Target: SCN9A; (+) strand; PAM type: NRG; PAM sequence: AAG
ttggtactcacctgttggta

SEQ ID NO: 48054 - DNA, 20 bp, Artificial Sequence
  Description of Artificial Sequence: Synthetic oligonucleotide
  Target: SCN9A; (+) strand; PAM type: NRG; PAM sequence: AGG
tggtactcacctgttggtaa

SEQ ID NO: 48055 - DNA, 20 bp, Artificial Sequence
  Description of Artificial Sequence: Synthetic oligonucleotide
  Target: SCN9A; (+) strand; PAM type: NRG; PAM sequence: CAG
cctgttggtaaaggttttcc

SEQ ID NO: 48056 - DNA, 20 bp, Artificial Sequence
  Description of Artificial Sequence: Synthetic oligonucleotide
  Target: SCN9A; (+) strand; PAM type: NRG; PAM sequence: TGG
aaaggttttcccagtaatct

SEQ ID NO: 48057 - DNA, 20 bp, Artificial Sequence
  Description of Artificial Sequence: Synthetic oligonucleotide
  Target: SCN9A; (+) strand; PAM type: NRG; PAM sequence: GGG
aaggttttcccagtaatctt

SEQ ID NO: 48058 - DNA, 20 bp, Artificial Sequence
  Description of Artificial Sequence: Synthetic oligonucleotide
  Target: SCN9A; (+) strand; PAM type: NRG; PAM sequence: TAG
tcccagtaatcttgggtcat

SEQ ID NO: 48059 - DNA, 20 bp, Artificial Sequence
  Description of Artificial Sequence: Synthetic oligonucleotide
  Target: SCN9A; (+) strand; PAM type: NRG; PAM sequence: AAG
cttgggtcattagcctaaac

SEQ ID NO: 48060 - DNA, 20 bp, Artificial Sequence
  Description of Artificial Sequence: Synthetic oligonucleotide
  Target: SCN9A; (+) strand; PAM type: NRG; PAM sequence: AGG
ttgggtcattagcctaaaca

SEQ ID NO: 48061 - DNA, 20 bp, Artificial Sequence
  Description of Artificial Sequence: Synthetic oligonucleotide
  Target: SCN9A; (+) strand; PAM type: NRG; PAM sequence: AAG
tcattagcctaaacaaggct

SEQ ID NO: 48062 - DNA, 20 bp, Artificial Sequence
  Description of Artificial Sequence: Synthetic oligonucleotide
  Target: SCN9A; (+) strand; PAM type: NRG; PAM sequence: AAG
ttagcctaaacaaggctaag

SEQ ID NO: 48063 - DNA, 20 bp, Artificial Sequence
  Description of Artificial Sequence: Synthetic oligonucleotide
  Target: SCN9A; (+) strand; PAM type: NRG; PAM sequence: AGG
tagcctaaacaaggctaaga

SEQ ID NO: 48064 - DNA, 20 bp, Artificial Sequence
  Description of Artificial Sequence: Synthetic oligonucleotide
  Target: SCN9A; (+) strand; PAM type: NRG; PAM sequence: CAG
taaacaaggctaagaaggcc

SEQ ID NO: 48065 - DNA, 20 bp, Artificial Sequence
  Description of Artificial Sequence: Synthetic oligonucleotide
  Target: SCN9A; (+) strand; PAM type: NRG; PAM sequence: AAG
ggctaagaaggcccagctga

SEQ ID NO: 48066 - DNA, 20 bp, Artificial Sequence
  Description of Artificial Sequence: Synthetic oligonucleotide
  Target: SCN9A; (+) strand; PAM type: NRG; PAM sequence: AAG
aggcccagctgaaagtgtca

SEQ ID NO: 48067 - DNA, 20 bp, Artificial Sequence
  Description of Artificial Sequence: Synthetic oligonucleotide
  Target: SCN9A; (+) strand; PAM type: NRG; PAM sequence: TAG
tgaaagtgtcaaagctcgtg

SEQ ID NO: 48068 - DNA, 20 bp, Artificial Sequence
  Description of Artificial Sequence: Synthetic oligonucleotide
  Target: SCN9A; (+) strand; PAM type: NRG; PAM sequence: CAG
aaagctcgtgtagccataat

SEQ ID NO: 48069 - DNA, 20 bp, Artificial Sequence
  Description of Artificial Sequence: Synthetic oligonucleotide
  Target: SCN9A; (+) strand; PAM type: NRG; PAM sequence: AGG
aagctcgtgtagccataatc

SEQ ID NO: 48070 - DNA, 20 bp, Artificial Sequence
  Description of Artificial Sequence: Synthetic oligonucleotide
  Target: SCN9A; (+) strand; PAM type: NRG; PAM sequence: GGG
agctcgtgtagccataatca

SEQ ID NO: 48071 - DNA, 20 bp, Artificial Sequence
  Description of Artificial Sequence: Synthetic oligonucleotide
  Target: SCN9A; (+) strand; PAM type: NRG; PAM sequence: CAG
ggtttctgccaattttcaca

SEQ ID NO: 48072 - DNA, 20 bp, Artificial Sequence
  Description of Artificial Sequence: Synthetic oligonucleotide
  Target: SCN9A; (+) strand; PAM type: NRG; PAM sequence: AGG
gtttctgccaattttcacac

SEQ ID NO: 48073 - DNA, 20 bp, Artificial Sequence
  Description of Artificial Sequence: Synthetic oligonucleotide
  Target: SCN9A; (+) strand; PAM type: NRG; PAM sequence: TGG
ttcacacaggtgtacccctc

SEQ ID NO: 48074 - DNA, 20 bp, Artificial Sequence
  Description of Artificial Sequence: Synthetic oligonucleotide
  Target: SCN9A; (+) strand; PAM type: NRG; PAM sequence: GAG
tctggacactgactacacac

SEQ ID NO: 48075 - DNA, 20 bp, Artificial Sequence
  Description of Artificial Sequence: Synthetic oligonucleotide
  Target: SCN9A; (+) strand; PAM type: NRG; PAM sequence: AAG
gacactgactacacacgaga

SEQ ID NO: 48076 - DNA, 20 bp, Artificial Sequence
  Description of Artificial Sequence: Synthetic oligonucleotide
  Target: SCN9A; (+) strand; PAM type: NRG; PAM sequence: TAG
acacacgagaaagaacatta

SEQ ID NO: 48077 - DNA, 20 bp, Artificial Sequence
  Description of Artificial Sequence: Synthetic oligonucleotide
  Target: SCN9A; (+) strand; PAM type: NRG; PAM sequence: AGG
cacacgagaaagaacattat

SEQ ID NO: 48078 - DNA, 20 bp, Artificial Sequence
  Description of Artificial Sequence: Synthetic oligonucleotide
  Target: SCN9A; (+) strand; PAM type: NRG; PAM sequence: GAG
cgagaaagaacattataggt

SEQ ID NO: 48079 - DNA, 20 bp, Artificial Sequence
  Description of Artificial Sequence: Synthetic oligonucleotide
  Target: SCN9A; (+) strand; PAM type: NRG; PAM sequence: GAG
agaaagaacattataggtga

SEQ ID NO: 48080 - DNA, 20 bp, Artificial Sequence
  Description of Artificial Sequence: Synthetic oligonucleotide
  Target: SCN9A; (+) strand; PAM type: NRG; PAM sequence: CAG
attataggtgagagtgtctt

SEQ ID NO: 48081 - DNA, 20 bp, Artificial Sequence
  Description of Artificial Sequence: Synthetic oligonucleotide
  Target: SCN9A; (+) strand; PAM type: NRG; PAM sequence: AGG
ttataggtgagagtgtcttc

SEQ ID NO: 48082 - DNA, 20 bp, Artificial Sequence
  Description of Artificial Sequence: Synthetic oligonucleotide
  Target: SCN9A; (+) strand; PAM type: NRG; PAM sequence: AAG
tgagagtgtcttcaggacac

SEQ ID NO: 48083 - DNA, 20 bp, Artificial Sequence
  Description of Artificial Sequence: Synthetic oligonucleotide
  Target: SCN9A; (+) strand; PAM type: NRG; PAM sequence: TAG
tcttcaggacacaagctaaa

SEQ ID NO: 48084 - DNA, 20 bp, Artificial Sequence
  Description of Artificial Sequence: Synthetic oligonucleotide
  Target: SCN9A; (+) strand; PAM type: NRG; PAM sequence: AAG
agctaaatagccttactgaa

SEQ ID NO: 48085 - DNA, 20 bp, Artificial Sequence
  Description of Artificial Sequence: Synthetic oligonucleotide
  Target: SCN9A; (+) strand; PAM type: NRG; PAM sequence: AAG
tactgaaaagttacaaactc

SEQ ID NO: 48086 - DNA, 20 bp, Artificial Sequence
  Description of Artificial Sequence: Synthetic oligonucleotide
  Target: SCN9A; (+) strand; PAM type: NRG; PAM sequence: AGG
actgaaaagttacaaactca

SEQ ID NO: 48087 - DNA, 20 bp, Artificial Sequence
  Description of Artificial Sequence: Synthetic oligonucleotide
  Target: SCN9A; (+) strand; PAM type: NRG; PAM sequence: TAG
caaactcaaggtttcttcta

SEQ ID NO: 48088 - DNA, 20 bp, Artificial Sequence
  Description of Artificial Sequence: Synthetic oligonucleotide
  Target: SCN9A; (+) strand; PAM type: NRG; PAM sequence: AGG
aaactcaaggtttcttctat

SEQ ID NO: 48089 - DNA, 20 bp, Artificial Sequence
  Description of Artificial Sequence: Synthetic oligonucleotide
  Target: SCN9A; (+) strand; PAM type: NRG; PAM sequence: GGG
aactcaaggtttcttctata

SEQ ID NO: 48090 - DNA, 20 bp, Artificial Sequence
  Description of Artificial Sequence: Synthetic oligonucleotide
  Target: SCN9A; (+) strand; PAM type: NRG; PAM sequence: GGG
actcaaggtttcttctatag

SEQ ID NO: 48091 - DNA, 20 bp, Artificial Sequence
  Description of Artificial Sequence: Synthetic oligonucleotide
  Target: SCN9A; (+) strand; PAM type: NRG; PAM sequence: GGG
ctcaaggtttcttctatagg

SEQ ID NO: 48092 - DNA, 20 bp, Artificial Sequence
  Description of Artificial Sequence: Synthetic oligonucleotide
  Target: SCN9A; (+) strand; PAM type: NRG; PAM sequence: AAG
atagggggacaatattgaat

SEQ ID NO: 48093 - DNA, 20 bp, Artificial Sequence
  Description of Artificial Sequence: Synthetic oligonucleotide
  Target: SCN9A; (+) strand; PAM type: NRG; PAM sequence: AGG
tagggggacaatattgaata

SEQ ID NO: 48094 - DNA, 20 bp, Artificial Sequence
  Description of Artificial Sequence: Synthetic oligonucleotide
  Target: SCN9A; (+) strand; PAM type: NRG; PAM sequence: AAG
gacaatattgaataaggatt

SEQ ID NO: 48095 - DNA, 20 bp, Artificial Sequence
  Description of Artificial Sequence: Synthetic oligonucleotide
  Target: SCN9A; (+) strand; PAM type: NRG; PAM sequence: TGG
aggattaagaatacatgatt

SEQ ID NO: 48096 - DNA, 20 bp, Artificial Sequence
  Description of Artificial Sequence: Synthetic oligonucleotide
  Target: SCN9A; (+) strand; PAM type: NRG; PAM sequence: TAG
tgatttggctactgactact

SEQ ID NO: 48097 - DNA, 20 bp, Artificial Sequence
  Description of Artificial Sequence: Synthetic oligonucleotide
  Target: SCN9A; (+) strand; PAM type: NRG; PAM sequence: AAG
gtgactttaccaaattcttc

SEQ ID NO: 48098 - DNA, 20 bp, Artificial Sequence
  Description of Artificial Sequence: Synthetic oligonucleotide
  Target: SCN9A; (+) strand; PAM type: NRG; PAM sequence: AGG
tgactttaccaaattcttca

SEQ ID NO: 48099 - DNA, 20 bp, Artificial Sequence
  Description of Artificial Sequence: Synthetic oligonucleotide
  Target: SCN9A; (+) strand; PAM type: NRG; PAM sequence: AAG
taccaaattcttcaaggcat

SEQ ID NO: 48100 - DNA, 20 bp, Artificial Sequence
  Description of Artificial Sequence: Synthetic oligonucleotide
  Target: SCN9A; (+) strand; PAM type: NRG; PAM sequence: TAG
cataagtctgtctgtgaaaa

SEQ ID NO: 48101 - DNA, 20 bp, Artificial Sequence
  Description of Artificial Sequence: Synthetic oligonucleotide
  Target: SCN9A; (+) strand; PAM type: NRG; PAM sequence: AGG
ataagtctgtctgtgaaaat

SEQ ID NO: 48102 - DNA, 20 bp, Artificial Sequence
  Description of Artificial Sequence: Synthetic oligonucleotide
  Target: SCN9A; (+) strand; PAM type: NRG; PAM sequence: AAG
aggataataacatctacctc

SEQ ID NO: 48103 - DNA, 20 bp, Artificial Sequence
  Description of Artificial Sequence: Synthetic oligonucleotide
  Target: SCN9A; (+) strand; PAM type: NRG; PAM sequence: AAG
aacatctacctcaagaaaat

SEQ ID NO: 48104 - DNA, 20 bp, Artificial Sequence
  Description of Artificial Sequence: Synthetic oligonucleotide
  Target: SCN9A; (+) strand; PAM type: NRG; PAM sequence: AAG
aagaaaataagacttgtaat

SEQ ID NO: 48105 - DNA, 20 bp, Artificial Sequence
  Description of Artificial Sequence: Synthetic oligonucleotide
  Target: SCN9A; (+) strand; PAM type: NRG; PAM sequence: AAG
gacttgtaataagtttaaat

SEQ ID NO: 48106 - DNA, 20 bp, Artificial Sequence
  Description of Artificial Sequence: Synthetic oligonucleotide
  Target: SCN9A; (+) strand; PAM type: NRG; PAM sequence: TAG
gataatgtgtacaaattact

SEQ ID NO: 48107 - DNA, 20 bp, Artificial Sequence
  Description of Artificial Sequence: Synthetic oligonucleotide
  Target: SCN9A; (+) strand; PAM type: NRG; PAM sequence: TAG
cttagcttacatcctgcaca

SEQ ID NO: 48108 - DNA, 20 bp, Artificial Sequence
  Description of Artificial Sequence: Synthetic oligonucleotide
  Target: SCN9A; (+) strand; PAM type: NRG; PAM sequence: AAG
gcttacatcctgcacataga

SEQ ID NO: 48109 - DNA, 20 bp, Artificial Sequence
  Description of Artificial Sequence: Synthetic oligonucleotide
  Target: SCN9A; (+) strand; PAM type: NRG; PAM sequence: TAG
agaaagtgtttaataaatca

SEQ ID NO: 48110 - DNA, 20 bp, Artificial Sequence
  Description of Artificial Sequence: Synthetic oligonucleotide
  Target: SCN9A; (+) strand; PAM type: NRG; PAM sequence: TAG
taataaatcatagctgccat

SEQ ID NO: 48111 - DNA, 20 bp, Artificial Sequence
  Description of Artificial Sequence: Synthetic oligonucleotide
  Target: SCN9A; (+) strand; PAM type: NRG; PAM sequence: TGG
gcatcatcatcattaaaaca

SEQ ID NO: 48112 - DNA, 20 bp, Artificial Sequence
  Description of Artificial Sequence: Synthetic oligonucleotide
  Target: SCN9A; (+) strand; PAM type: NRG; PAM sequence: CAG
taaaacatggaaattttcaa

SEQ ID NO: 48113 - DNA, 20 bp, Artificial Sequence
  Description of Artificial Sequence: Synthetic oligonucleotide
  Target: SCN9A; (+) strand; PAM type: NRG; PAM sequence: TAG
tttcaacagacgttttgtga

SEQ ID NO: 48114 - DNA, 20 bp, Artificial Sequence
  Description of Artificial Sequence: Synthetic oligonucleotide
  Target: SCN9A; (+) strand; PAM type: NRG; PAM sequence: TGG
agacgttttgtgatagttct

SEQ ID NO: 48115 - DNA, 20 bp, Artificial Sequence
  Description of Artificial Sequence: Synthetic oligonucleotide
  Target: SCN9A; (+) strand; PAM type: NRG; PAM sequence: CAG
ttttgtgatagttcttggtt

SEQ ID NO: 48116 - DNA, 20 bp, Artificial Sequence
  Description of Artificial Sequence: Synthetic oligonucleotide
  Target: SCN9A; (+) strand; PAM type: NRG; PAM sequence: TAG
gttcagtaaatattgatatg

SEQ ID NO: 48117 - DNA, 20 bp, Artificial Sequence
  Description of Artificial Sequence: Synthetic oligonucleotide
  Target: SCN9A; (+) strand; PAM type: NRG; PAM sequence: AGG
ttcagtaaatattgatatgt

SEQ ID NO: 48118 - DNA, 20 bp, Artificial Sequence
  Description of Artificial Sequence: Synthetic oligonucleotide
  Target: SCN9A; (+) strand; PAM type: NRG; PAM sequence: AAG
tgatatgtaggctgttacca

SEQ ID NO: 48119 - DNA, 20 bp, Artificial Sequence
  Description of Artificial Sequence: Synthetic oligonucleotide
  Target: SCN9A; (+) strand; PAM type: NRG; PAM sequence: TGG
ctttctgtctgtataattct

SEQ ID NO: 48120 - DNA, 20 bp, Artificial Sequence
  Description of Artificial Sequence: Synthetic oligonucleotide
  Target: SCN9A; (+) strand; PAM type: NRG; PAM sequence: TAG
tgtctgtataattcttggaa

SEQ ID NO: 48121 - DNA, 20 bp, Artificial Sequence
  Description of Artificial Sequence: Synthetic oligonucleotide
  Target: SCN9A; (+) strand; PAM type: NRG; PAM sequence: TAG
gtataattcttggaatagat

SEQ ID NO: 48122 - DNA, 20 bp, Artificial Sequence
  Description of Artificial Sequence: Synthetic oligonucleotide
  Target: SCN9A; (+) strand; PAM type: NRG; PAM sequence: GAG
ataattcttggaatagatta

SEQ ID NO: 48123 - DNA, 20 bp, Artificial Sequence
  Description of Artificial Sequence: Synthetic oligonucleotide
  Target: SCN9A; (+) strand; PAM type: NRG; PAM sequence: TAG
gaatagattagagtcaataa

SEQ ID NO: 48124 - DNA, 20 bp, Artificial Sequence
  Description of Artificial Sequence: Synthetic oligonucleotide
  Target: SCN9A; (+) strand; PAM type: NRG; PAM sequence: TAG
agtcaataatagtcaaaata

SEQ ID NO: 48125 - DNA, 20 bp, Artificial Sequence
  Description of Artificial Sequence: Synthetic oligonucleotide
  Target: SCN9A; (+) strand; PAM type: NRG; PAM sequence: AAG
tcaaaatatagtaattgtct

SEQ ID NO: 48126 - DNA, 20 bp, Artificial Sequence
  Description of Artificial Sequence: Synthetic oligonucleotide
  Target: SCN9A; (+) strand; PAM type: NRG; PAM sequence: CAG
tctaagttcataaaaatgtg

SEQ ID NO: 48127 - DNA, 20 bp, Artificial Sequence
  Description of Artificial Sequence: Synthetic oligonucleotide
  Target: SCN9A; (+) strand; PAM type: NRG; PAM sequence: AAG
tcataaaaatgtgcagcttt

SEQ ID NO: 48128 - DNA, 20 bp, Artificial Sequence
  Description of Artificial Sequence: Synthetic oligonucleotide
  Target: SCN9A; (+) strand; PAM type: NRG; PAM sequence: TGG
gacttttttctttctaaaat

SEQ ID NO: 48129 - DNA, 20 bp, Artificial Sequence
  Description of Artificial Sequence: Synthetic oligonucleotide
  Target: SCN9A; (+) strand; PAM type: NRG; PAM sequence: TGG
ttttttctttctaaaattgg

SEQ ID NO: 48130 - DNA, 20 bp, Artificial Sequence
  Description of Artificial Sequence: Synthetic oligonucleotide
  Target: SCN9A; (+) strand; PAM type: NRG; PAM sequence: TGG
tctttctaaaattggtggac

SEQ ID NO: 48131 - DNA, 20 bp, Artificial Sequence
  Description of Artificial Sequence: Synthetic oligonucleotide
  Target: SCN9A; (+) strand; PAM type: NRG; PAM sequence: GAG
ttaaataaatacaatattct

SEQ ID NO: 48132 - DNA, 20 bp, Artificial Sequence
  Description of Artificial Sequence: Synthetic oligonucleotide
  Target: SCN9A; (+) strand; PAM type: NRG; PAM sequence: TGG
acaatattctgagattcttc

SEQ ID NO: 48133 - DNA, 20 bp, Artificial Sequence
  Description of Artificial Sequence: Synthetic oligonucleotide
  Target: SCN9A; (+) strand; PAM type: NRG; PAM sequence: GGG
caatattctgagattcttct

SEQ ID NO: 48134 - DNA, 20 bp, Artificial Sequence
  Description of Artificial Sequence: Synthetic oligonucleotide
  Target: SCN9A; (+) strand; PAM type: NRG; PAM sequence: CAG
ttctgagattcttctgggaa

SEQ ID NO: 48135 - DNA, 20 bp, Artificial Sequence
  Description of Artificial Sequence: Synthetic oligonucleotide
  Target: SCN9A; (+) strand; PAM type: NRG; PAM sequence: CAG
ctgggaacagcaaccttatc

SEQ ID NO: 48136 - DNA, 20 bp, Artificial Sequence
  Description of Artificial Sequence: Synthetic oligonucleotide
  Target: SCN9A; (+) strand; PAM type: NRG; PAM sequence: CAG
ccagtttattcctatgttgc

SEQ ID NO: 48137 - DNA, 20 bp, Artificial Sequence
  Description of Artificial Sequence: Synthetic oligonucleotide
  Target: SCN9A; (+) strand; PAM type: NRG; PAM sequence: CAG
tcctatgttgccagtgtaca

SEQ ID NO: 48138 - DNA, 20 bp, Artificial Sequence
  Description of Artificial Sequence: Synthetic oligonucleotide
  Target: SCN9A; (+) strand; PAM type: NRG; PAM sequence: GAG
ctatgttgccagtgtacaca

SEQ ID NO: 48139 - DNA, 20 bp, Artificial Sequence
  Description of Artificial Sequence: Synthetic oligonucleotide
  Target: SCN9A; (+) strand; PAM type: NRG; PAM sequence: TAG
tgtacacagagcctgatgaa

SEQ ID NO: 48140 - DNA, 20 bp, Artificial Sequence
  Description of Artificial Sequence: Synthetic oligonucleotide
  Target: SCN9A; (+) strand; PAM type: NRG; PAM sequence: TAG
ctgatgaatagatgtctgca

SEQ ID NO: 48141 - DNA, 20 bp, Artificial Sequence
  Description of Artificial Sequence: Synthetic oligonucleotide
  Target: SCN9A; (+) strand; PAM type: NRG; PAM sequence: AGG
tgatgaatagatgtctgcat

SEQ ID NO: 48142 - DNA, 20 bp, Artificial Sequence
  Description of Artificial Sequence: Synthetic oligonucleotide
  Target: SCN9A; (+) strand; PAM type: NRG; PAM sequence: GGG
gatgaatagatgtctgcata

SEQ ID NO: 48143 - DNA, 20 bp, Artificial Sequence
  Description of Artificial Sequence: Synthetic oligonucleotide
  Target: SCN9A; (+) strand; PAM type: NRG; PAM sequence: GGG
atgaatagatgtctgcatag

SEQ ID NO: 48144 - DNA, 20 bp, Artificial Sequence
  Description of Artificial Sequence: Synthetic oligonucleotide
  Target: SCN9A; (+) strand; PAM type: NRG; PAM sequence: GGG
tgaatagatgtctgcatagg

SEQ ID NO: 48145 - DNA, 20 bp, Artificial Sequence
  Description of Artificial Sequence: Synthetic oligonucleotide
  Target: SCN9A; (+) strand; PAM type: NRG; PAM sequence: AAG
agatgtctgcatagggggaa

SEQ ID NO: 48146 - DNA, 20 bp, Artificial Sequence
  Description of Artificial Sequence: Synthetic oligonucleotide
  Target: SCN9A; (+) strand; PAM type: NRG; PAM sequence: AAG
gtctgcatagggggaaaagc

SEQ ID NO: 48147 - DNA, 20 bp, Artificial Sequence
  Description of Artificial Sequence: Synthetic oligonucleotide
  Target: SCN9A; (+) strand; PAM type: NRG; PAM sequence: GAG
ctgcatagggggaaaagcaa

SEQ ID NO: 48148 - DNA, 20 bp, Artificial Sequence
  Description of Artificial Sequence: Synthetic oligonucleotide
  Target: SCN9A; (+) strand; PAM type: NRG; PAM sequence: CAG
gggaaaagcaagagcttatg

SEQ ID NO: 48149 - DNA, 20 bp, Artificial Sequence
  Description of Artificial Sequence: Synthetic oligonucleotide
  Target: SCN9A; (+) strand; PAM type: NRG; PAM sequence: AAG
gcagctgatgctacaaaatg

SEQ ID NO: 48150 - DNA, 20 bp, Artificial Sequence
  Description of Artificial Sequence: Synthetic oligonucleotide
  Target: SCN9A; (+) strand; PAM type: NRG; PAM sequence: TGG
ctgatgctacaaaatgaagt

SEQ ID NO: 48151 - DNA, 20 bp, Artificial Sequence
  Description of Artificial Sequence: Synthetic oligonucleotide
  Target: SCN9A; (+) strand; PAM type: NRG; PAM sequence: AAG
ctacaaaatgaagttggtgt

SEQ ID NO: 48152 - DNA, 20 bp, Artificial Sequence
  Description of Artificial Sequence: Synthetic oligonucleotide
  Target: SCN9A; (+) strand; PAM type: NRG; PAM sequence: GAG
acaaaatgaagttggtgtaa

SEQ ID NO: 48153 - DNA, 20 bp, Artificial Sequence
  Description of Artificial Sequence: Synthetic oligonucleotide
  Target: SCN9A; (+) strand; PAM type: NRG; PAM sequence: GAG
aaaatgaagttggtgtaaga

SEQ ID NO: 48154 - DNA, 20 bp, Artificial Sequence
  Description of Artificial Sequence: Synthetic oligonucleotide
  Target: SCN9A; (+) strand; PAM type: NRG; PAM sequence: AAG
atgaagttggtgtaagagag

SEQ ID NO: 48155 - DNA, 20 bp, Artificial Sequence
  Description of Artificial Sequence: Synthetic oligonucleotide
  Target: SCN9A; (+) strand; PAM type: NRG; PAM sequence: CAG
aagttggtgtaagagagaag

SEQ ID NO: 48156 - DNA, 20 bp, Artificial Sequence
  Description of Artificial Sequence: Synthetic oligonucleotide
  Target: SCN9A; (+) strand; PAM type: NRG; PAM sequence: AAG
tggtgtaagagagaagcagc

SEQ ID NO: 48157 - DNA, 20 bp, Artificial Sequence
  Description of Artificial Sequence: Synthetic oligonucleotide
  Target: SCN9A; (+) strand; PAM type: NRG; PAM sequence: TGG
gtaagagagaagcagcaaga

SEQ ID NO: 48158 - DNA, 20 bp, Artificial Sequence
  Description of Artificial Sequence: Synthetic oligonucleotide
  Target: SCN9A; (+) strand; PAM type: NRG; PAM sequence: CAG
gagagaagcagcaagatgga

SEQ ID NO: 48159 - DNA, 20 bp, Artificial Sequence
  Description of Artificial Sequence: Synthetic oligonucleotide
  Target: SCN9A; (+) strand; PAM type: NRG; PAM sequence: AAG
ttcttaaaatatgtgtaccc

SEQ ID NO: 48160 - DNA, 20 bp, Artificial Sequence
  Description of Artificial Sequence: Synthetic oligonucleotide
  Target: SCN9A; (+) strand; PAM type: NRG; PAM sequence: AAG
aaatatgtgtacccaagtcc

SEQ ID NO: 48161 - DNA, 20 bp, Artificial Sequence
  Description of Artificial Sequence: Synthetic oligonucleotide
  Target: SCN9A; (+) strand; PAM type: NRG; PAM sequence: AGG
aatatgtgtacccaagtcca

SEQ ID NO: 48162 - DNA, 20 bp, Artificial Sequence
  Description of Artificial Sequence: Synthetic oligonucleotide
  Target: SCN9A; (+) strand; PAM type: NRG; PAM sequence: TAG
gtccaaggaatccctttgct

SEQ ID NO: 48163 - DNA, 20 bp, Artificial Sequence
  Description of Artificial Sequence: Synthetic oligonucleotide
  Target: SCN9A; (+) strand; PAM type: NRG; PAM sequence: GAG
ccaaggaatccctttgctta

SEQ ID NO: 48164 - DNA, 20 bp, Artificial Sequence
  Description of Artificial Sequence: Synthetic oligonucleotide
  Target: SCN9A; (+) strand; PAM type: NRG; PAM sequence: TGG
aggaatccctttgcttagag

SEQ ID NO: 48165 - DNA, 20 bp, Artificial Sequence
  Description of Artificial Sequence: Synthetic oligonucleotide
  Target: SCN9A; (+) strand; PAM type: NRG; PAM sequence: CAG
agtggccaaaacatgacatt

SEQ ID NO: 48166 - DNA, 20 bp, Artificial Sequence
  Description of Artificial Sequence: Synthetic oligonucleotide
  Target: SCN9A; (+) strand; PAM type: NRG; PAM sequence: GAG
catgacattcagtcacctat

SEQ ID NO: 48167 - DNA, 20 bp, Artificial Sequence
  Description of Artificial Sequence: Synthetic oligonucleotide
  Target: SCN9A; (+) strand; PAM type: NRG; PAM sequence: TGG
acctatgagtcacatttaat

SEQ ID NO: 48168 - DNA, 20 bp, Artificial Sequence
  Description of Artificial Sequence: Synthetic oligonucleotide
  Target: SCN9A; (+) strand; PAM type: NRG; PAM sequence: GAG
ctatgagtcacatttaattg

SEQ ID NO: 48169 - DNA, 20 bp, Artificial Sequence
  Description of Artificial Sequence: Synthetic oligonucleotide
  Target: SCN9A; (+) strand; PAM type: NRG; PAM sequence: GAG
gtcacatttaattggagaat

SEQ ID NO: 48170 - DNA, 20 bp, Artificial Sequence
  Description of Artificial Sequence: Synthetic oligonucleotide
  Target: SCN9A; (+) strand; PAM type: NRG; PAM sequence: TGG
acatttaattggagaatgag

SEQ ID NO: 48171 - DNA, 20 bp, Artificial Sequence
  Description of Artificial Sequence: Synthetic oligonucleotide
  Target: SCN9A; (+) strand; PAM type: NRG; PAM sequence: TGG
attggagaatgagtggaact

SEQ ID NO: 48172 - DNA, 20 bp, Artificial Sequence
  Description of Artificial Sequence: Synthetic oligonucleotide
  Target: SCN9A; (+) strand; PAM type: NRG; PAM sequence: GGG
ttggagaatgagtggaactt

SEQ ID NO: 48173 - DNA, 20 bp, Artificial Sequence
  Description of Artificial Sequence: Synthetic oligonucleotide
  Target: SCN9A; (+) strand; PAM type: NRG; PAM sequence: GAG
ggagaatgagtggaacttgg

SEQ ID NO: 48174 - DNA, 20 bp, Artificial Sequence
  Description of Artificial Sequence: Synthetic oligonucleotide
  Target: SCN9A; (+) strand; PAM type: NRG; PAM sequence: TAG
gaatgagtggaacttgggag

SEQ ID NO: 48175 - DNA, 20 bp, Artificial Sequence
  Description of Artificial Sequence: Synthetic oligonucleotide
  Target: SCN9A; (+) strand; PAM type: NRG; PAM sequence: AAG
gagtggaacttgggagtaga

SEQ ID NO: 48176 - DNA, 20 bp, Artificial Sequence
  Description of Artificial Sequence: Synthetic oligonucleotide
  Target: SCN9A; (+) strand; PAM type: NRG; PAM sequence: TAG
cttgggagtagaaagaaaaa

SEQ ID NO: 48177 - DNA, 20 bp, Artificial Sequence
  Description of Artificial Sequence: Synthetic oligonucleotide
  Target: SCN9A; (+) strand; PAM type: NRG; PAM sequence: CAG
ctttgtgactcttcgttttc

SEQ ID NO: 48178 - DNA, 20 bp, Artificial Sequence
  Description of Artificial Sequence: Synthetic oligonucleotide
  Target: SCN9A; (+) strand; PAM type: NRG; PAM sequence: AAG
gtgactcttcgttttccaga

SEQ ID NO: 48179 - DNA, 20 bp, Artificial Sequence
  Description of Artificial Sequence: Synthetic oligonucleotide
  Target: SCN9A; (+) strand; PAM type: NRG; PAM sequence: AAG
actcttcgttttccagaaag

SEQ ID NO: 48180 - DNA, 20 bp, Artificial Sequence
  Description of Artificial Sequence: Synthetic oligonucleotide
  Target: SCN9A; (+) strand; PAM type: NRG; PAM sequence: TGG
gaaattatccaaccaacttt

SEQ ID NO: 48181 - DNA, 20 bp, Artificial Sequence
  Description of Artificial Sequence: Synthetic oligonucleotide
  Target: SCN9A; (+) strand; PAM type: NRG; PAM sequence: TGG
attatccaaccaacttttgg

SEQ ID NO: 48182 - DNA, 20 bp, Artificial Sequence
  Description of Artificial Sequence: Synthetic oligonucleotide
  Target: SCN9A; (+) strand; PAM type: NRG; PAM sequence: GAG
tatccaaccaacttttggtg

SEQ ID NO: 48183 - DNA, 20 bp, Artificial Sequence
  Description of Artificial Sequence: Synthetic oligonucleotide
  Target: SCN9A; (+) strand; PAM type: NRG; PAM sequence: TAG
caacttttggtggagttttc

SEQ ID NO: 48184 - DNA, 20 bp, Artificial Sequence
  Description of Artificial Sequence: Synthetic oligonucleotide
  Target: SCN9A; (+) strand; PAM type: NRG; PAM sequence: AAG
cttttggtggagttttctag

SEQ ID NO: 48185 - DNA, 20 bp, Artificial Sequence
  Description of Artificial Sequence: Synthetic oligonucleotide
  Target: SCN9A; (+) strand; PAM type: NRG; PAM sequence: AAG
gtaacattttctaccttctt

SEQ ID NO: 48186 - DNA, 20 bp, Artificial Sequence
  Description of Artificial Sequence: Synthetic oligonucleotide
  Target: SCN9A; (+) strand; PAM type: NRG; PAM sequence: GAG
cttctgtcttgtgttaattc

SEQ ID NO: 48187 - DNA, 20 bp, Artificial Sequence
  Description of Artificial Sequence: Synthetic oligonucleotide
  Target: SCN9A; (+) strand; PAM type: NRG; PAM sequence: AAG
ttaattcgagcactgtctca

SEQ ID NO: 48188 - DNA, 20 bp, Artificial Sequence
  Description of Artificial Sequence: Synthetic oligonucleotide
  Target: SCN9A; (+) strand; PAM type: NRG; PAM sequence: AAG
tgtctcaaagtcttgctttc

SEQ ID NO: 48189 - DNA, 20 bp, Artificial Sequence
  Description of Artificial Sequence: Synthetic oligonucleotide
  Target: SCN9A; (+) strand; PAM type: NRG; PAM sequence: GAG
tctcaaagtcttgctttcaa

SEQ ID NO: 48190 - DNA, 20 bp, Artificial Sequence
  Description of Artificial Sequence: Synthetic oligonucleotide
  Target: SCN9A; (+) strand; PAM type: NRG; PAM sequence: AAG
cattaactgtgaacatttta

SEQ ID NO: 48191 - DNA, 20 bp, Artificial Sequence
  Description of Artificial Sequence: Synthetic oligonucleotide
  Target: SCN9A; (+) strand; PAM type: NRG; PAM sequence: TGG
actgtgaacattttaaagac

SEQ ID NO: 48192 - DNA, 20 bp, Artificial Sequence
  Description of Artificial Sequence: Synthetic oligonucleotide
  Target: SCN9A; (+) strand; PAM type: NRG; PAM sequence: TGG
tttaaagactggatttgctg

SEQ ID NO: 48193 - DNA, 20 bp, Artificial Sequence
  Description of Artificial Sequence: Synthetic oligonucleotide
  Target: SCN9A; (+) strand; PAM type: NRG; PAM sequence: GGG
ttaaagactggatttgctgt

SEQ ID NO: 48194 - DNA, 20 bp, Artificial Sequence
  Description of Artificial Sequence: Synthetic oligonucleotide
  Target: SCN9A; (+) strand; PAM type: NRG; PAM sequence: CAG
agactggatttgctgtggga

SEQ ID NO: 48195 - DNA, 20 bp, Artificial Sequence
  Description of Artificial Sequence: Synthetic oligonucleotide
  Target: SCN9A; (+) strand; PAM type: NRG; PAM sequence: GAG
gatttgctgtgggacagaat

SEQ ID NO: 48196 - DNA, 20 bp, Artificial Sequence
  Description of Artificial Sequence: Synthetic oligonucleotide
  Target: SCN9A; (+) strand; PAM type: NRG; PAM sequence: AAG
aataccatgaaatatataaa

SEQ ID NO: 48197 - DNA, 20 bp, Artificial Sequence
  Description of Artificial Sequence: Synthetic oligonucleotide
  Target: SCN9A; (+) strand; PAM type: NRG; PAM sequence: TAG
gaaatatataaaaagcaata

SEQ ID NO: 48198 - DNA, 20 bp, Artificial Sequence
  Description of Artificial Sequence: Synthetic oligonucleotide
  Target: SCN9A; (+) strand; PAM type: NRG; PAM sequence: AAG
taaaaagcaatatagaatca

SEQ ID NO: 48199 - DNA, 20 bp, Artificial Sequence
  Description of Artificial Sequence: Synthetic oligonucleotide
  Target: SCN9A; (+) strand; PAM type: NRG; PAM sequence: CAG
acattcttttccttctcttt

SEQ ID NO: 48200 - DNA, 20 bp, Artificial Sequence
  Description of Artificial Sequence: Synthetic oligonucleotide
  Target: SCN9A; (+) strand; PAM type: NRG; PAM sequence: TAG
tttccttctctttcagcctt

SEQ ID NO: 48201 - DNA, 20 bp, Artificial Sequence
  Description of Artificial Sequence: Synthetic oligonucleotide
  Target: SCN9A; (+) strand; PAM type: NRG; PAM sequence: AAG
ctttcagcctttagactaaa

SEQ ID NO: 48202 - DNA, 20 bp, Artificial Sequence
  Description of Artificial Sequence: Synthetic oligonucleotide
  Target: SCN9A; (+) strand; PAM type: NRG; PAM sequence: AAG
gaatctgtgctgaaaccaca

SEQ ID NO: 48203 - DNA, 20 bp, Artificial Sequence
  Description of Artificial Sequence: Synthetic oligonucleotide
  Target: SCN9A; (+) strand; PAM type: NRG; PAM sequence: AGG
aatctgtgctgaaaccacaa

SEQ ID NO: 48204 - DNA, 20 bp, Artificial Sequence
  Description of Artificial Sequence: Synthetic oligonucleotide
  Target: SCN9A; (+) strand; PAM type: NRG; PAM sequence: GAG
tctgtgctgaaaccacaaag

SEQ ID NO: 48205 - DNA, 20 bp, Artificial Sequence
  Description of Artificial Sequence: Synthetic oligonucleotide
  Target: SCN9A; (+) strand; PAM type: NRG; PAM sequence: GAG
tgtgctgaaaccacaaagga

SEQ ID NO: 48206 - DNA, 20 bp, Artificial Sequence
  Description of Artificial Sequence: Synthetic oligonucleotide
  Target: SCN9A; (+) strand; PAM type: NRG; PAM sequence: TGG
accacaaaggagagcatctt

SEQ ID NO: 48207 - DNA, 20 bp, Artificial Sequence
  Description of Artificial Sequence: Synthetic oligonucleotide
  Target: SCN9A; (+) strand; PAM type: NRG; PAM sequence: AAG
gagcatctttggatccttcc

SEQ ID NO: 48208 - DNA, 20 bp, Artificial Sequence
  Description of Artificial Sequence: Synthetic oligonucleotide
  Target: SCN9A; (+) strand; PAM type: NRG; PAM sequence: AAG
gtaataaaaatattctgttg

SEQ ID NO: 48209 - DNA, 20 bp, Artificial Sequence
  Description of Artificial Sequence: Synthetic oligonucleotide
  Target: SCN9A; (+) strand; PAM type: NRG; PAM sequence: AAG
ataaaaatattctgttgaag

SEQ ID NO: 48210 - DNA, 20 bp, Artificial Sequence
  Description of Artificial Sequence: Synthetic oligonucleotide
  Target: SCN9A; (+) strand; PAM type: NRG; PAM sequence: CAG
ctgttgaagaagaatttgaa

SEQ ID NO: 48211 - DNA, 20 bp, Artificial Sequence
  Description of Artificial Sequence: Synthetic oligonucleotide
  Target: SCN9A; (+) strand; PAM type: NRG; PAM sequence: CAG
tttgaacagttataacatca

SEQ ID NO: 48212 - DNA, 20 bp, Artificial Sequence
  Description of Artificial Sequence: Synthetic oligonucleotide
  Target: SCN9A; (+) strand; PAM type: NRG; PAM sequence: AAG
tttaatctgtgattgtgata

SEQ ID NO: 48213 - DNA, 20 bp, Artificial Sequence
  Description of Artificial Sequence: Synthetic oligonucleotide
  Target: SCN9A; (+) strand; PAM type: NRG; PAM sequence: AGG
ttaatctgtgattgtgataa

SEQ ID NO: 48214 - DNA, 20 bp, Artificial Sequence
  Description of Artificial Sequence: Synthetic oligonucleotide
  Target: SCN9A; (+) strand; PAM type: NRG; PAM sequence: GAG
aatctgtgattgtgataaag

SEQ ID NO: 48215 - DNA, 20 bp, Artificial Sequence
  Description of Artificial Sequence: Synthetic oligonucleotide
  Target: SCN9A; (+) strand; PAM type: NRG; PAM sequence: AGG
atctgtgattgtgataaagg

SEQ ID NO: 48216 - DNA, 20 bp, Artificial Sequence
  Description of Artificial Sequence: Synthetic oligonucleotide
  Target: SCN9A; (+) strand; PAM type: NRG; PAM sequence: TAG
aggaggtaaattaattgata

SEQ ID NO: 48217 - DNA, 20 bp, Artificial Sequence
  Description of Artificial Sequence: Synthetic oligonucleotide
  Target: SCN9A; (+) strand; PAM type: NRG; PAM sequence: CAG
tagacatttatctacaaatt

SEQ ID NO: 48218 - DNA, 20 bp, Artificial Sequence
  Description of Artificial Sequence: Synthetic oligonucleotide
  Target: SCN9A; (+) strand; PAM type: NRG; PAM sequence: AGG
agacatttatctacaaattc

SEQ ID NO: 48219 - DNA, 20 bp, Artificial Sequence
  Description of Artificial Sequence: Synthetic oligonucleotide
  Target: SCN9A; (+) strand; PAM type: NRG; PAM sequence: TGG
tttatctacaaattcaggcc

SEQ ID NO: 48220 - DNA, 20 bp, Artificial Sequence
  Description of Artificial Sequence: Synthetic oligonucleotide
  Target: SCN9A; (+) strand; PAM type: NRG; PAM sequence: CAG
tacaaattcaggcctggtcc

SEQ ID NO: 48221 - DNA, 20 bp, Artificial Sequence
  Description of Artificial Sequence: Synthetic oligonucleotide
  Target: SCN9A; (+) strand; PAM type: NRG; PAM sequence: AGG
acaaattcaggcctggtccc

SEQ ID NO: 48222 - DNA, 20 bp, Artificial Sequence
  Description of Artificial Sequence: Synthetic oligonucleotide
  Target: SCN9A; (+) strand; PAM type: NRG; PAM sequence: TAG
aatatttattgataatctct

SEQ ID NO: 48223 - DNA, 20 bp, Artificial Sequence
  Description of Artificial Sequence: Synthetic oligonucleotide
  Target: SCN9A; (+) strand; PAM type: NRG; PAM sequence: GAG
tatttattgataatctctta

SEQ ID NO: 48224 - DNA, 20 bp, Artificial Sequence
  Description of Artificial Sequence: Synthetic oligonucleotide
  Target: SCN9A; (+) strand; PAM type: NRG; PAM sequence: AGG
atttattgataatctcttag

SEQ ID NO: 48225 - DNA, 20 bp, Artificial Sequence
  Description of Artificial Sequence: Synthetic oligonucleotide
  Target: SCN9A; (+) strand; PAM type: NRG; PAM sequence: TAG
attgataatctcttagaggc

SEQ ID NO: 48226 - DNA, 20 bp, Artificial Sequence
  Description of Artificial Sequence: Synthetic oligonucleotide
  Target: SCN9A; (+) strand; PAM type: NRG; PAM sequence: AGG
ttgataatctcttagaggct

SEQ ID NO: 48227 - DNA, 20 bp, Artificial Sequence
  Description of Artificial Sequence: Synthetic oligonucleotide
  Target: SCN9A; (+) strand; PAM type: NRG; PAM sequence: TAG
aacacgataaataaaatcat

SEQ ID NO: 48228 - DNA, 20 bp, Artificial Sequence
  Description of Artificial Sequence: Synthetic oligonucleotide
  Target: SCN9A; (+) strand; PAM type: NRG; PAM sequence: GAG
aataaaatcattagttttat

SEQ ID NO: 48229 - DNA, 20 bp, Artificial Sequence
  Description of Artificial Sequence: Synthetic oligonucleotide
  Target: SCN9A; (+) strand; PAM type: NRG; PAM sequence: TAG
tatgagacctcctttatgtt

SEQ ID NO: 48230 - DNA, 20 bp, Artificial Sequence
  Description of Artificial Sequence: Synthetic oligonucleotide
  Target: SCN9A; (+) strand; PAM type: NRG; PAM sequence: AGG
atgagacctcctttatgttt

SEQ ID NO: 48231 - DNA, 20 bp, Artificial Sequence
  Description of Artificial Sequence: Synthetic oligonucleotide
  Target: SCN9A; (+) strand; PAM type: NRG; PAM sequence: GAG
gacctcctttatgtttaggt

SEQ ID NO: 48232 - DNA, 20 bp, Artificial Sequence
  Description of Artificial Sequence: Synthetic oligonucleotide
  Target: SCN9A; (+) strand; PAM type: NRG; PAM sequence: AGG
acctcctttatgtttaggtg

SEQ ID NO: 48233 - DNA, 20 bp, Artificial Sequence
  Description of Artificial Sequence: Synthetic oligonucleotide
  Target: SCN9A; (+) strand; PAM type: NRG; PAM sequence: GGG
cctcctttatgtttaggtga

SEQ ID NO: 48234 - DNA, 20 bp, Artificial Sequence
  Description of Artificial Sequence: Synthetic oligonucleotide
  Target: SCN9A; (+) strand; PAM type: NRG; PAM sequence: TGG
cctttatgtttaggtgaggg

SEQ ID NO: 48235 - DNA, 20 bp, Artificial Sequence
  Description of Artificial Sequence: Synthetic oligonucleotide
  Target: SCN9A; (+) strand; PAM type: NRG; PAM sequence: GAG
tttatgtttaggtgagggtg

SEQ ID NO: 48236 - DNA, 20 bp, Artificial Sequence
  Description of Artificial Sequence: Synthetic oligonucleotide
  Target: SCN9A; (+) strand; PAM type: NRG; PAM sequence: AGG
ttatgtttaggtgagggtgg

SEQ ID NO: 48237 - DNA, 20 bp, Artificial Sequence
  Description of Artificial Sequence: Synthetic oligonucleotide
  Target: SCN9A; (+) strand; PAM type: NRG; PAM sequence: TGG
ttaggtgagggtggaggttg

SEQ ID NO: 48238 - DNA, 20 bp, Artificial Sequence
  Description of Artificial Sequence: Synthetic oligonucleotide
  Target: SCN9A; (+) strand; PAM type: NRG; PAM sequence: TGG
gtgagggtggaggttgtggt

SEQ ID NO: 48239 - DNA, 20 bp, Artificial Sequence
  Description of Artificial Sequence: Synthetic oligonucleotide
  Target: SCN9A; (+) strand; PAM type: NRG; PAM sequence: AAG
ttgtggttggataaaaattt

SEQ ID NO: 48240 - DNA, 20 bp, Artificial Sequence
  Description of Artificial Sequence: Synthetic oligonucleotide
  Target: SCN9A; (+) strand; PAM type: NRG; PAM sequence: AAG
aagtaaataaataaatatac

SEQ ID NO: 48241 - DNA, 20 bp, Artificial Sequence
  Description of Artificial Sequence: Synthetic oligonucleotide
  Target: SCN9A; (+) strand; PAM type: NRG; PAM sequence: CAG
ataaatatacaagatatttt

SEQ ID NO: 48242 - DNA, 20 bp, Artificial Sequence
  Description of Artificial Sequence: Synthetic oligonucleotide
  Target: SCN9A; (+) strand; PAM type: NRG; PAM sequence: TAG
atatacaagatattttcaga

SEQ ID NO: 48243 - DNA, 20 bp, Artificial Sequence
  Description of Artificial Sequence: Synthetic oligonucleotide
  Target: SCN9A; (+) strand; PAM type: NRG; PAM sequence: AAG
agatagtgataaatgatcta

SEQ ID NO: 48244 - DNA, 20 bp, Artificial Sequence
  Description of Artificial Sequence: Synthetic oligonucleotide
  Target: SCN9A; (+) strand; PAM type: NRG; PAM sequence: AAG
tgatctaaagaaaataaatt

SEQ ID NO: 48245 - DNA, 20 bp, Artificial Sequence
  Description of Artificial Sequence: Synthetic oligonucleotide
  Target: SCN9A; (+) strand; PAM type: NRG; PAM sequence: AGG
gatctaaagaaaataaatta

SEQ ID NO: 48246 - DNA, 20 bp, Artificial Sequence
  Description of Artificial Sequence: Synthetic oligonucleotide
  Target: SCN9A; (+) strand; PAM type: NRG; PAM sequence: TGG
gaaaataaattaaggcaacg

SEQ ID NO: 48247 - DNA, 20 bp, Artificial Sequence
  Description of Artificial Sequence: Synthetic oligonucleotide
  Target: SCN9A; (+) strand; PAM type: NRG; PAM sequence: TAG
aataaattaaggcaacgtgg

SEQ ID NO: 48248 - DNA, 20 bp, Artificial Sequence
  Description of Artificial Sequence: Synthetic oligonucleotide
  Target: SCN9A; (+) strand; PAM type: NRG; PAM sequence: AGG
ataaattaaggcaacgtggt

SEQ ID NO: 48249 - DNA, 20 bp, Artificial Sequence
  Description of Artificial Sequence: Synthetic oligonucleotide
  Target: SCN9A; (+) strand; PAM type: NRG; PAM sequence: CAG
taaggcaacgtggtaggctg

SEQ ID NO: 48250 - DNA, 20 bp, Artificial Sequence
  Description of Artificial Sequence: Synthetic oligonucleotide
  Target: SCN9A; (+) strand; PAM type: NRG; PAM sequence: CAG
gcaacgtggtaggctgcagt

SEQ ID NO: 48251 - DNA, 20 bp, Artificial Sequence
  Description of Artificial Sequence: Synthetic oligonucleotide
  Target: SCN9A; (+) strand; PAM type: NRG; PAM sequence: AGG
caacgtggtaggctgcagtc

SEQ ID NO: 48252 - DNA, 20 bp, Artificial Sequence
  Description of Artificial Sequence: Synthetic oligonucleotide
  Target: SCN9A; (+) strand; PAM type: NRG; PAM sequence: GGG
aacgtggtaggctgcagtca

SEQ ID NO: 48253 - DNA, 20 bp, Artificial Sequence
  Description of Artificial Sequence: Synthetic oligonucleotide
  Target: SCN9A; (+) strand; PAM type: NRG; PAM sequence: CGG
tggtaggctgcagtcaggga

SEQ ID NO: 48254 - DNA, 20 bp, Artificial Sequence
  Description of Artificial Sequence: Synthetic oligonucleotide
  Target: SCN9A; (+) strand; PAM type: NRG; PAM sequence: AAG
cagtcagggacggtctttct

SEQ ID NO: 48255 - DNA, 20 bp, Artificial Sequence
  Description of Artificial Sequence: Synthetic oligonucleotide
  Target: SCN9A; (+) strand; PAM type: NRG; PAM sequence: AGG
agtcagggacggtctttcta

SEQ ID NO: 48256 - DNA, 20 bp, Artificial Sequence
  Description of Artificial Sequence: Synthetic oligonucleotide
  Target: SCN9A; (+) strand; PAM type: NRG; PAM sequence: GAG
tcagggacggtctttctaag

SEQ ID NO: 48257 - DNA, 20 bp, Artificial Sequence
  Description of Artificial Sequence: Synthetic oligonucleotide
  Target: SCN9A; (+) strand; PAM type: NRG; PAM sequence: AAG
aaggagatgatatttaaact

SEQ ID NO: 48258 - DNA, 20 bp, Artificial Sequence
  Description of Artificial Sequence: Synthetic oligonucleotide
  Target: SCN9A; (+) strand; PAM type: NRG; PAM sequence: AAG
tgatatttaaactaagacct

SEQ ID NO: 48259 - DNA, 20 bp, Artificial Sequence
  Description of Artificial Sequence: Synthetic oligonucleotide
  Target: SCN9A; (+) strand; PAM type: NRG; PAM sequence: AAG
actaagacctaagtgtgaca

SEQ ID NO: 48260 - DNA, 20 bp, Artificial Sequence
  Description of Artificial Sequence: Synthetic oligonucleotide
  Target: SCN9A; (+) strand; PAM type: NRG; PAM sequence: AAG
aagacctaagtgtgacaaag

SEQ ID NO: 48261 - DNA, 20 bp, Artificial Sequence
  Description of Artificial Sequence: Synthetic oligonucleotide
  Target: SCN9A; (+) strand; PAM type: NRG; PAM sequence: CAG
cctaagtgtgacaaagaaga

SEQ ID NO: 48262 - DNA, 20 bp, Artificial Sequence
  Description of Artificial Sequence: Synthetic oligonucleotide
  Target: SCN9A; (+) strand; PAM type: NRG; PAM sequence: TGG
gaagacagccatgaaaatac

SEQ ID NO: 48263 - DNA, 20 bp, Artificial Sequence
  Description of Artificial Sequence: Synthetic oligonucleotide
  Target: SCN9A; (+) strand; PAM type: NRG; PAM sequence: AAG
cagccatgaaaatactggtg

SEQ ID NO: 48264 - DNA, 20 bp, Artificial Sequence
  Description of Artificial Sequence: Synthetic oligonucleotide
  Target: SCN9A; (+) strand; PAM type: NRG; PAM sequence: GAG
gccatgaaaatactggtgaa

SEQ ID NO: 48265 - DNA, 20 bp, Artificial Sequence
  Description of Artificial Sequence: Synthetic oligonucleotide
  Target: SCN9A; (+) strand; PAM type: NRG; PAM sequence: TGG
aatactggtgaagagatatt

SEQ ID NO: 48266 - DNA, 20 bp, Artificial Sequence
  Description of Artificial Sequence: Synthetic oligonucleotide
  Target: SCN9A; (+) strand; PAM type: NRG; PAM sequence: GGG
atactggtgaagagatattt

SEQ ID NO: 48267 - DNA, 20 bp, Artificial Sequence
  Description of Artificial Sequence: Synthetic oligonucleotide
  Target: SCN9A; (+) strand; PAM type: NRG; PAM sequence: TGG
tggtgaagagatatttgggc

SEQ ID NO: 48268 - DNA, 20 bp, Artificial Sequence
  Description of Artificial Sequence: Synthetic oligonucleotide
  Target: SCN9A; (+) strand; PAM type: NRG; PAM sequence: GGG
ggtgaagagatatttgggct

SEQ ID NO: 48269 - DNA, 20 bp, Artificial Sequence
  Description of Artificial Sequence: Synthetic oligonucleotide
  Target: SCN9A; (+) strand; PAM type: NRG; PAM sequence: GGG
gtgaagagatatttgggctg

SEQ ID NO: 48270 - DNA, 20 bp, Artificial Sequence
  Description of Artificial Sequence: Synthetic oligonucleotide
  Target: SCN9A; (+) strand; PAM type: NRG; PAM sequence: GGG
tgaagagatatttgggctgg

SEQ ID NO: 48271 - DNA, 20 bp, Artificial Sequence
  Description of Artificial Sequence: Synthetic oligonucleotide
  Target: SCN9A; (+) strand; PAM type: NRG; PAM sequence: AAG
agagatatttgggctggggg

SEQ ID NO: 48272 - DNA, 20 bp, Artificial Sequence
  Description of Artificial Sequence: Synthetic oligonucleotide
  Target: SCN9A; (+) strand; PAM type: NRG; PAM sequence: GAG
agatatttgggctgggggaa

SEQ ID NO: 48273 - DNA, 20 bp, Artificial Sequence
  Description of Artificial Sequence: Synthetic oligonucleotide
  Target: SCN9A; (+) strand; PAM type: NRG; PAM sequence: AAG
atttgggctgggggaagaga

SEQ ID NO: 48274 - DNA, 20 bp, Artificial Sequence
  Description of Artificial Sequence: Synthetic oligonucleotide
  Target: SCN9A; (+) strand; PAM type: NRG; PAM sequence: AAG
tgggggaagagaaagaacta

SEQ ID NO: 48275 - DNA, 20 bp, Artificial Sequence
  Description of Artificial Sequence: Synthetic oligonucleotide
  Target: SCN9A; (+) strand; PAM type: NRG; PAM sequence: AAG
agagaaagaactaaagccct

SEQ ID NO: 48276 - DNA, 20 bp, Artificial Sequence
  Description of Artificial Sequence: Synthetic oligonucleotide
  Target: SCN9A; (+) strand; PAM type: NRG; PAM sequence: AGG
gagaaagaactaaagcccta

SEQ ID NO: 48277 - DNA, 20 bp, Artificial Sequence
  Description of Artificial Sequence: Synthetic oligonucleotide
  Target: SCN9A; (+) strand; PAM type: NRG; PAM sequence: CAG
aaagaactaaagccctaagg

SEQ ID NO: 48278 - DNA, 20 bp, Artificial Sequence
  Description of Artificial Sequence: Synthetic oligonucleotide
  Target: SCN9A; (+) strand; PAM type: NRG; PAM sequence: GAG
agaactaaagccctaaggca

SEQ ID NO: 48279 - DNA, 20 bp, Artificial Sequence
  Description of Artificial Sequence: Synthetic oligonucleotide
  Target: SCN9A; (+) strand; PAM type: NRG; PAM sequence: AAG
aaagccctaaggcagagatg

SEQ ID NO: 48280 - DNA, 20 bp, Artificial Sequence
  Description of Artificial Sequence: Synthetic oligonucleotide
  Target: SCN9A; (+) strand; PAM type: NRG; PAM sequence: TGG
ccctaaggcagagatgaagt

SEQ ID NO: 48281 - DNA, 20 bp, Artificial Sequence
  Description of Artificial Sequence: Synthetic oligonucleotide
  Target: SCN9A; (+) strand; PAM type: NRG; PAM sequence: TGG
gcagagatgaagttggtgtg

SEQ ID NO: 48282 - DNA, 20 bp, Artificial Sequence
  Description of Artificial Sequence: Synthetic oligonucleotide
  Target: SCN9A; (+) strand; PAM type: NRG; PAM sequence: AAG
gatgaagttggtgtgtggaa

SEQ ID NO: 48283 - DNA, 20 bp, Artificial Sequence
  Description of Artificial Sequence: Synthetic oligonucleotide
  Target: SCN9A; (+) strand; PAM type: NRG; PAM sequence: CAG
aagttggtgtgtggaaaagc

SEQ ID NO: 48284 - DNA, 20 bp, Artificial Sequence
  Description of Artificial Sequence: Synthetic oligonucleotide
  Target: SCN9A; (+) strand; PAM type: NRG; PAM sequence: AAG
tggtgtgtggaaaagccagc

SEQ ID NO: 48285 - DNA, 20 bp, Artificial Sequence
  Description of Artificial Sequence: Synthetic oligonucleotide
  Target: SCN9A; (+) strand; PAM type: NRG; PAM sequence: TGG
gtgtggaaaagccagcaaga

SEQ ID NO: 48286 - DNA, 20 bp, Artificial Sequence
  Description of Artificial Sequence: Synthetic oligonucleotide
  Target: SCN9A; (+) strand; PAM type: NRG; PAM sequence: CAG
ggaaaagccagcaagatggc

SEQ ID NO: 48287 - DNA, 20 bp, Artificial Sequence
  Description of Artificial Sequence: Synthetic oligonucleotide
  Target: SCN9A; (+) strand; PAM type: NRG; PAM sequence: TGG
agccagcaagatggccagtg

SEQ ID NO: 48288 - DNA, 20 bp, Artificial Sequence
  Description of Artificial Sequence: Synthetic oligonucleotide
  Target: SCN9A; (+) strand; PAM type: NRG; PAM sequence: CAG
caagatggccagtgtggcta

SEQ ID NO: 48289 - DNA, 20 bp, Artificial Sequence
  Description of Artificial Sequence: Synthetic oligonucleotide
  Target: SCN9A; (+) strand; PAM type: NRG; PAM sequence: TGG
tggccagtgtggctacagtg

SEQ ID NO: 48290 - DNA, 20 bp, Artificial Sequence
  Description of Artificial Sequence: Synthetic oligonucleotide
  Target: SCN9A; (+) strand; PAM type: NRG; PAM sequence: GAG
cagtgtggctacagtgtggt

SEQ ID NO: 48291 - DNA, 20 bp, Artificial Sequence
  Description of Artificial Sequence: Synthetic oligonucleotide
  Target: SCN9A; (+) strand; PAM type: NRG; PAM sequence: GAG
gtgtggctacagtgtggtga

SEQ ID NO: 48292 - DNA, 20 bp, Artificial Sequence
  Description of Artificial Sequence: Synthetic oligonucleotide
  Target: SCN9A; (+) strand; PAM type: NRG; PAM sequence: AGG
tgtggctacagtgtggtgag

SEQ ID NO: 48293 - DNA, 20 bp, Artificial Sequence
  Description of Artificial Sequence: Synthetic oligonucleotide
  Target: SCN9A; (+) strand; PAM type: NRG; PAM sequence: GGG
gtggctacagtgtggtgaga

SEQ ID NO: 48294 - DNA, 20 bp, Artificial Sequence
  Description of Artificial Sequence: Synthetic oligonucleotide
  Target: SCN9A; (+) strand; PAM type: NRG; PAM sequence: GAG
ggctacagtgtggtgagagg

SEQ ID NO: 48295 - DNA, 20 bp, Artificial Sequence
  Description of Artificial Sequence: Synthetic oligonucleotide
  Target: SCN9A; (+) strand; PAM type: NRG; PAM sequence: AGG
gctacagtgtggtgagaggg

SEQ ID NO: 48296 - DNA, 20 bp, Artificial Sequence
  Description of Artificial Sequence: Synthetic oligonucleotide
  Target: SCN9A; (+) strand; PAM type: NRG; PAM sequence: TGG
ggtgagagggaggattgtga

SEQ ID NO: 48297 - DNA, 20 bp, Artificial Sequence
  Description of Artificial Sequence: Synthetic oligonucleotide
  Target: SCN9A; (+) strand; PAM type: NRG; PAM sequence: CAG
gagagggaggattgtgatgg

SEQ ID NO: 48298 - DNA, 20 bp, Artificial Sequence
  Description of Artificial Sequence: Synthetic oligonucleotide
  Target: SCN9A; (+) strand; PAM type: NRG; PAM sequence: GAG
gagggaggattgtgatggca

SEQ ID NO: 48299 - DNA, 20 bp, Artificial Sequence
  Description of Artificial Sequence: Synthetic oligonucleotide
  Target: SCN9A; (+) strand; PAM type: NRG; PAM sequence: AGG
agggaggattgtgatggcag

SEQ ID NO: 48300 - DNA, 20 bp, Artificial Sequence
  Description of Artificial Sequence: Synthetic oligonucleotide
  Target: SCN9A; (+) strand; PAM type: NRG; PAM sequence: TAG
gaggattgtgatggcagagg

SEQ ID NO: 48301 - DNA, 20 bp, Artificial Sequence
  Description of Artificial Sequence: Synthetic oligonucleotide
  Target: SCN9A; (+) strand; PAM type: NRG; PAM sequence: AGG
aggattgtgatggcagaggt

SEQ ID NO: 48302 - DNA, 20 bp, Artificial Sequence
  Description of Artificial Sequence: Synthetic oligonucleotide
  Target: SCN9A; (+) strand; PAM type: NRG; PAM sequence: CAG
attgtgatggcagaggtagg

SEQ ID NO: 48303 - DNA, 20 bp, Artificial Sequence
  Description of Artificial Sequence: Synthetic oligonucleotide
  Target: SCN9A; (+) strand; PAM type: NRG; PAM sequence: AGG
ttgtgatggcagaggtaggc

SEQ ID NO: 48304 - DNA, 20 bp, Artificial Sequence
  Description of Artificial Sequence: Synthetic oligonucleotide
  Target: SCN9A; (+) strand; PAM type: NRG; PAM sequence: GGG
tgtgatggcagaggtaggca

SEQ ID NO: 48305 - DNA, 20 bp, Artificial Sequence
  Description of Artificial Sequence: Synthetic oligonucleotide
  Target: SCN9A; (+) strand; PAM type: NRG; PAM sequence: GGG
gtgatggcagaggtaggcag

SEQ ID NO: 48306 - DNA, 20 bp, Artificial Sequence
  Description of Artificial Sequence: Synthetic oligonucleotide
  Target: SCN9A; (+) strand; PAM type: NRG; PAM sequence: CGG
tggcagaggtaggcaggggc

SEQ ID NO: 48307 - DNA, 20 bp, Artificial Sequence
  Description of Artificial Sequence: Synthetic oligonucleotide
  Target: SCN9A; (+) strand; PAM type: NRG; PAM sequence: CGG
aggcaggggccggatcatgt

SEQ ID NO: 48308 - DNA, 20 bp, Artificial Sequence
  Description of Artificial Sequence: Synthetic oligonucleotide
  Target: SCN9A; (+) strand; PAM type: NRG; PAM sequence: TAG
atgtcggaatttgcatatca

SEQ ID NO: 48309 - DNA, 20 bp, Artificial Sequence
  Description of Artificial Sequence: Synthetic oligonucleotide
  Target: SCN9A; (+) strand; PAM type: NRG; PAM sequence: GAG
aatttgcatatcatagaaat

SEQ ID NO: 48310 - DNA, 20 bp, Artificial Sequence
  Description of Artificial Sequence: Synthetic oligonucleotide
  Target: SCN9A; (+) strand; PAM type: NRG; PAM sequence: TGG
gcatatcatagaaatgagtt

SEQ ID NO: 48311 - DNA, 20 bp, Artificial Sequence
  Description of Artificial Sequence: Synthetic oligonucleotide
  Target: SCN9A; (+) strand; PAM type: NRG; PAM sequence: AAG
tagaaatgagtttggatttt

SEQ ID NO: 48312 - DNA, 20 bp, Artificial Sequence
  Description of Artificial Sequence: Synthetic oligonucleotide
  Target: SCN9A; (+) strand; PAM type: NRG; PAM sequence: AAG
ttggattttaagtatgatta

SEQ ID NO: 48313 - DNA, 20 bp, Artificial Sequence
  Description of Artificial Sequence: Synthetic oligonucleotide
  Target: SCN9A; (+) strand; PAM type: NRG; PAM sequence: AGG
tggattttaagtatgattaa

SEQ ID NO: 48314 - DNA, 20 bp, Artificial Sequence
  Description of Artificial Sequence: Synthetic oligonucleotide
  Target: SCN9A; (+) strand; PAM type: NRG; PAM sequence: CGG
tttaagtatgattaaaggta

SEQ ID NO: 48315 - DNA, 20 bp, Artificial Sequence
  Description of Artificial Sequence: Synthetic oligonucleotide
  Target: SCN9A; (+) strand; PAM type: NRG; PAM sequence: GAG
taatgactgtgatacattct

SEQ ID NO: 48316 - DNA, 20 bp, Artificial Sequence
  Description of Artificial Sequence: Synthetic oligonucleotide
  Target: SCN9A; (+) strand; PAM type: NRG; PAM sequence: TAG
cattctgagaaatgcatcat

SEQ ID NO: 48317 - DNA, 20 bp, Artificial Sequence
  Description of Artificial Sequence: Synthetic oligonucleotide
  Target: SCN9A; (+) strand; PAM type: NRG; PAM sequence: AGG
attctgagaaatgcatcatt

SEQ ID NO: 48318 - DNA, 20 bp, Artificial Sequence
  Description of Artificial Sequence: Synthetic oligonucleotide
  Target: SCN9A; (+) strand; PAM type: NRG; PAM sequence: TAG
tcgtccttgtgcaaacatcc

SEQ ID NO: 48319 - DNA, 20 bp, Artificial Sequence
  Description of Artificial Sequence: Synthetic oligonucleotide
  Target: SCN9A; (+) strand; PAM type: NRG; PAM sequence: AGG
cgtccttgtgcaaacatcct

SEQ ID NO: 48320 - DNA, 20 bp, Artificial Sequence
  Description of Artificial Sequence: Synthetic oligonucleotide
  Target: SCN9A; (+) strand; PAM type: NRG; PAM sequence: GGG
gtccttgtgcaaacatccta

SEQ ID NO: 48321 - DNA, 20 bp, Artificial Sequence
  Description of Artificial Sequence: Synthetic oligonucleotide
  Target: SCN9A; (+) strand; PAM type: NRG; PAM sequence: TAG
agggtgcacttatacaaacc

SEQ ID NO: 48322 - DNA, 20 bp, Artificial Sequence
  Description of Artificial Sequence: Synthetic oligonucleotide
  Target: SCN9A; (+) strand; PAM type: NRG; PAM sequence: TGG
tgcacttatacaaacctaga

SEQ ID NO: 48323 - DNA, 20 bp, Artificial Sequence
  Description of Artificial Sequence: Synthetic oligonucleotide
  Target: SCN9A; (+) strand; PAM type: NRG; PAM sequence: TAG
ttatacaaacctagatggta

SEQ ID NO: 48324 - DNA, 20 bp, Artificial Sequence
  Description of Artificial Sequence: Synthetic oligonucleotide
  Target: SCN9A; (+) strand; PAM type: NRG; PAM sequence: AGG
tatacaaacctagatggtat

SEQ ID NO: 48325 - DNA, 20 bp, Artificial Sequence
  Description of Artificial Sequence: Synthetic oligonucleotide
  Target: SCN9A; (+) strand; PAM type: NRG; PAM sequence: TAG
ggtataggctaccatacacc

SEQ ID NO: 48326 - DNA, 20 bp, Artificial Sequence
  Description of Artificial Sequence: Synthetic oligonucleotide
  Target: SCN9A; (+) strand; PAM type: NRG; PAM sequence: AGG
gtataggctaccatacacct

SEQ ID NO: 48327 - DNA, 20 bp, Artificial Sequence
  Description of Artificial Sequence: Synthetic oligonucleotide
  Target: SCN9A; (+) strand; PAM type: NRG; PAM sequence: TGG
taccatacacctaggctatg

SEQ ID NO: 48328 - DNA, 20 bp, Artificial Sequence
  Description of Artificial Sequence: Synthetic oligonucleotide
  Target: SCN9A; (+) strand; PAM type: NRG; PAM sequence: TAG
tacacctaggctatgtggta

SEQ ID NO: 48329 - DNA, 20 bp, Artificial Sequence
  Description of Artificial Sequence: Synthetic oligonucleotide
  Target: SCN9A; (+) strand; PAM type: NRG; PAM sequence: TGG
gtggtatagcctattgctcc

SEQ ID NO: 48330 - DNA, 20 bp, Artificial Sequence
  Description of Artificial Sequence: Synthetic oligonucleotide
  Target: SCN9A; (+) strand; PAM type: NRG; PAM sequence: GGG
tggtatagcctattgctcct

SEQ ID NO: 48331 - DNA, 20 bp, Artificial Sequence
  Description of Artificial Sequence: Synthetic oligonucleotide
  Target: SCN9A; (+) strand; PAM type: NRG; PAM sequence: TAG
gctcctgggctgcaaacctg

SEQ ID NO: 48332 - DNA, 20 bp, Artificial Sequence
  Description of Artificial Sequence: Synthetic oligonucleotide
  Target: SCN9A; (+) strand; PAM type: NRG; PAM sequence: GAG
tcctgggctgcaaacctgta

SEQ ID NO: 48333 - DNA, 20 bp, Artificial Sequence
  Description of Artificial Sequence: Synthetic oligonucleotide
  Target: SCN9A; (+) strand; PAM type: NRG; PAM sequence: TGG
tgggctgcaaacctgtagag

SEQ ID NO: 48334 - DNA, 20 bp, Artificial Sequence
  Description of Artificial Sequence: Synthetic oligonucleotide
  Target: SCN9A; (+) strand; PAM type: NRG; PAM sequence: GGG
gggctgcaaacctgtagagt

SEQ ID NO: 48335 - DNA, 20 bp, Artificial Sequence
  Description of Artificial Sequence: Synthetic oligonucleotide
  Target: SCN9A; (+) strand; PAM type: NRG; PAM sequence: TAG
ggctactgtactcaatattg

SEQ ID NO: 48336 - DNA, 20 bp, Artificial Sequence
  Description of Artificial Sequence: Synthetic oligonucleotide
  Target: SCN9A; (+) strand; PAM type: NRG; PAM sequence: AGG
gctactgtactcaatattgt

SEQ ID NO: 48337 - DNA, 20 bp, Artificial Sequence
  Description of Artificial Sequence: Synthetic oligonucleotide
  Target: SCN9A; (+) strand; PAM type: NRG; PAM sequence: TGG
tgtaggcaactgttatacaa

SEQ ID NO: 48338 - DNA, 20 bp, Artificial Sequence
  Description of Artificial Sequence: Synthetic oligonucleotide
  Target: SCN9A; (+) strand; PAM type: NRG; PAM sequence: AAG
ggcaactgttatacaatgga

SEQ ID NO: 48339 - DNA, 20 bp, Artificial Sequence
  Description of Artificial Sequence: Synthetic oligonucleotide
  Target: SCN9A; (+) strand; PAM type: NRG; PAM sequence: AAG
caatggaaagtgtgtatcta

SEQ ID NO: 48340 - DNA, 20 bp, Artificial Sequence
  Description of Artificial Sequence: Synthetic oligonucleotide
  Target: SCN9A; (+) strand; PAM type: NRG; PAM sequence: CAG
ggaaagtgtgtatctaaaga

SEQ ID NO: 48341 - DNA, 20 bp, Artificial Sequence
  Description of Artificial Sequence: Synthetic oligonucleotide
  Target: SCN9A; (+) strand; PAM type: NRG; PAM sequence: AAG
gtgtgtatctaaagacagaa

SEQ ID NO: 48342 - DNA, 20 bp, Artificial Sequence
  Description of Artificial Sequence: Synthetic oligonucleotide
  Target: SCN9A; (+) strand; PAM type: NRG; PAM sequence: AGG
tgtgtatctaaagacagaaa

SEQ ID NO: 48343 - DNA, 20 bp, Artificial Sequence
  Description of Artificial Sequence: Synthetic oligonucleotide
  Target: SCN9A; (+) strand; PAM type: NRG; PAM sequence: CAG
atctaaagacagaaaaggta

SEQ ID NO: 48344 - DNA, 20 bp, Artificial Sequence
  Description of Artificial Sequence: Synthetic oligonucleotide
  Target: SCN9A; (+) strand; PAM type: NRG; PAM sequence: CAG
aaaggtacagtaaaaaaata

SEQ ID NO: 48345 - DNA, 20 bp, Artificial Sequence
  Description of Artificial Sequence: Synthetic oligonucleotide
  Target: SCN9A; (+) strand; PAM type: NRG; PAM sequence: GAG
atacagtattataatcttat

SEQ ID NO: 48346 - DNA, 20 bp, Artificial Sequence
  Description of Artificial Sequence: Synthetic oligonucleotide
  Target: SCN9A; (+) strand; PAM type: NRG; PAM sequence: TGG
tgagatcaccattatatata

SEQ ID NO: 48347 - DNA, 20 bp, Artificial Sequence
  Description of Artificial Sequence: Synthetic oligonucleotide
  Target: SCN9A; (+) strand; PAM type: NRG; PAM sequence: TGG
ttgactaaaacatccttatg

SEQ ID NO: 48348 - DNA, 20 bp, Artificial Sequence
  Description of Artificial Sequence: Synthetic oligonucleotide
  Target: SCN9A; (+) strand; PAM type: NRG; PAM sequence: CGG
ccttatgtggtacaatactc

SEQ ID NO: 48349 - DNA, 20 bp, Artificial Sequence
  Description of Artificial Sequence: Synthetic oligonucleotide
  Target: SCN9A; (+) strand; PAM type: NRG; PAM sequence: AAG
tatgtggtacaatactccgg

SEQ ID NO: 48350 - DNA, 20 bp, Artificial Sequence
  Description of Artificial Sequence: Synthetic oligonucleotide
  Target: SCN9A; (+) strand; PAM type: NRG; PAM sequence: GAG
tgtggtacaatactccggaa

SEQ ID NO: 48351 - DNA, 20 bp, Artificial Sequence
  Description of Artificial Sequence: Synthetic oligonucleotide
  Target: SCN9A; (+) strand; PAM type: NRG; PAM sequence: AGG
gtggtacaatactccggaag

SEQ ID NO: 48352 - DNA, 20 bp, Artificial Sequence
  Description of Artificial Sequence: Synthetic oligonucleotide
  Target: SCN9A; (+) strand; PAM type: NRG; PAM sequence: CAG
gtacaatactccggaagagg

SEQ ID NO: 48353 - DNA, 20 bp, Artificial Sequence
  Description of Artificial Sequence: Synthetic oligonucleotide
  Target: SCN9A; (+) strand; PAM type: NRG; PAM sequence: CAG
tactccggaagaggcagact

SEQ ID NO: 48354 - DNA, 20 bp, Artificial Sequence
  Description of Artificial Sequence: Synthetic oligonucleotide
  Target: SCN9A; (+) strand; PAM type: NRG; PAM sequence: AAG
ccggaagaggcagactcagt

SEQ ID NO: 48355 - DNA, 20 bp, Artificial Sequence
  Description of Artificial Sequence: Synthetic oligonucleotide
  Target: SCN9A; (+) strand; PAM type: NRG; PAM sequence: AGG
cggaagaggcagactcagta

SEQ ID NO: 48356 - DNA, 20 bp, Artificial Sequence
  Description of Artificial Sequence: Synthetic oligonucleotide
  Target: SCN9A; (+) strand; PAM type: NRG; PAM sequence: CAG
aagaggcagactcagtaagg

SEQ ID NO: 48357 - DNA, 20 bp, Artificial Sequence
  Description of Artificial Sequence: Synthetic oligonucleotide
  Target: SCN9A; (+) strand; PAM type: NRG; PAM sequence: AAG
actcagtaaggcagtaacat

SEQ ID NO: 48358 - DNA, 20 bp, Artificial Sequence
  Description of Artificial Sequence: Synthetic oligonucleotide
  Target: SCN9A; (+) strand; PAM type: NRG; PAM sequence: GAG
agtaaggcagtaacataagt

SEQ ID NO: 48359 - DNA, 20 bp, Artificial Sequence
  Description of Artificial Sequence: Synthetic oligonucleotide
  Target: SCN9A; (+) strand; PAM type: NRG; PAM sequence: CAG
ttatcttacttttcattcac

SEQ ID NO: 48360 - DNA, 20 bp, Artificial Sequence
  Description of Artificial Sequence: Synthetic oligonucleotide
  Target: SCN9A; (+) strand; PAM type: NRG; PAM sequence: TAG
ttcaccagtccatacttact

SEQ ID NO: 48361 - DNA, 20 bp, Artificial Sequence
  Description of Artificial Sequence: Synthetic oligonucleotide
  Target: SCN9A; (+) strand; PAM type: NRG; PAM sequence: AGG
tcaccagtccatacttactt

SEQ ID NO: 48362 - DNA, 20 bp, Artificial Sequence
  Description of Artificial Sequence: Synthetic oligonucleotide
  Target: SCN9A; (+) strand; PAM type: NRG; PAM sequence: TAG
tacttaggacctactaattc

SEQ ID NO: 48363 - DNA, 20 bp, Artificial Sequence
  Description of Artificial Sequence: Synthetic oligonucleotide
  Target: SCN9A; (+) strand; PAM type: NRG; PAM sequence: AGG
acttaggacctactaattct

SEQ ID NO: 48364 - DNA, 20 bp, Artificial Sequence
  Description of Artificial Sequence: Synthetic oligonucleotide
  Target: SCN9A; (+) strand; PAM type: NRG; PAM sequence: GAG
acctactaattctaggtgtt

SEQ ID NO: 48365 - DNA, 20 bp, Artificial Sequence
  Description of Artificial Sequence: Synthetic oligonucleotide
  Target: SCN9A; (+) strand; PAM type: NRG; PAM sequence: AGG
cctactaattctaggtgttg

SEQ ID NO: 48366 - DNA, 20 bp, Artificial Sequence
  Description of Artificial Sequence: Synthetic oligonucleotide
  Target: SCN9A; (+) strand; PAM type: NRG; PAM sequence: GAG
tactaattctaggtgttgag

SEQ ID NO: 48367 - DNA, 20 bp, Artificial Sequence
  Description of Artificial Sequence: Synthetic oligonucleotide
  Target: SCN9A; (+) strand; PAM type: NRG; PAM sequence: CAG
agatgacaatgtaatcaatg

SEQ ID NO: 48368 - DNA, 20 bp, Artificial Sequence
  Description of Artificial Sequence: Synthetic oligonucleotide
  Target: SCN9A; (+) strand; PAM type: NRG; PAM sequence: TGG
tttccatgtttcacctttca

SEQ ID NO: 48369 - DNA, 20 bp, Artificial Sequence
  Description of Artificial Sequence: Synthetic oligonucleotide
  Target: SCN9A; (+) strand; PAM type: NRG; PAM sequence: TAG
gtattctttgtgctaatttt

SEQ ID NO: 48370 - DNA, 20 bp, Artificial Sequence
  Description of Artificial Sequence: Synthetic oligonucleotide
  Target: SCN9A; (+) strand; PAM type: NRG; PAM sequence: TAG
ttctttgtgctaatttttag

SEQ ID NO: 48371 - DNA, 20 bp, Artificial Sequence
  Description of Artificial Sequence: Synthetic oligonucleotide
  Target: SCN9A; (+) strand; PAM type: NRG; PAM sequence: AAG
gtgctaatttttagtagtaa

SEQ ID NO: 48372 - DNA, 20 bp, Artificial Sequence
  Description of Artificial Sequence: Synthetic oligonucleotide
  Target: SCN9A; (+) strand; PAM type: NRG; PAM sequence: AAG
ctcttctgtcatttgctgtt

SEQ ID NO: 48373 - DNA, 20 bp, Artificial Sequence
  Description of Artificial Sequence: Synthetic oligonucleotide
  Target: SCN9A; (+) strand; PAM type: NRG; PAM sequence: AGG
tcttctgtcatttgctgtta

SEQ ID NO: 48374 - DNA, 20 bp, Artificial Sequence
  Description of Artificial Sequence: Synthetic oligonucleotide
  Target: SCN9A; (+) strand; PAM type: NRG; PAM sequence: AAG
tgctgttaaggcttgttcct

SEQ ID NO: 48375 - DNA, 20 bp, Artificial Sequence
  Description of Artificial Sequence: Synthetic oligonucleotide
  Target: SCN9A; (+) strand; PAM type: NRG; PAM sequence: TGG
ttaaggcttgttcctaagac

SEQ ID NO: 48376 - DNA, 20 bp, Artificial Sequence
  Description of Artificial Sequence: Synthetic oligonucleotide
  Target: SCN9A; (+) strand; PAM type: NRG; PAM sequence: GGG
taaggcttgttcctaagact

SEQ ID NO: 48377 - DNA, 20 bp, Artificial Sequence
  Description of Artificial Sequence: Synthetic oligonucleotide
  Target: SCN9A; (+) strand; PAM type: NRG; PAM sequence: GGG
aaggcttgttcctaagactg

SEQ ID NO: 48378 - DNA, 20 bp, Artificial Sequence
  Description of Artificial Sequence: Synthetic oligonucleotide
  Target: SCN9A; (+) strand; PAM type: NRG; PAM sequence: GGG
aggcttgttcctaagactgg

SEQ ID NO: 48379 - DNA, 20 bp, Artificial Sequence
  Description of Artificial Sequence: Synthetic oligonucleotide
  Target: SCN9A; (+) strand; PAM type: NRG; PAM sequence: CAG
cttgttcctaagactggggg

SEQ ID NO: 48380 - DNA, 20 bp, Artificial Sequence
  Description of Artificial Sequence: Synthetic oligonucleotide
  Target: SCN9A; (+) strand; PAM type: NRG; PAM sequence: TAG
ggggcagatctatccttgta

SEQ ID NO: 48381 - DNA, 20 bp, Artificial Sequence
  Description of Artificial Sequence: Synthetic oligonucleotide
  Target: SCN9A; (+) strand; PAM type: NRG; PAM sequence: AAG
ttaaatatctattctactat

SEQ ID NO: 48382 - DNA, 20 bp, Artificial Sequence
  Description of Artificial Sequence: Synthetic oligonucleotide
  Target: SCN9A; (+) strand; PAM type: NRG; PAM sequence: CAG
acctgacttcctattttact

SEQ ID NO: 48383 - DNA, 20 bp, Artificial Sequence
  Description of Artificial Sequence: Synthetic oligonucleotide
  Target: SCN9A; (+) strand; PAM type: NRG; PAM sequence: AGG
cctgacttcctattttactc

SEQ ID NO: 48384 - DNA, 20 bp, Artificial Sequence
  Description of Artificial Sequence: Synthetic oligonucleotide
  Target: SCN9A; (+) strand; PAM type: NRG; PAM sequence: TGG
aaattaaaaaatctgattat

SEQ ID NO: 48385 - DNA, 20 bp, Artificial Sequence
  Description of Artificial Sequence: Synthetic oligonucleotide
  Target: SCN9A; (+) strand; PAM type: NRG; PAM sequence: GGG
aattaaaaaatctgattatt

SEQ ID NO: 48386 - DNA, 20 bp, Artificial Sequence
  Description of Artificial Sequence: Synthetic oligonucleotide
  Target: SCN9A; (+) strand; PAM type: NRG; PAM sequence: GAG
ttaaaaaatctgattattgg

SEQ ID NO: 48387 - DNA, 20 bp, Artificial Sequence
  Description of Artificial Sequence: Synthetic oligonucleotide
  Target: SCN9A; (+) strand; PAM type: NRG; PAM sequence: TGG
tctgattattgggagacttt

SEQ ID NO: 48388 - DNA, 20 bp, Artificial Sequence
  Description of Artificial Sequence: Synthetic oligonucleotide
  Target: SCN9A; (+) strand; PAM type: NRG; PAM sequence: GAG
tgattattgggagacttttg

SEQ ID NO: 48389 - DNA, 20 bp, Artificial Sequence
  Description of Artificial Sequence: Synthetic oligonucleotide
  Target: SCN9A; (+) strand; PAM type: NRG; PAM sequence: TGG
ggagacttttggagtaatca

SEQ ID NO: 48390 - DNA, 20 bp, Artificial Sequence
  Description of Artificial Sequence: Synthetic oligonucleotide
  Target: SCN9A; (+) strand; PAM type: NRG; PAM sequence: AAG
gacttttggagtaatcatgg

SEQ ID NO: 48391 - DNA, 20 bp, Artificial Sequence
  Description of Artificial Sequence: Synthetic oligonucleotide
  Target: SCN9A; (+) strand; PAM type: NRG; PAM sequence: AAG
tttggagtaatcatggaaga

SEQ ID NO: 48392 - DNA, 20 bp, Artificial Sequence
  Description of Artificial Sequence: Synthetic oligonucleotide
  Target: SCN9A; (+) strand; PAM type: NRG; PAM sequence: CAG
tggaagaaagactatgaaat

SEQ ID NO: 48393 - DNA, 20 bp, Artificial Sequence
  Description of Artificial Sequence: Synthetic oligonucleotide
  Target: SCN9A; (+) strand; PAM type: NRG; PAM sequence: TGG
actatgaaatcagatattct

SEQ ID NO: 48394 - DNA, 20 bp, Artificial Sequence
  Description of Artificial Sequence: Synthetic oligonucleotide
  Target: SCN9A; (+) strand; PAM type: NRG; PAM sequence: AAG
tgttgcttctatcccttctt

SEQ ID NO: 48395 - DNA, 20 bp, Artificial Sequence
  Description of Artificial Sequence: Synthetic oligonucleotide
  Target: SCN9A; (+) strand; PAM type: NRG; PAM sequence: AAG
gcttctatcccttcttaagt

SEQ ID NO: 48396 - DNA, 20 bp, Artificial Sequence
  Description of Artificial Sequence: Synthetic oligonucleotide
  Target: SCN9A; (+) strand; PAM type: NRG; PAM sequence: AAG
taagtaagtgaattatcttt

SEQ ID NO: 48397 - DNA, 20 bp, Artificial Sequence
  Description of Artificial Sequence: Synthetic oligonucleotide
  Target: SCN9A; (+) strand; PAM type: NRG; PAM sequence: AAG
tgaattatctttaagccatt

SEQ ID NO: 48398 - DNA, 20 bp, Artificial Sequence
  Description of Artificial Sequence: Synthetic oligonucleotide
  Target: SCN9A; (+) strand; PAM type: NRG; PAM sequence: TAG
atctttaagccattaagcct

SEQ ID NO: 48399 - DNA, 20 bp, Artificial Sequence
  Description of Artificial Sequence: Synthetic oligonucleotide
  Target: SCN9A; (+) strand; PAM type: NRG; PAM sequence: AAG
tgcatctgtaaaatacgtat

SEQ ID NO: 48400 - DNA, 20 bp, Artificial Sequence
  Description of Artificial Sequence: Synthetic oligonucleotide
  Target: SCN9A; (+) strand; PAM type: NRG; PAM sequence: AAG
ataagaatacctactttata

SEQ ID NO: 48401 - DNA, 20 bp, Artificial Sequence
  Description of Artificial Sequence: Synthetic oligonucleotide
  Target: SCN9A; (+) strand; PAM type: NRG; PAM sequence: TAG
tactttataaagttgttaaa

SEQ ID NO: 48402 - DNA, 20 bp, Artificial Sequence
  Description of Artificial Sequence: Synthetic oligonucleotide
  Target: SCN9A; (+) strand; PAM type: NRG; PAM sequence: TAG
aagttgttaaatagtataaa

SEQ ID NO: 48403 - DNA, 20 bp, Artificial Sequence
  Description of Artificial Sequence: Synthetic oligonucleotide
  Target: SCN9A; (+) strand; PAM type: NRG; PAM sequence: AGG
agttgttaaatagtataaat

SEQ ID NO: 48404 - DNA, 20 bp, Artificial Sequence
  Description of Artificial Sequence: Synthetic oligonucleotide
  Target: SCN9A; (+) strand; PAM type: NRG; PAM sequence: TAG
gtgatccacacattctgtac

SEQ ID NO: 48405 - DNA, 20 bp, Artificial Sequence
  Description of Artificial Sequence: Synthetic oligonucleotide
  Target: SCN9A; (+) strand; PAM type: NRG; PAM sequence: CAG
ctgtactagctgctcaaaaa

SEQ ID NO: 48406 - DNA, 20 bp, Artificial Sequence
  Description of Artificial Sequence: Synthetic oligonucleotide
  Target: SCN9A; (+) strand; PAM type: NRG; PAM sequence: AGG
tgtactagctgctcaaaaac

SEQ ID NO: 48407 - DNA, 20 bp, Artificial Sequence
  Description of Artificial Sequence: Synthetic oligonucleotide
  Target: SCN9A; (+) strand; PAM type: NRG; PAM sequence: GAG
tactagctgctcaaaaacag

SEQ ID NO: 48408 - DNA, 20 bp, Artificial Sequence
  Description of Artificial Sequence: Synthetic oligonucleotide
  Target: SCN9A; (+) strand; PAM type: NRG; PAM sequence: TAG
aaaacaggagttattataat

SEQ ID NO: 48409 - DNA, 20 bp, Artificial Sequence
  Description of Artificial Sequence: Synthetic oligonucleotide
  Target: SCN9A; (+) strand; PAM type: NRG; PAM sequence: GAG
gttaaactattatacaattt

SEQ ID NO: 48410 - DNA, 20 bp, Artificial Sequence
  Description of Artificial Sequence: Synthetic oligonucleotide
  Target: SCN9A; (+) strand; PAM type: NRG; PAM sequence: TAG
catcatcattttatcttact

SEQ ID NO: 48411 - DNA, 20 bp, Artificial Sequence
  Description of Artificial Sequence: Synthetic oligonucleotide
  Target: SCN9A; (+) strand; PAM type: NRG; PAM sequence: AAG
catcattttatcttacttag

SEQ ID NO: 48412 - DNA, 20 bp, Artificial Sequence
  Description of Artificial Sequence: Synthetic oligonucleotide
  Target: SCN9A; (+) strand; PAM type: NRG; PAM sequence: CAG
tttatcttacttagaagaca

SEQ ID NO: 48413 - DNA, 20 bp, Artificial Sequence
  Description of Artificial Sequence: Synthetic oligonucleotide
  Target: SCN9A; (+) strand; PAM type: NRG; PAM sequence: AAG
aagacacagataaaacaata

SEQ ID NO: 48414 - DNA, 20 bp, Artificial Sequence
  Description of Artificial Sequence: Synthetic oligonucleotide
  Target: SCN9A; (+) strand; PAM type: NRG; PAM sequence: CAG
gataaaacaataaagccttg

SEQ ID NO: 48415 - DNA, 20 bp, Artificial Sequence
  Description of Artificial Sequence: Synthetic oligonucleotide
  Target: SCN9A; (+) strand; PAM type: NRG; PAM sequence: GAG
acaataaagccttgcagttt

SEQ ID NO: 48416 - DNA, 20 bp, Artificial Sequence
  Description of Artificial Sequence: Synthetic oligonucleotide
  Target: SCN9A; (+) strand; PAM type: NRG; PAM sequence: AGG
caataaagccttgcagtttg

SEQ ID NO: 48417 - DNA, 20 bp, Artificial Sequence
  Description of Artificial Sequence: Synthetic oligonucleotide
  Target: SCN9A; (+) strand; PAM type: NRG; PAM sequence: TAG
tgcagtttgaggtgcaaatg

SEQ ID NO: 48418 - DNA, 20 bp, Artificial Sequence
  Description of Artificial Sequence: Synthetic oligonucleotide
  Target: SCN9A; (+) strand; PAM type: NRG; PAM sequence: AGG
gcagtttgaggtgcaaatgt

SEQ ID NO: 48419 - DNA, 20 bp, Artificial Sequence
  Description of Artificial Sequence: Synthetic oligonucleotide
  Target: SCN9A; (+) strand; PAM type: NRG; PAM sequence: AAG
taggtgaaaatgtgcatgaa

SEQ ID NO: 48420 - DNA, 20 bp, Artificial Sequence
  Description of Artificial Sequence: Synthetic oligonucleotide
  Target: SCN9A; (+) strand; PAM type: NRG; PAM sequence: CGG
ctgaaaacactcctgaacct

SEQ ID NO: 48421 - DNA, 20 bp, Artificial Sequence
  Description of Artificial Sequence: Synthetic oligonucleotide
  Target: SCN9A; (+) strand; PAM type: NRG; PAM sequence: GGG
tgaaaacactcctgaacctc

SEQ ID NO: 48422 - DNA, 20 bp, Artificial Sequence
  Description of Artificial Sequence: Synthetic oligonucleotide
  Target: SCN9A; (+) strand; PAM type: NRG; PAM sequence: AAG
aaacactcctgaacctcggg

SEQ ID NO: 48423 - DNA, 20 bp, Artificial Sequence
  Description of Artificial Sequence: Synthetic oligonucleotide
  Target: SCN9A; (+) strand; PAM type: NRG; PAM sequence: AGG
aacactcctgaacctcggga

SEQ ID NO: 48424 - DNA, 20 bp, Artificial Sequence
  Description of Artificial Sequence: Synthetic oligonucleotide
  Target: SCN9A; (+) strand; PAM type: NRG; PAM sequence: TGG
ctcctgaacctcgggaagga

SEQ ID NO: 48425 - DNA, 20 bp, Artificial Sequence
  Description of Artificial Sequence: Synthetic oligonucleotide
  Target: SCN9A; (+) strand; PAM type: NRG; PAM sequence: GGG
tcctgaacctcgggaaggat

SEQ ID NO: 48426 - DNA, 20 bp, Artificial Sequence
  Description of Artificial Sequence: Synthetic oligonucleotide
  Target: SCN9A; (+) strand; PAM type: NRG; PAM sequence: TGG
aacctcgggaaggatgggcc

SEQ ID NO: 48427 - DNA, 20 bp, Artificial Sequence
  Description of Artificial Sequence: Synthetic oligonucleotide
  Target: SCN9A; (+) strand; PAM type: NRG; PAM sequence: TAG
ctcgggaaggatgggcctgg

SEQ ID NO: 48428 - DNA, 20 bp, Artificial Sequence
  Description of Artificial Sequence: Synthetic oligonucleotide
  Target: SCN9A; (+) strand; PAM type: NRG; PAM sequence: GAG
cgggaaggatgggcctggta

SEQ ID NO: 48429 - DNA, 20 bp, Artificial Sequence
  Description of Artificial Sequence: Synthetic oligonucleotide
  Target: SCN9A; (+) strand; PAM type: NRG; PAM sequence: GAG
aaggatgggcctggtagagt

SEQ ID NO: 48430 - DNA, 20 bp, Artificial Sequence
  Description of Artificial Sequence: Synthetic oligonucleotide
  Target: SCN9A; (+) strand; PAM type: NRG; PAM sequence: TGG
tgggcctggtagagtgagta

SEQ ID NO: 48431 - DNA, 20 bp, Artificial Sequence
  Description of Artificial Sequence: Synthetic oligonucleotide
  Target: SCN9A; (+) strand; PAM type: NRG; PAM sequence: GGG
gggcctggtagagtgagtat

SEQ ID NO: 48432 - DNA, 20 bp, Artificial Sequence
  Description of Artificial Sequence: Synthetic oligonucleotide
  Target: SCN9A; (+) strand; PAM type: NRG; PAM sequence: GAG
gcctggtagagtgagtatgg

SEQ ID NO: 48433 - DNA, 20 bp, Artificial Sequence
  Description of Artificial Sequence: Synthetic oligonucleotide
  Target: SCN9A; (+) strand; PAM type: NRG; PAM sequence: GAG
ctggtagagtgagtatggga

SEQ ID NO: 48434 - DNA, 20 bp, Artificial Sequence
  Description of Artificial Sequence: Synthetic oligonucleotide
  Target: SCN9A; (+) strand; PAM type: NRG; PAM sequence: AGG
tggtagagtgagtatgggag

SEQ ID NO: 48435 - DNA, 20 bp, Artificial Sequence
  Description of Artificial Sequence: Synthetic oligonucleotide
  Target: SCN9A; (+) strand; PAM type: NRG; PAM sequence: AAG
gagtgagtatgggagaggat

SEQ ID NO: 48436 - DNA, 20 bp, Artificial Sequence
  Description of Artificial Sequence: Synthetic oligonucleotide
  Target: SCN9A; (+) strand; PAM type: NRG; PAM sequence: AAG
aacatccaaaatattttaat

SEQ ID NO: 48437 - DNA, 20 bp, Artificial Sequence
  Description of Artificial Sequence: Synthetic oligonucleotide
  Target: SCN9A; (+) strand; PAM type: NRG; PAM sequence: AGG
acatccaaaatattttaata

SEQ ID NO: 48438 - DNA, 20 bp, Artificial Sequence
  Description of Artificial Sequence: Synthetic oligonucleotide
  Target: SCN9A; (+) strand; PAM type: NRG; PAM sequence: TGG
ccaaaatattttaataagga

SEQ ID NO: 48439 - DNA, 20 bp, Artificial Sequence
  Description of Artificial Sequence: Synthetic oligonucleotide
  Target: SCN9A; (+) strand; PAM type: NRG; PAM sequence: TAG
ttaataaggatggattactt

SEQ ID NO: 48440 - DNA, 20 bp, Artificial Sequence
  Description of Artificial Sequence: Synthetic oligonucleotide
  Target: SCN9A; (+) strand; PAM type: NRG; PAM sequence: TGG
attatcctttaaactaatgc

SEQ ID NO: 48441 - DNA, 20 bp, Artificial Sequence
  Description of Artificial Sequence: Synthetic oligonucleotide
  Target: SCN9A; (+) strand; PAM type: NRG; PAM sequence: GAG
gttcacatttatcaaccact

SEQ ID NO: 48442 - DNA, 20 bp, Artificial Sequence
  Description of Artificial Sequence: Synthetic oligonucleotide
  Target: SCN9A; (+) strand; PAM type: NRG; PAM sequence: AGG
ttcacatttatcaaccactg

SEQ ID NO: 48443 - DNA, 20 bp, Artificial Sequence
  Description of Artificial Sequence: Synthetic oligonucleotide
  Target: SCN9A; (+) strand; PAM type: NRG; PAM sequence: GAG
cacatttatcaaccactgag

SEQ ID NO: 48444 - DNA, 20 bp, Artificial Sequence
  Description of Artificial Sequence: Synthetic oligonucleotide
  Target: SCN9A; (+) strand; PAM type: NRG; PAM sequence: TGG
gaggagctgaattatatgaa

SEQ ID NO: 48445 - DNA, 20 bp, Artificial Sequence
  Description of Artificial Sequence: Synthetic oligonucleotide
  Target: SCN9A; (+) strand; PAM type: NRG; PAM sequence: GGG
aggagctgaattatatgaat

SEQ ID NO: 48446 - DNA, 20 bp, Artificial Sequence
  Description of Artificial Sequence: Synthetic oligonucleotide
  Target: SCN9A; (+) strand; PAM type: NRG; PAM sequence: TGG
tgaattatatgaatgggctc

SEQ ID NO: 48447 - DNA, 20 bp, Artificial Sequence
  Description of Artificial Sequence: Synthetic oligonucleotide
  Target: SCN9A; (+) strand; PAM type: NRG; PAM sequence: GAG
aattatatgaatgggctctg

SEQ ID NO: 48448 - DNA, 20 bp, Artificial Sequence
  Description of Artificial Sequence: Synthetic oligonucleotide
  Target: SCN9A; (+) strand; PAM type: NRG; PAM sequence: TAG
tgggctctggagctgtctat

SEQ ID NO: 48449 - DNA, 20 bp, Artificial Sequence
  Description of Artificial Sequence: Synthetic oligonucleotide
  Target: SCN9A; (+) strand; PAM type: NRG; PAM sequence: CAG
ctatactactgtatttaaca

SEQ ID NO: 48450 - DNA, 20 bp, Artificial Sequence
  Description of Artificial Sequence: Synthetic oligonucleotide
  Target: SCN9A; (+) strand; PAM type: NRG; PAM sequence: AAG
tactgtatttaacacagtat

SEQ ID NO: 48451 - DNA, 20 bp, Artificial Sequence
  Description of Artificial Sequence: Synthetic oligonucleotide
  Target: SCN9A; (+) strand; PAM type: NRG; PAM sequence: AAG
acacagtataagaatgatga

SEQ ID NO: 48452 - DNA, 20 bp, Artificial Sequence
  Description of Artificial Sequence: Synthetic oligonucleotide
  Target: SCN9A; (+) strand; PAM type: NRG; PAM sequence: AGG
cacagtataagaatgatgaa

SEQ ID NO: 48453 - DNA, 20 bp, Artificial Sequence
  Description of Artificial Sequence: Synthetic oligonucleotide
  Target: SCN9A; (+) strand; PAM type: NRG; PAM sequence: AAG
tataagaatgatgaaaggta

SEQ ID NO: 48454 - DNA, 20 bp, Artificial Sequence
  Description of Artificial Sequence: Synthetic oligonucleotide
  Target: SCN9A; (+) strand; PAM type: NRG; PAM sequence: CAG
tgatgaaaggtaaagcaatg

SEQ ID NO: 48455 - DNA, 20 bp, Artificial Sequence
  Description of Artificial Sequence: Synthetic oligonucleotide
  Target: SCN9A; (+) strand; PAM type: NRG; PAM sequence: AGG
gatgaaaggtaaagcaatgc

SEQ ID NO: 48456 - DNA, 20 bp, Artificial Sequence
  Description of Artificial Sequence: Synthetic oligonucleotide
  Target: SCN9A; (+) strand; PAM type: NRG; PAM sequence: TAG
gaaaggtaaagcaatgcagg

SEQ ID NO: 48457 - DNA, 20 bp, Artificial Sequence
  Description of Artificial Sequence: Synthetic oligonucleotide
  Target: SCN9A; (+) strand; PAM type: NRG; PAM sequence: TAG
gcaatgcaggtagctcactc

SEQ ID NO: 48458 - DNA, 20 bp, Artificial Sequence
  Description of Artificial Sequence: Synthetic oligonucleotide
  Target: SCN9A; (+) strand; PAM type: NRG; PAM sequence: AGG
caatgcaggtagctcactct

SEQ ID NO: 48459 - DNA, 20 bp, Artificial Sequence
  Description of Artificial Sequence: Synthetic oligonucleotide
  Target: SCN9A; (+) strand; PAM type: NRG; PAM sequence: TAG
ggtagctcactctaggtttg

SEQ ID NO: 48460 - DNA, 20 bp, Artificial Sequence
  Description of Artificial Sequence: Synthetic oligonucleotide
  Target: SCN9A; (+) strand; PAM type: NRG; PAM sequence: TAG
tacaataatttctaaacaac

SEQ ID NO: 48461 - DNA, 20 bp, Artificial Sequence
  Description of Artificial Sequence: Synthetic oligonucleotide
  Target: SCN9A; (+) strand; PAM type: NRG; PAM sequence: AAG
caactagacattaaattatt

SEQ ID NO: 48462 - DNA, 20 bp, Artificial Sequence
  Description of Artificial Sequence: Synthetic oligonucleotide
  Target: SCN9A; (+) strand; PAM type: NRG; PAM sequence: TGG
tagacattaaattattaaga

SEQ ID NO: 48463 - DNA, 20 bp, Artificial Sequence
  Description of Artificial Sequence: Synthetic oligonucleotide
  Target: SCN9A; (+) strand; PAM type: NRG; PAM sequence: TGG
cattaaattattaagatggt

SEQ ID NO: 48464 - DNA, 20 bp, Artificial Sequence
  Description of Artificial Sequence: Synthetic oligonucleotide
  Target: SCN9A; (+) strand; PAM type: NRG; PAM sequence: AAG
ttattaagatggttggcttc

SEQ ID NO: 48465 - DNA, 20 bp, Artificial Sequence
  Description of Artificial Sequence: Synthetic oligonucleotide
  Target: SCN9A; (+) strand; PAM type: NRG; PAM sequence: AAG
ttaagatggttggcttcaag

SEQ ID NO: 48466 - DNA, 20 bp, Artificial Sequence
  Description of Artificial Sequence: Synthetic oligonucleotide
  Target: SCN9A; (+) strand; PAM type: NRG; PAM sequence: AAG
ggttggcttcaagaagattt

SEQ ID NO: 48467 - DNA, 20 bp, Artificial Sequence
  Description of Artificial Sequence: Synthetic oligonucleotide
  Target: SCN9A; (+) strand; PAM type: NRG; PAM sequence: AGG
gttggcttcaagaagattta

SEQ ID NO: 48468 - DNA, 20 bp, Artificial Sequence
  Description of Artificial Sequence: Synthetic oligonucleotide
  Target: SCN9A; (+) strand; PAM type: NRG; PAM sequence: TGG
aaggttaacatctttaaaaa

SEQ ID NO: 48469 - DNA, 20 bp, Artificial Sequence
  Description of Artificial Sequence: Synthetic oligonucleotide
  Target: SCN9A; (+) strand; PAM type: NRG; PAM sequence: GGG
aggttaacatctttaaaaat

SEQ ID NO: 48470 - DNA, 20 bp, Artificial Sequence
  Description of Artificial Sequence: Synthetic oligonucleotide
  Target: SCN9A; (+) strand; PAM type: NRG; PAM sequence: AAG
atgggaaaaaattgaatgca

SEQ ID NO: 48471 - DNA, 20 bp, Artificial Sequence
  Description of Artificial Sequence: Synthetic oligonucleotide
  Target: SCN9A; (+) strand; PAM type: NRG; PAM sequence: AAG
tattgcttgtgcatattcaa

SEQ ID NO: 48472 - DNA, 20 bp, Artificial Sequence
  Description of Artificial Sequence: Synthetic oligonucleotide
  Target: SCN9A; (+) strand; PAM type: NRG; PAM sequence: TGG
tgcttgtgcatattcaaaag

SEQ ID NO: 48473 - DNA, 20 bp, Artificial Sequence
  Description of Artificial Sequence: Synthetic oligonucleotide
  Target: SCN9A; (+) strand; PAM type: NRG; PAM sequence: GGG
gcttgtgcatattcaaaagt

SEQ ID NO: 48474 - DNA, 20 bp, Artificial Sequence
  Description of Artificial Sequence: Synthetic oligonucleotide
  Target: SCN9A; (+) strand; PAM type: NRG; PAM sequence: AAG
caaaagtgggatgattctga

SEQ ID NO: 48475 - DNA, 20 bp, Artificial Sequence
  Description of Artificial Sequence: Synthetic oligonucleotide
  Target: SCN9A; (+) strand; PAM type: NRG; PAM sequence: AAG
tgggatgattctgaaagata

SEQ ID NO: 48476 - DNA, 20 bp, Artificial Sequence
  Description of Artificial Sequence: Synthetic oligonucleotide
  Target: SCN9A; (+) strand; PAM type: NRG; PAM sequence: CGG
gaaagataaagaatgaatca

SEQ ID NO: 48477 - DNA, 20 bp, Artificial Sequence
  Description of Artificial Sequence: Synthetic oligonucleotide
  Target: SCN9A; (+) strand; PAM type: NRG; PAM sequence: CGG
gataaagaatgaatcacggc

SEQ ID NO: 48478 - DNA, 20 bp, Artificial Sequence
  Description of Artificial Sequence: Synthetic oligonucleotide
  Target: SCN9A; (+) strand; PAM type: NRG; PAM sequence: GGG
ataaagaatgaatcacggcc

SEQ ID NO: 48479 - DNA, 20 bp, Artificial Sequence
  Description of Artificial Sequence: Synthetic oligonucleotide
  Target: SCN9A; (+) strand; PAM type: NRG; PAM sequence: CAG
gaatgaatcacggccgggcg

SEQ ID NO: 48480 - DNA, 20 bp, Artificial Sequence
  Description of Artificial Sequence: Synthetic oligonucleotide
  Target: SCN9A; (+) strand; PAM type: NRG; PAM sequence: TGG
tgaatcacggccgggcgcag

SEQ ID NO: 48481 - DNA, 20 bp, Artificial Sequence
  Description of Artificial Sequence: Synthetic oligonucleotide
  Target: SCN9A; (+) strand; PAM type: NRG; PAM sequence: CAG
gtggctcacgcctgtaatgc

SEQ ID NO: 48482 - DNA, 20 bp, Artificial Sequence
  Description of Artificial Sequence: Synthetic oligonucleotide
  Target: SCN9A; (+) strand; PAM type: NRG; PAM sequence: TGG
cgcctgtaatgccagcactt

SEQ ID NO: 48483 - DNA, 20 bp, Artificial Sequence
  Description of Artificial Sequence: Synthetic oligonucleotide
  Target: SCN9A; (+) strand; PAM type: NRG; PAM sequence: GGG
gcctgtaatgccagcacttt

SEQ ID NO: 48484 - DNA, 20 bp, Artificial Sequence
  Description of Artificial Sequence: Synthetic oligonucleotide
  Target: SCN9A; (+) strand; PAM type: NRG; PAM sequence: GAG
ctgtaatgccagcactttgg

SEQ ID NO: 48485 - DNA, 20 bp, Artificial Sequence
  Description of Artificial Sequence: Synthetic oligonucleotide
  Target: SCN9A; (+) strand; PAM type: NRG; PAM sequence: AGG
tgtaatgccagcactttggg

SEQ ID NO: 48486 - DNA, 20 bp, Artificial Sequence
  Description of Artificial Sequence: Synthetic oligonucleotide
  Target: SCN9A; (+) strand; PAM type: NRG; PAM sequence: GAG
tgccagcactttgggaggtc

SEQ ID NO: 48487 - DNA, 20 bp, Artificial Sequence
  Description of Artificial Sequence: Synthetic oligonucleotide
  Target: SCN9A; (+) strand; PAM type: NRG; PAM sequence: AGG
gccagcactttgggaggtcg

SEQ ID NO: 48488 - DNA, 20 bp, Artificial Sequence
  Description of Artificial Sequence: Synthetic oligonucleotide
  Target: SCN9A; (+) strand; PAM type: NRG; PAM sequence: CGG
agcactttgggaggtcgagg

SEQ ID NO: 48489 - DNA, 20 bp, Artificial Sequence
  Description of Artificial Sequence: Synthetic oligonucleotide
  Target: SCN9A; (+) strand; PAM type: NRG; PAM sequence: GGG
gcactttgggaggtcgaggc

SEQ ID NO: 48490 - DNA, 20 bp, Artificial Sequence
  Description of Artificial Sequence: Synthetic oligonucleotide
  Target: SCN9A; (+) strand; PAM type: NRG; PAM sequence: CAG
ctttgggaggtcgaggcggg

SEQ ID NO: 48491 - DNA, 20 bp, Artificial Sequence
  Description of Artificial Sequence: Synthetic oligonucleotide
  Target: SCN9A; (+) strand; PAM type: NRG; PAM sequence: GAG
ggtcgaggcgggcagatcac

SEQ ID NO: 48492 - DNA, 20 bp, Artificial Sequence
  Description of Artificial Sequence: Synthetic oligonucleotide
  Target: SCN9A; (+) strand; PAM type: NRG; PAM sequence: AGG
gtcgaggcgggcagatcacg

SEQ ID NO: 48493 - DNA, 20 bp, Artificial Sequence
  Description of Artificial Sequence: Synthetic oligonucleotide
  Target: SCN9A; (+) strand; PAM type: NRG; PAM sequence: CAG
aggcgggcagatcacgaggt

SEQ ID NO: 48494 - DNA, 20 bp, Artificial Sequence
  Description of Artificial Sequence: Synthetic oligonucleotide
  Target: SCN9A; (+) strand; PAM type: NRG; PAM sequence: AGG
ggcgggcagatcacgaggtc

SEQ ID NO: 48495 - DNA, 20 bp, Artificial Sequence
  Description of Artificial Sequence: Synthetic oligonucleotide
  Target: SCN9A; (+) strand; PAM type: NRG; PAM sequence: GAG
cgggcagatcacgaggtcag

SEQ ID NO: 48496 - DNA, 20 bp, Artificial Sequence
  Description of Artificial Sequence: Synthetic oligonucleotide
  Target: SCN9A; (+) strand; PAM type: NRG; PAM sequence: GAG
gatcacgaggtcaggagatc

SEQ ID NO: 48497 - DNA, 20 bp, Artificial Sequence
  Description of Artificial Sequence: Synthetic oligonucleotide
  Target: SCN9A; (+) strand; PAM type: NRG; PAM sequence: TGG
tcaggagatcgagaccatcc

SEQ ID NO: 48498 - DNA, 20 bp, Artificial Sequence
  Description of Artificial Sequence: Synthetic oligonucleotide
  Target: SCN9A; (+) strand; PAM type: NRG; PAM sequence: TAG
ctactaaaaatacaaaaaaa

SEQ ID NO: 48499 - DNA, 20 bp, Artificial Sequence
  Description of Artificial Sequence: Synthetic oligonucleotide
  Target: SCN9A; (+) strand; PAM type: NRG; PAM sequence: TGG
taaaaatacaaaaaaatagc

SEQ ID NO: 48500 - DNA, 20 bp, Artificial Sequence
  Description of Artificial Sequence: Synthetic oligonucleotide
  Target: SCN9A; (+) strand; PAM type: NRG; PAM sequence: GGG
aaaaatacaaaaaaatagct

SEQ ID NO: 48501 - DNA, 20 bp, Artificial Sequence
  Description of Artificial Sequence: Synthetic oligonucleotide
  Target: SCN9A; (+) strand; PAM type: NRG; PAM sequence: TGG
tacaaaaaaatagctgggcg

SEQ ID NO: 48502 - DNA, 20 bp, Artificial Sequence
  Description of Artificial Sequence: Synthetic oligonucleotide
  Target: SCN9A; (+) strand; PAM type: NRG; PAM sequence: TGG
aaaaaaatagctgggcgtgg

SEQ ID NO: 48503 - DNA, 20 bp, Artificial Sequence
  Description of Artificial Sequence: Synthetic oligonucleotide
  Target: SCN9A; (+) strand; PAM type: NRG; PAM sequence: CGG
aaaatagctgggcgtggtgg

SEQ ID NO: 48504 - DNA, 20 bp, Artificial Sequence
  Description of Artificial Sequence: Synthetic oligonucleotide
  Target: SCN9A; (+) strand; PAM type: NRG; PAM sequence: GGG
aaatagctgggcgtggtggc

SEQ ID NO: 48505 - DNA, 20 bp, Artificial Sequence
  Description of Artificial Sequence: Synthetic oligonucleotide
  Target: SCN9A; (+) strand; PAM type: NRG; PAM sequence: TAG
ggcgtggtggcgggcacctg

SEQ ID NO: 48506 - DNA, 20 bp, Artificial Sequence
  Description of Artificial Sequence: Synthetic oligonucleotide
  Target: SCN9A; (+) strand; PAM type: NRG; PAM sequence: CAG
gtggcgggcacctgtagtcc

SEQ ID NO: 48507 - DNA, 20 bp, Artificial Sequence
  Description of Artificial Sequence: Synthetic oligonucleotide
  Target: SCN9A; (+) strand; PAM type: NRG; PAM sequence: TGG
cacctgtagtcccagctact

SEQ ID NO: 48508 - DNA, 20 bp, Artificial Sequence
  Description of Artificial Sequence: Synthetic oligonucleotide
  Target: SCN9A; (+) strand; PAM type: NRG; PAM sequence: CAG
ctgtagtcccagctacttgg

SEQ ID NO: 48509 - DNA, 20 bp, Artificial Sequence
  Description of Artificial Sequence: Synthetic oligonucleotide
  Target: SCN9A; (+) strand; PAM type: NRG; PAM sequence: AGG
tgtagtcccagctacttggc

SEQ ID NO: 48510 - DNA, 20 bp, Artificial Sequence
  Description of Artificial Sequence: Synthetic oligonucleotide
  Target: SCN9A; (+) strand; PAM type: NRG; PAM sequence: GAG
tcccagctacttggcaggct

SEQ ID NO: 48511 - DNA, 20 bp, Artificial Sequence
  Description of Artificial Sequence: Synthetic oligonucleotide
  Target: SCN9A; (+) strand; PAM type: NRG; PAM sequence: AGG
cccagctacttggcaggctg

SEQ ID NO: 48512 - DNA, 20 bp, Artificial Sequence
  Description of Artificial Sequence: Synthetic oligonucleotide
  Target: SCN9A; (+) strand; PAM type: NRG; PAM sequence: CAG
agctacttggcaggctgagg

SEQ ID NO: 48513 - DNA, 20 bp, Artificial Sequence
  Description of Artificial Sequence: Synthetic oligonucleotide
  Target: SCN9A; (+) strand; PAM type: NRG; PAM sequence: AGG
gctacttggcaggctgaggc

SEQ ID NO: 48514 - DNA, 20 bp, Artificial Sequence
  Description of Artificial Sequence: Synthetic oligonucleotide
  Target: SCN9A; (+) strand; PAM type: NRG; PAM sequence: GAG
tacttggcaggctgaggcag

SEQ ID NO: 48515 - DNA, 20 bp, Artificial Sequence
  Description of Artificial Sequence: Synthetic oligonucleotide
  Target: SCN9A; (+) strand; PAM type: NRG; PAM sequence: TGG
ggcaggctgaggcaggagaa

SEQ ID NO: 48516 - DNA, 20 bp, Artificial Sequence
  Description of Artificial Sequence: Synthetic oligonucleotide
  Target: SCN9A; (+) strand; PAM type: NRG; PAM sequence: CGG
gcaggagaatggtgtgaacc

SEQ ID NO: 48517 - DNA, 20 bp, Artificial Sequence
  Description of Artificial Sequence: Synthetic oligonucleotide
  Target: SCN9A; (+) strand; PAM type: NRG; PAM sequence: GGG
caggagaatggtgtgaaccc

SEQ ID NO: 48518 - DNA, 20 bp, Artificial Sequence
  Description of Artificial Sequence: Synthetic oligonucleotide
  Target: SCN9A; (+) strand; PAM type: NRG; PAM sequence: GAG
ggagaatggtgtgaacccgg

SEQ ID NO: 48519 - DNA, 20 bp, Artificial Sequence
  Description of Artificial Sequence: Synthetic oligonucleotide
  Target: SCN9A; (+) strand; PAM type: NRG; PAM sequence: AGG
gagaatggtgtgaacccggg

SEQ ID NO: 48520 - DNA, 20 bp, Artificial Sequence
  Description of Artificial Sequence: Synthetic oligonucleotide
  Target: SCN9A; (+) strand; PAM type: NRG; PAM sequence: CGG
aatggtgtgaacccgggagg

SEQ ID NO: 48521 - DNA, 20 bp, Artificial Sequence
  Description of Artificial Sequence: Synthetic oligonucleotide
  Target: SCN9A; (+) strand; PAM type: NRG; PAM sequence: GAG
tggtgtgaacccgggaggcg

SEQ ID NO: 48522 - DNA, 20 bp, Artificial Sequence
  Description of Artificial Sequence: Synthetic oligonucleotide
  Target: SCN9A; (+) strand; PAM type: NRG; PAM sequence: CAG
aacccgggaggcggagctta

SEQ ID NO: 48523 - DNA, 20 bp, Artificial Sequence
  Description of Artificial Sequence: Synthetic oligonucleotide
  Target: SCN9A; (+) strand; PAM type: NRG; PAM sequence: GAG
cgggaggcggagcttacagt

SEQ ID NO: 48524 - DNA, 20 bp, Artificial Sequence
  Description of Artificial Sequence: Synthetic oligonucleotide
  Target: SCN9A; (+) strand; PAM type: NRG; PAM sequence: GAG
ggcggagcttacagtgagcc

SEQ ID NO: 48525 - DNA, 20 bp, Artificial Sequence
  Description of Artificial Sequence: Synthetic oligonucleotide
  Target: SCN9A; (+) strand; PAM type: NRG; PAM sequence: TAG
gagcttacagtgagccgaga

SEQ ID NO: 48526 - DNA, 20 bp, Artificial Sequence
  Description of Artificial Sequence: Synthetic oligonucleotide
  Target: SCN9A; (+) strand; PAM type: NRG; PAM sequence: CAG
gagatagcgacactgcattc

SEQ ID NO: 48527 - DNA, 20 bp, Artificial Sequence
  Description of Artificial Sequence: Synthetic oligonucleotide
  Target: SCN9A; (+) strand; PAM type: NRG; PAM sequence: TAG
agcgacactgcattccagcc

SEQ ID NO: 48528 - DNA, 20 bp, Artificial Sequence
  Description of Artificial Sequence: Synthetic oligonucleotide
  Target: SCN9A; (+) strand; PAM type: NRG; PAM sequence: AGG
gcgacactgcattccagcct

SEQ ID NO: 48529 - DNA, 20 bp, Artificial Sequence
  Description of Artificial Sequence: Synthetic oligonucleotide
  Target: SCN9A; (+) strand; PAM type: NRG; PAM sequence: CAG
ctgcattccagcctaggcga

SEQ ID NO: 48530 - DNA, 20 bp, Artificial Sequence
  Description of Artificial Sequence: Synthetic oligonucleotide
  Target: SCN9A; (+) strand; PAM type: NRG; PAM sequence: GAG
gcattccagcctaggcgaca

SEQ ID NO: 48531 - DNA, 20 bp, Artificial Sequence
  Description of Artificial Sequence: Synthetic oligonucleotide
  Target: SCN9A; (+) strand; PAM type: NRG; PAM sequence: GAG
tccagcctaggcgacagagt

SEQ ID NO: 48532 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaaaaaaaaaaaaaa

SEQ ID NO: 48533 - DNA, 20 bp, Artificial Sequence
  Description of Artificial Sequence: Synthetic oligonucleotide
  Target: SCN9A; (+) strand; PAM type: NRG; PAM sequence: CAG
aaaaaaaaagaaccatgact

SEQ ID NO: 48534 - DNA, 20 bp, Artificial Sequence
  Description of Artificial Sequence: Synthetic oligonucleotide
  Target: SCN9A; (+) strand; PAM type: NRG; PAM sequence: TAG
tgactcagtaatcccactac

SEQ ID NO: 48535 - DNA, 20 bp, Artificial Sequence
  Description of Artificial Sequence: Synthetic oligonucleotide
  Target: SCN9A; (+) strand; PAM type: NRG; PAM sequence: AGG
gactcagtaatcccactact

SEQ ID NO: 48536 - DNA, 20 bp, Artificial Sequence
  Description of Artificial Sequence: Synthetic oligonucleotide
  Target: SCN9A; (+) strand; PAM type: NRG; PAM sequence: GAG
cccactactaggtatatact

SEQ ID NO: 48537 - DNA, 20 bp, Artificial Sequence
  Description of Artificial Sequence: Synthetic oligonucleotide
  Target: SCN9A; (+) strand; PAM type: NRG; PAM sequence: CAG
aacttgtacatgaatgttta

SEQ ID NO: 48538 - DNA, 20 bp, Artificial Sequence
  Description of Artificial Sequence: Synthetic oligonucleotide
  Target: SCN9A; (+) strand; PAM type: NRG; PAM sequence: AAG
acattatgcattataaccaa

SEQ ID NO: 48539 - DNA, 20 bp, Artificial Sequence
  Description of Artificial Sequence: Synthetic oligonucleotide
  Target: SCN9A; (+) strand; PAM type: NRG; PAM sequence: CGG
tatgcattataaccaaaaga

SEQ ID NO: 48540 - DNA, 20 bp, Artificial Sequence
  Description of Artificial Sequence: Synthetic oligonucleotide
  Target: SCN9A; (+) strand; PAM type: NRG; PAM sequence: TAG
atgaatgtataaacaaaata

SEQ ID NO: 48541 - DNA, 20 bp, Artificial Sequence
  Description of Artificial Sequence: Synthetic oligonucleotide
  Target: SCN9A; (+) strand; PAM type: NRG; PAM sequence: TAG
acatacaatgaaatatcatt

SEQ ID NO: 48542 - DNA, 20 bp, Artificial Sequence
  Description of Artificial Sequence: Synthetic oligonucleotide
  Target: SCN9A; (+) strand; PAM type: NRG; PAM sequence: AAG
aaatatcatttagcaataaa

SEQ ID NO: 48543 - DNA, 20 bp, Artificial Sequence
  Description of Artificial Sequence: Synthetic oligonucleotide
  Target: SCN9A; (+) strand; PAM type: NRG; PAM sequence: AAG
tttagcaataaaaagaaatg

SEQ ID NO: 48544 - DNA, 20 bp, Artificial Sequence
  Description of Artificial Sequence: Synthetic oligonucleotide
  Target: SCN9A; (+) strand; PAM type: NRG; PAM sequence: TAG
caataaaaagaaatgaagca

SEQ ID NO: 48545 - DNA, 20 bp, Artificial Sequence
  Description of Artificial Sequence: Synthetic oligonucleotide
  Target: SCN9A; (+) strand; PAM type: NRG; PAM sequence: TGG
catagatacatactatacca

SEQ ID NO: 48546 - DNA, 20 bp, Artificial Sequence
  Description of Artificial Sequence: Synthetic oligonucleotide
  Target: SCN9A; (+) strand; PAM type: NRG; PAM sequence: TAG
aaattttgaaaacattatgc

SEQ ID NO: 48547 - DNA, 20 bp, Artificial Sequence
  Description of Artificial Sequence: Synthetic oligonucleotide
  Target: SCN9A; (+) strand; PAM type: NRG; PAM sequence: AGG
aattttgaaaacattatgct

SEQ ID NO: 48548 - DNA, 20 bp, Artificial Sequence
  Description of Artificial Sequence: Synthetic oligonucleotide
  Target: SCN9A; (+) strand; PAM type: NRG; PAM sequence: AAG
gaaaacattatgctaggtgt

SEQ ID NO: 48549 - DNA, 20 bp, Artificial Sequence
  Description of Artificial Sequence: Synthetic oligonucleotide
  Target: SCN9A; (+) strand; PAM type: NRG; PAM sequence: AAG
aacattatgctaggtgtaag

SEQ ID NO: 48550 - DNA, 20 bp, Artificial Sequence
  Description of Artificial Sequence: Synthetic oligonucleotide
  Target: SCN9A; (+) strand; PAM type: NRG; PAM sequence: CAG
ttatgctaggtgtaagaagc

SEQ ID NO: 48551 - DNA, 20 bp, Artificial Sequence
  Description of Artificial Sequence: Synthetic oligonucleotide
  Target: SCN9A; (+) strand; PAM type: NRG; PAM sequence: AAG
tgtaagaagccagatacaaa

SEQ ID NO: 48552 - DNA, 20 bp, Artificial Sequence
  Description of Artificial Sequence: Synthetic oligonucleotide
  Target: SCN9A; (+) strand; PAM type: NRG; PAM sequence: CAG
ttccatgtatattaaatcta

SEQ ID NO: 48553 - DNA, 20 bp, Artificial Sequence
  Description of Artificial Sequence: Synthetic oligonucleotide
  Target: SCN9A; (+) strand; PAM type: NRG; PAM sequence: GAG
ccatgtatattaaatctaca

SEQ ID NO: 48554 - DNA, 20 bp, Artificial Sequence
  Description of Artificial Sequence: Synthetic oligonucleotide
  Target: SCN9A; (+) strand; PAM type: NRG; PAM sequence: TGG
tgtatattaaatctacagag

SEQ ID NO: 48555 - DNA, 20 bp, Artificial Sequence
  Description of Artificial Sequence: Synthetic oligonucleotide
  Target: SCN9A; (+) strand; PAM type: NRG; PAM sequence: GGG
gtatattaaatctacagagt

SEQ ID NO: 48556 - DNA, 20 bp, Artificial Sequence
  Description of Artificial Sequence: Synthetic oligonucleotide
  Target: SCN9A; (+) strand; PAM type: NRG; PAM sequence: TAG
ctacagagtgggtaaatccc

SEQ ID NO: 48557 - DNA, 20 bp, Artificial Sequence
  Description of Artificial Sequence: Synthetic oligonucleotide
  Target: SCN9A; (+) strand; PAM type: NRG; PAM sequence: AGG
tacagagtgggtaaatccct

SEQ ID NO: 48558 - DNA, 20 bp, Artificial Sequence
  Description of Artificial Sequence: Synthetic oligonucleotide
  Target: SCN9A; (+) strand; PAM type: NRG; PAM sequence: GGG
acagagtgggtaaatcccta

SEQ ID NO: 48559 - DNA, 20 bp, Artificial Sequence
  Description of Artificial Sequence: Synthetic oligonucleotide
  Target: SCN9A; (+) strand; PAM type: NRG; PAM sequence: CAG
agtgggtaaatccctaggga

SEQ ID NO: 48560 - DNA, 20 bp, Artificial Sequence
  Description of Artificial Sequence: Synthetic oligonucleotide
  Target: SCN9A; (+) strand; PAM type: NRG; PAM sequence: AAG
ggtaaatccctagggacaga

SEQ ID NO: 48561 - DNA, 20 bp, Artificial Sequence
  Description of Artificial Sequence: Synthetic oligonucleotide
  Target: SCN9A; (+) strand; PAM type: NRG; PAM sequence: TAG
aaatccctagggacagaaag

SEQ ID NO: 48562 - DNA, 20 bp, Artificial Sequence
  Description of Artificial Sequence: Synthetic oligonucleotide
  Target: SCN9A; (+) strand; PAM type: NRG; PAM sequence: TAG
cctagggacagaaagtagat

SEQ ID NO: 48563 - DNA, 20 bp, Artificial Sequence
  Description of Artificial Sequence: Synthetic oligonucleotide
  Target: SCN9A; (+) strand; PAM type: NRG; PAM sequence: TGG
agggacagaaagtagattag

SEQ ID NO: 48564 - DNA, 20 bp, Artificial Sequence
  Description of Artificial Sequence: Synthetic oligonucleotide
  Target: SCN9A; (+) strand; PAM type: NRG; PAM sequence: CAG
gaaagtagattagtggttgc

SEQ ID NO: 48565 - DNA, 20 bp, Artificial Sequence
  Description of Artificial Sequence: Synthetic oligonucleotide
  Target: SCN9A; (+) strand; PAM type: NRG; PAM sequence: AGG
aaagtagattagtggttgcc

SEQ ID NO: 48566 - DNA, 20 bp, Artificial Sequence
  Description of Artificial Sequence: Synthetic oligonucleotide
  Target: SCN9A; (+) strand; PAM type: NRG; PAM sequence: GGG
aagtagattagtggttgcca

SEQ ID NO: 48567 - DNA, 20 bp, Artificial Sequence
  Description of Artificial Sequence: Synthetic oligonucleotide
  Target: SCN9A; (+) strand; PAM type: NRG; PAM sequence: GGG
agtagattagtggttgccag

SEQ ID NO: 48568 - DNA, 20 bp, Artificial Sequence
  Description of Artificial Sequence: Synthetic oligonucleotide
  Target: SCN9A; (+) strand; PAM type: NRG; PAM sequence: TGG
gattagtggttgccaggggc

SEQ ID NO: 48569 - DNA, 20 bp, Artificial Sequence
  Description of Artificial Sequence: Synthetic oligonucleotide
  Target: SCN9A; (+) strand; PAM type: NRG; PAM sequence: GGG
attagtggttgccaggggct

SEQ ID NO: 48570 - DNA, 20 bp, Artificial Sequence
  Description of Artificial Sequence: Synthetic oligonucleotide
  Target: SCN9A; (+) strand; PAM type: NRG; PAM sequence: GAG
tagtggttgccaggggctgg

SEQ ID NO: 48571 - DNA, 20 bp, Artificial Sequence
  Description of Artificial Sequence: Synthetic oligonucleotide
  Target: SCN9A; (+) strand; PAM type: NRG; PAM sequence: AAG
gttgccaggggctgggagaa

SEQ ID NO: 48572 - DNA, 20 bp, Artificial Sequence
  Description of Artificial Sequence: Synthetic oligonucleotide
  Target: SCN9A; (+) strand; PAM type: NRG; PAM sequence: AGG
ttgccaggggctgggagaaa

SEQ ID NO: 48573 - DNA, 20 bp, Artificial Sequence
  Description of Artificial Sequence: Synthetic oligonucleotide
  Target: SCN9A; (+) strand; PAM type: NRG; PAM sequence: GGG
tgccaggggctgggagaaaa

SEQ ID NO: 48574 - DNA, 20 bp, Artificial Sequence
  Description of Artificial Sequence: Synthetic oligonucleotide
  Target: SCN9A; (+) strand; PAM type: NRG; PAM sequence: TGG
gggctgggagaaaagggaaa

SEQ ID NO: 48575 - DNA, 20 bp, Artificial Sequence
  Description of Artificial Sequence: Synthetic oligonucleotide
  Target: SCN9A; (+) strand; PAM type: NRG; PAM sequence: GGG
ggctgggagaaaagggaaat

SEQ ID NO: 48576 - DNA, 20 bp, Artificial Sequence
  Description of Artificial Sequence: Synthetic oligonucleotide
  Target: SCN9A; (+) strand; PAM type: NRG; PAM sequence: GGG
gctgggagaaaagggaaatg

SEQ ID NO: 48577 - DNA, 20 bp, Artificial Sequence
  Description of Artificial Sequence: Synthetic oligonucleotide
  Target: SCN9A; (+) strand; PAM type: NRG; PAM sequence: CGG
aaatggggaatgactactaa

SEQ ID NO: 48578 - DNA, 20 bp, Artificial Sequence
  Description of Artificial Sequence: Synthetic oligonucleotide
  Target: SCN9A; (+) strand; PAM type: NRG; PAM sequence: GGG
aatggggaatgactactaac

SEQ ID NO: 48579 - DNA, 20 bp, Artificial Sequence
  Description of Artificial Sequence: Synthetic oligonucleotide
  Target: SCN9A; (+) strand; PAM type: NRG; PAM sequence: TGG
gaatgactactaacgggccc

SEQ ID NO: 48580 - DNA, 20 bp, Artificial Sequence
  Description of Artificial Sequence: Synthetic oligonucleotide
  Target: SCN9A; (+) strand; PAM type: NRG; PAM sequence: GGG
aatgactactaacgggccct

SEQ ID NO: 48581 - DNA, 20 bp, Artificial Sequence
  Description of Artificial Sequence: Synthetic oligonucleotide
  Target: SCN9A; (+) strand; PAM type: NRG; PAM sequence: TGG
ctaacgggccctgggtttct

SEQ ID NO: 48582 - DNA, 20 bp, Artificial Sequence
  Description of Artificial Sequence: Synthetic oligonucleotide
  Target: SCN9A; (+) strand; PAM type: NRG; PAM sequence: TGG
acgggccctgggtttcttgg

SEQ ID NO: 48583 - DNA, 20 bp, Artificial Sequence
  Description of Artificial Sequence: Synthetic oligonucleotide
  Target: SCN9A; (+) strand; PAM type: NRG; PAM sequence: GGG
cgggccctgggtttcttggt

SEQ ID NO: 48584 - DNA, 20 bp, Artificial Sequence
  Description of Artificial Sequence: Synthetic oligonucleotide
  Target: SCN9A; (+) strand; PAM type: NRG; PAM sequence: AAG
ccctgggtttcttggtggga

SEQ ID NO: 48585 - DNA, 20 bp, Artificial Sequence
  Description of Artificial Sequence: Synthetic oligonucleotide
  Target: SCN9A; (+) strand; PAM type: NRG; PAM sequence: TAG
aagatgaaaatattttaaat

SEQ ID NO: 48586 - DNA, 20 bp, Artificial Sequence
  Description of Artificial Sequence: Synthetic oligonucleotide
  Target: SCN9A; (+) strand; PAM type: NRG; PAM sequence: TAG
tgaaaatattttaaattaga

SEQ ID NO: 48587 - DNA, 20 bp, Artificial Sequence
  Description of Artificial Sequence: Synthetic oligonucleotide
  Target: SCN9A; (+) strand; PAM type: NRG; PAM sequence: TGG
aaatattttaaattagatag

SEQ ID NO: 48588 - DNA, 20 bp, Artificial Sequence
  Description of Artificial Sequence: Synthetic oligonucleotide
  Target: SCN9A; (+) strand; PAM type: NRG; PAM sequence: GAG
ggcgatcgttgcacaactct

SEQ ID NO: 48589 - DNA, 20 bp, Artificial Sequence
  Description of Artificial Sequence: Synthetic oligonucleotide
  Target: SCN9A; (+) strand; PAM type: NRG; PAM sequence: TAG
tcgttgcacaactctgagta

SEQ ID NO: 48590 - DNA, 20 bp, Artificial Sequence
  Description of Artificial Sequence: Synthetic oligonucleotide
  Target: SCN9A; (+) strand; PAM type: NRG; PAM sequence: GAG
ctgagtatagtttaaaaaat

SEQ ID NO: 48591 - DNA, 20 bp, Artificial Sequence
  Description of Artificial Sequence: Synthetic oligonucleotide
  Target: SCN9A; (+) strand; PAM type: NRG; PAM sequence: CAG
agtttaaaaaatgagttata

SEQ ID NO: 48592 - DNA, 20 bp, Artificial Sequence
  Description of Artificial Sequence: Synthetic oligonucleotide
  Target: SCN9A; (+) strand; PAM type: NRG; PAM sequence: AAG
tgagttatacagtttaaaaa

SEQ ID NO: 48593 - DNA, 20 bp, Artificial Sequence
  Description of Artificial Sequence: Synthetic oligonucleotide
  Target: SCN9A; (+) strand; PAM type: NRG; PAM sequence: AGG
gagttatacagtttaaaaaa

SEQ ID NO: 48594 - DNA, 20 bp, Artificial Sequence
  Description of Artificial Sequence: Synthetic oligonucleotide
  Target: SCN9A; (+) strand; PAM type: NRG; PAM sequence: TGG
gtttaaaaaaaggaattttg

SEQ ID NO: 48595 - DNA, 20 bp, Artificial Sequence
  Description of Artificial Sequence: Synthetic oligonucleotide
  Target: SCN9A; (+) strand; PAM type: NRG; PAM sequence: AAG
ctcaataaacctatttttaa

SEQ ID NO: 48596 - DNA, 20 bp, Artificial Sequence
  Description of Artificial Sequence: Synthetic oligonucleotide
  Target: SCN9A; (+) strand; PAM type: NRG; PAM sequence: AGG
tcaataaacctatttttaaa

SEQ ID NO: 48597 - DNA, 20 bp, Artificial Sequence
  Description of Artificial Sequence: Synthetic oligonucleotide
  Target: SCN9A; (+) strand; PAM type: NRG; PAM sequence: GGG
caataaacctatttttaaaa

SEQ ID NO: 48598 - DNA, 20 bp, Artificial Sequence
  Description of Artificial Sequence: Synthetic oligonucleotide
  Target: SCN9A; (+) strand; PAM type: NRG; PAM sequence: CAG
cctatttttaaaagggaatg

SEQ ID NO: 48599 - DNA, 20 bp, Artificial Sequence
  Description of Artificial Sequence: Synthetic oligonucleotide
  Target: SCN9A; (+) strand; PAM type: NRG; PAM sequence: CGG
taaaagggaatgcagcataa

SEQ ID NO: 48600 - DNA, 20 bp, Artificial Sequence
  Description of Artificial Sequence: Synthetic oligonucleotide
  Target: SCN9A; (+) strand; PAM type: NRG; PAM sequence: AAG
gggaatgcagcataacggca

SEQ ID NO: 48601 - DNA, 20 bp, Artificial Sequence
  Description of Artificial Sequence: Synthetic oligonucleotide
  Target: SCN9A; (+) strand; PAM type: NRG; PAM sequence: AGG
ggaatgcagcataacggcaa

SEQ ID NO: 48602 - DNA, 20 bp, Artificial Sequence
  Description of Artificial Sequence: Synthetic oligonucleotide
  Target: SCN9A; (+) strand; PAM type: NRG; PAM sequence: TGG
cagcataacggcaaaggttg

SEQ ID NO: 48603 - DNA, 20 bp, Artificial Sequence
  Description of Artificial Sequence: Synthetic oligonucleotide
  Target: SCN9A; (+) strand; PAM type: NRG; PAM sequence: GGG
agcataacggcaaaggttgt

SEQ ID NO: 48604 - DNA, 20 bp, Artificial Sequence
  Description of Artificial Sequence: Synthetic oligonucleotide
  Target: SCN9A; (+) strand; PAM type: NRG; PAM sequence: TGG
ataacggcaaaggttgtggg

SEQ ID NO: 48605 - DNA, 20 bp, Artificial Sequence
  Description of Artificial Sequence: Synthetic oligonucleotide
  Target: SCN9A; (+) strand; PAM type: NRG; PAM sequence: GGG
taacggcaaaggttgtgggt

SEQ ID NO: 48606 - DNA, 20 bp, Artificial Sequence
  Description of Artificial Sequence: Synthetic oligonucleotide
  Target: SCN9A; (+) strand; PAM type: NRG; PAM sequence: GGG
aacggcaaaggttgtgggtg

SEQ ID NO: 48607 - DNA, 20 bp, Artificial Sequence
  Description of Artificial Sequence: Synthetic oligonucleotide
  Target: SCN9A; (+) strand; PAM type: NRG; PAM sequence: GGG
acggcaaaggttgtgggtgg

SEQ ID NO: 48608 - DNA, 20 bp, Artificial Sequence
  Description of Artificial Sequence: Synthetic oligonucleotide
  Target: SCN9A; (+) strand; PAM type: NRG; PAM sequence: TGG
acttatcactaaaatacgta

SEQ ID NO: 48609 - DNA, 20 bp, Artificial Sequence
  Description of Artificial Sequence: Synthetic oligonucleotide
  Target: SCN9A; (+) strand; PAM type: NRG; PAM sequence: GGG
cttatcactaaaatacgtat

SEQ ID NO: 48610 - DNA, 20 bp, Artificial Sequence
  Description of Artificial Sequence: Synthetic oligonucleotide
  Target: SCN9A; (+) strand; PAM type: NRG; PAM sequence: GGG
ttatcactaaaatacgtatg

SEQ ID NO: 48611 - DNA, 20 bp, Artificial Sequence
  Description of Artificial Sequence: Synthetic oligonucleotide
  Target: SCN9A; (+) strand; PAM type: NRG; PAM sequence: CAG
aaattgatataacaaaaata

SEQ ID NO: 48612 - DNA, 20 bp, Artificial Sequence
  Description of Artificial Sequence: Synthetic oligonucleotide
  Target: SCN9A; (+) strand; PAM type: NRG; PAM sequence: AAG
aattgatattaaatctaatg

SEQ ID NO: 48613 - DNA, 20 bp, Artificial Sequence
  Description of Artificial Sequence: Synthetic oligonucleotide
  Target: SCN9A; (+) strand; PAM type: NRG; PAM sequence: TGG
attaaatctaatgaagattc

SEQ ID NO: 48614 - DNA, 20 bp, Artificial Sequence
  Description of Artificial Sequence: Synthetic oligonucleotide
  Target: SCN9A; (+) strand; PAM type: NRG; PAM sequence: GGG
ttaaatctaatgaagattct

SEQ ID NO: 48615 - DNA, 20 bp, Artificial Sequence
  Description of Artificial Sequence: Synthetic oligonucleotide
  Target: SCN9A; (+) strand; PAM type: NRG; PAM sequence: AAG
tctaatgaagattctgggtg

SEQ ID NO: 48616 - DNA, 20 bp, Artificial Sequence
  Description of Artificial Sequence: Synthetic oligonucleotide
  Target: SCN9A; (+) strand; PAM type: NRG; PAM sequence: AAG
aagtttttaaattaattttc

SEQ ID NO: 48617 - DNA, 20 bp, Artificial Sequence
  Description of Artificial Sequence: Synthetic oligonucleotide
  Target: SCN9A; (+) strand; PAM type: NRG; PAM sequence: TAG
attaattttcaagattaatg

SEQ ID NO: 48618 - DNA, 20 bp, Artificial Sequence
  Description of Artificial Sequence: Synthetic oligonucleotide
  Target: SCN9A; (+) strand; PAM type: NRG; PAM sequence: TAG
tcaagattaatgtagcaaaa

SEQ ID NO: 48619 - DNA, 20 bp, Artificial Sequence
  Description of Artificial Sequence: Synthetic oligonucleotide
  Target: SCN9A; (+) strand; PAM type: NRG; PAM sequence: TGG
tagcaaaatagaaaaaaaaa

SEQ ID NO: 48620 - DNA, 20 bp, Artificial Sequence
  Description of Artificial Sequence: Synthetic oligonucleotide
  Target: SCN9A; (+) strand; PAM type: NRG; PAM sequence: CAG
atggtaattctgcccttgct

SEQ ID NO: 48621 - DNA, 20 bp, Artificial Sequence
  Description of Artificial Sequence: Synthetic oligonucleotide
  Target: SCN9A; (+) strand; PAM type: NRG; PAM sequence: AAG
taattctgcccttgctcaga

SEQ ID NO: 48622 - DNA, 20 bp, Artificial Sequence
  Description of Artificial Sequence: Synthetic oligonucleotide
  Target: SCN9A; (+) strand; PAM type: NRG; PAM sequence: TGG
caacttatgacaattgtgta

SEQ ID NO: 48623 - DNA, 20 bp, Artificial Sequence
  Description of Artificial Sequence: Synthetic oligonucleotide
  Target: SCN9A; (+) strand; PAM type: NRG; PAM sequence: TGG
tatgacaattgtgtatggct

SEQ ID NO: 48624 - DNA, 20 bp, Artificial Sequence
  Description of Artificial Sequence: Synthetic oligonucleotide
  Target: SCN9A; (+) strand; PAM type: NRG; PAM sequence: GGG
atgacaattgtgtatggctt

SEQ ID NO: 48625 - DNA, 20 bp, Artificial Sequence
  Description of Artificial Sequence: Synthetic oligonucleotide
  Target: SCN9A; (+) strand; PAM type: NRG; PAM sequence: TGG
ttgtgtatggcttgggccta

SEQ ID NO: 48626 - DNA, 20 bp, Artificial Sequence
  Description of Artificial Sequence: Synthetic oligonucleotide
  Target: SCN9A; (+) strand; PAM type: NRG; PAM sequence: AAG
tgtatggcttgggcctatgg

SEQ ID NO: 48627 - DNA, 20 bp, Artificial Sequence
  Description of Artificial Sequence: Synthetic oligonucleotide
  Target: SCN9A; (+) strand; PAM type: NRG; PAM sequence: AAG
ggcttgggcctatggaagtg

SEQ ID NO: 48628 - DNA, 20 bp, Artificial Sequence
  Description of Artificial Sequence: Synthetic oligonucleotide
  Target: SCN9A; (+) strand; PAM type: NRG; PAM sequence: GAG
cttgggcctatggaagtgaa

SEQ ID NO: 48629 - DNA, 20 bp, Artificial Sequence
  Description of Artificial Sequence: Synthetic oligonucleotide
  Target: SCN9A; (+) strand; PAM type: NRG; PAM sequence: AAG
tgaagagtatatccccaacg

SEQ ID NO: 48630 - DNA, 20 bp, Artificial Sequence
  Description of Artificial Sequence: Synthetic oligonucleotide
  Target: SCN9A; (+) strand; PAM type: NRG; PAM sequence: AGG
gaagagtatatccccaacga

SEQ ID NO: 48631 - DNA, 20 bp, Artificial Sequence
  Description of Artificial Sequence: Synthetic oligonucleotide
  Target: SCN9A; (+) strand; PAM type: NRG; PAM sequence: GGG
aagagtatatccccaacgaa

SEQ ID NO: 48632 - DNA, 20 bp, Artificial Sequence
  Description of Artificial Sequence: Synthetic oligonucleotide
  Target: SCN9A; (+) strand; PAM type: NRG; PAM sequence: GAG
agggcaaataatgcaactct

SEQ ID NO: 48633 - DNA, 20 bp, Artificial Sequence
  Description of Artificial Sequence: Synthetic oligonucleotide
  Target: SCN9A; (+) strand; PAM type: NRG; PAM sequence: TAG
taatgcaactctgagaaaac

SEQ ID NO: 48634 - DNA, 20 bp, Artificial Sequence
  Description of Artificial Sequence: Synthetic oligonucleotide
  Target: SCN9A; (+) strand; PAM type: NRG; PAM sequence: CAG
caactctgagaaaactagtg

SEQ ID NO: 48635 - DNA, 20 bp, Artificial Sequence
  Description of Artificial Sequence: Synthetic oligonucleotide
  Target: SCN9A; (+) strand; PAM type: NRG; PAM sequence: AGG
aactctgagaaaactagtgc

SEQ ID NO: 48636 - DNA, 20 bp, Artificial Sequence
  Description of Artificial Sequence: Synthetic oligonucleotide
  Target: SCN9A; (+) strand; PAM type: NRG; PAM sequence: GGG
actctgagaaaactagtgca

SEQ ID NO: 48637 - DNA, 20 bp, Artificial Sequence
  Description of Artificial Sequence: Synthetic oligonucleotide
  Target: SCN9A; (+) strand; PAM type: NRG; PAM sequence: GGG
ctctgagaaaactagtgcag

SEQ ID NO: 48638 - DNA, 20 bp, Artificial Sequence
  Description of Artificial Sequence: Synthetic oligonucleotide
  Target: SCN9A; (+) strand; PAM type: NRG; PAM sequence: CAG
agaaaactagtgcaggggat

SEQ ID NO: 48639 - DNA, 20 bp, Artificial Sequence
  Description of Artificial Sequence: Synthetic oligonucleotide
  Target: SCN9A; (+) strand; PAM type: NRG; PAM sequence: AGG
gaaaactagtgcaggggatc

SEQ ID NO: 48640 - DNA, 20 bp, Artificial Sequence
  Description of Artificial Sequence: Synthetic oligonucleotide
  Target: SCN9A; (+) strand; PAM type: NRG; PAM sequence: TGG
ctagtgcaggggatcaggac

SEQ ID NO: 48641 - DNA, 20 bp, Artificial Sequence
  Description of Artificial Sequence: Synthetic oligonucleotide
  Target: SCN9A; (+) strand; PAM type: NRG; PAM sequence: GGG
tagtgcaggggatcaggact

SEQ ID NO: 48642 - DNA, 20 bp, Artificial Sequence
  Description of Artificial Sequence: Synthetic oligonucleotide
  Target: SCN9A; (+) strand; PAM type: NRG; PAM sequence: CAG
tgcaggggatcaggactggg

SEQ ID NO: 48643 - DNA, 20 bp, Artificial Sequence
  Description of Artificial Sequence: Synthetic oligonucleotide
  Target: SCN9A; (+) strand; PAM type: NRG; PAM sequence: GAG
caggggatcaggactgggca

SEQ ID NO: 48644 - DNA, 20 bp, Artificial Sequence
  Description of Artificial Sequence: Synthetic oligonucleotide
  Target: SCN9A; (+) strand; PAM type: NRG; PAM sequence: AGG
aggggatcaggactgggcag

SEQ ID NO: 48645 - DNA, 20 bp, Artificial Sequence
  Description of Artificial Sequence: Synthetic oligonucleotide
  Target: SCN9A; (+) strand; PAM type: NRG; PAM sequence: GGG
ggggatcaggactgggcaga

SEQ ID NO: 48646 - DNA, 20 bp, Artificial Sequence
  Description of Artificial Sequence: Synthetic oligonucleotide
  Target: SCN9A; (+) strand; PAM type: NRG; PAM sequence: TGG
gcacatgatactctacactc

SEQ ID NO: 48647 - DNA, 20 bp, Artificial Sequence
  Description of Artificial Sequence: Synthetic oligonucleotide
  Target: SCN9A; (+) strand; PAM type: NRG; PAM sequence: TAG
actctacactctggcaaatg

SEQ ID NO: 48648 - DNA, 20 bp, Artificial Sequence
  Description of Artificial Sequence: Synthetic oligonucleotide
  Target: SCN9A; (+) strand; PAM type: NRG; PAM sequence: AAG
ctggcaaatgtagttctcac

SEQ ID NO: 48649 - DNA, 20 bp, Artificial Sequence
  Description of Artificial Sequence: Synthetic oligonucleotide
  Target: SCN9A; (+) strand; PAM type: NRG; PAM sequence: CAG
atgtagttctcacaagaaaa

SEQ ID NO: 48650 - DNA, 20 bp, Artificial Sequence
  Description of Artificial Sequence: Synthetic oligonucleotide
  Target: SCN9A; (+) strand; PAM type: NRG; PAM sequence: TAG
ttctcacaagaaaacagctg

SEQ ID NO: 48651 - DNA, 20 bp, Artificial Sequence
  Description of Artificial Sequence: Synthetic oligonucleotide
  Target: SCN9A; (+) strand; PAM type: NRG; PAM sequence: AAG
caagaaaacagctgtagatg

SEQ ID NO: 48652 - DNA, 20 bp, Artificial Sequence
  Description of Artificial Sequence: Synthetic oligonucleotide
  Target: SCN9A; (+) strand; PAM type: NRG; PAM sequence: AGG
aagaaaacagctgtagatga

SEQ ID NO: 48653 - DNA, 20 bp, Artificial Sequence
  Description of Artificial Sequence: Synthetic oligonucleotide
  Target: SCN9A; (+) strand; PAM type: NRG; PAM sequence: GAG
gaaaacagctgtagatgaag

SEQ ID NO: 48654 - DNA, 20 bp, Artificial Sequence
  Description of Artificial Sequence: Synthetic oligonucleotide
  Target: SCN9A; (+) strand; PAM type: NRG; PAM sequence: TAG
acagctgtagatgaaggaga

SEQ ID NO: 48655 - DNA, 20 bp, Artificial Sequence
  Description of Artificial Sequence: Synthetic oligonucleotide
  Target: SCN9A; (+) strand; PAM type: NRG; PAM sequence: AGG
cagctgtagatgaaggagat

SEQ ID NO: 48656 - DNA, 20 bp, Artificial Sequence
  Description of Artificial Sequence: Synthetic oligonucleotide
  Target: SCN9A; (+) strand; PAM type: NRG; PAM sequence: TAG
ggagataggaaaattcctgt

SEQ ID NO: 48657 - DNA, 20 bp, Artificial Sequence
  Description of Artificial Sequence: Synthetic oligonucleotide
  Target: SCN9A; (+) strand; PAM type: NRG; PAM sequence: TAG
gataggaaaattcctgttag

SEQ ID NO: 48658 - DNA, 20 bp, Artificial Sequence
  Description of Artificial Sequence: Synthetic oligonucleotide
  Target: SCN9A; (+) strand; PAM type: NRG; PAM sequence: AAG
gaaaattcctgttagtagtg

SEQ ID NO: 48659 - DNA, 20 bp, Artificial Sequence
  Description of Artificial Sequence: Synthetic oligonucleotide
  Target: SCN9A; (+) strand; PAM type: NRG; PAM sequence: AGG
aaaattcctgttagtagtga

SEQ ID NO: 48660 - DNA, 20 bp, Artificial Sequence
  Description of Artificial Sequence: Synthetic oligonucleotide
  Target: SCN9A; (+) strand; PAM type: NRG; PAM sequence: CGG
agtagtgaaggccaatattg

SEQ ID NO: 48661 - DNA, 20 bp, Artificial Sequence
  Description of Artificial Sequence: Synthetic oligonucleotide
  Target: SCN9A; (+) strand; PAM type: NRG; PAM sequence: TAG
ctctattaaatgtcaaatat

SEQ ID NO: 48662 - DNA, 20 bp, Artificial Sequence
  Description of Artificial Sequence: Synthetic oligonucleotide
  Target: SCN9A; (+) strand; PAM type: NRG; PAM sequence: CAG
aatgtcaaatattagaaaaa

SEQ ID NO: 48663 - DNA, 20 bp, Artificial Sequence
  Description of Artificial Sequence: Synthetic oligonucleotide
  Target: SCN9A; (+) strand; PAM type: NRG; PAM sequence: AGG
atgtcaaatattagaaaaac

SEQ ID NO: 48664 - DNA, 20 bp, Artificial Sequence
  Description of Artificial Sequence: Synthetic oligonucleotide
  Target: SCN9A; (+) strand; PAM type: NRG; PAM sequence: GAG
gtcaaatattagaaaaacag

SEQ ID NO: 48665 - DNA, 20 bp, Artificial Sequence
  Description of Artificial Sequence: Synthetic oligonucleotide
  Target: SCN9A; (+) strand; PAM type: NRG; PAM sequence: AGG
tcaaatattagaaaaacagg

SEQ ID NO: 48666 - DNA, 20 bp, Artificial Sequence
  Description of Artificial Sequence: Synthetic oligonucleotide
  Target: SCN9A; (+) strand; PAM type: NRG; PAM sequence: AAG
aatattagaaaaacaggagg

SEQ ID NO: 48667 - DNA, 20 bp, Artificial Sequence
  Description of Artificial Sequence: Synthetic oligonucleotide
  Target: SCN9A; (+) strand; PAM type: NRG; PAM sequence: GAG
tattagaaaaacaggaggaa

SEQ ID NO: 48668 - DNA, 20 bp, Artificial Sequence
  Description of Artificial Sequence: Synthetic oligonucleotide
  Target: SCN9A; (+) strand; PAM type: NRG; PAM sequence: TAG
aggaagagaatatcctgttt

SEQ ID NO: 48669 - DNA, 20 bp, Artificial Sequence
  Description of Artificial Sequence: Synthetic oligonucleotide
  Target: SCN9A; (+) strand; PAM type: NRG; PAM sequence: CAG
gttttagcccaatataacca

SEQ ID NO: 48670 - DNA, 20 bp, Artificial Sequence
  Description of Artificial Sequence: Synthetic oligonucleotide
  Target: SCN9A; (+) strand; PAM type: NRG; PAM sequence: TAG
tctccataatactgcacatt

SEQ ID NO: 48671 - DNA, 20 bp, Artificial Sequence
  Description of Artificial Sequence: Synthetic oligonucleotide
  Target: SCN9A; (+) strand; PAM type: NRG; PAM sequence: TAG
atgaaccccactttcatctg

SEQ ID NO: 48672 - DNA, 20 bp, Artificial Sequence
  Description of Artificial Sequence: Synthetic oligonucleotide
  Target: SCN9A; (+) strand; PAM type: NRG; PAM sequence: CAG
aaccccactttcatctgtag

SEQ ID NO: 48673 - DNA, 20 bp, Artificial Sequence
  Description of Artificial Sequence: Synthetic oligonucleotide
  Target: SCN9A; (+) strand; PAM type: NRG; PAM sequence: AAG
tcatctgtagcagcataaaa

SEQ ID NO: 48674 - DNA, 20 bp, Artificial Sequence
  Description of Artificial Sequence: Synthetic oligonucleotide
  Target: SCN9A; (+) strand; PAM type: NRG; PAM sequence: GAG
agcataaaaaagtgtttgat

SEQ ID NO: 48675 - DNA, 20 bp, Artificial Sequence
  Description of Artificial Sequence: Synthetic oligonucleotide
  Target: SCN9A; (+) strand; PAM type: NRG; PAM sequence: AAG
aaagtgtttgatgagcatca

SEQ ID NO: 48676 - DNA, 20 bp, Artificial Sequence
  Description of Artificial Sequence: Synthetic oligonucleotide
  Target: SCN9A; (+) strand; PAM type: NRG; PAM sequence: TAG
gtgtttgatgagcatcaaag

SEQ ID NO: 48677 - DNA, 20 bp, Artificial Sequence
  Description of Artificial Sequence: Synthetic oligonucleotide
  Target: SCN9A; (+) strand; PAM type: NRG; PAM sequence: CAG
ttgatgagcatcaaagtaga

SEQ ID NO: 48678 - DNA, 20 bp, Artificial Sequence
  Description of Artificial Sequence: Synthetic oligonucleotide
  Target: SCN9A; (+) strand; PAM type: NRG; PAM sequence: AAG
caaagtagacagcaacacca

SEQ ID NO: 48679 - DNA, 20 bp, Artificial Sequence
  Description of Artificial Sequence: Synthetic oligonucleotide
  Target: SCN9A; (+) strand; PAM type: NRG; PAM sequence: AGG
aaagtagacagcaacaccaa

SEQ ID NO: 48680 - DNA, 20 bp, Artificial Sequence
  Description of Artificial Sequence: Synthetic oligonucleotide
  Target: SCN9A; (+) strand; PAM type: NRG; PAM sequence: CAG
tctacaaattgtatgttttt

SEQ ID NO: 48681 - DNA, 20 bp, Artificial Sequence
  Description of Artificial Sequence: Synthetic oligonucleotide
  Target: SCN9A; (+) strand; PAM type: NRG; PAM sequence: CAG
acaaattgtatgtttttcag

SEQ ID NO: 48682 - DNA, 20 bp, Artificial Sequence
  Description of Artificial Sequence: Synthetic oligonucleotide
  Target: SCN9A; (+) strand; PAM type: NRG; PAM sequence: AGG
caaattgtatgtttttcagc

SEQ ID NO: 48683 - DNA, 20 bp, Artificial Sequence
  Description of Artificial Sequence: Synthetic oligonucleotide
  Target: SCN9A; (+) strand; PAM type: NRG; PAM sequence: GAG
aattgtatgtttttcagcag

SEQ ID NO: 48684 - DNA, 20 bp, Artificial Sequence
  Description of Artificial Sequence: Synthetic oligonucleotide
  Target: SCN9A; (+) strand; PAM type: NRG; PAM sequence: AGG
attgtatgtttttcagcagg

SEQ ID NO: 48685 - DNA, 20 bp, Artificial Sequence
  Description of Artificial Sequence: Synthetic oligonucleotide
  Target: SCN9A; (+) strand; PAM type: NRG; PAM sequence: GAG
tatgtttttcagcaggaggt

SEQ ID NO: 48686 - DNA, 20 bp, Artificial Sequence
  Description of Artificial Sequence: Synthetic oligonucleotide
  Target: SCN9A; (+) strand; PAM type: NRG; PAM sequence: CAG
tttttcagcaggaggtgaga

SEQ ID NO: 48687 - DNA, 20 bp, Artificial Sequence
  Description of Artificial Sequence: Synthetic oligonucleotide
  Target: SCN9A; (+) strand; PAM type: NRG; PAM sequence: TGG
ttcagcaggaggtgagacag

SEQ ID NO: 48688 - DNA, 20 bp, Artificial Sequence
  Description of Artificial Sequence: Synthetic oligonucleotide
  Target: SCN9A; (+) strand; PAM type: NRG; PAM sequence: GGG
tcagcaggaggtgagacagt

SEQ ID NO: 48689 - DNA, 20 bp, Artificial Sequence
  Description of Artificial Sequence: Synthetic oligonucleotide
  Target: SCN9A; (+) strand; PAM type: NRG; PAM sequence: TGG
aatttatttgattgtgaatt

SEQ ID NO: 48690 - DNA, 20 bp, Artificial Sequence
  Description of Artificial Sequence: Synthetic oligonucleotide
  Target: SCN9A; (+) strand; PAM type: NRG; PAM sequence: AAG
tatttgattgtgaatttgga

SEQ ID NO: 48691 - DNA, 20 bp, Artificial Sequence
  Description of Artificial Sequence: Synthetic oligonucleotide
  Target: SCN9A; (+) strand; PAM type: NRG; PAM sequence: AGG
atttgattgtgaatttggaa

SEQ ID NO: 48692 - DNA, 20 bp, Artificial Sequence
  Description of Artificial Sequence: Synthetic oligonucleotide
  Target: SCN9A; (+) strand; PAM type: NRG; PAM sequence: CGG
gtgaatttggaaaggcattt

SEQ ID NO: 48693 - DNA, 20 bp, Artificial Sequence
  Description of Artificial Sequence: Synthetic oligonucleotide
  Target: SCN9A; (+) strand; PAM type: NRG; PAM sequence: TAG
tttcggaaaatactttgcta

SEQ ID NO: 48694 - DNA, 20 bp, Artificial Sequence
  Description of Artificial Sequence: Synthetic oligonucleotide
  Target: SCN9A; (+) strand; PAM type: NRG; PAM sequence: AGG
ttcggaaaatactttgctat

SEQ ID NO: 48695 - DNA, 20 bp, Artificial Sequence
  Description of Artificial Sequence: Synthetic oligonucleotide
  Target: SCN9A; (+) strand; PAM type: NRG; PAM sequence: CAG
aaatactttgctataggcac

SEQ ID NO: 48696 - DNA, 20 bp, Artificial Sequence
  Description of Artificial Sequence: Synthetic oligonucleotide
  Target: SCN9A; (+) strand; PAM type: NRG; PAM sequence: TAG
taggcaccagaaaatgcttt

SEQ ID NO: 48697 - DNA, 20 bp, Artificial Sequence
  Description of Artificial Sequence: Synthetic oligonucleotide
  Target: SCN9A; (+) strand; PAM type: NRG; PAM sequence: CAG
aaatgcttttagattatgct

SEQ ID NO: 48698 - DNA, 20 bp, Artificial Sequence
  Description of Artificial Sequence: Synthetic oligonucleotide
  Target: SCN9A; (+) strand; PAM type: NRG; PAM sequence: AGG
aatgcttttagattatgctc

SEQ ID NO: 48699 - DNA, 20 bp, Artificial Sequence
  Description of Artificial Sequence: Synthetic oligonucleotide
  Target: SCN9A; (+) strand; PAM type: NRG; PAM sequence: TAG
ttatgctcaggttctctgtg

SEQ ID NO: 48700 - DNA, 20 bp, Artificial Sequence
  Description of Artificial Sequence: Synthetic oligonucleotide
  Target: SCN9A; (+) strand; PAM type: NRG; PAM sequence: TAG
tattgccaattcatttgcct

SEQ ID NO: 48701 - DNA, 20 bp, Artificial Sequence
  Description of Artificial Sequence: Synthetic oligonucleotide
  Target: SCN9A; (+) strand; PAM type: NRG; PAM sequence: AAG
tttctcatgatctatcaacc

SEQ ID NO: 48702 - DNA, 20 bp, Artificial Sequence
  Description of Artificial Sequence: Synthetic oligonucleotide
  Target: SCN9A; (+) strand; PAM type: NRG; PAM sequence: CAG
agttcttgtcactctttgta

SEQ ID NO: 48703 - DNA, 20 bp, Artificial Sequence
  Description of Artificial Sequence: Synthetic oligonucleotide
  Target: SCN9A; (+) strand; PAM type: NRG; PAM sequence: TGG
ctttgtacagcttaaatcca

SEQ ID NO: 48704 - DNA, 20 bp, Artificial Sequence
  Description of Artificial Sequence: Synthetic oligonucleotide
  Target: SCN9A; (+) strand; PAM type: NRG; PAM sequence: GGG
tttgtacagcttaaatccat

SEQ ID NO: 48705 - DNA, 20 bp, Artificial Sequence
  Description of Artificial Sequence: Synthetic oligonucleotide
  Target: SCN9A; (+) strand; PAM type: NRG; PAM sequence: CAG
ccatgggcattcattatcat

SEQ ID NO: 48706 - DNA, 20 bp, Artificial Sequence
  Description of Artificial Sequence: Synthetic oligonucleotide
  Target: SCN9A; (+) strand; PAM type: NRG; PAM sequence: TGG
attatcatcagtgcctaacc

SEQ ID NO: 48707 - DNA, 20 bp, Artificial Sequence
  Description of Artificial Sequence: Synthetic oligonucleotide
  Target: SCN9A; (+) strand; PAM type: NRG; PAM sequence: CAG
atcatcagtgcctaacctgg

SEQ ID NO: 48708 - DNA, 20 bp, Artificial Sequence
  Description of Artificial Sequence: Synthetic oligonucleotide
  Target: SCN9A; (+) strand; PAM type: NRG; PAM sequence: CAG
tgcctaacctggcagaacca

SEQ ID NO: 48709 - DNA, 20 bp, Artificial Sequence
  Description of Artificial Sequence: Synthetic oligonucleotide
  Target: SCN9A; (+) strand; PAM type: NRG; PAM sequence: TGG
accacagtctacacataatc

SEQ ID NO: 48710 - DNA, 20 bp, Artificial Sequence
  Description of Artificial Sequence: Synthetic oligonucleotide
  Target: SCN9A; (+) strand; PAM type: NRG; PAM sequence: TGG
ggcatctgtcttttccatgc

SEQ ID NO: 48711 - DNA, 20 bp, Artificial Sequence
  Description of Artificial Sequence: Synthetic oligonucleotide
  Target: SCN9A; (+) strand; PAM type: NRG; PAM sequence: TGG
tttccatgctggctaccaaa

SEQ ID NO: 48712 - DNA, 20 bp, Artificial Sequence
  Description of Artificial Sequence: Synthetic oligonucleotide
  Target: SCN9A; (+) strand; PAM type: NRG; PAM sequence: TGG
gctaccaaatggctgaatgt

SEQ ID NO: 48713 - DNA, 20 bp, Artificial Sequence
  Description of Artificial Sequence: Synthetic oligonucleotide
  Target: SCN9A; (+) strand; PAM type: NRG; PAM sequence: TGG
accaaatggctgaatgttgg

SEQ ID NO: 48714 - DNA, 20 bp, Artificial Sequence
  Description of Artificial Sequence: Synthetic oligonucleotide
  Target: SCN9A; (+) strand; PAM type: NRG; PAM sequence: GAG
caaatggctgaatgttggtg

SEQ ID NO: 48715 - DNA, 20 bp, Artificial Sequence
  Description of Artificial Sequence: Synthetic oligonucleotide
  Target: SCN9A; (+) strand; PAM type: NRG; PAM sequence: AAG
gtggagaaactctcacaacc

SEQ ID NO: 48716 - DNA, 20 bp, Artificial Sequence
  Description of Artificial Sequence: Synthetic oligonucleotide
  Target: SCN9A; (+) strand; PAM type: NRG; PAM sequence: TGG
aactctcacaaccaagtgaa

SEQ ID NO: 48717 - DNA, 20 bp, Artificial Sequence
  Description of Artificial Sequence: Synthetic oligonucleotide
  Target: SCN9A; (+) strand; PAM type: NRG; PAM sequence: AAG
caagtgaatggttatatttt

SEQ ID NO: 48718 - DNA, 20 bp, Artificial Sequence
  Description of Artificial Sequence: Synthetic oligonucleotide
  Target: SCN9A; (+) strand; PAM type: NRG; PAM sequence: AAG
tgaatggttatattttaagt

SEQ ID NO: 48719 - DNA, 20 bp, Artificial Sequence
  Description of Artificial Sequence: Synthetic oligonucleotide
  Target: SCN9A; (+) strand; PAM type: NRG; PAM sequence: TAG
cattctcatcaaatcatctg

SEQ ID NO: 48720 - DNA, 20 bp, Artificial Sequence
  Description of Artificial Sequence: Synthetic oligonucleotide
  Target: SCN9A; (+) strand; PAM type: NRG; PAM sequence: CAG
ctcttcctcatttgcactct

SEQ ID NO: 48721 - DNA, 20 bp, Artificial Sequence
  Description of Artificial Sequence: Synthetic oligonucleotide
  Target: SCN9A; (+) strand; PAM type: NRG; PAM sequence: AGG
tcttcctcatttgcactctc

SEQ ID NO: 48722 - DNA, 20 bp, Artificial Sequence
  Description of Artificial Sequence: Synthetic oligonucleotide
  Target: SCN9A; (+) strand; PAM type: NRG; PAM sequence: GAG
atgatcccatcttatacttt

SEQ ID NO: 48723 - DNA, 20 bp, Artificial Sequence
  Description of Artificial Sequence: Synthetic oligonucleotide
  Target: SCN9A; (+) strand; PAM type: NRG; PAM sequence: AGG
tgatcccatcttatactttg

SEQ ID NO: 48724 - DNA, 20 bp, Artificial Sequence
  Description of Artificial Sequence: Synthetic oligonucleotide
  Target: SCN9A; (+) strand; PAM type: NRG; PAM sequence: TGG
tttgaggaaataaaaaccat

SEQ ID NO: 48725 - DNA, 20 bp, Artificial Sequence
  Description of Artificial Sequence: Synthetic oligonucleotide
  Target: SCN9A; (+) strand; PAM type: NRG; PAM sequence: GGG
ttgaggaaataaaaaccatt

SEQ ID NO: 48726 - DNA, 20 bp, Artificial Sequence
  Description of Artificial Sequence: Synthetic oligonucleotide
  Target: SCN9A; (+) strand; PAM type: NRG; PAM sequence: CAG
atcatcttttgataactctg

SEQ ID NO: 48727 - DNA, 20 bp, Artificial Sequence
  Description of Artificial Sequence: Synthetic oligonucleotide
  Target: SCN9A; (+) strand; PAM type: NRG; PAM sequence: CGG
ttctatctttcctcctgttt

SEQ ID NO: 48728 - DNA, 20 bp, Artificial Sequence
  Description of Artificial Sequence: Synthetic oligonucleotide
  Target: SCN9A; (+) strand; PAM type: NRG; PAM sequence: TGG
tatctttcctcctgtttcgg

SEQ ID NO: 48729 - DNA, 20 bp, Artificial Sequence
  Description of Artificial Sequence: Synthetic oligonucleotide
  Target: SCN9A; (+) strand; PAM type: NRG; PAM sequence: GAG
tctttcctcctgtttcggtg

SEQ ID NO: 48730 - DNA, 20 bp, Artificial Sequence
  Description of Artificial Sequence: Synthetic oligonucleotide
  Target: SCN9A; (+) strand; PAM type: NRG; PAM sequence: GAG
ctttactctttcactttcac

SEQ ID NO: 48731 - DNA, 20 bp, Artificial Sequence
  Description of Artificial Sequence: Synthetic oligonucleotide
  Target: SCN9A; (+) strand; PAM type: NRG; PAM sequence: AGG
tttactctttcactttcacg

SEQ ID NO: 48732 - DNA, 20 bp, Artificial Sequence
  Description of Artificial Sequence: Synthetic oligonucleotide
  Target: SCN9A; (+) strand; PAM type: NRG; PAM sequence: TAG
aactactcattcattatcac

SEQ ID NO: 48733 - DNA, 20 bp, Artificial Sequence
  Description of Artificial Sequence: Synthetic oligonucleotide
  Target: SCN9A; (+) strand; PAM type: NRG; PAM sequence: CAG
ccatatatttttttaaatgc

SEQ ID NO: 48734 - DNA, 20 bp, Artificial Sequence
  Description of Artificial Sequence: Synthetic oligonucleotide
  Target: SCN9A; (+) strand; PAM type: NRG; PAM sequence: TAG
cattattctgcttcccttta

SEQ ID NO: 48735 - DNA, 20 bp, Artificial Sequence
  Description of Artificial Sequence: Synthetic oligonucleotide
  Target: SCN9A; (+) strand; PAM type: NRG; PAM sequence: TGG
ccctttatagccaaatttct

SEQ ID NO: 48736 - DNA, 20 bp, Artificial Sequence
  Description of Artificial Sequence: Synthetic oligonucleotide
  Target: SCN9A; (+) strand; PAM type: NRG; PAM sequence: GGG
cctttatagccaaatttctt

SEQ ID NO: 48737 - DNA, 20 bp, Artificial Sequence
  Description of Artificial Sequence: Synthetic oligonucleotide
  Target: SCN9A; (+) strand; PAM type: NRG; PAM sequence: GAG
tttatagccaaatttcttgg

SEQ ID NO: 48738 - DNA, 20 bp, Artificial Sequence
  Description of Artificial Sequence: Synthetic oligonucleotide
  Target: SCN9A; (+) strand; PAM type: NRG; PAM sequence: AAG
ccacttacccaaattttctc

SEQ ID NO: 48739 - DNA, 20 bp, Artificial Sequence
  Description of Artificial Sequence: Synthetic oligonucleotide
  Target: SCN9A; (+) strand; PAM type: NRG; PAM sequence: CAG
atccttactccttgatcttg

SEQ ID NO: 48740 - DNA, 20 bp, Artificial Sequence
  Description of Artificial Sequence: Synthetic oligonucleotide
  Target: SCN9A; (+) strand; PAM type: NRG; PAM sequence: AAG
cttgcagcatgattctacac

SEQ ID NO: 48741 - DNA, 20 bp, Artificial Sequence
  Description of Artificial Sequence: Synthetic oligonucleotide
  Target: SCN9A; (+) strand; PAM type: NRG; PAM sequence: TGG
tacaatatgttttcttctct

SEQ ID NO: 48742 - DNA, 20 bp, Artificial Sequence
  Description of Artificial Sequence: Synthetic oligonucleotide
  Target: SCN9A; (+) strand; PAM type: NRG; PAM sequence: TGG
atctttgcttcttactttat

SEQ ID NO: 48743 - DNA, 20 bp, Artificial Sequence
  Description of Artificial Sequence: Synthetic oligonucleotide
  Target: SCN9A; (+) strand; PAM type: NRG; PAM sequence: CGG
tttgcttcttactttattgg

SEQ ID NO: 48744 - DNA, 20 bp, Artificial Sequence
  Description of Artificial Sequence: Synthetic oligonucleotide
  Target: SCN9A; (+) strand; PAM type: NRG; PAM sequence: TGG
tctttctctgtgttcttttc

SEQ ID NO: 48745 - DNA, 20 bp, Artificial Sequence
  Description of Artificial Sequence: Synthetic oligonucleotide
  Target: SCN9A; (+) strand; PAM type: NRG; PAM sequence: GGG
ctttctctgtgttcttttct

SEQ ID NO: 48746 - DNA, 20 bp, Artificial Sequence
  Description of Artificial Sequence: Synthetic oligonucleotide
  Target: SCN9A; (+) strand; PAM type: NRG; PAM sequence: CAG
tctacctgaattctaaatgt

SEQ ID NO: 48747 - DNA, 20 bp, Artificial Sequence
  Description of Artificial Sequence: Synthetic oligonucleotide
  Target: SCN9A; (+) strand; PAM type: NRG; PAM sequence: GAG
tacctgaattctaaatgtca

SEQ ID NO: 48748 - DNA, 20 bp, Artificial Sequence
  Description of Artificial Sequence: Synthetic oligonucleotide
  Target: SCN9A; (+) strand; PAM type: NRG; PAM sequence: TAG
aattctaaatgtcagagttg

SEQ ID NO: 48749 - DNA, 20 bp, Artificial Sequence
  Description of Artificial Sequence: Synthetic oligonucleotide
  Target: SCN9A; (+) strand; PAM type: NRG; PAM sequence: TGG
aatgtcagagttgtagatct

SEQ ID NO: 48750 - DNA, 20 bp, Artificial Sequence
  Description of Artificial Sequence: Synthetic oligonucleotide
  Target: SCN9A; (+) strand; PAM type: NRG; PAM sequence: CAG
agagttgtagatcttggtac

SEQ ID NO: 48751 - DNA, 20 bp, Artificial Sequence
  Description of Artificial Sequence: Synthetic oligonucleotide
  Target: SCN9A; (+) strand; PAM type: NRG; PAM sequence: CAG
taccagattgctttaaatac

SEQ ID NO: 48752 - DNA, 20 bp, Artificial Sequence
  Description of Artificial Sequence: Synthetic oligonucleotide
  Target: SCN9A; (+) strand; PAM type: NRG; PAM sequence: AGG
accagattgctttaaatacc

SEQ ID NO: 48753 - DNA, 20 bp, Artificial Sequence
  Description of Artificial Sequence: Synthetic oligonucleotide
  Target: SCN9A; (+) strand; PAM type: NRG; PAM sequence: CAG
ctctatctacttaaaaatat

SEQ ID NO: 48754 - DNA, 20 bp, Artificial Sequence
  Description of Artificial Sequence: Synthetic oligonucleotide
  Target: SCN9A; (+) strand; PAM type: NRG; PAM sequence: AGG
tctatctacttaaaaatatc

SEQ ID NO: 48755 - DNA, 20 bp, Artificial Sequence
  Description of Artificial Sequence: Synthetic oligonucleotide
  Target: SCN9A; (+) strand; PAM type: NRG; PAM sequence: GGG
ctatctacttaaaaatatca

SEQ ID NO: 48756 - DNA, 20 bp, Artificial Sequence
  Description of Artificial Sequence: Synthetic oligonucleotide
  Target: SCN9A; (+) strand; PAM type: NRG; PAM sequence: CAG
ttaaaaatatcagggatgtt

SEQ ID NO: 48757 - DNA, 20 bp, Artificial Sequence
  Description of Artificial Sequence: Synthetic oligonucleotide
  Target: SCN9A; (+) strand; PAM type: NRG; PAM sequence: GAG
aaaaatatcagggatgttca

SEQ ID NO: 48758 - DNA, 20 bp, Artificial Sequence
  Description of Artificial Sequence: Synthetic oligonucleotide
  Target: SCN9A; (+) strand; PAM type: NRG; PAM sequence: AGG
aaaatatcagggatgttcag

SEQ ID NO: 48759 - DNA, 20 bp, Artificial Sequence
  Description of Artificial Sequence: Synthetic oligonucleotide
  Target: SCN9A; (+) strand; PAM type: NRG; PAM sequence: TAG
atatcagggatgttcagagg

SEQ ID NO: 48760 - DNA, 20 bp, Artificial Sequence
  Description of Artificial Sequence: Synthetic oligonucleotide
  Target: SCN9A; (+) strand; PAM type: NRG; PAM sequence: GAG
atcagggatgttcagaggta

SEQ ID NO: 48761 - DNA, 20 bp, Artificial Sequence
  Description of Artificial Sequence: Synthetic oligonucleotide
  Target: SCN9A; (+) strand; PAM type: NRG; PAM sequence: AGG
tcagggatgttcagaggtag

SEQ ID NO: 48762 - DNA, 20 bp, Artificial Sequence
  Description of Artificial Sequence: Synthetic oligonucleotide
  Target: SCN9A; (+) strand; PAM type: NRG; PAM sequence: TGG
tttctttttgctgattgctc

SEQ ID NO: 48763 - DNA, 20 bp, Artificial Sequence
  Description of Artificial Sequence: Synthetic oligonucleotide
  Target: SCN9A; (+) strand; PAM type: NRG; PAM sequence: CAG
ctggaatttatctccaaact

SEQ ID NO: 48764 - DNA, 20 bp, Artificial Sequence
  Description of Artificial Sequence: Synthetic oligonucleotide
  Target: SCN9A; (+) strand; PAM type: NRG; PAM sequence: CAG
gaatttatctccaaactcag

SEQ ID NO: 48765 - DNA, 20 bp, Artificial Sequence
  Description of Artificial Sequence: Synthetic oligonucleotide
  Target: SCN9A; (+) strand; PAM type: NRG; PAM sequence: AGG
aatttatctccaaactcagc

SEQ ID NO: 48766 - DNA, 20 bp, Artificial Sequence
  Description of Artificial Sequence: Synthetic oligonucleotide
  Target: SCN9A; (+) strand; PAM type: NRG; PAM sequence: TGG
ctctatattatatatccacc

SEQ ID NO: 48767 - DNA, 20 bp, Artificial Sequence
  Description of Artificial Sequence: Synthetic oligonucleotide
  Target: SCN9A; (+) strand; PAM type: NRG; PAM sequence: AAG
atatccacctggacatctca

SEQ ID NO: 48768 - DNA, 20 bp, Artificial Sequence
  Description of Artificial Sequence: Synthetic oligonucleotide
  Target: SCN9A; (+) strand; PAM type: NRG; PAM sequence: AGG
tatccacctggacatctcaa

SEQ ID NO: 48769 - DNA, 20 bp, Artificial Sequence
  Description of Artificial Sequence: Synthetic oligonucleotide
  Target: SCN9A; (+) strand; PAM type: NRG; PAM sequence: TAG
aaggcatctcattttaattt

SEQ ID NO: 48770 - DNA, 20 bp, Artificial Sequence
  Description of Artificial Sequence: Synthetic oligonucleotide
  Target: SCN9A; (+) strand; PAM type: NRG; PAM sequence: TAG
catctcattttaattttagc

SEQ ID NO: 48771 - DNA, 20 bp, Artificial Sequence
  Description of Artificial Sequence: Synthetic oligonucleotide
  Target: SCN9A; (+) strand; PAM type: NRG; PAM sequence: TAG
ttttaattttagctagctaa

SEQ ID NO: 48772 - DNA, 20 bp, Artificial Sequence
  Description of Artificial Sequence: Synthetic oligonucleotide
  Target: SCN9A; (+) strand; PAM type: NRG; PAM sequence: CAG
attaaccatcaccacccatc

SEQ ID NO: 48773 - DNA, 20 bp, Artificial Sequence
  Description of Artificial Sequence: Synthetic oligonucleotide
  Target: SCN9A; (+) strand; PAM type: NRG; PAM sequence: CAG
caccacccatccagttattg

SEQ ID NO: 48774 - DNA, 20 bp, Artificial Sequence
  Description of Artificial Sequence: Synthetic oligonucleotide
  Target: SCN9A; (+) strand; PAM type: NRG; PAM sequence: CAG
acccatccagttattgcagc

SEQ ID NO: 48775 - DNA, 20 bp, Artificial Sequence
  Description of Artificial Sequence: Synthetic oligonucleotide
  Target: SCN9A; (+) strand; PAM type: NRG; PAM sequence: GAG
agttattgcagccagaaact

SEQ ID NO: 48776 - DNA, 20 bp, Artificial Sequence
  Description of Artificial Sequence: Synthetic oligonucleotide
  Target: SCN9A; (+) strand; PAM type: NRG; PAM sequence: AAG
tattgcagccagaaactgag

SEQ ID NO: 48777 - DNA, 20 bp, Artificial Sequence
  Description of Artificial Sequence: Synthetic oligonucleotide
  Target: SCN9A; (+) strand; PAM type: NRG; PAM sequence: CAG
tcctgtcttctttaatccat

SEQ ID NO: 48778 - DNA, 20 bp, Artificial Sequence
  Description of Artificial Sequence: Synthetic oligonucleotide
  Target: SCN9A; (+) strand; PAM type: NRG; PAM sequence: AAG
gtcttctttaatccatcagc

SEQ ID NO: 48779 - DNA, 20 bp, Artificial Sequence
  Description of Artificial Sequence: Synthetic oligonucleotide
  Target: SCN9A; (+) strand; PAM type: NRG; PAM sequence: CAG
taatccatcagcaagctcta

SEQ ID NO: 48780 - DNA, 20 bp, Artificial Sequence
  Description of Artificial Sequence: Synthetic oligonucleotide
  Target: SCN9A; (+) strand; PAM type: NRG; PAM sequence: GAG
ctctacagactttgtatgtt

SEQ ID NO: 48781 - DNA, 20 bp, Artificial Sequence
  Description of Artificial Sequence: Synthetic oligonucleotide
  Target: SCN9A; (+) strand; PAM type: NRG; PAM sequence: TAG
tcatttctctgccatcactc

SEQ ID NO: 48782 - DNA, 20 bp, Artificial Sequence
  Description of Artificial Sequence: Synthetic oligonucleotide
  Target: SCN9A; (+) strand; PAM type: NRG; PAM sequence: TAG
aacctttattttctcttgcc

SEQ ID NO: 48783 - DNA, 20 bp, Artificial Sequence
  Description of Artificial Sequence: Synthetic oligonucleotide
  Target: SCN9A; (+) strand; PAM type: NRG; PAM sequence: GAG
ttattttctcttgcctagat

SEQ ID NO: 48784 - DNA, 20 bp, Artificial Sequence
  Description of Artificial Sequence: Synthetic oligonucleotide
  Target: SCN9A; (+) strand; PAM type: NRG; PAM sequence: GAG
attttctcttgcctagatga

SEQ ID NO: 48785 - DNA, 20 bp, Artificial Sequence
  Description of Artificial Sequence: Synthetic oligonucleotide
  Target: SCN9A; (+) strand; PAM type: NRG; PAM sequence: AAG
ttctcttgcctagatgagag

SEQ ID NO: 48786 - DNA, 20 bp, Artificial Sequence
  Description of Artificial Sequence: Synthetic oligonucleotide
  Target: SCN9A; (+) strand; PAM type: NRG; PAM sequence: CAG
accatctacccttgctcaat

SEQ ID NO: 48787 - DNA, 20 bp, Artificial Sequence
  Description of Artificial Sequence: Synthetic oligonucleotide
  Target: SCN9A; (+) strand; PAM type: NRG; PAM sequence: AAG
ttgctcaatcagttgtgcac

SEQ ID NO: 48788 - DNA, 20 bp, Artificial Sequence
  Description of Artificial Sequence: Synthetic oligonucleotide
  Target: SCN9A; (+) strand; PAM type: NRG; PAM sequence: CAG
tcaatcagttgtgcacaaga

SEQ ID NO: 48789 - DNA, 20 bp, Artificial Sequence
  Description of Artificial Sequence: Synthetic oligonucleotide
  Target: SCN9A; (+) strand; PAM type: NRG; PAM sequence: CAG
tcagttgtgcacaagacaga

SEQ ID NO: 48790 - DNA, 20 bp, Artificial Sequence
  Description of Artificial Sequence: Synthetic oligonucleotide
  Target: SCN9A; (+) strand; PAM type: NRG; PAM sequence: TGG
aaaatacaaactccttccca

SEQ ID NO: 48791 - DNA, 20 bp, Artificial Sequence
  Description of Artificial Sequence: Synthetic oligonucleotide
  Target: SCN9A; (+) strand; PAM type: NRG; PAM sequence: GGG
aaatacaaactccttcccat

SEQ ID NO: 48792 - DNA, 20 bp, Artificial Sequence
  Description of Artificial Sequence: Synthetic oligonucleotide
  Target: SCN9A; (+) strand; PAM type: NRG; PAM sequence: CAG
acccataccctccctttatt

SEQ ID NO: 48793 - DNA, 20 bp, Artificial Sequence
  Description of Artificial Sequence: Synthetic oligonucleotide
  Target: SCN9A; (+) strand; PAM type: NRG; PAM sequence: AGG
cccataccctccctttattc

SEQ ID NO: 48794 - DNA, 20 bp, Artificial Sequence
  Description of Artificial Sequence: Synthetic oligonucleotide
  Target: SCN9A; (+) strand; PAM type: NRG; PAM sequence: AAG
catgctatttctcctaattg

SEQ ID NO: 48795 - DNA, 20 bp, Artificial Sequence
  Description of Artificial Sequence: Synthetic oligonucleotide
  Target: SCN9A; (+) strand; PAM type: NRG; PAM sequence: CAG
gctatttctcctaattgaag

SEQ ID NO: 48796 - DNA, 20 bp, Artificial Sequence
  Description of Artificial Sequence: Synthetic oligonucleotide
  Target: SCN9A; (+) strand; PAM type: NRG; PAM sequence: TAG
gaagcagcaccccccacaca

SEQ ID NO: 48797 - DNA, 20 bp, Artificial Sequence
  Description of Artificial Sequence: Synthetic oligonucleotide
  Target: SCN9A; (+) strand; PAM type: NRG; PAM sequence: TGG
cccacacttaaactatttta

SEQ ID NO: 48798 - DNA, 20 bp, Artificial Sequence
  Description of Artificial Sequence: Synthetic oligonucleotide
  Target: SCN9A; (+) strand; PAM type: NRG; PAM sequence: TAG
tatggcttcttactatcttt

SEQ ID NO: 48799 - DNA, 20 bp, Artificial Sequence
  Description of Artificial Sequence: Synthetic oligonucleotide
  Target: SCN9A; (+) strand; PAM type: NRG; PAM sequence: CAG
tcttactatcttttagatct

SEQ ID NO: 48800 - DNA, 20 bp, Artificial Sequence
  Description of Artificial Sequence: Synthetic oligonucleotide
  Target: SCN9A; (+) strand; PAM type: NRG; PAM sequence: CAG
cagcttaaatgccatcacct

SEQ ID NO: 48801 - DNA, 20 bp, Artificial Sequence
  Description of Artificial Sequence: Synthetic oligonucleotide
  Target: SCN9A; (+) strand; PAM type: NRG; PAM sequence: GAG
gcttaaatgccatcacctca

SEQ ID NO: 48802 - DNA, 20 bp, Artificial Sequence
  Description of Artificial Sequence: Synthetic oligonucleotide
  Target: SCN9A; (+) strand; PAM type: NRG; PAM sequence: TAG
ctcagagatgtcttctcatc

SEQ ID NO: 48803 - DNA, 20 bp, Artificial Sequence
  Description of Artificial Sequence: Synthetic oligonucleotide
  Target: SCN9A; (+) strand; PAM type: NRG; PAM sequence: CAG
ttctcatctagttgatatct

SEQ ID NO: 48804 - DNA, 20 bp, Artificial Sequence
  Description of Artificial Sequence: Synthetic oligonucleotide
  Target: SCN9A; (+) strand; PAM type: NRG; PAM sequence: GAG
tagttgatatctcagcacct

SEQ ID NO: 48805 - DNA, 20 bp, Artificial Sequence
  Description of Artificial Sequence: Synthetic oligonucleotide
  Target: SCN9A; (+) strand; PAM type: NRG; PAM sequence: TGG
tgagactcacttcctttgca

SEQ ID NO: 48806 - DNA, 20 bp, Artificial Sequence
  Description of Artificial Sequence: Synthetic oligonucleotide
  Target: SCN9A; (+) strand; PAM type: NRG; PAM sequence: GAG
catggcatttattataactt

SEQ ID NO: 48807 - DNA, 20 bp, Artificial Sequence
  Description of Artificial Sequence: Synthetic oligonucleotide
  Target: SCN9A; (+) strand; PAM type: NRG; PAM sequence: TAG
acattttttttcattcccac

SEQ ID NO: 48808 - DNA, 20 bp, Artificial Sequence
  Description of Artificial Sequence: Synthetic oligonucleotide
  Target: SCN9A; (+) strand; PAM type: NRG; PAM sequence: AAG
tttcattcccactagatgat

SEQ ID NO: 48809 - DNA, 20 bp, Artificial Sequence
  Description of Artificial Sequence: Synthetic oligonucleotide
  Target: SCN9A; (+) strand; PAM type: NRG; PAM sequence: AAG
ctagatgataagctctgtga

SEQ ID NO: 48810 - DNA, 20 bp, Artificial Sequence
  Description of Artificial Sequence: Synthetic oligonucleotide
  Target: SCN9A; (+) strand; PAM type: NRG; PAM sequence: AAG
atgataagctctgtgaaagc

SEQ ID NO: 48811 - DNA, 20 bp, Artificial Sequence
  Description of Artificial Sequence: Synthetic oligonucleotide
  Target: SCN9A; (+) strand; PAM type: NRG; PAM sequence: AGG
tgataagctctgtgaaagca

SEQ ID NO: 48812 - DNA, 20 bp, Artificial Sequence
  Description of Artificial Sequence: Synthetic oligonucleotide
  Target: SCN9A; (+) strand; PAM type: NRG; PAM sequence: GGG
gataagctctgtgaaagcaa

SEQ ID NO: 48813 - DNA, 20 bp, Artificial Sequence
  Description of Artificial Sequence: Synthetic oligonucleotide
  Target: SCN9A; (+) strand; PAM type: NRG; PAM sequence: GAG
gctctgtgaaagcaagggct

SEQ ID NO: 48814 - DNA, 20 bp, Artificial Sequence
  Description of Artificial Sequence: Synthetic oligonucleotide
  Target: SCN9A; (+) strand; PAM type: NRG; PAM sequence: AGG
ctctgtgaaagcaagggctg

SEQ ID NO: 48815 - DNA, 20 bp, Artificial Sequence
  Description of Artificial Sequence: Synthetic oligonucleotide
  Target: SCN9A; (+) strand; PAM type: NRG; PAM sequence: TAG
gaggctatcatttattgcta

SEQ ID NO: 48816 - DNA, 20 bp, Artificial Sequence
  Description of Artificial Sequence: Synthetic oligonucleotide
  Target: SCN9A; (+) strand; PAM type: NRG; PAM sequence: CAG
tatcatttattgctatagct

SEQ ID NO: 48817 - DNA, 20 bp, Artificial Sequence
  Description of Artificial Sequence: Synthetic oligonucleotide
  Target: SCN9A; (+) strand; PAM type: NRG; PAM sequence: AGG
atcatttattgctatagctc

SEQ ID NO: 48818 - DNA, 20 bp, Artificial Sequence
  Description of Artificial Sequence: Synthetic oligonucleotide
  Target: SCN9A; (+) strand; PAM type: NRG; PAM sequence: GGG
tcatttattgctatagctca

SEQ ID NO: 48819 - DNA, 20 bp, Artificial Sequence
  Description of Artificial Sequence: Synthetic oligonucleotide
  Target: SCN9A; (+) strand; PAM type: NRG; PAM sequence: AAG
ataaacgcaccaataaatga

SEQ ID NO: 48820 - DNA, 20 bp, Artificial Sequence
  Description of Artificial Sequence: Synthetic oligonucleotide
  Target: SCN9A; (+) strand; PAM type: NRG; PAM sequence: CAG
gaaagtttgaatcaattatg

SEQ ID NO: 48821 - DNA, 20 bp, Artificial Sequence
  Description of Artificial Sequence: Synthetic oligonucleotide
  Target: SCN9A; (+) strand; PAM type: NRG; PAM sequence: TGG
atcaattatgcagtcaaaaa

SEQ ID NO: 48822 - DNA, 20 bp, Artificial Sequence
  Description of Artificial Sequence: Synthetic oligonucleotide
  Target: SCN9A; (+) strand; PAM type: NRG; PAM sequence: TAG
caaaaatggcttctatgaca

SEQ ID NO: 48823 - DNA, 20 bp, Artificial Sequence
  Description of Artificial Sequence: Synthetic oligonucleotide
  Target: SCN9A; (+) strand; PAM type: NRG; PAM sequence: AGG
aaaaatggcttctatgacat

SEQ ID NO: 48824 - DNA, 20 bp, Artificial Sequence
  Description of Artificial Sequence: Synthetic oligonucleotide
  Target: SCN9A; (+) strand; PAM type: NRG; PAM sequence: CAG
ggcttctatgacataggaaa

SEQ ID NO: 48825 - DNA, 20 bp, Artificial Sequence
  Description of Artificial Sequence: Synthetic oligonucleotide
  Target: SCN9A; (+) strand; PAM type: NRG; PAM sequence: AAG
ttctatgacataggaaacag

SEQ ID NO: 48826 - DNA, 20 bp, Artificial Sequence
  Description of Artificial Sequence: Synthetic oligonucleotide
  Target: SCN9A; (+) strand; PAM type: NRG; PAM sequence: CAG
taggaaacagaagcaaaatt

SEQ ID NO: 48827 - DNA, 20 bp, Artificial Sequence
  Description of Artificial Sequence: Synthetic oligonucleotide
  Target: SCN9A; (+) strand; PAM type: NRG; PAM sequence: CAG
tcttcactaaaactacattt

SEQ ID NO: 48828 - DNA, 20 bp, Artificial Sequence
  Description of Artificial Sequence: Synthetic oligonucleotide
  Target: SCN9A; (+) strand; PAM type: NRG; PAM sequence: AAG
tcactaaaactacatttcag

SEQ ID NO: 48829 - DNA, 20 bp, Artificial Sequence
  Description of Artificial Sequence: Synthetic oligonucleotide
  Target: SCN9A; (+) strand; PAM type: NRG; PAM sequence: AAG
ctacatttcagaagaaaata

SEQ ID NO: 48830 - DNA, 20 bp, Artificial Sequence
  Description of Artificial Sequence: Synthetic oligonucleotide
  Target: SCN9A; (+) strand; PAM type: NRG; PAM sequence: CAG
agaaaataaagaataatgta

SEQ ID NO: 48831 - DNA, 20 bp, Artificial Sequence
  Description of Artificial Sequence: Synthetic oligonucleotide
  Target: SCN9A; (+) strand; PAM type: NRG; PAM sequence: TGG
taaagaataatgtacagatt

SEQ ID NO: 48832 - DNA, 20 bp, Artificial Sequence
  Description of Artificial Sequence: Synthetic oligonucleotide
  Target: SCN9A; (+) strand; PAM type: NRG; PAM sequence: AAG
agaataatgtacagatttgg

SEQ ID NO: 48833 - DNA, 20 bp, Artificial Sequence
  Description of Artificial Sequence: Synthetic oligonucleotide
  Target: SCN9A; (+) strand; PAM type: NRG; PAM sequence: CAG
taatgtacagatttggaaga

SEQ ID NO: 48834 - DNA, 20 bp, Artificial Sequence
  Description of Artificial Sequence: Synthetic oligonucleotide
  Target: SCN9A; (+) strand; PAM type: NRG; PAM sequence: AGG
aatgtacagatttggaagac

SEQ ID NO: 48835 - DNA, 20 bp, Artificial Sequence
  Description of Artificial Sequence: Synthetic oligonucleotide
  Target: SCN9A; (+) strand; PAM type: NRG; PAM sequence: TGG
agatttggaagacaggattg

SEQ ID NO: 48836 - DNA, 20 bp, Artificial Sequence
  Description of Artificial Sequence: Synthetic oligonucleotide
  Target: SCN9A; (+) strand; PAM type: NRG; PAM sequence: AAG
ggaagacaggattgtggtat

SEQ ID NO: 48837 - DNA, 20 bp, Artificial Sequence
  Description of Artificial Sequence: Synthetic oligonucleotide
  Target: SCN9A; (+) strand; PAM type: NRG; PAM sequence: TAG
tgtggtataagattcattat

SEQ ID NO: 48838 - DNA, 20 bp, Artificial Sequence
  Description of Artificial Sequence: Synthetic oligonucleotide
  Target: SCN9A; (+) strand; PAM type: NRG; PAM sequence: AAG
tcatgtttaaatataatata

SEQ ID NO: 48839 - DNA, 20 bp, Artificial Sequence
  Description of Artificial Sequence: Synthetic oligonucleotide
  Target: SCN9A; (+) strand; PAM type: NRG; PAM sequence: AAG
aaagataattcacataactc

SEQ ID NO: 48840 - DNA, 20 bp, Artificial Sequence
  Description of Artificial Sequence: Synthetic oligonucleotide
  Target: SCN9A; (+) strand; PAM type: NRG; PAM sequence: AGG
aagataattcacataactca

SEQ ID NO: 48841 - DNA, 20 bp, Artificial Sequence
  Description of Artificial Sequence: Synthetic oligonucleotide
  Target: SCN9A; (+) strand; PAM type: NRG; PAM sequence: GGG
agataattcacataactcaa

SEQ ID NO: 48842 - DNA, 20 bp, Artificial Sequence
  Description of Artificial Sequence: Synthetic oligonucleotide
  Target: SCN9A; (+) strand; PAM type: NRG; PAM sequence: GAG
ttattaatttatttattttt

SEQ ID NO: 48843 - DNA, 20 bp, Artificial Sequence
  Description of Artificial Sequence: Synthetic oligonucleotide
  Target: SCN9A; (+) strand; PAM type: NRG; PAM sequence: CAG
taatttatttatttttgaga

SEQ ID NO: 48844 - DNA, 20 bp, Artificial Sequence
  Description of Artificial Sequence: Synthetic oligonucleotide
  Target: SCN9A; (+) strand; PAM type: NRG; PAM sequence: CAG
acagtttcgctcttgttgcc

SEQ ID NO: 48845 - DNA, 20 bp, Artificial Sequence
  Description of Artificial Sequence: Synthetic oligonucleotide
  Target: SCN9A; (+) strand; PAM type: NRG; PAM sequence: AGG
cagtttcgctcttgttgccc

SEQ ID NO: 48846 - DNA, 20 bp, Artificial Sequence
  Description of Artificial Sequence: Synthetic oligonucleotide
  Target: SCN9A; (+) strand; PAM type: NRG; PAM sequence: TGG
ttcgctcttgttgcccaggc

SEQ ID NO: 48847 - DNA, 20 bp, Artificial Sequence
  Description of Artificial Sequence: Synthetic oligonucleotide
  Target: SCN9A; (+) strand; PAM type: NRG; PAM sequence: GAG
cgctcttgttgcccaggctg

SEQ ID NO: 48848 - DNA, 20 bp, Artificial Sequence
  Description of Artificial Sequence: Synthetic oligonucleotide
  Target: SCN9A; (+) strand; PAM type: NRG; PAM sequence: TGG
ttgcccaggctggagtgcaa

SEQ ID NO: 48849 - DNA, 20 bp, Artificial Sequence
  Description of Artificial Sequence: Synthetic oligonucleotide
  Target: SCN9A; (+) strand; PAM type: NRG; PAM sequence: CGG
ggagtgcaatggcacgatct

SEQ ID NO: 48850 - DNA, 20 bp, Artificial Sequence
  Description of Artificial Sequence: Synthetic oligonucleotide
  Target: SCN9A; (+) strand; PAM type: NRG; PAM sequence: GAG
caccgcaacctctgcctccc

SEQ ID NO: 48851 - DNA, 20 bp, Artificial Sequence
  Description of Artificial Sequence: Synthetic oligonucleotide
  Target: SCN9A; (+) strand; PAM type: NRG; PAM sequence: AAG
aacctctgcctcccgagttc

SEQ ID NO: 48852 - DNA, 20 bp, Artificial Sequence
  Description of Artificial Sequence: Synthetic oligonucleotide
  Target: SCN9A; (+) strand; PAM type: NRG; PAM sequence: CAG
ttcaagcgattctcctgcct

SEQ ID NO: 48853 - DNA, 20 bp, Artificial Sequence
  Description of Artificial Sequence: Synthetic oligonucleotide
  Target: SCN9A; (+) strand; PAM type: NRG; PAM sequence: GAG
ttctcctgcctcagcctcct

SEQ ID NO: 48854 - DNA, 20 bp, Artificial Sequence
  Description of Artificial Sequence: Synthetic oligonucleotide
  Target: SCN9A; (+) strand; PAM type: NRG; PAM sequence: TAG
tcctgcctcagcctcctgag

SEQ ID NO: 48855 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctcctgagtagc

SEQ ID NO: 48856 - DNA, 20 bp, Artificial Sequence
  Description of Artificial Sequence: Synthetic oligonucleotide
  Target: SCN9A; (+) strand; PAM type: NRG; PAM sequence: CAG
ctcctgagtagctggaatta

SEQ ID NO: 48857 - DNA, 20 bp, Artificial Sequence
  Description of Artificial Sequence: Synthetic oligonucleotide
  Target: SCN9A; (+) strand; PAM type: NRG; PAM sequence: AGG
tcctgagtagctggaattac

SEQ ID NO: 48858 - DNA, 20 bp, Artificial Sequence
  Description of Artificial Sequence: Synthetic oligonucleotide
  Target: SCN9A; (+) strand; PAM type: NRG; PAM sequence: CGG
caggcgcccaccaccatgcc

SEQ ID NO: 48859 - DNA, 20 bp, Artificial Sequence
  Description of Artificial Sequence: Synthetic oligonucleotide
  Target: SCN9A; (+) strand; PAM type: NRG; PAM sequence: TAG
cggctaattttttgtatttt

SEQ ID NO: 48860 - DNA, 20 bp, Artificial Sequence
  Description of Artificial Sequence: Synthetic oligonucleotide
  Target: SCN9A; (+) strand; PAM type: NRG; PAM sequence: TAG
ctaattttttgtatttttag

SEQ ID NO: 48861 - DNA, 20 bp, Artificial Sequence
  Description of Artificial Sequence: Synthetic oligonucleotide
  Target: SCN9A; (+) strand; PAM type: NRG; PAM sequence: GAG
aattttttgtatttttagta

SEQ ID NO: 48862 - DNA, 20 bp, Artificial Sequence
  Description of Artificial Sequence: Synthetic oligonucleotide
  Target: SCN9A; (+) strand; PAM type: NRG; PAM sequence: CGG
ttttgtatttttagtagaga

SEQ ID NO: 48863 - DNA, 20 bp, Artificial Sequence
  Description of Artificial Sequence: Synthetic oligonucleotide
  Target: SCN9A; (+) strand; PAM type: NRG; PAM sequence: GGG
tttgtatttttagtagagac

SEQ ID NO: 48864 - DNA, 20 bp, Artificial Sequence
  Description of Artificial Sequence: Synthetic oligonucleotide
  Target: SCN9A; (+) strand; PAM type: NRG; PAM sequence: GGG
ttgtatttttagtagagacg

SEQ ID NO: 48865 - DNA, 20 bp, Artificial Sequence
  Description of Artificial Sequence: Synthetic oligonucleotide
  Target: SCN9A; (+) strand; PAM type: NRG; PAM sequence: TAG
tctttttttgtattattttt

SEQ ID NO: 48866 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaaaaaaaatacatg

SEQ ID NO: 48867 - DNA, 20 bp, Artificial Sequence
  Description of Artificial Sequence: Synthetic oligonucleotide
  Target: SCN9A; (+) strand; PAM type: NRG; PAM sequence: CAG
aaaaatacatgaagcaattc

SEQ ID NO: 48868 - DNA, 20 bp, Artificial Sequence
  Description of Artificial Sequence: Synthetic oligonucleotide
  Target: SCN9A; (+) strand; PAM type: NRG; PAM sequence: AAG
atacatgaagcaattccaga

SEQ ID NO: 48869 - DNA, 20 bp, Artificial Sequence
  Description of Artificial Sequence: Synthetic oligonucleotide
  Target: SCN9A; (+) strand; PAM type: NRG; PAM sequence: AAG
aattaaattaaatttgatta

SEQ ID NO: 48870 - DNA, 20 bp, Artificial Sequence
  Description of Artificial Sequence: Synthetic oligonucleotide
  Target: SCN9A; (+) strand; PAM type: NRG; PAM sequence: AGG
attaaattaaatttgattaa

SEQ ID NO: 48871 - DNA, 20 bp, Artificial Sequence
  Description of Artificial Sequence: Synthetic oligonucleotide
  Target: SCN9A; (+) strand; PAM type: NRG; PAM sequence: TAG
ttaaaggctgtctgtgtaca

SEQ ID NO: 48872 - DNA, 20 bp, Artificial Sequence
  Description of Artificial Sequence: Synthetic oligonucleotide
  Target: SCN9A; (+) strand; PAM type: NRG; PAM sequence: GAG
aaaggctgtctgtgtacata

SEQ ID NO: 48873 - DNA, 20 bp, Artificial Sequence
  Description of Artificial Sequence: Synthetic oligonucleotide
  Target: SCN9A; (+) strand; PAM type: NRG; PAM sequence: TAG
caaattgcattctaatctat

SEQ ID NO: 48874 - DNA, 20 bp, Artificial Sequence
  Description of Artificial Sequence: Synthetic oligonucleotide
  Target: SCN9A; (+) strand; PAM type: NRG; PAM sequence: AAG
tattagtatattcttgtaac

SEQ ID NO: 48875 - DNA, 20 bp, Artificial Sequence
  Description of Artificial Sequence: Synthetic oligonucleotide
  Target: SCN9A; (+) strand; PAM type: NRG; PAM sequence: TAG
tagtatattcttgtaacaag

SEQ ID NO: 48876 - DNA, 20 bp, Artificial Sequence
  Description of Artificial Sequence: Synthetic oligonucleotide
  Target: SCN9A; (+) strand; PAM type: NRG; PAM sequence: CAG
cttgtaacaagtagctgtct

SEQ ID NO: 48877 - DNA, 20 bp, Artificial Sequence
  Description of Artificial Sequence: Synthetic oligonucleotide
  Target: SCN9A; (+) strand; PAM type: NRG; PAM sequence: CAG
gtagctgtctcagccaatca

SEQ ID NO: 48878 - DNA, 20 bp, Artificial Sequence
  Description of Artificial Sequence: Synthetic oligonucleotide
  Target: SCN9A; (+) strand; PAM type: NRG; PAM sequence: CAG
gctgtctcagccaatcacag

SEQ ID NO: 48879 - DNA, 20 bp, Artificial Sequence
  Description of Artificial Sequence: Synthetic oligonucleotide
  Target: SCN9A; (+) strand; PAM type: NRG; PAM sequence: GAG
ctcagccaatcacagcagct

SEQ ID NO: 48880 - DNA, 20 bp, Artificial Sequence
  Description of Artificial Sequence: Synthetic oligonucleotide
  Target: SCN9A; (+) strand; PAM type: NRG; PAM sequence: CAG
caatcacagcagctgagctt

SEQ ID NO: 48881 - DNA, 20 bp, Artificial Sequence
  Description of Artificial Sequence: Synthetic oligonucleotide
  Target: SCN9A; (+) strand; PAM type: NRG; PAM sequence: CAG
agctgagcttcagccaacca

SEQ ID NO: 48882 - DNA, 20 bp, Artificial Sequence
  Description of Artificial Sequence: Synthetic oligonucleotide
  Target: SCN9A; (+) strand; PAM type: NRG; PAM sequence: CAG
accacagcctgctgatttat

SEQ ID NO: 48883 - DNA, 20 bp, Artificial Sequence
  Description of Artificial Sequence: Synthetic oligonucleotide
  Target: SCN9A; (+) strand; PAM type: NRG; PAM sequence: AAG
ttatcagacaatgtccacat

SEQ ID NO: 48884 - DNA, 20 bp, Artificial Sequence
  Description of Artificial Sequence: Synthetic oligonucleotide
  Target: SCN9A; (+) strand; PAM type: NRG; PAM sequence: AGG
tatcagacaatgtccacata

SEQ ID NO: 48885 - DNA, 20 bp, Artificial Sequence
  Description of Artificial Sequence: Synthetic oligonucleotide
  Target: SCN9A; (+) strand; PAM type: NRG; PAM sequence: AAG
gtccacataaggcaaatgtc

SEQ ID NO: 48886 - DNA, 20 bp, Artificial Sequence
  Description of Artificial Sequence: Synthetic oligonucleotide
  Target: SCN9A; (+) strand; PAM type: NRG; PAM sequence: AAG
taaggcaaatgtcaagctat

SEQ ID NO: 48887 - DNA, 20 bp, Artificial Sequence
  Description of Artificial Sequence: Synthetic oligonucleotide
  Target: SCN9A; (+) strand; PAM type: NRG; PAM sequence: AAG
atgtcaagctataagcaatc

SEQ ID NO: 48888 - DNA, 20 bp, Artificial Sequence
  Description of Artificial Sequence: Synthetic oligonucleotide
  Target: SCN9A; (+) strand; PAM type: NRG; PAM sequence: GAG
atactcctgctcatgttgct

SEQ ID NO: 48889 - DNA, 20 bp, Artificial Sequence
  Description of Artificial Sequence: Synthetic oligonucleotide
  Target: SCN9A; (+) strand; PAM type: NRG; PAM sequence: GAG
cctgctcatgttgctgagtt

SEQ ID NO: 48890 - DNA, 20 bp, Artificial Sequence
  Description of Artificial Sequence: Synthetic oligonucleotide
  Target: SCN9A; (+) strand; PAM type: NRG; PAM sequence: TGG
tgagctctccgaacttctct

SEQ ID NO: 48891 - DNA, 20 bp, Artificial Sequence
  Description of Artificial Sequence: Synthetic oligonucleotide
  Target: SCN9A; (+) strand; PAM type: NRG; PAM sequence: GAG
tccgaacttctcttggttct

SEQ ID NO: 48892 - DNA, 20 bp, Artificial Sequence
  Description of Artificial Sequence: Synthetic oligonucleotide
  Target: SCN9A; (+) strand; PAM type: NRG; PAM sequence: CAG
ttattattattatcttattt

SEQ ID NO: 48893 - DNA, 20 bp, Artificial Sequence
  Description of Artificial Sequence: Synthetic oligonucleotide
  Target: SCN9A; (+) strand; PAM type: NRG; PAM sequence: AAG
tactatttcattgctgaaat

SEQ ID NO: 48894 - DNA, 20 bp, Artificial Sequence
  Description of Artificial Sequence: Synthetic oligonucleotide
  Target: SCN9A; (+) strand; PAM type: NRG; PAM sequence: AAG
tgaaaatttttcttttaaca

SEQ ID NO: 48895 - DNA, 20 bp, Artificial Sequence
  Description of Artificial Sequence: Synthetic oligonucleotide
  Target: SCN9A; (+) strand; PAM type: NRG; PAM sequence: AGG
gaaaatttttcttttaacaa

SEQ ID NO: 48896 - DNA, 20 bp, Artificial Sequence
  Description of Artificial Sequence: Synthetic oligonucleotide
  Target: SCN9A; (+) strand; PAM type: NRG; PAM sequence: AAG
tttttcttttaacaaaggtt

SEQ ID NO: 48897 - DNA, 20 bp, Artificial Sequence
  Description of Artificial Sequence: Synthetic oligonucleotide
  Target: SCN9A; (+) strand; PAM type: NRG; PAM sequence: CAG
aaggttaagaaaaccattca

SEQ ID NO: 48898 - DNA, 20 bp, Artificial Sequence
  Description of Artificial Sequence: Synthetic oligonucleotide
  Target: SCN9A; (+) strand; PAM type: NRG; PAM sequence: CAG
aaccattcacagtataaact

SEQ ID NO: 48899 - DNA, 20 bp, Artificial Sequence
  Description of Artificial Sequence: Synthetic oligonucleotide
  Target: SCN9A; (+) strand; PAM type: NRG; PAM sequence: TAG
tcacagtataaactcagaaa

SEQ ID NO: 48900 - DNA, 20 bp, Artificial Sequence
  Description of Artificial Sequence: Synthetic oligonucleotide
  Target: SCN9A; (+) strand; PAM type: NRG; PAM sequence: AGG
cacagtataaactcagaaat

SEQ ID NO: 48901 - DNA, 20 bp, Artificial Sequence
  Description of Artificial Sequence: Synthetic oligonucleotide
  Target: SCN9A; (+) strand; PAM type: NRG; PAM sequence: GAG
cagtataaactcagaaatag

SEQ ID NO: 48902 - DNA, 20 bp, Artificial Sequence
  Description of Artificial Sequence: Synthetic oligonucleotide
  Target: SCN9A; (+) strand; PAM type: NRG; PAM sequence: AAG
ataaactcagaaataggagc

SEQ ID NO: 48903 - DNA, 20 bp, Artificial Sequence
  Description of Artificial Sequence: Synthetic oligonucleotide
  Target: SCN9A; (+) strand; PAM type: NRG; PAM sequence: CAG
tcagaaataggagcaagact

SEQ ID NO: 48904 - DNA, 20 bp, Artificial Sequence
  Description of Artificial Sequence: Synthetic oligonucleotide
  Target: SCN9A; (+) strand; PAM type: NRG; PAM sequence: AAG
aggagcaagactcagaataa

SEQ ID NO: 48905 - DNA, 20 bp, Artificial Sequence
  Description of Artificial Sequence: Synthetic oligonucleotide
  Target: SCN9A; (+) strand; PAM type: NRG; PAM sequence: AGG
ggagcaagactcagaataaa

SEQ ID NO: 48906 - DNA, 20 bp, Artificial Sequence
  Description of Artificial Sequence: Synthetic oligonucleotide
  Target: SCN9A; (+) strand; PAM type: NRG; PAM sequence: CAG
caagactcagaataaaagga

SEQ ID NO: 48907 - DNA, 20 bp, Artificial Sequence
  Description of Artificial Sequence: Synthetic oligonucleotide
  Target: SCN9A; (+) strand; PAM type: NRG; PAM sequence: CAG
cagaataaaaggacagatcc

SEQ ID NO: 48908 - DNA, 20 bp, Artificial Sequence
  Description of Artificial Sequence: Synthetic oligonucleotide
  Target: SCN9A; (+) strand; PAM type: NRG; PAM sequence: GAG
ataaaaggacagatcccagt

SEQ ID NO: 48909 - DNA, 20 bp, Artificial Sequence
  Description of Artificial Sequence: Synthetic oligonucleotide
  Target: SCN9A; (+) strand; PAM type: NRG; PAM sequence: AAG
agatcccagtgagaaaactt

SEQ ID NO: 48910 - DNA, 20 bp, Artificial Sequence
  Description of Artificial Sequence: Synthetic oligonucleotide
  Target: SCN9A; (+) strand; PAM type: NRG; PAM sequence: AAG
gagaaaacttaagtttaaat

SEQ ID NO: 48911 - DNA, 20 bp, Artificial Sequence
  Description of Artificial Sequence: Synthetic oligonucleotide
  Target: SCN9A; (+) strand; PAM type: NRG; PAM sequence: TGG
aacttaagtttaaataagtg

SEQ ID NO: 48912 - DNA, 20 bp, Artificial Sequence
  Description of Artificial Sequence: Synthetic oligonucleotide
  Target: SCN9A; (+) strand; PAM type: NRG; PAM sequence: AAG
taatctacaatattaaatgt

SEQ ID NO: 48913 - DNA, 20 bp, Artificial Sequence
  Description of Artificial Sequence: Synthetic oligonucleotide
  Target: SCN9A; (+) strand; PAM type: NRG; PAM sequence: CAG
attaaatgtaagttactcat

SEQ ID NO: 48914 - DNA, 20 bp, Artificial Sequence
  Description of Artificial Sequence: Synthetic oligonucleotide
  Target: SCN9A; (+) strand; PAM type: NRG; PAM sequence: CAG
catcagatatattaatttta

SEQ ID NO: 48915 - DNA, 20 bp, Artificial Sequence
  Description of Artificial Sequence: Synthetic oligonucleotide
  Target: SCN9A; (+) strand; PAM type: NRG; PAM sequence: AAG
aattttacagcatataaatt

SEQ ID NO: 48916 - DNA, 20 bp, Artificial Sequence
  Description of Artificial Sequence: Synthetic oligonucleotide
  Target: SCN9A; (+) strand; PAM type: NRG; PAM sequence: TGG
aaataaaattctccatccat

SEQ ID NO: 48917 - DNA, 20 bp, Artificial Sequence
  Description of Artificial Sequence: Synthetic oligonucleotide
  Target: SCN9A; (+) strand; PAM type: NRG; PAM sequence: AAG
attctccatccattggaaat

SEQ ID NO: 48918 - DNA, 20 bp, Artificial Sequence
  Description of Artificial Sequence: Synthetic oligonucleotide
  Target: SCN9A; (+) strand; PAM type: NRG; PAM sequence: CAG
caaatcatgtttgtaacaat

SEQ ID NO: 48919 - DNA, 20 bp, Artificial Sequence
  Description of Artificial Sequence: Synthetic oligonucleotide
  Target: SCN9A; (+) strand; PAM type: NRG; PAM sequence: TGG
tgtttgtaacaatcagaaac

SEQ ID NO: 48920 - DNA, 20 bp, Artificial Sequence
  Description of Artificial Sequence: Synthetic oligonucleotide
  Target: SCN9A; (+) strand; PAM type: NRG; PAM sequence: AAG
gtaacaatcagaaactggaa

SEQ ID NO: 48921 - DNA, 20 bp, Artificial Sequence
  Description of Artificial Sequence: Synthetic oligonucleotide
  Target: SCN9A; (+) strand; PAM type: NRG; PAM sequence: GAG
aacaatcagaaactggaaaa

SEQ ID NO: 48922 - DNA, 20 bp, Artificial Sequence
  Description of Artificial Sequence: Synthetic oligonucleotide
  Target: SCN9A; (+) strand; PAM type: NRG; PAM sequence: AGG
acaatcagaaactggaaaag

SEQ ID NO: 48923 - DNA, 20 bp, Artificial Sequence
  Description of Artificial Sequence: Synthetic oligonucleotide
  Target: SCN9A; (+) strand; PAM type: NRG; PAM sequence: GGG
caatcagaaactggaaaaga

SEQ ID NO: 48924 - DNA, 20 bp, Artificial Sequence
  Description of Artificial Sequence: Synthetic oligonucleotide
  Target: SCN9A; (+) strand; PAM type: NRG; PAM sequence: AAG
gaaaagagggtaaatataaa

SEQ ID NO: 48925 - DNA, 20 bp, Artificial Sequence
  Description of Artificial Sequence: Synthetic oligonucleotide
  Target: SCN9A; (+) strand; PAM type: NRG; PAM sequence: AAG
aagagggtaaatataaaaag

SEQ ID NO: 48926 - DNA, 20 bp, Artificial Sequence
  Description of Artificial Sequence: Synthetic oligonucleotide
  Target: SCN9A; (+) strand; PAM type: NRG; PAM sequence: AGG
agagggtaaatataaaaaga

SEQ ID NO: 48927 - DNA, 20 bp, Artificial Sequence
  Description of Artificial Sequence: Synthetic oligonucleotide
  Target: SCN9A; (+) strand; PAM type: NRG; PAM sequence: GGG
gagggtaaatataaaaagaa

SEQ ID NO: 48928 - DNA, 20 bp, Artificial Sequence
  Description of Artificial Sequence: Synthetic oligonucleotide
  Target: SCN9A; (+) strand; PAM type: NRG; PAM sequence: GGG
agggtaaatataaaaagaag

SEQ ID NO: 48929 - DNA, 20 bp, Artificial Sequence
  Description of Artificial Sequence: Synthetic oligonucleotide
  Target: SCN9A; (+) strand; PAM type: NRG; PAM sequence: TGG
atgctaaattcctcatcaaa

SEQ ID NO: 48930 - DNA, 20 bp, Artificial Sequence
  Description of Artificial Sequence: Synthetic oligonucleotide
  Target: SCN9A; (+) strand; PAM type: NRG; PAM sequence: TGG
ctaaattcctcatcaaatgg

SEQ ID NO: 48931 - DNA, 20 bp, Artificial Sequence
  Description of Artificial Sequence: Synthetic oligonucleotide
  Target: SCN9A; (+) strand; PAM type: NRG; PAM sequence: TAG
aattcctcatcaaatggtgg

SEQ ID NO: 48932 - DNA, 20 bp, Artificial Sequence
  Description of Artificial Sequence: Synthetic oligonucleotide
  Target: SCN9A; (+) strand; PAM type: NRG; PAM sequence: CAG
acattttacttcaaaacttt

SEQ ID NO: 48933 - DNA, 20 bp, Artificial Sequence
  Description of Artificial Sequence: Synthetic oligonucleotide
  Target: SCN9A; (+) strand; PAM type: NRG; PAM sequence: AAG
aaactttcagttttcttgtt

SEQ ID NO: 48934 - DNA, 20 bp, Artificial Sequence
  Description of Artificial Sequence: Synthetic oligonucleotide
  Target: SCN9A; (+) strand; PAM type: NRG; PAM sequence: AGG
aactttcagttttcttgtta

SEQ ID NO: 48935 - DNA, 20 bp, Artificial Sequence
  Description of Artificial Sequence: Synthetic oligonucleotide
  Target: SCN9A; (+) strand; PAM type: NRG; PAM sequence: TAG
tttttctgtcattttattta

SEQ ID NO: 48936 - DNA, 20 bp, Artificial Sequence
  Description of Artificial Sequence: Synthetic oligonucleotide
  Target: SCN9A; (+) strand; PAM type: NRG; PAM sequence: TGG
atttatagtcttttaccatg

SEQ ID NO: 48937 - DNA, 20 bp, Artificial Sequence
  Description of Artificial Sequence: Synthetic oligonucleotide
  Target: SCN9A; (+) strand; PAM type: NRG; PAM sequence: GGG
tttatagtcttttaccatgt

SEQ ID NO: 48938 - DNA, 20 bp, Artificial Sequence
  Description of Artificial Sequence: Synthetic oligonucleotide
  Target: SCN9A; (+) strand; PAM type: NRG; PAM sequence: TAG
tagtcttttaccatgtgggc

SEQ ID NO: 48939 - DNA, 20 bp, Artificial Sequence
  Description of Artificial Sequence: Synthetic oligonucleotide
  Target: SCN9A; (+) strand; PAM type: NRG; PAM sequence: AGG
agtcttttaccatgtgggct

SEQ ID NO: 48940 - DNA, 20 bp, Artificial Sequence
  Description of Artificial Sequence: Synthetic oligonucleotide
  Target: SCN9A; (+) strand; PAM type: NRG; PAM sequence: CAG
ttatttgattttatttatca

SEQ ID NO: 48941 - DNA, 20 bp, Artificial Sequence
  Description of Artificial Sequence: Synthetic oligonucleotide
  Target: SCN9A; (+) strand; PAM type: NRG; PAM sequence: GAG
ttgattttatttatcacagt

SEQ ID NO: 48942 - DNA, 20 bp, Artificial Sequence
  Description of Artificial Sequence: Synthetic oligonucleotide
  Target: SCN9A; (+) strand; PAM type: NRG; PAM sequence: GAG
ttttatttatcacagtgagt

SEQ ID NO: 48943 - DNA, 20 bp, Artificial Sequence
  Description of Artificial Sequence: Synthetic oligonucleotide
  Target: SCN9A; (+) strand; PAM type: NRG; PAM sequence: AAG
atttatcacagtgagtgaga

SEQ ID NO: 48944 - DNA, 20 bp, Artificial Sequence
  Description of Artificial Sequence: Synthetic oligonucleotide
  Target: SCN9A; (+) strand; PAM type: NRG; PAM sequence: AGG
tttatcacagtgagtgagaa

SEQ ID NO: 48945 - DNA, 20 bp, Artificial Sequence
  Description of Artificial Sequence: Synthetic oligonucleotide
  Target: SCN9A; (+) strand; PAM type: NRG; PAM sequence: TGG
tgagtgagaaaggacacatt

SEQ ID NO: 48946 - DNA, 20 bp, Artificial Sequence
  Description of Artificial Sequence: Synthetic oligonucleotide
  Target: SCN9A; (+) strand; PAM type: NRG; PAM sequence: AAG
aaggacacatttggtaaaat

SEQ ID NO: 48947 - DNA, 20 bp, Artificial Sequence
  Description of Artificial Sequence: Synthetic oligonucleotide
  Target: SCN9A; (+) strand; PAM type: NRG; PAM sequence: AAG
tatattactttttattatct

SEQ ID NO: 48948 - DNA, 20 bp, Artificial Sequence
  Description of Artificial Sequence: Synthetic oligonucleotide
  Target: SCN9A; (+) strand; PAM type: NRG; PAM sequence: AGG
atattactttttattatcta

SEQ ID NO: 48949 - DNA, 20 bp, Artificial Sequence
  Description of Artificial Sequence: Synthetic oligonucleotide
  Target: SCN9A; (+) strand; PAM type: NRG; PAM sequence: GAG
attactttttattatctaag

SEQ ID NO: 48950 - DNA, 20 bp, Artificial Sequence
  Description of Artificial Sequence: Synthetic oligonucleotide
  Target: SCN9A; (+) strand; PAM type: NRG; PAM sequence: TGG
tttcctccctcatttccttt

SEQ ID NO: 48951 - DNA, 20 bp, Artificial Sequence
  Description of Artificial Sequence: Synthetic oligonucleotide
  Target: SCN9A; (+) strand; PAM type: NRG; PAM sequence: CAG
ccctcatttccttttggcaa

SEQ ID NO: 48952 - DNA, 20 bp, Artificial Sequence
  Description of Artificial Sequence: Synthetic oligonucleotide
  Target: SCN9A; (+) strand; PAM type: NRG; PAM sequence: AAG
gcaacagcacatatatttga

SEQ ID NO: 48953 - DNA, 20 bp, Artificial Sequence
  Description of Artificial Sequence: Synthetic oligonucleotide
  Target: SCN9A; (+) strand; PAM type: NRG; PAM sequence: AGG
caacagcacatatatttgaa

SEQ ID NO: 48954 - DNA, 20 bp, Artificial Sequence
  Description of Artificial Sequence: Synthetic oligonucleotide
  Target: SCN9A; (+) strand; PAM type: NRG; PAM sequence: TGG
cgtgacttccataccacacc

SEQ ID NO: 48955 - DNA, 20 bp, Artificial Sequence
  Description of Artificial Sequence: Synthetic oligonucleotide
  Target: SCN9A; (+) strand; PAM type: NRG; PAM sequence: GGG
gtgacttccataccacacct

SEQ ID NO: 48956 - DNA, 20 bp, Artificial Sequence
  Description of Artificial Sequence: Synthetic oligonucleotide
  Target: SCN9A; (+) strand; PAM type: NRG; PAM sequence: AAG
cctgggtcaaattatctatt

SEQ ID NO: 48957 - DNA, 20 bp, Artificial Sequence
  Description of Artificial Sequence: Synthetic oligonucleotide
  Target: SCN9A; (+) strand; PAM type: NRG; PAM sequence: TGG
ttaagatttatgtattcacg

SEQ ID NO: 48958 - DNA, 20 bp, Artificial Sequence
  Description of Artificial Sequence: Synthetic oligonucleotide
  Target: SCN9A; (+) strand; PAM type: NRG; PAM sequence: GGG
taagatttatgtattcacgt

SEQ ID NO: 48959 - DNA, 20 bp, Artificial Sequence
  Description of Artificial Sequence: Synthetic oligonucleotide
  Target: SCN9A; (+) strand; PAM type: NRG; PAM sequence: CAG
tgtattcacgtgggcaccat

SEQ ID NO: 48960 - DNA, 20 bp, Artificial Sequence
  Description of Artificial Sequence: Synthetic oligonucleotide
  Target: SCN9A; (+) strand; PAM type: NRG; PAM sequence: TAG
ttcacgtgggcaccatcaga

SEQ ID NO: 48961 - DNA, 20 bp, Artificial Sequence
  Description of Artificial Sequence: Synthetic oligonucleotide
  Target: SCN9A; (+) strand; PAM type: NRG; PAM sequence: CAG
accatcagatagatacattc

SEQ ID NO: 48962 - DNA, 20 bp, Artificial Sequence
  Description of Artificial Sequence: Synthetic oligonucleotide
  Target: SCN9A; (+) strand; PAM type: NRG; PAM sequence: AGG
ccatcagatagatacattcc

SEQ ID NO: 48963 - DNA, 20 bp, Artificial Sequence
  Description of Artificial Sequence: Synthetic oligonucleotide
  Target: SCN9A; (+) strand; PAM type: NRG; PAM sequence: CAG
gatagatacattccaggtgt

SEQ ID NO: 48964 - DNA, 20 bp, Artificial Sequence
  Description of Artificial Sequence: Synthetic oligonucleotide
  Target: SCN9A; (+) strand; PAM type: NRG; PAM sequence: CAG
gatacattccaggtgtcaga

SEQ ID NO: 48965 - DNA, 20 bp, Artificial Sequence
  Description of Artificial Sequence: Synthetic oligonucleotide
  Target: SCN9A; (+) strand; PAM type: NRG; PAM sequence: AAG
cattccaggtgtcagacaga

SEQ ID NO: 48966 - DNA, 20 bp, Artificial Sequence
  Description of Artificial Sequence: Synthetic oligonucleotide
  Target: SCN9A; (+) strand; PAM type: NRG; PAM sequence: CAG
ccaatattcatcaaccgttc

SEQ ID NO: 48967 - DNA, 20 bp, Artificial Sequence
  Description of Artificial Sequence: Synthetic oligonucleotide
  Target: SCN9A; (+) strand; PAM type: NRG; PAM sequence: GAG
tattcatcaaccgttccagt

SEQ ID NO: 48968 - DNA, 20 bp, Artificial Sequence
  Description of Artificial Sequence: Synthetic oligonucleotide
  Target: SCN9A; (+) strand; PAM type: NRG; PAM sequence: GAG
ttcatcaaccgttccagtga

SEQ ID NO: 48969 - DNA, 20 bp, Artificial Sequence
  Description of Artificial Sequence: Synthetic oligonucleotide
  Target: SCN9A; (+) strand; PAM type: NRG; PAM sequence: TAG
tccagtgagagacaccatgc

SEQ ID NO: 48970 - DNA, 20 bp, Artificial Sequence
  Description of Artificial Sequence: Synthetic oligonucleotide
  Target: SCN9A; (+) strand; PAM type: NRG; PAM sequence: AGG
ccagtgagagacaccatgct

SEQ ID NO: 48971 - DNA, 20 bp, Artificial Sequence
  Description of Artificial Sequence: Synthetic oligonucleotide
  Target: SCN9A; (+) strand; PAM type: NRG; PAM sequence: GGG
cagtgagagacaccatgcta

SEQ ID NO: 48972 - DNA, 20 bp, Artificial Sequence
  Description of Artificial Sequence: Synthetic oligonucleotide
  Target: SCN9A; (+) strand; PAM type: NRG; PAM sequence: GGG
agtgagagacaccatgctag

SEQ ID NO: 48973 - DNA, 20 bp, Artificial Sequence
  Description of Artificial Sequence: Synthetic oligonucleotide
  Target: SCN9A; (+) strand; PAM type: NRG; PAM sequence: TAG
catgctaggggataattgtt

SEQ ID NO: 48974 - DNA, 20 bp, Artificial Sequence
  Description of Artificial Sequence: Synthetic oligonucleotide
  Target: SCN9A; (+) strand; PAM type: NRG; PAM sequence: GAG
tgctaggggataattgttta

SEQ ID NO: 48975 - DNA, 20 bp, Artificial Sequence
  Description of Artificial Sequence: Synthetic oligonucleotide
  Target: SCN9A; (+) strand; PAM type: NRG; PAM sequence: AAG
attcaattcatgctttatgt

SEQ ID NO: 48976 - DNA, 20 bp, Artificial Sequence
  Description of Artificial Sequence: Synthetic oligonucleotide
  Target: SCN9A; (+) strand; PAM type: NRG; PAM sequence: AAG
ctaattgatacttctgaatt

SEQ ID NO: 48977 - DNA, 20 bp, Artificial Sequence
  Description of Artificial Sequence: Synthetic oligonucleotide
  Target: SCN9A; (+) strand; PAM type: NRG; PAM sequence: CAG
attgatacttctgaattaag

SEQ ID NO: 48978 - DNA, 20 bp, Artificial Sequence
  Description of Artificial Sequence: Synthetic oligonucleotide
  Target: SCN9A; (+) strand; PAM type: NRG; PAM sequence: GAG
tctgaattaagcagacttct

SEQ ID NO: 48979 - DNA, 20 bp, Artificial Sequence
  Description of Artificial Sequence: Synthetic oligonucleotide
  Target: SCN9A; (+) strand; PAM type: NRG; PAM sequence: GAG
tgaattaagcagacttctga

SEQ ID NO: 48980 - DNA, 20 bp, Artificial Sequence
  Description of Artificial Sequence: Synthetic oligonucleotide
  Target: SCN9A; (+) strand; PAM type: NRG; PAM sequence: CAG
cagacttctgagagtgcata

SEQ ID NO: 48981 - DNA, 20 bp, Artificial Sequence
  Description of Artificial Sequence: Synthetic oligonucleotide
  Target: SCN9A; (+) strand; PAM type: NRG; PAM sequence: TGG
tgcatacagatgatctcatg

SEQ ID NO: 48982 - DNA, 20 bp, Artificial Sequence
  Description of Artificial Sequence: Synthetic oligonucleotide
  Target: SCN9A; (+) strand; PAM type: NRG; PAM sequence: CAG
atgatctcatgtggtaccta

SEQ ID NO: 48983 - DNA, 20 bp, Artificial Sequence
  Description of Artificial Sequence: Synthetic oligonucleotide
  Target: SCN9A; (+) strand; PAM type: NRG; PAM sequence: CAG
aaactttgatatcttgccat

SEQ ID NO: 48984 - DNA, 20 bp, Artificial Sequence
  Description of Artificial Sequence: Synthetic oligonucleotide
  Target: SCN9A; (+) strand; PAM type: NRG; PAM sequence: AAG
cttgccatcagcctatattg

SEQ ID NO: 48985 - DNA, 20 bp, Artificial Sequence
  Description of Artificial Sequence: Synthetic oligonucleotide
  Target: SCN9A; (+) strand; PAM type: NRG; PAM sequence: AGG
ttgccatcagcctatattga

SEQ ID NO: 48986 - DNA, 20 bp, Artificial Sequence
  Description of Artificial Sequence: Synthetic oligonucleotide
  Target: SCN9A; (+) strand; PAM type: NRG; PAM sequence: AAG
ccatcagcctatattgaagg

SEQ ID NO: 48987 - DNA, 20 bp, Artificial Sequence
  Description of Artificial Sequence: Synthetic oligonucleotide
  Target: SCN9A; (+) strand; PAM type: NRG; PAM sequence: CAG
ttgaaggaagccattaaaaa

SEQ ID NO: 48988 - DNA, 20 bp, Artificial Sequence
  Description of Artificial Sequence: Synthetic oligonucleotide
  Target: SCN9A; (+) strand; PAM type: NRG; PAM sequence: TGG
acagctatgaaactcgtcat

SEQ ID NO: 48989 - DNA, 20 bp, Artificial Sequence
  Description of Artificial Sequence: Synthetic oligonucleotide
  Target: SCN9A; (+) strand; PAM type: NRG; PAM sequence: AAG
gaaactcgtcattggttaca

SEQ ID NO: 48990 - DNA, 20 bp, Artificial Sequence
  Description of Artificial Sequence: Synthetic oligonucleotide
  Target: SCN9A; (+) strand; PAM type: NRG; PAM sequence: TGG
actcgtcattggttacaaag

SEQ ID NO: 48991 - DNA, 20 bp, Artificial Sequence
  Description of Artificial Sequence: Synthetic oligonucleotide
  Target: SCN9A; (+) strand; PAM type: NRG; PAM sequence: AAG
ttacaaagtggatgttgata

SEQ ID NO: 48992 - DNA, 20 bp, Artificial Sequence
  Description of Artificial Sequence: Synthetic oligonucleotide
  Target: SCN9A; (+) strand; PAM type: NRG; PAM sequence: GAG
aagtggatgttgataaagct

SEQ ID NO: 48993 - DNA, 20 bp, Artificial Sequence
  Description of Artificial Sequence: Synthetic oligonucleotide
  Target: SCN9A; (+) strand; PAM type: NRG; PAM sequence: TAG
ttttgctttgtacaaatctt

SEQ ID NO: 48994 - DNA, 20 bp, Artificial Sequence
  Description of Artificial Sequence: Synthetic oligonucleotide
  Target: SCN9A; (+) strand; PAM type: NRG; PAM sequence: AGG
tttgctttgtacaaatcttt

SEQ ID NO: 48995 - DNA, 20 bp, Artificial Sequence
  Description of Artificial Sequence: Synthetic oligonucleotide
  Target: SCN9A; (+) strand; PAM type: NRG; PAM sequence: AAG
aaatctttaggaatactatc

SEQ ID NO: 48996 - DNA, 20 bp, Artificial Sequence
  Description of Artificial Sequence: Synthetic oligonucleotide
  Target: SCN9A; (+) strand; PAM type: NRG; PAM sequence: CAG
ttaggaatactatcaagata

SEQ ID NO: 48997 - DNA, 20 bp, Artificial Sequence
  Description of Artificial Sequence: Synthetic oligonucleotide
  Target: SCN9A; (+) strand; PAM type: NRG; PAM sequence: TAG
ttatcattatatatgattaa

SEQ ID NO: 48998 - DNA, 20 bp, Artificial Sequence
  Description of Artificial Sequence: Synthetic oligonucleotide
  Target: SCN9A; (+) strand; PAM type: NRG; PAM sequence: AAG
tatatgattaatagaacttt

SEQ ID NO: 48999 - DNA, 20 bp, Artificial Sequence
  Description of Artificial Sequence: Synthetic oligonucleotide
  Target: SCN9A; (+) strand; PAM type: NRG; PAM sequence: TAG
aatagaactttaagatgtta

SEQ ID NO: 49000 - DNA, 20 bp, Artificial Sequence
  Description of Artificial Sequence: Synthetic oligonucleotide
  Target: SCN9A; (+) strand; PAM type: NRG; PAM sequence: GAG
ctttaagatgttatagttat

SEQ ID NO: 49001 - DNA, 20 bp, Artificial Sequence
  Description of Artificial Sequence: Synthetic oligonucleotide
  Target: SCN9A; (+) strand; PAM type: NRG; PAM sequence: AAG
agttatgagtacaatctatt

SEQ ID NO: 49002 - DNA, 20 bp, Artificial Sequence
  Description of Artificial Sequence: Synthetic oligonucleotide
  Target: SCN9A; (+) strand; PAM type: NRG; PAM sequence: AAG
acattatatataataaatat

SEQ ID NO: 49003 - DNA, 20 bp, Artificial Sequence
  Description of Artificial Sequence: Synthetic oligonucleotide
  Target: SCN9A; (+) strand; PAM type: NRG; PAM sequence: TGG
tattatattgttaaatgtaa

SEQ ID NO: 49004 - DNA, 20 bp, Artificial Sequence
  Description of Artificial Sequence: Synthetic oligonucleotide
  Target: SCN9A; (+) strand; PAM type: NRG; PAM sequence: AAG
atggttaatgttattaattc

SEQ ID NO: 49005 - DNA, 20 bp, Artificial Sequence
  Description of Artificial Sequence: Synthetic oligonucleotide
  Target: SCN9A; (+) strand; PAM type: NRG; PAM sequence: AGG
tggttaatgttattaattca

SEQ ID NO: 49006 - DNA, 20 bp, Artificial Sequence
  Description of Artificial Sequence: Synthetic oligonucleotide
  Target: SCN9A; (+) strand; PAM type: NRG; PAM sequence: TAG
caaggctacatttatttctc

SEQ ID NO: 49007 - DNA, 20 bp, Artificial Sequence
  Description of Artificial Sequence: Synthetic oligonucleotide
  Target: SCN9A; (+) strand; PAM type: NRG; PAM sequence: GAG
aggctacatttatttctcta

SEQ ID NO: 49008 - DNA, 20 bp, Artificial Sequence
  Description of Artificial Sequence: Synthetic oligonucleotide
  Target: SCN9A; (+) strand; PAM type: NRG; PAM sequence: TAG
aataattcttttttatgata

SEQ ID NO: 49009 - DNA, 20 bp, Artificial Sequence
  Description of Artificial Sequence: Synthetic oligonucleotide
  Target: SCN9A; (+) strand; PAM type: NRG; PAM sequence: TAG
cttttttatgatatagaaat

SEQ ID NO: 49010 - DNA, 20 bp, Artificial Sequence
  Description of Artificial Sequence: Synthetic oligonucleotide
  Target: SCN9A; (+) strand; PAM type: NRG; PAM sequence: AGG
ttttttatgatatagaaatt

SEQ ID NO: 49011 - DNA, 20 bp, Artificial Sequence
  Description of Artificial Sequence: Synthetic oligonucleotide
  Target: SCN9A; (+) strand; PAM type: NRG; PAM sequence: TGG
gatatagaaattaggaatta

SEQ ID NO: 49012 - DNA, 20 bp, Artificial Sequence
  Description of Artificial Sequence: Synthetic oligonucleotide
  Target: SCN9A; (+) strand; PAM type: NRG; PAM sequence: CAG
ctatcctgtgttccttttgc

SEQ ID NO: 49013 - DNA, 20 bp, Artificial Sequence
  Description of Artificial Sequence: Synthetic oligonucleotide
  Target: SCN9A; (+) strand; PAM type: NRG; PAM sequence: TAG
gttccttttgccagtactgc

SEQ ID NO: 49014 - DNA, 20 bp, Artificial Sequence
  Description of Artificial Sequence: Synthetic oligonucleotide
  Target: SCN9A; (+) strand; PAM type: NRG; PAM sequence: TAG
cttttgccagtactgctaga

SEQ ID NO: 49015 - DNA, 20 bp, Artificial Sequence
  Description of Artificial Sequence: Synthetic oligonucleotide
  Target: SCN9A; (+) strand; PAM type: NRG; PAM sequence: TAG
gccagtactgctagatagct

SEQ ID NO: 49016 - DNA, 20 bp, Artificial Sequence
  Description of Artificial Sequence: Synthetic oligonucleotide
  Target: SCN9A; (+) strand; PAM type: NRG; PAM sequence: CAG
actgctagatagcttagaac

SEQ ID NO: 49017 - DNA, 20 bp, Artificial Sequence
  Description of Artificial Sequence: Synthetic oligonucleotide
  Target: SCN9A; (+) strand; PAM type: NRG; PAM sequence: AGG
ctgctagatagcttagaacc

SEQ ID NO: 49018 - DNA, 20 bp, Artificial Sequence
  Description of Artificial Sequence: Synthetic oligonucleotide
  Target: SCN9A; (+) strand; PAM type: NRG; PAM sequence: TAG
catgacccaaattcacactg

SEQ ID NO: 49019 - DNA, 20 bp, Artificial Sequence
  Description of Artificial Sequence: Synthetic oligonucleotide
  Target: SCN9A; (+) strand; PAM type: NRG; PAM sequence: CAG
gacccaaattcacactgtag

SEQ ID NO: 49020 - DNA, 20 bp, Artificial Sequence
  Description of Artificial Sequence: Synthetic oligonucleotide
  Target: SCN9A; (+) strand; PAM type: NRG; PAM sequence: TAG
cagctttctatatatttgaa

SEQ ID NO: 49021 - DNA, 20 bp, Artificial Sequence
  Description of Artificial Sequence: Synthetic oligonucleotide
  Target: SCN9A; (+) strand; PAM type: NRG; PAM sequence: AAG
ctttgaaatgattaaaatga

SEQ ID NO: 49022 - DNA, 20 bp, Artificial Sequence
  Description of Artificial Sequence: Synthetic oligonucleotide
  Target: SCN9A; (+) strand; PAM type: NRG; PAM sequence: AAG
aagcaacatttcattattaa

SEQ ID NO: 49023 - DNA, 20 bp, Artificial Sequence
  Description of Artificial Sequence: Synthetic oligonucleotide
  Target: SCN9A; (+) strand; PAM type: NRG; PAM sequence: GAG
gcaacatttcattattaaaa

SEQ ID NO: 49024 - DNA, 20 bp, Artificial Sequence
  Description of Artificial Sequence: Synthetic oligonucleotide
  Target: SCN9A; (+) strand; PAM type: NRG; PAM sequence: GAG
aacatttcattattaaaaga

SEQ ID NO: 49025 - DNA, 20 bp, Artificial Sequence
  Description of Artificial Sequence: Synthetic oligonucleotide
  Target: SCN9A; (+) strand; PAM type: NRG; PAM sequence: TAG
ttaaaagagagcaatgtttt

SEQ ID NO: 49026 - DNA, 20 bp, Artificial Sequence
  Description of Artificial Sequence: Synthetic oligonucleotide
  Target: SCN9A; (+) strand; PAM type: NRG; PAM sequence: AAG
ttcaacctaataacaaatgc

SEQ ID NO: 49027 - DNA, 20 bp, Artificial Sequence
  Description of Artificial Sequence: Synthetic oligonucleotide
  Target: SCN9A; (+) strand; PAM type: NRG; PAM sequence: AGG
tcaacctaataacaaatgca

SEQ ID NO: 49028 - DNA, 20 bp, Artificial Sequence
  Description of Artificial Sequence: Synthetic oligonucleotide
  Target: SCN9A; (+) strand; PAM type: NRG; PAM sequence: AAG
caaggacattcttacttcta

SEQ ID NO: 49029 - DNA, 20 bp, Artificial Sequence
  Description of Artificial Sequence: Synthetic oligonucleotide
  Target: SCN9A; (+) strand; PAM type: NRG; PAM sequence: TAG
ctaaagtcttcttcactctc

SEQ ID NO: 49030 - DNA, 20 bp, Artificial Sequence
  Description of Artificial Sequence: Synthetic oligonucleotide
  Target: SCN9A; (+) strand; PAM type: NRG; PAM sequence: AGG
taaagtcttcttcactctct

SEQ ID NO: 49031 - DNA, 20 bp, Artificial Sequence
  Description of Artificial Sequence: Synthetic oligonucleotide
  Target: SCN9A; (+) strand; PAM type: NRG; PAM sequence: GGG
aaagtcttcttcactctcta

SEQ ID NO: 49032 - DNA, 20 bp, Artificial Sequence
  Description of Artificial Sequence: Synthetic oligonucleotide
  Target: SCN9A; (+) strand; PAM type: NRG; PAM sequence: AAG
tctaatgtttcattattttc

SEQ ID NO: 49033 - DNA, 20 bp, Artificial Sequence
  Description of Artificial Sequence: Synthetic oligonucleotide
  Target: SCN9A; (+) strand; PAM type: NRG; PAM sequence: CAG
tttcgaaaacatttatgctt

SEQ ID NO: 49034 - DNA, 20 bp, Artificial Sequence
  Description of Artificial Sequence: Synthetic oligonucleotide
  Target: SCN9A; (+) strand; PAM type: NRG; PAM sequence: AGG
ttcgaaaacatttatgcttc

SEQ ID NO: 49035 - DNA, 20 bp, Artificial Sequence
  Description of Artificial Sequence: Synthetic oligonucleotide
  Target: SCN9A; (+) strand; PAM type: NRG; PAM sequence: CAG
tgcttcaggtttcccatgaa

SEQ ID NO: 49036 - DNA, 20 bp, Artificial Sequence
  Description of Artificial Sequence: Synthetic oligonucleotide
  Target: SCN9A; (+) strand; PAM type: NRG; PAM sequence: TAG
aggtttcccatgaacagctg

SEQ ID NO: 49037 - DNA, 20 bp, Artificial Sequence
  Description of Artificial Sequence: Synthetic oligonucleotide
  Target: SCN9A; (+) strand; PAM type: NRG; PAM sequence: TAG
atgaacagctgtagtccaat

SEQ ID NO: 49038 - DNA, 20 bp, Artificial Sequence
  Description of Artificial Sequence: Synthetic oligonucleotide
  Target: SCN9A; (+) strand; PAM type: NRG; PAM sequence: CAG
ccaattagtgcaaacacact

SEQ ID NO: 49039 - DNA, 20 bp, Artificial Sequence
  Description of Artificial Sequence: Synthetic oligonucleotide
  Target: SCN9A; (+) strand; PAM type: NRG; PAM sequence: CAG
ttagtgcaaacacactcaga

SEQ ID NO: 49040 - DNA, 20 bp, Artificial Sequence
  Description of Artificial Sequence: Synthetic oligonucleotide
  Target: SCN9A; (+) strand; PAM type: NRG; PAM sequence: CAG
aaacacactcagacagaaca

SEQ ID NO: 49041 - DNA, 20 bp, Artificial Sequence
  Description of Artificial Sequence: Synthetic oligonucleotide
  Target: SCN9A; (+) strand; PAM type: NRG; PAM sequence: CAG
acactcagacagaacacagt

SEQ ID NO: 49042 - DNA, 20 bp, Artificial Sequence
  Description of Artificial Sequence: Synthetic oligonucleotide
  Target: SCN9A; (+) strand; PAM type: NRG; PAM sequence: AGG
cactcagacagaacacagtc

SEQ ID NO: 49043 - DNA, 20 bp, Artificial Sequence
  Description of Artificial Sequence: Synthetic oligonucleotide
  Target: SCN9A; (+) strand; PAM type: NRG; PAM sequence: CAG
cacagtcaggatcatgacat

SEQ ID NO: 49044 - DNA, 20 bp, Artificial Sequence
  Description of Artificial Sequence: Synthetic oligonucleotide
  Target: SCN9A; (+) strand; PAM type: NRG; PAM sequence: AAG
gtcaggatcatgacatcaga

SEQ ID NO: 49045 - DNA, 20 bp, Artificial Sequence
  Description of Artificial Sequence: Synthetic oligonucleotide
  Target: SCN9A; (+) strand; PAM type: NRG; PAM sequence: TGG
cagaaagcttcttcactgac

SEQ ID NO: 49046 - DNA, 20 bp, Artificial Sequence
  Description of Artificial Sequence: Synthetic oligonucleotide
  Target: SCN9A; (+) strand; PAM type: NRG; PAM sequence: AAG
cttcttcactgactggatca

SEQ ID NO: 49047 - DNA, 20 bp, Artificial Sequence
  Description of Artificial Sequence: Synthetic oligonucleotide
  Target: SCN9A; (+) strand; PAM type: NRG; PAM sequence: CAG
aaagcccctacaattgtctt

SEQ ID NO: 49048 - DNA, 20 bp, Artificial Sequence
  Description of Artificial Sequence: Synthetic oligonucleotide
  Target: SCN9A; (+) strand; PAM type: NRG; PAM sequence: AGG
aagcccctacaattgtcttc

SEQ ID NO: 49049 - DNA, 20 bp, Artificial Sequence
  Description of Artificial Sequence: Synthetic oligonucleotide
  Target: SCN9A; (+) strand; PAM type: NRG; PAM sequence: TGG
attgtcttcaggcctgaaaa

SEQ ID NO: 49050 - DNA, 20 bp, Artificial Sequence
  Description of Artificial Sequence: Synthetic oligonucleotide
  Target: SCN9A; (+) strand; PAM type: NRG; PAM sequence: GGG
ttgtcttcaggcctgaaaat

SEQ ID NO: 49051 - DNA, 20 bp, Artificial Sequence
  Description of Artificial Sequence: Synthetic oligonucleotide
  Target: SCN9A; (+) strand; PAM type: NRG; PAM sequence: GAG
gtcttcaggcctgaaaatgg

SEQ ID NO: 49052 - DNA, 20 bp, Artificial Sequence
  Description of Artificial Sequence: Synthetic oligonucleotide
  Target: SCN9A; (+) strand; PAM type: NRG; PAM sequence: AAG
ggcctgaaaatgggagaaaa

SEQ ID NO: 49053 - DNA, 20 bp, Artificial Sequence
  Description of Artificial Sequence: Synthetic oligonucleotide
  Target: SCN9A; (+) strand; PAM type: NRG; PAM sequence: AAG
aaagtgtttgtaatgacata

SEQ ID NO: 49054 - DNA, 20 bp, Artificial Sequence
  Description of Artificial Sequence: Synthetic oligonucleotide
  Target: SCN9A; (+) strand; PAM type: NRG; PAM sequence: AAG
tgaatcgaaacaaaaaacac

SEQ ID NO: 49055 - DNA, 20 bp, Artificial Sequence
  Description of Artificial Sequence: Synthetic oligonucleotide
  Target: SCN9A; (+) strand; PAM type: NRG; PAM sequence: TAG
acaaaaaacacaagctttcc

SEQ ID NO: 49056 - DNA, 20 bp, Artificial Sequence
  Description of Artificial Sequence: Synthetic oligonucleotide
  Target: SCN9A; (+) strand; PAM type: NRG; PAM sequence: AAG
aaaacacaagctttcctaga

SEQ ID NO: 49057 - DNA, 20 bp, Artificial Sequence
  Description of Artificial Sequence: Synthetic oligonucleotide
  Target: SCN9A; (+) strand; PAM type: NRG; PAM sequence: AAG
tatatcaaatcaatgacctt

SEQ ID NO: 49058 - DNA, 20 bp, Artificial Sequence
  Description of Artificial Sequence: Synthetic oligonucleotide
  Target: SCN9A; (+) strand; PAM type: NRG; PAM sequence: AAG
taagtaacctaattcaaaaa

SEQ ID NO: 49059 - DNA, 20 bp, Artificial Sequence
  Description of Artificial Sequence: Synthetic oligonucleotide
  Target: SCN9A; (+) strand; PAM type: NRG; PAM sequence: TGG
ctaattcaaaaaaagccttc

SEQ ID NO: 49060 - DNA, 20 bp, Artificial Sequence
  Description of Artificial Sequence: Synthetic oligonucleotide
  Target: SCN9A; (+) strand; PAM type: NRG; PAM sequence: GGG
taattcaaaaaaagccttct

SEQ ID NO: 49061 - DNA, 20 bp, Artificial Sequence
  Description of Artificial Sequence: Synthetic oligonucleotide
  Target: SCN9A; (+) strand; PAM type: NRG; PAM sequence: CAG
tactttgtttttatatatta

SEQ ID NO: 49062 - DNA, 20 bp, Artificial Sequence
  Description of Artificial Sequence: Synthetic oligonucleotide
  Target: SCN9A; (+) strand; PAM type: NRG; PAM sequence: TGG
tttttatatattacagcaaa

SEQ ID NO: 49063 - DNA, 20 bp, Artificial Sequence
  Description of Artificial Sequence: Synthetic oligonucleotide
  Target: SCN9A; (+) strand; PAM type: NRG; PAM sequence: TAG
ttacagcaaatggttaaaaa

SEQ ID NO: 49064 - DNA, 20 bp, Artificial Sequence
  Description of Artificial Sequence: Synthetic oligonucleotide
  Target: SCN9A; (+) strand; PAM type: NRG; PAM sequence: AGG
tacagcaaatggttaaaaat

SEQ ID NO: 49065 - DNA, 20 bp, Artificial Sequence
  Description of Artificial Sequence: Synthetic oligonucleotide
  Target: SCN9A; (+) strand; PAM type: NRG; PAM sequence: AAG
aaaataggaacatattctca

SEQ ID NO: 49066 - DNA, 20 bp, Artificial Sequence
  Description of Artificial Sequence: Synthetic oligonucleotide
  Target: SCN9A; (+) strand; PAM type: NRG; PAM sequence: TAG
acatattctcaaagaatacc

SEQ ID NO: 49067 - DNA, 20 bp, Artificial Sequence
  Description of Artificial Sequence: Synthetic oligonucleotide
  Target: SCN9A; (+) strand; PAM type: NRG; PAM sequence: AGG
catattctcaaagaatacct

SEQ ID NO: 49068 - DNA, 20 bp, Artificial Sequence
  Description of Artificial Sequence: Synthetic oligonucleotide
  Target: SCN9A; (+) strand; PAM type: NRG; PAM sequence: TGG
ggttgtcaaaatgaacaatt

SEQ ID NO: 49069 - DNA, 20 bp, Artificial Sequence
  Description of Artificial Sequence: Synthetic oligonucleotide
  Target: SCN9A; (+) strand; PAM type: NRG; PAM sequence: AAG
actttaaaaataatttttgt

SEQ ID NO: 49070 - DNA, 20 bp, Artificial Sequence
  Description of Artificial Sequence: Synthetic oligonucleotide
  Target: SCN9A; (+) strand; PAM type: NRG; PAM sequence: TGG
acaaaccacttctctataaa

SEQ ID NO: 49071 - DNA, 20 bp, Artificial Sequence
  Description of Artificial Sequence: Synthetic oligonucleotide
  Target: SCN9A; (+) strand; PAM type: NRG; PAM sequence: CAG
aatggcaccaaaacaaatta

SEQ ID NO: 49072 - DNA, 20 bp, Artificial Sequence
  Description of Artificial Sequence: Synthetic oligonucleotide
  Target: SCN9A; (+) strand; PAM type: NRG; PAM sequence: TAG
ccaaaacaaattacagcata

SEQ ID NO: 49073 - DNA, 20 bp, Artificial Sequence
  Description of Artificial Sequence: Synthetic oligonucleotide
  Target: SCN9A; (+) strand; PAM type: NRG; PAM sequence: AAG
ccttgtaataattttcaata

SEQ ID NO: 49074 - DNA, 20 bp, Artificial Sequence
  Description of Artificial Sequence: Synthetic oligonucleotide
  Target: SCN9A; (+) strand; PAM type: NRG; PAM sequence: TGG
aataattttcaataaagaaa

SEQ ID NO: 49075 - DNA, 20 bp, Artificial Sequence
  Description of Artificial Sequence: Synthetic oligonucleotide
  Target: SCN9A; (+) strand; PAM type: NRG; PAM sequence: GAG
caataaagaaatggtttgct

SEQ ID NO: 49076 - DNA, 20 bp, Artificial Sequence
  Description of Artificial Sequence: Synthetic oligonucleotide
  Target: SCN9A; (+) strand; PAM type: NRG; PAM sequence: AAG
atatttatgatctctttcct

SEQ ID NO: 49077 - DNA, 20 bp, Artificial Sequence
  Description of Artificial Sequence: Synthetic oligonucleotide
  Target: SCN9A; (+) strand; PAM type: NRG; PAM sequence: TGG
tattttaaaatcaattaaaa

SEQ ID NO: 49078 - DNA, 20 bp, Artificial Sequence
  Description of Artificial Sequence: Synthetic oligonucleotide
  Target: SCN9A; (+) strand; PAM type: NRG; PAM sequence: AAG
tgaaattttccttcctgtat

SEQ ID NO: 49079 - DNA, 20 bp, Artificial Sequence
  Description of Artificial Sequence: Synthetic oligonucleotide
  Target: SCN9A; (+) strand; PAM type: NRG; PAM sequence: TGG
ttccttcctgtataagcaaa

SEQ ID NO: 49080 - DNA, 20 bp, Artificial Sequence
  Description of Artificial Sequence: Synthetic oligonucleotide
  Target: SCN9A; (+) strand; PAM type: NRG; PAM sequence: CAG
caaatggaaaaacaaaccct

SEQ ID NO: 49081 - DNA, 20 bp, Artificial Sequence
  Description of Artificial Sequence: Synthetic oligonucleotide
  Target: SCN9A; (+) strand; PAM type: NRG; PAM sequence: CAG
tggaaaaacaaaccctcaga

SEQ ID NO: 49082 - DNA, 20 bp, Artificial Sequence
  Description of Artificial Sequence: Synthetic oligonucleotide
  Target: SCN9A; (+) strand; PAM type: NRG; PAM sequence: AGG
ggaaaaacaaaccctcagac

SEQ ID NO: 49083 - DNA, 20 bp, Artificial Sequence
  Description of Artificial Sequence: Synthetic oligonucleotide
  Target: SCN9A; (+) strand; PAM type: NRG; PAM sequence: GAG
aaaaacaaaccctcagacag

SEQ ID NO: 49084 - DNA, 20 bp, Artificial Sequence
  Description of Artificial Sequence: Synthetic oligonucleotide
  Target: SCN9A; (+) strand; PAM type: NRG; PAM sequence: AGG
aaaacaaaccctcagacagg

SEQ ID NO: 49085 - DNA, 20 bp, Artificial Sequence
  Description of Artificial Sequence: Synthetic oligonucleotide
  Target: SCN9A; (+) strand; PAM type: NRG; PAM sequence: GGG
aaacaaaccctcagacagga

SEQ ID NO: 49086 - DNA, 20 bp, Artificial Sequence
  Description of Artificial Sequence: Synthetic oligonucleotide
  Target: SCN9A; (+) strand; PAM type: NRG; PAM sequence: AAG
caaaccctcagacaggaggg

SEQ ID NO: 49087 - DNA, 20 bp, Artificial Sequence
  Description of Artificial Sequence: Synthetic oligonucleotide
  Target: SCN9A; (+) strand; PAM type: NRG; PAM sequence: AAG
cagacaggagggaagatttc

SEQ ID NO: 49088 - DNA, 20 bp, Artificial Sequence
  Description of Artificial Sequence: Synthetic oligonucleotide
  Target: SCN9A; (+) strand; PAM type: NRG; PAM sequence: GAG
aggagggaagatttcaagtt

SEQ ID NO: 49089 - DNA, 20 bp, Artificial Sequence
  Description of Artificial Sequence: Synthetic oligonucleotide
  Target: SCN9A; (+) strand; PAM type: NRG; PAM sequence: GAG
aagatttcaagttgagatgt

SEQ ID NO: 49090 - DNA, 20 bp, Artificial Sequence
  Description of Artificial Sequence: Synthetic oligonucleotide
  Target: SCN9A; (+) strand; PAM type: NRG; PAM sequence: AAG
ttcaagttgagatgtgagcc

SEQ ID NO: 49091 - DNA, 20 bp, Artificial Sequence
  Description of Artificial Sequence: Synthetic oligonucleotide
  Target: SCN9A; (+) strand; PAM type: NRG; PAM sequence: TAG
aagttgagatgtgagccaag

SEQ ID NO: 49092 - DNA, 20 bp, Artificial Sequence
  Description of Artificial Sequence: Synthetic oligonucleotide
  Target: SCN9A; (+) strand; PAM type: NRG; PAM sequence: AAG
aagtagtcatcctcatccta

SEQ ID NO: 49093 - DNA, 20 bp, Artificial Sequence
  Description of Artificial Sequence: Synthetic oligonucleotide
  Target: SCN9A; (+) strand; PAM type: NRG; PAM sequence: AAG
catgcaattgattaaactca

SEQ ID NO: 49094 - DNA, 20 bp, Artificial Sequence
  Description of Artificial Sequence: Synthetic oligonucleotide
  Target: SCN9A; (+) strand; PAM type: NRG; PAM sequence: AGG
atgcaattgattaaactcaa

SEQ ID NO: 49095 - DNA, 20 bp, Artificial Sequence
  Description of Artificial Sequence: Synthetic oligonucleotide
  Target: SCN9A; (+) strand; PAM type: NRG; PAM sequence: TGG
ttgacttttgataatgattg

SEQ ID NO: 49096 - DNA, 20 bp, Artificial Sequence
  Description of Artificial Sequence: Synthetic oligonucleotide
  Target: SCN9A; (+) strand; PAM type: NRG; PAM sequence: CAG
ttgataatgattgtggaaaa

SEQ ID NO: 49097 - DNA, 20 bp, Artificial Sequence
  Description of Artificial Sequence: Synthetic oligonucleotide
  Target: SCN9A; (+) strand; PAM type: NRG; PAM sequence: AAG
ataatgattgtggaaaacag

SEQ ID NO: 49098 - DNA, 20 bp, Artificial Sequence
  Description of Artificial Sequence: Synthetic oligonucleotide
  Target: SCN9A; (+) strand; PAM type: NRG; PAM sequence: AAG
aatttaattaaaattgcata

SEQ ID NO: 49099 - DNA, 20 bp, Artificial Sequence
  Description of Artificial Sequence: Synthetic oligonucleotide
  Target: SCN9A; (+) strand; PAM type: NRG; PAM sequence: AAG
taattaaaattgcataaaga

SEQ ID NO: 49100 - DNA, 20 bp, Artificial Sequence
  Description of Artificial Sequence: Synthetic oligonucleotide
  Target: SCN9A; (+) strand; PAM type: NRG; PAM sequence: AGG
aattaaaattgcataaagaa

SEQ ID NO: 49101 - DNA, 20 bp, Artificial Sequence
  Description of Artificial Sequence: Synthetic oligonucleotide
  Target: SCN9A; (+) strand; PAM type: NRG; PAM sequence: AAG
tttttatgtctttctttcaa

SEQ ID NO: 49102 - DNA, 20 bp, Artificial Sequence
  Description of Artificial Sequence: Synthetic oligonucleotide
  Target: SCN9A; (+) strand; PAM type: NRG; PAM sequence: AAG
gtctttctttcaaaagatca

SEQ ID NO: 49103 - DNA, 20 bp, Artificial Sequence
  Description of Artificial Sequence: Synthetic oligonucleotide
  Target: SCN9A; (+) strand; PAM type: NRG; PAM sequence: CAG
ttctttcaaaagatcaaagt

SEQ ID NO: 49104 - DNA, 20 bp, Artificial Sequence
  Description of Artificial Sequence: Synthetic oligonucleotide
  Target: SCN9A; (+) strand; PAM type: NRG; PAM sequence: TGG
caaaagatcaaagtcagccc

SEQ ID NO: 49105 - DNA, 20 bp, Artificial Sequence
  Description of Artificial Sequence: Synthetic oligonucleotide
  Target: SCN9A; (+) strand; PAM type: NRG; PAM sequence: TGG
tgtttaaccccactctcacc

SEQ ID NO: 49106 - DNA, 20 bp, Artificial Sequence
  Description of Artificial Sequence: Synthetic oligonucleotide
  Target: SCN9A; (+) strand; PAM type: NRG; PAM sequence: CGG
ctgaaattgttttcaatgct

SEQ ID NO: 49107 - DNA, 20 bp, Artificial Sequence
  Description of Artificial Sequence: Synthetic oligonucleotide
  Target: SCN9A; (+) strand; PAM type: NRG; PAM sequence: GAG
gaaattgttttcaatgctcg

SEQ ID NO: 49108 - DNA, 20 bp, Artificial Sequence
  Description of Artificial Sequence: Synthetic oligonucleotide
  Target: SCN9A; (+) strand; PAM type: NRG; PAM sequence: GAG
ctctgaatgttctcaatgct

SEQ ID NO: 49109 - DNA, 20 bp, Artificial Sequence
  Description of Artificial Sequence: Synthetic oligonucleotide
  Target: SCN9A; (+) strand; PAM type: NRG; PAM sequence: CAG
ctcaatgctgagacattgcc

SEQ ID NO: 49110 - DNA, 20 bp, Artificial Sequence
  Description of Artificial Sequence: Synthetic oligonucleotide
  Target: SCN9A; (+) strand; PAM type: NRG; PAM sequence: AGG
tcaatgctgagacattgccc

SEQ ID NO: 49111 - DNA, 20 bp, Artificial Sequence
  Description of Artificial Sequence: Synthetic oligonucleotide
  Target: SCN9A; (+) strand; PAM type: NRG; PAM sequence: TAG
actctgtcacatatctgtaa

SEQ ID NO: 49112 - DNA, 20 bp, Artificial Sequence
  Description of Artificial Sequence: Synthetic oligonucleotide
  Target: SCN9A; (+) strand; PAM type: NRG; PAM sequence: AGG
ctctgtcacatatctgtaat

SEQ ID NO: 49113 - DNA, 20 bp, Artificial Sequence
  Description of Artificial Sequence: Synthetic oligonucleotide
  Target: SCN9A; (+) strand; PAM type: NRG; PAM sequence: GGG
tctgtcacatatctgtaata

SEQ ID NO: 49114 - DNA, 20 bp, Artificial Sequence
  Description of Artificial Sequence: Synthetic oligonucleotide
  Target: SCN9A; (+) strand; PAM type: NRG; PAM sequence: GGG
ctgtcacatatctgtaatag

SEQ ID NO: 49115 - DNA, 20 bp, Artificial Sequence
  Description of Artificial Sequence: Synthetic oligonucleotide
  Target: SCN9A; (+) strand; PAM type: NRG; PAM sequence: GAG
gtcacatatctgtaataggg

SEQ ID NO: 49116 - DNA, 20 bp, Artificial Sequence
  Description of Artificial Sequence: Synthetic oligonucleotide
  Target: SCN9A; (+) strand; PAM type: NRG; PAM sequence: CAG
aataggggagtttatacaca

SEQ ID NO: 49117 - DNA, 20 bp, Artificial Sequence
  Description of Artificial Sequence: Synthetic oligonucleotide
  Target: SCN9A; (+) strand; PAM type: NRG; PAM sequence: AAG
gacacacacacaaacgaaca

SEQ ID NO: 49118 - DNA, 20 bp, Artificial Sequence
  Description of Artificial Sequence: Synthetic oligonucleotide
  Target: SCN9A; (+) strand; PAM type: NRG; PAM sequence: TAG
aacaaagaacaactcccaaa

SEQ ID NO: 49119 - DNA, 20 bp, Artificial Sequence
  Description of Artificial Sequence: Synthetic oligonucleotide
  Target: SCN9A; (+) strand; PAM type: NRG; PAM sequence: TGG
aagaacaactcccaaatagt

SEQ ID NO: 49120 - DNA, 20 bp, Artificial Sequence
  Description of Artificial Sequence: Synthetic oligonucleotide
  Target: SCN9A; (+) strand; PAM type: NRG; PAM sequence: GAG
gaacaactcccaaatagttg

SEQ ID NO: 49121 - DNA, 20 bp, Artificial Sequence
  Description of Artificial Sequence: Synthetic oligonucleotide
  Target: SCN9A; (+) strand; PAM type: NRG; PAM sequence: GAG
tcccaaatagttggagttat

SEQ ID NO: 49122 - DNA, 20 bp, Artificial Sequence
  Description of Artificial Sequence: Synthetic oligonucleotide
  Target: SCN9A; (+) strand; PAM type: NRG; PAM sequence: TGG
caaatagttggagttatgag

SEQ ID NO: 49123 - DNA, 20 bp, Artificial Sequence
  Description of Artificial Sequence: Synthetic oligonucleotide
  Target: SCN9A; (+) strand; PAM type: NRG; PAM sequence: TGG
cacaccaattacttcttacc

SEQ ID NO: 49124 - DNA, 20 bp, Artificial Sequence
  Description of Artificial Sequence: Synthetic oligonucleotide
  Target: SCN9A; (+) strand; PAM type: NRG; PAM sequence: GGG
acaccaattacttcttacct

SEQ ID NO: 49125 - DNA, 20 bp, Artificial Sequence
  Description of Artificial Sequence: Synthetic oligonucleotide
  Target: SCN9A; (+) strand; PAM type: NRG; PAM sequence: CAG
ttacttcttacctgggatta

SEQ ID NO: 49126 - DNA, 20 bp, Artificial Sequence
  Description of Artificial Sequence: Synthetic oligonucleotide
  Target: SCN9A; (+) strand; PAM type: NRG; PAM sequence: TAG
cttacctgggattacagaaa

SEQ ID NO: 49127 - DNA, 20 bp, Artificial Sequence
  Description of Artificial Sequence: Synthetic oligonucleotide
  Target: SCN9A; (+) strand; PAM type: NRG; PAM sequence: AAG
gattacagaaatagttttca

SEQ ID NO: 49128 - DNA, 20 bp, Artificial Sequence
  Description of Artificial Sequence: Synthetic oligonucleotide
  Target: SCN9A; (+) strand; PAM type: NRG; PAM sequence: AAG
caaagctctcaatactctga

SEQ ID NO: 49129 - DNA, 20 bp, Artificial Sequence
  Description of Artificial Sequence: Synthetic oligonucleotide
  Target: SCN9A; (+) strand; PAM type: NRG; PAM sequence: AAG
ctcaatactctgaaagttcg

SEQ ID NO: 49130 - DNA, 20 bp, Artificial Sequence
  Description of Artificial Sequence: Synthetic oligonucleotide
  Target: SCN9A; (+) strand; PAM type: NRG; PAM sequence: GAG
caatactctgaaagttcgaa

SEQ ID NO: 49131 - DNA, 20 bp, Artificial Sequence
  Description of Artificial Sequence: Synthetic oligonucleotide
  Target: SCN9A; (+) strand; PAM type: NRG; PAM sequence: TAG
cgaagagctgaaacattgcc

SEQ ID NO: 49132 - DNA, 20 bp, Artificial Sequence
  Description of Artificial Sequence: Synthetic oligonucleotide
  Target: SCN9A; (+) strand; PAM type: NRG; PAM sequence: AGG
gaagagctgaaacattgcct

SEQ ID NO: 49133 - DNA, 20 bp, Artificial Sequence
  Description of Artificial Sequence: Synthetic oligonucleotide
  Target: SCN9A; (+) strand; PAM type: NRG; PAM sequence: TAG
caaattctgttaaatacctg

SEQ ID NO: 49134 - DNA, 20 bp, Artificial Sequence
  Description of Artificial Sequence: Synthetic oligonucleotide
  Target: SCN9A; (+) strand; PAM type: NRG; PAM sequence: CAG
aaatacctgtagaattaaat

SEQ ID NO: 49135 - DNA, 20 bp, Artificial Sequence
  Description of Artificial Sequence: Synthetic oligonucleotide
  Target: SCN9A; (+) strand; PAM type: NRG; PAM sequence: CAG
agaattaaatcagaattatt

SEQ ID NO: 49136 - DNA, 20 bp, Artificial Sequence
  Description of Artificial Sequence: Synthetic oligonucleotide
  Target: SCN9A; (+) strand; PAM type: NRG; PAM sequence: TAG
aatcagaattattcagaatt

SEQ ID NO: 49137 - DNA, 20 bp, Artificial Sequence
  Description of Artificial Sequence: Synthetic oligonucleotide
  Target: SCN9A; (+) strand; PAM type: NRG; PAM sequence: TAG
agaattattcagaatttaga

SEQ ID NO: 49138 - DNA, 20 bp, Artificial Sequence
  Description of Artificial Sequence: Synthetic oligonucleotide
  Target: SCN9A; (+) strand; PAM type: NRG; PAM sequence: GAG
aattattcagaatttagata

SEQ ID NO: 49139 - DNA, 20 bp, Artificial Sequence
  Description of Artificial Sequence: Synthetic oligonucleotide
  Target: SCN9A; (+) strand; PAM type: NRG; PAM sequence: GAG
agagtctatgatacttacct

SEQ ID NO: 49140 - DNA, 20 bp, Artificial Sequence
  Description of Artificial Sequence: Synthetic oligonucleotide
  Target: SCN9A; (+) strand; PAM type: NRG; PAM sequence: TAG
atgatacttacctgagcctt

SEQ ID NO: 49141 - DNA, 20 bp, Artificial Sequence
  Description of Artificial Sequence: Synthetic oligonucleotide
  Target: SCN9A; (+) strand; PAM type: NRG; PAM sequence: AAG
acttacctgagcctttagtc

SEQ ID NO: 49142 - DNA, 20 bp, Artificial Sequence
  Description of Artificial Sequence: Synthetic oligonucleotide
  Target: SCN9A; (+) strand; PAM type: NRG; PAM sequence: AGG
cttacctgagcctttagtca

SEQ ID NO: 49143 - DNA, 20 bp, Artificial Sequence
  Description of Artificial Sequence: Synthetic oligonucleotide
  Target: SCN9A; (+) strand; PAM type: NRG; PAM sequence: TGG
gtcaaggtattttctacgtt

SEQ ID NO: 49144 - DNA, 20 bp, Artificial Sequence
  Description of Artificial Sequence: Synthetic oligonucleotide
  Target: SCN9A; (+) strand; PAM type: NRG; PAM sequence: GGG
tcaaggtattttctacgttt

SEQ ID NO: 49145 - DNA, 20 bp, Artificial Sequence
  Description of Artificial Sequence: Synthetic oligonucleotide
  Target: SCN9A; (+) strand; PAM type: NRG; PAM sequence: GGG
caaggtattttctacgtttg

SEQ ID NO: 49146 - DNA, 20 bp, Artificial Sequence
  Description of Artificial Sequence: Synthetic oligonucleotide
  Target: SCN9A; (+) strand; PAM type: NRG; PAM sequence: TAG
gggcttctattttaaatgta

SEQ ID NO: 49147 - DNA, 20 bp, Artificial Sequence
  Description of Artificial Sequence: Synthetic oligonucleotide
  Target: SCN9A; (+) strand; PAM type: NRG; PAM sequence: AAG
ttttaaatgtatagttctgc

SEQ ID NO: 49148 - DNA, 20 bp, Artificial Sequence
  Description of Artificial Sequence: Synthetic oligonucleotide
  Target: SCN9A; (+) strand; PAM type: NRG; PAM sequence: TAG
cataactaacttaatttaat

SEQ ID NO: 49149 - DNA, 20 bp, Artificial Sequence
  Description of Artificial Sequence: Synthetic oligonucleotide
  Target: SCN9A; (+) strand; PAM type: NRG; PAM sequence: CAG
catttgatgcaaacaaaata

SEQ ID NO: 49150 - DNA, 20 bp, Artificial Sequence
  Description of Artificial Sequence: Synthetic oligonucleotide
  Target: SCN9A; (+) strand; PAM type: NRG; PAM sequence: TGG
gatattatatattattaaat

SEQ ID NO: 49151 - DNA, 20 bp, Artificial Sequence
  Description of Artificial Sequence: Synthetic oligonucleotide
  Target: SCN9A; (+) strand; PAM type: NRG; PAM sequence: TGG
caactaaatgtttcaattgt

SEQ ID NO: 49152 - DNA, 20 bp, Artificial Sequence
  Description of Artificial Sequence: Synthetic oligonucleotide
  Target: SCN9A; (+) strand; PAM type: NRG; PAM sequence: TGG
ttgttggacccttaacatta

SEQ ID NO: 49153 - DNA, 20 bp, Artificial Sequence
  Description of Artificial Sequence: Synthetic oligonucleotide
  Target: SCN9A; (+) strand; PAM type: NRG; PAM sequence: TAG
cccttaacattatggtaatt

SEQ ID NO: 49154 - DNA, 20 bp, Artificial Sequence
  Description of Artificial Sequence: Synthetic oligonucleotide
  Target: SCN9A; (+) strand; PAM type: NRG; PAM sequence: TAG
tttttataaaacattgaaaa

SEQ ID NO: 49155 - DNA, 20 bp, Artificial Sequence
  Description of Artificial Sequence: Synthetic oligonucleotide
  Target: SCN9A; (+) strand; PAM type: NRG; PAM sequence: AAG
aacattgaaaatagtatgct

SEQ ID NO: 49156 - DNA, 20 bp, Artificial Sequence
  Description of Artificial Sequence: Synthetic oligonucleotide
  Target: SCN9A; (+) strand; PAM type: NRG; PAM sequence: CAG
gaaaatagtatgctaagtgt

SEQ ID NO: 49157 - DNA, 20 bp, Artificial Sequence
  Description of Artificial Sequence: Synthetic oligonucleotide
  Target: SCN9A; (+) strand; PAM type: NRG; PAM sequence: AAG
atgctaagtgtcagacacaa

SEQ ID NO: 49158 - DNA, 20 bp, Artificial Sequence
  Description of Artificial Sequence: Synthetic oligonucleotide
  Target: SCN9A; (+) strand; PAM type: NRG; PAM sequence: AGG
tgctaagtgtcagacacaaa

SEQ ID NO: 49159 - DNA, 20 bp, Artificial Sequence
  Description of Artificial Sequence: Synthetic oligonucleotide
  Target: SCN9A; (+) strand; PAM type: NRG; PAM sequence: TAG
cattcataaaaaaatccaaa

SEQ ID NO: 49160 - DNA, 20 bp, Artificial Sequence
  Description of Artificial Sequence: Synthetic oligonucleotide
  Target: SCN9A; (+) strand; PAM type: NRG; PAM sequence: TAG
aatccaaatagacaaatcca

SEQ ID NO: 49161 - DNA, 20 bp, Artificial Sequence
  Description of Artificial Sequence: Synthetic oligonucleotide
  Target: SCN9A; (+) strand; PAM type: NRG; PAM sequence: GAG
tccaaatagacaaatccata

SEQ ID NO: 49162 - DNA, 20 bp, Artificial Sequence
  Description of Artificial Sequence: Synthetic oligonucleotide
  Target: SCN9A; (+) strand; PAM type: NRG; PAM sequence: TAG
aaatccatagagataaaaca

SEQ ID NO: 49163 - DNA, 20 bp, Artificial Sequence
  Description of Artificial Sequence: Synthetic oligonucleotide
  Target: SCN9A; (+) strand; PAM type: NRG; PAM sequence: GAG
catagagataaaacatagat

SEQ ID NO: 49164 - DNA, 20 bp, Artificial Sequence
  Description of Artificial Sequence: Synthetic oligonucleotide
  Target: SCN9A; (+) strand; PAM type: NRG; PAM sequence: TGG
agagataaaacatagatgag

SEQ ID NO: 49165 - DNA, 20 bp, Artificial Sequence
  Description of Artificial Sequence: Synthetic oligonucleotide
  Target: SCN9A; (+) strand; PAM type: NRG; PAM sequence: AAG
aacatagatgagtggtttcc

SEQ ID NO: 49166 - DNA, 20 bp, Artificial Sequence
  Description of Artificial Sequence: Synthetic oligonucleotide
  Target: SCN9A; (+) strand; PAM type: NRG; PAM sequence: AGG
acatagatgagtggtttcca

SEQ ID NO: 49167 - DNA, 20 bp, Artificial Sequence
  Description of Artificial Sequence: Synthetic oligonucleotide
  Target: SCN9A; (+) strand; PAM type: NRG; PAM sequence: GGG
catagatgagtggtttccaa

SEQ ID NO: 49168 - DNA, 20 bp, Artificial Sequence
  Description of Artificial Sequence: Synthetic oligonucleotide
  Target: SCN9A; (+) strand; PAM type: NRG; PAM sequence: GGG
atagatgagtggtttccaag

SEQ ID NO: 49169 - DNA, 20 bp, Artificial Sequence
  Description of Artificial Sequence: Synthetic oligonucleotide
  Target: SCN9A; (+) strand; PAM type: NRG; PAM sequence: CAG
atgagtggtttccaaggggc

SEQ ID NO: 49170 - DNA, 20 bp, Artificial Sequence
  Description of Artificial Sequence: Synthetic oligonucleotide
  Target: SCN9A; (+) strand; PAM type: NRG; PAM sequence: AGG
tgagtggtttccaaggggcc

SEQ ID NO: 49171 - DNA, 20 bp, Artificial Sequence
  Description of Artificial Sequence: Synthetic oligonucleotide
  Target: SCN9A; (+) strand; PAM type: NRG; PAM sequence: GGG
gagtggtttccaaggggcca

SEQ ID NO: 49172 - DNA, 20 bp, Artificial Sequence
  Description of Artificial Sequence: Synthetic oligonucleotide
  Target: SCN9A; (+) strand; PAM type: NRG; PAM sequence: GAG
gtggtttccaaggggccagg

SEQ ID NO: 49173 - DNA, 20 bp, Artificial Sequence
  Description of Artificial Sequence: Synthetic oligonucleotide
  Target: SCN9A; (+) strand; PAM type: NRG; PAM sequence: GAG
ggtttccaaggggccaggga

SEQ ID NO: 49174 - DNA, 20 bp, Artificial Sequence
  Description of Artificial Sequence: Synthetic oligonucleotide
  Target: SCN9A; (+) strand; PAM type: NRG; PAM sequence: AAG
ttccaaggggccagggagag

SEQ ID NO: 49175 - DNA, 20 bp, Artificial Sequence
  Description of Artificial Sequence: Synthetic oligonucleotide
  Target: SCN9A; (+) strand; PAM type: NRG; PAM sequence: AGG
tccaaggggccagggagaga

SEQ ID NO: 49176 - DNA, 20 bp, Artificial Sequence
  Description of Artificial Sequence: Synthetic oligonucleotide
  Target: SCN9A; (+) strand; PAM type: NRG; PAM sequence: AAG
ccagggagagaaggaaattg

SEQ ID NO: 49177 - DNA, 20 bp, Artificial Sequence
  Description of Artificial Sequence: Synthetic oligonucleotide
  Target: SCN9A; (+) strand; PAM type: NRG; PAM sequence: GAG
aaattgaagtgactgctaat

SEQ ID NO: 49178 - DNA, 20 bp, Artificial Sequence
  Description of Artificial Sequence: Synthetic oligonucleotide
  Target: SCN9A; (+) strand; PAM type: NRG; PAM sequence: CAG
gaagtgactgctaatgagta

SEQ ID NO: 49179 - DNA, 20 bp, Artificial Sequence
  Description of Artificial Sequence: Synthetic oligonucleotide
  Target: SCN9A; (+) strand; PAM type: NRG; PAM sequence: GAG
agtgactgctaatgagtaca

SEQ ID NO: 49180 - DNA, 20 bp, Artificial Sequence
  Description of Artificial Sequence: Synthetic oligonucleotide
  Target: SCN9A; (+) strand; PAM type: NRG; PAM sequence: TGG
atgagtacagagtttctatt

SEQ ID NO: 49181 - DNA, 20 bp, Artificial Sequence
  Description of Artificial Sequence: Synthetic oligonucleotide
  Target: SCN9A; (+) strand; PAM type: NRG; PAM sequence: GGG
tgagtacagagtttctattt

SEQ ID NO: 49182 - DNA, 20 bp, Artificial Sequence
  Description of Artificial Sequence: Synthetic oligonucleotide
  Target: SCN9A; (+) strand; PAM type: NRG; PAM sequence: GGG
gagtacagagtttctatttg

SEQ ID NO: 49183 - DNA, 20 bp, Artificial Sequence
  Description of Artificial Sequence: Synthetic oligonucleotide
  Target: SCN9A; (+) strand; PAM type: NRG; PAM sequence: TAG
ggttgttaaacttctctaat

SEQ ID NO: 49184 - DNA, 20 bp, Artificial Sequence
  Description of Artificial Sequence: Synthetic oligonucleotide
  Target: SCN9A; (+) strand; PAM type: NRG; PAM sequence: AGG
gttgttaaacttctctaatt

SEQ ID NO: 49185 - DNA, 20 bp, Artificial Sequence
  Description of Artificial Sequence: Synthetic oligonucleotide
  Target: SCN9A; (+) strand; PAM type: NRG; PAM sequence: TAG
gttaaacttctctaattagg

SEQ ID NO: 49186 - DNA, 20 bp, Artificial Sequence
  Description of Artificial Sequence: Synthetic oligonucleotide
  Target: SCN9A; (+) strand; PAM type: NRG; PAM sequence: TGG
aaacttctctaattaggtag

SEQ ID NO: 49187 - DNA, 20 bp, Artificial Sequence
  Description of Artificial Sequence: Synthetic oligonucleotide
  Target: SCN9A; (+) strand; PAM type: NRG; PAM sequence: AAG
aggtagtggtgatgttgcgc

SEQ ID NO: 49188 - DNA, 20 bp, Artificial Sequence
  Description of Artificial Sequence: Synthetic oligonucleotide
  Target: SCN9A; (+) strand; PAM type: NRG; PAM sequence: TAG
ctttaaaattgtgaattttg

SEQ ID NO: 49189 - DNA, 20 bp, Artificial Sequence
  Description of Artificial Sequence: Synthetic oligonucleotide
  Target: SCN9A; (+) strand; PAM type: NRG; PAM sequence: TAG
tagtatttgaattgtaccaa

SEQ ID NO: 49190 - DNA, 20 bp, Artificial Sequence
  Description of Artificial Sequence: Synthetic oligonucleotide
  Target: SCN9A; (+) strand; PAM type: NRG; PAM sequence: AGG
agtatttgaattgtaccaat

SEQ ID NO: 49191 - DNA, 20 bp, Artificial Sequence
  Description of Artificial Sequence: Synthetic oligonucleotide
  Target: SCN9A; (+) strand; PAM type: NRG; PAM sequence: AAG
aattgtaccaataggaaaaa

SEQ ID NO: 49192 - DNA, 20 bp, Artificial Sequence
  Description of Artificial Sequence: Synthetic oligonucleotide
  Target: SCN9A; (+) strand; PAM type: NRG; PAM sequence: AGG
attgtaccaataggaaaaaa

SEQ ID NO: 49193 - DNA, 20 bp, Artificial Sequence
  Description of Artificial Sequence: Synthetic oligonucleotide
  Target: SCN9A; (+) strand; PAM type: NRG; PAM sequence: GAG
tgtaccaataggaaaaaaag

SEQ ID NO: 49194 - DNA, 20 bp, Artificial Sequence
  Description of Artificial Sequence: Synthetic oligonucleotide
  Target: SCN9A; (+) strand; PAM type: NRG; PAM sequence: GAG
aggaaaaaaaggagacctat

SEQ ID NO: 49195 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaggagacctatgag

SEQ ID NO: 49196 - DNA, 20 bp, Artificial Sequence
  Description of Artificial Sequence: Synthetic oligonucleotide
  Target: SCN9A; (+) strand; PAM type: NRG; PAM sequence: GAG
aaaaaggagacctatgagaa

SEQ ID NO: 49197 - DNA, 20 bp, Artificial Sequence
  Description of Artificial Sequence: Synthetic oligonucleotide
  Target: SCN9A; (+) strand; PAM type: NRG; PAM sequence: AGG
aaaaggagacctatgagaag

SEQ ID NO: 49198 - DNA, 20 bp, Artificial Sequence
  Description of Artificial Sequence: Synthetic oligonucleotide
  Target: SCN9A; (+) strand; PAM type: NRG; PAM sequence: CAG
aggagacctatgagaagagg

SEQ ID NO: 49199 - DNA, 20 bp, Artificial Sequence
  Description of Artificial Sequence: Synthetic oligonucleotide
  Target: SCN9A; (+) strand; PAM type: NRG; PAM sequence: TAG
ttctttgcacaatgttttct

SEQ ID NO: 49200 - DNA, 20 bp, Artificial Sequence
  Description of Artificial Sequence: Synthetic oligonucleotide
  Target: SCN9A; (+) strand; PAM type: NRG; PAM sequence: CAG
tttgcacaatgttttcttag

SEQ ID NO: 49201 - DNA, 20 bp, Artificial Sequence
  Description of Artificial Sequence: Synthetic oligonucleotide
  Target: SCN9A; (+) strand; PAM type: NRG; PAM sequence: CAG
gcacaatgttttcttagcag

SEQ ID NO: 49202 - DNA, 20 bp, Artificial Sequence
  Description of Artificial Sequence: Synthetic oligonucleotide
  Target: SCN9A; (+) strand; PAM type: NRG; PAM sequence: AGG
cacaatgttttcttagcagc

SEQ ID NO: 49203 - DNA, 20 bp, Artificial Sequence
  Description of Artificial Sequence: Synthetic oligonucleotide
  Target: SCN9A; (+) strand; PAM type: NRG; PAM sequence: TAG
aatgttttcttagcagcagg

SEQ ID NO: 49204 - DNA, 20 bp, Artificial Sequence
  Description of Artificial Sequence: Synthetic oligonucleotide
  Target: SCN9A; (+) strand; PAM type: NRG; PAM sequence: CAG
gttttcttagcagcaggtag

SEQ ID NO: 49205 - DNA, 20 bp, Artificial Sequence
  Description of Artificial Sequence: Synthetic oligonucleotide
  Target: SCN9A; (+) strand; PAM type: NRG; PAM sequence: TGG
tcttagcagcaggtagcaga

SEQ ID NO: 49206 - DNA, 20 bp, Artificial Sequence
  Description of Artificial Sequence: Synthetic oligonucleotide
  Target: SCN9A; (+) strand; PAM type: NRG; PAM sequence: AAG
cccatcatatgtgacctcaa

SEQ ID NO: 49207 - DNA, 20 bp, Artificial Sequence
  Description of Artificial Sequence: Synthetic oligonucleotide
  Target: SCN9A; (+) strand; PAM type: NRG; PAM sequence: AGG
ccatcatatgtgacctcaaa

SEQ ID NO: 49208 - DNA, 20 bp, Artificial Sequence
  Description of Artificial Sequence: Synthetic oligonucleotide
  Target: SCN9A; (+) strand; PAM type: NRG; PAM sequence: GAG
atcatatgtgacctcaaaag

SEQ ID NO: 49209 - DNA, 20 bp, Artificial Sequence
  Description of Artificial Sequence: Synthetic oligonucleotide
  Target: SCN9A; (+) strand; PAM type: NRG; PAM sequence: AGG
tcatatgtgacctcaaaagg

SEQ ID NO: 49210 - DNA, 20 bp, Artificial Sequence
  Description of Artificial Sequence: Synthetic oligonucleotide
  Target: SCN9A; (+) strand; PAM type: NRG; PAM sequence: GGG
catatgtgacctcaaaagga

SEQ ID NO: 49211 - DNA, 20 bp, Artificial Sequence
  Description of Artificial Sequence: Synthetic oligonucleotide
  Target: SCN9A; (+) strand; PAM type: NRG; PAM sequence: GAG
tatgtgacctcaaaaggagg

SEQ ID NO: 49212 - DNA, 20 bp, Artificial Sequence
  Description of Artificial Sequence: Synthetic oligonucleotide
  Target: SCN9A; (+) strand; PAM type: NRG; PAM sequence: TGG
ctcaaaaggagggagcctga

SEQ ID NO: 49213 - DNA, 20 bp, Artificial Sequence
  Description of Artificial Sequence: Synthetic oligonucleotide
  Target: SCN9A; (+) strand; PAM type: NRG; PAM sequence: AAG
aaggagggagcctgatggaa

SEQ ID NO: 49214 - DNA, 20 bp, Artificial Sequence
  Description of Artificial Sequence: Synthetic oligonucleotide
  Target: SCN9A; (+) strand; PAM type: NRG; PAM sequence: GAG
ggagggagcctgatggaaaa

SEQ ID NO: 49215 - DNA, 20 bp, Artificial Sequence
  Description of Artificial Sequence: Synthetic oligonucleotide
  Target: SCN9A; (+) strand; PAM type: NRG; PAM sequence: AGG
gagggagcctgatggaaaag

SEQ ID NO: 49216 - DNA, 20 bp, Artificial Sequence
  Description of Artificial Sequence: Synthetic oligonucleotide
  Target: SCN9A; (+) strand; PAM type: NRG; PAM sequence: TAG
gagcctgatggaaaagaggt

SEQ ID NO: 49217 - DNA, 20 bp, Artificial Sequence
  Description of Artificial Sequence: Synthetic oligonucleotide
  Target: SCN9A; (+) strand; PAM type: NRG; PAM sequence: AGG
agcctgatggaaaagaggtt

SEQ ID NO: 49218 - DNA, 20 bp, Artificial Sequence
  Description of Artificial Sequence: Synthetic oligonucleotide
  Target: SCN9A; (+) strand; PAM type: NRG; PAM sequence: CAG
ctgatggaaaagaggttagg

SEQ ID NO: 49219 - DNA, 20 bp, Artificial Sequence
  Description of Artificial Sequence: Synthetic oligonucleotide
  Target: SCN9A; (+) strand; PAM type: NRG; PAM sequence: AGG
tgatggaaaagaggttaggc

SEQ ID NO: 49220 - DNA, 20 bp, Artificial Sequence
  Description of Artificial Sequence: Synthetic oligonucleotide
  Target: SCN9A; (+) strand; PAM type: NRG; PAM sequence: GGG
gatggaaaagaggttaggca

SEQ ID NO: 49221 - DNA, 20 bp, Artificial Sequence
  Description of Artificial Sequence: Synthetic oligonucleotide
  Target: SCN9A; (+) strand; PAM type: NRG; PAM sequence: AAG
aaagaggttaggcagggatg

SEQ ID NO: 49222 - DNA, 20 bp, Artificial Sequence
  Description of Artificial Sequence: Synthetic oligonucleotide
  Target: SCN9A; (+) strand; PAM type: NRG; PAM sequence: AGG
aagaggttaggcagggatga

SEQ ID NO: 49223 - DNA, 20 bp, Artificial Sequence
  Description of Artificial Sequence: Synthetic oligonucleotide
  Target: SCN9A; (+) strand; PAM type: NRG; PAM sequence: CGG
ttaggcagggatgaaggaat

SEQ ID NO: 49224 - DNA, 20 bp, Artificial Sequence
  Description of Artificial Sequence: Synthetic oligonucleotide
  Target: SCN9A; (+) strand; PAM type: NRG; PAM sequence: TAG
gggatgaaggaatcggatat

SEQ ID NO: 49225 - DNA, 20 bp, Artificial Sequence
  Description of Artificial Sequence: Synthetic oligonucleotide
  Target: SCN9A; (+) strand; PAM type: NRG; PAM sequence: AGG
ggatgaaggaatcggatatt

SEQ ID NO: 49226 - DNA, 20 bp, Artificial Sequence
  Description of Artificial Sequence: Synthetic oligonucleotide
  Target: SCN9A; (+) strand; PAM type: NRG; PAM sequence: AAG
aatcggatattaggaatctt

SEQ ID NO: 49227 - DNA, 20 bp, Artificial Sequence
  Description of Artificial Sequence: Synthetic oligonucleotide
  Target: SCN9A; (+) strand; PAM type: NRG; PAM sequence: TAG
taagacccttctgtattgtc

SEQ ID NO: 49228 - DNA, 20 bp, Artificial Sequence
  Description of Artificial Sequence: Synthetic oligonucleotide
  Target: SCN9A; (+) strand; PAM type: NRG; PAM sequence: AGG
aagacccttctgtattgtct

SEQ ID NO: 49229 - DNA, 20 bp, Artificial Sequence
  Description of Artificial Sequence: Synthetic oligonucleotide
  Target: SCN9A; (+) strand; PAM type: NRG; PAM sequence: TGG
acccttctgtattgtctagg

SEQ ID NO: 49230 - DNA, 20 bp, Artificial Sequence
  Description of Artificial Sequence: Synthetic oligonucleotide
  Target: SCN9A; (+) strand; PAM type: NRG; PAM sequence: CAG
ctgtattgtctaggtggctc

SEQ ID NO: 49231 - DNA, 20 bp, Artificial Sequence
  Description of Artificial Sequence: Synthetic oligonucleotide
  Target: SCN9A; (+) strand; PAM type: NRG; PAM sequence: TGG
ctaggtggctccagtgaacc

SEQ ID NO: 49232 - DNA, 20 bp, Artificial Sequence
  Description of Artificial Sequence: Synthetic oligonucleotide
  Target: SCN9A; (+) strand; PAM type: NRG; PAM sequence: AAG
tggattactttgataattca

SEQ ID NO: 49233 - DNA, 20 bp, Artificial Sequence
  Description of Artificial Sequence: Synthetic oligonucleotide
  Target: SCN9A; (+) strand; PAM type: NRG; PAM sequence: CGG
tgataattcaaagtcattaa

SEQ ID NO: 49234 - DNA, 20 bp, Artificial Sequence
  Description of Artificial Sequence: Synthetic oligonucleotide
  Target: SCN9A; (+) strand; PAM type: NRG; PAM sequence: TAG
tcaaagtcattaacggaaaa

SEQ ID NO: 49235 - DNA, 20 bp, Artificial Sequence
  Description of Artificial Sequence: Synthetic oligonucleotide
  Target: SCN9A; (+) strand; PAM type: NRG; PAM sequence: TAG
ttaacggaaaatagaatatc

SEQ ID NO: 49236 - DNA, 20 bp, Artificial Sequence
  Description of Artificial Sequence: Synthetic oligonucleotide
  Target: SCN9A; (+) strand; PAM type: NRG; PAM sequence: GAG
aaaatagaatatctagatat

SEQ ID NO: 49237 - DNA, 20 bp, Artificial Sequence
  Description of Artificial Sequence: Synthetic oligonucleotide
  Target: SCN9A; (+) strand; PAM type: NRG; PAM sequence: TGG
atttttctgataaatacatt

SEQ ID NO: 49238 - DNA, 20 bp, Artificial Sequence
  Description of Artificial Sequence: Synthetic oligonucleotide
  Target: SCN9A; (+) strand; PAM type: NRG; PAM sequence: GGG
tttttctgataaatacattt

SEQ ID NO: 49239 - DNA, 20 bp, Artificial Sequence
  Description of Artificial Sequence: Synthetic oligonucleotide
  Target: SCN9A; (+) strand; PAM type: NRG; PAM sequence: AAG
ctgataaatacatttgggaa

SEQ ID NO: 49240 - DNA, 20 bp, Artificial Sequence
  Description of Artificial Sequence: Synthetic oligonucleotide
  Target: SCN9A; (+) strand; PAM type: NRG; PAM sequence: GAG
gataaatacatttgggaaaa

SEQ ID NO: 49241 - DNA, 20 bp, Artificial Sequence
  Description of Artificial Sequence: Synthetic oligonucleotide
  Target: SCN9A; (+) strand; PAM type: NRG; PAM sequence: GAG
attttccttgaaaataaact

SEQ ID NO: 49242 - DNA, 20 bp, Artificial Sequence
  Description of Artificial Sequence: Synthetic oligonucleotide
  Target: SCN9A; (+) strand; PAM type: NRG; PAM sequence: TAG
tgtatacaatgcattaatct

SEQ ID NO: 49243 - DNA, 20 bp, Artificial Sequence
  Description of Artificial Sequence: Synthetic oligonucleotide
  Target: SCN9A; (+) strand; PAM type: NRG; PAM sequence: AGG
gtatacaatgcattaatctt

SEQ ID NO: 49244 - DNA, 20 bp, Artificial Sequence
  Description of Artificial Sequence: Synthetic oligonucleotide
  Target: SCN9A; (+) strand; PAM type: NRG; PAM sequence: TAG
caatgcattaatcttaggct

SEQ ID NO: 49245 - DNA, 20 bp, Artificial Sequence
  Description of Artificial Sequence: Synthetic oligonucleotide
  Target: SCN9A; (+) strand; PAM type: NRG; PAM sequence: AAG
gcattaatcttaggcttagt

SEQ ID NO: 49246 - DNA, 20 bp, Artificial Sequence
  Description of Artificial Sequence: Synthetic oligonucleotide
  Target: SCN9A; (+) strand; PAM type: NRG; PAM sequence: CAG
ttaatcttaggcttagtaag

SEQ ID NO: 49247 - DNA, 20 bp, Artificial Sequence
  Description of Artificial Sequence: Synthetic oligonucleotide
  Target: SCN9A; (+) strand; PAM type: NRG; PAM sequence: CAG
ttaggcttagtaagcagtga

SEQ ID NO: 49248 - DNA, 20 bp, Artificial Sequence
  Description of Artificial Sequence: Synthetic oligonucleotide
  Target: SCN9A; (+) strand; PAM type: NRG; PAM sequence: CAG
tataaaataattgaataata

SEQ ID NO: 49249 - DNA, 20 bp, Artificial Sequence
  Description of Artificial Sequence: Synthetic oligonucleotide
  Target: SCN9A; (+) strand; PAM type: NRG; PAM sequence: AGG
ataaaataattgaataatac

SEQ ID NO: 49250 - DNA, 20 bp, Artificial Sequence
  Description of Artificial Sequence: Synthetic oligonucleotide
  Target: SCN9A; (+) strand; PAM type: NRG; PAM sequence: GGG
taaaataattgaataataca

SEQ ID NO: 49251 - DNA, 20 bp, Artificial Sequence
  Description of Artificial Sequence: Synthetic oligonucleotide
  Target: SCN9A; (+) strand; PAM type: NRG; PAM sequence: AAG
gaataatacagggtaatata

SEQ ID NO: 49252 - DNA, 20 bp, Artificial Sequence
  Description of Artificial Sequence: Synthetic oligonucleotide
  Target: SCN9A; (+) strand; PAM type: NRG; PAM sequence: GAG
ataatacagggtaatataaa

SEQ ID NO: 49253 - DNA, 20 bp, Artificial Sequence
  Description of Artificial Sequence: Synthetic oligonucleotide
  Target: SCN9A; (+) strand; PAM type: NRG; PAM sequence: AAG
gagcactgtacttgtattta

SEQ ID NO: 49254 - DNA, 20 bp, Artificial Sequence
  Description of Artificial Sequence: Synthetic oligonucleotide
  Target: SCN9A; (+) strand; PAM type: NRG; PAM sequence: AGG
agcactgtacttgtatttaa

SEQ ID NO: 49255 - DNA, 20 bp, Artificial Sequence
  Description of Artificial Sequence: Synthetic oligonucleotide
  Target: SCN9A; (+) strand; PAM type: NRG; PAM sequence: GAG
gtacttgtatttaaaggcct

SEQ ID NO: 49256 - DNA, 20 bp, Artificial Sequence
  Description of Artificial Sequence: Synthetic oligonucleotide
  Target: SCN9A; (+) strand; PAM type: NRG; PAM sequence: TAG
agttttttgtgtgcttctta

SEQ ID NO: 49257 - DNA, 20 bp, Artificial Sequence
  Description of Artificial Sequence: Synthetic oligonucleotide
  Target: SCN9A; (+) strand; PAM type: NRG; PAM sequence: AGG
gttttttgtgtgcttcttat

SEQ ID NO: 49258 - DNA, 20 bp, Artificial Sequence
  Description of Artificial Sequence: Synthetic oligonucleotide
  Target: SCN9A; (+) strand; PAM type: NRG; PAM sequence: AAG
ggttttattcatttttaaac

SEQ ID NO: 49259 - DNA, 20 bp, Artificial Sequence
  Description of Artificial Sequence: Synthetic oligonucleotide
  Target: SCN9A; (+) strand; PAM type: NRG; PAM sequence: TGG
ttcatttttaaacaagaact

SEQ ID NO: 49260 - DNA, 20 bp, Artificial Sequence
  Description of Artificial Sequence: Synthetic oligonucleotide
  Target: SCN9A; (+) strand; PAM type: NRG; PAM sequence: AAG
tttaaacaagaacttggaaa

SEQ ID NO: 49261 - DNA, 20 bp, Artificial Sequence
  Description of Artificial Sequence: Synthetic oligonucleotide
  Target: SCN9A; (+) strand; PAM type: NRG; PAM sequence: TGG
ggaaaaagtgtaaacctaat

SEQ ID NO: 49262 - DNA, 20 bp, Artificial Sequence
  Description of Artificial Sequence: Synthetic oligonucleotide
  Target: SCN9A; (+) strand; PAM type: NRG; PAM sequence: TAG
taaacctaattggcactgca

SEQ ID NO: 49263 - DNA, 20 bp, Artificial Sequence
  Description of Artificial Sequence: Synthetic oligonucleotide
  Target: SCN9A; (+) strand; PAM type: NRG; PAM sequence: AAG
actgcatagactatccatcc

SEQ ID NO: 49264 - DNA, 20 bp, Artificial Sequence
  Description of Artificial Sequence: Synthetic oligonucleotide
  Target: SCN9A; (+) strand; PAM type: NRG; PAM sequence: GAG
agactatccatccaagtgct

SEQ ID NO: 49265 - DNA, 20 bp, Artificial Sequence
  Description of Artificial Sequence: Synthetic oligonucleotide
  Target: SCN9A; (+) strand; PAM type: NRG; PAM sequence: TGG
atccatccaagtgctgagca

SEQ ID NO: 49266 - DNA, 20 bp, Artificial Sequence
  Description of Artificial Sequence: Synthetic oligonucleotide
  Target: SCN9A; (+) strand; PAM type: NRG; PAM sequence: GAG
ccatccaagtgctgagcatg

SEQ ID NO: 49267 - DNA, 20 bp, Artificial Sequence
  Description of Artificial Sequence: Synthetic oligonucleotide
  Target: SCN9A; (+) strand; PAM type: NRG; PAM sequence: AGG
catccaagtgctgagcatgg

SEQ ID NO: 49268 - DNA, 20 bp, Artificial Sequence
  Description of Artificial Sequence: Synthetic oligonucleotide
  Target: SCN9A; (+) strand; PAM type: NRG; PAM sequence: AAG
ccaagtgctgagcatggagg

SEQ ID NO: 49269 - DNA, 20 bp, Artificial Sequence
  Description of Artificial Sequence: Synthetic oligonucleotide
  Target: SCN9A; (+) strand; PAM type: NRG; PAM sequence: GAG
caatgatgtcacatacctct

SEQ ID NO: 49270 - DNA, 20 bp, Artificial Sequence
  Description of Artificial Sequence: Synthetic oligonucleotide
  Target: SCN9A; (+) strand; PAM type: NRG; PAM sequence: TGG
tgatgtcacatacctctgag

SEQ ID NO: 49271 - DNA, 20 bp, Artificial Sequence
  Description of Artificial Sequence: Synthetic oligonucleotide
  Target: SCN9A; (+) strand; PAM type: NRG; PAM sequence: GGG
gatgtcacatacctctgagt

SEQ ID NO: 49272 - DNA, 20 bp, Artificial Sequence
  Description of Artificial Sequence: Synthetic oligonucleotide
  Target: SCN9A; (+) strand; PAM type: NRG; PAM sequence: GAG
tgtcacatacctctgagtgg

SEQ ID NO: 49273 - DNA, 20 bp, Artificial Sequence
  Description of Artificial Sequence: Synthetic oligonucleotide
  Target: SCN9A; (+) strand; PAM type: NRG; PAM sequence: TAG
acatacctctgagtgggaga

SEQ ID NO: 49274 - DNA, 20 bp, Artificial Sequence
  Description of Artificial Sequence: Synthetic oligonucleotide
  Target: SCN9A; (+) strand; PAM type: NRG; PAM sequence: TAG
gatagtctttttgaaaaatt

SEQ ID NO: 49275 - DNA, 20 bp, Artificial Sequence
  Description of Artificial Sequence: Synthetic oligonucleotide
  Target: SCN9A; (+) strand; PAM type: NRG; PAM sequence: TAG
agtatttgcctatcaatgac

SEQ ID NO: 49276 - DNA, 20 bp, Artificial Sequence
  Description of Artificial Sequence: Synthetic oligonucleotide
  Target: SCN9A; (+) strand; PAM type: NRG; PAM sequence: TAG
atcaatgactagctttcata

SEQ ID NO: 49277 - DNA, 20 bp, Artificial Sequence
  Description of Artificial Sequence: Synthetic oligonucleotide
  Target: SCN9A; (+) strand; PAM type: NRG; PAM sequence: CAG
cttccattttcctttaaata

SEQ ID NO: 49278 - DNA, 20 bp, Artificial Sequence
  Description of Artificial Sequence: Synthetic oligonucleotide
  Target: SCN9A; (+) strand; PAM type: NRG; PAM sequence: TGG
taaatacagacattccatgc

SEQ ID NO: 49279 - DNA, 20 bp, Artificial Sequence
  Description of Artificial Sequence: Synthetic oligonucleotide
  Target: SCN9A; (+) strand; PAM type: NRG; PAM sequence: CAG
acattccatgctggaaaaat

SEQ ID NO: 49280 - DNA, 20 bp, Artificial Sequence
  Description of Artificial Sequence: Synthetic oligonucleotide
  Target: SCN9A; (+) strand; PAM type: NRG; PAM sequence: CAG
atgctggaaaaatcagaccc

SEQ ID NO: 49281 - DNA, 20 bp, Artificial Sequence
  Description of Artificial Sequence: Synthetic oligonucleotide
  Target: SCN9A; (+) strand; PAM type: NRG; PAM sequence: GAG
gctggaaaaatcagacccca

SEQ ID NO: 49282 - DNA, 20 bp, Artificial Sequence
  Description of Artificial Sequence: Synthetic oligonucleotide
  Target: SCN9A; (+) strand; PAM type: NRG; PAM sequence: AGG
ctggaaaaatcagaccccag

SEQ ID NO: 49283 - DNA, 20 bp, Artificial Sequence
  Description of Artificial Sequence: Synthetic oligonucleotide
  Target: SCN9A; (+) strand; PAM type: NRG; PAM sequence: TGG
ccccagaggtttgctgttat

SEQ ID NO: 49284 - DNA, 20 bp, Artificial Sequence
  Description of Artificial Sequence: Synthetic oligonucleotide
  Target: SCN9A; (+) strand; PAM type: NRG; PAM sequence: GAG
attggaacactgtgctgcct

SEQ ID NO: 49285 - DNA, 20 bp, Artificial Sequence
  Description of Artificial Sequence: Synthetic oligonucleotide
  Target: SCN9A; (+) strand; PAM type: NRG; PAM sequence: AAG
cataaatttgccgtttcaaa

SEQ ID NO: 49286 - DNA, 20 bp, Artificial Sequence
  Description of Artificial Sequence: Synthetic oligonucleotide
  Target: SCN9A; (+) strand; PAM type: NRG; PAM sequence: AAG
ttgccgtttcaaaaagctga

SEQ ID NO: 49287 - DNA, 20 bp, Artificial Sequence
  Description of Artificial Sequence: Synthetic oligonucleotide
  Target: SCN9A; (+) strand; PAM type: NRG; PAM sequence: CAG
aaaacaatgacgacaaaatc

SEQ ID NO: 49288 - DNA, 20 bp, Artificial Sequence
  Description of Artificial Sequence: Synthetic oligonucleotide
  Target: SCN9A; (+) strand; PAM type: NRG; PAM sequence: CAG
caatgacgacaaaatccagc

SEQ ID NO: 49289 - DNA, 20 bp, Artificial Sequence
  Description of Artificial Sequence: Synthetic oligonucleotide
  Target: SCN9A; (+) strand; PAM type: NRG; PAM sequence: CGG
acaaaatccagccagttcca

SEQ ID NO: 49290 - DNA, 20 bp, Artificial Sequence
  Description of Artificial Sequence: Synthetic oligonucleotide
  Target: SCN9A; (+) strand; PAM type: NRG; PAM sequence: GGG
caaaatccagccagttccac

SEQ ID NO: 49291 - DNA, 20 bp, Artificial Sequence
  Description of Artificial Sequence: Synthetic oligonucleotide
  Target: SCN9A; (+) strand; PAM type: NRG; PAM sequence: AAG
agccagttccacgggtcacg

SEQ ID NO: 49292 - DNA, 20 bp, Artificial Sequence
  Description of Artificial Sequence: Synthetic oligonucleotide
  Target: SCN9A; (+) strand; PAM type: NRG; PAM sequence: AAG
gttccacgggtcacgaagaa

SEQ ID NO: 49293 - DNA, 20 bp, Artificial Sequence
  Description of Artificial Sequence: Synthetic oligonucleotide
  Target: SCN9A; (+) strand; PAM type: NRG; PAM sequence: CAG
gaaaagtgaattctcctaca

SEQ ID NO: 49294 - DNA, 20 bp, Artificial Sequence
  Description of Artificial Sequence: Synthetic oligonucleotide
  Target: SCN9A; (+) strand; PAM type: NRG; PAM sequence: AAG
aagtgaattctcctacacag

SEQ ID NO: 49295 - DNA, 20 bp, Artificial Sequence
  Description of Artificial Sequence: Synthetic oligonucleotide
  Target: SCN9A; (+) strand; PAM type: NRG; PAM sequence: AAG
cctacacagaagcctcttgc

SEQ ID NO: 49296 - DNA, 20 bp, Artificial Sequence
  Description of Artificial Sequence: Synthetic oligonucleotide
  Target: SCN9A; (+) strand; PAM type: NRG; PAM sequence: AGG
ctacacagaagcctcttgca

SEQ ID NO: 49297 - DNA, 20 bp, Artificial Sequence
  Description of Artificial Sequence: Synthetic oligonucleotide
  Target: SCN9A; (+) strand; PAM type: NRG; PAM sequence: AAG
cctcttgcaaggatttttac

SEQ ID NO: 49298 - DNA, 20 bp, Artificial Sequence
  Description of Artificial Sequence: Synthetic oligonucleotide
  Target: SCN9A; (+) strand; PAM type: NRG; PAM sequence: AAG
gatttttacaagtgattcaa

SEQ ID NO: 49299 - DNA, 20 bp, Artificial Sequence
  Description of Artificial Sequence: Synthetic oligonucleotide
  Target: SCN9A; (+) strand; PAM type: NRG; PAM sequence: CAG
tgattcaaaagtatatattc

SEQ ID NO: 49300 - DNA, 20 bp, Artificial Sequence
  Description of Artificial Sequence: Synthetic oligonucleotide
  Target: SCN9A; (+) strand; PAM type: NRG; PAM sequence: AAG
aaaagtatatattccagtaa

SEQ ID NO: 49301 - DNA, 20 bp, Artificial Sequence
  Description of Artificial Sequence: Synthetic oligonucleotide
  Target: SCN9A; (+) strand; PAM type: NRG; PAM sequence: AAG
gtaaaagtgtacctaaacac

SEQ ID NO: 49302 - DNA, 20 bp, Artificial Sequence
  Description of Artificial Sequence: Synthetic oligonucleotide
  Target: SCN9A; (+) strand; PAM type: NRG; PAM sequence: TGG
acctaaacacaagattccat

SEQ ID NO: 49303 - DNA, 20 bp, Artificial Sequence
  Description of Artificial Sequence: Synthetic oligonucleotide
  Target: SCN9A; (+) strand; PAM type: NRG; PAM sequence: GGG
cctaaacacaagattccatt

SEQ ID NO: 49304 - DNA, 20 bp, Artificial Sequence
  Description of Artificial Sequence: Synthetic oligonucleotide
  Target: SCN9A; (+) strand; PAM type: NRG; PAM sequence: TAG
acaagattccattgggatac

SEQ ID NO: 49305 - DNA, 20 bp, Artificial Sequence
  Description of Artificial Sequence: Synthetic oligonucleotide
  Target: SCN9A; (+) strand; PAM type: NRG; PAM sequence: AAG
attgggatactagatgtgaa

SEQ ID NO: 49306 - DNA, 20 bp, Artificial Sequence
  Description of Artificial Sequence: Synthetic oligonucleotide
  Target: SCN9A; (+) strand; PAM type: NRG; PAM sequence: TGG
tattttctctaattaaccac

SEQ ID NO: 49307 - DNA, 20 bp, Artificial Sequence
  Description of Artificial Sequence: Synthetic oligonucleotide
  Target: SCN9A; (+) strand; PAM type: NRG; PAM sequence: AAG
tttctctaattaaccactgg

SEQ ID NO: 49308 - DNA, 20 bp, Artificial Sequence
  Description of Artificial Sequence: Synthetic oligonucleotide
  Target: SCN9A; (+) strand; PAM type: NRG; PAM sequence: TGG
aaccactggaagacatatat

SEQ ID NO: 49309 - DNA, 20 bp, Artificial Sequence
  Description of Artificial Sequence: Synthetic oligonucleotide
  Target: SCN9A; (+) strand; PAM type: NRG; PAM sequence: GAG
ccactggaagacatatattg

SEQ ID NO: 49310 - DNA, 20 bp, Artificial Sequence
  Description of Artificial Sequence: Synthetic oligonucleotide
  Target: SCN9A; (+) strand; PAM type: NRG; PAM sequence: AGG
cactggaagacatatattgg

SEQ ID NO: 49311 - DNA, 20 bp, Artificial Sequence
  Description of Artificial Sequence: Synthetic oligonucleotide
  Target: SCN9A; (+) strand; PAM type: NRG; PAM sequence: TGG
ggaagacatatattggagga

SEQ ID NO: 49312 - DNA, 20 bp, Artificial Sequence
  Description of Artificial Sequence: Synthetic oligonucleotide
  Target: SCN9A; (+) strand; PAM type: NRG; PAM sequence: TGG
atatattggaggatggctgt

SEQ ID NO: 49313 - DNA, 20 bp, Artificial Sequence
  Description of Artificial Sequence: Synthetic oligonucleotide
  Target: SCN9A; (+) strand; PAM type: NRG; PAM sequence: GGG
tatattggaggatggctgtt

SEQ ID NO: 49314 - DNA, 20 bp, Artificial Sequence
  Description of Artificial Sequence: Synthetic oligonucleotide
  Target: SCN9A; (+) strand; PAM type: NRG; PAM sequence: TGG
ggaggatggctgttgggtta

SEQ ID NO: 49315 - DNA, 20 bp, Artificial Sequence
  Description of Artificial Sequence: Synthetic oligonucleotide
  Target: SCN9A; (+) strand; PAM type: NRG; PAM sequence: TAG
cacaccctattaaactacaa

SEQ ID NO: 49316 - DNA, 20 bp, Artificial Sequence
  Description of Artificial Sequence: Synthetic oligonucleotide
  Target: SCN9A; (+) strand; PAM type: NRG; PAM sequence: AGG
acaccctattaaactacaat

SEQ ID NO: 49317 - DNA, 20 bp, Artificial Sequence
  Description of Artificial Sequence: Synthetic oligonucleotide
  Target: SCN9A; (+) strand; PAM type: NRG; PAM sequence: CAG
taaactacaataggtctatc

SEQ ID NO: 49318 - DNA, 20 bp, Artificial Sequence
  Description of Artificial Sequence: Synthetic oligonucleotide
  Target: SCN9A; (+) strand; PAM type: NRG; PAM sequence: CAG
aaatattaaaatgtcaatat

SEQ ID NO: 49319 - DNA, 20 bp, Artificial Sequence
  Description of Artificial Sequence: Synthetic oligonucleotide
  Target: SCN9A; (+) strand; PAM type: NRG; PAM sequence: CAG
gtcaatatcagaaacactcc

SEQ ID NO: 49320 - DNA, 20 bp, Artificial Sequence
  Description of Artificial Sequence: Synthetic oligonucleotide
  Target: SCN9A; (+) strand; PAM type: NRG; PAM sequence: AAG
atatcagaaacactcccaga

SEQ ID NO: 49321 - DNA, 20 bp, Artificial Sequence
  Description of Artificial Sequence: Synthetic oligonucleotide
  Target: SCN9A; (+) strand; PAM type: NRG; PAM sequence: CAG
tcagaaacactcccagaaag

SEQ ID NO: 49322 - DNA, 20 bp, Artificial Sequence
  Description of Artificial Sequence: Synthetic oligonucleotide
  Target: SCN9A; (+) strand; PAM type: NRG; PAM sequence: GAG
agaaacactcccagaaagca

SEQ ID NO: 49323 - DNA, 20 bp, Artificial Sequence
  Description of Artificial Sequence: Synthetic oligonucleotide
  Target: SCN9A; (+) strand; PAM type: NRG; PAM sequence: AGG
gaaacactcccagaaagcag

SEQ ID NO: 49324 - DNA, 20 bp, Artificial Sequence
  Description of Artificial Sequence: Synthetic oligonucleotide
  Target: SCN9A; (+) strand; PAM type: NRG; PAM sequence: AAG
cagaggtacttgaaataact

SEQ ID NO: 49325 - DNA, 20 bp, Artificial Sequence
  Description of Artificial Sequence: Synthetic oligonucleotide
  Target: SCN9A; (+) strand; PAM type: NRG; PAM sequence: TAG
acttgaaataactaagaata

SEQ ID NO: 49326 - DNA, 20 bp, Artificial Sequence
  Description of Artificial Sequence: Synthetic oligonucleotide
  Target: SCN9A; (+) strand; PAM type: NRG; PAM sequence: AGG
cttgaaataactaagaatat

SEQ ID NO: 49327 - DNA, 20 bp, Artificial Sequence
  Description of Artificial Sequence: Synthetic oligonucleotide
  Target: SCN9A; (+) strand; PAM type: NRG; PAM sequence: CAG
ataactaagaatataggtct

SEQ ID NO: 49328 - DNA, 20 bp, Artificial Sequence
  Description of Artificial Sequence: Synthetic oligonucleotide
  Target: SCN9A; (+) strand; PAM type: NRG; PAM sequence: AAG
taattataaaacatacaccc

SEQ ID NO: 49329 - DNA, 20 bp, Artificial Sequence
  Description of Artificial Sequence: Synthetic oligonucleotide
  Target: SCN9A; (+) strand; PAM type: NRG; PAM sequence: AAG
aaaatatgtgtaacatgtct

SEQ ID NO: 49330 - DNA, 20 bp, Artificial Sequence
  Description of Artificial Sequence: Synthetic oligonucleotide
  Target: SCN9A; (+) strand; PAM type: NRG; PAM sequence: CAG
atgtgtaacatgtctaagaa

SEQ ID NO: 49331 - DNA, 20 bp, Artificial Sequence
  Description of Artificial Sequence: Synthetic oligonucleotide
  Target: SCN9A; (+) strand; PAM type: NRG; PAM sequence: AGG
tgtgtaacatgtctaagaac

SEQ ID NO: 49332 - DNA, 20 bp, Artificial Sequence
  Description of Artificial Sequence: Synthetic oligonucleotide
  Target: SCN9A; (+) strand; PAM type: NRG; PAM sequence: TGG
taacatgtctaagaacagga

SEQ ID NO: 49333 - DNA, 20 bp, Artificial Sequence
  Description of Artificial Sequence: Synthetic oligonucleotide
  Target: SCN9A; (+) strand; PAM type: NRG; PAM sequence: GAG
acatgtctaagaacaggatg

SEQ ID NO: 49334 - DNA, 20 bp, Artificial Sequence
  Description of Artificial Sequence: Synthetic oligonucleotide
  Target: SCN9A; (+) strand; PAM type: NRG; PAM sequence: AAG
aacaggatggagcatctgac

SEQ ID NO: 49335 - DNA, 20 bp, Artificial Sequence
  Description of Artificial Sequence: Synthetic oligonucleotide
  Target: SCN9A; (+) strand; PAM type: NRG; PAM sequence: GAG
atctgacaagttcattcttt

SEQ ID NO: 49336 - DNA, 20 bp, Artificial Sequence
  Description of Artificial Sequence: Synthetic oligonucleotide
  Target: SCN9A; (+) strand; PAM type: NRG; PAM sequence: TAG
cattctttgagaaaacactg

SEQ ID NO: 49337 - DNA, 20 bp, Artificial Sequence
  Description of Artificial Sequence: Synthetic oligonucleotide
  Target: SCN9A; (+) strand; PAM type: NRG; PAM sequence: TAG
agcatctaatttttctaatc

SEQ ID NO: 49338 - DNA, 20 bp, Artificial Sequence
  Description of Artificial Sequence: Synthetic oligonucleotide
  Target: SCN9A; (+) strand; PAM type: NRG; PAM sequence: CAG
atctaatttttctaatctag

SEQ ID NO: 49339 - DNA, 20 bp, Artificial Sequence
  Description of Artificial Sequence: Synthetic oligonucleotide
  Target: SCN9A; (+) strand; PAM type: NRG; PAM sequence: AGG
tctaatttttctaatctagc

SEQ ID NO: 49340 - DNA, 20 bp, Artificial Sequence
  Description of Artificial Sequence: Synthetic oligonucleotide
  Target: SCN9A; (+) strand; PAM type: NRG; PAM sequence: TAG
aatctagcaggttaatatca

SEQ ID NO: 49341 - DNA, 20 bp, Artificial Sequence
  Description of Artificial Sequence: Synthetic oligonucleotide
  Target: SCN9A; (+) strand; PAM type: NRG; PAM sequence: GAG
tctagcaggttaatatcata

SEQ ID NO: 49342 - DNA, 20 bp, Artificial Sequence
  Description of Artificial Sequence: Synthetic oligonucleotide
  Target: SCN9A; (+) strand; PAM type: NRG; PAM sequence: AGG
ctagcaggttaatatcatag

SEQ ID NO: 49343 - DNA, 20 bp, Artificial Sequence
  Description of Artificial Sequence: Synthetic oligonucleotide
  Target: SCN9A; (+) strand; PAM type: NRG; PAM sequence: GAG
agcaggttaatatcatagag

SEQ ID NO: 49344 - DNA, 20 bp, Artificial Sequence
  Description of Artificial Sequence: Synthetic oligonucleotide
  Target: SCN9A; (+) strand; PAM type: NRG; PAM sequence: AGG
gcaggttaatatcatagagg

SEQ ID NO: 49345 - DNA, 20 bp, Artificial Sequence
  Description of Artificial Sequence: Synthetic oligonucleotide
  Target: SCN9A; (+) strand; PAM type: NRG; PAM sequence: AAG
ttaatatcatagaggaggta

SEQ ID NO: 49346 - DNA, 20 bp, Artificial Sequence
  Description of Artificial Sequence: Synthetic oligonucleotide
  Target: SCN9A; (+) strand; PAM type: NRG; PAM sequence: AAG
atagaggaggtaaagaacaa

SEQ ID NO: 49347 - DNA, 20 bp, Artificial Sequence
  Description of Artificial Sequence: Synthetic oligonucleotide
  Target: SCN9A; (+) strand; PAM type: NRG; PAM sequence: AAG
ggaggtaaagaacaaaagaa

SEQ ID NO: 49348 - DNA, 20 bp, Artificial Sequence
  Description of Artificial Sequence: Synthetic oligonucleotide
  Target: SCN9A; (+) strand; PAM type: NRG; PAM sequence: AAG
gtaaagaacaaaagaaaagc

SEQ ID NO: 49349 - DNA, 20 bp, Artificial Sequence
  Description of Artificial Sequence: Synthetic oligonucleotide
  Target: SCN9A; (+) strand; PAM type: NRG; PAM sequence: TGG
agaaaagcaagcatataaca

SEQ ID NO: 49350 - DNA, 20 bp, Artificial Sequence
  Description of Artificial Sequence: Synthetic oligonucleotide
  Target: SCN9A; (+) strand; PAM type: NRG; PAM sequence: GGG
gaaaagcaagcatataacat

SEQ ID NO: 49351 - DNA, 20 bp, Artificial Sequence
  Description of Artificial Sequence: Synthetic oligonucleotide
  Target: SCN9A; (+) strand; PAM type: NRG; PAM sequence: AAG
aagcaagcatataacatggg

SEQ ID NO: 49352 - DNA, 20 bp, Artificial Sequence
  Description of Artificial Sequence: Synthetic oligonucleotide
  Target: SCN9A; (+) strand; PAM type: NRG; PAM sequence: AGG
agcaagcatataacatggga

SEQ ID NO: 49353 - DNA, 20 bp, Artificial Sequence
  Description of Artificial Sequence: Synthetic oligonucleotide
  Target: SCN9A; (+) strand; PAM type: NRG; PAM sequence: AAG
gcatataacatgggaaggta

SEQ ID NO: 49354 - DNA, 20 bp, Artificial Sequence
  Description of Artificial Sequence: Synthetic oligonucleotide
  Target: SCN9A; (+) strand; PAM type: NRG; PAM sequence: CAG
attccccatcttcataaatg

SEQ ID NO: 49355 - DNA, 20 bp, Artificial Sequence
  Description of Artificial Sequence: Synthetic oligonucleotide
  Target: SCN9A; (+) strand; PAM type: NRG; PAM sequence: TGG
tcataaatgcagtaacttcc

SEQ ID NO: 49356 - DNA, 20 bp, Artificial Sequence
  Description of Artificial Sequence: Synthetic oligonucleotide
  Target: SCN9A; (+) strand; PAM type: NRG; PAM sequence: CAG
taaatgcagtaacttcctgg

SEQ ID NO: 49357 - DNA, 20 bp, Artificial Sequence
  Description of Artificial Sequence: Synthetic oligonucleotide
  Target: SCN9A; (+) strand; PAM type: NRG; PAM sequence: AGG
aaatgcagtaacttcctggc

SEQ ID NO: 49358 - DNA, 20 bp, Artificial Sequence
  Description of Artificial Sequence: Synthetic oligonucleotide
  Target: SCN9A; (+) strand; PAM type: NRG; PAM sequence: AAG
cagtaacttcctggcaggaa

SEQ ID NO: 49359 - DNA, 20 bp, Artificial Sequence
  Description of Artificial Sequence: Synthetic oligonucleotide
  Target: SCN9A; (+) strand; PAM type: NRG; PAM sequence: AGG
agtaacttcctggcaggaaa

SEQ ID NO: 49360 - DNA, 20 bp, Artificial Sequence
  Description of Artificial Sequence: Synthetic oligonucleotide
  Target: SCN9A; (+) strand; PAM type: NRG; PAM sequence: AAG
acttcctggcaggaaaagga

SEQ ID NO: 49361 - DNA, 20 bp, Artificial Sequence
  Description of Artificial Sequence: Synthetic oligonucleotide
  Target: SCN9A; (+) strand; PAM type: NRG; PAM sequence: AGG
cttcctggcaggaaaaggaa

SEQ ID NO: 49362 - DNA, 20 bp, Artificial Sequence
  Description of Artificial Sequence: Synthetic oligonucleotide
  Target: SCN9A; (+) strand; PAM type: NRG; PAM sequence: TGG
acccacttactcgacatttt

SEQ ID NO: 49363 - DNA, 20 bp, Artificial Sequence
  Description of Artificial Sequence: Synthetic oligonucleotide
  Target: SCN9A; (+) strand; PAM type: NRG; PAM sequence: CAG
cttactcgacatttttggtc

SEQ ID NO: 49364 - DNA, 20 bp, Artificial Sequence
  Description of Artificial Sequence: Synthetic oligonucleotide
  Target: SCN9A; (+) strand; PAM type: NRG; PAM sequence: CGG
tcgacatttttggtccagtc

SEQ ID NO: 49365 - DNA, 20 bp, Artificial Sequence
  Description of Artificial Sequence: Synthetic oligonucleotide
  Target: SCN9A; (+) strand; PAM type: NRG; PAM sequence: TGG
acatttttggtccagtccgg

SEQ ID NO: 49366 - DNA, 20 bp, Artificial Sequence
  Description of Artificial Sequence: Synthetic oligonucleotide
  Target: SCN9A; (+) strand; PAM type: NRG; PAM sequence: GGG
catttttggtccagtccggt

SEQ ID NO: 49367 - DNA, 20 bp, Artificial Sequence
  Description of Artificial Sequence: Synthetic oligonucleotide
  Target: SCN9A; (+) strand; PAM type: NRG; PAM sequence: TGG
ccagtccggtgggttattca

SEQ ID NO: 49368 - DNA, 20 bp, Artificial Sequence
  Description of Artificial Sequence: Synthetic oligonucleotide
  Target: SCN9A; (+) strand; PAM type: NRG; PAM sequence: CAG
tattcatggtcataaatatg

SEQ ID NO: 49369 - DNA, 20 bp, Artificial Sequence
  Description of Artificial Sequence: Synthetic oligonucleotide
  Target: SCN9A; (+) strand; PAM type: NRG; PAM sequence: CAG
gtcataaatatgcagtttgt

SEQ ID NO: 49370 - DNA, 20 bp, Artificial Sequence
  Description of Artificial Sequence: Synthetic oligonucleotide
  Target: SCN9A; (+) strand; PAM type: NRG; PAM sequence: TAG
aaatatgcagtttgtcagaa

SEQ ID NO: 49371 - DNA, 20 bp, Artificial Sequence
  Description of Artificial Sequence: Synthetic oligonucleotide
  Target: SCN9A; (+) strand; PAM type: NRG; PAM sequence: GAG
gtcagaatagtgcacatgat

SEQ ID NO: 49372 - DNA, 20 bp, Artificial Sequence
  Description of Artificial Sequence: Synthetic oligonucleotide
  Target: SCN9A; (+) strand; PAM type: NRG; PAM sequence: AAG
acatgatgagcatgctgaat

SEQ ID NO: 49373 - DNA, 20 bp, Artificial Sequence
  Description of Artificial Sequence: Synthetic oligonucleotide
  Target: SCN9A; (+) strand; PAM type: NRG; PAM sequence: AGG
catgatgagcatgctgaata

SEQ ID NO: 49374 - DNA, 20 bp, Artificial Sequence
  Description of Artificial Sequence: Synthetic oligonucleotide
  Target: SCN9A; (+) strand; PAM type: NRG; PAM sequence: TAG
gatgagcatgctgaataagg

SEQ ID NO: 49375 - DNA, 20 bp, Artificial Sequence
  Description of Artificial Sequence: Synthetic oligonucleotide
  Target: SCN9A; (+) strand; PAM type: NRG; PAM sequence: TAG
gcatgctgaataaggtagct

SEQ ID NO: 49376 - DNA, 20 bp, Artificial Sequence
  Description of Artificial Sequence: Synthetic oligonucleotide
  Target: SCN9A; (+) strand; PAM type: NRG; PAM sequence: AAG
gaataaggtagcttagaatc

SEQ ID NO: 49377 - DNA, 20 bp, Artificial Sequence
  Description of Artificial Sequence: Synthetic oligonucleotide
  Target: SCN9A; (+) strand; PAM type: NRG; PAM sequence: AGG
aataaggtagcttagaatca

SEQ ID NO: 49378 - DNA, 20 bp, Artificial Sequence
  Description of Artificial Sequence: Synthetic oligonucleotide
  Target: SCN9A; (+) strand; PAM type: NRG; PAM sequence: AAG
agcttagaatcaaggaacaa

SEQ ID NO: 49379 - DNA, 20 bp, Artificial Sequence
  Description of Artificial Sequence: Synthetic oligonucleotide
  Target: SCN9A; (+) strand; PAM type: NRG; PAM sequence: GAG
cttagaatcaaggaacaaaa

SEQ ID NO: 49380 - DNA, 20 bp, Artificial Sequence
  Description of Artificial Sequence: Synthetic oligonucleotide
  Target: SCN9A; (+) strand; PAM type: NRG; PAM sequence: CAG
tcaaggaacaaaagagacga

SEQ ID NO: 49381 - DNA, 20 bp, Artificial Sequence
  Description of Artificial Sequence: Synthetic oligonucleotide
  Target: SCN9A; (+) strand; PAM type: NRG; PAM sequence: TGG
aggaacaaaagagacgacag

SEQ ID NO: 49382 - DNA, 20 bp, Artificial Sequence
  Description of Artificial Sequence: Synthetic oligonucleotide
  Target: SCN9A; (+) strand; PAM type: NRG; PAM sequence: GGG
ggaacaaaagagacgacagt

SEQ ID NO: 49383 - DNA, 20 bp, Artificial Sequence
  Description of Artificial Sequence: Synthetic oligonucleotide
  Target: SCN9A; (+) strand; PAM type: NRG; PAM sequence: GAG
agtgggaatttgaaatattt

SEQ ID NO: 49384 - DNA, 20 bp, Artificial Sequence
  Description of Artificial Sequence: Synthetic oligonucleotide
  Target: SCN9A; (+) strand; PAM type: NRG; PAM sequence: AGG
gtgggaatttgaaatatttg

SEQ ID NO: 49385 - DNA, 20 bp, Artificial Sequence
  Description of Artificial Sequence: Synthetic oligonucleotide
  Target: SCN9A; (+) strand; PAM type: NRG; PAM sequence: AAG
aaatgcttacaacttttcct

SEQ ID NO: 49386 - DNA, 20 bp, Artificial Sequence
  Description of Artificial Sequence: Synthetic oligonucleotide
  Target: SCN9A; (+) strand; PAM type: NRG; PAM sequence: GAG
ctaagaaaaaaattctaaat

SEQ ID NO: 49387 - DNA, 20 bp, Artificial Sequence
  Description of Artificial Sequence: Synthetic oligonucleotide
  Target: SCN9A; (+) strand; PAM type: NRG; PAM sequence: TAG
aaaaattctaaatgagcttg

SEQ ID NO: 49388 - DNA, 20 bp, Artificial Sequence
  Description of Artificial Sequence: Synthetic oligonucleotide
  Target: SCN9A; (+) strand; PAM type: NRG; PAM sequence: AAG
actattttgtctctttgaac

SEQ ID NO: 49389 - DNA, 20 bp, Artificial Sequence
  Description of Artificial Sequence: Synthetic oligonucleotide
  Target: SCN9A; (+) strand; PAM type: NRG; PAM sequence: GAG
tattttgtctctttgaacaa

SEQ ID NO: 49390 - DNA, 20 bp, Artificial Sequence
  Description of Artificial Sequence: Synthetic oligonucleotide
  Target: SCN9A; (+) strand; PAM type: NRG; PAM sequence: GAG
ttttgtctctttgaacaaga

SEQ ID NO: 49391 - DNA, 20 bp, Artificial Sequence
  Description of Artificial Sequence: Synthetic oligonucleotide
  Target: SCN9A; (+) strand; PAM type: NRG; PAM sequence: AAG
aacaagagagtaataaataa

SEQ ID NO: 49392 - DNA, 20 bp, Artificial Sequence
  Description of Artificial Sequence: Synthetic oligonucleotide
  Target: SCN9A; (+) strand; PAM type: NRG; PAM sequence: CAG
tcttaatattgccactctcc

SEQ ID NO: 49393 - DNA, 20 bp, Artificial Sequence
  Description of Artificial Sequence: Synthetic oligonucleotide
  Target: SCN9A; (+) strand; PAM type: NRG; PAM sequence: GAG
ccactctcccagtcttctct

SEQ ID NO: 49394 - DNA, 20 bp, Artificial Sequence
  Description of Artificial Sequence: Synthetic oligonucleotide
  Target: SCN9A; (+) strand; PAM type: NRG; PAM sequence: CAG
tgaaattaataaactaaaac

SEQ ID NO: 49395 - DNA, 20 bp, Artificial Sequence
  Description of Artificial Sequence: Synthetic oligonucleotide
  Target: SCN9A; (+) strand; PAM type: NRG; PAM sequence: GAG
aaattaataaactaaaacca

SEQ ID NO: 49396 - DNA, 20 bp, Artificial Sequence
  Description of Artificial Sequence: Synthetic oligonucleotide
  Target: SCN9A; (+) strand; PAM type: NRG; PAM sequence: AAG
aactaaaaccagagtctttc

SEQ ID NO: 49397 - DNA, 20 bp, Artificial Sequence
  Description of Artificial Sequence: Synthetic oligonucleotide
  Target: SCN9A; (+) strand; PAM type: NRG; PAM sequence: AGG
actaaaaccagagtctttca

SEQ ID NO: 49398 - DNA, 20 bp, Artificial Sequence
  Description of Artificial Sequence: Synthetic oligonucleotide
  Target: SCN9A; (+) strand; PAM type: NRG; PAM sequence: AAG
cagagtctttcaaggtgcaa

SEQ ID NO: 49399 - DNA, 20 bp, Artificial Sequence
  Description of Artificial Sequence: Synthetic oligonucleotide
  Target: SCN9A; (+) strand; PAM type: NRG; PAM sequence: AGG
agagtctttcaaggtgcaaa

SEQ ID NO: 49400 - DNA, 20 bp, Artificial Sequence
  Description of Artificial Sequence: Synthetic oligonucleotide
  Target: SCN9A; (+) strand; PAM type: NRG; PAM sequence: TAG
acatctatatttgaataaaa

SEQ ID NO: 49401 - DNA, 20 bp, Artificial Sequence
  Description of Artificial Sequence: Synthetic oligonucleotide
  Target: SCN9A; (+) strand; PAM type: NRG; PAM sequence: AAG
atagcaaaaattacaccata

SEQ ID NO: 49402 - DNA, 20 bp, Artificial Sequence
  Description of Artificial Sequence: Synthetic oligonucleotide
  Target: SCN9A; (+) strand; PAM type: NRG; PAM sequence: TGG
attacaccataaagtgccac

SEQ ID NO: 49403 - DNA, 20 bp, Artificial Sequence
  Description of Artificial Sequence: Synthetic oligonucleotide
  Target: SCN9A; (+) strand; PAM type: NRG; PAM sequence: AAG
ctggatgtaatcatttttaa

SEQ ID NO: 49404 - DNA, 20 bp, Artificial Sequence
  Description of Artificial Sequence: Synthetic oligonucleotide
  Target: SCN9A; (+) strand; PAM type: NRG; PAM sequence: AGG
tggatgtaatcatttttaaa

SEQ ID NO: 49405 - DNA, 20 bp, Artificial Sequence
  Description of Artificial Sequence: Synthetic oligonucleotide
  Target: SCN9A; (+) strand; PAM type: NRG; PAM sequence: GAG
aatcatttttaaaaggatat

SEQ ID NO: 49406 - DNA, 20 bp, Artificial Sequence
  Description of Artificial Sequence: Synthetic oligonucleotide
  Target: SCN9A; (+) strand; PAM type: NRG; PAM sequence: TAG
tgagtgtactaaaatcttaa

SEQ ID NO: 49407 - DNA, 20 bp, Artificial Sequence
  Description of Artificial Sequence: Synthetic oligonucleotide
  Target: SCN9A; (+) strand; PAM type: NRG; PAM sequence: TAG
atcttaatagatattcttct

SEQ ID NO: 49408 - DNA, 20 bp, Artificial Sequence
  Description of Artificial Sequence: Synthetic oligonucleotide
  Target: SCN9A; (+) strand; PAM type: NRG; PAM sequence: GAG
cttaatagatattcttctta

SEQ ID NO: 49409 - DNA, 20 bp, Artificial Sequence
  Description of Artificial Sequence: Synthetic oligonucleotide
  Target: SCN9A; (+) strand; PAM type: NRG; PAM sequence: AGG
ttaatagatattcttcttag

SEQ ID NO: 49410 - DNA, 20 bp, Artificial Sequence
  Description of Artificial Sequence: Synthetic oligonucleotide
  Target: SCN9A; (+) strand; PAM type: NRG; PAM sequence: AAG
tattcttcttagaggactga

SEQ ID NO: 49411 - DNA, 20 bp, Artificial Sequence
  Description of Artificial Sequence: Synthetic oligonucleotide
  Target: SCN9A; (+) strand; PAM type: NRG; PAM sequence: AGG
attcttcttagaggactgaa

SEQ ID NO: 49412 - DNA, 20 bp, Artificial Sequence
  Description of Artificial Sequence: Synthetic oligonucleotide
  Target: SCN9A; (+) strand; PAM type: NRG; PAM sequence: GAG
tcttcttagaggactgaaag

SEQ ID NO: 49413 - DNA, 20 bp, Artificial Sequence
  Description of Artificial Sequence: Synthetic oligonucleotide
  Target: SCN9A; (+) strand; PAM type: NRG; PAM sequence: AAG
cttagaggactgaaaggaga

SEQ ID NO: 49414 - DNA, 20 bp, Artificial Sequence
  Description of Artificial Sequence: Synthetic oligonucleotide
  Target: SCN9A; (+) strand; PAM type: NRG; PAM sequence: AAG
gaaaggagaaagcatatata

SEQ ID NO: 49415 - DNA, 20 bp, Artificial Sequence
  Description of Artificial Sequence: Synthetic oligonucleotide
  Target: SCN9A; (+) strand; PAM type: NRG; PAM sequence: CAG
aggagaaagcatatataaag

SEQ ID NO: 49416 - DNA, 20 bp, Artificial Sequence
  Description of Artificial Sequence: Synthetic oligonucleotide
  Target: SCN9A; (+) strand; PAM type: NRG; PAM sequence: AGG
ggagaaagcatatataaagc

SEQ ID NO: 49417 - DNA, 20 bp, Artificial Sequence
  Description of Artificial Sequence: Synthetic oligonucleotide
  Target: SCN9A; (+) strand; PAM type: NRG; PAM sequence: TGG
aagcatatataaagcaggtg

SEQ ID NO: 49418 - DNA, 20 bp, Artificial Sequence
  Description of Artificial Sequence: Synthetic oligonucleotide
  Target: SCN9A; (+) strand; PAM type: NRG; PAM sequence: CGG
aagcaggtgtggcattgaaa

SEQ ID NO: 49419 - DNA, 20 bp, Artificial Sequence
  Description of Artificial Sequence: Synthetic oligonucleotide
  Target: SCN9A; (+) strand; PAM type: NRG; PAM sequence: AAG
caggtgtggcattgaaacgg

SEQ ID NO: 49420 - DNA, 20 bp, Artificial Sequence
  Description of Artificial Sequence: Synthetic oligonucleotide
  Target: SCN9A; (+) strand; PAM type: NRG; PAM sequence: AAG
ccctttgttcaatactatga

SEQ ID NO: 49421 - DNA, 20 bp, Artificial Sequence
  Description of Artificial Sequence: Synthetic oligonucleotide
  Target: SCN9A; (+) strand; PAM type: NRG; PAM sequence: CAG
ttcaatactatgaaagtctg

SEQ ID NO: 49422 - DNA, 20 bp, Artificial Sequence
  Description of Artificial Sequence: Synthetic oligonucleotide
  Target: SCN9A; (+) strand; PAM type: NRG; PAM sequence: AGG
tcaatactatgaaagtctgc

SEQ ID NO: 49423 - DNA, 20 bp, Artificial Sequence
  Description of Artificial Sequence: Synthetic oligonucleotide
  Target: SCN9A; (+) strand; PAM type: NRG; PAM sequence: GAG
aatactatgaaagtctgcag

SEQ ID NO: 49424 - DNA, 20 bp, Artificial Sequence
  Description of Artificial Sequence: Synthetic oligonucleotide
  Target: SCN9A; (+) strand; PAM type: NRG; PAM sequence: AGG
atactatgaaagtctgcagg

SEQ ID NO: 49425 - DNA, 20 bp, Artificial Sequence
  Description of Artificial Sequence: Synthetic oligonucleotide
  Target: SCN9A; (+) strand; PAM type: NRG; PAM sequence: AAG
tgaaagtctgcaggaggaaa

SEQ ID NO: 49426 - DNA, 20 bp, Artificial Sequence
  Description of Artificial Sequence: Synthetic oligonucleotide
  Target: SCN9A; (+) strand; PAM type: NRG; PAM sequence: AAG
agtctgcaggaggaaaaaga

SEQ ID NO: 49427 - DNA, 20 bp, Artificial Sequence
  Description of Artificial Sequence: Synthetic oligonucleotide
  Target: SCN9A; (+) strand; PAM type: NRG; PAM sequence: AGG
gtctgcaggaggaaaaagaa

SEQ ID NO: 49428 - DNA, 20 bp, Artificial Sequence
  Description of Artificial Sequence: Synthetic oligonucleotide
  Target: SCN9A; (+) strand; PAM type: NRG; PAM sequence: GAG
gaaaaagaaaggatgaaatt

SEQ ID NO: 49429 - DNA, 20 bp, Artificial Sequence
  Description of Artificial Sequence: Synthetic oligonucleotide
  Target: SCN9A; (+) strand; PAM type: NRG; PAM sequence: CAG
tcaatttttcacatcaatat

SEQ ID NO: 49430 - DNA, 20 bp, Artificial Sequence
  Description of Artificial Sequence: Synthetic oligonucleotide
  Target: SCN9A; (+) strand; PAM type: NRG; PAM sequence: CAG
atttttcacatcaatatcag

SEQ ID NO: 49431 - DNA, 20 bp, Artificial Sequence
  Description of Artificial Sequence: Synthetic oligonucleotide
  Target: SCN9A; (+) strand; PAM type: NRG; PAM sequence: TGG
cagcagtttacctttctaca

SEQ ID NO: 49432 - DNA, 20 bp, Artificial Sequence
  Description of Artificial Sequence: Synthetic oligonucleotide
  Target: SCN9A; (+) strand; PAM type: NRG; PAM sequence: CAG
cagtttacctttctacatgg

SEQ ID NO: 49433 - DNA, 20 bp, Artificial Sequence
  Description of Artificial Sequence: Synthetic oligonucleotide
  Target: SCN9A; (+) strand; PAM type: NRG; PAM sequence: AAG
tacatggcagtgttatattg

SEQ ID NO: 49434 - DNA, 20 bp, Artificial Sequence
  Description of Artificial Sequence: Synthetic oligonucleotide
  Target: SCN9A; (+) strand; PAM type: NRG; PAM sequence: CAG
tattgaagaaacactgccat

SEQ ID NO: 49435 - DNA, 20 bp, Artificial Sequence
  Description of Artificial Sequence: Synthetic oligonucleotide
  Target: SCN9A; (+) strand; PAM type: NRG; PAM sequence: CAG
gaaacactgccatcagactc

SEQ ID NO: 49436 - DNA, 20 bp, Artificial Sequence
  Description of Artificial Sequence: Synthetic oligonucleotide
  Target: SCN9A; (+) strand; PAM type: NRG; PAM sequence: TGG
gccatcagactccagcaatg

SEQ ID NO: 49437 - DNA, 20 bp, Artificial Sequence
  Description of Artificial Sequence: Synthetic oligonucleotide
  Target: SCN9A; (+) strand; PAM type: NRG; PAM sequence: TGG
cgcatctatcaatgtcacct

SEQ ID NO: 49438 - DNA, 20 bp, Artificial Sequence
  Description of Artificial Sequence: Synthetic oligonucleotide
  Target: SCN9A; (+) strand; PAM type: NRG; PAM sequence: AAG
caccttggccaatgaactcc

SEQ ID NO: 49439 - DNA, 20 bp, Artificial Sequence
  Description of Artificial Sequence: Synthetic oligonucleotide
  Target: SCN9A; (+) strand; PAM type: NRG; PAM sequence: TAG
actccaagtccacttcttca

SEQ ID NO: 49440 - DNA, 20 bp, Artificial Sequence
  Description of Artificial Sequence: Synthetic oligonucleotide
  Target: SCN9A; (+) strand; PAM type: NRG; PAM sequence: GAG
tcatagtaactttaaaaatt

SEQ ID NO: 49441 - DNA, 20 bp, Artificial Sequence
  Description of Artificial Sequence: Synthetic oligonucleotide
  Target: SCN9A; (+) strand; PAM type: NRG; PAM sequence: TAG
ttaaaaattgagctatttgt

SEQ ID NO: 49442 - DNA, 20 bp, Artificial Sequence
  Description of Artificial Sequence: Synthetic oligonucleotide
  Target: SCN9A; (+) strand; PAM type: NRG; PAM sequence: TAG
atttgttagcatgtattgct

SEQ ID NO: 49443 - DNA, 20 bp, Artificial Sequence
  Description of Artificial Sequence: Synthetic oligonucleotide
  Target: SCN9A; (+) strand; PAM type: NRG; PAM sequence: GAG
ttgttagcatgtattgctta

SEQ ID NO: 49444 - DNA, 20 bp, Artificial Sequence
  Description of Artificial Sequence: Synthetic oligonucleotide
  Target: SCN9A; (+) strand; PAM type: NRG; PAM sequence: CAG
tatttttcattttctttcac

SEQ ID NO: 49445 - DNA, 20 bp, Artificial Sequence
  Description of Artificial Sequence: Synthetic oligonucleotide
  Target: SCN9A; (+) strand; PAM type: NRG; PAM sequence: TGG
ttcaccagtaacaataactg

SEQ ID NO: 49446 - DNA, 20 bp, Artificial Sequence
  Description of Artificial Sequence: Synthetic oligonucleotide
  Target: SCN9A; (+) strand; PAM type: NRG; PAM sequence: AAG
cagtaacaataactgtggtt

SEQ ID NO: 49447 - DNA, 20 bp, Artificial Sequence
  Description of Artificial Sequence: Synthetic oligonucleotide
  Target: SCN9A; (+) strand; PAM type: NRG; PAM sequence: AAG
actgtggttaagttatttta

SEQ ID NO: 49448 - DNA, 20 bp, Artificial Sequence
  Description of Artificial Sequence: Synthetic oligonucleotide
  Target: SCN9A; (+) strand; PAM type: NRG; PAM sequence: AAG
cttccattacactgcatttt

SEQ ID NO: 49449 - DNA, 20 bp, Artificial Sequence
  Description of Artificial Sequence: Synthetic oligonucleotide
  Target: SCN9A; (+) strand; PAM type: NRG; PAM sequence: AAG
cattacactgcattttaaga

SEQ ID NO: 49450 - DNA, 20 bp, Artificial Sequence
  Description of Artificial Sequence: Synthetic oligonucleotide
  Target: SCN9A; (+) strand; PAM type: NRG; PAM sequence: TAG
tgcattttaagaaagccaaa

SEQ ID NO: 49451 - DNA, 20 bp, Artificial Sequence
  Description of Artificial Sequence: Synthetic oligonucleotide
  Target: SCN9A; (+) strand; PAM type: NRG; PAM sequence: TAG
taagaaagccaaatagaaac

SEQ ID NO: 49452 - DNA, 20 bp, Artificial Sequence
  Description of Artificial Sequence: Synthetic oligonucleotide
  Target: SCN9A; (+) strand; PAM type: NRG; PAM sequence: GAG
tatttttatcataaaacctt

SEQ ID NO: 49453 - DNA, 20 bp, Artificial Sequence
  Description of Artificial Sequence: Synthetic oligonucleotide
  Target: SCN9A; (+) strand; PAM type: NRG; PAM sequence: TGG
ttgagaattttaatacttgc

SEQ ID NO: 49454 - DNA, 20 bp, Artificial Sequence
  Description of Artificial Sequence: Synthetic oligonucleotide
  Target: SCN9A; (+) strand; PAM type: NRG; PAM sequence: TGG
atacttgctggcaattgtta

SEQ ID NO: 49455 - DNA, 20 bp, Artificial Sequence
  Description of Artificial Sequence: Synthetic oligonucleotide
  Target: SCN9A; (+) strand; PAM type: NRG; PAM sequence: TAG
ttgctggcaattgttatggt

SEQ ID NO: 49456 - DNA, 20 bp, Artificial Sequence
  Description of Artificial Sequence: Synthetic oligonucleotide
  Target: SCN9A; (+) strand; PAM type: NRG; PAM sequence: CAG
ctggcaattgttatggttag

SEQ ID NO: 49457 - DNA, 20 bp, Artificial Sequence
  Description of Artificial Sequence: Synthetic oligonucleotide
  Target: SCN9A; (+) strand; PAM type: NRG; PAM sequence: GAG
cagcacatgttccaaaatat

SEQ ID NO: 49458 - DNA, 20 bp, Artificial Sequence
  Description of Artificial Sequence: Synthetic oligonucleotide
  Target: SCN9A; (+) strand; PAM type: NRG; PAM sequence: AAG
atttcaaaaaatattttcct

SEQ ID NO: 49459 - DNA, 20 bp, Artificial Sequence
  Description of Artificial Sequence: Synthetic oligonucleotide
  Target: SCN9A; (+) strand; PAM type: NRG; PAM sequence: AAG
aaaaatattttcctaagttg

SEQ ID NO: 49460 - DNA, 20 bp, Artificial Sequence
  Description of Artificial Sequence: Synthetic oligonucleotide
  Target: SCN9A; (+) strand; PAM type: NRG; PAM sequence: AGG
aaaatattttcctaagttga

SEQ ID NO: 49461 - DNA, 20 bp, Artificial Sequence
  Description of Artificial Sequence: Synthetic oligonucleotide
  Target: SCN9A; (+) strand; PAM type: NRG; PAM sequence: CAG
ttcctaagttgaaggaacgt

SEQ ID NO: 49462 - DNA, 20 bp, Artificial Sequence
  Description of Artificial Sequence: Synthetic oligonucleotide
  Target: SCN9A; (+) strand; PAM type: NRG; PAM sequence: GAG
cctaagttgaaggaacgtca

SEQ ID NO: 49463 - DNA, 20 bp, Artificial Sequence
  Description of Artificial Sequence: Synthetic oligonucleotide
  Target: SCN9A; (+) strand; PAM type: NRG; PAM sequence: TGG
agttgaaggaacgtcagagt

SEQ ID NO: 49464 - DNA, 20 bp, Artificial Sequence
  Description of Artificial Sequence: Synthetic oligonucleotide
  Target: SCN9A; (+) strand; PAM type: NRG; PAM sequence: AAG
tgaaggaacgtcagagttgg

SEQ ID NO: 49465 - DNA, 20 bp, Artificial Sequence
  Description of Artificial Sequence: Synthetic oligonucleotide
  Target: SCN9A; (+) strand; PAM type: NRG; PAM sequence: GAG
gaagaatccttccaatcact

SEQ ID NO: 49466 - DNA, 20 bp, Artificial Sequence
  Description of Artificial Sequence: Synthetic oligonucleotide
  Target: SCN9A; (+) strand; PAM type: NRG; PAM sequence: TAG
tgagttcaatttctttattt

SEQ ID NO: 49467 - DNA, 20 bp, Artificial Sequence
  Description of Artificial Sequence: Synthetic oligonucleotide
  Target: SCN9A; (+) strand; PAM type: NRG; PAM sequence: TAG
tttagttataatactaatat

SEQ ID NO: 49468 - DNA, 20 bp, Artificial Sequence
  Description of Artificial Sequence: Synthetic oligonucleotide
  Target: SCN9A; (+) strand; PAM type: NRG; PAM sequence: AAG
atactaatattagcttttaa

SEQ ID NO: 49469 - DNA, 20 bp, Artificial Sequence
  Description of Artificial Sequence: Synthetic oligonucleotide
  Target: SCN9A; (+) strand; PAM type: NRG; PAM sequence: AGG
tactaatattagcttttaaa

SEQ ID NO: 49470 - DNA, 20 bp, Artificial Sequence
  Description of Artificial Sequence: Synthetic oligonucleotide
  Target: SCN9A; (+) strand; PAM type: NRG; PAM sequence: GGG
actaatattagcttttaaaa

SEQ ID NO: 49471 - DNA, 20 bp, Artificial Sequence
  Description of Artificial Sequence: Synthetic oligonucleotide
  Target: SCN9A; (+) strand; PAM type: NRG; PAM sequence: AAG
ttttaaaagggacttaaatt

SEQ ID NO: 49472 - DNA, 20 bp, Artificial Sequence
  Description of Artificial Sequence: Synthetic oligonucleotide
  Target: SCN9A; (+) strand; PAM type: NRG; PAM sequence: GAG
ttaaaagggacttaaattaa

SEQ ID NO: 49473 - DNA, 20 bp, Artificial Sequence
  Description of Artificial Sequence: Synthetic oligonucleotide
  Target: SCN9A; (+) strand; PAM type: NRG; PAM sequence: AGG
taaaagggacttaaattaag

SEQ ID NO: 49474 - DNA, 20 bp, Artificial Sequence
  Description of Artificial Sequence: Synthetic oligonucleotide
  Target: SCN9A; (+) strand; PAM type: NRG; PAM sequence: CGG
gattcctcacttactaacca

SEQ ID NO: 49475 - DNA, 20 bp, Artificial Sequence
  Description of Artificial Sequence: Synthetic oligonucleotide
  Target: SCN9A; (+) strand; PAM type: NRG; PAM sequence: TAG
aatttaaaaaacgatatgaa

SEQ ID NO: 49476 - DNA, 20 bp, Artificial Sequence
  Description of Artificial Sequence: Synthetic oligonucleotide
  Target: SCN9A; (+) strand; PAM type: NRG; PAM sequence: AAG
ttaaaaaacgatatgaatag

SEQ ID NO: 49477 - DNA, 20 bp, Artificial Sequence
  Description of Artificial Sequence: Synthetic oligonucleotide
  Target: SCN9A; (+) strand; PAM type: NRG; PAM sequence: TAG
acattcttgaaatgttattg

SEQ ID NO: 49478 - DNA, 20 bp, Artificial Sequence
  Description of Artificial Sequence: Synthetic oligonucleotide
  Target: SCN9A; (+) strand; PAM type: NRG; PAM sequence: AAG
tgttattgtagccattccat

SEQ ID NO: 49479 - DNA, 20 bp, Artificial Sequence
  Description of Artificial Sequence: Synthetic oligonucleotide
  Target: SCN9A; (+) strand; PAM type: NRG; PAM sequence: TAG
tccataagtgtccttttcca

SEQ ID NO: 49480 - DNA, 20 bp, Artificial Sequence
  Description of Artificial Sequence: Synthetic oligonucleotide
  Target: SCN9A; (+) strand; PAM type: NRG; PAM sequence: TAG
agtgtccttttccatagctt

SEQ ID NO: 49481 - DNA, 20 bp, Artificial Sequence
  Description of Artificial Sequence: Synthetic oligonucleotide
  Target: SCN9A; (+) strand; PAM type: NRG; PAM sequence: CAG
ttttccatagctttagtatt

SEQ ID NO: 49482 - DNA, 20 bp, Artificial Sequence
  Description of Artificial Sequence: Synthetic oligonucleotide
  Target: SCN9A; (+) strand; PAM type: NRG; PAM sequence: AAG
catagctttagtattcagtt

SEQ ID NO: 49483 - DNA, 20 bp, Artificial Sequence
  Description of Artificial Sequence: Synthetic oligonucleotide
  Target: SCN9A; (+) strand; PAM type: NRG; PAM sequence: CAG
agttaagaaataaaaacaac

SEQ ID NO: 49484 - DNA, 20 bp, Artificial Sequence
  Description of Artificial Sequence: Synthetic oligonucleotide
  Target: SCN9A; (+) strand; PAM type: NRG; PAM sequence: CAG
taagaaataaaaacaaccag

SEQ ID NO: 49485 - DNA, 20 bp, Artificial Sequence
  Description of Artificial Sequence: Synthetic oligonucleotide
  Target: SCN9A; (+) strand; PAM type: NRG; PAM sequence: AAG
gcagtaacaacaaaatatta

SEQ ID NO: 49486 - DNA, 20 bp, Artificial Sequence
  Description of Artificial Sequence: Synthetic oligonucleotide
  Target: SCN9A; (+) strand; PAM type: NRG; PAM sequence: AAG
caaaatattaaagcaaccta

SEQ ID NO: 49487 - DNA, 20 bp, Artificial Sequence
  Description of Artificial Sequence: Synthetic oligonucleotide
  Target: SCN9A; (+) strand; PAM type: NRG; PAM sequence: TGG
attaaagcaacctaaagcat

SEQ ID NO: 49488 - DNA, 20 bp, Artificial Sequence
  Description of Artificial Sequence: Synthetic oligonucleotide
  Target: SCN9A; (+) strand; PAM type: NRG; PAM sequence: TAG
agcaacctaaagcattggct

SEQ ID NO: 49489 - DNA, 20 bp, Artificial Sequence
  Description of Artificial Sequence: Synthetic oligonucleotide
  Target: SCN9A; (+) strand; PAM type: NRG; PAM sequence: CAG
taaagcattggcttagaaat

SEQ ID NO: 49490 - DNA, 20 bp, Artificial Sequence
  Description of Artificial Sequence: Synthetic oligonucleotide
  Target: SCN9A; (+) strand; PAM type: NRG; PAM sequence: AAG
gcattggcttagaaatcaga

SEQ ID NO: 49491 - DNA, 20 bp, Artificial Sequence
  Description of Artificial Sequence: Synthetic oligonucleotide
  Target: SCN9A; (+) strand; PAM type: NRG; PAM sequence: AAG
gcttagaaatcagaaagaca

SEQ ID NO: 49492 - DNA, 20 bp, Artificial Sequence
  Description of Artificial Sequence: Synthetic oligonucleotide
  Target: SCN9A; (+) strand; PAM type: NRG; PAM sequence: CAG
gaaagacaaagttcaaatcc

SEQ ID NO: 49493 - DNA, 20 bp, Artificial Sequence
  Description of Artificial Sequence: Synthetic oligonucleotide
  Target: SCN9A; (+) strand; PAM type: NRG; PAM sequence: CGG
atcccagccttatttttctc

SEQ ID NO: 49494 - DNA, 20 bp, Artificial Sequence
  Description of Artificial Sequence: Synthetic oligonucleotide
  Target: SCN9A; (+) strand; PAM type: NRG; PAM sequence: TGG
cagccttatttttctccggt

SEQ ID NO: 49495 - DNA, 20 bp, Artificial Sequence
  Description of Artificial Sequence: Synthetic oligonucleotide
  Target: SCN9A; (+) strand; PAM type: NRG; PAM sequence: CAG
ccttatttttctccggttgg

SEQ ID NO: 49496 - DNA, 20 bp, Artificial Sequence
  Description of Artificial Sequence: Synthetic oligonucleotide
  Target: SCN9A; (+) strand; PAM type: NRG; PAM sequence: AGG
cttatttttctccggttggc

SEQ ID NO: 49497 - DNA, 20 bp, Artificial Sequence
  Description of Artificial Sequence: Synthetic oligonucleotide
  Target: SCN9A; (+) strand; PAM type: NRG; PAM sequence: AAG
atttttctccggttggcagg

SEQ ID NO: 49498 - DNA, 20 bp, Artificial Sequence
  Description of Artificial Sequence: Synthetic oligonucleotide
  Target: SCN9A; (+) strand; PAM type: NRG; PAM sequence: TAG
ggcaggaagatgacttgtgt

SEQ ID NO: 49499 - DNA, 20 bp, Artificial Sequence
  Description of Artificial Sequence: Synthetic oligonucleotide
  Target: SCN9A; (+) strand; PAM type: NRG; PAM sequence: AAG
agatgacttgtgttagctga

SEQ ID NO: 49500 - DNA, 20 bp, Artificial Sequence
  Description of Artificial Sequence: Synthetic oligonucleotide
  Target: SCN9A; (+) strand; PAM type: NRG; PAM sequence: TAG
ctgactttctaaattttata

SEQ ID NO: 49501 - DNA, 20 bp, Artificial Sequence
  Description of Artificial Sequence: Synthetic oligonucleotide
  Target: SCN9A; (+) strand; PAM type: NRG; PAM sequence: AGG
tgactttctaaattttatat

SEQ ID NO: 49502 - DNA, 20 bp, Artificial Sequence
  Description of Artificial Sequence: Synthetic oligonucleotide
  Target: SCN9A; (+) strand; PAM type: NRG; PAM sequence: GGG
gactttctaaattttatata

SEQ ID NO: 49503 - DNA, 20 bp, Artificial Sequence
  Description of Artificial Sequence: Synthetic oligonucleotide
  Target: SCN9A; (+) strand; PAM type: NRG; PAM sequence: CAG
taaattttatatagggttat

SEQ ID NO: 49504 - DNA, 20 bp, Artificial Sequence
  Description of Artificial Sequence: Synthetic oligonucleotide
  Target: SCN9A; (+) strand; PAM type: NRG; PAM sequence: TGG
attttatatagggttatcag

SEQ ID NO: 49505 - DNA, 20 bp, Artificial Sequence
  Description of Artificial Sequence: Synthetic oligonucleotide
  Target: SCN9A; (+) strand; PAM type: NRG; PAM sequence: GGG
ttttatatagggttatcagt

SEQ ID NO: 49506 - DNA, 20 bp, Artificial Sequence
  Description of Artificial Sequence: Synthetic oligonucleotide
  Target: SCN9A; (+) strand; PAM type: NRG; PAM sequence: TGG
tagggttatcagtgggtttc

SEQ ID NO: 49507 - DNA, 20 bp, Artificial Sequence
  Description of Artificial Sequence: Synthetic oligonucleotide
  Target: SCN9A; (+) strand; PAM type: NRG; PAM sequence: AAG
atcagtgggtttctggcaat

SEQ ID NO: 49508 - DNA, 20 bp, Artificial Sequence
  Description of Artificial Sequence: Synthetic oligonucleotide
  Target: SCN9A; (+) strand; PAM type: NRG; PAM sequence: CAG
taagcatttctcaccgtatt

SEQ ID NO: 49509 - DNA, 20 bp, Artificial Sequence
  Description of Artificial Sequence: Synthetic oligonucleotide
  Target: SCN9A; (+) strand; PAM type: NRG; PAM sequence: AGG
aagcatttctcaccgtattc

SEQ ID NO: 49510 - DNA, 20 bp, Artificial Sequence
  Description of Artificial Sequence: Synthetic oligonucleotide
  Target: SCN9A; (+) strand; PAM type: NRG; PAM sequence: GAG
gcatttctcaccgtattcag

SEQ ID NO: 49511 - DNA, 20 bp, Artificial Sequence
  Description of Artificial Sequence: Synthetic oligonucleotide
  Target: SCN9A; (+) strand; PAM type: NRG; PAM sequence: AGG
catttctcaccgtattcagg

SEQ ID NO: 49512 - DNA, 20 bp, Artificial Sequence
  Description of Artificial Sequence: Synthetic oligonucleotide
  Target: SCN9A; (+) strand; PAM type: NRG; PAM sequence: AAG
tctcaccgtattcaggaggt

SEQ ID NO: 49513 - DNA, 20 bp, Artificial Sequence
  Description of Artificial Sequence: Synthetic oligonucleotide
  Target: SCN9A; (+) strand; PAM type: NRG; PAM sequence: GAG
tattcaggaggtaagtctgt

SEQ ID NO: 49514 - DNA, 20 bp, Artificial Sequence
  Description of Artificial Sequence: Synthetic oligonucleotide
  Target: SCN9A; (+) strand; PAM type: NRG; PAM sequence: CAG
caggaggtaagtctgtgagt

SEQ ID NO: 49515 - DNA, 20 bp, Artificial Sequence
  Description of Artificial Sequence: Synthetic oligonucleotide
  Target: SCN9A; (+) strand; PAM type: NRG; PAM sequence: AGG
aggaggtaagtctgtgagtc

SEQ ID NO: 49516 - DNA, 20 bp, Artificial Sequence
  Description of Artificial Sequence: Synthetic oligonucleotide
  Target: SCN9A; (+) strand; PAM type: NRG; PAM sequence: CGG
tcaggctttttatttgtatg

SEQ ID NO: 49517 - DNA, 20 bp, Artificial Sequence
  Description of Artificial Sequence: Synthetic oligonucleotide
  Target: SCN9A; (+) strand; PAM type: NRG; PAM sequence: CAG
ggctttttatttgtatgcgg

SEQ ID NO: 49518 - DNA, 20 bp, Artificial Sequence
  Description of Artificial Sequence: Synthetic oligonucleotide
  Target: SCN9A; (+) strand; PAM type: NRG; PAM sequence: AAG
gtatgcggcagcgttccctc

SEQ ID NO: 49519 - DNA, 20 bp, Artificial Sequence
  Description of Artificial Sequence: Synthetic oligonucleotide
  Target: SCN9A; (+) strand; PAM type: NRG; PAM sequence: CAG
gttccctcaagaaaacaaat

SEQ ID NO: 49520 - DNA, 20 bp, Artificial Sequence
  Description of Artificial Sequence: Synthetic oligonucleotide
  Target: SCN9A; (+) strand; PAM type: NRG; PAM sequence: GAG
tccctcaagaaaacaaatca

SEQ ID NO: 49521 - DNA, 20 bp, Artificial Sequence
  Description of Artificial Sequence: Synthetic oligonucleotide
  Target: SCN9A; (+) strand; PAM type: NRG; PAM sequence: CAG
aaatcagagtctattgtttt

SEQ ID NO: 49522 - DNA, 20 bp, Artificial Sequence
  Description of Artificial Sequence: Synthetic oligonucleotide
  Target: SCN9A; (+) strand; PAM type: NRG; PAM sequence: AGG
aatcagagtctattgttttc

SEQ ID NO: 49523 - DNA, 20 bp, Artificial Sequence
  Description of Artificial Sequence: Synthetic oligonucleotide
  Target: SCN9A; (+) strand; PAM type: NRG; PAM sequence: CAG
cctgctccctttcactgtat

SEQ ID NO: 49524 - DNA, 20 bp, Artificial Sequence
  Description of Artificial Sequence: Synthetic oligonucleotide
  Target: SCN9A; (+) strand; PAM type: NRG; PAM sequence: TGG
atgtaaaattcacttttaca

SEQ ID NO: 49525 - DNA, 20 bp, Artificial Sequence
  Description of Artificial Sequence: Synthetic oligonucleotide
  Target: SCN9A; (+) strand; PAM type: NRG; PAM sequence: TAG
attattttaaaattaatacc

SEQ ID NO: 49526 - DNA, 20 bp, Artificial Sequence
  Description of Artificial Sequence: Synthetic oligonucleotide
  Target: SCN9A; (+) strand; PAM type: NRG; PAM sequence: AAG
aaaattaatacctagtcctc

SEQ ID NO: 49527 - DNA, 20 bp, Artificial Sequence
  Description of Artificial Sequence: Synthetic oligonucleotide
  Target: SCN9A; (+) strand; PAM type: NRG; PAM sequence: CAG
atcctttttgtcttaaatct

SEQ ID NO: 49528 - DNA, 20 bp, Artificial Sequence
  Description of Artificial Sequence: Synthetic oligonucleotide
  Target: SCN9A; (+) strand; PAM type: NRG; PAM sequence: TAG
ctttttgtcttaaatctcag

SEQ ID NO: 49529 - DNA, 20 bp, Artificial Sequence
  Description of Artificial Sequence: Synthetic oligonucleotide
  Target: SCN9A; (+) strand; PAM type: NRG; PAM sequence: TGG
tttctgcaattgtattgaca

SEQ ID NO: 49530 - DNA, 20 bp, Artificial Sequence
  Description of Artificial Sequence: Synthetic oligonucleotide
  Target: SCN9A; (+) strand; PAM type: NRG; PAM sequence: TGG
gcaattgtattgacatggtt

SEQ ID NO: 49531 - DNA, 20 bp, Artificial Sequence
  Description of Artificial Sequence: Synthetic oligonucleotide
  Target: SCN9A; (+) strand; PAM type: NRG; PAM sequence: CAG
gaattgtaatccccacgtct

SEQ ID NO: 49532 - DNA, 20 bp, Artificial Sequence
  Description of Artificial Sequence: Synthetic oligonucleotide
  Target: SCN9A; (+) strand; PAM type: NRG; PAM sequence: AGG
aattgtaatccccacgtctc

SEQ ID NO: 49533 - DNA, 20 bp, Artificial Sequence
  Description of Artificial Sequence: Synthetic oligonucleotide
  Target: SCN9A; (+) strand; PAM type: NRG; PAM sequence: GGG
attgtaatccccacgtctca

SEQ ID NO: 49534 - DNA, 20 bp, Artificial Sequence
  Description of Artificial Sequence: Synthetic oligonucleotide
  Target: SCN9A; (+) strand; PAM type: NRG; PAM sequence: GGG
ttgtaatccccacgtctcag

SEQ ID NO: 49535 - DNA, 20 bp, Artificial Sequence
  Description of Artificial Sequence: Synthetic oligonucleotide
  Target: SCN9A; (+) strand; PAM type: NRG; PAM sequence: GAG
gtaatccccacgtctcaggg

SEQ ID NO: 49536 - DNA, 20 bp, Artificial Sequence
  Description of Artificial Sequence: Synthetic oligonucleotide
  Target: SCN9A; (+) strand; PAM type: NRG; PAM sequence: AGG
taatccccacgtctcagggg

SEQ ID NO: 49537 - DNA, 20 bp, Artificial Sequence
  Description of Artificial Sequence: Synthetic oligonucleotide
  Target: SCN9A; (+) strand; PAM type: NRG; PAM sequence: GGG
aatccccacgtctcagggga

SEQ ID NO: 49538 - DNA, 20 bp, Artificial Sequence
  Description of Artificial Sequence: Synthetic oligonucleotide
  Target: SCN9A; (+) strand; PAM type: NRG; PAM sequence: TGG
cacgtctcaggggagggacc

SEQ ID NO: 49539 - DNA, 20 bp, Artificial Sequence
  Description of Artificial Sequence: Synthetic oligonucleotide
  Target: SCN9A; (+) strand; PAM type: NRG; PAM sequence: TGG
gtctcaggggagggacctgg

SEQ ID NO: 49540 - DNA, 20 bp, Artificial Sequence
  Description of Artificial Sequence: Synthetic oligonucleotide
  Target: SCN9A; (+) strand; PAM type: NRG; PAM sequence: AAG
caggggagggacctggtggt

SEQ ID NO: 49541 - DNA, 20 bp, Artificial Sequence
  Description of Artificial Sequence: Synthetic oligonucleotide
  Target: SCN9A; (+) strand; PAM type: NRG; PAM sequence: TGG
gggacctggtggtaagtgat

SEQ ID NO: 49542 - DNA, 20 bp, Artificial Sequence
  Description of Artificial Sequence: Synthetic oligonucleotide
  Target: SCN9A; (+) strand; PAM type: NRG; PAM sequence: TGG
ggtggtaagtgattggatca

SEQ ID NO: 49543 - DNA, 20 bp, Artificial Sequence
  Description of Artificial Sequence: Synthetic oligonucleotide
  Target: SCN9A; (+) strand; PAM type: NRG; PAM sequence: GGG
gtggtaagtgattggatcat

SEQ ID NO: 49544 - DNA, 20 bp, Artificial Sequence
  Description of Artificial Sequence: Synthetic oligonucleotide
  Target: SCN9A; (+) strand; PAM type: NRG; PAM sequence: GAG
ggtaagtgattggatcatgg

SEQ ID NO: 49545 - DNA, 20 bp, Artificial Sequence
  Description of Artificial Sequence: Synthetic oligonucleotide
  Target: SCN9A; (+) strand; PAM type: NRG; PAM sequence: CGG
aagtgattggatcatgggag

SEQ ID NO: 49546 - DNA, 20 bp, Artificial Sequence
  Description of Artificial Sequence: Synthetic oligonucleotide
  Target: SCN9A; (+) strand; PAM type: NRG; PAM sequence: CAG
gatcatgggagcggtttccc

SEQ ID NO: 49547 - DNA, 20 bp, Artificial Sequence
  Description of Artificial Sequence: Synthetic oligonucleotide
  Target: SCN9A; (+) strand; PAM type: NRG; PAM sequence: TAG
ccccagtgctgttctcatga

SEQ ID NO: 49548 - DNA, 20 bp, Artificial Sequence
  Description of Artificial Sequence: Synthetic oligonucleotide
  Target: SCN9A; (+) strand; PAM type: NRG; PAM sequence: GAG
agtgctgttctcatgatagt

SEQ ID NO: 49549 - DNA, 20 bp, Artificial Sequence
  Description of Artificial Sequence: Synthetic oligonucleotide
  Target: SCN9A; (+) strand; PAM type: NRG; PAM sequence: GAG
ctgttctcatgatagtgagt

SEQ ID NO: 49550 - DNA, 20 bp, Artificial Sequence
  Description of Artificial Sequence: Synthetic oligonucleotide
  Target: SCN9A; (+) strand; PAM type: NRG; PAM sequence: GAG
tctcatgatagtgagtgagt

SEQ ID NO: 49551 - DNA, 20 bp, Artificial Sequence
  Description of Artificial Sequence: Synthetic oligonucleotide
  Target: SCN9A; (+) strand; PAM type: NRG; PAM sequence: GAG
gtgagtgagtgagttctcat

SEQ ID NO: 49552 - DNA, 20 bp, Artificial Sequence
  Description of Artificial Sequence: Synthetic oligonucleotide
  Target: SCN9A; (+) strand; PAM type: NRG; PAM sequence: TGG
tgagttctcatgagatctga

SEQ ID NO: 49553 - DNA, 20 bp, Artificial Sequence
  Description of Artificial Sequence: Synthetic oligonucleotide
  Target: SCN9A; (+) strand; PAM type: NRG; PAM sequence: GGG
gagttctcatgagatctgat

SEQ ID NO: 49554 - DNA, 20 bp, Artificial Sequence
  Description of Artificial Sequence: Synthetic oligonucleotide
  Target: SCN9A; (+) strand; PAM type: NRG; PAM sequence: AAG
atgagatctgatgggtttaa

SEQ ID NO: 49555 - DNA, 20 bp, Artificial Sequence
  Description of Artificial Sequence: Synthetic oligonucleotide
  Target: SCN9A; (+) strand; PAM type: NRG; PAM sequence: CGG
atctgatgggtttaaaagtg

SEQ ID NO: 49556 - DNA, 20 bp, Artificial Sequence
  Description of Artificial Sequence: Synthetic oligonucleotide
  Target: SCN9A; (+) strand; PAM type: NRG; PAM sequence: AAG
tccctctcctgcaccatgtt

SEQ ID NO: 49557 - DNA, 20 bp, Artificial Sequence
  Description of Artificial Sequence: Synthetic oligonucleotide
  Target: SCN9A; (+) strand; PAM type: NRG; PAM sequence: AAG
ttgccttcgaccatgattgt

SEQ ID NO: 49558 - DNA, 20 bp, Artificial Sequence
  Description of Artificial Sequence: Synthetic oligonucleotide
  Target: SCN9A; (+) strand; PAM type: NRG; PAM sequence: GAG
accatgattgtaagttttct

SEQ ID NO: 49559 - DNA, 20 bp, Artificial Sequence
  Description of Artificial Sequence: Synthetic oligonucleotide
  Target: SCN9A; (+) strand; PAM type: NRG; PAM sequence: AGG
ccatgattgtaagttttctg

SEQ ID NO: 49560 - DNA, 20 bp, Artificial Sequence
  Description of Artificial Sequence: Synthetic oligonucleotide
  Target: SCN9A; (+) strand; PAM type: NRG; PAM sequence: CAG
ctgaggcctcccctgccatt

SEQ ID NO: 49561 - DNA, 20 bp, Artificial Sequence
  Description of Artificial Sequence: Synthetic oligonucleotide
  Target: SCN9A; (+) strand; PAM type: NRG; PAM sequence: CAG
gcctcccctgccattcagaa

SEQ ID NO: 49562 - DNA, 20 bp, Artificial Sequence
  Description of Artificial Sequence: Synthetic oligonucleotide
  Target: SCN9A; (+) strand; PAM type: NRG; PAM sequence: GAG
cccctgccattcagaacagt

SEQ ID NO: 49563 - DNA, 20 bp, Artificial Sequence
  Description of Artificial Sequence: Synthetic oligonucleotide
  Target: SCN9A; (+) strand; PAM type: NRG; PAM sequence: CAG
tcttttctttataaattacc

SEQ ID NO: 49564 - DNA, 20 bp, Artificial Sequence
  Description of Artificial Sequence: Synthetic oligonucleotide
  Target: SCN9A; (+) strand; PAM type: NRG; PAM sequence: CAG
ctttataaattacccagtct

SEQ ID NO: 49565 - DNA, 20 bp, Artificial Sequence
  Description of Artificial Sequence: Synthetic oligonucleotide
  Target: SCN9A; (+) strand; PAM type: NRG; PAM sequence: AGG
tttataaattacccagtctc

SEQ ID NO: 49566 - DNA, 20 bp, Artificial Sequence
  Description of Artificial Sequence: Synthetic oligonucleotide
  Target: SCN9A; (+) strand; PAM type: NRG; PAM sequence: TAG
ataaattacccagtctcagg

SEQ ID NO: 49567 - DNA, 20 bp, Artificial Sequence
  Description of Artificial Sequence: Synthetic oligonucleotide
  Target: SCN9A; (+) strand; PAM type: NRG; PAM sequence: TAG
cagtctcaggtagttcttta

SEQ ID NO: 49568 - DNA, 20 bp, Artificial Sequence
  Description of Artificial Sequence: Synthetic oligonucleotide
  Target: SCN9A; (+) strand; PAM type: NRG; PAM sequence: CAG
tctcaggtagttctttatag

SEQ ID NO: 49569 - DNA, 20 bp, Artificial Sequence
  Description of Artificial Sequence: Synthetic oligonucleotide
  Target: SCN9A; (+) strand; PAM type: NRG; PAM sequence: TGG
tctttatagcagtgtaaaaa

SEQ ID NO: 49570 - DNA, 20 bp, Artificial Sequence
  Description of Artificial Sequence: Synthetic oligonucleotide
  Target: SCN9A; (+) strand; PAM type: NRG; PAM sequence: CGG
agtgtaaaaatggactaata

SEQ ID NO: 49571 - DNA, 20 bp, Artificial Sequence
  Description of Artificial Sequence: Synthetic oligonucleotide
  Target: SCN9A; (+) strand; PAM type: NRG; PAM sequence: CGG
taaaaatggactaatacggc

SEQ ID NO: 49572 - DNA, 20 bp, Artificial Sequence
  Description of Artificial Sequence: Synthetic oligonucleotide
  Target: SCN9A; (+) strand; PAM type: NRG; PAM sequence: GGG
aaaaatggactaatacggcc

SEQ ID NO: 49573 - DNA, 20 bp, Artificial Sequence
  Description of Artificial Sequence: Synthetic oligonucleotide
  Target: SCN9A; (+) strand; PAM type: NRG; PAM sequence: TGG
tggactaatacggccgggcg

SEQ ID NO: 49574 - DNA, 20 bp, Artificial Sequence
  Description of Artificial Sequence: Synthetic oligonucleotide
  Target: SCN9A; (+) strand; PAM type: NRG; PAM sequence: TGG
actaatacggccgggcgtgg

SEQ ID NO: 49575 - DNA, 20 bp, Artificial Sequence
  Description of Artificial Sequence: Synthetic oligonucleotide
  Target: SCN9A; (+) strand; PAM type: NRG; PAM sequence: CAG
gtggctcacgcctgtgttcc

SEQ ID NO: 49576 - DNA, 20 bp, Artificial Sequence
  Description of Artificial Sequence: Synthetic oligonucleotide
  Target: SCN9A; (+) strand; PAM type: NRG; PAM sequence: TGG
cgcctgtgttcccagcactt

SEQ ID NO: 49577 - DNA, 20 bp, Artificial Sequence
  Description of Artificial Sequence: Synthetic oligonucleotide
  Target: SCN9A; (+) strand; PAM type: NRG; PAM sequence: GGG
gcctgtgttcccagcacttt

SEQ ID NO: 49578 - DNA, 20 bp, Artificial Sequence
  Description of Artificial Sequence: Synthetic oligonucleotide
  Target: SCN9A; (+) strand; PAM type: NRG; PAM sequence: GAG
ctgtgttcccagcactttgg

SEQ ID NO: 49579 - DNA, 20 bp, Artificial Sequence
  Description of Artificial Sequence: Synthetic oligonucleotide
  Target: SCN9A; (+) strand; PAM type: NRG; PAM sequence: AGG
tgtgttcccagcactttggg

SEQ ID NO: 49580 - DNA, 20 bp, Artificial Sequence
  Description of Artificial Sequence: Synthetic oligonucleotide
  Target: SCN9A; (+) strand; PAM type: NRG; PAM sequence: AAG
tcccagcactttgggaggcc

SEQ ID NO: 49581 - DNA, 20 bp, Artificial Sequence
  Description of Artificial Sequence: Synthetic oligonucleotide
  Target: SCN9A; (+) strand; PAM type: NRG; PAM sequence: AGG
cccagcactttgggaggcca

SEQ ID NO: 49582 - DNA, 20 bp, Artificial Sequence
  Description of Artificial Sequence: Synthetic oligonucleotide
  Target: SCN9A; (+) strand; PAM type: NRG; PAM sequence: TGG
agcactttgggaggccaagg

SEQ ID NO: 49583 - DNA, 20 bp, Artificial Sequence
  Description of Artificial Sequence: Synthetic oligonucleotide
  Target: SCN9A; (+) strand; PAM type: NRG; PAM sequence: GGG
gcactttgggaggccaaggt

SEQ ID NO: 49584 - DNA, 20 bp, Artificial Sequence
  Description of Artificial Sequence: Synthetic oligonucleotide
  Target: SCN9A; (+) strand; PAM type: NRG; PAM sequence: CAG
ctttgggaggccaaggtggg

SEQ ID NO: 49585 - DNA, 20 bp, Artificial Sequence
  Description of Artificial Sequence: Synthetic oligonucleotide
  Target: SCN9A; (+) strand; PAM type: NRG; PAM sequence: CAG
aggtgggcagaacacaacgt

SEQ ID NO: 49586 - DNA, 20 bp, Artificial Sequence
  Description of Artificial Sequence: Synthetic oligonucleotide
  Target: SCN9A; (+) strand; PAM type: NRG; PAM sequence: AGG
ggtgggcagaacacaacgtc

SEQ ID NO: 49587 - DNA, 20 bp, Artificial Sequence
  Description of Artificial Sequence: Synthetic oligonucleotide
  Target: SCN9A; (+) strand; PAM type: NRG; PAM sequence: GAG
tgggcagaacacaacgtcag

SEQ ID NO: 49588 - DNA, 20 bp, Artificial Sequence
  Description of Artificial Sequence: Synthetic oligonucleotide
  Target: SCN9A; (+) strand; PAM type: NRG; PAM sequence: GAG
gaacacaacgtcaggagatc

SEQ ID NO: 49589 - DNA, 20 bp, Artificial Sequence
  Description of Artificial Sequence: Synthetic oligonucleotide
  Target: SCN9A; (+) strand; PAM type: NRG; PAM sequence: TGG
tcaggagatcgagaccatcc

SEQ ID NO: 49590 - DNA, 20 bp, Artificial Sequence
  Description of Artificial Sequence: Synthetic oligonucleotide
  Target: SCN9A; (+) strand; PAM type: NRG; PAM sequence: CGG
cgagaccatcctggctaaca

SEQ ID NO: 49591 - DNA, 20 bp, Artificial Sequence
  Description of Artificial Sequence: Synthetic oligonucleotide
  Target: SCN9A; (+) strand; PAM type: NRG; PAM sequence: TAG
taaaaatacaaaaacaaaat

SEQ ID NO: 49592 - DNA, 20 bp, Artificial Sequence
  Description of Artificial Sequence: Synthetic oligonucleotide
  Target: SCN9A; (+) strand; PAM type: NRG; PAM sequence: CAG
aatacaaaaacaaaattagc

SEQ ID NO: 49593 - DNA, 20 bp, Artificial Sequence
  Description of Artificial Sequence: Synthetic oligonucleotide
  Target: SCN9A; (+) strand; PAM type: NRG; PAM sequence: AGG
atacaaaaacaaaattagcc

SEQ ID NO: 49594 - DNA, 20 bp, Artificial Sequence
  Description of Artificial Sequence: Synthetic oligonucleotide
  Target: SCN9A; (+) strand; PAM type: NRG; PAM sequence: TGG
aaaacaaaattagccaggtg

SEQ ID NO: 49595 - DNA, 20 bp, Artificial Sequence
  Description of Artificial Sequence: Synthetic oligonucleotide
  Target: SCN9A; (+) strand; PAM type: NRG; PAM sequence: TGG
acaaaattagccaggtgtgg

SEQ ID NO: 49596 - DNA, 20 bp, Artificial Sequence
  Description of Artificial Sequence: Synthetic oligonucleotide
  Target: SCN9A; (+) strand; PAM type: NRG; PAM sequence: CGG
aaattagccaggtgtggtgg

SEQ ID NO: 49597 - DNA, 20 bp, Artificial Sequence
  Description of Artificial Sequence: Synthetic oligonucleotide
  Target: SCN9A; (+) strand; PAM type: NRG; PAM sequence: GGG
aattagccaggtgtggtggc

SEQ ID NO: 49598 - DNA, 20 bp, Artificial Sequence
  Description of Artificial Sequence: Synthetic oligonucleotide
  Target: SCN9A; (+) strand; PAM type: NRG; PAM sequence: TAG
ggtgtggtggcgggtacctg

SEQ ID NO: 49599 - DNA, 20 bp, Artificial Sequence
  Description of Artificial Sequence: Synthetic oligonucleotide
  Target: SCN9A; (+) strand; PAM type: NRG; PAM sequence: CAG
gtggcgggtacctgtagtcc

SEQ ID NO: 49600 - DNA, 20 bp, Artificial Sequence
  Description of Artificial Sequence: Synthetic oligonucleotide
  Target: SCN9A; (+) strand; PAM type: NRG; PAM sequence: TGG
acctgtagtcccagctaccc

SEQ ID NO: 49601 - DNA, 20 bp, Artificial Sequence
  Description of Artificial Sequence: Synthetic oligonucleotide
  Target: SCN9A; (+) strand; PAM type: NRG; PAM sequence: GAG
ctgtagtcccagctaccctg

SEQ ID NO: 49602 - DNA, 20 bp, Artificial Sequence
  Description of Artificial Sequence: Synthetic oligonucleotide
  Target: SCN9A; (+) strand; PAM type: NRG; PAM sequence: AGG
tgtagtcccagctaccctgg

SEQ ID NO: 49603 - DNA, 20 bp, Artificial Sequence
  Description of Artificial Sequence: Synthetic oligonucleotide
  Target: SCN9A; (+) strand; PAM type: NRG; PAM sequence: GAG
tcccagctaccctggaggct

SEQ ID NO: 49604 - DNA, 20 bp, Artificial Sequence
  Description of Artificial Sequence: Synthetic oligonucleotide
  Target: SCN9A; (+) strand; PAM type: NRG; PAM sequence: AGG
cccagctaccctggaggctg

SEQ ID NO: 49605 - DNA, 20 bp, Artificial Sequence
  Description of Artificial Sequence: Synthetic oligonucleotide
  Target: SCN9A; (+) strand; PAM type: NRG; PAM sequence: TGG
agctaccctggaggctgagg

SEQ ID NO: 49606 - DNA, 20 bp, Artificial Sequence
  Description of Artificial Sequence: Synthetic oligonucleotide
  Target: SCN9A; (+) strand; PAM type: NRG; PAM sequence: GGG
gctaccctggaggctgaggt

SEQ ID NO: 49607 - DNA, 20 bp, Artificial Sequence
  Description of Artificial Sequence: Synthetic oligonucleotide
  Target: SCN9A; (+) strand; PAM type: NRG; PAM sequence: GAG
taccctggaggctgaggtgg

SEQ ID NO: 49608 - DNA, 20 bp, Artificial Sequence
  Description of Artificial Sequence: Synthetic oligonucleotide
  Target: SCN9A; (+) strand; PAM type: NRG; PAM sequence: TGG
tggaggctgaggtgggagaa

SEQ ID NO: 49609 - DNA, 20 bp, Artificial Sequence
  Description of Artificial Sequence: Synthetic oligonucleotide
  Target: SCN9A; (+) strand; PAM type: NRG; PAM sequence: CGG
gtgggagaatggcgtgaacc

SEQ ID NO: 49610 - DNA, 20 bp, Artificial Sequence
  Description of Artificial Sequence: Synthetic oligonucleotide
  Target: SCN9A; (+) strand; PAM type: NRG; PAM sequence: GGG
tgggagaatggcgtgaaccc

SEQ ID NO: 49611 - DNA, 20 bp, Artificial Sequence
  Description of Artificial Sequence: Synthetic oligonucleotide
  Target: SCN9A; (+) strand; PAM type: NRG; PAM sequence: GAG
ggagaatggcgtgaacccgg

SEQ ID NO: 49612 - DNA, 20 bp, Artificial Sequence
  Description of Artificial Sequence: Synthetic oligonucleotide
  Target: SCN9A; (+) strand; PAM type: NRG; PAM sequence: AGG
gagaatggcgtgaacccggg

SEQ ID NO: 49613 - DNA, 20 bp, Artificial Sequence
  Description of Artificial Sequence: Synthetic oligonucleotide
  Target: SCN9A; (+) strand; PAM type: NRG; PAM sequence: CGG
aatggcgtgaacccgggagg

SEQ ID NO: 49614 - DNA, 20 bp, Artificial Sequence
  Description of Artificial Sequence: Synthetic oligonucleotide
  Target: SCN9A; (+) strand; PAM type: NRG; PAM sequence: GAG
tggcgtgaacccgggaggcg

SEQ ID NO: 49615 - DNA, 20 bp, Artificial Sequence
  Description of Artificial Sequence: Synthetic oligonucleotide
  Target: SCN9A; (+) strand; PAM type: NRG; PAM sequence: CAG
aacccgggaggcggagcttg

SEQ ID NO: 49616 - DNA, 20 bp, Artificial Sequence
  Description of Artificial Sequence: Synthetic oligonucleotide
  Target: SCN9A; (+) strand; PAM type: NRG; PAM sequence: GAG
cgggaggcggagcttgcagt

SEQ ID NO: 49617 - DNA, 20 bp, Artificial Sequence
  Description of Artificial Sequence: Synthetic oligonucleotide
  Target: SCN9A; (+) strand; PAM type: NRG; PAM sequence: CGG
agtgagccaaaatcgcgcca

SEQ ID NO: 49618 - DNA, 20 bp, Artificial Sequence
  Description of Artificial Sequence: Synthetic oligonucleotide
  Target: SCN9A; (+) strand; PAM type: NRG; PAM sequence: CAG
aaaatcgcgccacggcactc

SEQ ID NO: 49619 - DNA, 20 bp, Artificial Sequence
  Description of Artificial Sequence: Synthetic oligonucleotide
  Target: SCN9A; (+) strand; PAM type: NRG; PAM sequence: TGG
cgcgccacggcactccagcc

SEQ ID NO: 49620 - DNA, 20 bp, Artificial Sequence
  Description of Artificial Sequence: Synthetic oligonucleotide
  Target: SCN9A; (+) strand; PAM type: NRG; PAM sequence: GGG
gcgccacggcactccagcct

SEQ ID NO: 49621 - DNA, 20 bp, Artificial Sequence
  Description of Artificial Sequence: Synthetic oligonucleotide
  Target: SCN9A; (+) strand; PAM type: NRG; PAM sequence: CAG
cggcactccagcctgggcaa

SEQ ID NO: 49622 - DNA, 20 bp, Artificial Sequence
  Description of Artificial Sequence: Synthetic oligonucleotide
  Target: SCN9A; (+) strand; PAM type: NRG; PAM sequence: GAG
gcactccagcctgggcaaca

SEQ ID NO: 49623 - DNA, 20 bp, Artificial Sequence
  Description of Artificial Sequence: Synthetic oligonucleotide
  Target: SCN9A; (+) strand; PAM type: NRG; PAM sequence: AGG
cactccagcctgggcaacag

SEQ ID NO: 49624 - DNA, 20 bp, Artificial Sequence
  Description of Artificial Sequence: Synthetic oligonucleotide
  Target: SCN9A; (+) strand; PAM type: NRG; PAM sequence: GGG
actccagcctgggcaacaga

SEQ ID NO: 49625 - DNA, 20 bp, Artificial Sequence
  Description of Artificial Sequence: Synthetic oligonucleotide
  Target: SCN9A; (+) strand; PAM type: NRG; PAM sequence: GAG
tccagcctgggcaacagagg

SEQ ID NO: 49626 - DNA, 20 bp, Artificial Sequence
  Description of Artificial Sequence: Synthetic oligonucleotide
  Target: SCN9A; (+) strand; PAM type: NRG; PAM sequence: AAG
tcaaaaaaaaaaaaaaaaaa

SEQ ID NO: 49627 - DNA, 20 bp, Artificial Sequence
  Description of Artificial Sequence: Synthetic oligonucleotide
  Target: SCN9A; (+) strand; PAM type: NRG; PAM sequence: TAG
aaaaaagactaatacatgta

SEQ ID NO: 49628 - DNA, 20 bp, Artificial Sequence
  Description of Artificial Sequence: Synthetic oligonucleotide
  Target: SCN9A; (+) strand; PAM type: NRG; PAM sequence: CAG
aagactaatacatgtatagt

SEQ ID NO: 49629 - DNA, 20 bp, Artificial Sequence
  Description of Artificial Sequence: Synthetic oligonucleotide
  Target: SCN9A; (+) strand; PAM type: NRG; PAM sequence: CAG
agtcagaaactatatcataa

SEQ ID NO: 49630 - DNA, 20 bp, Artificial Sequence
  Description of Artificial Sequence: Synthetic oligonucleotide
  Target: SCN9A; (+) strand; PAM type: NRG; PAM sequence: AGG
gtcagaaactatatcataac

SEQ ID NO: 49631 - DNA, 20 bp, Artificial Sequence
  Description of Artificial Sequence: Synthetic oligonucleotide
  Target: SCN9A; (+) strand; PAM type: NRG; PAM sequence: AAG
atatcataacaggtaatgaa

SEQ ID NO: 49632 - DNA, 20 bp, Artificial Sequence
  Description of Artificial Sequence: Synthetic oligonucleotide
  Target: SCN9A; (+) strand; PAM type: NRG; PAM sequence: AGG
tatcataacaggtaatgaaa

SEQ ID NO: 49633 - DNA, 20 bp, Artificial Sequence
  Description of Artificial Sequence: Synthetic oligonucleotide
  Target: SCN9A; (+) strand; PAM type: NRG; PAM sequence: GAG
tcataacaggtaatgaaaag

SEQ ID NO: 49634 - DNA, 20 bp, Artificial Sequence
  Description of Artificial Sequence: Synthetic oligonucleotide
  Target: SCN9A; (+) strand; PAM type: NRG; PAM sequence: AAG
aaaggagtttgaacaaaaat

SEQ ID NO: 49635 - DNA, 20 bp, Artificial Sequence
  Description of Artificial Sequence: Synthetic oligonucleotide
  Target: SCN9A; (+) strand; PAM type: NRG; PAM sequence: AGG
aaggagtttgaacaaaaata

SEQ ID NO: 49636 - DNA, 20 bp, Artificial Sequence
  Description of Artificial Sequence: Synthetic oligonucleotide
  Target: SCN9A; (+) strand; PAM type: NRG; PAM sequence: GAG
tttgaacaaaaataaggcat

SEQ ID NO: 49637 - DNA, 20 bp, Artificial Sequence
  Description of Artificial Sequence: Synthetic oligonucleotide
  Target: SCN9A; (+) strand; PAM type: NRG; PAM sequence: AAG
aaggcatgagttttgtattc

SEQ ID NO: 49638 - DNA, 20 bp, Artificial Sequence
  Description of Artificial Sequence: Synthetic oligonucleotide
  Target: SCN9A; (+) strand; PAM type: NRG; PAM sequence: AGG
aggcatgagttttgtattca

SEQ ID NO: 49639 - DNA, 20 bp, Artificial Sequence
  Description of Artificial Sequence: Synthetic oligonucleotide
  Target: SCN9A; (+) strand; PAM type: NRG; PAM sequence: TAG
tttgtattcaaggaacttcc

SEQ ID NO: 49640 - DNA, 20 bp, Artificial Sequence
  Description of Artificial Sequence: Synthetic oligonucleotide
  Target: SCN9A; (+) strand; PAM type: NRG; PAM sequence: AAG
gaacttcctagaaaaatgaa

SEQ ID NO: 49641 - DNA, 20 bp, Artificial Sequence
  Description of Artificial Sequence: Synthetic oligonucleotide
  Target: SCN9A; (+) strand; PAM type: NRG; PAM sequence: AAG
cttcctagaaaaatgaaaag

SEQ ID NO: 49642 - DNA, 20 bp, Artificial Sequence
  Description of Artificial Sequence: Synthetic oligonucleotide
  Target: SCN9A; (+) strand; PAM type: NRG; PAM sequence: AAG
ctagaaaaatgaaaagaaga

SEQ ID NO: 49643 - DNA, 20 bp, Artificial Sequence
  Description of Artificial Sequence: Synthetic oligonucleotide
  Target: SCN9A; (+) strand; PAM type: NRG; PAM sequence: AAG
aagaagaaagtaactaatat

SEQ ID NO: 49644 - DNA, 20 bp, Artificial Sequence
  Description of Artificial Sequence: Synthetic oligonucleotide
  Target: SCN9A; (+) strand; PAM type: NRG; PAM sequence: AGG
agaagaaagtaactaatata

SEQ ID NO: 49645 - DNA, 20 bp, Artificial Sequence
  Description of Artificial Sequence: Synthetic oligonucleotide
  Target: SCN9A; (+) strand; PAM type: NRG; PAM sequence: AAG
gaaagtaactaatataaggc

SEQ ID NO: 49646 - DNA, 20 bp, Artificial Sequence
  Description of Artificial Sequence: Synthetic oligonucleotide
  Target: SCN9A; (+) strand; PAM type: NRG; PAM sequence: CAG
taatataaggcaagatgtga

SEQ ID NO: 49647 - DNA, 20 bp, Artificial Sequence
  Description of Artificial Sequence: Synthetic oligonucleotide
  Target: SCN9A; (+) strand; PAM type: NRG; PAM sequence: CAG
aagatgtgacagatatcata

SEQ ID NO: 49648 - DNA, 20 bp, Artificial Sequence
  Description of Artificial Sequence: Synthetic oligonucleotide
  Target: SCN9A; (+) strand; PAM type: NRG; PAM sequence: AAG
atatcatacagaaaaatata

SEQ ID NO: 49649 - DNA, 20 bp, Artificial Sequence
  Description of Artificial Sequence: Synthetic oligonucleotide
  Target: SCN9A; (+) strand; PAM type: NRG; PAM sequence: AGG
tatcatacagaaaaatataa

SEQ ID NO: 49650 - DNA, 20 bp, Artificial Sequence
  Description of Artificial Sequence: Synthetic oligonucleotide
  Target: SCN9A; (+) strand; PAM type: NRG; PAM sequence: GGG
atcatacagaaaaatataaa

SEQ ID NO: 49651 - DNA, 20 bp, Artificial Sequence
  Description of Artificial Sequence: Synthetic oligonucleotide
  Target: SCN9A; (+) strand; PAM type: NRG; PAM sequence: GGG
tcatacagaaaaatataaag

SEQ ID NO: 49652 - DNA, 20 bp, Artificial Sequence
  Description of Artificial Sequence: Synthetic oligonucleotide
  Target: SCN9A; (+) strand; PAM type: NRG; PAM sequence: GGG
catacagaaaaatataaagg

SEQ ID NO: 49653 - DNA, 20 bp, Artificial Sequence
  Description of Artificial Sequence: Synthetic oligonucleotide
  Target: SCN9A; (+) strand; PAM type: NRG; PAM sequence: AAG
acagaaaaatataaaggggg

SEQ ID NO: 49654 - DNA, 20 bp, Artificial Sequence
  Description of Artificial Sequence: Synthetic oligonucleotide
  Target: SCN9A; (+) strand; PAM type: NRG; PAM sequence: GAG
aaatataaagggggaagaat

SEQ ID NO: 49655 - DNA, 20 bp, Artificial Sequence
  Description of Artificial Sequence: Synthetic oligonucleotide
  Target: SCN9A; (+) strand; PAM type: NRG; PAM sequence: GAG
atataaagggggaagaatga

SEQ ID NO: 49656 - DNA, 20 bp, Artificial Sequence
  Description of Artificial Sequence: Synthetic oligonucleotide
  Target: SCN9A; (+) strand; PAM type: NRG; PAM sequence: AAG
aagggggaagaatgagagtg

SEQ ID NO: 49657 - DNA, 20 bp, Artificial Sequence
  Description of Artificial Sequence: Synthetic oligonucleotide
  Target: SCN9A; (+) strand; PAM type: NRG; PAM sequence: GAG
gggggaagaatgagagtgaa

SEQ ID NO: 49658 - DNA, 20 bp, Artificial Sequence
  Description of Artificial Sequence: Synthetic oligonucleotide
  Target: SCN9A; (+) strand; PAM type: NRG; PAM sequence: AGG
ggggaagaatgagagtgaag

SEQ ID NO: 49659 - DNA, 20 bp, Artificial Sequence
  Description of Artificial Sequence: Synthetic oligonucleotide
  Target: SCN9A; (+) strand; PAM type: NRG; PAM sequence: GGG
gggaagaatgagagtgaaga

SEQ ID NO: 49660 - DNA, 20 bp, Artificial Sequence
  Description of Artificial Sequence: Synthetic oligonucleotide
  Target: SCN9A; (+) strand; PAM type: NRG; PAM sequence: CAG
gaatgagagtgaagagggaa

SEQ ID NO: 49661 - DNA, 20 bp, Artificial Sequence
  Description of Artificial Sequence: Synthetic oligonucleotide
  Target: SCN9A; (+) strand; PAM type: NRG; PAM sequence: AGG
aatgagagtgaagagggaac

SEQ ID NO: 49662 - DNA, 20 bp, Artificial Sequence
  Description of Artificial Sequence: Synthetic oligonucleotide
  Target: SCN9A; (+) strand; PAM type: NRG; PAM sequence: GGG
atgagagtgaagagggaaca

SEQ ID NO: 49663 - DNA, 20 bp, Artificial Sequence
  Description of Artificial Sequence: Synthetic oligonucleotide
  Target: SCN9A; (+) strand; PAM type: NRG; PAM sequence: CAG
cacatgactgtcaaaattat

SEQ ID NO: 49664 - DNA, 20 bp, Artificial Sequence
  Description of Artificial Sequence: Synthetic oligonucleotide
  Target: SCN9A; (+) strand; PAM type: NRG; PAM sequence: AGG
acatgactgtcaaaattatc

SEQ ID NO: 49665 - DNA, 20 bp, Artificial Sequence
  Description of Artificial Sequence: Synthetic oligonucleotide
  Target: SCN9A; (+) strand; PAM type: NRG; PAM sequence: GGG
catgactgtcaaaattatca

SEQ ID NO: 49666 - DNA, 20 bp, Artificial Sequence
  Description of Artificial Sequence: Synthetic oligonucleotide
  Target: SCN9A; (+) strand; PAM type: NRG; PAM sequence: GAG
tgactgtcaaaattatcagg

SEQ ID NO: 49667 - DNA, 20 bp, Artificial Sequence
  Description of Artificial Sequence: Synthetic oligonucleotide
  Target: SCN9A; (+) strand; PAM type: NRG; PAM sequence: CGG
atcagggagactttataaac

SEQ ID NO: 49668 - DNA, 20 bp, Artificial Sequence
  Description of Artificial Sequence: Synthetic oligonucleotide
  Target: SCN9A; (+) strand; PAM type: NRG; PAM sequence: GAG
cagggagactttataaaccg

SEQ ID NO: 49669 - DNA, 20 bp, Artificial Sequence
  Description of Artificial Sequence: Synthetic oligonucleotide
  Target: SCN9A; (+) strand; PAM type: NRG; PAM sequence: AGG
agggagactttataaaccgg

SEQ ID NO: 49670 - DNA, 20 bp, Artificial Sequence
  Description of Artificial Sequence: Synthetic oligonucleotide
  Target: SCN9A; (+) strand; PAM type: NRG; PAM sequence: GAG
ttataaaccggaggtcatct

SEQ ID NO: 49671 - DNA, 20 bp, Artificial Sequence
  Description of Artificial Sequence: Synthetic oligonucleotide
  Target: SCN9A; (+) strand; PAM type: NRG; PAM sequence: TAG
aaaaatcacaacatactaca

SEQ ID NO: 49672 - DNA, 20 bp, Artificial Sequence
  Description of Artificial Sequence: Synthetic oligonucleotide
  Target: SCN9A; (+) strand; PAM type: NRG; PAM sequence: TGG
cacaacatactacatagtat

SEQ ID NO: 49673 - DNA, 20 bp, Artificial Sequence
  Description of Artificial Sequence: Synthetic oligonucleotide
  Target: SCN9A; (+) strand; PAM type: NRG; PAM sequence: AAG
acatactacatagtattggc

SEQ ID NO: 49674 - DNA, 20 bp, Artificial Sequence
  Description of Artificial Sequence: Synthetic oligonucleotide
  Target: SCN9A; (+) strand; PAM type: NRG; PAM sequence: AAG
tacatagtattggcaagatc

SEQ ID NO: 49675 - DNA, 20 bp, Artificial Sequence
  Description of Artificial Sequence: Synthetic oligonucleotide
  Target: SCN9A; (+) strand; PAM type: NRG; PAM sequence: AAG
atacttgaaattttaataaa

SEQ ID NO: 49676 - DNA, 20 bp, Artificial Sequence
  Description of Artificial Sequence: Synthetic oligonucleotide
  Target: SCN9A; (+) strand; PAM type: NRG; PAM sequence: TGG
attttaataaaaagaattgt

SEQ ID NO: 49677 - DNA, 20 bp, Artificial Sequence
  Description of Artificial Sequence: Synthetic oligonucleotide
  Target: SCN9A; (+) strand; PAM type: NRG; PAM sequence: TAG
tggtattttaaaattgaaat

SEQ ID NO: 49678 - DNA, 20 bp, Artificial Sequence
  Description of Artificial Sequence: Synthetic oligonucleotide
  Target: SCN9A; (+) strand; PAM type: NRG; PAM sequence: AAG
cattctcattaaaaactttt

SEQ ID NO: 49679 - DNA, 20 bp, Artificial Sequence
  Description of Artificial Sequence: Synthetic oligonucleotide
  Target: SCN9A; (+) strand; PAM type: NRG; PAM sequence: TGG
aaaaacttttaagtgatttt

SEQ ID NO: 49680 - DNA, 20 bp, Artificial Sequence
  Description of Artificial Sequence: Synthetic oligonucleotide
  Target: SCN9A; (+) strand; PAM type: NRG; PAM sequence: GGG
aaaacttttaagtgattttt

SEQ ID NO: 49681 - DNA, 20 bp, Artificial Sequence
  Description of Artificial Sequence: Synthetic oligonucleotide
  Target: SCN9A; (+) strand; PAM type: NRG; PAM sequence: GAG
ttttgggtctgcatacacat

SEQ ID NO: 49682 - DNA, 20 bp, Artificial Sequence
  Description of Artificial Sequence: Synthetic oligonucleotide
  Target: SCN9A; (+) strand; PAM type: NRG; PAM sequence: GAG
ttgggtctgcatacacatga

SEQ ID NO: 49683 - DNA, 20 bp, Artificial Sequence
  Description of Artificial Sequence: Synthetic oligonucleotide
  Target: SCN9A; (+) strand; PAM type: NRG; PAM sequence: TAG
tacacatgagagttaattat

SEQ ID NO: 49684 - DNA, 20 bp, Artificial Sequence
  Description of Artificial Sequence: Synthetic oligonucleotide
  Target: SCN9A; (+) strand; PAM type: NRG; PAM sequence: CAG
acatgagagttaattattag

SEQ ID NO: 49685 - DNA, 20 bp, Artificial Sequence
  Description of Artificial Sequence: Synthetic oligonucleotide
  Target: SCN9A; (+) strand; PAM type: NRG; PAM sequence: AGG
catgagagttaattattagc

SEQ ID NO: 49686 - DNA, 20 bp, Artificial Sequence
  Description of Artificial Sequence: Synthetic oligonucleotide
  Target: SCN9A; (+) strand; PAM type: NRG; PAM sequence: TAG
taattattagcaggaaaaaa

SEQ ID NO: 49687 - DNA, 20 bp, Artificial Sequence
  Description of Artificial Sequence: Synthetic oligonucleotide
  Target: SCN9A; (+) strand; PAM type: NRG; PAM sequence: AGG
aattattagcaggaaaaaat

SEQ ID NO: 49688 - DNA, 20 bp, Artificial Sequence
  Description of Artificial Sequence: Synthetic oligonucleotide
  Target: SCN9A; (+) strand; PAM type: NRG; PAM sequence: TGG
ataggtatgattataaaatt

SEQ ID NO: 49689 - DNA, 20 bp, Artificial Sequence
  Description of Artificial Sequence: Synthetic oligonucleotide
  Target: SCN9A; (+) strand; PAM type: NRG; PAM sequence: CAG
ggtatgattataaaatttgg

SEQ ID NO: 49690 - DNA, 20 bp, Artificial Sequence
  Description of Artificial Sequence: Synthetic oligonucleotide
  Target: SCN9A; (+) strand; PAM type: NRG; PAM sequence: AAG
taaatttcacaattgcttca

SEQ ID NO: 49691 - DNA, 20 bp, Artificial Sequence
  Description of Artificial Sequence: Synthetic oligonucleotide
  Target: SCN9A; (+) strand; PAM type: NRG; PAM sequence: GAG
aatttcacaattgcttcaaa

SEQ ID NO: 49692 - DNA, 20 bp, Artificial Sequence
  Description of Artificial Sequence: Synthetic oligonucleotide
  Target: SCN9A; (+) strand; PAM type: NRG; PAM sequence: TAG
ttcaaagagaataaaatacc

SEQ ID NO: 49693 - DNA, 20 bp, Artificial Sequence
  Description of Artificial Sequence: Synthetic oligonucleotide
  Target: SCN9A; (+) strand; PAM type: NRG; PAM sequence: AGG
tcaaagagaataaaatacct

SEQ ID NO: 49694 - DNA, 20 bp, Artificial Sequence
  Description of Artificial Sequence: Synthetic oligonucleotide
  Target: SCN9A; (+) strand; PAM type: NRG; PAM sequence: AAG
tacctaggaatccaacttac

SEQ ID NO: 49695 - DNA, 20 bp, Artificial Sequence
  Description of Artificial Sequence: Synthetic oligonucleotide
  Target: SCN9A; (+) strand; PAM type: NRG; PAM sequence: AGG
acctaggaatccaacttaca

SEQ ID NO: 49696 - DNA, 20 bp, Artificial Sequence
  Description of Artificial Sequence: Synthetic oligonucleotide
  Target: SCN9A; (+) strand; PAM type: NRG; PAM sequence: GGG
cctaggaatccaacttacaa

SEQ ID NO: 49697 - DNA, 20 bp, Artificial Sequence
  Description of Artificial Sequence: Synthetic oligonucleotide
  Target: SCN9A; (+) strand; PAM type: NRG; PAM sequence: AAG
tccaacttacaagggatgtg

SEQ ID NO: 49698 - DNA, 20 bp, Artificial Sequence
  Description of Artificial Sequence: Synthetic oligonucleotide
  Target: SCN9A; (+) strand; PAM type: NRG; PAM sequence: AGG
ccaacttacaagggatgtga

SEQ ID NO: 49699 - DNA, 20 bp, Artificial Sequence
  Description of Artificial Sequence: Synthetic oligonucleotide
  Target: SCN9A; (+) strand; PAM type: NRG; PAM sequence: GAG
gggatgtgaaggacctcttc

SEQ ID NO: 49700 - DNA, 20 bp, Artificial Sequence
  Description of Artificial Sequence: Synthetic oligonucleotide
  Target: SCN9A; (+) strand; PAM type: NRG; PAM sequence: AGG
ggatgtgaaggacctcttcg

SEQ ID NO: 49701 - DNA, 20 bp, Artificial Sequence
  Description of Artificial Sequence: Synthetic oligonucleotide
  Target: SCN9A; (+) strand; PAM type: NRG; PAM sequence: GAG
atgtgaaggacctcttcgag

SEQ ID NO: 49702 - DNA, 20 bp, Artificial Sequence
  Description of Artificial Sequence: Synthetic oligonucleotide
  Target: SCN9A; (+) strand; PAM type: NRG; PAM sequence: AAG
agaactacaaaccactgctc

SEQ ID NO: 49703 - DNA, 20 bp, Artificial Sequence
  Description of Artificial Sequence: Synthetic oligonucleotide
  Target: SCN9A; (+) strand; PAM type: NRG; PAM sequence: AGG
gaactacaaaccactgctca

SEQ ID NO: 49704 - DNA, 20 bp, Artificial Sequence
  Description of Artificial Sequence: Synthetic oligonucleotide
  Target: SCN9A; (+) strand; PAM type: NRG; PAM sequence: AAG
accactgctcaaggaaataa

SEQ ID NO: 49705 - DNA, 20 bp, Artificial Sequence
  Description of Artificial Sequence: Synthetic oligonucleotide
  Target: SCN9A; (+) strand; PAM type: NRG; PAM sequence: GAG
cactgctcaaggaaataaaa

SEQ ID NO: 49706 - DNA, 20 bp, Artificial Sequence
  Description of Artificial Sequence: Synthetic oligonucleotide
  Target: SCN9A; (+) strand; PAM type: NRG; PAM sequence: AGG
actgctcaaggaaataaaag

SEQ ID NO: 49707 - DNA, 20 bp, Artificial Sequence
  Description of Artificial Sequence: Synthetic oligonucleotide
  Target: SCN9A; (+) strand; PAM type: NRG; PAM sequence: TGG
taaaagaggatacaaacaaa

SEQ ID NO: 49708 - DNA, 20 bp, Artificial Sequence
  Description of Artificial Sequence: Synthetic oligonucleotide
  Target: SCN9A; (+) strand; PAM type: NRG; PAM sequence: AAG
aagaggatacaaacaaatgg

SEQ ID NO: 49709 - DNA, 20 bp, Artificial Sequence
  Description of Artificial Sequence: Synthetic oligonucleotide
  Target: SCN9A; (+) strand; PAM type: NRG; PAM sequence: TAG
gaacattccatgctcatgtg

SEQ ID NO: 49710 - DNA, 20 bp, Artificial Sequence
  Description of Artificial Sequence: Synthetic oligonucleotide
  Target: SCN9A; (+) strand; PAM type: NRG; PAM sequence: AGG
aacattccatgctcatgtgt

SEQ ID NO: 49711 - DNA, 20 bp, Artificial Sequence
  Description of Artificial Sequence: Synthetic oligonucleotide
  Target: SCN9A; (+) strand; PAM type: NRG; PAM sequence: AAG
attccatgctcatgtgtagg

SEQ ID NO: 49712 - DNA, 20 bp, Artificial Sequence
  Description of Artificial Sequence: Synthetic oligonucleotide
  Target: SCN9A; (+) strand; PAM type: NRG; PAM sequence: TGG
aagaatcaatatcgtgaaaa

SEQ ID NO: 49713 - DNA, 20 bp, Artificial Sequence
  Description of Artificial Sequence: Synthetic oligonucleotide
  Target: SCN9A; (+) strand; PAM type: NRG; PAM sequence: AAG
tgaaaatggccatactgccc

SEQ ID NO: 49714 - DNA, 20 bp, Artificial Sequence
  Description of Artificial Sequence: Synthetic oligonucleotide
  Target: SCN9A; (+) strand; PAM type: NRG; PAM sequence: AGG
gaaaatggccatactgccca

SEQ ID NO: 49715 - DNA, 20 bp, Artificial Sequence
  Description of Artificial Sequence: Synthetic oligonucleotide
  Target: SCN9A; (+) strand; PAM type: NRG; PAM sequence: CAG
atactgcccaaggtaattta

SEQ ID NO: 49716 - DNA, 20 bp, Artificial Sequence
  Description of Artificial Sequence: Synthetic oligonucleotide
  Target: SCN9A; (+) strand; PAM type: NRG; PAM sequence: AAG
gattcaatgccatccccatc

SEQ ID NO: 49717 - DNA, 20 bp, Artificial Sequence
  Description of Artificial Sequence: Synthetic oligonucleotide
  Target: SCN9A; (+) strand; PAM type: NRG; PAM sequence: CAG
gctaccaatgactttcttca

SEQ ID NO: 49718 - DNA, 20 bp, Artificial Sequence
  Description of Artificial Sequence: Synthetic oligonucleotide
  Target: SCN9A; (+) strand; PAM type: NRG; PAM sequence: TGG
aatgactttcttcacagaac

SEQ ID NO: 49719 - DNA, 20 bp, Artificial Sequence
  Description of Artificial Sequence: Synthetic oligonucleotide
  Target: SCN9A; (+) strand; PAM type: NRG; PAM sequence: AAG
aactggaaaaaactacttta

SEQ ID NO: 49720 - DNA, 20 bp, Artificial Sequence
  Description of Artificial Sequence: Synthetic oligonucleotide
  Target: SCN9A; (+) strand; PAM type: NRG; PAM sequence: TGG
aaactactttaaagttcata

SEQ ID NO: 49721 - DNA, 20 bp, Artificial Sequence
  Description of Artificial Sequence: Synthetic oligonucleotide
  Target: SCN9A; (+) strand; PAM type: NRG; PAM sequence: AAG
aagttcatatggaaccaaaa

SEQ ID NO: 49722 - DNA, 20 bp, Artificial Sequence
  Description of Artificial Sequence: Synthetic oligonucleotide
  Target: SCN9A; (+) strand; PAM type: NRG; PAM sequence: GAG
gttcatatggaaccaaaaaa

SEQ ID NO: 49723 - DNA, 20 bp, Artificial Sequence
  Description of Artificial Sequence: Synthetic oligonucleotide
  Target: SCN9A; (+) strand; PAM type: NRG; PAM sequence: AAG
aaaaaagagcccgcatcgcc

SEQ ID NO: 49724 - DNA, 20 bp, Artificial Sequence
  Description of Artificial Sequence: Synthetic oligonucleotide
  Target: SCN9A; (+) strand; PAM type: NRG; PAM sequence: AAG
cgcatcgccaagtcaatcct

SEQ ID NO: 49725 - DNA, 20 bp, Artificial Sequence
  Description of Artificial Sequence: Synthetic oligonucleotide
  Target: SCN9A; (+) strand; PAM type: NRG; PAM sequence: AAG
ccaagtcaatcctaagccaa

SEQ ID NO: 49726 - DNA, 20 bp, Artificial Sequence
  Description of Artificial Sequence: Synthetic oligonucleotide
  Target: SCN9A; (+) strand; PAM type: NRG; PAM sequence: AAG
aatcctaagccaaaagaaca

SEQ ID NO: 49727 - DNA, 20 bp, Artificial Sequence
  Description of Artificial Sequence: Synthetic oligonucleotide
  Target: SCN9A; (+) strand; PAM type: NRG; PAM sequence: TGG
ctaagccaaaagaacaaagc

SEQ ID NO: 49728 - DNA, 20 bp, Artificial Sequence
  Description of Artificial Sequence: Synthetic oligonucleotide
  Target: SCN9A; (+) strand; PAM type: NRG; PAM sequence: GAG
aagccaaaagaacaaagctg

SEQ ID NO: 49729 - DNA, 20 bp, Artificial Sequence
  Description of Artificial Sequence: Synthetic oligonucleotide
  Target: SCN9A; (+) strand; PAM type: NRG; PAM sequence: AGG
agccaaaagaacaaagctgg

SEQ ID NO: 49730 - DNA, 20 bp, Artificial Sequence
  Description of Artificial Sequence: Synthetic oligonucleotide
  Target: SCN9A; (+) strand; PAM type: NRG; PAM sequence: AAG
ctgacttcaaactacactac

SEQ ID NO: 49731 - DNA, 20 bp, Artificial Sequence
  Description of Artificial Sequence: Synthetic oligonucleotide
  Target: SCN9A; (+) strand; PAM type: NRG; PAM sequence: AGG
tgacttcaaactacactaca

SEQ ID NO: 49732 - DNA, 20 bp, Artificial Sequence
  Description of Artificial Sequence: Synthetic oligonucleotide
  Target: SCN9A; (+) strand; PAM type: NRG; PAM sequence: CAG
caaactacactacaaggcta

SEQ ID NO: 49733 - DNA, 20 bp, Artificial Sequence
  Description of Artificial Sequence: Synthetic oligonucleotide
  Target: SCN9A; (+) strand; PAM type: NRG; PAM sequence: CAG
caaggctacagtaacccaaa

SEQ ID NO: 49734 - DNA, 20 bp, Artificial Sequence
  Description of Artificial Sequence: Synthetic oligonucleotide
  Target: SCN9A; (+) strand; PAM type: NRG; PAM sequence: TGG
ctacagtaacccaaacagca

SEQ ID NO: 49735 - DNA, 20 bp, Artificial Sequence
  Description of Artificial Sequence: Synthetic oligonucleotide
  Target: SCN9A; (+) strand; PAM type: NRG; PAM sequence: TGG
taacccaaacagcatggtac

SEQ ID NO: 49736 - DNA, 20 bp, Artificial Sequence
  Description of Artificial Sequence: Synthetic oligonucleotide
  Target: SCN9A; (+) strand; PAM type: NRG; PAM sequence: CAG
gcatggtactggtaccaaaa

SEQ ID NO: 49737 - DNA, 20 bp, Artificial Sequence
  Description of Artificial Sequence: Synthetic oligonucleotide
  Target: SCN9A; (+) strand; PAM type: NRG; PAM sequence: GAG
atggtactggtaccaaaaca

SEQ ID NO: 49738 - DNA, 20 bp, Artificial Sequence
  Description of Artificial Sequence: Synthetic oligonucleotide
  Target: SCN9A; (+) strand; PAM type: NRG; PAM sequence: TAG
ctggtaccaaaacagagata

SEQ ID NO: 49739 - DNA, 20 bp, Artificial Sequence
  Description of Artificial Sequence: Synthetic oligonucleotide
  Target: SCN9A; (+) strand; PAM type: NRG; PAM sequence: TGG
aaaacagagatatagatcaa

SEQ ID NO: 49740 - DNA, 20 bp, Artificial Sequence
  Description of Artificial Sequence: Synthetic oligonucleotide
  Target: SCN9A; (+) strand; PAM type: NRG; PAM sequence: CAG
agagatatagatcaatggaa

SEQ ID NO: 49741 - DNA, 20 bp, Artificial Sequence
  Description of Artificial Sequence: Synthetic oligonucleotide
  Target: SCN9A; (+) strand; PAM type: NRG; PAM sequence: CAG
tatagatcaatggaacagaa

SEQ ID NO: 49742 - DNA, 20 bp, Artificial Sequence
  Description of Artificial Sequence: Synthetic oligonucleotide
  Target: SCN9A; (+) strand; PAM type: NRG; PAM sequence: GAG
tagatcaatggaacagaaca

SEQ ID NO: 49743 - DNA, 20 bp, Artificial Sequence
  Description of Artificial Sequence: Synthetic oligonucleotide
  Target: SCN9A; (+) strand; PAM type: NRG; PAM sequence: CAG
atggaacagaacagagccct

SEQ ID NO: 49744 - DNA, 20 bp, Artificial Sequence
  Description of Artificial Sequence: Synthetic oligonucleotide
  Target: SCN9A; (+) strand; PAM type: NRG; PAM sequence: GAG
atctgatctttgacaaacct

SEQ ID NO: 49745 - DNA, 20 bp, Artificial Sequence
  Description of Artificial Sequence: Synthetic oligonucleotide
  Target: SCN9A; (+) strand; PAM type: NRG; PAM sequence: AAG
ttgacaaacctgagaaaaac

SEQ ID NO: 49746 - DNA, 20 bp, Artificial Sequence
  Description of Artificial Sequence: Synthetic oligonucleotide
  Target: SCN9A; (+) strand; PAM type: NRG; PAM sequence: TGG
aacctgagaaaaacaagcaa

SEQ ID NO: 49747 - DNA, 20 bp, Artificial Sequence
  Description of Artificial Sequence: Synthetic oligonucleotide
  Target: SCN9A; (+) strand; PAM type: NRG; PAM sequence: GGG
acctgagaaaaacaagcaat

SEQ ID NO: 49748 - DNA, 20 bp, Artificial Sequence
  Description of Artificial Sequence: Synthetic oligonucleotide
  Target: SCN9A; (+) strand; PAM type: NRG; PAM sequence: GGG
cctgagaaaaacaagcaatg

SEQ ID NO: 49749 - DNA, 20 bp, Artificial Sequence
  Description of Artificial Sequence: Synthetic oligonucleotide
  Target: SCN9A; (+) strand; PAM type: NRG; PAM sequence: AAG
agaaaaacaagcaatgggga

SEQ ID NO: 49750 - DNA, 20 bp, Artificial Sequence
  Description of Artificial Sequence: Synthetic oligonucleotide
  Target: SCN9A; (+) strand; PAM type: NRG; PAM sequence: AGG
gaaaaacaagcaatggggaa

SEQ ID NO: 49751 - DNA, 20 bp, Artificial Sequence
  Description of Artificial Sequence: Synthetic oligonucleotide
  Target: SCN9A; (+) strand; PAM type: NRG; PAM sequence: TGG
aggattccctatttaacaaa

SEQ ID NO: 49752 - DNA, 20 bp, Artificial Sequence
  Description of Artificial Sequence: Synthetic oligonucleotide
  Target: SCN9A; (+) strand; PAM type: NRG; PAM sequence: TGG
ccctatttaacaaatggtgc

SEQ ID NO: 49753 - DNA, 20 bp, Artificial Sequence
  Description of Artificial Sequence: Synthetic oligonucleotide
  Target: SCN9A; (+) strand; PAM type: NRG; PAM sequence: GGG
cctatttaacaaatggtgct

SEQ ID NO: 49754 - DNA, 20 bp, Artificial Sequence
  Description of Artificial Sequence: Synthetic oligonucleotide
  Target: SCN9A; (+) strand; PAM type: NRG; PAM sequence: TGG
acaaatggtgctgggaaaac

SEQ ID NO: 49755 - DNA, 20 bp, Artificial Sequence
  Description of Artificial Sequence: Synthetic oligonucleotide
  Target: SCN9A; (+) strand; PAM type: NRG; PAM sequence: TAG
atggtgctgggaaaactggc

SEQ ID NO: 49756 - DNA, 20 bp, Artificial Sequence
  Description of Artificial Sequence: Synthetic oligonucleotide
  Target: SCN9A; (+) strand; PAM type: NRG; PAM sequence: TAG
gaaaactggctagccatatg

SEQ ID NO: 49757 - DNA, 20 bp, Artificial Sequence
  Description of Artificial Sequence: Synthetic oligonucleotide
  Target: SCN9A; (+) strand; PAM type: NRG; PAM sequence: AAG
actggctagccatatgtaga

SEQ ID NO: 49758 - DNA, 20 bp, Artificial Sequence
  Description of Artificial Sequence: Synthetic oligonucleotide
  Target: SCN9A; (+) strand; PAM type: NRG; PAM sequence: TGG
catatgtagaaagctgaaac

SEQ ID NO: 49759 - DNA, 20 bp, Artificial Sequence
  Description of Artificial Sequence: Synthetic oligonucleotide
  Target: SCN9A; (+) strand; PAM type: NRG; PAM sequence: AAG
ccttatacaaaaatcaattc

SEQ ID NO: 49760 - DNA, 20 bp, Artificial Sequence
  Description of Artificial Sequence: Synthetic oligonucleotide
  Target: SCN9A; (+) strand; PAM type: NRG; PAM sequence: TGG
atacaaaaatcaattcaaga

SEQ ID NO: 49761 - DNA, 20 bp, Artificial Sequence
  Description of Artificial Sequence: Synthetic oligonucleotide
  Target: SCN9A; (+) strand; PAM type: NRG; PAM sequence: AAG
aatcaattcaagatggatta

SEQ ID NO: 49762 - DNA, 20 bp, Artificial Sequence
  Description of Artificial Sequence: Synthetic oligonucleotide
  Target: SCN9A; (+) strand; PAM type: NRG; PAM sequence: TAG
tggattaaagacttaaacat

SEQ ID NO: 49763 - DNA, 20 bp, Artificial Sequence
  Description of Artificial Sequence: Synthetic oligonucleotide
  Target: SCN9A; (+) strand; PAM type: NRG; PAM sequence: TAG
acctaaaaccataaaaaccc

SEQ ID NO: 49764 - DNA, 20 bp, Artificial Sequence
  Description of Artificial Sequence: Synthetic oligonucleotide
  Target: SCN9A; (+) strand; PAM type: NRG; PAM sequence: AAG
taaaaccataaaaaccctag

SEQ ID NO: 49765 - DNA, 20 bp, Artificial Sequence
  Description of Artificial Sequence: Synthetic oligonucleotide
  Target: SCN9A; (+) strand; PAM type: NRG; PAM sequence: CAG
aaaaaccctagaagaaaacc

SEQ ID NO: 49766 - DNA, 20 bp, Artificial Sequence
  Description of Artificial Sequence: Synthetic oligonucleotide
  Target: SCN9A; (+) strand; PAM type: NRG; PAM sequence: AGG
aaaaccctagaagaaaaccc

SEQ ID NO: 49767 - DNA, 20 bp, Artificial Sequence
  Description of Artificial Sequence: Synthetic oligonucleotide
  Target: SCN9A; (+) strand; PAM type: NRG; PAM sequence: CAG
aaaacccaggcattaccatt

SEQ ID NO: 49768 - DNA, 20 bp, Artificial Sequence
  Description of Artificial Sequence: Synthetic oligonucleotide
  Target: SCN9A; (+) strand; PAM type: NRG; PAM sequence: AGG
aaacccaggcattaccattc

SEQ ID NO: 49769 - DNA, 20 bp, Artificial Sequence
  Description of Artificial Sequence: Synthetic oligonucleotide
  Target: SCN9A; (+) strand; PAM type: NRG; PAM sequence: TAG
aggcattaccattcaggaca

SEQ ID NO: 49770 - DNA, 20 bp, Artificial Sequence
  Description of Artificial Sequence: Synthetic oligonucleotide
  Target: SCN9A; (+) strand; PAM type: NRG; PAM sequence: AGG
ggcattaccattcaggacat

SEQ ID NO: 49771 - DNA, 20 bp, Artificial Sequence
  Description of Artificial Sequence: Synthetic oligonucleotide
  Target: SCN9A; (+) strand; PAM type: NRG; PAM sequence: TGG
taccattcaggacataggca

SEQ ID NO: 49772 - DNA, 20 bp, Artificial Sequence
  Description of Artificial Sequence: Synthetic oligonucleotide
  Target: SCN9A; (+) strand; PAM type: NRG; PAM sequence: GGG
accattcaggacataggcat

SEQ ID NO: 49773 - DNA, 20 bp, Artificial Sequence
  Description of Artificial Sequence: Synthetic oligonucleotide
  Target: SCN9A; (+) strand; PAM type: NRG; PAM sequence: AAG
ttcaggacataggcatgggc

SEQ ID NO: 49774 - DNA, 20 bp, Artificial Sequence
  Description of Artificial Sequence: Synthetic oligonucleotide
  Target: SCN9A; (+) strand; PAM type: NRG; PAM sequence: AGG
tcaggacataggcatgggca

SEQ ID NO: 49775 - DNA, 20 bp, Artificial Sequence
  Description of Artificial Sequence: Synthetic oligonucleotide
  Target: SCN9A; (+) strand; PAM type: NRG; PAM sequence: AAG
cttcatgtctaaaacaccaa

SEQ ID NO: 49776 - DNA, 20 bp, Artificial Sequence
  Description of Artificial Sequence: Synthetic oligonucleotide
  Target: SCN9A; (+) strand; PAM type: NRG; PAM sequence: TGG
gtctaaaacaccaaaagcaa

SEQ ID NO: 49777 - DNA, 20 bp, Artificial Sequence
  Description of Artificial Sequence: Synthetic oligonucleotide
  Target: SCN9A; (+) strand; PAM type: NRG; PAM sequence: AAG
accaaaagcaatggcaacaa

SEQ ID NO: 49778 - DNA, 20 bp, Artificial Sequence
  Description of Artificial Sequence: Synthetic oligonucleotide
  Target: SCN9A; (+) strand; PAM type: NRG; PAM sequence: TGG
caaaagacaaaattgacaaa

SEQ ID NO: 49779 - DNA, 20 bp, Artificial Sequence
  Description of Artificial Sequence: Synthetic oligonucleotide
  Target: SCN9A; (+) strand; PAM type: NRG; PAM sequence: GGG
aaaagacaaaattgacaaat

SEQ ID NO: 49780 - DNA, 20 bp, Artificial Sequence
  Description of Artificial Sequence: Synthetic oligonucleotide
  Target: SCN9A; (+) strand; PAM type: NRG; PAM sequence: AAG
aatgggatctaattaaacta

SEQ ID NO: 49781 - DNA, 20 bp, Artificial Sequence
  Description of Artificial Sequence: Synthetic oligonucleotide
  Target: SCN9A; (+) strand; PAM type: NRG; PAM sequence: GAG
tgggatctaattaaactaaa

SEQ ID NO: 49782 - DNA, 20 bp, Artificial Sequence
  Description of Artificial Sequence: Synthetic oligonucleotide
  Target: SCN9A; (+) strand; PAM type: NRG; PAM sequence: CAG
taaactaaagagcttctgca

SEQ ID NO: 49783 - DNA, 20 bp, Artificial Sequence
  Description of Artificial Sequence: Synthetic oligonucleotide
  Target: SCN9A; (+) strand; PAM type: NRG; PAM sequence: CAG
acagcaaaataaactaccat

SEQ ID NO: 49784 - DNA, 20 bp, Artificial Sequence
  Description of Artificial Sequence: Synthetic oligonucleotide
  Target: SCN9A; (+) strand; PAM type: NRG; PAM sequence: GAG
agcaaaataaactaccatca

SEQ ID NO: 49785 - DNA, 20 bp, Artificial Sequence
  Description of Artificial Sequence: Synthetic oligonucleotide
  Target: SCN9A; (+) strand; PAM type: NRG; PAM sequence: TGG
tgaacatgcaacctacaaaa

SEQ ID NO: 49786 - DNA, 20 bp, Artificial Sequence
  Description of Artificial Sequence: Synthetic oligonucleotide
  Target: SCN9A; (+) strand; PAM type: NRG; PAM sequence: GGG
gaacatgcaacctacaaaat

SEQ ID NO: 49787 - DNA, 20 bp, Artificial Sequence
  Description of Artificial Sequence: Synthetic oligonucleotide
  Target: SCN9A; (+) strand; PAM type: NRG; PAM sequence: GAG
acatgcaacctacaaaatgg

SEQ ID NO: 49788 - DNA, 20 bp, Artificial Sequence
  Description of Artificial Sequence: Synthetic oligonucleotide
  Target: SCN9A; (+) strand; PAM type: NRG; PAM sequence: AAG
gcaacctactcatctgacaa

SEQ ID NO: 49789 - DNA, 20 bp, Artificial Sequence
  Description of Artificial Sequence: Synthetic oligonucleotide
  Target: SCN9A; (+) strand; PAM type: NRG; PAM sequence: AGG
caacctactcatctgacaaa

SEQ ID NO: 49790 - DNA, 20 bp, Artificial Sequence
  Description of Artificial Sequence: Synthetic oligonucleotide
  Target: SCN9A; (+) strand; PAM type: NRG; PAM sequence: CAG
tctgacaaaaggctaatatc

SEQ ID NO: 49791 - DNA, 20 bp, Artificial Sequence
  Description of Artificial Sequence: Synthetic oligonucleotide
  Target: SCN9A; (+) strand; PAM type: NRG; PAM sequence: AAG
atgaactcaaacaaatttac

SEQ ID NO: 49792 - DNA, 20 bp, Artificial Sequence
  Description of Artificial Sequence: Synthetic oligonucleotide
  Target: SCN9A; (+) strand; PAM type: NRG; PAM sequence: AAG
aaacaaacaaccccatcaaa

SEQ ID NO: 49793 - DNA, 20 bp, Artificial Sequence
  Description of Artificial Sequence: Synthetic oligonucleotide
  Target: SCN9A; (+) strand; PAM type: NRG; PAM sequence: TGG
caaacaaccccatcaaaaag

SEQ ID NO: 49794 - DNA, 20 bp, Artificial Sequence
  Description of Artificial Sequence: Synthetic oligonucleotide
  Target: SCN9A; (+) strand; PAM type: NRG; PAM sequence: GGG
aaacaaccccatcaaaaagt

SEQ ID NO: 49795 - DNA, 20 bp, Artificial Sequence
  Description of Artificial Sequence: Synthetic oligonucleotide
  Target: SCN9A; (+) strand; PAM type: NRG; PAM sequence: AAG
accccatcaaaaagtgggca

SEQ ID NO: 49796 - DNA, 20 bp, Artificial Sequence
  Description of Artificial Sequence: Synthetic oligonucleotide
  Target: SCN9A; (+) strand; PAM type: NRG; PAM sequence: AGG
ccccatcaaaaagtgggcaa

SEQ ID NO: 49797 - DNA, 20 bp, Artificial Sequence
  Description of Artificial Sequence: Synthetic oligonucleotide
  Target: SCN9A; (+) strand; PAM type: NRG; PAM sequence: CAG
aagtgggcaaaggacatgaa

SEQ ID NO: 49798 - DNA, 20 bp, Artificial Sequence
  Description of Artificial Sequence: Synthetic oligonucleotide
  Target: SCN9A; (+) strand; PAM type: NRG; PAM sequence: AAG
catgaacagacacttctcaa

SEQ ID NO: 49799 - DNA, 20 bp, Artificial Sequence
  Description of Artificial Sequence: Synthetic oligonucleotide
  Target: SCN9A; (+) strand; PAM type: NRG; PAM sequence: AAG
gaacagacacttctcaaaag

SEQ ID NO: 49800 - DNA, 20 bp, Artificial Sequence
  Description of Artificial Sequence: Synthetic oligonucleotide
  Target: SCN9A; (+) strand; PAM type: NRG; PAM sequence: CAG
ctcaaaagaagacatttatg

SEQ ID NO: 49801 - DNA, 20 bp, Artificial Sequence
  Description of Artificial Sequence: Synthetic oligonucleotide
  Target: SCN9A; (+) strand; PAM type: NRG; PAM sequence: TGG
gaaaaaatgctcatcatcac

SEQ ID NO: 49802 - DNA, 20 bp, Artificial Sequence
  Description of Artificial Sequence: Synthetic oligonucleotide
  Target: SCN9A; (+) strand; PAM type: NRG; PAM sequence: CAG
tgctcatcatcactggccat

SEQ ID NO: 49803 - DNA, 20 bp, Artificial Sequence
  Description of Artificial Sequence: Synthetic oligonucleotide
  Target: SCN9A; (+) strand; PAM type: NRG; PAM sequence: GAG
ctcatcatcactggccatca

SEQ ID NO: 49804 - DNA, 20 bp, Artificial Sequence
  Description of Artificial Sequence: Synthetic oligonucleotide
  Target: SCN9A; (+) strand; PAM type: NRG; PAM sequence: GAG
atgcaaatcaaaaccacaat

SEQ ID NO: 49805 - DNA, 20 bp, Artificial Sequence
  Description of Artificial Sequence: Synthetic oligonucleotide
  Target: SCN9A; (+) strand; PAM type: NRG; PAM sequence: CAG
aatgagataccatctcacac

SEQ ID NO: 49806 - DNA, 20 bp, Artificial Sequence
  Description of Artificial Sequence: Synthetic oligonucleotide
  Target: SCN9A; (+) strand; PAM type: NRG; PAM sequence: TAG
agataccatctcacaccagt

SEQ ID NO: 49807 - DNA, 20 bp, Artificial Sequence
  Description of Artificial Sequence: Synthetic oligonucleotide
  Target: SCN9A; (+) strand; PAM type: NRG; PAM sequence: TGG
ccatctcacaccagttagaa

SEQ ID NO: 49808 - DNA, 20 bp, Artificial Sequence
  Description of Artificial Sequence: Synthetic oligonucleotide
  Target: SCN9A; (+) strand; PAM type: NRG; PAM sequence: AAG
ttagaatggcaatcattaaa

SEQ ID NO: 49809 - DNA, 20 bp, Artificial Sequence
  Description of Artificial Sequence: Synthetic oligonucleotide
  Target: SCN9A; (+) strand; PAM type: NRG; PAM sequence: CAG
aatggcaatcattaaaaagt

SEQ ID NO: 49810 - DNA, 20 bp, Artificial Sequence
  Description of Artificial Sequence: Synthetic oligonucleotide
  Target: SCN9A; (+) strand; PAM type: NRG; PAM sequence: AGG
atggcaatcattaaaaagtc

SEQ ID NO: 49811 - DNA, 20 bp, Artificial Sequence
  Description of Artificial Sequence: Synthetic oligonucleotide
  Target: SCN9A; (+) strand; PAM type: NRG; PAM sequence: CAG
attaaaaagtcaggaaacaa

SEQ ID NO: 49812 - DNA, 20 bp, Artificial Sequence
  Description of Artificial Sequence: Synthetic oligonucleotide
  Target: SCN9A; (+) strand; PAM type: NRG; PAM sequence: AGG
ttaaaaagtcaggaaacaac

SEQ ID NO: 49813 - DNA, 20 bp, Artificial Sequence
  Description of Artificial Sequence: Synthetic oligonucleotide
  Target: SCN9A; (+) strand; PAM type: NRG; PAM sequence: TGG
agtcaggaaacaacaggtgc

SEQ ID NO: 49814 - DNA, 20 bp, Artificial Sequence
  Description of Artificial Sequence: Synthetic oligonucleotide
  Target: SCN9A; (+) strand; PAM type: NRG; PAM sequence: GAG
tcaggaaacaacaggtgctg

SEQ ID NO: 49815 - DNA, 20 bp, Artificial Sequence
  Description of Artificial Sequence: Synthetic oligonucleotide
  Target: SCN9A; (+) strand; PAM type: NRG; PAM sequence: GAG
aggaaacaacaggtgctgga

SEQ ID NO: 49816 - DNA, 20 bp, Artificial Sequence
  Description of Artificial Sequence: Synthetic oligonucleotide
  Target: SCN9A; (+) strand; PAM type: NRG; PAM sequence: AGG
ggaaacaacaggtgctggag

SEQ ID NO: 49817 - DNA, 20 bp, Artificial Sequence
  Description of Artificial Sequence: Synthetic oligonucleotide
  Target: SCN9A; (+) strand; PAM type: NRG; PAM sequence: TGG
aacaggtgctggagaggatg

SEQ ID NO: 49818 - DNA, 20 bp, Artificial Sequence
  Description of Artificial Sequence: Synthetic oligonucleotide
  Target: SCN9A; (+) strand; PAM type: NRG; PAM sequence: GAG
caggtgctggagaggatgtg

SEQ ID NO: 49819 - DNA, 20 bp, Artificial Sequence
  Description of Artificial Sequence: Synthetic oligonucleotide
  Target: SCN9A; (+) strand; PAM type: NRG; PAM sequence: TAG
ctggagaggatgtggagaaa

SEQ ID NO: 49820 - DNA, 20 bp, Artificial Sequence
  Description of Artificial Sequence: Synthetic oligonucleotide
  Target: SCN9A; (+) strand; PAM type: NRG; PAM sequence: AGG
tggagaggatgtggagaaat

SEQ ID NO: 49821 - DNA, 20 bp, Artificial Sequence
  Description of Artificial Sequence: Synthetic oligonucleotide
  Target: SCN9A; (+) strand; PAM type: NRG; PAM sequence: TGG
taggaacacttttacactgt

SEQ ID NO: 49822 - DNA, 20 bp, Artificial Sequence
  Description of Artificial Sequence: Synthetic oligonucleotide
  Target: SCN9A; (+) strand; PAM type: NRG; PAM sequence: TGG
gaacacttttacactgttgg

SEQ ID NO: 49823 - DNA, 20 bp, Artificial Sequence
  Description of Artificial Sequence: Synthetic oligonucleotide
  Target: SCN9A; (+) strand; PAM type: NRG; PAM sequence: TAG
ttacactgttggtggtaaac

SEQ ID NO: 49824 - DNA, 20 bp, Artificial Sequence
  Description of Artificial Sequence: Synthetic oligonucleotide
  Target: SCN9A; (+) strand; PAM type: NRG; PAM sequence: TGG
gtaaactagttcaaccattg

SEQ ID NO: 49825 - DNA, 20 bp, Artificial Sequence
  Description of Artificial Sequence: Synthetic oligonucleotide
  Target: SCN9A; (+) strand; PAM type: NRG; PAM sequence: AAG
aactagttcaaccattgtgg

SEQ ID NO: 49826 - DNA, 20 bp, Artificial Sequence
  Description of Artificial Sequence: Synthetic oligonucleotide
  Target: SCN9A; (+) strand; PAM type: NRG; PAM sequence: CAG
agttcaaccattgtggaagt

SEQ ID NO: 49827 - DNA, 20 bp, Artificial Sequence
  Description of Artificial Sequence: Synthetic oligonucleotide
  Target: SCN9A; (+) strand; PAM type: NRG; PAM sequence: TGG
aaccattgtggaagtcagtg

SEQ ID NO: 49828 - DNA, 20 bp, Artificial Sequence
  Description of Artificial Sequence: Synthetic oligonucleotide
  Target: SCN9A; (+) strand; PAM type: NRG; PAM sequence: CAG
aagtcagtgtggcgattcct

SEQ ID NO: 49829 - DNA, 20 bp, Artificial Sequence
  Description of Artificial Sequence: Synthetic oligonucleotide
  Target: SCN9A; (+) strand; PAM type: NRG; PAM sequence: AGG
agtcagtgtggcgattcctc

SEQ ID NO: 49830 - DNA, 20 bp, Artificial Sequence
  Description of Artificial Sequence: Synthetic oligonucleotide
  Target: SCN9A; (+) strand; PAM type: NRG; PAM sequence: GGG
gtcagtgtggcgattcctca

SEQ ID NO: 49831 - DNA, 20 bp, Artificial Sequence
  Description of Artificial Sequence: Synthetic oligonucleotide
  Target: SCN9A; (+) strand; PAM type: NRG; PAM sequence: TAG
gtggcgattcctcagggatc

SEQ ID NO: 49832 - DNA, 20 bp, Artificial Sequence
  Description of Artificial Sequence: Synthetic oligonucleotide
  Target: SCN9A; (+) strand; PAM type: NRG; PAM sequence: TAG
attcctcagggatctagaac

SEQ ID NO: 49833 - DNA, 20 bp, Artificial Sequence
  Description of Artificial Sequence: Synthetic oligonucleotide
  Target: SCN9A; (+) strand; PAM type: NRG; PAM sequence: CAG
actagaaataccatttgacc

SEQ ID NO: 49834 - DNA, 20 bp, Artificial Sequence
  Description of Artificial Sequence: Synthetic oligonucleotide
  Target: SCN9A; (+) strand; PAM type: NRG; PAM sequence: TGG
tgacccagccatcccattac

SEQ ID NO: 49835 - DNA, 20 bp, Artificial Sequence
  Description of Artificial Sequence: Synthetic oligonucleotide
  Target: SCN9A; (+) strand; PAM type: NRG; PAM sequence: GGG
gacccagccatcccattact

SEQ ID NO: 49836 - DNA, 20 bp, Artificial Sequence
  Description of Artificial Sequence: Synthetic oligonucleotide
  Target: SCN9A; (+) strand; PAM type: NRG; PAM sequence: AAG
cattactgggtatataccca

SEQ ID NO: 49837 - DNA, 20 bp, Artificial Sequence
  Description of Artificial Sequence: Synthetic oligonucleotide
  Target: SCN9A; (+) strand; PAM type: NRG; PAM sequence: AGG
attactgggtatatacccaa

SEQ ID NO: 49838 - DNA, 20 bp, Artificial Sequence
  Description of Artificial Sequence: Synthetic oligonucleotide
  Target: SCN9A; (+) strand; PAM type: NRG; PAM sequence: AAG
ctataaatcatgctgctata

SEQ ID NO: 49839 - DNA, 20 bp, Artificial Sequence
  Description of Artificial Sequence: Synthetic oligonucleotide
  Target: SCN9A; (+) strand; PAM type: NRG; PAM sequence: TGG
atgcacacatatgtttattg

SEQ ID NO: 49840 - DNA, 20 bp, Artificial Sequence
  Description of Artificial Sequence: Synthetic oligonucleotide
  Target: SCN9A; (+) strand; PAM type: NRG; PAM sequence: TAG
tattgtggcattattcacaa

SEQ ID NO: 49841 - DNA, 20 bp, Artificial Sequence
  Description of Artificial Sequence: Synthetic oligonucleotide
  Target: SCN9A; (+) strand; PAM type: NRG; PAM sequence: TGG
tattcacaatagcaaacact

SEQ ID NO: 49842 - DNA, 20 bp, Artificial Sequence
  Description of Artificial Sequence: Synthetic oligonucleotide
  Target: SCN9A; (+) strand; PAM type: NRG; PAM sequence: TAG
acccaaatgtccaacaatga

SEQ ID NO: 49843 - DNA, 20 bp, Artificial Sequence
  Description of Artificial Sequence: Synthetic oligonucleotide
  Target: SCN9A; (+) strand; PAM type: NRG; PAM sequence: TGG
aatgtccaacaatgatagac

SEQ ID NO: 49844 - DNA, 20 bp, Artificial Sequence
  Description of Artificial Sequence: Synthetic oligonucleotide
  Target: SCN9A; (+) strand; PAM type: NRG; PAM sequence: AAG
caacaatgatagactggatt

SEQ ID NO: 49845 - DNA, 20 bp, Artificial Sequence
  Description of Artificial Sequence: Synthetic oligonucleotide
  Target: SCN9A; (+) strand; PAM type: NRG; PAM sequence: TGG
tagactggattaagaaaatg

SEQ ID NO: 49846 - DNA, 20 bp, Artificial Sequence
  Description of Artificial Sequence: Synthetic oligonucleotide
  Target: SCN9A; (+) strand; PAM type: NRG; PAM sequence: TGG
aatgtggctcatatacacca

SEQ ID NO: 49847 - DNA, 20 bp, Artificial Sequence
  Description of Artificial Sequence: Synthetic oligonucleotide
  Target: SCN9A; (+) strand; PAM type: NRG; PAM sequence: CAG
atacaccatggaatactatg

SEQ ID NO: 49848 - DNA, 20 bp, Artificial Sequence
  Description of Artificial Sequence: Synthetic oligonucleotide
  Target: SCN9A; (+) strand; PAM type: NRG; PAM sequence: GAG
atgcagccataaaaaatgat

SEQ ID NO: 49849 - DNA, 20 bp, Artificial Sequence
  Description of Artificial Sequence: Synthetic oligonucleotide
  Target: SCN9A; (+) strand; PAM type: NRG; PAM sequence: TAG
tgatgagttcacgtcctttg

SEQ ID NO: 49850 - DNA, 20 bp, Artificial Sequence
  Description of Artificial Sequence: Synthetic oligonucleotide
  Target: SCN9A; (+) strand; PAM type: NRG; PAM sequence: AGG
gatgagttcacgtcctttgt

SEQ ID NO: 49851 - DNA, 20 bp, Artificial Sequence
  Description of Artificial Sequence: Synthetic oligonucleotide
  Target: SCN9A; (+) strand; PAM type: NRG; PAM sequence: GGG
atgagttcacgtcctttgta

SEQ ID NO: 49852 - DNA, 20 bp, Artificial Sequence
  Description of Artificial Sequence: Synthetic oligonucleotide
  Target: SCN9A; (+) strand; PAM type: NRG; PAM sequence: TGG
tcacgtcctttgtagggaca

SEQ ID NO: 49853 - DNA, 20 bp, Artificial Sequence
  Description of Artificial Sequence: Synthetic oligonucleotide
  Target: SCN9A; (+) strand; PAM type: NRG; PAM sequence: TGG
tgtagggacatggatgcaat

SEQ ID NO: 49854 - DNA, 20 bp, Artificial Sequence
  Description of Artificial Sequence: Synthetic oligonucleotide
  Target: SCN9A; (+) strand; PAM type: NRG; PAM sequence: CAG
caattggaaatcatcattct

SEQ ID NO: 49855 - DNA, 20 bp, Artificial Sequence
  Description of Artificial Sequence: Synthetic oligonucleotide
  Target: SCN9A; (+) strand; PAM type: NRG; PAM sequence: AAG
cattctcagtaaactatcac

SEQ ID NO: 49856 - DNA, 20 bp, Artificial Sequence
  Description of Artificial Sequence: Synthetic oligonucleotide
  Target: SCN9A; (+) strand; PAM type: NRG; PAM sequence: TAG
acaccgcatattctcactca

SEQ ID NO: 49857 - DNA, 20 bp, Artificial Sequence
  Description of Artificial Sequence: Synthetic oligonucleotide
  Target: SCN9A; (+) strand; PAM type: NRG; PAM sequence: AGG
caccgcatattctcactcat

SEQ ID NO: 49858 - DNA, 20 bp, Artificial Sequence
  Description of Artificial Sequence: Synthetic oligonucleotide
  Target: SCN9A; (+) strand; PAM type: NRG; PAM sequence: TGG
cgcatattctcactcatagg

SEQ ID NO: 49859 - DNA, 20 bp, Artificial Sequence
  Description of Artificial Sequence: Synthetic oligonucleotide
  Target: SCN9A; (+) strand; PAM type: NRG; PAM sequence: GGG
gcatattctcactcataggt

SEQ ID NO: 49860 - DNA, 20 bp, Artificial Sequence
  Description of Artificial Sequence: Synthetic oligonucleotide
  Target: SCN9A; (+) strand; PAM type: NRG; PAM sequence: TGG
aattgaacaatgaaatcaca

SEQ ID NO: 49861 - DNA, 20 bp, Artificial Sequence
  Description of Artificial Sequence: Synthetic oligonucleotide
  Target: SCN9A; (+) strand; PAM type: NRG; PAM sequence: CAG
acaatgaaatcacatggaca

SEQ ID NO: 49862 - DNA, 20 bp, Artificial Sequence
  Description of Artificial Sequence: Synthetic oligonucleotide
  Target: SCN9A; (+) strand; PAM type: NRG; PAM sequence: AGG
caatgaaatcacatggacac

SEQ ID NO: 49863 - DNA, 20 bp, Artificial Sequence
  Description of Artificial Sequence: Synthetic oligonucleotide
  Target: SCN9A; (+) strand; PAM type: NRG; PAM sequence: AAG
tgaaatcacatggacacagg

SEQ ID NO: 49864 - DNA, 20 bp, Artificial Sequence
  Description of Artificial Sequence: Synthetic oligonucleotide
  Target: SCN9A; (+) strand; PAM type: NRG; PAM sequence: AGG
gaaatcacatggacacagga

SEQ ID NO: 49865 - DNA, 20 bp, Artificial Sequence
  Description of Artificial Sequence: Synthetic oligonucleotide
  Target: SCN9A; (+) strand; PAM type: NRG; PAM sequence: GGG
aaatcacatggacacaggaa

SEQ ID NO: 49866 - DNA, 20 bp, Artificial Sequence
  Description of Artificial Sequence: Synthetic oligonucleotide
  Target: SCN9A; (+) strand; PAM type: NRG; PAM sequence: GGG
aatcacatggacacaggaag

SEQ ID NO: 49867 - DNA, 20 bp, Artificial Sequence
  Description of Artificial Sequence: Synthetic oligonucleotide
  Target: SCN9A; (+) strand; PAM type: NRG; PAM sequence: TAG
ggaaggggaatatcacactc

SEQ ID NO: 49868 - DNA, 20 bp, Artificial Sequence
  Description of Artificial Sequence: Synthetic oligonucleotide
  Target: SCN9A; (+) strand; PAM type: NRG; PAM sequence: AGG
gaaggggaatatcacactct

SEQ ID NO: 49869 - DNA, 20 bp, Artificial Sequence
  Description of Artificial Sequence: Synthetic oligonucleotide
  Target: SCN9A; (+) strand; PAM type: NRG; PAM sequence: GGG
aaggggaatatcacactcta

SEQ ID NO: 49870 - DNA, 20 bp, Artificial Sequence
  Description of Artificial Sequence: Synthetic oligonucleotide
  Target: SCN9A; (+) strand; PAM type: NRG; PAM sequence: TGG
atatcacactctagggactg

SEQ ID NO: 49871 - DNA, 20 bp, Artificial Sequence
  Description of Artificial Sequence: Synthetic oligonucleotide
  Target: SCN9A; (+) strand; PAM type: NRG; PAM sequence: TGG
tcacactctagggactgtgg

SEQ ID NO: 49872 - DNA, 20 bp, Artificial Sequence
  Description of Artificial Sequence: Synthetic oligonucleotide
  Target: SCN9A; (+) strand; PAM type: NRG; PAM sequence: GGG
cacactctagggactgtggt

SEQ ID NO: 49873 - DNA, 20 bp, Artificial Sequence
  Description of Artificial Sequence: Synthetic oligonucleotide
  Target: SCN9A; (+) strand; PAM type: NRG; PAM sequence: GGG
acactctagggactgtggtg

SEQ ID NO: 49874 - DNA, 20 bp, Artificial Sequence
  Description of Artificial Sequence: Synthetic oligonucleotide
  Target: SCN9A; (+) strand; PAM type: NRG; PAM sequence: TGG
ctctagggactgtggtgggg

SEQ ID NO: 49875 - DNA, 20 bp, Artificial Sequence
  Description of Artificial Sequence: Synthetic oligonucleotide
  Target: SCN9A; (+) strand; PAM type: NRG; PAM sequence: GGG
tctagggactgtggtggggt

SEQ ID NO: 49876 - DNA, 20 bp, Artificial Sequence
  Description of Artificial Sequence: Synthetic oligonucleotide
  Target: SCN9A; (+) strand; PAM type: NRG; PAM sequence: GGG
ctagggactgtggtggggtg

SEQ ID NO: 49877 - DNA, 20 bp, Artificial Sequence
  Description of Artificial Sequence: Synthetic oligonucleotide
  Target: SCN9A; (+) strand; PAM type: NRG; PAM sequence: GGG
tagggactgtggtggggtgg

SEQ ID NO: 49878 - DNA, 20 bp, Artificial Sequence
  Description of Artificial Sequence: Synthetic oligonucleotide
  Target: SCN9A; (+) strand; PAM type: NRG; PAM sequence: GGG
agggactgtggtggggtggg

SEQ ID NO: 49879 - DNA, 20 bp, Artificial Sequence
  Description of Artificial Sequence: Synthetic oligonucleotide
  Target: SCN9A; (+) strand; PAM type: NRG; PAM sequence: GAG
ggactgtggtggggtggggg

SEQ ID NO: 49880 - DNA, 20 bp, Artificial Sequence
  Description of Artificial Sequence: Synthetic oligonucleotide
  Target: SCN9A; (+) strand; PAM type: NRG; PAM sequence: AGG
gactgtggtggggtgggggg

SEQ ID NO: 49881 - DNA, 20 bp, Artificial Sequence
  Description of Artificial Sequence: Synthetic oligonucleotide
  Target: SCN9A; (+) strand; PAM type: NRG; PAM sequence: GGG
actgtggtggggtgggggga

SEQ ID NO: 49882 - DNA, 20 bp, Artificial Sequence
  Description of Artificial Sequence: Synthetic oligonucleotide
  Target: SCN9A; (+) strand; PAM type: NRG; PAM sequence: GGG
ctgtggtggggtggggggag

SEQ ID NO: 49883 - DNA, 20 bp, Artificial Sequence
  Description of Artificial Sequence: Synthetic oligonucleotide
  Target: SCN9A; (+) strand; PAM type: NRG; PAM sequence: GGG
tgtggtggggtggggggagg

SEQ ID NO: 49884 - DNA, 20 bp, Artificial Sequence
  Description of Artificial Sequence: Synthetic oligonucleotide
  Target: SCN9A; (+) strand; PAM type: NRG; PAM sequence: GGG
gtggtggggtggggggaggg

SEQ ID NO: 49885 - DNA, 20 bp, Artificial Sequence
  Description of Artificial Sequence: Synthetic oligonucleotide
  Target: SCN9A; (+) strand; PAM type: NRG; PAM sequence: GAG
ggtggggtggggggaggggg

SEQ ID NO: 49886 - DNA, 20 bp, Artificial Sequence
  Description of Artificial Sequence: Synthetic oligonucleotide
  Target: SCN9A; (+) strand; PAM type: NRG; PAM sequence: AGG
gtggggtggggggagggggg

SEQ ID NO: 49887 - DNA, 20 bp, Artificial Sequence
  Description of Artificial Sequence: Synthetic oligonucleotide
  Target: SCN9A; (+) strand; PAM type: NRG; PAM sequence: GGG
tggggtggggggagggggga

SEQ ID NO: 49888 - DNA, 20 bp, Artificial Sequence
  Description of Artificial Sequence: Synthetic oligonucleotide
  Target: SCN9A; (+) strand; PAM type: NRG; PAM sequence: TAG
gtggggggaggggggaggga

SEQ ID NO: 49889 - DNA, 20 bp, Artificial Sequence
  Description of Artificial Sequence: Synthetic oligonucleotide
  Target: SCN9A; (+) strand; PAM type: NRG; PAM sequence: TGG
ggaggggggagggatagcat

SEQ ID NO: 49890 - DNA, 20 bp, Artificial Sequence
  Description of Artificial Sequence: Synthetic oligonucleotide
  Target: SCN9A; (+) strand; PAM type: NRG; PAM sequence: GGG
gaggggggagggatagcatt

SEQ ID NO: 49891 - DNA, 20 bp, Artificial Sequence
  Description of Artificial Sequence: Synthetic oligonucleotide
  Target: SCN9A; (+) strand; PAM type: NRG; PAM sequence: GAG
ggggggagggatagcattgg

SEQ ID NO: 49892 - DNA, 20 bp, Artificial Sequence
  Description of Artificial Sequence: Synthetic oligonucleotide
  Target: SCN9A; (+) strand; PAM type: NRG; PAM sequence: TAG
ttgggagatatacctaatgc

SEQ ID NO: 49893 - DNA, 20 bp, Artificial Sequence
  Description of Artificial Sequence: Synthetic oligonucleotide
  Target: SCN9A; (+) strand; PAM type: NRG; PAM sequence: CAG
tatacctaatgctagatgac

SEQ ID NO: 49894 - DNA, 20 bp, Artificial Sequence
  Description of Artificial Sequence: Synthetic oligonucleotide
  Target: SCN9A; (+) strand; PAM type: NRG; PAM sequence: TAG
cctaatgctagatgaccagt

SEQ ID NO: 49895 - DNA, 20 bp, Artificial Sequence
  Description of Artificial Sequence: Synthetic oligonucleotide
  Target: SCN9A; (+) strand; PAM type: NRG; PAM sequence: TGG
aatgctagatgaccagttag

SEQ ID NO: 49896 - DNA, 20 bp, Artificial Sequence
  Description of Artificial Sequence: Synthetic oligonucleotide
  Target: SCN9A; (+) strand; PAM type: NRG; PAM sequence: GGG
atgctagatgaccagttagt

SEQ ID NO: 49897 - DNA, 20 bp, Artificial Sequence
  Description of Artificial Sequence: Synthetic oligonucleotide
  Target: SCN9A; (+) strand; PAM type: NRG; PAM sequence: CAG
agatgaccagttagtgggtg

SEQ ID NO: 49898 - DNA, 20 bp, Artificial Sequence
  Description of Artificial Sequence: Synthetic oligonucleotide
  Target: SCN9A; (+) strand; PAM type: NRG; PAM sequence: CAG
agttagtgggtgcagcgcac

SEQ ID NO: 49899 - DNA, 20 bp, Artificial Sequence
  Description of Artificial Sequence: Synthetic oligonucleotide
  Target: SCN9A; (+) strand; PAM type: NRG; PAM sequence: TGG
gtgggtgcagcgcaccagca

SEQ ID NO: 49900 - DNA, 20 bp, Artificial Sequence
  Description of Artificial Sequence: Synthetic oligonucleotide
  Target: SCN9A; (+) strand; PAM type: NRG; PAM sequence: AAG
cacatgtaccctaaaactta

SEQ ID NO: 49901 - DNA, 20 bp, Artificial Sequence
  Description of Artificial Sequence: Synthetic oligonucleotide
  Target: SCN9A; (+) strand; PAM type: NRG; PAM sequence: AAG
taattaaaaaaaaaaattaa

SEQ ID NO: 49902 - DNA, 20 bp, Artificial Sequence
  Description of Artificial Sequence: Synthetic oligonucleotide
  Target: SCN9A; (+) strand; PAM type: NRG; PAM sequence: TAG
ttaaaaaaaaaaattaaaag

SEQ ID NO: 49903 - DNA, 20 bp, Artificial Sequence
  Description of Artificial Sequence: Synthetic oligonucleotide
  Target: SCN9A; (+) strand; PAM type: NRG; PAM sequence: CAG
taaaagtagtatgccaatgc

SEQ ID NO: 49904 - DNA, 20 bp, Artificial Sequence
  Description of Artificial Sequence: Synthetic oligonucleotide
  Target: SCN9A; (+) strand; PAM type: NRG; PAM sequence: GAG
aaagtagtatgccaatgcca

SEQ ID NO: 49905 - DNA, 20 bp, Artificial Sequence
  Description of Artificial Sequence: Synthetic oligonucleotide
  Target: SCN9A; (+) strand; PAM type: NRG; PAM sequence: AAG
tttcaatgaaaaatttgaaa

SEQ ID NO: 49906 - DNA, 20 bp, Artificial Sequence
  Description of Artificial Sequence: Synthetic oligonucleotide
  Target: SCN9A; (+) strand; PAM type: NRG; PAM sequence: CAG
atgaaaaatttgaaaaagta

SEQ ID NO: 49907 - DNA, 20 bp, Artificial Sequence
  Description of Artificial Sequence: Synthetic oligonucleotide
  Target: SCN9A; (+) strand; PAM type: NRG; PAM sequence: TGG
atatatttaatttaacattc

SEQ ID NO: 49908 - DNA, 20 bp, Artificial Sequence
  Description of Artificial Sequence: Synthetic oligonucleotide
  Target: SCN9A; (+) strand; PAM type: NRG; PAM sequence: TGG
ttaacattctggtcatgata

SEQ ID NO: 49909 - DNA, 20 bp, Artificial Sequence
  Description of Artificial Sequence: Synthetic oligonucleotide
  Target: SCN9A; (+) strand; PAM type: NRG; PAM sequence: CAG
aatttaaaataatttttata

SEQ ID NO: 49910 - DNA, 20 bp, Artificial Sequence
  Description of Artificial Sequence: Synthetic oligonucleotide
  Target: SCN9A; (+) strand; PAM type: NRG; PAM sequence: AAG
ttaaaataatttttatacag

SEQ ID NO: 49911 - DNA, 20 bp, Artificial Sequence
  Description of Artificial Sequence: Synthetic oligonucleotide
  Target: SCN9A; (+) strand; PAM type: NRG; PAM sequence: AGG
taaaataatttttatacaga

SEQ ID NO: 49912 - DNA, 20 bp, Artificial Sequence
  Description of Artificial Sequence: Synthetic oligonucleotide
  Target: SCN9A; (+) strand; PAM type: NRG; PAM sequence: AAG
aataatttttatacagaagg

SEQ ID NO: 49913 - DNA, 20 bp, Artificial Sequence
  Description of Artificial Sequence: Synthetic oligonucleotide
  Target: SCN9A; (+) strand; PAM type: NRG; PAM sequence: CAG
tttatacagaaggaagccaa

SEQ ID NO: 49914 - DNA, 20 bp, Artificial Sequence
  Description of Artificial Sequence: Synthetic oligonucleotide
  Target: SCN9A; (+) strand; PAM type: NRG; PAM sequence: AAG
ccaacagaaactgaccactg

SEQ ID NO: 49915 - DNA, 20 bp, Artificial Sequence
  Description of Artificial Sequence: Synthetic oligonucleotide
  Target: SCN9A; (+) strand; PAM type: NRG; PAM sequence: TAG
aactcacctttttgtctgca

SEQ ID NO: 49916 - DNA, 20 bp, Artificial Sequence
  Description of Artificial Sequence: Synthetic oligonucleotide
  Target: SCN9A; (+) strand; PAM type: NRG; PAM sequence: TAG
tcacctttttgtctgcatag

SEQ ID NO: 49917 - DNA, 20 bp, Artificial Sequence
  Description of Artificial Sequence: Synthetic oligonucleotide
  Target: SCN9A; (+) strand; PAM type: NRG; PAM sequence: AGG
cacctttttgtctgcatagt

SEQ ID NO: 49918 - DNA, 20 bp, Artificial Sequence
  Description of Artificial Sequence: Synthetic oligonucleotide
  Target: SCN9A; (+) strand; PAM type: NRG; PAM sequence: GGG
acctttttgtctgcatagta

SEQ ID NO: 49919 - DNA, 20 bp, Artificial Sequence
  Description of Artificial Sequence: Synthetic oligonucleotide
  Target: SCN9A; (+) strand; PAM type: NRG; PAM sequence: GGG
cctttttgtctgcatagtag

SEQ ID NO: 49920 - DNA, 20 bp, Artificial Sequence
  Description of Artificial Sequence: Synthetic oligonucleotide
  Target: SCN9A; (+) strand; PAM type: NRG; PAM sequence: AAG
tgtctgcatagtaggggtcc

SEQ ID NO: 49921 - DNA, 20 bp, Artificial Sequence
  Description of Artificial Sequence: Synthetic oligonucleotide
  Target: SCN9A; (+) strand; PAM type: NRG; PAM sequence: CAG
tagtaggggtccaagtcctc

SEQ ID NO: 49922 - DNA, 20 bp, Artificial Sequence
  Description of Artificial Sequence: Synthetic oligonucleotide
  Target: SCN9A; (+) strand; PAM type: NRG; PAM sequence: AGG
agtaggggtccaagtcctcc

SEQ ID NO: 49923 - DNA, 20 bp, Artificial Sequence
  Description of Artificial Sequence: Synthetic oligonucleotide
  Target: SCN9A; (+) strand; PAM type: NRG; PAM sequence: GGG
gtaggggtccaagtcctcca

SEQ ID NO: 49924 - DNA, 20 bp, Artificial Sequence
  Description of Artificial Sequence: Synthetic oligonucleotide
  Target: SCN9A; (+) strand; PAM type: NRG; PAM sequence: GGG
taggggtccaagtcctccag

SEQ ID NO: 49925 - DNA, 20 bp, Artificial Sequence
  Description of Artificial Sequence: Synthetic oligonucleotide
  Target: SCN9A; (+) strand; PAM type: NRG; PAM sequence: CGG
caggggctctgacaccatgc

SEQ ID NO: 49926 - DNA, 20 bp, Artificial Sequence
  Description of Artificial Sequence: Synthetic oligonucleotide
  Target: SCN9A; (+) strand; PAM type: NRG; PAM sequence: GGG
aggggctctgacaccatgcc

SEQ ID NO: 49927 - DNA, 20 bp, Artificial Sequence
  Description of Artificial Sequence: Synthetic oligonucleotide
  Target: SCN9A; (+) strand; PAM type: NRG; PAM sequence: GAG
gggctctgacaccatgccgg

SEQ ID NO: 49928 - DNA, 20 bp, Artificial Sequence
  Description of Artificial Sequence: Synthetic oligonucleotide
  Target: SCN9A; (+) strand; PAM type: NRG; PAM sequence: AGG
ggctctgacaccatgccggg

SEQ ID NO: 49929 - DNA, 20 bp, Artificial Sequence
  Description of Artificial Sequence: Synthetic oligonucleotide
  Target: SCN9A; (+) strand; PAM type: NRG; PAM sequence: TAG
tgccgggaggaatgtcccca

SEQ ID NO: 49930 - DNA, 20 bp, Artificial Sequence
  Description of Artificial Sequence: Synthetic oligonucleotide
  Target: SCN9A; (+) strand; PAM type: NRG; PAM sequence: AAG
gaggaatgtccccatagatg

SEQ ID NO: 49931 - DNA, 20 bp, Artificial Sequence
  Description of Artificial Sequence: Synthetic oligonucleotide
  Target: SCN9A; (+) strand; PAM type: NRG; PAM sequence: AGG
aggaatgtccccatagatga

SEQ ID NO: 49932 - DNA, 20 bp, Artificial Sequence
  Description of Artificial Sequence: Synthetic oligonucleotide
  Target: SCN9A; (+) strand; PAM type: NRG; PAM sequence: GGG
ggaatgtccccatagatgaa

SEQ ID NO: 49933 - DNA, 20 bp, Artificial Sequence
  Description of Artificial Sequence: Synthetic oligonucleotide
  Target: SCN9A; (+) strand; PAM type: NRG; PAM sequence: CAG
atgtccccatagatgaaggg

SEQ ID NO: 49934 - DNA, 20 bp, Artificial Sequence
  Description of Artificial Sequence: Synthetic oligonucleotide
  Target: SCN9A; (+) strand; PAM type: NRG; PAM sequence: CAG
gatgaagggcagctgtttgc

SEQ ID NO: 49935 - DNA, 20 bp, Artificial Sequence
  Description of Artificial Sequence: Synthetic oligonucleotide
  Target: SCN9A; (+) strand; PAM type: NRG; PAM sequence: AAG
gcagctgtttgccagcttcc

SEQ ID NO: 49936 - DNA, 20 bp, Artificial Sequence
  Description of Artificial Sequence: Synthetic oligonucleotide
  Target: SCN9A; (+) strand; PAM type: NRG; PAM sequence: TGG
ccagcttccaagtcactgct

SEQ ID NO: 49937 - DNA, 20 bp, Artificial Sequence
  Description of Artificial Sequence: Synthetic oligonucleotide
  Target: SCN9A; (+) strand; PAM type: NRG; PAM sequence: TGG
tccaagtcactgcttggctt

SEQ ID NO: 49938 - DNA, 20 bp, Artificial Sequence
  Description of Artificial Sequence: Synthetic oligonucleotide
  Target: SCN9A; (+) strand; PAM type: NRG; PAM sequence: GGG
ccaagtcactgcttggcttt

SEQ ID NO: 49939 - DNA, 20 bp, Artificial Sequence
  Description of Artificial Sequence: Synthetic oligonucleotide
  Target: SCN9A; (+) strand; PAM type: NRG; PAM sequence: GGG
caagtcactgcttggctttg

SEQ ID NO: 49940 - DNA, 20 bp, Artificial Sequence
  Description of Artificial Sequence: Synthetic oligonucleotide
  Target: SCN9A; (+) strand; PAM type: NRG; PAM sequence: TGG
atcatctttcttttcttctt

SEQ ID NO: 49941 - DNA, 20 bp, Artificial Sequence
  Description of Artificial Sequence: Synthetic oligonucleotide
  Target: SCN9A; (+) strand; PAM type: NRG; PAM sequence: GGG
tcatctttcttttcttcttt

SEQ ID NO: 49942 - DNA, 20 bp, Artificial Sequence
  Description of Artificial Sequence: Synthetic oligonucleotide
  Target: SCN9A; (+) strand; PAM type: NRG; PAM sequence: CAG
gggttcctttgattttcttt

SEQ ID NO: 49943 - DNA, 20 bp, Artificial Sequence
  Description of Artificial Sequence: Synthetic oligonucleotide
  Target: SCN9A; (+) strand; PAM type: NRG; PAM sequence: GAG
tcagcaatgcgttgttcaat

SEQ ID NO: 49944 - DNA, 20 bp, Artificial Sequence
  Description of Artificial Sequence: Synthetic oligonucleotide
  Target: SCN9A; (+) strand; PAM type: NRG; PAM sequence: AGG
cagcaatgcgttgttcaatg

SEQ ID NO: 49945 - DNA, 20 bp, Artificial Sequence
  Description of Artificial Sequence: Synthetic oligonucleotide
  Target: SCN9A; (+) strand; PAM type: NRG; PAM sequence: GGG
agcaatgcgttgttcaatga

SEQ ID NO: 49946 - DNA, 20 bp, Artificial Sequence
  Description of Artificial Sequence: Synthetic oligonucleotide
  Target: SCN9A; (+) strand; PAM type: NRG; PAM sequence: AAG
atgcgttgttcaatgagggc

SEQ ID NO: 49947 - DNA, 20 bp, Artificial Sequence
  Description of Artificial Sequence: Synthetic oligonucleotide
  Target: SCN9A; (+) strand; PAM type: NRG; PAM sequence: GAG
gcgttgttcaatgagggcaa

SEQ ID NO: 49948 - DNA, 20 bp, Artificial Sequence
  Description of Artificial Sequence: Synthetic oligonucleotide
  Target: SCN9A; (+) strand; PAM type: NRG; PAM sequence: TGG
caagagactgttttgtgaaa

SEQ ID NO: 49949 - DNA, 20 bp, Artificial Sequence
  Description of Artificial Sequence: Synthetic oligonucleotide
  Target: SCN9A; (+) strand; PAM type: NRG; PAM sequence: AAG
actgttttgtgaaatggaca

SEQ ID NO: 49950 - DNA, 20 bp, Artificial Sequence
  Description of Artificial Sequence: Synthetic oligonucleotide
  Target: SCN9A; (+) strand; PAM type: NRG; PAM sequence: GAG
tgtgaaatggacaaagctct

SEQ ID NO: 49951 - DNA, 20 bp, Artificial Sequence
  Description of Artificial Sequence: Synthetic oligonucleotide
  Target: SCN9A; (+) strand; PAM type: NRG; PAM sequence: AGG
gtgaaatggacaaagctctg

SEQ ID NO: 49952 - DNA, 20 bp, Artificial Sequence
  Description of Artificial Sequence: Synthetic oligonucleotide
  Target: SCN9A; (+) strand; PAM type: NRG; PAM sequence: TGG
tggacaaagctctgaggtcc

SEQ ID NO: 49953 - DNA, 20 bp, Artificial Sequence
  Description of Artificial Sequence: Synthetic oligonucleotide
  Target: SCN9A; (+) strand; PAM type: NRG; PAM sequence: GGG
ggacaaagctctgaggtcct

SEQ ID NO: 49954 - DNA, 20 bp, Artificial Sequence
  Description of Artificial Sequence: Synthetic oligonucleotide
  Target: SCN9A; (+) strand; PAM type: NRG; PAM sequence: GGG
gacaaagctctgaggtcctg

SEQ ID NO: 49955 - DNA, 20 bp, Artificial Sequence
  Description of Artificial Sequence: Synthetic oligonucleotide
  Target: SCN9A; (+) strand; PAM type: NRG; PAM sequence: GGG
acaaagctctgaggtcctgg

SEQ ID NO: 49956 - DNA, 20 bp, Artificial Sequence
  Description of Artificial Sequence: Synthetic oligonucleotide
  Target: SCN9A; (+) strand; PAM type: NRG; PAM sequence: GAG
aaagctctgaggtcctgggg

SEQ ID NO: 49957 - DNA, 20 bp, Artificial Sequence
  Description of Artificial Sequence: Synthetic oligonucleotide
  Target: SCN9A; (+) strand; PAM type: NRG; PAM sequence: AGG
aagctctgaggtcctggggg

SEQ ID NO: 49958 - DNA, 20 bp, Artificial Sequence
  Description of Artificial Sequence: Synthetic oligonucleotide
  Target: SCN9A; (+) strand; PAM type: NRG; PAM sequence: CAG
tgtatattttaattcctctt

SEQ ID NO: 49959 - DNA, 20 bp, Artificial Sequence
  Description of Artificial Sequence: Synthetic oligonucleotide
  Target: SCN9A; (+) strand; PAM type: NRG; PAM sequence: AAG
tcctcttcagctcctcacat

SEQ ID NO: 49960 - DNA, 20 bp, Artificial Sequence
  Description of Artificial Sequence: Synthetic oligonucleotide
  Target: SCN9A; (+) strand; PAM type: NRG; PAM sequence: GAG
ctcttcagctcctcacataa

SEQ ID NO: 49961 - DNA, 20 bp, Artificial Sequence
  Description of Artificial Sequence: Synthetic oligonucleotide
  Target: SCN9A; (+) strand; PAM type: NRG; PAM sequence: AGG
tcttcagctcctcacataag

SEQ ID NO: 49962 - DNA, 20 bp, Artificial Sequence
  Description of Artificial Sequence: Synthetic oligonucleotide
  Target: SCN9A; (+) strand; PAM type: NRG; PAM sequence: TGG
agctcctcacataagaggcc

SEQ ID NO: 49963 - DNA, 20 bp, Artificial Sequence
  Description of Artificial Sequence: Synthetic oligonucleotide
  Target: SCN9A; (+) strand; PAM type: NRG; PAM sequence: TGG
cctcacataagaggcctgga

SEQ ID NO: 49964 - DNA, 20 bp, Artificial Sequence
  Description of Artificial Sequence: Synthetic oligonucleotide
  Target: SCN9A; (+) strand; PAM type: NRG; PAM sequence: AAG
aagaggcctggatggaaaca

SEQ ID NO: 49965 - DNA, 20 bp, Artificial Sequence
  Description of Artificial Sequence: Synthetic oligonucleotide
  Target: SCN9A; (+) strand; PAM type: NRG; PAM sequence: AAG
tggatggaaacaaagaaata

SEQ ID NO: 49966 - DNA, 20 bp, Artificial Sequence
  Description of Artificial Sequence: Synthetic oligonucleotide
  Target: SCN9A; (+) strand; PAM type: NRG; PAM sequence: AAG
gacttaactatttgcctgcc

SEQ ID NO: 49967 - DNA, 20 bp, Artificial Sequence
  Description of Artificial Sequence: Synthetic oligonucleotide
  Target: SCN9A; (+) strand; PAM type: NRG; PAM sequence: AAG
taactatttgcctgccaaga

SEQ ID NO: 49968 - DNA, 20 bp, Artificial Sequence
  Description of Artificial Sequence: Synthetic oligonucleotide
  Target: SCN9A; (+) strand; PAM type: NRG; PAM sequence: AGG
aactatttgcctgccaagaa

SEQ ID NO: 49969 - DNA, 20 bp, Artificial Sequence
  Description of Artificial Sequence: Synthetic oligonucleotide
  Target: SCN9A; (+) strand; PAM type: NRG; PAM sequence: CAG
actaataataacaacataaa

SEQ ID NO: 49970 - DNA, 20 bp, Artificial Sequence
  Description of Artificial Sequence: Synthetic oligonucleotide
  Target: SCN9A; (+) strand; PAM type: NRG; PAM sequence: TAG
taacaacataaacagatttt

SEQ ID NO: 49971 - DNA, 20 bp, Artificial Sequence
  Description of Artificial Sequence: Synthetic oligonucleotide
  Target: SCN9A; (+) strand; PAM type: NRG; PAM sequence: AAG
atttttagtttcaactacaa

SEQ ID NO: 49972 - DNA, 20 bp, Artificial Sequence
  Description of Artificial Sequence: Synthetic oligonucleotide
  Target: SCN9A; (+) strand; PAM type: NRG; PAM sequence: AGG
tttttagtttcaactacaaa

SEQ ID NO: 49973 - DNA, 20 bp, Artificial Sequence
  Description of Artificial Sequence: Synthetic oligonucleotide
  Target: SCN9A; (+) strand; PAM type: NRG; PAM sequence: TAG
ctacaaaaggtaacatgttc

SEQ ID NO: 49974 - DNA, 20 bp, Artificial Sequence
  Description of Artificial Sequence: Synthetic oligonucleotide
  Target: SCN9A; (+) strand; PAM type: NRG; PAM sequence: CAG
gtaacatgttctagaattat

SEQ ID NO: 49975 - DNA, 20 bp, Artificial Sequence
  Description of Artificial Sequence: Synthetic oligonucleotide
  Target: SCN9A; (+) strand; PAM type: NRG; PAM sequence: AAG
tctagaattatcagcttgtt

SEQ ID NO: 49976 - DNA, 20 bp, Artificial Sequence
  Description of Artificial Sequence: Synthetic oligonucleotide
  Target: SCN9A; (+) strand; PAM type: NRG; PAM sequence: AGG
ctagaattatcagcttgtta

SEQ ID NO: 49977 - DNA, 20 bp, Artificial Sequence
  Description of Artificial Sequence: Synthetic oligonucleotide
  Target: SCN9A; (+) strand; PAM type: NRG; PAM sequence: GGG
tagaattatcagcttgttaa

SEQ ID NO: 49978 - DNA, 20 bp, Artificial Sequence
  Description of Artificial Sequence: Synthetic oligonucleotide
  Target: SCN9A; (+) strand; PAM type: NRG; PAM sequence: CAG
gttaagggattactatgtgt

SEQ ID NO: 49979 - DNA, 20 bp, Artificial Sequence
  Description of Artificial Sequence: Synthetic oligonucleotide
  Target: SCN9A; (+) strand; PAM type: NRG; PAM sequence: AGG
ttaagggattactatgtgtc

SEQ ID NO: 49980 - DNA, 20 bp, Artificial Sequence
  Description of Artificial Sequence: Synthetic oligonucleotide
  Target: SCN9A; (+) strand; PAM type: NRG; PAM sequence: TGG
gattactatgtgtcaggcaa

SEQ ID NO: 49981 - DNA, 20 bp, Artificial Sequence
  Description of Artificial Sequence: Synthetic oligonucleotide
  Target: SCN9A; (+) strand; PAM type: NRG; PAM sequence: GGG
attactatgtgtcaggcaat

SEQ ID NO: 49982 - DNA, 20 bp, Artificial Sequence
  Description of Artificial Sequence: Synthetic oligonucleotide
  Target: SCN9A; (+) strand; PAM type: NRG; PAM sequence: CGG
actatgtgtcaggcaatggg

SEQ ID NO: 49983 - DNA, 20 bp, Artificial Sequence
  Description of Artificial Sequence: Synthetic oligonucleotide
  Target: SCN9A; (+) strand; PAM type: NRG; PAM sequence: GGG
ctatgtgtcaggcaatgggc

SEQ ID NO: 49984 - DNA, 20 bp, Artificial Sequence
  Description of Artificial Sequence: Synthetic oligonucleotide
  Target: SCN9A; (+) strand; PAM type: NRG; PAM sequence: CAG
cttctaaccatctttatact

SEQ ID NO: 49985 - DNA, 20 bp, Artificial Sequence
  Description of Artificial Sequence: Synthetic oligonucleotide
  Target: SCN9A; (+) strand; PAM type: NRG; PAM sequence: AAG
tctttatactcagaaatttg

SEQ ID NO: 49986 - DNA, 20 bp, Artificial Sequence
  Description of Artificial Sequence: Synthetic oligonucleotide
  Target: SCN9A; (+) strand; PAM type: NRG; PAM sequence: TAG
aatttgaagtttacgcttca

SEQ ID NO: 49987 - DNA, 20 bp, Artificial Sequence
  Description of Artificial Sequence: Synthetic oligonucleotide
  Target: SCN9A; (+) strand; PAM type: NRG; PAM sequence: AAG
gtttacgcttcatagcttta

SEQ ID NO: 49988 - DNA, 20 bp, Artificial Sequence
  Description of Artificial Sequence: Synthetic oligonucleotide
  Target: SCN9A; (+) strand; PAM type: NRG; PAM sequence: GAG
gtaaaaaatgacaattttct

SEQ ID NO: 49989 - DNA, 20 bp, Artificial Sequence
  Description of Artificial Sequence: Synthetic oligonucleotide
  Target: SCN9A; (+) strand; PAM type: NRG; PAM sequence: TGG
ttttcgtctatatttacctt

SEQ ID NO: 49990 - DNA, 20 bp, Artificial Sequence
  Description of Artificial Sequence: Synthetic oligonucleotide
  Target: SCN9A; (+) strand; PAM type: NRG; PAM sequence: AAG
actcaactttcctcttttaa

SEQ ID NO: 49991 - DNA, 20 bp, Artificial Sequence
  Description of Artificial Sequence: Synthetic oligonucleotide
  Target: SCN9A; (+) strand; PAM type: NRG; PAM sequence: TGG
agtctttatgataatgcctt

SEQ ID NO: 49992 - DNA, 20 bp, Artificial Sequence
  Description of Artificial Sequence: Synthetic oligonucleotide
  Target: SCN9A; (+) strand; PAM type: NRG; PAM sequence: TAG
ctttatgataatgcctttgg

SEQ ID NO: 49993 - DNA, 20 bp, Artificial Sequence
  Description of Artificial Sequence: Synthetic oligonucleotide
  Target: SCN9A; (+) strand; PAM type: NRG; PAM sequence: CAG
cctttggtagcaccactctc

SEQ ID NO: 49994 - DNA, 20 bp, Artificial Sequence
  Description of Artificial Sequence: Synthetic oligonucleotide
  Target: SCN9A; (+) strand; PAM type: NRG; PAM sequence: CAG
aatgttcataacatcttgac

SEQ ID NO: 49995 - DNA, 20 bp, Artificial Sequence
  Description of Artificial Sequence: Synthetic oligonucleotide
  Target: SCN9A; (+) strand; PAM type: NRG; PAM sequence: AGG
atgttcataacatcttgacc

SEQ ID NO: 49996 - DNA, 20 bp, Artificial Sequence
  Description of Artificial Sequence: Synthetic oligonucleotide
  Target: SCN9A; (+) strand; PAM type: NRG; PAM sequence: GAG
gttcataacatcttgaccag

SEQ ID NO: 49997 - DNA, 20 bp, Artificial Sequence
  Description of Artificial Sequence: Synthetic oligonucleotide
  Target: SCN9A; (+) strand; PAM type: NRG; PAM sequence: AAG
cataacatcttgaccaggag

SEQ ID NO: 49998 - DNA, 20 bp, Artificial Sequence
  Description of Artificial Sequence: Synthetic oligonucleotide
  Target: SCN9A; (+) strand; PAM type: NRG; PAM sequence: CAG
cactttctttgcttatcaat

SEQ ID NO: 49999 - DNA, 20 bp, Artificial Sequence
  Description of Artificial Sequence: Synthetic oligonucleotide
  Target: SCN9A; (+) strand; PAM type: NRG; PAM sequence: AAG
tttctttgcttatcaatcag

SEQ ID NO: 50000 - DNA, 20 bp, Artificial Sequence
  Description of Artificial Sequence: Synthetic oligonucleotide
  Target: SCN9A; (+) strand; PAM type: NRG; PAM sequence: AAG
aagcaactcctcatccattc

SEQ ID NO: 50001 - DNA, 20 bp, Artificial Sequence
  Description of Artificial Sequence: Synthetic oligonucleotide
  Target: SCN9A; (+) strand; PAM type: NRG; PAM sequence: GAG
tcatccattcaagttaccgc

SEQ ID NO: 50002 - DNA, 20 bp, Artificial Sequence
  Description of Artificial Sequence: Synthetic oligonucleotide
  Target: SCN9A; (+) strand; PAM type: NRG; PAM sequence: TGG
ccattcaagttaccgcgaga

SEQ ID NO: 50003 - DNA, 20 bp, Artificial Sequence
  Description of Artificial Sequence: Synthetic oligonucleotide
  Target: SCN9A; (+) strand; PAM type: NRG; PAM sequence: CAG
ttcaagttaccgcgagatgg

SEQ ID NO: 50004 - DNA, 20 bp, Artificial Sequence
  Description of Artificial Sequence: Synthetic oligonucleotide
  Target: SCN9A; (+) strand; PAM type: NRG; PAM sequence: CAG
accgcgagatggcagcaatt

SEQ ID NO: 50005 - DNA, 20 bp, Artificial Sequence
  Description of Artificial Sequence: Synthetic oligonucleotide
  Target: SCN9A; (+) strand; PAM type: NRG; PAM sequence: TAG
cagcaattcagtcacaattt

SEQ ID NO: 50006 - DNA, 20 bp, Artificial Sequence
  Description of Artificial Sequence: Synthetic oligonucleotide
  Target: SCN9A; (+) strand; PAM type: NRG; PAM sequence: AGG
agcaattcagtcacaatttt

SEQ ID NO: 50007 - DNA, 20 bp, Artificial Sequence
  Description of Artificial Sequence: Synthetic oligonucleotide
  Target: SCN9A; (+) strand; PAM type: NRG; PAM sequence: CAG
tgctatttccaccacatctg

SEQ ID NO: 50008 - DNA, 20 bp, Artificial Sequence
  Description of Artificial Sequence: Synthetic oligonucleotide
  Target: SCN9A; (+) strand; PAM type: NRG; PAM sequence: AAG
tgcagttctttccatcactg

SEQ ID NO: 50009 - DNA, 20 bp, Artificial Sequence
  Description of Artificial Sequence: Synthetic oligonucleotide
  Target: SCN9A; (+) strand; PAM type: NRG; PAM sequence: TAG
ctgaagtcttaaacctctca

SEQ ID NO: 50010 - DNA, 20 bp, Artificial Sequence
  Description of Artificial Sequence: Synthetic oligonucleotide
  Target: SCN9A; (+) strand; PAM type: NRG; PAM sequence: GAG
aacctctcatagtcatccat

SEQ ID NO: 50011 - DNA, 20 bp, Artificial Sequence
  Description of Artificial Sequence: Synthetic oligonucleotide
  Target: SCN9A; (+) strand; PAM type: NRG; PAM sequence: GAG
cctctcatagtcatccatga

SEQ ID NO: 50012 - DNA, 20 bp, Artificial Sequence
  Description of Artificial Sequence: Synthetic oligonucleotide
  Target: SCN9A; (+) strand; PAM type: NRG; PAM sequence: TGG
tcatagtcatccatgagagt

SEQ ID NO: 50013 - DNA, 20 bp, Artificial Sequence
  Description of Artificial Sequence: Synthetic oligonucleotide
  Target: SCN9A; (+) strand; PAM type: NRG; PAM sequence: TAG
attaatgttctaataacatc

SEQ ID NO: 50014 - DNA, 20 bp, Artificial Sequence
  Description of Artificial Sequence: Synthetic oligonucleotide
  Target: SCN9A; (+) strand; PAM type: NRG; PAM sequence: TGG
tgttctaataacatctagaa

SEQ ID NO: 50015 - DNA, 20 bp, Artificial Sequence
  Description of Artificial Sequence: Synthetic oligonucleotide
  Target: SCN9A; (+) strand; PAM type: NRG; PAM sequence: CAG
ctagaatggtgaatcctttc

SEQ ID NO: 50016 - DNA, 20 bp, Artificial Sequence
  Description of Artificial Sequence: Synthetic oligonucleotide
  Target: SCN9A; (+) strand; PAM type: NRG; PAM sequence: AAG
gaatggtgaatcctttccag

SEQ ID NO: 50017 - DNA, 20 bp, Artificial Sequence
  Description of Artificial Sequence: Synthetic oligonucleotide
  Target: SCN9A; (+) strand; PAM type: NRG; PAM sequence: CAG
gattttcaatttacttttcc

SEQ ID NO: 50018 - DNA, 20 bp, Artificial Sequence
  Description of Artificial Sequence: Synthetic oligonucleotide
  Target: SCN9A; (+) strand; PAM type: NRG; PAM sequence: CAG
tttacttttcccagacccat

SEQ ID NO: 50019 - DNA, 20 bp, Artificial Sequence
  Description of Artificial Sequence: Synthetic oligonucleotide
  Target: SCN9A; (+) strand; PAM type: NRG; PAM sequence: GAG
tacttttcccagacccatca

SEQ ID NO: 50020 - DNA, 20 bp, Artificial Sequence
  Description of Artificial Sequence: Synthetic oligonucleotide
  Target: SCN9A; (+) strand; PAM type: NRG; PAM sequence: AGG
acttttcccagacccatcag

SEQ ID NO: 50021 - DNA, 20 bp, Artificial Sequence
  Description of Artificial Sequence: Synthetic oligonucleotide
  Target: SCN9A; (+) strand; PAM type: NRG; PAM sequence: TGG
atcagaggaatcactatcta

SEQ ID NO: 50022 - DNA, 20 bp, Artificial Sequence
  Description of Artificial Sequence: Synthetic oligonucleotide
  Target: SCN9A; (+) strand; PAM type: NRG; PAM sequence: CAG
agaggaatcactatctatgg

SEQ ID NO: 50023 - DNA, 20 bp, Artificial Sequence
  Description of Artificial Sequence: Synthetic oligonucleotide
  Target: SCN9A; (+) strand; PAM type: NRG; PAM sequence: TAG
atcactatctatggcagcta

SEQ ID NO: 50024 - DNA, 20 bp, Artificial Sequence
  Description of Artificial Sequence: Synthetic oligonucleotide
  Target: SCN9A; (+) strand; PAM type: NRG; PAM sequence: AAG
aaatgtatttattaaaaaat

SEQ ID NO: 50025 - DNA, 20 bp, Artificial Sequence
  Description of Artificial Sequence: Synthetic oligonucleotide
  Target: SCN9A; (+) strand; PAM type: NRG; PAM sequence: AAG
tattaaaaaataagacttaa

SEQ ID NO: 50026 - DNA, 20 bp, Artificial Sequence
  Description of Artificial Sequence: Synthetic oligonucleotide
  Target: SCN9A; (+) strand; PAM type: NRG; PAM sequence: TGG
taaaagttgaaattactctt

SEQ ID NO: 50027 - DNA, 20 bp, Artificial Sequence
  Description of Artificial Sequence: Synthetic oligonucleotide
  Target: SCN9A; (+) strand; PAM type: NRG; PAM sequence: TAG
tgaaattactctttggccca

SEQ ID NO: 50028 - DNA, 20 bp, Artificial Sequence
  Description of Artificial Sequence: Synthetic oligonucleotide
  Target: SCN9A; (+) strand; PAM type: NRG; PAM sequence: AGG
gaaattactctttggcccat

SEQ ID NO: 50029 - DNA, 20 bp, Artificial Sequence
  Description of Artificial Sequence: Synthetic oligonucleotide
  Target: SCN9A; (+) strand; PAM type: NRG; PAM sequence: CAG
actctttggcccataggcta

SEQ ID NO: 50030 - DNA, 20 bp, Artificial Sequence
  Description of Artificial Sequence: Synthetic oligonucleotide
  Target: SCN9A; (+) strand; PAM type: NRG; PAM sequence: TGG
ttggcccataggctacagaa

SEQ ID NO: 50031 - DNA, 20 bp, Artificial Sequence
  Description of Artificial Sequence: Synthetic oligonucleotide
  Target: SCN9A; (+) strand; PAM type: NRG; PAM sequence: TAG
cccataggctacagaatgga

SEQ ID NO: 50032 - DNA, 20 bp, Artificial Sequence
  Description of Artificial Sequence: Synthetic oligonucleotide
  Target: SCN9A; (+) strand; PAM type: NRG; PAM sequence: TAG
ggctacagaatggatagcgt

SEQ ID NO: 50033 - DNA, 20 bp, Artificial Sequence
  Description of Artificial Sequence: Synthetic oligonucleotide
  Target: SCN9A; (+) strand; PAM type: NRG; PAM sequence: CAG
tacagaatggatagcgttag

SEQ ID NO: 50034 - DNA, 20 bp, Artificial Sequence
  Description of Artificial Sequence: Synthetic oligonucleotide
  Target: SCN9A; (+) strand; PAM type: NRG; PAM sequence: AGG
acagaatggatagcgttagc

SEQ ID NO: 50035 - DNA, 20 bp, Artificial Sequence
  Description of Artificial Sequence: Synthetic oligonucleotide
  Target: SCN9A; (+) strand; PAM type: NRG; PAM sequence: TAG
atgcccttgtacctctccgt

SEQ ID NO: 50036 - DNA, 20 bp, Artificial Sequence
  Description of Artificial Sequence: Synthetic oligonucleotide
  Target: SCN9A; (+) strand; PAM type: NRG; PAM sequence: GAG
gcccttgtacctctccgtta

SEQ ID NO: 50037 - DNA, 20 bp, Artificial Sequence
  Description of Artificial Sequence: Synthetic oligonucleotide
  Target: SCN9A; (+) strand; PAM type: NRG; PAM sequence: GAG
acctctccgttagagctctt

SEQ ID NO: 50038 - DNA, 20 bp, Artificial Sequence
  Description of Artificial Sequence: Synthetic oligonucleotide
  Target: SCN9A; (+) strand; PAM type: NRG; PAM sequence: CAG
cgttagagctcttgagtgac

SEQ ID NO: 50039 - DNA, 20 bp, Artificial Sequence
  Description of Artificial Sequence: Synthetic oligonucleotide
  Target: SCN9A; (+) strand; PAM type: NRG; PAM sequence: AGG
gttagagctcttgagtgacc

SEQ ID NO: 50040 - DNA, 20 bp, Artificial Sequence
  Description of Artificial Sequence: Synthetic oligonucleotide
  Target: SCN9A; (+) strand; PAM type: NRG; PAM sequence: TAG
gtgaccaggcacattgtcaa

SEQ ID NO: 50041 - DNA, 20 bp, Artificial Sequence
  Description of Artificial Sequence: Synthetic oligonucleotide
  Target: SCN9A; (+) strand; PAM type: NRG; PAM sequence: AGG
tgaccaggcacattgtcaat

SEQ ID NO: 50042 - DNA, 20 bp, Artificial Sequence
  Description of Artificial Sequence: Synthetic oligonucleotide
  Target: SCN9A; (+) strand; PAM type: NRG; PAM sequence: CAG
ccaggcacattgtcaatagg

SEQ ID NO: 50043 - DNA, 20 bp, Artificial Sequence
  Description of Artificial Sequence: Synthetic oligonucleotide
  Target: SCN9A; (+) strand; PAM type: NRG; PAM sequence: AAG
aataggcagtgatattttga

SEQ ID NO: 50044 - DNA, 20 bp, Artificial Sequence
  Description of Artificial Sequence: Synthetic oligonucleotide
  Target: SCN9A; (+) strand; PAM type: NRG; PAM sequence: GAG
aaatcttttttttttttcct

SEQ ID NO: 50045 - DNA, 20 bp, Artificial Sequence
  Description of Artificial Sequence: Synthetic oligonucleotide
  Target: SCN9A; (+) strand; PAM type: NRG; PAM sequence: AAG
ttttttttttcctgagctat

SEQ ID NO: 50046 - DNA, 20 bp, Artificial Sequence
  Description of Artificial Sequence: Synthetic oligonucleotide
  Target: SCN9A; (+) strand; PAM type: NRG; PAM sequence: TGG
tgagctataagtatcaacac

SEQ ID NO: 50047 - DNA, 20 bp, Artificial Sequence
  Description of Artificial Sequence: Synthetic oligonucleotide
  Target: SCN9A; (+) strand; PAM type: NRG; PAM sequence: GGG
gagctataagtatcaacact

SEQ ID NO: 50048 - DNA, 20 bp, Artificial Sequence
  Description of Artificial Sequence: Synthetic oligonucleotide
  Target: SCN9A; (+) strand; PAM type: NRG; PAM sequence: TAG
aacactgggcctaaaatatt

SEQ ID NO: 50049 - DNA, 20 bp, Artificial Sequence
  Description of Artificial Sequence: Synthetic oligonucleotide
  Target: SCN9A; (+) strand; PAM type: NRG; PAM sequence: CAG
ttagtgaaccatgctgtaaa

SEQ ID NO: 50050 - DNA, 20 bp, Artificial Sequence
  Description of Artificial Sequence: Synthetic oligonucleotide
  Target: SCN9A; (+) strand; PAM type: NRG; PAM sequence: CAG
taaacagacgtgctgtcatc

SEQ ID NO: 50051 - DNA, 20 bp, Artificial Sequence
  Description of Artificial Sequence: Synthetic oligonucleotide
  Target: SCN9A; (+) strand; PAM type: NRG; PAM sequence: AGG
aaacagacgtgctgtcatcc

SEQ ID NO: 50052 - DNA, 20 bp, Artificial Sequence
  Description of Artificial Sequence: Synthetic oligonucleotide
  Target: SCN9A; (+) strand; PAM type: NRG; PAM sequence: TAG
aggctttgttgttctattta

SEQ ID NO: 50053 - DNA, 20 bp, Artificial Sequence
  Description of Artificial Sequence: Synthetic oligonucleotide
  Target: SCN9A; (+) strand; PAM type: NRG; PAM sequence: GAG
gctttgttgttctatttata

SEQ ID NO: 50054 - DNA, 20 bp, Artificial Sequence
  Description of Artificial Sequence: Synthetic oligonucleotide
  Target: SCN9A; (+) strand; PAM type: NRG; PAM sequence: CAG
gttgttctatttatagagca

SEQ ID NO: 50055 - DNA, 20 bp, Artificial Sequence
  Description of Artificial Sequence: Synthetic oligonucleotide
  Target: SCN9A; (+) strand; PAM type: NRG; PAM sequence: AGG
ttgttctatttatagagcac

SEQ ID NO: 50056 - DNA, 20 bp, Artificial Sequence
  Description of Artificial Sequence: Synthetic oligonucleotide
  Target: SCN9A; (+) strand; PAM type: NRG; PAM sequence: CAG
ttctatttatagagcacagg

SEQ ID NO: 50057 - DNA, 20 bp, Artificial Sequence
  Description of Artificial Sequence: Synthetic oligonucleotide
  Target: SCN9A; (+) strand; PAM type: NRG; PAM sequence: GAG
ctatttatagagcacaggca

SEQ ID NO: 50058 - DNA, 20 bp, Artificial Sequence
  Description of Artificial Sequence: Synthetic oligonucleotide
  Target: SCN9A; (+) strand; PAM type: NRG; PAM sequence: TAG
tttatagagcacaggcagag

SEQ ID NO: 50059 - DNA, 20 bp, Artificial Sequence
  Description of Artificial Sequence: Synthetic oligonucleotide
  Target: SCN9A; (+) strand; PAM type: NRG; PAM sequence: TAG
gagcacaggcagagtagatt

SEQ ID NO: 50060 - DNA, 20 bp, Artificial Sequence
  Description of Artificial Sequence: Synthetic oligonucleotide
  Target: SCN9A; (+) strand; PAM type: NRG; PAM sequence: AAG
gtagatttagtataattctt

SEQ ID NO: 50061 - DNA, 20 bp, Artificial Sequence
  Description of Artificial Sequence: Synthetic oligonucleotide
  Target: SCN9A; (+) strand; PAM type: NRG; PAM sequence: GAG
agatttagtataattcttaa

SEQ ID NO: 50062 - DNA, 20 bp, Artificial Sequence
  Description of Artificial Sequence: Synthetic oligonucleotide
  Target: SCN9A; (+) strand; PAM type: NRG; PAM sequence: TAG
ttctgaataattaaataata

SEQ ID NO: 50063 - DNA, 20 bp, Artificial Sequence
  Description of Artificial Sequence: Synthetic oligonucleotide
  Target: SCN9A; (+) strand; PAM type: NRG; PAM sequence: TAG
ttattatttaattttctgaa

SEQ ID NO: 50064 - DNA, 20 bp, Artificial Sequence
  Description of Artificial Sequence: Synthetic oligonucleotide
  Target: SCN9A; (+) strand; PAM type: NRG; PAM sequence: AAG
atttaattttctgaatagta

SEQ ID NO: 50065 - DNA, 20 bp, Artificial Sequence
  Description of Artificial Sequence: Synthetic oligonucleotide
  Target: SCN9A; (+) strand; PAM type: NRG; PAM sequence: TAG
taattatttaattttctgaa

SEQ ID NO: 50066 - DNA, 20 bp, Artificial Sequence
  Description of Artificial Sequence: Synthetic oligonucleotide
  Target: SCN9A; (+) strand; PAM type: NRG; PAM sequence: TAG
ttattatgtaattttctgaa

SEQ ID NO: 50067 - DNA, 20 bp, Artificial Sequence
  Description of Artificial Sequence: Synthetic oligonucleotide
  Target: SCN9A; (+) strand; PAM type: NRG; PAM sequence: TAG
ttattatgtaattttctgaa

SEQ ID NO: 50068 - DNA, 20 bp, Artificial Sequence
  Description of Artificial Sequence: Synthetic oligonucleotide
  Target: SCN9A; (+) strand; PAM type: NRG; PAM sequence: AAG
taattaaataatataattct

SEQ ID NO: 50069 - DNA, 20 bp, Artificial Sequence
  Description of Artificial Sequence: Synthetic oligonucleotide
  Target: SCN9A; (+) strand; PAM type: NRG; PAM sequence: TAG
agattttctgaacgataaat

SEQ ID NO: 50070 - DNA, 20 bp, Artificial Sequence
  Description of Artificial Sequence: Synthetic oligonucleotide
  Target: SCN9A; (+) strand; PAM type: NRG; PAM sequence: AAG
ttagcatttgcttcaattta

SEQ ID NO: 50071 - DNA, 20 bp, Artificial Sequence
  Description of Artificial Sequence: Synthetic oligonucleotide
  Target: SCN9A; (+) strand; PAM type: NRG; PAM sequence: CAG
ttgcttcaatttaaagtcac

SEQ ID NO: 50072 - DNA, 20 bp, Artificial Sequence
  Description of Artificial Sequence: Synthetic oligonucleotide
  Target: SCN9A; (+) strand; PAM type: NRG; PAM sequence: AAG
cagctgcattatcccctaac

SEQ ID NO: 50073 - DNA, 20 bp, Artificial Sequence
  Description of Artificial Sequence: Synthetic oligonucleotide
  Target: SCN9A; (+) strand; PAM type: NRG; PAM sequence: GAG
gctgcattatcccctaacaa

SEQ ID NO: 50074 - DNA, 20 bp, Artificial Sequence
  Description of Artificial Sequence: Synthetic oligonucleotide
  Target: SCN9A; (+) strand; PAM type: NRG; PAM sequence: GAG
tgcattatcccctaacaaga

SEQ ID NO: 50075 - DNA, 20 bp, Artificial Sequence
  Description of Artificial Sequence: Synthetic oligonucleotide
  Target: SCN9A; (+) strand; PAM type: NRG; PAM sequence: CAG
ttatcccctaacaagagagt

SEQ ID NO: 50076 - DNA, 20 bp, Artificial Sequence
  Description of Artificial Sequence: Synthetic oligonucleotide
  Target: SCN9A; (+) strand; PAM type: NRG; PAM sequence: AAG
gagagtcagcctgttcgttg

SEQ ID NO: 50077 - DNA, 20 bp, Artificial Sequence
  Description of Artificial Sequence: Synthetic oligonucleotide
  Target: SCN9A; (+) strand; PAM type: NRG; PAM sequence: AAG
gcctgttcgttgaagctttg

SEQ ID NO: 50078 - DNA, 20 bp, Artificial Sequence
  Description of Artificial Sequence: Synthetic oligonucleotide
  Target: SCN9A; (+) strand; PAM type: NRG; PAM sequence: CAG
gttcgttgaagctttgaagc

SEQ ID NO: 50079 - DNA, 20 bp, Artificial Sequence
  Description of Artificial Sequence: Synthetic oligonucleotide
  Target: SCN9A; (+) strand; PAM type: NRG; PAM sequence: TAG
agacattgacttctcctttc

SEQ ID NO: 50080 - DNA, 20 bp, Artificial Sequence
  Description of Artificial Sequence: Synthetic oligonucleotide
  Target: SCN9A; (+) strand; PAM type: NRG; PAM sequence: TAG
ctagctataatatattcttc

SEQ ID NO: 50081 - DNA, 20 bp, Artificial Sequence
  Description of Artificial Sequence: Synthetic oligonucleotide
  Target: SCN9A; (+) strand; PAM type: NRG; PAM sequence: TAG
gctataatatattcttctag

SEQ ID NO: 50082 - DNA, 20 bp, Artificial Sequence
  Description of Artificial Sequence: Synthetic oligonucleotide
  Target: SCN9A; (+) strand; PAM type: NRG; PAM sequence: AAG
ataatatattcttctagtag

SEQ ID NO: 50083 - DNA, 20 bp, Artificial Sequence
  Description of Artificial Sequence: Synthetic oligonucleotide
  Target: SCN9A; (+) strand; PAM type: NRG; PAM sequence: AGG
taatatattcttctagtaga

SEQ ID NO: 50084 - DNA, 20 bp, Artificial Sequence
  Description of Artificial Sequence: Synthetic oligonucleotide
  Target: SCN9A; (+) strand; PAM type: NRG; PAM sequence: TAG
ttcttctagtagaaggctgt

SEQ ID NO: 50085 - DNA, 20 bp, Artificial Sequence
  Description of Artificial Sequence: Synthetic oligonucleotide
  Target: SCN9A; (+) strand; PAM type: NRG; PAM sequence: TAG
accactcttatcaatgatct

SEQ ID NO: 50086 - DNA, 20 bp, Artificial Sequence
  Description of Artificial Sequence: Synthetic oligonucleotide
  Target: SCN9A; (+) strand; PAM type: NRG; PAM sequence: TAG
ctcttatcaatgatcttagc

SEQ ID NO: 50087 - DNA, 20 bp, Artificial Sequence
  Description of Artificial Sequence: Synthetic oligonucleotide
  Target: SCN9A; (+) strand; PAM type: NRG; PAM sequence: TGG
acttgctgcatcttctccat

SEQ ID NO: 50088 - DNA, 20 bp, Artificial Sequence
  Description of Artificial Sequence: Synthetic oligonucleotide
  Target: SCN9A; (+) strand; PAM type: NRG; PAM sequence: TGG
caccttgcatttttatgtta

SEQ ID NO: 50089 - DNA, 20 bp, Artificial Sequence
  Description of Artificial Sequence: Synthetic oligonucleotide
  Target: SCN9A; (+) strand; PAM type: NRG; PAM sequence: CAG
cttgcatttttatgttatgg

SEQ ID NO: 50090 - DNA, 20 bp, Artificial Sequence
  Description of Artificial Sequence: Synthetic oligonucleotide
  Target: SCN9A; (+) strand; PAM type: NRG; PAM sequence: TGG
acttctttccttcaatctca

SEQ ID NO: 50091 - DNA, 20 bp, Artificial Sequence
  Description of Artificial Sequence: Synthetic oligonucleotide
  Target: SCN9A; (+) strand; PAM type: NRG; PAM sequence: GGG
cttctttccttcaatctcat

SEQ ID NO: 50092 - DNA, 20 bp, Artificial Sequence
  Description of Artificial Sequence: Synthetic oligonucleotide
  Target: SCN9A; (+) strand; PAM type: NRG; PAM sequence: GGG
ttctttccttcaatctcatg

SEQ ID NO: 50093 - DNA, 20 bp, Artificial Sequence
  Description of Artificial Sequence: Synthetic oligonucleotide
  Target: SCN9A; (+) strand; PAM type: NRG; PAM sequence: CAG
tctcatggggtaccgtctgc

SEQ ID NO: 50094 - DNA, 20 bp, Artificial Sequence
  Description of Artificial Sequence: Synthetic oligonucleotide
  Target: SCN9A; (+) strand; PAM type: NRG; PAM sequence: CAG
agcttcaaaccttttttttc

SEQ ID NO: 50095 - DNA, 20 bp, Artificial Sequence
  Description of Artificial Sequence: Synthetic oligonucleotide
  Target: SCN9A; (+) strand; PAM type: NRG; PAM sequence: CAG
tttccagcttcttcacctct

SEQ ID NO: 50096 - DNA, 20 bp, Artificial Sequence
  Description of Artificial Sequence: Synthetic oligonucleotide
  Target: SCN9A; (+) strand; PAM type: NRG; PAM sequence: TGG
cctctcagccttcatacaat

SEQ ID NO: 50097 - DNA, 20 bp, Artificial Sequence
  Description of Artificial Sequence: Synthetic oligonucleotide
  Target: SCN9A; (+) strand; PAM type: NRG; PAM sequence: GAG
tctcagccttcatacaattg

SEQ ID NO: 50098 - DNA, 20 bp, Artificial Sequence
  Description of Artificial Sequence: Synthetic oligonucleotide
  Target: SCN9A; (+) strand; PAM type: NRG; PAM sequence: TGG
ccttcatacaattggagtta

SEQ ID NO: 50099 - DNA, 20 bp, Artificial Sequence
  Description of Artificial Sequence: Synthetic oligonucleotide
  Target: SCN9A; (+) strand; PAM type: NRG; PAM sequence: TGG
ttggagttatggccttgctg

SEQ ID NO: 50100 - DNA, 20 bp, Artificial Sequence
  Description of Artificial Sequence: Synthetic oligonucleotide
  Target: SCN9A; (+) strand; PAM type: NRG; PAM sequence: TAG
gttatggccttgctgtggat

SEQ ID NO: 50101 - DNA, 20 bp, Artificial Sequence
  Description of Artificial Sequence: Synthetic oligonucleotide
  Target: SCN9A; (+) strand; PAM type: NRG; PAM sequence: AGG
ttatggccttgctgtggatt

SEQ ID NO: 50102 - DNA, 20 bp, Artificial Sequence
  Description of Artificial Sequence: Synthetic oligonucleotide
  Target: SCN9A; (+) strand; PAM type: NRG; PAM sequence: TGG
ccttgctgtggattaggctt

SEQ ID NO: 50103 - DNA, 20 bp, Artificial Sequence
  Description of Artificial Sequence: Synthetic oligonucleotide
  Target: SCN9A; (+) strand; PAM type: NRG; PAM sequence: AAG
tgtggattaggctttggctt

SEQ ID NO: 50104 - DNA, 20 bp, Artificial Sequence
  Description of Artificial Sequence: Synthetic oligonucleotide
  Target: SCN9A; (+) strand; PAM type: NRG; PAM sequence: AGG
gtggattaggctttggctta

SEQ ID NO: 50105 - DNA, 20 bp, Artificial Sequence
  Description of Artificial Sequence: Synthetic oligonucleotide
  Target: SCN9A; (+) strand; PAM type: NRG; PAM sequence: TGG
tttggcttaaggaaatgttg

SEQ ID NO: 50106 - DNA, 20 bp, Artificial Sequence
  Description of Artificial Sequence: Synthetic oligonucleotide
  Target: SCN9A; (+) strand; PAM type: NRG; PAM sequence: TGG
gcttaaggaaatgttgtggc

SEQ ID NO: 50107 - DNA, 20 bp, Artificial Sequence
  Description of Artificial Sequence: Synthetic oligonucleotide
  Target: SCN9A; (+) strand; PAM type: NRG; PAM sequence: TAG
tggctggttgatcttctatc

SEQ ID NO: 50108 - DNA, 20 bp, Artificial Sequence
  Description of Artificial Sequence: Synthetic oligonucleotide
  Target: SCN9A; (+) strand; PAM type: NRG; PAM sequence: AAG
actttctctatatttgcaat

SEQ ID NO: 50109 - DNA, 20 bp, Artificial Sequence
  Description of Artificial Sequence: Synthetic oligonucleotide
  Target: SCN9A; (+) strand; PAM type: NRG; PAM sequence: AGG
ctttctctatatttgcaata

SEQ ID NO: 50110 - DNA, 20 bp, Artificial Sequence
  Description of Artificial Sequence: Synthetic oligonucleotide
  Target: SCN9A; (+) strand; PAM type: NRG; PAM sequence: TGG
cttatcattcatgtgttcac

SEQ ID NO: 50111 - DNA, 20 bp, Artificial Sequence
  Description of Artificial Sequence: Synthetic oligonucleotide
  Target: SCN9A; (+) strand; PAM type: NRG; PAM sequence: GAG
tatcattcatgtgttcactg

SEQ ID NO: 50112 - DNA, 20 bp, Artificial Sequence
  Description of Artificial Sequence: Synthetic oligonucleotide
  Target: SCN9A; (+) strand; PAM type: NRG; PAM sequence: TAG
cattcatgtgttcactggag

SEQ ID NO: 50113 - DNA, 20 bp, Artificial Sequence
  Description of Artificial Sequence: Synthetic oligonucleotide
  Target: SCN9A; (+) strand; PAM type: NRG; PAM sequence: AAG
tagcacatttgatttccttc

SEQ ID NO: 50114 - DNA, 20 bp, Artificial Sequence
  Description of Artificial Sequence: Synthetic oligonucleotide
  Target: SCN9A; (+) strand; PAM type: NRG; PAM sequence: TGG
tttcctttgcattcacaact

SEQ ID NO: 50115 - DNA, 20 bp, Artificial Sequence
  Description of Artificial Sequence: Synthetic oligonucleotide
  Target: SCN9A; (+) strand; PAM type: NRG; PAM sequence: AAG
tttgcattcacaacttggct

SEQ ID NO: 50116 - DNA, 20 bp, Artificial Sequence
  Description of Artificial Sequence: Synthetic oligonucleotide
  Target: SCN9A; (+) strand; PAM type: NRG; PAM sequence: TAG
tcacaacttggctaagtact

SEQ ID NO: 50117 - DNA, 20 bp, Artificial Sequence
  Description of Artificial Sequence: Synthetic oligonucleotide
  Target: SCN9A; (+) strand; PAM type: NRG; PAM sequence: AAG
cttggctaagtacttagtgc

SEQ ID NO: 50118 - DNA, 20 bp, Artificial Sequence
  Description of Artificial Sequence: Synthetic oligonucleotide
  Target: SCN9A; (+) strand; PAM type: NRG; PAM sequence: GAG
tggctaagtacttagtgcaa

SEQ ID NO: 50119 - DNA, 20 bp, Artificial Sequence
  Description of Artificial Sequence: Synthetic oligonucleotide
  Target: SCN9A; (+) strand; PAM type: NRG; PAM sequence: AGG
ggctaagtacttagtgcaag

SEQ ID NO: 50120 - DNA, 20 bp, Artificial Sequence
  Description of Artificial Sequence: Synthetic oligonucleotide
  Target: SCN9A; (+) strand; PAM type: NRG; PAM sequence: TAG
agtacttagtgcaagaggcc

SEQ ID NO: 50121 - DNA, 20 bp, Artificial Sequence
  Description of Artificial Sequence: Synthetic oligonucleotide
  Target: SCN9A; (+) strand; PAM type: NRG; PAM sequence: TGG
agtgcaagaggcctagattt

SEQ ID NO: 50122 - DNA, 20 bp, Artificial Sequence
  Description of Artificial Sequence: Synthetic oligonucleotide
  Target: SCN9A; (+) strand; PAM type: NRG; PAM sequence: TGG
gcctagattttggcctatct

SEQ ID NO: 50123 - DNA, 20 bp, Artificial Sequence
  Description of Artificial Sequence: Synthetic oligonucleotide
  Target: SCN9A; (+) strand; PAM type: NRG; PAM sequence: AAG
ttcaacatgccttcctcact

SEQ ID NO: 50124 - DNA, 20 bp, Artificial Sequence
  Description of Artificial Sequence: Synthetic oligonucleotide
  Target: SCN9A; (+) strand; PAM type: NRG; PAM sequence: TAG
tcactaagcttaatcatttc

SEQ ID NO: 50125 - DNA, 20 bp, Artificial Sequence
  Description of Artificial Sequence: Synthetic oligonucleotide
  Target: SCN9A; (+) strand; PAM type: NRG; PAM sequence: AAG
catttctagcttctgattta

SEQ ID NO: 50126 - DNA, 20 bp, Artificial Sequence
  Description of Artificial Sequence: Synthetic oligonucleotide
  Target: SCN9A; (+) strand; PAM type: NRG; PAM sequence: GAG
tctagcttctgatttaaagt

SEQ ID NO: 50127 - DNA, 20 bp, Artificial Sequence
  Description of Artificial Sequence: Synthetic oligonucleotide
  Target: SCN9A; (+) strand; PAM type: NRG; PAM sequence: TAG
ttcttcctttacttgaacat

SEQ ID NO: 50128 - DNA, 20 bp, Artificial Sequence
  Description of Artificial Sequence: Synthetic oligonucleotide
  Target: SCN9A; (+) strand; PAM type: NRG; PAM sequence: AGG
tcttcctttacttgaacatt

SEQ ID NO: 50129 - DNA, 20 bp, Artificial Sequence
  Description of Artificial Sequence: Synthetic oligonucleotide
  Target: SCN9A; (+) strand; PAM type: NRG; PAM sequence: GGG
cttcctttacttgaacatta

SEQ ID NO: 50130 - DNA, 20 bp, Artificial Sequence
  Description of Artificial Sequence: Synthetic oligonucleotide
  Target: SCN9A; (+) strand; PAM type: NRG; PAM sequence: GGG
ttcctttacttgaacattag

SEQ ID NO: 50131 - DNA, 20 bp, Artificial Sequence
  Description of Artificial Sequence: Synthetic oligonucleotide
  Target: SCN9A; (+) strand; PAM type: NRG; PAM sequence: TGG
ctttacttgaacattagggg

SEQ ID NO: 50132 - DNA, 20 bp, Artificial Sequence
  Description of Artificial Sequence: Synthetic oligonucleotide
  Target: SCN9A; (+) strand; PAM type: NRG; PAM sequence: GGG
tttacttgaacattaggggt

SEQ ID NO: 50133 - DNA, 20 bp, Artificial Sequence
  Description of Artificial Sequence: Synthetic oligonucleotide
  Target: SCN9A; (+) strand; PAM type: NRG; PAM sequence: TGG
ttgaacattaggggtgggaa

SEQ ID NO: 50134 - DNA, 20 bp, Artificial Sequence
  Description of Artificial Sequence: Synthetic oligonucleotide
  Target: SCN9A; (+) strand; PAM type: NRG; PAM sequence: GGG
tgaacattaggggtgggaat

SEQ ID NO: 50135 - DNA, 20 bp, Artificial Sequence
  Description of Artificial Sequence: Synthetic oligonucleotide
  Target: SCN9A; (+) strand; PAM type: NRG; PAM sequence: TGG
ggtgggaatgggttactaat

SEQ ID NO: 50136 - DNA, 20 bp, Artificial Sequence
  Description of Artificial Sequence: Synthetic oligonucleotide
  Target: SCN9A; (+) strand; PAM type: NRG; PAM sequence: CAG
attttaacatcgttgtgtgt

SEQ ID NO: 50137 - DNA, 20 bp, Artificial Sequence
  Description of Artificial Sequence: Synthetic oligonucleotide
  Target: SCN9A; (+) strand; PAM type: NRG; PAM sequence: AGG
ttttaacatcgttgtgtgtc

SEQ ID NO: 50138 - DNA, 20 bp, Artificial Sequence
  Description of Artificial Sequence: Synthetic oligonucleotide
  Target: SCN9A; (+) strand; PAM type: NRG; PAM sequence: GGG
tttaacatcgttgtgtgtca

SEQ ID NO: 50139 - DNA, 20 bp, Artificial Sequence
  Description of Artificial Sequence: Synthetic oligonucleotide
  Target: SCN9A; (+) strand; PAM type: NRG; PAM sequence: CAG
catcgttgtgtgtcagggaa

SEQ ID NO: 50140 - DNA, 20 bp, Artificial Sequence
  Description of Artificial Sequence: Synthetic oligonucleotide
  Target: SCN9A; (+) strand; PAM type: NRG; PAM sequence: AGG
atcgttgtgtgtcagggaac

SEQ ID NO: 50141 - DNA, 20 bp, Artificial Sequence
  Description of Artificial Sequence: Synthetic oligonucleotide
  Target: SCN9A; (+) strand; PAM type: NRG; PAM sequence: GGG
tcgttgtgtgtcagggaaca

SEQ ID NO: 50142 - DNA, 20 bp, Artificial Sequence
  Description of Artificial Sequence: Synthetic oligonucleotide
  Target: SCN9A; (+) strand; PAM type: NRG; PAM sequence: AAG
ttgtgtgtcagggaacaggg

SEQ ID NO: 50143 - DNA, 20 bp, Artificial Sequence
  Description of Artificial Sequence: Synthetic oligonucleotide
  Target: SCN9A; (+) strand; PAM type: NRG; PAM sequence: GAG
gtcagggaacagggaagcct

SEQ ID NO: 50144 - DNA, 20 bp, Artificial Sequence
  Description of Artificial Sequence: Synthetic oligonucleotide
  Target: SCN9A; (+) strand; PAM type: NRG; PAM sequence: AGG
tcagggaacagggaagcctg

SEQ ID NO: 50145 - DNA, 20 bp, Artificial Sequence
  Description of Artificial Sequence: Synthetic oligonucleotide
  Target: SCN9A; (+) strand; PAM type: NRG; PAM sequence: AAG
ggaacagggaagcctgagga

SEQ ID NO: 50146 - DNA, 20 bp, Artificial Sequence
  Description of Artificial Sequence: Synthetic oligonucleotide
  Target: SCN9A; (+) strand; PAM type: NRG; PAM sequence: AGG
gaacagggaagcctgaggaa

SEQ ID NO: 50147 - DNA, 20 bp, Artificial Sequence
  Description of Artificial Sequence: Synthetic oligonucleotide
  Target: SCN9A; (+) strand; PAM type: NRG; PAM sequence: GGG
aacagggaagcctgaggaaa

SEQ ID NO: 50148 - DNA, 20 bp, Artificial Sequence
  Description of Artificial Sequence: Synthetic oligonucleotide
  Target: SCN9A; (+) strand; PAM type: NRG; PAM sequence: GAG
cagggaagcctgaggaaagg

SEQ ID NO: 50149 - DNA, 20 bp, Artificial Sequence
  Description of Artificial Sequence: Synthetic oligonucleotide
  Target: SCN9A; (+) strand; PAM type: NRG; PAM sequence: GAG
gggaagcctgaggaaaggga

SEQ ID NO: 50150 - DNA, 20 bp, Artificial Sequence
  Description of Artificial Sequence: Synthetic oligonucleotide
  Target: SCN9A; (+) strand; PAM type: NRG; PAM sequence: GAG
gaagcctgaggaaagggaga

SEQ ID NO: 50151 - DNA, 20 bp, Artificial Sequence
  Description of Artificial Sequence: Synthetic oligonucleotide
  Target: SCN9A; (+) strand; PAM type: NRG; PAM sequence: TAG
cctgaggaaagggagagaga

SEQ ID NO: 50152 - DNA, 20 bp, Artificial Sequence
  Description of Artificial Sequence: Synthetic oligonucleotide
  Target: SCN9A; (+) strand; PAM type: NRG; PAM sequence: AGG
ctgaggaaagggagagagat

SEQ ID NO: 50153 - DNA, 20 bp, Artificial Sequence
  Description of Artificial Sequence: Synthetic oligonucleotide
  Target: SCN9A; (+) strand; PAM type: NRG; PAM sequence: GGG
tgaggaaagggagagagata

SEQ ID NO: 50154 - DNA, 20 bp, Artificial Sequence
  Description of Artificial Sequence: Synthetic oligonucleotide
  Target: SCN9A; (+) strand; PAM type: NRG; PAM sequence: CAG
gagagatagggatgctgaaa

SEQ ID NO: 50155 - DNA, 20 bp, Artificial Sequence
  Description of Artificial Sequence: Synthetic oligonucleotide
  Target: SCN9A; (+) strand; PAM type: NRG; PAM sequence: TGG
tgattgtttgctgtcttatg

SEQ ID NO: 50156 - DNA, 20 bp, Artificial Sequence
  Description of Artificial Sequence: Synthetic oligonucleotide
  Target: SCN9A; (+) strand; PAM type: NRG; PAM sequence: TGG
tttgctgtcttatgtggatg

SEQ ID NO: 50157 - DNA, 20 bp, Artificial Sequence
  Description of Artificial Sequence: Synthetic oligonucleotide
  Target: SCN9A; (+) strand; PAM type: NRG; PAM sequence: TAG
tcttatgtggatgtggttca

SEQ ID NO: 50158 - DNA, 20 bp, Artificial Sequence
  Description of Artificial Sequence: Synthetic oligonucleotide
  Target: SCN9A; (+) strand; PAM type: NRG; PAM sequence: CAG
gcaccccaaaacaattacca

SEQ ID NO: 50159 - DNA, 20 bp, Artificial Sequence
  Description of Artificial Sequence: Synthetic oligonucleotide
  Target: SCN9A; (+) strand; PAM type: NRG; PAM sequence: AAG
caattaccacagtaacaaca

SEQ ID NO: 50160 - DNA, 20 bp, Artificial Sequence
  Description of Artificial Sequence: Synthetic oligonucleotide
  Target: SCN9A; (+) strand; PAM type: NRG; PAM sequence: TAG
acaacaaagatcactgatca

SEQ ID NO: 50161 - DNA, 20 bp, Artificial Sequence
  Description of Artificial Sequence: Synthetic oligonucleotide
  Target: SCN9A; (+) strand; PAM type: NRG; PAM sequence: CAG
atagatcaccataacacata

SEQ ID NO: 50162 - DNA, 20 bp, Artificial Sequence
  Description of Artificial Sequence: Synthetic oligonucleotide
  Target: SCN9A; (+) strand; PAM type: NRG; PAM sequence: TGG
atacagtaataattaaataa

SEQ ID NO: 50163 - DNA, 20 bp, Artificial Sequence
  Description of Artificial Sequence: Synthetic oligonucleotide
  Target: SCN9A; (+) strand; PAM type: NRG; PAM sequence: AAG
attaaataatggcaattaca

SEQ ID NO: 50164 - DNA, 20 bp, Artificial Sequence
  Description of Artificial Sequence: Synthetic oligonucleotide
  Target: SCN9A; (+) strand; PAM type: NRG; PAM sequence: GAG
ttacaaagttgaaatattgt

SEQ ID NO: 50165 - DNA, 20 bp, Artificial Sequence
  Description of Artificial Sequence: Synthetic oligonucleotide
  Target: SCN9A; (+) strand; PAM type: NRG; PAM sequence: AAG
aaatattgtgagaattgcca

SEQ ID NO: 50166 - DNA, 20 bp, Artificial Sequence
  Description of Artificial Sequence: Synthetic oligonucleotide
  Target: SCN9A; (+) strand; PAM type: NRG; PAM sequence: CAG
agaattgccaaagtgtgaca

SEQ ID NO: 50167 - DNA, 20 bp, Artificial Sequence
  Description of Artificial Sequence: Synthetic oligonucleotide
  Target: SCN9A; (+) strand; PAM type: NRG; PAM sequence: AAG
aagtgtgacacagatgcatg

SEQ ID NO: 50168 - DNA, 20 bp, Artificial Sequence
  Description of Artificial Sequence: Synthetic oligonucleotide
  Target: SCN9A; (+) strand; PAM type: NRG; PAM sequence: GAG
gtgacacagatgcatgaagt

SEQ ID NO: 50169 - DNA, 20 bp, Artificial Sequence
  Description of Artificial Sequence: Synthetic oligonucleotide
  Target: SCN9A; (+) strand; PAM type: NRG; PAM sequence: CAG
tgttgaaaaaattacgctga

SEQ ID NO: 50170 - DNA, 20 bp, Artificial Sequence
  Description of Artificial Sequence: Synthetic oligonucleotide
  Target: SCN9A; (+) strand; PAM type: NRG; PAM sequence: CAG
gctgacagacttgcttaatg

SEQ ID NO: 50171 - DNA, 20 bp, Artificial Sequence
  Description of Artificial Sequence: Synthetic oligonucleotide
  Target: SCN9A; (+) strand; PAM type: NRG; PAM sequence: AGG
ctgacagacttgcttaatgc

SEQ ID NO: 50172 - DNA, 20 bp, Artificial Sequence
  Description of Artificial Sequence: Synthetic oligonucleotide
  Target: SCN9A; (+) strand; PAM type: NRG; PAM sequence: GGG
tgacagacttgcttaatgca

SEQ ID NO: 50173 - DNA, 20 bp, Artificial Sequence
  Description of Artificial Sequence: Synthetic oligonucleotide
  Target: SCN9A; (+) strand; PAM type: NRG; PAM sequence: AAG
ccacaaaccttcaacttgta

SEQ ID NO: 50174 - DNA, 20 bp, Artificial Sequence
  Description of Artificial Sequence: Synthetic oligonucleotide
  Target: SCN9A; (+) strand; PAM type: NRG; PAM sequence: CAG
ccttcaacttgtaaagaatg

SEQ ID NO: 50175 - DNA, 20 bp, Artificial Sequence
  Description of Artificial Sequence: Synthetic oligonucleotide
  Target: SCN9A; (+) strand; PAM type: NRG; PAM sequence: AAG
gtaaagaatgcagtatcttg

SEQ ID NO: 50176 - DNA, 20 bp, Artificial Sequence
  Description of Artificial Sequence: Synthetic oligonucleotide
  Target: SCN9A; (+) strand; PAM type: NRG; PAM sequence: AAG
cagtatcttgaagtgcaata

SEQ ID NO: 50177 - DNA, 20 bp, Artificial Sequence
  Description of Artificial Sequence: Synthetic oligonucleotide
  Target: SCN9A; (+) strand; PAM type: NRG; PAM sequence: AAG
tcttgaagtgcaataaagta

SEQ ID NO: 50178 - DNA, 20 bp, Artificial Sequence
  Description of Artificial Sequence: Synthetic oligonucleotide
  Target: SCN9A; (+) strand; PAM type: NRG; PAM sequence: AAG
aagtaaagccccataaaatg

SEQ ID NO: 50179 - DNA, 20 bp, Artificial Sequence
  Description of Artificial Sequence: Synthetic oligonucleotide
  Target: SCN9A; (+) strand; PAM type: NRG; PAM sequence: TGG
gaagtatgcctgtattttga

SEQ ID NO: 50180 - DNA, 20 bp, Artificial Sequence
  Description of Artificial Sequence: Synthetic oligonucleotide
  Target: SCN9A; (+) strand; PAM type: NRG; PAM sequence: AAG
ctgtattttgatggaaacca

SEQ ID NO: 50181 - DNA, 20 bp, Artificial Sequence
  Description of Artificial Sequence: Synthetic oligonucleotide
  Target: SCN9A; (+) strand; PAM type: NRG; PAM sequence: TAG
attttgatggaaaccaaagt

SEQ ID NO: 50182 - DNA, 20 bp, Artificial Sequence
  Description of Artificial Sequence: Synthetic oligonucleotide
  Target: SCN9A; (+) strand; PAM type: NRG; PAM sequence: AGG
ttttgatggaaaccaaagtt

SEQ ID NO: 50183 - DNA, 20 bp, Artificial Sequence
  Description of Artificial Sequence: Synthetic oligonucleotide
  Target: SCN9A; (+) strand; PAM type: NRG; PAM sequence: AAG
tggaaaccaaagttaggata

SEQ ID NO: 50184 - DNA, 20 bp, Artificial Sequence
  Description of Artificial Sequence: Synthetic oligonucleotide
  Target: SCN9A; (+) strand; PAM type: NRG; PAM sequence: AGG
ggaaaccaaagttaggataa

SEQ ID NO: 50185 - DNA, 20 bp, Artificial Sequence
  Description of Artificial Sequence: Synthetic oligonucleotide
  Target: SCN9A; (+) strand; PAM type: NRG; PAM sequence: AAG
agttaggataaaggttttta

SEQ ID NO: 50186 - DNA, 20 bp, Artificial Sequence
  Description of Artificial Sequence: Synthetic oligonucleotide
  Target: SCN9A; (+) strand; PAM type: NRG; PAM sequence: TAG
ataaaggtttttaaagaatg

SEQ ID NO: 50187 - DNA, 20 bp, Artificial Sequence
  Description of Artificial Sequence: Synthetic oligonucleotide
  Target: SCN9A; (+) strand; PAM type: NRG; PAM sequence: AAG
taaagaatgtagtgaaaaat

SEQ ID NO: 50188 - DNA, 20 bp, Artificial Sequence
  Description of Artificial Sequence: Synthetic oligonucleotide
  Target: SCN9A; (+) strand; PAM type: NRG; PAM sequence: AGG
aaagaatgtagtgaaaaata

SEQ ID NO: 50189 - DNA, 20 bp, Artificial Sequence
  Description of Artificial Sequence: Synthetic oligonucleotide
  Target: SCN9A; (+) strand; PAM type: NRG; PAM sequence: GGG
aagaatgtagtgaaaaataa

SEQ ID NO: 50190 - DNA, 20 bp, Artificial Sequence
  Description of Artificial Sequence: Synthetic oligonucleotide
  Target: SCN9A; (+) strand; PAM type: NRG; PAM sequence: AAG
tatttcatatacacattcaa

SEQ ID NO: 50191 - DNA, 20 bp, Artificial Sequence
  Description of Artificial Sequence: Synthetic oligonucleotide
  Target: SCN9A; (+) strand; PAM type: NRG; PAM sequence: TAG
ttcatatacacattcaaaag

SEQ ID NO: 50192 - DNA, 20 bp, Artificial Sequence
  Description of Artificial Sequence: Synthetic oligonucleotide
  Target: SCN9A; (+) strand; PAM type: NRG; PAM sequence: AGG
tcatatacacattcaaaagt

SEQ ID NO: 50193 - DNA, 20 bp, Artificial Sequence
  Description of Artificial Sequence: Synthetic oligonucleotide
  Target: SCN9A; (+) strand; PAM type: NRG; PAM sequence: AAG
caaaagtaggatgattctga

SEQ ID NO: 50194 - DNA, 20 bp, Artificial Sequence
  Description of Artificial Sequence: Synthetic oligonucleotide
  Target: SCN9A; (+) strand; PAM type: NRG; PAM sequence: AGG
aaaagtaggatgattctgaa

SEQ ID NO: 50195 - DNA, 20 bp, Artificial Sequence
  Description of Artificial Sequence: Synthetic oligonucleotide
  Target: SCN9A; (+) strand; PAM type: NRG; PAM sequence: AAG
taggatgattctgaaaggta

SEQ ID NO: 50196 - DNA, 20 bp, Artificial Sequence
  Description of Artificial Sequence: Synthetic oligonucleotide
  Target: SCN9A; (+) strand; PAM type: NRG; PAM sequence: GAG
ggatgattctgaaaggtaaa

SEQ ID NO: 50197 - DNA, 20 bp, Artificial Sequence
  Description of Artificial Sequence: Synthetic oligonucleotide
  Target: SCN9A; (+) strand; PAM type: NRG; PAM sequence: AAG
gattctgaaaggtaaagagt

SEQ ID NO: 50198 - DNA, 20 bp, Artificial Sequence
  Description of Artificial Sequence: Synthetic oligonucleotide
  Target: SCN9A; (+) strand; PAM type: NRG; PAM sequence: CGG
gtaaagagtaagttatgact

SEQ ID NO: 50199 - DNA, 20 bp, Artificial Sequence
  Description of Artificial Sequence: Synthetic oligonucleotide
  Target: SCN9A; (+) strand; PAM type: NRG; PAM sequence: TGG
gactcggcaattccactact

SEQ ID NO: 50200 - DNA, 20 bp, Artificial Sequence
  Description of Artificial Sequence: Synthetic oligonucleotide
  Target: SCN9A; (+) strand; PAM type: NRG; PAM sequence: CAG
ggcaattccactacttggta

SEQ ID NO: 50201 - DNA, 20 bp, Artificial Sequence
  Description of Artificial Sequence: Synthetic oligonucleotide
  Target: SCN9A; (+) strand; PAM type: NRG; PAM sequence: AAG
ccactacttggtacagactc

SEQ ID NO: 50202 - DNA, 20 bp, Artificial Sequence
  Description of Artificial Sequence: Synthetic oligonucleotide
  Target: SCN9A; (+) strand; PAM type: NRG; PAM sequence: AGG
cactacttggtacagactca

SEQ ID NO: 50203 - DNA, 20 bp, Artificial Sequence
  Description of Artificial Sequence: Synthetic oligonucleotide
  Target: SCN9A; (+) strand; PAM type: NRG; PAM sequence: GGG
actacttggtacagactcaa

SEQ ID NO: 50204 - DNA, 20 bp, Artificial Sequence
  Description of Artificial Sequence: Synthetic oligonucleotide
  Target: SCN9A; (+) strand; PAM type: NRG; PAM sequence: AAG
tttaaaacatatgtccacac

SEQ ID NO: 50205 - DNA, 20 bp, Artificial Sequence
  Description of Artificial Sequence: Synthetic oligonucleotide
  Target: SCN9A; (+) strand; PAM type: NRG; PAM sequence: CAG
agaacgtttacatgaatgtt

SEQ ID NO: 50206 - DNA, 20 bp, Artificial Sequence
  Description of Artificial Sequence: Synthetic oligonucleotide
  Target: SCN9A; (+) strand; PAM type: NRG; PAM sequence: CAG
acgtttacatgaatgttcag

SEQ ID NO: 50207 - DNA, 20 bp, Artificial Sequence
  Description of Artificial Sequence: Synthetic oligonucleotide
  Target: SCN9A; (+) strand; PAM type: NRG; PAM sequence: TAG
ttcagcagcattattcatac

SEQ ID NO: 50208 - DNA, 20 bp, Artificial Sequence
  Description of Artificial Sequence: Synthetic oligonucleotide
  Target: SCN9A; (+) strand; PAM type: NRG; PAM sequence: AAG
cattattcatactagccaaa

SEQ ID NO: 50209 - DNA, 20 bp, Artificial Sequence
  Description of Artificial Sequence: Synthetic oligonucleotide
  Target: SCN9A; (+) strand; PAM type: NRG; PAM sequence: TGG
attactcaccaatgaataaa

SEQ ID NO: 50210 - DNA, 20 bp, Artificial Sequence
  Description of Artificial Sequence: Synthetic oligonucleotide
  Target: SCN9A; (+) strand; PAM type: NRG; PAM sequence: AAG
caccaatgaataaatggata

SEQ ID NO: 50211 - DNA, 20 bp, Artificial Sequence
  Description of Artificial Sequence: Synthetic oligonucleotide
  Target: SCN9A; (+) strand; PAM type: NRG; PAM sequence: AGG
accaatgaataaatggataa

SEQ ID NO: 50212 - DNA, 20 bp, Artificial Sequence
  Description of Artificial Sequence: Synthetic oligonucleotide
  Target: SCN9A; (+) strand; PAM type: NRG; PAM sequence: TGG
aataaatggataaaggaatg

SEQ ID NO: 50213 - DNA, 20 bp, Artificial Sequence
  Description of Artificial Sequence: Synthetic oligonucleotide
  Target: SCN9A; (+) strand; PAM type: NRG; PAM sequence: GGG
ataaatggataaaggaatgt

SEQ ID NO: 50214 - DNA, 20 bp, Artificial Sequence
  Description of Artificial Sequence: Synthetic oligonucleotide
  Target: SCN9A; (+) strand; PAM type: NRG; PAM sequence: TAG
gggatattcaaacactgaat

SEQ ID NO: 50215 - DNA, 20 bp, Artificial Sequence
  Description of Artificial Sequence: Synthetic oligonucleotide
  Target: SCN9A; (+) strand; PAM type: NRG; PAM sequence: TAG
tcaaacactgaattagtatt

SEQ ID NO: 50216 - DNA, 20 bp, Artificial Sequence
  Description of Artificial Sequence: Synthetic oligonucleotide
  Target: SCN9A; (+) strand; PAM type: NRG; PAM sequence: AAG
tttagcaataaaaacaaatg

SEQ ID NO: 50217 - DNA, 20 bp, Artificial Sequence
  Description of Artificial Sequence: Synthetic oligonucleotide
  Target: SCN9A; (+) strand; PAM type: NRG; PAM sequence: TAG
caataaaaacaaatgaagta

SEQ ID NO: 50218 - DNA, 20 bp, Artificial Sequence
  Description of Artificial Sequence: Synthetic oligonucleotide
  Target: SCN9A; (+) strand; PAM type: NRG; PAM sequence: AGG
aataaaaacaaatgaagtat

SEQ ID NO: 50219 - DNA, 20 bp, Artificial Sequence
  Description of Artificial Sequence: Synthetic oligonucleotide
  Target: SCN9A; (+) strand; PAM type: NRG; PAM sequence: TGG
tataggtacatgttacaaca

SEQ ID NO: 50220 - DNA, 20 bp, Artificial Sequence
  Description of Artificial Sequence: Synthetic oligonucleotide
  Target: SCN9A; (+) strand; PAM type: NRG; PAM sequence: AAG
atgtgatgaaaaccccgtga

SEQ ID NO: 50221 - DNA, 20 bp, Artificial Sequence
  Description of Artificial Sequence: Synthetic oligonucleotide
  Target: SCN9A; (+) strand; PAM type: NRG; PAM sequence: CAG
gaaaaccccgtgaaagaaca

SEQ ID NO: 50222 - DNA, 20 bp, Artificial Sequence
  Description of Artificial Sequence: Synthetic oligonucleotide
  Target: SCN9A; (+) strand; PAM type: NRG; PAM sequence: GAG
aaaccccgtgaaagaacaca

SEQ ID NO: 50223 - DNA, 20 bp, Artificial Sequence
  Description of Artificial Sequence: Synthetic oligonucleotide
  Target: SCN9A; (+) strand; PAM type: NRG; PAM sequence: AAG
gtgaaagaacacagagccaa

SEQ ID NO: 50224 - DNA, 20 bp, Artificial Sequence
  Description of Artificial Sequence: Synthetic oligonucleotide
  Target: SCN9A; (+) strand; PAM type: NRG; PAM sequence: AGG
tgaaagaacacagagccaaa

SEQ ID NO: 50225 - DNA, 20 bp, Artificial Sequence
  Description of Artificial Sequence: Synthetic oligonucleotide
  Target: SCN9A; (+) strand; PAM type: NRG; PAM sequence: CAG
attccatcttatgaaatgtc

SEQ ID NO: 50226 - DNA, 20 bp, Artificial Sequence
  Description of Artificial Sequence: Synthetic oligonucleotide
  Target: SCN9A; (+) strand; PAM type: NRG; PAM sequence: TAG
atcttatgaaatgtccagaa

SEQ ID NO: 50227 - DNA, 20 bp, Artificial Sequence
  Description of Artificial Sequence: Synthetic oligonucleotide
  Target: SCN9A; (+) strand; PAM type: NRG; PAM sequence: AGG
tcttatgaaatgtccagaat

SEQ ID NO: 50228 - DNA, 20 bp, Artificial Sequence
  Description of Artificial Sequence: Synthetic oligonucleotide
  Target: SCN9A; (+) strand; PAM type: NRG; PAM sequence: CAG
gtccagaataggcaaatccc

SEQ ID NO: 50229 - DNA, 20 bp, Artificial Sequence
  Description of Artificial Sequence: Synthetic oligonucleotide
  Target: SCN9A; (+) strand; PAM type: NRG; PAM sequence: TAG
aaatccccagaaacaaaatg

SEQ ID NO: 50230 - DNA, 20 bp, Artificial Sequence
  Description of Artificial Sequence: Synthetic oligonucleotide
  Target: SCN9A; (+) strand; PAM type: NRG; PAM sequence: GAG
atccccagaaacaaaatgta

SEQ ID NO: 50231 - DNA, 20 bp, Artificial Sequence
  Description of Artificial Sequence: Synthetic oligonucleotide
  Target: SCN9A; (+) strand; PAM type: NRG; PAM sequence: CAG
aaatgtagagtattttttgt

SEQ ID NO: 50232 - DNA, 20 bp, Artificial Sequence
  Description of Artificial Sequence: Synthetic oligonucleotide
  Target: SCN9A; (+) strand; PAM type: NRG; PAM sequence: GAG
atgtagagtattttttgtca

SEQ ID NO: 50233 - DNA, 20 bp, Artificial Sequence
  Description of Artificial Sequence: Synthetic oligonucleotide
  Target: SCN9A; (+) strand; PAM type: NRG; PAM sequence: AGG
tgtagagtattttttgtcag

SEQ ID NO: 50234 - DNA, 20 bp, Artificial Sequence
  Description of Artificial Sequence: Synthetic oligonucleotide
  Target: SCN9A; (+) strand; PAM type: NRG; PAM sequence: TGG
gagtattttttgtcagaggc

SEQ ID NO: 50235 - DNA, 20 bp, Artificial Sequence
  Description of Artificial Sequence: Synthetic oligonucleotide
  Target: SCN9A; (+) strand; PAM type: NRG; PAM sequence: GGG
agtattttttgtcagaggct

SEQ ID NO: 50236 - DNA, 20 bp, Artificial Sequence
  Description of Artificial Sequence: Synthetic oligonucleotide
  Target: SCN9A; (+) strand; PAM type: NRG; PAM sequence: TAG
ttgtcagaggctgggtgtaa

SEQ ID NO: 50237 - DNA, 20 bp, Artificial Sequence
  Description of Artificial Sequence: Synthetic oligonucleotide
  Target: SCN9A; (+) strand; PAM type: NRG; PAM sequence: AGG
tgtcagaggctgggtgtaat

SEQ ID NO: 50238 - DNA, 20 bp, Artificial Sequence
  Description of Artificial Sequence: Synthetic oligonucleotide
  Target: SCN9A; (+) strand; PAM type: NRG; PAM sequence: AAG
cagaggctgggtgtaatagg

SEQ ID NO: 50239 - DNA, 20 bp, Artificial Sequence
  Description of Artificial Sequence: Synthetic oligonucleotide
  Target: SCN9A; (+) strand; PAM type: NRG; PAM sequence: TGG
taataggaagtgattattga

SEQ ID NO: 50240 - DNA, 20 bp, Artificial Sequence
  Description of Artificial Sequence: Synthetic oligonucleotide
  Target: SCN9A; (+) strand; PAM type: NRG; PAM sequence: TGG
agtgattattgatggttatg

SEQ ID NO: 50241 - DNA, 20 bp, Artificial Sequence
  Description of Artificial Sequence: Synthetic oligonucleotide
  Target: SCN9A; (+) strand; PAM type: NRG; PAM sequence: TGG
attgatggttatgtggttaa

SEQ ID NO: 50242 - DNA, 20 bp, Artificial Sequence
  Description of Artificial Sequence: Synthetic oligonucleotide
  Target: SCN9A; (+) strand; PAM type: NRG; PAM sequence: AAG
ggttatgtggttaatggtta

SEQ ID NO: 50243 - DNA, 20 bp, Artificial Sequence
  Description of Artificial Sequence: Synthetic oligonucleotide
  Target: SCN9A; (+) strand; PAM type: NRG; PAM sequence: GAG
ttatgtggttaatggttaaa

SEQ ID NO: 50244 - DNA, 20 bp, Artificial Sequence
  Description of Artificial Sequence: Synthetic oligonucleotide
  Target: SCN9A; (+) strand; PAM type: NRG; PAM sequence: TGG
tggttaatggttaaagagta

SEQ ID NO: 50245 - DNA, 20 bp, Artificial Sequence
  Description of Artificial Sequence: Synthetic oligonucleotide
  Target: SCN9A; (+) strand; PAM type: NRG; PAM sequence: GGG
ggttaatggttaaagagtat

SEQ ID NO: 50246 - DNA, 20 bp, Artificial Sequence
  Description of Artificial Sequence: Synthetic oligonucleotide
  Target: SCN9A; (+) strand; PAM type: NRG; PAM sequence: GGG
gttaatggttaaagagtatg

SEQ ID NO: 50247 - DNA, 20 bp, Artificial Sequence
  Description of Artificial Sequence: Synthetic oligonucleotide
  Target: SCN9A; (+) strand; PAM type: NRG; PAM sequence: TGG
aaagagtatggggcttcttt

SEQ ID NO: 50248 - DNA, 20 bp, Artificial Sequence
  Description of Artificial Sequence: Synthetic oligonucleotide
  Target: SCN9A; (+) strand; PAM type: NRG; PAM sequence: GGG
aagagtatggggcttctttt

SEQ ID NO: 50249 - DNA, 20 bp, Artificial Sequence
  Description of Artificial Sequence: Synthetic oligonucleotide
  Target: SCN9A; (+) strand; PAM type: NRG; PAM sequence: GGG
agagtatggggcttcttttg

SEQ ID NO: 50250 - DNA, 20 bp, Artificial Sequence
  Description of Artificial Sequence: Synthetic oligonucleotide
  Target: SCN9A; (+) strand; PAM type: NRG; PAM sequence: GAG
tgaacatactaaaaaccact

SEQ ID NO: 50251 - DNA, 20 bp, Artificial Sequence
  Description of Artificial Sequence: Synthetic oligonucleotide
  Target: SCN9A; (+) strand; PAM type: NRG; PAM sequence: TGG
ctgagtgatacactttaaaa

SEQ ID NO: 50252 - DNA, 20 bp, Artificial Sequence
  Description of Artificial Sequence: Synthetic oligonucleotide
  Target: SCN9A; (+) strand; PAM type: NRG; PAM sequence: TGG
tttaaaatggtgatttttta

SEQ ID NO: 50253 - DNA, 20 bp, Artificial Sequence
  Description of Artificial Sequence: Synthetic oligonucleotide
  Target: SCN9A; (+) strand; PAM type: NRG; PAM sequence: AAG
aactactatgaatatgcatt

SEQ ID NO: 50254 - DNA, 20 bp, Artificial Sequence
  Description of Artificial Sequence: Synthetic oligonucleotide
  Target: SCN9A; (+) strand; PAM type: NRG; PAM sequence: CAG
aaatatgtgaaaattgtcct

SEQ ID NO: 50255 - DNA, 20 bp, Artificial Sequence
  Description of Artificial Sequence: Synthetic oligonucleotide
  Target: SCN9A; (+) strand; PAM type: NRG; PAM sequence: TAG
tgtgaaaattgtcctcagaa

SEQ ID NO: 50256 - DNA, 20 bp, Artificial Sequence
  Description of Artificial Sequence: Synthetic oligonucleotide
  Target: SCN9A; (+) strand; PAM type: NRG; PAM sequence: AGG
gtgaaaattgtcctcagaat

SEQ ID NO: 50257 - DNA, 20 bp, Artificial Sequence
  Description of Artificial Sequence: Synthetic oligonucleotide
  Target: SCN9A; (+) strand; PAM type: NRG; PAM sequence: AAG
aaaattgtcctcagaatagg

SEQ ID NO: 50258 - DNA, 20 bp, Artificial Sequence
  Description of Artificial Sequence: Synthetic oligonucleotide
  Target: SCN9A; (+) strand; PAM type: NRG; PAM sequence: GAG
aattgtcctcagaataggaa

SEQ ID NO: 50259 - DNA, 20 bp, Artificial Sequence
  Description of Artificial Sequence: Synthetic oligonucleotide
  Target: SCN9A; (+) strand; PAM type: NRG; PAM sequence: TAG
cctcagaataggaagagatt

SEQ ID NO: 50260 - DNA, 20 bp, Artificial Sequence
  Description of Artificial Sequence: Synthetic oligonucleotide
  Target: SCN9A; (+) strand; PAM type: NRG; PAM sequence: AAG
ataggaagagatttagtaaa

SEQ ID NO: 50261 - DNA, 20 bp, Artificial Sequence
  Description of Artificial Sequence: Synthetic oligonucleotide
  Target: SCN9A; (+) strand; PAM type: NRG; PAM sequence: AGG
taggaagagatttagtaaaa

SEQ ID NO: 50262 - DNA, 20 bp, Artificial Sequence
  Description of Artificial Sequence: Synthetic oligonucleotide
  Target: SCN9A; (+) strand; PAM type: NRG; PAM sequence: AAG
caaatcaatgaatcaaatca

SEQ ID NO: 50263 - DNA, 20 bp, Artificial Sequence
  Description of Artificial Sequence: Synthetic oligonucleotide
  Target: SCN9A; (+) strand; PAM type: NRG; PAM sequence: CAG
atcaatgaatcaaatcaaag

SEQ ID NO: 50264 - DNA, 20 bp, Artificial Sequence
  Description of Artificial Sequence: Synthetic oligonucleotide
  Target: SCN9A; (+) strand; PAM type: NRG; PAM sequence: TGG
agcagttgccacttgtgctt

SEQ ID NO: 50265 - DNA, 20 bp, Artificial Sequence
  Description of Artificial Sequence: Synthetic oligonucleotide
  Target: SCN9A; (+) strand; PAM type: NRG; PAM sequence: GAG
cagttgccacttgtgctttg

SEQ ID NO: 50266 - DNA, 20 bp, Artificial Sequence
  Description of Artificial Sequence: Synthetic oligonucleotide
  Target: SCN9A; (+) strand; PAM type: NRG; PAM sequence: TGG
tggagattcctcaacacttt

SEQ ID NO: 50267 - DNA, 20 bp, Artificial Sequence
  Description of Artificial Sequence: Synthetic oligonucleotide
  Target: SCN9A; (+) strand; PAM type: NRG; PAM sequence: AAG
caacacttttggaaatcata

SEQ ID NO: 50268 - DNA, 20 bp, Artificial Sequence
  Description of Artificial Sequence: Synthetic oligonucleotide
  Target: SCN9A; (+) strand; PAM type: NRG; PAM sequence: AGG
aacacttttggaaatcataa

SEQ ID NO: 50269 - DNA, 20 bp, Artificial Sequence
  Description of Artificial Sequence: Synthetic oligonucleotide
  Target: SCN9A; (+) strand; PAM type: NRG; PAM sequence: GAG
cttttggaaatcataaaggt

SEQ ID NO: 50270 - DNA, 20 bp, Artificial Sequence
  Description of Artificial Sequence: Synthetic oligonucleotide
  Target: SCN9A; (+) strand; PAM type: NRG; PAM sequence: AAG
ttggaaatcataaaggtgag

SEQ ID NO: 50271 - DNA, 20 bp, Artificial Sequence
  Description of Artificial Sequence: Synthetic oligonucleotide
  Target: SCN9A; (+) strand; PAM type: NRG; PAM sequence: CGG
aaatcataaaggtgagaaga

SEQ ID NO: 50272 - DNA, 20 bp, Artificial Sequence
  Description of Artificial Sequence: Synthetic oligonucleotide
  Target: SCN9A; (+) strand; PAM type: NRG; PAM sequence: GGG
aatcataaaggtgagaagac

SEQ ID NO: 50273 - DNA, 20 bp, Artificial Sequence
  Description of Artificial Sequence: Synthetic oligonucleotide
  Target: SCN9A; (+) strand; PAM type: NRG; PAM sequence: TAG
gacgggataacttgcctcac

SEQ ID NO: 50274 - DNA, 20 bp, Artificial Sequence
  Description of Artificial Sequence: Synthetic oligonucleotide
  Target: SCN9A; (+) strand; PAM type: NRG; PAM sequence: CAG
aacttgcctcactagacttt

SEQ ID NO: 50275 - DNA, 20 bp, Artificial Sequence
  Description of Artificial Sequence: Synthetic oligonucleotide
  Target: SCN9A; (+) strand; PAM type: NRG; PAM sequence: TAG
gcctcactagactttcagtg

SEQ ID NO: 50276 - DNA, 20 bp, Artificial Sequence
  Description of Artificial Sequence: Synthetic oligonucleotide
  Target: SCN9A; (+) strand; PAM type: NRG; PAM sequence: TGG
ctttcagtgtagacatactg

SEQ ID NO: 50277 - DNA, 20 bp, Artificial Sequence
  Description of Artificial Sequence: Synthetic oligonucleotide
  Target: SCN9A; (+) strand; PAM type: NRG; PAM sequence: AAG
tagacatactgtggctcttg

SEQ ID NO: 50278 - DNA, 20 bp, Artificial Sequence
  Description of Artificial Sequence: Synthetic oligonucleotide
  Target: SCN9A; (+) strand; PAM type: NRG; PAM sequence: AAG
atactgtggctcttgaagaa

SEQ ID NO: 50279 - DNA, 20 bp, Artificial Sequence
  Description of Artificial Sequence: Synthetic oligonucleotide
  Target: SCN9A; (+) strand; PAM type: NRG; PAM sequence: TGG
tgtggctcttgaagaaaagt

SEQ ID NO: 50280 - DNA, 20 bp, Artificial Sequence
  Description of Artificial Sequence: Synthetic oligonucleotide
  Target: SCN9A; (+) strand; PAM type: NRG; PAM sequence: TGG
gaaaagttggcttgaataac

SEQ ID NO: 50281 - DNA, 20 bp, Artificial Sequence
  Description of Artificial Sequence: Synthetic oligonucleotide
  Target: SCN9A; (+) strand; PAM type: NRG; PAM sequence: TAG
ttgaataactggtgtttttg

SEQ ID NO: 50282 - DNA, 20 bp, Artificial Sequence
  Description of Artificial Sequence: Synthetic oligonucleotide
  Target: SCN9A; (+) strand; PAM type: NRG; PAM sequence: TGG
ttgtagattctacattcaac

SEQ ID NO: 50283 - DNA, 20 bp, Artificial Sequence
  Description of Artificial Sequence: Synthetic oligonucleotide
  Target: SCN9A; (+) strand; PAM type: NRG; PAM sequence: GAG
gtagattctacattcaactg

SEQ ID NO: 50284 - DNA, 20 bp, Artificial Sequence
  Description of Artificial Sequence: Synthetic oligonucleotide
  Target: SCN9A; (+) strand; PAM type: NRG; PAM sequence: AGG
tagattctacattcaactgg

SEQ ID NO: 50285 - DNA, 20 bp, Artificial Sequence
  Description of Artificial Sequence: Synthetic oligonucleotide
  Target: SCN9A; (+) strand; PAM type: NRG; PAM sequence: GGG
agattctacattcaactgga

SEQ ID NO: 50286 - DNA, 20 bp, Artificial Sequence
  Description of Artificial Sequence: Synthetic oligonucleotide
  Target: SCN9A; (+) strand; PAM type: NRG; PAM sequence: AAG
tggagggtaccatctctttc

SEQ ID NO: 50287 - DNA, 20 bp, Artificial Sequence
  Description of Artificial Sequence: Synthetic oligonucleotide
  Target: SCN9A; (+) strand; PAM type: NRG; PAM sequence: CAG
ctctttcaagaattatttga

SEQ ID NO: 50288 - DNA, 20 bp, Artificial Sequence
  Description of Artificial Sequence: Synthetic oligonucleotide
  Target: SCN9A; (+) strand; PAM type: NRG; PAM sequence: TAG
agaattatttgacagaaatc

SEQ ID NO: 50289 - DNA, 20 bp, Artificial Sequence
  Description of Artificial Sequence: Synthetic oligonucleotide
  Target: SCN9A; (+) strand; PAM type: NRG; PAM sequence: AGG
gaattatttgacagaaatct

SEQ ID NO: 50290 - DNA, 20 bp, Artificial Sequence
  Description of Artificial Sequence: Synthetic oligonucleotide
  Target: SCN9A; (+) strand; PAM type: NRG; PAM sequence: AAG
ttgacagaaatctaggtaca

SEQ ID NO: 50291 - DNA, 20 bp, Artificial Sequence
  Description of Artificial Sequence: Synthetic oligonucleotide
  Target: SCN9A; (+) strand; PAM type: NRG; PAM sequence: CAG
gtacaaagatgttgtgaact

SEQ ID NO: 50292 - DNA, 20 bp, Artificial Sequence
  Description of Artificial Sequence: Synthetic oligonucleotide
  Target: SCN9A; (+) strand; PAM type: NRG; PAM sequence: CAG
tgaactcagatgtccattac

SEQ ID NO: 50293 - DNA, 20 bp, Artificial Sequence
  Description of Artificial Sequence: Synthetic oligonucleotide
  Target: SCN9A; (+) strand; PAM type: NRG; PAM sequence: CAG
ccccatgcacatgctcaaca

SEQ ID NO: 50294 - DNA, 20 bp, Artificial Sequence
  Description of Artificial Sequence: Synthetic oligonucleotide
  Target: SCN9A; (+) strand; PAM type: NRG; PAM sequence: CAG
gcacatgctcaacacagctc

SEQ ID NO: 50295 - DNA, 20 bp, Artificial Sequence
  Description of Artificial Sequence: Synthetic oligonucleotide
  Target: SCN9A; (+) strand; PAM type: NRG; PAM sequence: AAG
acacagctccagaatgacta

SEQ ID NO: 50296 - DNA, 20 bp, Artificial Sequence
  Description of Artificial Sequence: Synthetic oligonucleotide
  Target: SCN9A; (+) strand; PAM type: NRG; PAM sequence: AAG
atgactaaagtatatgaaaa

SEQ ID NO: 50297 - DNA, 20 bp, Artificial Sequence
  Description of Artificial Sequence: Synthetic oligonucleotide
  Target: SCN9A; (+) strand; PAM type: NRG; PAM sequence: CAG
actaaagtatatgaaaaaag

SEQ ID NO: 50298 - DNA, 20 bp, Artificial Sequence
  Description of Artificial Sequence: Synthetic oligonucleotide
  Target: SCN9A; (+) strand; PAM type: NRG; PAM sequence: GAG
taaagtatatgaaaaaagca

SEQ ID NO: 50299 - DNA, 20 bp, Artificial Sequence
  Description of Artificial Sequence: Synthetic oligonucleotide
  Target: SCN9A; (+) strand; PAM type: NRG; PAM sequence: AGG
aaagtatatgaaaaaagcag

SEQ ID NO: 50300 - DNA, 20 bp, Artificial Sequence
  Description of Artificial Sequence: Synthetic oligonucleotide
  Target: SCN9A; (+) strand; PAM type: NRG; PAM sequence: AAG
atatgaaaaaagcagaggca

SEQ ID NO: 50301 - DNA, 20 bp, Artificial Sequence
  Description of Artificial Sequence: Synthetic oligonucleotide
  Target: SCN9A; (+) strand; PAM type: NRG; PAM sequence: AGG
tatgaaaaaagcagaggcaa

SEQ ID NO: 50302 - DNA, 20 bp, Artificial Sequence
  Description of Artificial Sequence: Synthetic oligonucleotide
  Target: SCN9A; (+) strand; PAM type: NRG; PAM sequence: GGG
atgaaaaaagcagaggcaaa

SEQ ID NO: 50303 - DNA, 20 bp, Artificial Sequence
  Description of Artificial Sequence: Synthetic oligonucleotide
  Target: SCN9A; (+) strand; PAM type: NRG; PAM sequence: TGG
aaaaaagcagaggcaaaggg

SEQ ID NO: 50304 - DNA, 20 bp, Artificial Sequence
  Description of Artificial Sequence: Synthetic oligonucleotide
  Target: SCN9A; (+) strand; PAM type: NRG; PAM sequence: TAG
aggcaaagggtggtcaatgc

SEQ ID NO: 50305 - DNA, 20 bp, Artificial Sequence
  Description of Artificial Sequence: Synthetic oligonucleotide
  Target: SCN9A; (+) strand; PAM type: NRG; PAM sequence: TGG
caaagggtggtcaatgctag

SEQ ID NO: 50306 - DNA, 20 bp, Artificial Sequence
  Description of Artificial Sequence: Synthetic oligonucleotide
  Target: SCN9A; (+) strand; PAM type: NRG; PAM sequence: TGG
aatgctagtggtaccatgca

SEQ ID NO: 50307 - DNA, 20 bp, Artificial Sequence
  Description of Artificial Sequence: Synthetic oligonucleotide
  Target: SCN9A; (+) strand; PAM type: NRG; PAM sequence: GGG
atgctagtggtaccatgcat

SEQ ID NO: 50308 - DNA, 20 bp, Artificial Sequence
  Description of Artificial Sequence: Synthetic oligonucleotide
  Target: SCN9A; (+) strand; PAM type: NRG; PAM sequence: AAG
tgggcaatatttccctgatc

SEQ ID NO: 50309 - DNA, 20 bp, Artificial Sequence
  Description of Artificial Sequence: Synthetic oligonucleotide
  Target: SCN9A; (+) strand; PAM type: NRG; PAM sequence: AAG
tccctgatcaagctaaatta

SEQ ID NO: 50310 - DNA, 20 bp, Artificial Sequence
  Description of Artificial Sequence: Synthetic oligonucleotide
  Target: SCN9A; (+) strand; PAM type: NRG; PAM sequence: AGG
ccctgatcaagctaaattaa

SEQ ID NO: 50311 - DNA, 20 bp, Artificial Sequence
  Description of Artificial Sequence: Synthetic oligonucleotide
  Target: SCN9A; (+) strand; PAM type: NRG; PAM sequence: AAG
tgatcaagctaaattaaagg

SEQ ID NO: 50312 - DNA, 20 bp, Artificial Sequence
  Description of Artificial Sequence: Synthetic oligonucleotide
  Target: SCN9A; (+) strand; PAM type: NRG; PAM sequence: AAG
ctaaattaaaggaagacact

SEQ ID NO: 50313 - DNA, 20 bp, Artificial Sequence
  Description of Artificial Sequence: Synthetic oligonucleotide
  Target: SCN9A; (+) strand; PAM type: NRG; PAM sequence: TGG
taacatcatgatctgtgaaa

SEQ ID NO: 50314 - DNA, 20 bp, Artificial Sequence
  Description of Artificial Sequence: Synthetic oligonucleotide
  Target: SCN9A; (+) strand; PAM type: NRG; PAM sequence: AAG
catcatgatctgtgaaatgg

SEQ ID NO: 50315 - DNA, 20 bp, Artificial Sequence
  Description of Artificial Sequence: Synthetic oligonucleotide
  Target: SCN9A; (+) strand; PAM type: NRG; PAM sequence: AAG
gatctgtgaaatggaagttg

SEQ ID NO: 50316 - DNA, 20 bp, Artificial Sequence
  Description of Artificial Sequence: Synthetic oligonucleotide
  Target: SCN9A; (+) strand; PAM type: NRG; PAM sequence: GAG
tctgtgaaatggaagttgaa

SEQ ID NO: 50317 - DNA, 20 bp, Artificial Sequence
  Description of Artificial Sequence: Synthetic oligonucleotide
  Target: SCN9A; (+) strand; PAM type: NRG; PAM sequence: CAG
gaagttgaagagaccttgat

SEQ ID NO: 50318 - DNA, 20 bp, Artificial Sequence
  Description of Artificial Sequence: Synthetic oligonucleotide
  Target: SCN9A; (+) strand; PAM type: NRG; PAM sequence: TAG
cagatttcatcatcatcctc

SEQ ID NO: 50319 - DNA, 20 bp, Artificial Sequence
  Description of Artificial Sequence: Synthetic oligonucleotide
  Target: SCN9A; (+) strand; PAM type: NRG; PAM sequence: TGG
ttcatcatcatcctctagtt

SEQ ID NO: 50320 - DNA, 20 bp, Artificial Sequence
  Description of Artificial Sequence: Synthetic oligonucleotide
  Target: SCN9A; (+) strand; PAM type: NRG; PAM sequence: GAG
catcatcatcctctagtttg

SEQ ID NO: 50321 - DNA, 20 bp, Artificial Sequence
  Description of Artificial Sequence: Synthetic oligonucleotide
  Target: SCN9A; (+) strand; PAM type: NRG; PAM sequence: GAG
tcatcatcctctagtttgga

SEQ ID NO: 50322 - DNA, 20 bp, Artificial Sequence
  Description of Artificial Sequence: Synthetic oligonucleotide
  Target: SCN9A; (+) strand; PAM type: NRG; PAM sequence: AGG
catcatcctctagtttggag

SEQ ID NO: 50323 - DNA, 20 bp, Artificial Sequence
  Description of Artificial Sequence: Synthetic oligonucleotide
  Target: SCN9A; (+) strand; PAM type: NRG; PAM sequence: TAG
ctttcattttactaatttta

SEQ ID NO: 50324 - DNA, 20 bp, Artificial Sequence
  Description of Artificial Sequence: Synthetic oligonucleotide
  Target: SCN9A; (+) strand; PAM type: NRG; PAM sequence: AAG
ttactaattttatagctttg

SEQ ID NO: 50325 - DNA, 20 bp, Artificial Sequence
  Description of Artificial Sequence: Synthetic oligonucleotide
  Target: SCN9A; (+) strand; PAM type: NRG; PAM sequence: AAG
ctaattttatagctttgaag

SEQ ID NO: 50326 - DNA, 20 bp, Artificial Sequence
  Description of Artificial Sequence: Synthetic oligonucleotide
  Target: SCN9A; (+) strand; PAM type: NRG; PAM sequence: GAG
aattttatagctttgaagaa

SEQ ID NO: 50327 - DNA, 20 bp, Artificial Sequence
  Description of Artificial Sequence: Synthetic oligonucleotide
  Target: SCN9A; (+) strand; PAM type: NRG; PAM sequence: CAG
tttatagctttgaagaagag

SEQ ID NO: 50328 - DNA, 20 bp, Artificial Sequence
  Description of Artificial Sequence: Synthetic oligonucleotide
  Target: SCN9A; (+) strand; PAM type: NRG; PAM sequence: TAG
gctttgaagaagagcagctt

SEQ ID NO: 50329 - DNA, 20 bp, Artificial Sequence
  Description of Artificial Sequence: Synthetic oligonucleotide
  Target: SCN9A; (+) strand; PAM type: NRG; PAM sequence: TGG
tgaagaagagcagctttagt

SEQ ID NO: 50330 - DNA, 20 bp, Artificial Sequence
  Description of Artificial Sequence: Synthetic oligonucleotide
  Target: SCN9A; (+) strand; PAM type: NRG; PAM sequence: GAG
agcagctttagttggcatct

SEQ ID NO: 50331 - DNA, 20 bp, Artificial Sequence
  Description of Artificial Sequence: Synthetic oligonucleotide
  Target: SCN9A; (+) strand; PAM type: NRG; PAM sequence: TGG
agttggcatctgagtttgct

SEQ ID NO: 50332 - DNA, 20 bp, Artificial Sequence
  Description of Artificial Sequence: Synthetic oligonucleotide
  Target: SCN9A; (+) strand; PAM type: NRG; PAM sequence: AAG
tggcatctgagtttgcttgg

SEQ ID NO: 50333 - DNA, 20 bp, Artificial Sequence
  Description of Artificial Sequence: Synthetic oligonucleotide
  Target: SCN9A; (+) strand; PAM type: NRG; PAM sequence: CAG
ttgcttggaagttattgtac

SEQ ID NO: 50334 - DNA, 20 bp, Artificial Sequence
  Description of Artificial Sequence: Synthetic oligonucleotide
  Target: SCN9A; (+) strand; PAM type: NRG; PAM sequence: AGG
tgcttggaagttattgtacc

SEQ ID NO: 50335 - DNA, 20 bp, Artificial Sequence
  Description of Artificial Sequence: Synthetic oligonucleotide
  Target: SCN9A; (+) strand; PAM type: NRG; PAM sequence: CAG
tggaagttattgtaccaggc

SEQ ID NO: 50336 - DNA, 20 bp, Artificial Sequence
  Description of Artificial Sequence: Synthetic oligonucleotide
  Target: SCN9A; (+) strand; PAM type: NRG; PAM sequence: TGG
aagttattgtaccaggccag

SEQ ID NO: 50337 - DNA, 20 bp, Artificial Sequence
  Description of Artificial Sequence: Synthetic oligonucleotide
  Target: SCN9A; (+) strand; PAM type: NRG; PAM sequence: GGG
agttattgtaccaggccagt

SEQ ID NO: 50338 - DNA, 20 bp, Artificial Sequence
  Description of Artificial Sequence: Synthetic oligonucleotide
  Target: SCN9A; (+) strand; PAM type: NRG; PAM sequence: GGG
gttattgtaccaggccagtg

SEQ ID NO: 50339 - DNA, 20 bp, Artificial Sequence
  Description of Artificial Sequence: Synthetic oligonucleotide
  Target: SCN9A; (+) strand; PAM type: NRG; PAM sequence: TGG
attgtaccaggccagtgggg

SEQ ID NO: 50340 - DNA, 20 bp, Artificial Sequence
  Description of Artificial Sequence: Synthetic oligonucleotide
  Target: SCN9A; (+) strand; PAM type: NRG; PAM sequence: AAG
taccaggccagtggggtggc

SEQ ID NO: 50341 - DNA, 20 bp, Artificial Sequence
  Description of Artificial Sequence: Synthetic oligonucleotide
  Target: SCN9A; (+) strand; PAM type: NRG; PAM sequence: TAG
ccagtggggtggcaagatga

SEQ ID NO: 50342 - DNA, 20 bp, Artificial Sequence
  Description of Artificial Sequence: Synthetic oligonucleotide
  Target: SCN9A; (+) strand; PAM type: NRG; PAM sequence: AGG
cagtggggtggcaagatgat

SEQ ID NO: 50343 - DNA, 20 bp, Artificial Sequence
  Description of Artificial Sequence: Synthetic oligonucleotide
  Target: SCN9A; (+) strand; PAM type: NRG; PAM sequence: CAG
gtggcaagatgataggctga

SEQ ID NO: 50344 - DNA, 20 bp, Artificial Sequence
  Description of Artificial Sequence: Synthetic oligonucleotide
  Target: SCN9A; (+) strand; PAM type: NRG; PAM sequence: AGG
tggcaagatgataggctgac

SEQ ID NO: 50345 - DNA, 20 bp, Artificial Sequence
  Description of Artificial Sequence: Synthetic oligonucleotide
  Target: SCN9A; (+) strand; PAM type: NRG; PAM sequence: GGG
ggcaagatgataggctgaca

SEQ ID NO: 50346 - DNA, 20 bp, Artificial Sequence
  Description of Artificial Sequence: Synthetic oligonucleotide
  Target: SCN9A; (+) strand; PAM type: NRG; PAM sequence: CAG
atgataggctgacagggtta

SEQ ID NO: 50347 - DNA, 20 bp, Artificial Sequence
  Description of Artificial Sequence: Synthetic oligonucleotide
  Target: SCN9A; (+) strand; PAM type: NRG; PAM sequence: GAG
gataggctgacagggttaca

SEQ ID NO: 50348 - DNA, 20 bp, Artificial Sequence
  Description of Artificial Sequence: Synthetic oligonucleotide
  Target: SCN9A; (+) strand; PAM type: NRG; PAM sequence: AGG
ataggctgacagggttacag

SEQ ID NO: 50349 - DNA, 20 bp, Artificial Sequence
  Description of Artificial Sequence: Synthetic oligonucleotide
  Target: SCN9A; (+) strand; PAM type: NRG; PAM sequence: GGG
taggctgacagggttacaga

SEQ ID NO: 50350 - DNA, 20 bp, Artificial Sequence
  Description of Artificial Sequence: Synthetic oligonucleotide
  Target: SCN9A; (+) strand; PAM type: NRG; PAM sequence: AAG
agggttacagagggcaacat

SEQ ID NO: 50351 - DNA, 20 bp, Artificial Sequence
  Description of Artificial Sequence: Synthetic oligonucleotide
  Target: SCN9A; (+) strand; PAM type: NRG; PAM sequence: TGG
gagggcaacataagtaaaaa

SEQ ID NO: 50352 - DNA, 20 bp, Artificial Sequence
  Description of Artificial Sequence: Synthetic oligonucleotide
  Target: SCN9A; (+) strand; PAM type: NRG; PAM sequence: GAG
gggcaacataagtaaaaatg

SEQ ID NO: 50353 - DNA, 20 bp, Artificial Sequence
  Description of Artificial Sequence: Synthetic oligonucleotide
  Target: SCN9A; (+) strand; PAM type: NRG; PAM sequence: AAG
acacttcaccaacacacaca

SEQ ID NO: 50354 - DNA, 20 bp, Artificial Sequence
  Description of Artificial Sequence: Synthetic oligonucleotide
  Target: SCN9A; (+) strand; PAM type: NRG; PAM sequence: AAG
cttcaccaacacacacaaag

SEQ ID NO: 50355 - DNA, 20 bp, Artificial Sequence
  Description of Artificial Sequence: Synthetic oligonucleotide
  Target: SCN9A; (+) strand; PAM type: NRG; PAM sequence: TGG
acacaaagaagatgcaatga

SEQ ID NO: 50356 - DNA, 20 bp, Artificial Sequence
  Description of Artificial Sequence: Synthetic oligonucleotide
  Target: SCN9A; (+) strand; PAM type: NRG; PAM sequence: GGG
cacaaagaagatgcaatgat

SEQ ID NO: 50357 - DNA, 20 bp, Artificial Sequence
  Description of Artificial Sequence: Synthetic oligonucleotide
  Target: SCN9A; (+) strand; PAM type: NRG; PAM sequence: GGG
acaaagaagatgcaatgatg

SEQ ID NO: 50358 - DNA, 20 bp, Artificial Sequence
  Description of Artificial Sequence: Synthetic oligonucleotide
  Target: SCN9A; (+) strand; PAM type: NRG; PAM sequence: CAG
aagaagatgcaatgatgggg

SEQ ID NO: 50359 - DNA, 20 bp, Artificial Sequence
  Description of Artificial Sequence: Synthetic oligonucleotide
  Target: SCN9A; (+) strand; PAM type: NRG; PAM sequence: AGG
agaagatgcaatgatggggc

SEQ ID NO: 50360 - DNA, 20 bp, Artificial Sequence
  Description of Artificial Sequence: Synthetic oligonucleotide
  Target: SCN9A; (+) strand; PAM type: NRG; PAM sequence: TAG
caacttctttcctcttccct

SEQ ID NO: 50361 - DNA, 20 bp, Artificial Sequence
  Description of Artificial Sequence: Synthetic oligonucleotide
  Target: SCN9A; (+) strand; PAM type: NRG; PAM sequence: TGG
ttcctcttcccttagtcttc

SEQ ID NO: 50362 - DNA, 20 bp, Artificial Sequence
  Description of Artificial Sequence: Synthetic oligonucleotide
  Target: SCN9A; (+) strand; PAM type: NRG; PAM sequence: CAG
cccttagtcttctggataaa

SEQ ID NO: 50363 - DNA, 20 bp, Artificial Sequence
  Description of Artificial Sequence: Synthetic oligonucleotide
  Target: SCN9A; (+) strand; PAM type: NRG; PAM sequence: AGG
ccttagtcttctggataaac

SEQ ID NO: 50364 - DNA, 20 bp, Artificial Sequence
  Description of Artificial Sequence: Synthetic oligonucleotide
  Target: SCN9A; (+) strand; PAM type: NRG; PAM sequence: CAG
tcttctggataaacaggcca

SEQ ID NO: 50365 - DNA, 20 bp, Artificial Sequence
  Description of Artificial Sequence: Synthetic oligonucleotide
  Target: SCN9A; (+) strand; PAM type: NRG; PAM sequence: AGG
cttctggataaacaggccac

SEQ ID NO: 50366 - DNA, 20 bp, Artificial Sequence
  Description of Artificial Sequence: Synthetic oligonucleotide
  Target: SCN9A; (+) strand; PAM type: NRG; PAM sequence: GAG
tctggataaacaggccacag

SEQ ID NO: 50367 - DNA, 20 bp, Artificial Sequence
  Description of Artificial Sequence: Synthetic oligonucleotide
  Target: SCN9A; (+) strand; PAM type: NRG; PAM sequence: TAG
caggccacaggagttttcat

SEQ ID NO: 50368 - DNA, 20 bp, Artificial Sequence
  Description of Artificial Sequence: Synthetic oligonucleotide
  Target: SCN9A; (+) strand; PAM type: NRG; PAM sequence: CAG
ccacaggagttttcattagt

SEQ ID NO: 50369 - DNA, 20 bp, Artificial Sequence
  Description of Artificial Sequence: Synthetic oligonucleotide
  Target: SCN9A; (+) strand; PAM type: NRG; PAM sequence: AGG
cacaggagttttcattagtc

SEQ ID NO: 50370 - DNA, 20 bp, Artificial Sequence
  Description of Artificial Sequence: Synthetic oligonucleotide
  Target: SCN9A; (+) strand; PAM type: NRG; PAM sequence: TAG
gttttcattagtcaggcatt

SEQ ID NO: 50371 - DNA, 20 bp, Artificial Sequence
  Description of Artificial Sequence: Synthetic oligonucleotide
  Target: SCN9A; (+) strand; PAM type: NRG; PAM sequence: AAG
attagtcaggcatttagttt

SEQ ID NO: 50372 - DNA, 20 bp, Artificial Sequence
  Description of Artificial Sequence: Synthetic oligonucleotide
  Target: SCN9A; (+) strand; PAM type: NRG; PAM sequence: GAG
aggcatttagtttaagattt

SEQ ID NO: 50373 - DNA, 20 bp, Artificial Sequence
  Description of Artificial Sequence: Synthetic oligonucleotide
  Target: SCN9A; (+) strand; PAM type: NRG; PAM sequence: TGG
agtttaagatttgagatttc

SEQ ID NO: 50374 - DNA, 20 bp, Artificial Sequence
  Description of Artificial Sequence: Synthetic oligonucleotide
  Target: SCN9A; (+) strand; PAM type: NRG; PAM sequence: TGG
ttaagatttgagatttctgg

SEQ ID NO: 50375 - DNA, 20 bp, Artificial Sequence
  Description of Artificial Sequence: Synthetic oligonucleotide
  Target: SCN9A; (+) strand; PAM type: NRG; PAM sequence: GAG
aagatttgagatttctggtg

SEQ ID NO: 50376 - DNA, 20 bp, Artificial Sequence
  Description of Artificial Sequence: Synthetic oligonucleotide
  Target: SCN9A; (+) strand; PAM type: NRG; PAM sequence: TGG
tggtggagtaaatatttaaa

SEQ ID NO: 50377 - DNA, 20 bp, Artificial Sequence
  Description of Artificial Sequence: Synthetic oligonucleotide
  Target: SCN9A; (+) strand; PAM type: NRG; PAM sequence: AAG
aatatttaaatggaaaaata

SEQ ID NO: 50378 - DNA, 20 bp, Artificial Sequence
  Description of Artificial Sequence: Synthetic oligonucleotide
  Target: SCN9A; (+) strand; PAM type: NRG; PAM sequence: AAG
aagctcaaacattctaataa

SEQ ID NO: 50379 - DNA, 20 bp, Artificial Sequence
  Description of Artificial Sequence: Synthetic oligonucleotide
  Target: SCN9A; (+) strand; PAM type: NRG; PAM sequence: GAG
aatgaatacttatttaatgt

SEQ ID NO: 50380 - DNA, 20 bp, Artificial Sequence
  Description of Artificial Sequence: Synthetic oligonucleotide
  Target: SCN9A; (+) strand; PAM type: NRG; PAM sequence: GAG
tgaatacttatttaatgtga

SEQ ID NO: 50381 - DNA, 20 bp, Artificial Sequence
  Description of Artificial Sequence: Synthetic oligonucleotide
  Target: SCN9A; (+) strand; PAM type: NRG; PAM sequence: TAG
atacttatttaatgtgagag

SEQ ID NO: 50382 - DNA, 20 bp, Artificial Sequence
  Description of Artificial Sequence: Synthetic oligonucleotide
  Target: SCN9A; (+) strand; PAM type: NRG; PAM sequence: GAG
acttatttaatgtgagagta

SEQ ID NO: 50383 - DNA, 20 bp, Artificial Sequence
  Description of Artificial Sequence: Synthetic oligonucleotide
  Target: SCN9A; (+) strand; PAM type: NRG; PAM sequence: GAG
ttatttaatgtgagagtaga

SEQ ID NO: 50384 - DNA, 20 bp, Artificial Sequence
  Description of Artificial Sequence: Synthetic oligonucleotide
  Target: SCN9A; (+) strand; PAM type: NRG; PAM sequence: AGG
tatttaatgtgagagtagag

SEQ ID NO: 50385 - DNA, 20 bp, Artificial Sequence
  Description of Artificial Sequence: Synthetic oligonucleotide
  Target: SCN9A; (+) strand; PAM type: NRG; PAM sequence: AAG
gagagtagagaggacttgta

SEQ ID NO: 50386 - DNA, 20 bp, Artificial Sequence
  Description of Artificial Sequence: Synthetic oligonucleotide
  Target: SCN9A; (+) strand; PAM type: NRG; PAM sequence: AAG
acttgtaaagcattacacca

SEQ ID NO: 50387 - DNA, 20 bp, Artificial Sequence
  Description of Artificial Sequence: Synthetic oligonucleotide
  Target: SCN9A; (+) strand; PAM type: NRG; PAM sequence: AGG
cttgtaaagcattacaccaa

SEQ ID NO: 50388 - DNA, 20 bp, Artificial Sequence
  Description of Artificial Sequence: Synthetic oligonucleotide
  Target: SCN9A; (+) strand; PAM type: NRG; PAM sequence: AAG
caccaaaggcaaaatcgaaa

SEQ ID NO: 50389 - DNA, 20 bp, Artificial Sequence
  Description of Artificial Sequence: Synthetic oligonucleotide
  Target: SCN9A; (+) strand; PAM type: NRG; PAM sequence: AAG
aggcaaaatcgaaaaagata

SEQ ID NO: 50390 - DNA, 20 bp, Artificial Sequence
  Description of Artificial Sequence: Synthetic oligonucleotide
  Target: SCN9A; (+) strand; PAM type: NRG; PAM sequence: TAG
tcgaaaaagataaagaatgc

SEQ ID NO: 50391 - DNA, 20 bp, Artificial Sequence
  Description of Artificial Sequence: Synthetic oligonucleotide
  Target: SCN9A; (+) strand; PAM type: NRG; PAM sequence: AAG
gatttaatctcataacaatg

SEQ ID NO: 50392 - DNA, 20 bp, Artificial Sequence
  Description of Artificial Sequence: Synthetic oligonucleotide
  Target: SCN9A; (+) strand; PAM type: NRG; PAM sequence: AGG
atttaatctcataacaatga

SEQ ID NO: 50393 - DNA, 20 bp, Artificial Sequence
  Description of Artificial Sequence: Synthetic oligonucleotide
  Target: SCN9A; (+) strand; PAM type: NRG; PAM sequence: AAG
ataacaatgaaggtttttaa

SEQ ID NO: 50394 - DNA, 20 bp, Artificial Sequence
  Description of Artificial Sequence: Synthetic oligonucleotide
  Target: SCN9A; (+) strand; PAM type: NRG; PAM sequence: TGG
acaatgaaggtttttaaaag

SEQ ID NO: 50395 - DNA, 20 bp, Artificial Sequence
  Description of Artificial Sequence: Synthetic oligonucleotide
  Target: SCN9A; (+) strand; PAM type: NRG; PAM sequence: AAG
atgaaggtttttaaaagtgg

SEQ ID NO: 50396 - DNA, 20 bp, Artificial Sequence
  Description of Artificial Sequence: Synthetic oligonucleotide
  Target: SCN9A; (+) strand; PAM type: NRG; PAM sequence: AGG
tgaaggtttttaaaagtgga

SEQ ID NO: 50397 - DNA, 20 bp, Artificial Sequence
  Description of Artificial Sequence: Synthetic oligonucleotide
  Target: SCN9A; (+) strand; PAM type: NRG; PAM sequence: AAG
aggcatccacaaaataaaaa

SEQ ID NO: 50398 - DNA, 20 bp, Artificial Sequence
  Description of Artificial Sequence: Synthetic oligonucleotide
  Target: SCN9A; (+) strand; PAM type: NRG; PAM sequence: CAG
aaaaagtacaatacaaatga

SEQ ID NO: 50399 - DNA, 20 bp, Artificial Sequence
  Description of Artificial Sequence: Synthetic oligonucleotide
  Target: SCN9A; (+) strand; PAM type: NRG; PAM sequence: AAG
tacaatacaaatgacagatg

SEQ ID NO: 50400 - DNA, 20 bp, Artificial Sequence
  Description of Artificial Sequence: Synthetic oligonucleotide
  Target: SCN9A; (+) strand; PAM type: NRG; PAM sequence: AAG
tgcttttcctttaatgaata

SEQ ID NO: 50401 - DNA, 20 bp, Artificial Sequence
  Description of Artificial Sequence: Synthetic oligonucleotide
  Target: SCN9A; (+) strand; PAM type: NRG; PAM sequence: TAG
ttaatatatctcataaaatt

SEQ ID NO: 50402 - DNA, 20 bp, Artificial Sequence
  Description of Artificial Sequence: Synthetic oligonucleotide
  Target: SCN9A; (+) strand; PAM type: NRG; PAM sequence: TGG
taattatctaaaaatacaaa

SEQ ID NO: 50403 - DNA, 20 bp, Artificial Sequence
  Description of Artificial Sequence: Synthetic oligonucleotide
  Target: SCN9A; (+) strand; PAM type: NRG; PAM sequence: TAG
gtaaccatgtcaaacctcac

SEQ ID NO: 50404 - DNA, 20 bp, Artificial Sequence
  Description of Artificial Sequence: Synthetic oligonucleotide
  Target: SCN9A; (+) strand; PAM type: NRG; PAM sequence: AAG
tcaaacctcactagtaatca

SEQ ID NO: 50405 - DNA, 20 bp, Artificial Sequence
  Description of Artificial Sequence: Synthetic oligonucleotide
  Target: SCN9A; (+) strand; PAM type: NRG; PAM sequence: TGG
aacaaatattaaaataaaca

SEQ ID NO: 50406 - DNA, 20 bp, Artificial Sequence
  Description of Artificial Sequence: Synthetic oligonucleotide
  Target: SCN9A; (+) strand; PAM type: NRG; PAM sequence: GGG
acaaatattaaaataaacat

SEQ ID NO: 50407 - DNA, 20 bp, Artificial Sequence
  Description of Artificial Sequence: Synthetic oligonucleotide
  Target: SCN9A; (+) strand; PAM type: NRG; PAM sequence: GGG
caaatattaaaataaacatg

SEQ ID NO: 50408 - DNA, 20 bp, Artificial Sequence
  Description of Artificial Sequence: Synthetic oligonucleotide
  Target: SCN9A; (+) strand; PAM type: NRG; PAM sequence: TGG
taaacatggggaaccaaatt

SEQ ID NO: 50409 - DNA, 20 bp, Artificial Sequence
  Description of Artificial Sequence: Synthetic oligonucleotide
  Target: SCN9A; (+) strand; PAM type: NRG; PAM sequence: TAG
aaatttggcctattaatcat

SEQ ID NO: 50410 - DNA, 20 bp, Artificial Sequence
  Description of Artificial Sequence: Synthetic oligonucleotide
  Target: SCN9A; (+) strand; PAM type: NRG; PAM sequence: AAG
tggcctattaatcattagca

SEQ ID NO: 50411 - DNA, 20 bp, Artificial Sequence
  Description of Artificial Sequence: Synthetic oligonucleotide
  Target: SCN9A; (+) strand; PAM type: NRG; PAM sequence: AAG
attagcaaagattttaacaa

SEQ ID NO: 50412 - DNA, 20 bp, Artificial Sequence
  Description of Artificial Sequence: Synthetic oligonucleotide
  Target: SCN9A; (+) strand; PAM type: NRG; PAM sequence: TAG
aaagattttaacaaaagtaa

SEQ ID NO: 50413 - DNA, 20 bp, Artificial Sequence
  Description of Artificial Sequence: Synthetic oligonucleotide
  Target: SCN9A; (+) strand; PAM type: NRG; PAM sequence: TAG
aacaaaagtaatagtgatat

SEQ ID NO: 50414 - DNA, 20 bp, Artificial Sequence
  Description of Artificial Sequence: Synthetic oligonucleotide
  Target: SCN9A; (+) strand; PAM type: NRG; PAM sequence: GAG
caaaagtaatagtgatatta

SEQ ID NO: 50415 - DNA, 20 bp, Artificial Sequence
  Description of Artificial Sequence: Synthetic oligonucleotide
  Target: SCN9A; (+) strand; PAM type: NRG; PAM sequence: GAG
aaagtaatagtgatattaga

SEQ ID NO: 50416 - DNA, 20 bp, Artificial Sequence
  Description of Artificial Sequence: Synthetic oligonucleotide
  Target: SCN9A; (+) strand; PAM type: NRG; PAM sequence: AGG
aagtaatagtgatattagag

SEQ ID NO: 50417 - DNA, 20 bp, Artificial Sequence
  Description of Artificial Sequence: Synthetic oligonucleotide
  Target: SCN9A; (+) strand; PAM type: NRG; PAM sequence: TAG
tagtgatattagagaggtta

SEQ ID NO: 50418 - DNA, 20 bp, Artificial Sequence
  Description of Artificial Sequence: Synthetic oligonucleotide
  Target: SCN9A; (+) strand; PAM type: NRG; PAM sequence: AGG
agtgatattagagaggttat

SEQ ID NO: 50419 - DNA, 20 bp, Artificial Sequence
  Description of Artificial Sequence: Synthetic oligonucleotide
  Target: SCN9A; (+) strand; PAM type: NRG; PAM sequence: GGG
gtgatattagagaggttata

SEQ ID NO: 50420 - DNA, 20 bp, Artificial Sequence
  Description of Artificial Sequence: Synthetic oligonucleotide
  Target: SCN9A; (+) strand; PAM type: NRG; PAM sequence: GGG
tgatattagagaggttatag

SEQ ID NO: 50421 - DNA, 20 bp, Artificial Sequence
  Description of Artificial Sequence: Synthetic oligonucleotide
  Target: SCN9A; (+) strand; PAM type: NRG; PAM sequence: CAG
agagaggttataggggaaat

SEQ ID NO: 50422 - DNA, 20 bp, Artificial Sequence
  Description of Artificial Sequence: Synthetic oligonucleotide
  Target: SCN9A; (+) strand; PAM type: NRG; PAM sequence: TGG
ggaaatcagtgttgcctgtc

SEQ ID NO: 50423 - DNA, 20 bp, Artificial Sequence
  Description of Artificial Sequence: Synthetic oligonucleotide
  Target: SCN9A; (+) strand; PAM type: NRG; PAM sequence: AAG
agtgttgcctgtctggatga

SEQ ID NO: 50424 - DNA, 20 bp, Artificial Sequence
  Description of Artificial Sequence: Synthetic oligonucleotide
  Target: SCN9A; (+) strand; PAM type: NRG; PAM sequence: TGG
aataaataatgtgtactgtc

SEQ ID NO: 50425 - DNA, 20 bp, Artificial Sequence
  Description of Artificial Sequence: Synthetic oligonucleotide
  Target: SCN9A; (+) strand; PAM type: NRG; PAM sequence: GGG
ataaataatgtgtactgtct

SEQ ID NO: 50426 - DNA, 20 bp, Artificial Sequence
  Description of Artificial Sequence: Synthetic oligonucleotide
  Target: SCN9A; (+) strand; PAM type: NRG; PAM sequence: CGG
taatgtgtactgtctgggtg

SEQ ID NO: 50427 - DNA, 20 bp, Artificial Sequence
  Description of Artificial Sequence: Synthetic oligonucleotide
  Target: SCN9A; (+) strand; PAM type: NRG; PAM sequence: TGG
tgtgtactgtctgggtgcgg

SEQ ID NO: 50428 - DNA, 20 bp, Artificial Sequence
  Description of Artificial Sequence: Synthetic oligonucleotide
  Target: SCN9A; (+) strand; PAM type: NRG; PAM sequence: CAG
gtggctcacgcctataatcc

SEQ ID NO: 50429 - DNA, 20 bp, Artificial Sequence
  Description of Artificial Sequence: Synthetic oligonucleotide
  Target: SCN9A; (+) strand; PAM type: NRG; PAM sequence: TGG
cgcctataatcccagaactt

SEQ ID NO: 50430 - DNA, 20 bp, Artificial Sequence
  Description of Artificial Sequence: Synthetic oligonucleotide
  Target: SCN9A; (+) strand; PAM type: NRG; PAM sequence: GGG
gcctataatcccagaacttt

SEQ ID NO: 50431 - DNA, 20 bp, Artificial Sequence
  Description of Artificial Sequence: Synthetic oligonucleotide
  Target: SCN9A; (+) strand; PAM type: NRG; PAM sequence: GAG
ctataatcccagaactttgg

SEQ ID NO: 50432 - DNA, 20 bp, Artificial Sequence
  Description of Artificial Sequence: Synthetic oligonucleotide
  Target: SCN9A; (+) strand; PAM type: NRG; PAM sequence: AGG
tataatcccagaactttggg

SEQ ID NO: 50433 - DNA, 20 bp, Artificial Sequence
  Description of Artificial Sequence: Synthetic oligonucleotide
  Target: SCN9A; (+) strand; PAM type: NRG; PAM sequence: CAG
tcccagaactttgggaggcc

SEQ ID NO: 50434 - DNA, 20 bp, Artificial Sequence
  Description of Artificial Sequence: Synthetic oligonucleotide
  Target: SCN9A; (+) strand; PAM type: NRG; PAM sequence: AGG
cccagaactttgggaggccc

SEQ ID NO: 50435 - DNA, 20 bp, Artificial Sequence
  Description of Artificial Sequence: Synthetic oligonucleotide
  Target: SCN9A; (+) strand; PAM type: NRG; PAM sequence: CAG
agaactttgggaggcccagg

SEQ ID NO: 50436 - DNA, 20 bp, Artificial Sequence
  Description of Artificial Sequence: Synthetic oligonucleotide
  Target: SCN9A; (+) strand; PAM type: NRG; PAM sequence: AGG
gaactttgggaggcccaggc

SEQ ID NO: 50437 - DNA, 20 bp, Artificial Sequence
  Description of Artificial Sequence: Synthetic oligonucleotide
  Target: SCN9A; (+) strand; PAM type: NRG; PAM sequence: CAG
ctttgggaggcccaggcagg

SEQ ID NO: 50438 - DNA, 20 bp, Artificial Sequence
  Description of Artificial Sequence: Synthetic oligonucleotide
  Target: SCN9A; (+) strand; PAM type: NRG; PAM sequence: GAG
ggcccaggcaggcagatcat

SEQ ID NO: 50439 - DNA, 20 bp, Artificial Sequence
  Description of Artificial Sequence: Synthetic oligonucleotide
  Target: SCN9A; (+) strand; PAM type: NRG; PAM sequence: AGG
gcccaggcaggcagatcatg

SEQ ID NO: 50440 - DNA, 20 bp, Artificial Sequence
  Description of Artificial Sequence: Synthetic oligonucleotide
  Target: SCN9A; (+) strand; PAM type: NRG; PAM sequence: CAG
aggcaggcagatcatgaggt

SEQ ID NO: 50441 - DNA, 20 bp, Artificial Sequence
  Description of Artificial Sequence: Synthetic oligonucleotide
  Target: SCN9A; (+) strand; PAM type: NRG; PAM sequence: AGG
ggcaggcagatcatgaggtc

SEQ ID NO: 50442 - DNA, 20 bp, Artificial Sequence
  Description of Artificial Sequence: Synthetic oligonucleotide
  Target: SCN9A; (+) strand; PAM type: NRG; PAM sequence: GAG
caggcagatcatgaggtcag

SEQ ID NO: 50443 - DNA, 20 bp, Artificial Sequence
  Description of Artificial Sequence: Synthetic oligonucleotide
  Target: SCN9A; (+) strand; PAM type: NRG; PAM sequence: GAG
gatcatgaggtcaggagatc

SEQ ID NO: 50444 - DNA, 20 bp, Artificial Sequence
  Description of Artificial Sequence: Synthetic oligonucleotide
  Target: SCN9A; (+) strand; PAM type: NRG; PAM sequence: TGG
tcaggagatcgagaccaacc

SEQ ID NO: 50445 - DNA, 20 bp, Artificial Sequence
  Description of Artificial Sequence: Synthetic oligonucleotide
  Target: SCN9A; (+) strand; PAM type: NRG; PAM sequence: AAG
tgaaaccctgtctctactaa

SEQ ID NO: 50446 - DNA, 20 bp, Artificial Sequence
  Description of Artificial Sequence: Synthetic oligonucleotide
  Target: SCN9A; (+) strand; PAM type: NRG; PAM sequence: TAG
tactaaaagtacaaaaaaat

SEQ ID NO: 50447 - DNA, 20 bp, Artificial Sequence
  Description of Artificial Sequence: Synthetic oligonucleotide
  Target: SCN9A; (+) strand; PAM type: NRG; PAM sequence: CAG
aaaagtacaaaaaaattagc

SEQ ID NO: 50448 - DNA, 20 bp, Artificial Sequence
  Description of Artificial Sequence: Synthetic oligonucleotide
  Target: SCN9A; (+) strand; PAM type: NRG; PAM sequence: AGG
aaagtacaaaaaaattagcc

SEQ ID NO: 50449 - DNA, 20 bp, Artificial Sequence
  Description of Artificial Sequence: Synthetic oligonucleotide
  Target: SCN9A; (+) strand; PAM type: NRG; PAM sequence: TGG
aaaaaattagccaggcatgt

SEQ ID NO: 50450 - DNA, 20 bp, Artificial Sequence
  Description of Artificial Sequence: Synthetic oligonucleotide
  Target: SCN9A; (+) strand; PAM type: NRG; PAM sequence: CAG
aaattagccaggcatgttgg

SEQ ID NO: 50451 - DNA, 20 bp, Artificial Sequence
  Description of Artificial Sequence: Synthetic oligonucleotide
  Target: SCN9A; (+) strand; PAM type: NRG; PAM sequence: AGG
aattagccaggcatgttggc

SEQ ID NO: 50452 - DNA, 20 bp, Artificial Sequence
  Description of Artificial Sequence: Synthetic oligonucleotide
  Target: SCN9A; (+) strand; PAM type: NRG; PAM sequence: TAG
ggcatgttggcaggcgccta

SEQ ID NO: 50453 - DNA, 20 bp, Artificial Sequence
  Description of Artificial Sequence: Synthetic oligonucleotide
  Target: SCN9A; (+) strand; PAM type: NRG; PAM sequence: CAG
ttggcaggcgcctatagtcc

SEQ ID NO: 50454 - DNA, 20 bp, Artificial Sequence
  Description of Artificial Sequence: Synthetic oligonucleotide
  Target: SCN9A; (+) strand; PAM type: NRG; PAM sequence: CGG
cgcctatagtcccagctgct

SEQ ID NO: 50455 - DNA, 20 bp, Artificial Sequence
  Description of Artificial Sequence: Synthetic oligonucleotide
  Target: SCN9A; (+) strand; PAM type: NRG; PAM sequence: GGG
gcctatagtcccagctgctc

SEQ ID NO: 50456 - DNA, 20 bp, Artificial Sequence
  Description of Artificial Sequence: Synthetic oligonucleotide
  Target: SCN9A; (+) strand; PAM type: NRG; PAM sequence: GAG
ctatagtcccagctgctcgg

SEQ ID NO: 50457 - DNA, 20 bp, Artificial Sequence
  Description of Artificial Sequence: Synthetic oligonucleotide
  Target: SCN9A; (+) strand; PAM type: NRG; PAM sequence: AGG
tatagtcccagctgctcggg

SEQ ID NO: 50458 - DNA, 20 bp, Artificial Sequence
  Description of Artificial Sequence: Synthetic oligonucleotide
  Target: SCN9A; (+) strand; PAM type: NRG; PAM sequence: GAG
tcccagctgctcgggaggct

SEQ ID NO: 50459 - DNA, 20 bp, Artificial Sequence
  Description of Artificial Sequence: Synthetic oligonucleotide
  Target: SCN9A; (+) strand; PAM type: NRG; PAM sequence: AGG
cccagctgctcgggaggctg

SEQ ID NO: 50460 - DNA, 20 bp, Artificial Sequence
  Description of Artificial Sequence: Synthetic oligonucleotide
  Target: SCN9A; (+) strand; PAM type: NRG; PAM sequence: CAG
agctgctcgggaggctgagg

SEQ ID NO: 50461 - DNA, 20 bp, Artificial Sequence
  Description of Artificial Sequence: Synthetic oligonucleotide
  Target: SCN9A; (+) strand; PAM type: NRG; PAM sequence: GAG
ctgctcgggaggctgaggca

SEQ ID NO: 50462 - DNA, 20 bp, Artificial Sequence
  Description of Artificial Sequence: Synthetic oligonucleotide
  Target: SCN9A; (+) strand; PAM type: NRG; PAM sequence: TGG
cgggaggctgaggcagagaa

SEQ ID NO: 50463 - DNA, 20 bp, Artificial Sequence
  Description of Artificial Sequence: Synthetic oligonucleotide
  Target: SCN9A; (+) strand; PAM type: NRG; PAM sequence: CAG
ggcagagaatggcgtgaacc

SEQ ID NO: 50464 - DNA, 20 bp, Artificial Sequence
  Description of Artificial Sequence: Synthetic oligonucleotide
  Target: SCN9A; (+) strand; PAM type: NRG; PAM sequence: AGG
gcagagaatggcgtgaaccc

SEQ ID NO: 50465 - DNA, 20 bp, Artificial Sequence
  Description of Artificial Sequence: Synthetic oligonucleotide
  Target: SCN9A; (+) strand; PAM type: NRG; PAM sequence: GAG
agagaatggcgtgaacccag

SEQ ID NO: 50466 - DNA, 20 bp, Artificial Sequence
  Description of Artificial Sequence: Synthetic oligonucleotide
  Target: SCN9A; (+) strand; PAM type: NRG; PAM sequence: AGG
gagaatggcgtgaacccagg

SEQ ID NO: 50467 - DNA, 20 bp, Artificial Sequence
  Description of Artificial Sequence: Synthetic oligonucleotide
  Target: SCN9A; (+) strand; PAM type: NRG; PAM sequence: CGG
aatggcgtgaacccaggagg

SEQ ID NO: 50468 - DNA, 20 bp, Artificial Sequence
  Description of Artificial Sequence: Synthetic oligonucleotide
  Target: SCN9A; (+) strand; PAM type: NRG; PAM sequence: GAG
tggcgtgaacccaggaggcg

SEQ ID NO: 50469 - DNA, 20 bp, Artificial Sequence
  Description of Artificial Sequence: Synthetic oligonucleotide
  Target: SCN9A; (+) strand; PAM type: NRG; PAM sequence: CAG
aacccaggaggcggagcttg

SEQ ID NO: 50470 - DNA, 20 bp, Artificial Sequence
  Description of Artificial Sequence: Synthetic oligonucleotide
  Target: SCN9A; (+) strand; PAM type: NRG; PAM sequence: GAG
caggaggcggagcttgcagt

SEQ ID NO: 50471 - DNA, 20 bp, Artificial Sequence
  Description of Artificial Sequence: Synthetic oligonucleotide
  Target: SCN9A; (+) strand; PAM type: NRG; PAM sequence: AAG
ggcggagcttgcagtgagcc

SEQ ID NO: 50472 - DNA, 20 bp, Artificial Sequence
  Description of Artificial Sequence: Synthetic oligonucleotide
  Target: SCN9A; (+) strand; PAM type: NRG; PAM sequence: CAG
aagatcgtgccactgcactc

SEQ ID NO: 50473 - DNA, 20 bp, Artificial Sequence
  Description of Artificial Sequence: Synthetic oligonucleotide
  Target: SCN9A; (+) strand; PAM type: NRG; PAM sequence: TGG
cgtgccactgcactccagcc

SEQ ID NO: 50474 - DNA, 20 bp, Artificial Sequence
  Description of Artificial Sequence: Synthetic oligonucleotide
  Target: SCN9A; (+) strand; PAM type: NRG; PAM sequence: GGG
gtgccactgcactccagcct

SEQ ID NO: 50475 - DNA, 20 bp, Artificial Sequence
  Description of Artificial Sequence: Synthetic oligonucleotide
  Target: SCN9A; (+) strand; PAM type: NRG; PAM sequence: TAG
ctgcactccagcctgggcaa

SEQ ID NO: 50476 - DNA, 20 bp, Artificial Sequence
  Description of Artificial Sequence: Synthetic oligonucleotide
  Target: SCN9A; (+) strand; PAM type: NRG; PAM sequence: GAG
gcactccagcctgggcaata

SEQ ID NO: 50477 - DNA, 20 bp, Artificial Sequence
  Description of Artificial Sequence: Synthetic oligonucleotide
  Target: SCN9A; (+) strand; PAM type: NRG; PAM sequence: GAG
tccagcctgggcaatagagc

SEQ ID NO: 50478 - DNA, 20 bp, Artificial Sequence
  Description of Artificial Sequence: Synthetic oligonucleotide
  Target: SCN9A; (+) strand; PAM type: NRG; PAM sequence: AAG
ccgtctcaaataaataaata

SEQ ID NO: 50479 - DNA, 20 bp, Artificial Sequence
  Description of Artificial Sequence: Synthetic oligonucleotide
  Target: SCN9A; (+) strand; PAM type: NRG; PAM sequence: GAG
ataaagtgtacaaacttttt

SEQ ID NO: 50480 - DNA, 20 bp, Artificial Sequence
  Description of Artificial Sequence: Synthetic oligonucleotide
  Target: SCN9A; (+) strand; PAM type: NRG; PAM sequence: AGG
taaagtgtacaaactttttg

SEQ ID NO: 50481 - DNA, 20 bp, Artificial Sequence
  Description of Artificial Sequence: Synthetic oligonucleotide
  Target: SCN9A; (+) strand; PAM type: NRG; PAM sequence: GGG
aaagtgtacaaactttttga

SEQ ID NO: 50482 - DNA, 20 bp, Artificial Sequence
  Description of Artificial Sequence: Synthetic oligonucleotide
  Target: SCN9A; (+) strand; PAM type: NRG; PAM sequence: AAG
aattttgtaatatctatcaa

SEQ ID NO: 50483 - DNA, 20 bp, Artificial Sequence
  Description of Artificial Sequence: Synthetic oligonucleotide
  Target: SCN9A; (+) strand; PAM type: NRG; PAM sequence: TAG
ttgccaaataattttccttc

SEQ ID NO: 50484 - DNA, 20 bp, Artificial Sequence
  Description of Artificial Sequence: Synthetic oligonucleotide
  Target: SCN9A; (+) strand; PAM type: NRG; PAM sequence: AGG
tgccaaataattttccttct

SEQ ID NO: 50485 - DNA, 20 bp, Artificial Sequence
  Description of Artificial Sequence: Synthetic oligonucleotide
  Target: SCN9A; (+) strand; PAM type: NRG; PAM sequence: AAG
tccttctaggaatttattca

SEQ ID NO: 50486 - DNA, 20 bp, Artificial Sequence
  Description of Artificial Sequence: Synthetic oligonucleotide
  Target: SCN9A; (+) strand; PAM type: NRG; PAM sequence: CAG
tctaggaatttattcaaaga

SEQ ID NO: 50487 - DNA, 20 bp, Artificial Sequence
  Description of Artificial Sequence: Synthetic oligonucleotide
  Target: SCN9A; (+) strand; PAM type: NRG; PAM sequence: CAG
ttattcaaagacagtaatct

SEQ ID NO: 50488 - DNA, 20 bp, Artificial Sequence
  Description of Artificial Sequence: Synthetic oligonucleotide
  Target: SCN9A; (+) strand; PAM type: NRG; PAM sequence: AGG
tattcaaagacagtaatctc

SEQ ID NO: 50489 - DNA, 20 bp, Artificial Sequence
  Description of Artificial Sequence: Synthetic oligonucleotide
  Target: SCN9A; (+) strand; PAM type: NRG; PAM sequence: CAG
taatcaatccaaaatcctaa

SEQ ID NO: 50490 - DNA, 20 bp, Artificial Sequence
  Description of Artificial Sequence: Synthetic oligonucleotide
  Target: SCN9A; (+) strand; PAM type: NRG; PAM sequence: AAG
caatccaaaatcctaacagt

SEQ ID NO: 50491 - DNA, 20 bp, Artificial Sequence
  Description of Artificial Sequence: Synthetic oligonucleotide
  Target: SCN9A; (+) strand; PAM type: NRG; PAM sequence: AGG
aatccaaaatcctaacagta

SEQ ID NO: 50492 - DNA, 20 bp, Artificial Sequence
  Description of Artificial Sequence: Synthetic oligonucleotide
  Target: SCN9A; (+) strand; PAM type: NRG; PAM sequence: GGG
atccaaaatcctaacagtaa

SEQ ID NO: 50493 - DNA, 20 bp, Artificial Sequence
  Description of Artificial Sequence: Synthetic oligonucleotide
  Target: SCN9A; (+) strand; PAM type: NRG; PAM sequence: AAG
agtaagggttacactaaatg

SEQ ID NO: 50494 - DNA, 20 bp, Artificial Sequence
  Description of Artificial Sequence: Synthetic oligonucleotide
  Target: SCN9A; (+) strand; PAM type: NRG; PAM sequence: GAG
tgaatgtataatgaaataat

SEQ ID NO: 50495 - DNA, 20 bp, Artificial Sequence
  Description of Artificial Sequence: Synthetic oligonucleotide
  Target: SCN9A; (+) strand; PAM type: NRG; PAM sequence: CAG
atgtataatgaaataatgag

SEQ ID NO: 50496 - DNA, 20 bp, Artificial Sequence
  Description of Artificial Sequence: Synthetic oligonucleotide
  Target: SCN9A; (+) strand; PAM type: NRG; PAM sequence: AAG
gaaataatgagcagctttga

SEQ ID NO: 50497 - DNA, 20 bp, Artificial Sequence
  Description of Artificial Sequence: Synthetic oligonucleotide
  Target: SCN9A; (+) strand; PAM type: NRG; PAM sequence: GAG
aataatgagcagctttgaaa

SEQ ID NO: 50498 - DNA, 20 bp, Artificial Sequence
  Description of Artificial Sequence: Synthetic oligonucleotide
  Target: SCN9A; (+) strand; PAM type: NRG; PAM sequence: GAG
taatgagcagctttgaaaga

SEQ ID NO: 50499 - DNA, 20 bp, Artificial Sequence
  Description of Artificial Sequence: Synthetic oligonucleotide
  Target: SCN9A; (+) strand; PAM type: NRG; PAM sequence: AAG
gctttgaaagagagcgttca

SEQ ID NO: 50500 - DNA, 20 bp, Artificial Sequence
  Description of Artificial Sequence: Synthetic oligonucleotide
  Target: SCN9A; (+) strand; PAM type: NRG; PAM sequence: AAG
ataaaaatataatgcataat

SEQ ID NO: 50501 - DNA, 20 bp, Artificial Sequence
  Description of Artificial Sequence: Synthetic oligonucleotide
  Target: SCN9A; (+) strand; PAM type: NRG; PAM sequence: TGG
aaaatataatgcataataag

SEQ ID NO: 50502 - DNA, 20 bp, Artificial Sequence
  Description of Artificial Sequence: Synthetic oligonucleotide
  Target: SCN9A; (+) strand; PAM type: NRG; PAM sequence: CAG
aatgcataataagtggaatc

SEQ ID NO: 50503 - DNA, 20 bp, Artificial Sequence
  Description of Artificial Sequence: Synthetic oligonucleotide
  Target: SCN9A; (+) strand; PAM type: NRG; PAM sequence: AGG
atgcataataagtggaatcc

SEQ ID NO: 50504 - DNA, 20 bp, Artificial Sequence
  Description of Artificial Sequence: Synthetic oligonucleotide
  Target: SCN9A; (+) strand; PAM type: NRG; PAM sequence: CAG
tggaatccaggttatacaca

SEQ ID NO: 50505 - DNA, 20 bp, Artificial Sequence
  Description of Artificial Sequence: Synthetic oligonucleotide
  Target: SCN9A; (+) strand; PAM type: NRG; PAM sequence: TAG
atccaggttatacacacaga

SEQ ID NO: 50506 - DNA, 20 bp, Artificial Sequence
  Description of Artificial Sequence: Synthetic oligonucleotide
  Target: SCN9A; (+) strand; PAM type: NRG; PAM sequence: AAG
aatacacaatgcatttaaca

SEQ ID NO: 50507 - DNA, 20 bp, Artificial Sequence
  Description of Artificial Sequence: Synthetic oligonucleotide
  Target: SCN9A; (+) strand; PAM type: NRG; PAM sequence: TAG
acaatgcatttaacaaagtt

SEQ ID NO: 50508 - DNA, 20 bp, Artificial Sequence
  Description of Artificial Sequence: Synthetic oligonucleotide
  Target: SCN9A; (+) strand; PAM type: NRG; PAM sequence: TAG
catttaacaaagtttagccc

SEQ ID NO: 50509 - DNA, 20 bp, Artificial Sequence
  Description of Artificial Sequence: Synthetic oligonucleotide
  Target: SCN9A; (+) strand; PAM type: NRG; PAM sequence: AAG
aacaaagtttagccctagtt

SEQ ID NO: 50510 - DNA, 20 bp, Artificial Sequence
  Description of Artificial Sequence: Synthetic oligonucleotide
  Target: SCN9A; (+) strand; PAM type: NRG; PAM sequence: GAG
caaagtttagccctagttaa

SEQ ID NO: 50511 - DNA, 20 bp, Artificial Sequence
  Description of Artificial Sequence: Synthetic oligonucleotide
  Target: SCN9A; (+) strand; PAM type: NRG; PAM sequence: TGG
tagccctagttaagagatta

SEQ ID NO: 50512 - DNA, 20 bp, Artificial Sequence
  Description of Artificial Sequence: Synthetic oligonucleotide
  Target: SCN9A; (+) strand; PAM type: NRG; PAM sequence: CAG
aaatgtcatgtttttctatc

SEQ ID NO: 50513 - DNA, 20 bp, Artificial Sequence
  Description of Artificial Sequence: Synthetic oligonucleotide
  Target: SCN9A; (+) strand; PAM type: NRG; PAM sequence: AAG
tgtcatgtttttctatccag

SEQ ID NO: 50514 - DNA, 20 bp, Artificial Sequence
  Description of Artificial Sequence: Synthetic oligonucleotide
  Target: SCN9A; (+) strand; PAM type: NRG; PAM sequence: AAG
atgtttttctatccagaaga

SEQ ID NO: 50515 - DNA, 20 bp, Artificial Sequence
  Description of Artificial Sequence: Synthetic oligonucleotide
  Target: SCN9A; (+) strand; PAM type: NRG; PAM sequence: TAG
ttatttgacctaattttata

SEQ ID NO: 50516 - DNA, 20 bp, Artificial Sequence
  Description of Artificial Sequence: Synthetic oligonucleotide
  Target: SCN9A; (+) strand; PAM type: NRG; PAM sequence: TAG
tactatgattgtatcttctt

SEQ ID NO: 50517 - DNA, 20 bp, Artificial Sequence
  Description of Artificial Sequence: Synthetic oligonucleotide
  Target: SCN9A; (+) strand; PAM type: NRG; PAM sequence: AAG
aaatcccaatgttgcatata

SEQ ID NO: 50518 - DNA, 20 bp, Artificial Sequence
  Description of Artificial Sequence: Synthetic oligonucleotide
  Target: SCN9A; (+) strand; PAM type: NRG; PAM sequence: AGG
aatcccaatgttgcatataa

SEQ ID NO: 50519 - DNA, 20 bp, Artificial Sequence
  Description of Artificial Sequence: Synthetic oligonucleotide
  Target: SCN9A; (+) strand; PAM type: NRG; PAM sequence: CAG
cccaatgttgcatataaagg

SEQ ID NO: 50520 - DNA, 20 bp, Artificial Sequence
  Description of Artificial Sequence: Synthetic oligonucleotide
  Target: SCN9A; (+) strand; PAM type: NRG; PAM sequence: TAG
actcaccattaatctcatat

SEQ ID NO: 50521 - DNA, 20 bp, Artificial Sequence
  Description of Artificial Sequence: Synthetic oligonucleotide
  Target: SCN9A; (+) strand; PAM type: NRG; PAM sequence: GAG
tcaccattaatctcatatta

SEQ ID NO: 50522 - DNA, 20 bp, Artificial Sequence
  Description of Artificial Sequence: Synthetic oligonucleotide
  Target: SCN9A; (+) strand; PAM type: NRG; PAM sequence: TAG
atctcatattagagaatact

SEQ ID NO: 50523 - DNA, 20 bp, Artificial Sequence
  Description of Artificial Sequence: Synthetic oligonucleotide
  Target: SCN9A; (+) strand; PAM type: NRG; PAM sequence: AGG
tctcatattagagaatactt

SEQ ID NO: 50524 - DNA, 20 bp, Artificial Sequence
  Description of Artificial Sequence: Synthetic oligonucleotide
  Target: SCN9A; (+) strand; PAM type: NRG; PAM sequence: AAG
aatgtgttattcttgtatct

SEQ ID NO: 50525 - DNA, 20 bp, Artificial Sequence
  Description of Artificial Sequence: Synthetic oligonucleotide
  Target: SCN9A; (+) strand; PAM type: NRG; PAM sequence: TAG
cttgtatctaagatttccta

SEQ ID NO: 50526 - DNA, 20 bp, Artificial Sequence
  Description of Artificial Sequence: Synthetic oligonucleotide
  Target: SCN9A; (+) strand; PAM type: NRG; PAM sequence: TGG
tcctatagttaaaatcaata

SEQ ID NO: 50527 - DNA, 20 bp, Artificial Sequence
  Description of Artificial Sequence: Synthetic oligonucleotide
  Target: SCN9A; (+) strand; PAM type: NRG; PAM sequence: CAG
tttcttattttctatgtatg

SEQ ID NO: 50528 - DNA, 20 bp, Artificial Sequence
  Description of Artificial Sequence: Synthetic oligonucleotide
  Target: SCN9A; (+) strand; PAM type: NRG; PAM sequence: TAG
tgcagacacacacatatata

SEQ ID NO: 50529 - DNA, 20 bp, Artificial Sequence
  Description of Artificial Sequence: Synthetic oligonucleotide
  Target: SCN9A; (+) strand; PAM type: NRG; PAM sequence: TGG
tatctatgcttatccatcta

SEQ ID NO: 50530 - DNA, 20 bp, Artificial Sequence
  Description of Artificial Sequence: Synthetic oligonucleotide
  Target: SCN9A; (+) strand; PAM type: NRG; PAM sequence: TAG
atatcatgtatttgtctatc

SEQ ID NO: 50531 - DNA, 20 bp, Artificial Sequence
  Description of Artificial Sequence: Synthetic oligonucleotide
  Target: SCN9A; (+) strand; PAM type: NRG; PAM sequence: CAG
tttttcttcacacatctttc

SEQ ID NO: 50532 - DNA, 20 bp, Artificial Sequence
  Description of Artificial Sequence: Synthetic oligonucleotide
  Target: SCN9A; (+) strand; PAM type: NRG; PAM sequence: AAG
ttcacacatctttccagtca

SEQ ID NO: 50533 - DNA, 20 bp, Artificial Sequence
  Description of Artificial Sequence: Synthetic oligonucleotide
  Target: SCN9A; (+) strand; PAM type: NRG; PAM sequence: CAG
ctttccagtcaaagcaatgt

SEQ ID NO: 50534 - DNA, 20 bp, Artificial Sequence
  Description of Artificial Sequence: Synthetic oligonucleotide
  Target: SCN9A; (+) strand; PAM type: NRG; PAM sequence: CAG
gtcaaagcaatgtcagctcc

SEQ ID NO: 50535 - DNA, 20 bp, Artificial Sequence
  Description of Artificial Sequence: Synthetic oligonucleotide
  Target: SCN9A; (+) strand; PAM type: NRG; PAM sequence: TGG
cagctcccagttcatgaaaa

SEQ ID NO: 50536 - DNA, 20 bp, Artificial Sequence
  Description of Artificial Sequence: Synthetic oligonucleotide
  Target: SCN9A; (+) strand; PAM type: NRG; PAM sequence: TGG
catgtgtttatcacactctc

SEQ ID NO: 50537 - DNA, 20 bp, Artificial Sequence
  Description of Artificial Sequence: Synthetic oligonucleotide
  Target: SCN9A; (+) strand; PAM type: NRG; PAM sequence: CAG
tggccttcaaatttccattg

SEQ ID NO: 50538 - DNA, 20 bp, Artificial Sequence
  Description of Artificial Sequence: Synthetic oligonucleotide
  Target: SCN9A; (+) strand; PAM type: NRG; PAM sequence: AAG
tttccattgcagtaaaaaca

SEQ ID NO: 50539 - DNA, 20 bp, Artificial Sequence
  Description of Artificial Sequence: Synthetic oligonucleotide
  Target: SCN9A; (+) strand; PAM type: NRG; PAM sequence: CAG
gcagtaaaaacaaagatgta

SEQ ID NO: 50540 - DNA, 20 bp, Artificial Sequence
  Description of Artificial Sequence: Synthetic oligonucleotide
  Target: SCN9A; (+) strand; PAM type: NRG; PAM sequence: TGG
gtaaaaacaaagatgtacag

SEQ ID NO: 50541 - DNA, 20 bp, Artificial Sequence
  Description of Artificial Sequence: Synthetic oligonucleotide
  Target: SCN9A; (+) strand; PAM type: NRG; PAM sequence: TAG
gatgtacagtggcgaaatgt

SEQ ID NO: 50542 - DNA, 20 bp, Artificial Sequence
  Description of Artificial Sequence: Synthetic oligonucleotide
  Target: SCN9A; (+) strand; PAM type: NRG; PAM sequence: CAG
tagataatatcactaaaaac

SEQ ID NO: 50543 - DNA, 20 bp, Artificial Sequence
  Description of Artificial Sequence: Synthetic oligonucleotide
  Target: SCN9A; (+) strand; PAM type: NRG; PAM sequence: GAG
gataatatcactaaaaacca

SEQ ID NO: 50544 - DNA, 20 bp, Artificial Sequence
  Description of Artificial Sequence: Synthetic oligonucleotide
  Target: SCN9A; (+) strand; PAM type: NRG; PAM sequence: AGG
ataatatcactaaaaaccag

SEQ ID NO: 50545 - DNA, 20 bp, Artificial Sequence
  Description of Artificial Sequence: Synthetic oligonucleotide
  Target: SCN9A; (+) strand; PAM type: NRG; PAM sequence: AAG
atatcactaaaaaccagagg

SEQ ID NO: 50546 - DNA, 20 bp, Artificial Sequence
  Description of Artificial Sequence: Synthetic oligonucleotide
  Target: SCN9A; (+) strand; PAM type: NRG; PAM sequence: AAG
aaaccagaggaagacaaaaa

SEQ ID NO: 50547 - DNA, 20 bp, Artificial Sequence
  Description of Artificial Sequence: Synthetic oligonucleotide
  Target: SCN9A; (+) strand; PAM type: NRG; PAM sequence: AAG
aaaaagttatcataaatcat

SEQ ID NO: 50548 - DNA, 20 bp, Artificial Sequence
  Description of Artificial Sequence: Synthetic oligonucleotide
  Target: SCN9A; (+) strand; PAM type: NRG; PAM sequence: TAG
cataaatcataagattaccc

SEQ ID NO: 50549 - DNA, 20 bp, Artificial Sequence
  Description of Artificial Sequence: Synthetic oligonucleotide
  Target: SCN9A; (+) strand; PAM type: NRG; PAM sequence: GAG
aatcataagattaccctagt

SEQ ID NO: 50550 - DNA, 20 bp, Artificial Sequence
  Description of Artificial Sequence: Synthetic oligonucleotide
  Target: SCN9A; (+) strand; PAM type: NRG; PAM sequence: AGG
atcataagattaccctagtg

SEQ ID NO: 50551 - DNA, 20 bp, Artificial Sequence
  Description of Artificial Sequence: Synthetic oligonucleotide
  Target: SCN9A; (+) strand; PAM type: NRG; PAM sequence: GAG
cataagattaccctagtgag

SEQ ID NO: 50552 - DNA, 20 bp, Artificial Sequence
  Description of Artificial Sequence: Synthetic oligonucleotide
  Target: SCN9A; (+) strand; PAM type: NRG; PAM sequence: AAG
ttaccctagtgaggagatca

SEQ ID NO: 50553 - DNA, 20 bp, Artificial Sequence
  Description of Artificial Sequence: Synthetic oligonucleotide
  Target: SCN9A; (+) strand; PAM type: NRG; PAM sequence: CAG
ccctagtgaggagatcaaag

SEQ ID NO: 50554 - DNA, 20 bp, Artificial Sequence
  Description of Artificial Sequence: Synthetic oligonucleotide
  Target: SCN9A; (+) strand; PAM type: NRG; PAM sequence: AAG
tagtgaggagatcaaagcag

SEQ ID NO: 50555 - DNA, 20 bp, Artificial Sequence
  Description of Artificial Sequence: Synthetic oligonucleotide
  Target: SCN9A; (+) strand; PAM type: NRG; PAM sequence: CAG
ggagatcaaagcagaagcta

SEQ ID NO: 50556 - DNA, 20 bp, Artificial Sequence
  Description of Artificial Sequence: Synthetic oligonucleotide
  Target: SCN9A; (+) strand; PAM type: NRG; PAM sequence: TAG
tcaaagcagaagctacagtc

SEQ ID NO: 50557 - DNA, 20 bp, Artificial Sequence
  Description of Artificial Sequence: Synthetic oligonucleotide
  Target: SCN9A; (+) strand; PAM type: NRG; PAM sequence: GAG
acagtctagaacactcatct

SEQ ID NO: 50558 - DNA, 20 bp, Artificial Sequence
  Description of Artificial Sequence: Synthetic oligonucleotide
  Target: SCN9A; (+) strand; PAM type: NRG; PAM sequence: TAG
gaacactcatctgagaatgt

SEQ ID NO: 50559 - DNA, 20 bp, Artificial Sequence
  Description of Artificial Sequence: Synthetic oligonucleotide
  Target: SCN9A; (+) strand; PAM type: NRG; PAM sequence: TAG
agaatgttagaatttctttc

SEQ ID NO: 50560 - DNA, 20 bp, Artificial Sequence
  Description of Artificial Sequence: Synthetic oligonucleotide
  Target: SCN9A; (+) strand; PAM type: NRG; PAM sequence: CAG
atgttagaatttctttctag

SEQ ID NO: 50561 - DNA, 20 bp, Artificial Sequence
  Description of Artificial Sequence: Synthetic oligonucleotide
  Target: SCN9A; (+) strand; PAM type: NRG; PAM sequence: GAG
gttagaatttctttctagca

SEQ ID NO: 50562 - DNA, 20 bp, Artificial Sequence
  Description of Artificial Sequence: Synthetic oligonucleotide
  Target: SCN9A; (+) strand; PAM type: NRG; PAM sequence: AAG
agaatttctttctagcagag

SEQ ID NO: 50563 - DNA, 20 bp, Artificial Sequence
  Description of Artificial Sequence: Synthetic oligonucleotide
  Target: SCN9A; (+) strand; PAM type: NRG; PAM sequence: CAG
tctttctagcagagaagtca

SEQ ID NO: 50564 - DNA, 20 bp, Artificial Sequence
  Description of Artificial Sequence: Synthetic oligonucleotide
  Target: SCN9A; (+) strand; PAM type: NRG; PAM sequence: TGG
agagaagtcacagatttcta

SEQ ID NO: 50565 - DNA, 20 bp, Artificial Sequence
  Description of Artificial Sequence: Synthetic oligonucleotide
  Target: SCN9A; (+) strand; PAM type: NRG; PAM sequence: TAG
tctatggcaaatatgtgatg

SEQ ID NO: 50566 - DNA, 20 bp, Artificial Sequence
  Description of Artificial Sequence: Synthetic oligonucleotide
  Target: SCN9A; (+) strand; PAM type: NRG; PAM sequence: CAG
ggcaaatatgtgatgtagat

SEQ ID NO: 50567 - DNA, 20 bp, Artificial Sequence
  Description of Artificial Sequence: Synthetic oligonucleotide
  Target: SCN9A; (+) strand; PAM type: NRG; PAM sequence: AAG
tgtgatgtagatcagaaaac

SEQ ID NO: 50568 - DNA, 20 bp, Artificial Sequence
  Description of Artificial Sequence: Synthetic oligonucleotide
  Target: SCN9A; (+) strand; PAM type: NRG; PAM sequence: TGG
aaaacaagttgattaatcca

SEQ ID NO: 50569 - DNA, 20 bp, Artificial Sequence
  Description of Artificial Sequence: Synthetic oligonucleotide
  Target: SCN9A; (+) strand; PAM type: NRG; PAM sequence: CAG
ttatttattcaataatgttg

SEQ ID NO: 50570 - DNA, 20 bp, Artificial Sequence
  Description of Artificial Sequence: Synthetic oligonucleotide
  Target: SCN9A; (+) strand; PAM type: NRG; PAM sequence: TAG
ccctctctatgttaaatatg

SEQ ID NO: 50571 - DNA, 20 bp, Artificial Sequence
  Description of Artificial Sequence: Synthetic oligonucleotide
  Target: SCN9A; (+) strand; PAM type: NRG; PAM sequence: CAG
tctctatgttaaatatgtag

SEQ ID NO: 50572 - DNA, 20 bp, Artificial Sequence
  Description of Artificial Sequence: Synthetic oligonucleotide
  Target: SCN9A; (+) strand; PAM type: NRG; PAM sequence: GAG
tctatgttaaatatgtagca

SEQ ID NO: 50573 - DNA, 20 bp, Artificial Sequence
  Description of Artificial Sequence: Synthetic oligonucleotide
  Target: SCN9A; (+) strand; PAM type: NRG; PAM sequence: TGG
atgttaaatatgtagcagag

SEQ ID NO: 50574 - DNA, 20 bp, Artificial Sequence
  Description of Artificial Sequence: Synthetic oligonucleotide
  Target: SCN9A; (+) strand; PAM type: NRG; PAM sequence: AAG
tagcagagtggtttatctcc

SEQ ID NO: 50575 - DNA, 20 bp, Artificial Sequence
  Description of Artificial Sequence: Synthetic oligonucleotide
  Target: SCN9A; (+) strand; PAM type: NRG; PAM sequence: AAG
tatctccaagctatcaccaa

SEQ ID NO: 50576 - DNA, 20 bp, Artificial Sequence
  Description of Artificial Sequence: Synthetic oligonucleotide
  Target: SCN9A; (+) strand; PAM type: NRG; PAM sequence: AGG
atctccaagctatcaccaaa

SEQ ID NO: 50577 - DNA, 20 bp, Artificial Sequence
  Description of Artificial Sequence: Synthetic oligonucleotide
  Target: SCN9A; (+) strand; PAM type: NRG; PAM sequence: AAG
ggataatatctgcattaatt

SEQ ID NO: 50578 - DNA, 20 bp, Artificial Sequence
  Description of Artificial Sequence: Synthetic oligonucleotide
  Target: SCN9A; (+) strand; PAM type: NRG; PAM sequence: AGG
gataatatctgcattaatta

SEQ ID NO: 50579 - DNA, 20 bp, Artificial Sequence
  Description of Artificial Sequence: Synthetic oligonucleotide
  Target: SCN9A; (+) strand; PAM type: NRG; PAM sequence: TAG
aatatctgcattaattaagg

SEQ ID NO: 50580 - DNA, 20 bp, Artificial Sequence
  Description of Artificial Sequence: Synthetic oligonucleotide
  Target: SCN9A; (+) strand; PAM type: NRG; PAM sequence: AGG
atatctgcattaattaaggt

SEQ ID NO: 50581 - DNA, 20 bp, Artificial Sequence
  Description of Artificial Sequence: Synthetic oligonucleotide
  Target: SCN9A; (+) strand; PAM type: NRG; PAM sequence: TAG
attaattaaggtaggactcc

SEQ ID NO: 50582 - DNA, 20 bp, Artificial Sequence
  Description of Artificial Sequence: Synthetic oligonucleotide
  Target: SCN9A; (+) strand; PAM type: NRG; PAM sequence: AGG
ttaattaaggtaggactcct

SEQ ID NO: 50583 - DNA, 20 bp, Artificial Sequence
  Description of Artificial Sequence: Synthetic oligonucleotide
  Target: SCN9A; (+) strand; PAM type: NRG; PAM sequence: GGG
taattaaggtaggactccta

SEQ ID NO: 50584 - DNA, 20 bp, Artificial Sequence
  Description of Artificial Sequence: Synthetic oligonucleotide
  Target: SCN9A; (+) strand; PAM type: NRG; PAM sequence: TAG
tagggtatccatgtccattt

SEQ ID NO: 50585 - DNA, 20 bp, Artificial Sequence
  Description of Artificial Sequence: Synthetic oligonucleotide
  Target: SCN9A; (+) strand; PAM type: NRG; PAM sequence: TAG
gtatccatgtccattttagc

SEQ ID NO: 50586 - DNA, 20 bp, Artificial Sequence
  Description of Artificial Sequence: Synthetic oligonucleotide
  Target: SCN9A; (+) strand; PAM type: NRG; PAM sequence: CAG
atgtccattttagctagaac

SEQ ID NO: 50587 - DNA, 20 bp, Artificial Sequence
  Description of Artificial Sequence: Synthetic oligonucleotide
  Target: SCN9A; (+) strand; PAM type: NRG; PAM sequence: AGG
tgtccattttagctagaacc

SEQ ID NO: 50588 - DNA, 20 bp, Artificial Sequence
  Description of Artificial Sequence: Synthetic oligonucleotide
  Target: SCN9A; (+) strand; PAM type: NRG; PAM sequence: GGG
gtccattttagctagaacca

SEQ ID NO: 50589 - DNA, 20 bp, Artificial Sequence
  Description of Artificial Sequence: Synthetic oligonucleotide
  Target: SCN9A; (+) strand; PAM type: NRG; PAM sequence: TGG
cattttagctagaaccaggg

SEQ ID NO: 50590 - DNA, 20 bp, Artificial Sequence
  Description of Artificial Sequence: Synthetic oligonucleotide
  Target: SCN9A; (+) strand; PAM type: NRG; PAM sequence: GAG
ttttagctagaaccagggtg

SEQ ID NO: 50591 - DNA, 20 bp, Artificial Sequence
  Description of Artificial Sequence: Synthetic oligonucleotide
  Target: SCN9A; (+) strand; PAM type: NRG; PAM sequence: GAG
gctagaaccagggtggagtc

SEQ ID NO: 50592 - DNA, 20 bp, Artificial Sequence
  Description of Artificial Sequence: Synthetic oligonucleotide
  Target: SCN9A; (+) strand; PAM type: NRG; PAM sequence: AGG
ctagaaccagggtggagtcg

SEQ ID NO: 50593 - DNA, 20 bp, Artificial Sequence
  Description of Artificial Sequence: Synthetic oligonucleotide
  Target: SCN9A; (+) strand; PAM type: NRG; PAM sequence: GGG
tagaaccagggtggagtcga

SEQ ID NO: 50594 - DNA, 20 bp, Artificial Sequence
  Description of Artificial Sequence: Synthetic oligonucleotide
  Target: SCN9A; (+) strand; PAM type: NRG; PAM sequence: AAG
accagggtggagtcgaggga

SEQ ID NO: 50595 - DNA, 20 bp, Artificial Sequence
  Description of Artificial Sequence: Synthetic oligonucleotide
  Target: SCN9A; (+) strand; PAM type: NRG; PAM sequence: AGG
ccagggtggagtcgagggaa

SEQ ID NO: 50596 - DNA, 20 bp, Artificial Sequence
  Description of Artificial Sequence: Synthetic oligonucleotide
  Target: SCN9A; (+) strand; PAM type: NRG; PAM sequence: TAG
catccatacatcctaaaatg

SEQ ID NO: 50597 - DNA, 20 bp, Artificial Sequence
  Description of Artificial Sequence: Synthetic oligonucleotide
  Target: SCN9A; (+) strand; PAM type: NRG; PAM sequence: CAG
ctaaaatgtagcctgcctgt

SEQ ID NO: 50598 - DNA, 20 bp, Artificial Sequence
  Description of Artificial Sequence: Synthetic oligonucleotide
  Target: SCN9A; (+) strand; PAM type: NRG; PAM sequence: CAG
acaccatacatgtatataca

SEQ ID NO: 50599 - DNA, 20 bp, Artificial Sequence
  Description of Artificial Sequence: Synthetic oligonucleotide
  Target: SCN9A; (+) strand; PAM type: NRG; PAM sequence: CAG
atgtatatacacagaccttt

SEQ ID NO: 50600 - DNA, 20 bp, Artificial Sequence
  Description of Artificial Sequence: Synthetic oligonucleotide
  Target: SCN9A; (+) strand; PAM type: NRG; PAM sequence: AAG
ttcagtcatccctctctttc

SEQ ID NO: 50601 - DNA, 20 bp, Artificial Sequence
  Description of Artificial Sequence: Synthetic oligonucleotide
  Target: SCN9A; (+) strand; PAM type: NRG; PAM sequence: GAG
cagtcatccctctctttcaa

SEQ ID NO: 50602 - DNA, 20 bp, Artificial Sequence
  Description of Artificial Sequence: Synthetic oligonucleotide
  Target: SCN9A; (+) strand; PAM type: NRG; PAM sequence: GAG
gtcatccctctctttcaaga

SEQ ID NO: 50603 - DNA, 20 bp, Artificial Sequence
  Description of Artificial Sequence: Synthetic oligonucleotide
  Target: SCN9A; (+) strand; PAM type: NRG; PAM sequence: AGG
tcatccctctctttcaagag

SEQ ID NO: 50604 - DNA, 20 bp, Artificial Sequence
  Description of Artificial Sequence: Synthetic oligonucleotide
  Target: SCN9A; (+) strand; PAM type: NRG; PAM sequence: TGG
ctttcaagagaggatttgtc

SEQ ID NO: 50605 - DNA, 20 bp, Artificial Sequence
  Description of Artificial Sequence: Synthetic oligonucleotide
  Target: SCN9A; (+) strand; PAM type: NRG; PAM sequence: GGG
tttcaagagaggatttgtct

SEQ ID NO: 50606 - DNA, 20 bp, Artificial Sequence
  Description of Artificial Sequence: Synthetic oligonucleotide
  Target: SCN9A; (+) strand; PAM type: NRG; PAM sequence: CAG
gagaggatttgtctgggaaa

SEQ ID NO: 50607 - DNA, 20 bp, Artificial Sequence
  Description of Artificial Sequence: Synthetic oligonucleotide
  Target: SCN9A; (+) strand; PAM type: NRG; PAM sequence: AAG
ctgggaaacagacctgtata

SEQ ID NO: 50608 - DNA, 20 bp, Artificial Sequence
  Description of Artificial Sequence: Synthetic oligonucleotide
  Target: SCN9A; (+) strand; PAM type: NRG; PAM sequence: CAG
gaaacagacctgtataaaga

SEQ ID NO: 50609 - DNA, 20 bp, Artificial Sequence
  Description of Artificial Sequence: Synthetic oligonucleotide
  Target: SCN9A; (+) strand; PAM type: NRG; PAM sequence: TGG
tataaagacagatgcaaacc

SEQ ID NO: 50610 - DNA, 20 bp, Artificial Sequence
  Description of Artificial Sequence: Synthetic oligonucleotide
  Target: SCN9A; (+) strand; PAM type: NRG; PAM sequence: TGG
aaacctggccaacaccaacc

SEQ ID NO: 50611 - DNA, 20 bp, Artificial Sequence
  Description of Artificial Sequence: Synthetic oligonucleotide
  Target: SCN9A; (+) strand; PAM type: NRG; PAM sequence: TAG
ctttcttccataaatattaa

SEQ ID NO: 50612 - DNA, 20 bp, Artificial Sequence
  Description of Artificial Sequence: Synthetic oligonucleotide
  Target: SCN9A; (+) strand; PAM type: NRG; PAM sequence: AAG
ataaatattaatagattatc

SEQ ID NO: 50613 - DNA, 20 bp, Artificial Sequence
  Description of Artificial Sequence: Synthetic oligonucleotide
  Target: SCN9A; (+) strand; PAM type: NRG; PAM sequence: TGG
atagattatcaagaataaat

SEQ ID NO: 50614 - DNA, 20 bp, Artificial Sequence
  Description of Artificial Sequence: Synthetic oligonucleotide
  Target: SCN9A; (+) strand; PAM type: NRG; PAM sequence: AAG
tcaagaataaattggtaatg

SEQ ID NO: 50615 - DNA, 20 bp, Artificial Sequence
  Description of Artificial Sequence: Synthetic oligonucleotide
  Target: SCN9A; (+) strand; PAM type: NRG; PAM sequence: AAG
tctaccaaacataaaattga

SEQ ID NO: 50616 - DNA, 20 bp, Artificial Sequence
  Description of Artificial Sequence: Synthetic oligonucleotide
  Target: SCN9A; (+) strand; PAM type: NRG; PAM sequence: AAG
aaacataaaattgaaagact

SEQ ID NO: 50617 - DNA, 20 bp, Artificial Sequence
  Description of Artificial Sequence: Synthetic oligonucleotide
  Target: SCN9A; (+) strand; PAM type: NRG; PAM sequence: CAG
aattgaaagactaagatgaa

SEQ ID NO: 50618 - DNA, 20 bp, Artificial Sequence
  Description of Artificial Sequence: Synthetic oligonucleotide
  Target: SCN9A; (+) strand; PAM type: NRG; PAM sequence: TAG
acagaccaaacttttaactt

SEQ ID NO: 50619 - DNA, 20 bp, Artificial Sequence
  Description of Artificial Sequence: Synthetic oligonucleotide
  Target: SCN9A; (+) strand; PAM type: NRG; PAM sequence: AAG
ttttaactttagaaaaaaaa

SEQ ID NO: 50620 - DNA, 20 bp, Artificial Sequence
  Description of Artificial Sequence: Synthetic oligonucleotide
  Target: SCN9A; (+) strand; PAM type: NRG; PAM sequence: TGG
aaaaaaaaaagcaaacattg

SEQ ID NO: 50621 - DNA, 20 bp, Artificial Sequence
  Description of Artificial Sequence: Synthetic oligonucleotide
  Target: SCN9A; (+) strand; PAM type: NRG; PAM sequence: GGG
aaaaaaaaagcaaacattgt

SEQ ID NO: 50622 - DNA, 20 bp, Artificial Sequence
  Description of Artificial Sequence: Synthetic oligonucleotide
  Target: SCN9A; (+) strand; PAM type: NRG; PAM sequence: GAG
agcaaacattgtgggatatt

SEQ ID NO: 50623 - DNA, 20 bp, Artificial Sequence
  Description of Artificial Sequence: Synthetic oligonucleotide
  Target: SCN9A; (+) strand; PAM type: NRG; PAM sequence: AAG
aaacattgtgggatattgag

SEQ ID NO: 50624 - DNA, 20 bp, Artificial Sequence
  Description of Artificial Sequence: Synthetic oligonucleotide
  Target: SCN9A; (+) strand; PAM type: NRG; PAM sequence: AAG
tgtgggatattgagaagtta

SEQ ID NO: 50625 - DNA, 20 bp, Artificial Sequence
  Description of Artificial Sequence: Synthetic oligonucleotide
  Target: SCN9A; (+) strand; PAM type: NRG; PAM sequence: TAG
ggatattgagaagttaaagt

SEQ ID NO: 50626 - DNA, 20 bp, Artificial Sequence
  Description of Artificial Sequence: Synthetic oligonucleotide
  Target: SCN9A; (+) strand; PAM type: NRG; PAM sequence: TAG
gaagttaaagttagtattcc

SEQ ID NO: 50627 - DNA, 20 bp, Artificial Sequence
  Description of Artificial Sequence: Synthetic oligonucleotide
  Target: SCN9A; (+) strand; PAM type: NRG; PAM sequence: GAG
agttaaagttagtattccta

SEQ ID NO: 50628 - DNA, 20 bp, Artificial Sequence
  Description of Artificial Sequence: Synthetic oligonucleotide
  Target: SCN9A; (+) strand; PAM type: NRG; PAM sequence: GAG
tagtattcctagagaaattt

SEQ ID NO: 50629 - DNA, 20 bp, Artificial Sequence
  Description of Artificial Sequence: Synthetic oligonucleotide
  Target: SCN9A; (+) strand; PAM type: NRG; PAM sequence: AGG
agtattcctagagaaatttg

SEQ ID NO: 50630 - DNA, 20 bp, Artificial Sequence
  Description of Artificial Sequence: Synthetic oligonucleotide
  Target: SCN9A; (+) strand; PAM type: NRG; PAM sequence: GAG
tattcctagagaaatttgag

SEQ ID NO: 50631 - DNA, 20 bp, Artificial Sequence
  Description of Artificial Sequence: Synthetic oligonucleotide
  Target: SCN9A; (+) strand; PAM type: NRG; PAM sequence: CAG
cctagagaaatttgaggaga

SEQ ID NO: 50632 - DNA, 20 bp, Artificial Sequence
  Description of Artificial Sequence: Synthetic oligonucleotide
  Target: SCN9A; (+) strand; PAM type: NRG; PAM sequence: GAG
tagagaaatttgaggagaca

SEQ ID NO: 50633 - DNA, 20 bp, Artificial Sequence
  Description of Artificial Sequence: Synthetic oligonucleotide
  Target: SCN9A; (+) strand; PAM type: NRG; PAM sequence: TAG
cttttattaaaaaaaaaaaa

SEQ ID NO: 50634 - DNA, 20 bp, Artificial Sequence
  Description of Artificial Sequence: Synthetic oligonucleotide
  Target: SCN9A; (+) strand; PAM type: NRG; PAM sequence: AGG
ttttattaaaaaaaaaaaat

SEQ ID NO: 50635 - DNA, 20 bp, Artificial Sequence
  Description of Artificial Sequence: Synthetic oligonucleotide
  Target: SCN9A; (+) strand; PAM type: NRG; PAM sequence: TGG
aaaaacaacaacatcaattc

SEQ ID NO: 50636 - DNA, 20 bp, Artificial Sequence
  Description of Artificial Sequence: Synthetic oligonucleotide
  Target: SCN9A; (+) strand; PAM type: NRG; PAM sequence: GGG
aaaacaacaacatcaattct

SEQ ID NO: 50637 - DNA, 20 bp, Artificial Sequence
  Description of Artificial Sequence: Synthetic oligonucleotide
  Target: SCN9A; (+) strand; PAM type: NRG; PAM sequence: AAG
aacaacatcaattctgggta

SEQ ID NO: 50638 - DNA, 20 bp, Artificial Sequence
  Description of Artificial Sequence: Synthetic oligonucleotide
  Target: SCN9A; (+) strand; PAM type: NRG; PAM sequence: AGG
acaacatcaattctgggtaa

SEQ ID NO: 50639 - DNA, 20 bp, Artificial Sequence
  Description of Artificial Sequence: Synthetic oligonucleotide
  Target: SCN9A; (+) strand; PAM type: NRG; PAM sequence: CAG
ctttgtgaaacaaaaaattt

SEQ ID NO: 50640 - DNA, 20 bp, Artificial Sequence
  Description of Artificial Sequence: Synthetic oligonucleotide
  Target: SCN9A; (+) strand; PAM type: NRG; PAM sequence: TAG
tgtgaaacaaaaaatttcag

SEQ ID NO: 50641 - DNA, 20 bp, Artificial Sequence
  Description of Artificial Sequence: Synthetic oligonucleotide
  Target: SCN9A; (+) strand; PAM type: NRG; PAM sequence: AAG
tcagtagaatgcttgctgaa

SEQ ID NO: 50642 - DNA, 20 bp, Artificial Sequence
  Description of Artificial Sequence: Synthetic oligonucleotide
  Target: SCN9A; (+) strand; PAM type: NRG; PAM sequence: AGG
cagtagaatgcttgctgaaa

SEQ ID NO: 50643 - DNA, 20 bp, Artificial Sequence
  Description of Artificial Sequence: Synthetic oligonucleotide
  Target: SCN9A; (+) strand; PAM type: NRG; PAM sequence: GAG
gtagaatgcttgctgaaaag

SEQ ID NO: 50644 - DNA, 20 bp, Artificial Sequence
  Description of Artificial Sequence: Synthetic oligonucleotide
  Target: SCN9A; (+) strand; PAM type: NRG; PAM sequence: AAG
gaatgcttgctgaaaaggag

SEQ ID NO: 50645 - DNA, 20 bp, Artificial Sequence
  Description of Artificial Sequence: Synthetic oligonucleotide
  Target: SCN9A; (+) strand; PAM type: NRG; PAM sequence: TAG
aaaaggagaagtcataattg

SEQ ID NO: 50646 - DNA, 20 bp, Artificial Sequence
  Description of Artificial Sequence: Synthetic oligonucleotide
  Target: SCN9A; (+) strand; PAM type: NRG; PAM sequence: AAG
ttaccttttactttacccaa

SEQ ID NO: 50647 - DNA, 20 bp, Artificial Sequence
  Description of Artificial Sequence: Synthetic oligonucleotide
  Target: SCN9A; (+) strand; PAM type: NRG; PAM sequence: AGG
taccttttactttacccaaa

SEQ ID NO: 50648 - DNA, 20 bp, Artificial Sequence
  Description of Artificial Sequence: Synthetic oligonucleotide
  Target: SCN9A; (+) strand; PAM type: NRG; PAM sequence: GGG
accttttactttacccaaaa

SEQ ID NO: 50649 - DNA, 20 bp, Artificial Sequence
  Description of Artificial Sequence: Synthetic oligonucleotide
  Target: SCN9A; (+) strand; PAM type: NRG; PAM sequence: GGG
ccttttactttacccaaaag

SEQ ID NO: 50650 - DNA, 20 bp, Artificial Sequence
  Description of Artificial Sequence: Synthetic oligonucleotide
  Target: SCN9A; (+) strand; PAM type: NRG; PAM sequence: CAG
acccaaaaggggcactttac

SEQ ID NO: 50651 - DNA, 20 bp, Artificial Sequence
  Description of Artificial Sequence: Synthetic oligonucleotide
  Target: SCN9A; (+) strand; PAM type: NRG; PAM sequence: TGG
aaaggggcactttaccagaa

SEQ ID NO: 50652 - DNA, 20 bp, Artificial Sequence
  Description of Artificial Sequence: Synthetic oligonucleotide
  Target: SCN9A; (+) strand; PAM type: NRG; PAM sequence: GGG
aaggggcactttaccagaat

SEQ ID NO: 50653 - DNA, 20 bp, Artificial Sequence
  Description of Artificial Sequence: Synthetic oligonucleotide
  Target: SCN9A; (+) strand; PAM type: NRG; PAM sequence: GGG
aggggcactttaccagaatg

SEQ ID NO: 50654 - DNA, 20 bp, Artificial Sequence
  Description of Artificial Sequence: Synthetic oligonucleotide
  Target: SCN9A; (+) strand; PAM type: NRG; PAM sequence: CAG
actttaccagaatggggcac

SEQ ID NO: 50655 - DNA, 20 bp, Artificial Sequence
  Description of Artificial Sequence: Synthetic oligonucleotide
  Target: SCN9A; (+) strand; PAM type: NRG; PAM sequence: GAG
taccagaatggggcaccagt

SEQ ID NO: 50656 - DNA, 20 bp, Artificial Sequence
  Description of Artificial Sequence: Synthetic oligonucleotide
  Target: SCN9A; (+) strand; PAM type: NRG; PAM sequence: CAG
ggggcaccagtgagcattct

SEQ ID NO: 50657 - DNA, 20 bp, Artificial Sequence
  Description of Artificial Sequence: Synthetic oligonucleotide
  Target: SCN9A; (+) strand; PAM type: NRG; PAM sequence: AGG
gggcaccagtgagcattctc

SEQ ID NO: 50658 - DNA, 20 bp, Artificial Sequence
  Description of Artificial Sequence: Synthetic oligonucleotide
  Target: SCN9A; (+) strand; PAM type: NRG; PAM sequence: TAG
cagtgagcattctcaggtgc

SEQ ID NO: 50659 - DNA, 20 bp, Artificial Sequence
  Description of Artificial Sequence: Synthetic oligonucleotide
  Target: SCN9A; (+) strand; PAM type: NRG; PAM sequence: TGG
ctataccttgatctatgtga

SEQ ID NO: 50660 - DNA, 20 bp, Artificial Sequence
  Description of Artificial Sequence: Synthetic oligonucleotide
  Target: SCN9A; (+) strand; PAM type: NRG; PAM sequence: TGG
tgatctatgtgatggttaca

SEQ ID NO: 50661 - DNA, 20 bp, Artificial Sequence
  Description of Artificial Sequence: Synthetic oligonucleotide
  Target: SCN9A; (+) strand; PAM type: NRG; PAM sequence: GGG
gatctatgtgatggttacat

SEQ ID NO: 50662 - DNA, 20 bp, Artificial Sequence
  Description of Artificial Sequence: Synthetic oligonucleotide
  Target: SCN9A; (+) strand; PAM type: NRG; PAM sequence: TGG
tatgtatatgtaaaaatgca

SEQ ID NO: 50663 - DNA, 20 bp, Artificial Sequence
  Description of Artificial Sequence: Synthetic oligonucleotide
  Target: SCN9A; (+) strand; PAM type: NRG; PAM sequence: GAG
tgtatatgtaaaaatgcatg

SEQ ID NO: 50664 - DNA, 20 bp, Artificial Sequence
  Description of Artificial Sequence: Synthetic oligonucleotide
  Target: SCN9A; (+) strand; PAM type: NRG; PAM sequence: TAG
atgcatggagttctatatct

SEQ ID NO: 50665 - DNA, 20 bp, Artificial Sequence
  Description of Artificial Sequence: Synthetic oligonucleotide
  Target: SCN9A; (+) strand; PAM type: NRG; PAM sequence: TAG
ttagatttttctatatattt

SEQ ID NO: 50666 - DNA, 20 bp, Artificial Sequence
  Description of Artificial Sequence: Synthetic oligonucleotide
  Target: SCN9A; (+) strand; PAM type: NRG; PAM sequence: AGG
tagatttttctatatatttt

SEQ ID NO: 50667 - DNA, 20 bp, Artificial Sequence
  Description of Artificial Sequence: Synthetic oligonucleotide
  Target: SCN9A; (+) strand; PAM type: NRG; PAM sequence: GAG
gatttttctatatattttag

SEQ ID NO: 50668 - DNA, 20 bp, Artificial Sequence
  Description of Artificial Sequence: Synthetic oligonucleotide
  Target: SCN9A; (+) strand; PAM type: NRG; PAM sequence: AAG
gagaattttaaaaattaaaa

SEQ ID NO: 50669 - DNA, 20 bp, Artificial Sequence
  Description of Artificial Sequence: Synthetic oligonucleotide
  Target: SCN9A; (+) strand; PAM type: NRG; PAM sequence: TAG
aaaaagtacaaaataaaact

SEQ ID NO: 50670 - DNA, 20 bp, Artificial Sequence
  Description of Artificial Sequence: Synthetic oligonucleotide
  Target: SCN9A; (+) strand; PAM type: NRG; PAM sequence: AAG
aagtacaaaataaaacttag

SEQ ID NO: 50671 - DNA, 20 bp, Artificial Sequence
  Description of Artificial Sequence: Synthetic oligonucleotide
  Target: SCN9A; (+) strand; PAM type: NRG; PAM sequence: CAG
aaaataaaacttagaagata

SEQ ID NO: 50672 - DNA, 20 bp, Artificial Sequence
  Description of Artificial Sequence: Synthetic oligonucleotide
  Target: SCN9A; (+) strand; PAM type: NRG; PAM sequence: TAG
taatccatgttgttcgacat

SEQ ID NO: 50673 - DNA, 20 bp, Artificial Sequence
  Description of Artificial Sequence: Synthetic oligonucleotide
  Target: SCN9A; (+) strand; PAM type: NRG; PAM sequence: AAG
tgttgttcgacattagtctc

SEQ ID NO: 50674 - DNA, 20 bp, Artificial Sequence
  Description of Artificial Sequence: Synthetic oligonucleotide
  Target: SCN9A; (+) strand; PAM type: NRG; PAM sequence: GAG
ttgttcgacattagtctcaa

SEQ ID NO: 50675 - DNA, 20 bp, Artificial Sequence
  Description of Artificial Sequence: Synthetic oligonucleotide
  Target: SCN9A; (+) strand; PAM type: NRG; PAM sequence: GAG
gttcgacattagtctcaaga

SEQ ID NO: 50676 - DNA, 20 bp, Artificial Sequence
  Description of Artificial Sequence: Synthetic oligonucleotide
  Target: SCN9A; (+) strand; PAM type: NRG; PAM sequence: CAG
cgacattagtctcaagagag

SEQ ID NO: 50677 - DNA, 20 bp, Artificial Sequence
  Description of Artificial Sequence: Synthetic oligonucleotide
  Target: SCN9A; (+) strand; PAM type: NRG; PAM sequence: TAG
agtctcaagagagcagcaaa

SEQ ID NO: 50678 - DNA, 20 bp, Artificial Sequence
  Description of Artificial Sequence: Synthetic oligonucleotide
  Target: SCN9A; (+) strand; PAM type: NRG; PAM sequence: TAG
ctcaagagagcagcaaatag

SEQ ID NO: 50679 - DNA, 20 bp, Artificial Sequence
  Description of Artificial Sequence: Synthetic oligonucleotide
  Target: SCN9A; (+) strand; PAM type: NRG; PAM sequence: TAG
agagagcagcaaatagtaga

SEQ ID NO: 50680 - DNA, 20 bp, Artificial Sequence
  Description of Artificial Sequence: Synthetic oligonucleotide
  Target: SCN9A; (+) strand; PAM type: NRG; PAM sequence: AGG
gagagcagcaaatagtagat

SEQ ID NO: 50681 - DNA, 20 bp, Artificial Sequence
  Description of Artificial Sequence: Synthetic oligonucleotide
  Target: SCN9A; (+) strand; PAM type: NRG; PAM sequence: AAG
tagataggaaataataaaca

SEQ ID NO: 50682 - DNA, 20 bp, Artificial Sequence
  Description of Artificial Sequence: Synthetic oligonucleotide
  Target: SCN9A; (+) strand; PAM type: NRG; PAM sequence: TGG
ggaaataataaacaaagtaa

SEQ ID NO: 50683 - DNA, 20 bp, Artificial Sequence
  Description of Artificial Sequence: Synthetic oligonucleotide
  Target: SCN9A; (+) strand; PAM type: NRG; PAM sequence: CAG
aataataaacaaagtaatgg

SEQ ID NO: 50684 - DNA, 20 bp, Artificial Sequence
  Description of Artificial Sequence: Synthetic oligonucleotide
  Target: SCN9A; (+) strand; PAM type: NRG; PAM sequence: AAG
gtaatggcagaaaattcacc

SEQ ID NO: 50685 - DNA, 20 bp, Artificial Sequence
  Description of Artificial Sequence: Synthetic oligonucleotide
  Target: SCN9A; (+) strand; PAM type: NRG; PAM sequence: GAG
aatggcagaaaattcaccaa

SEQ ID NO: 50686 - DNA, 20 bp, Artificial Sequence
  Description of Artificial Sequence: Synthetic oligonucleotide
  Target: SCN9A; (+) strand; PAM type: NRG; PAM sequence: AAG
aaaattcaccaagagtcatc

SEQ ID NO: 50687 - DNA, 20 bp, Artificial Sequence
  Description of Artificial Sequence: Synthetic oligonucleotide
  Target: SCN9A; (+) strand; PAM type: NRG; PAM sequence: AAG
accaagagtcatcaagctaa

SEQ ID NO: 50688 - DNA, 20 bp, Artificial Sequence
  Description of Artificial Sequence: Synthetic oligonucleotide
  Target: SCN9A; (+) strand; PAM type: NRG; PAM sequence: AAG
tcatcaagctaaaagtacaa

SEQ ID NO: 50689 - DNA, 20 bp, Artificial Sequence
  Description of Artificial Sequence: Synthetic oligonucleotide
  Target: SCN9A; (+) strand; PAM type: NRG; PAM sequence: AAG
tcaagctaaaagtacaaaag

SEQ ID NO: 50690 - DNA, 20 bp, Artificial Sequence
  Description of Artificial Sequence: Synthetic oligonucleotide
  Target: SCN9A; (+) strand; PAM type: NRG; PAM sequence: AAG
acaaaagaagatcaatttaa

SEQ ID NO: 50691 - DNA, 20 bp, Artificial Sequence
  Description of Artificial Sequence: Synthetic oligonucleotide
  Target: SCN9A; (+) strand; PAM type: NRG; PAM sequence: AAG
taaaagttccattcttgtga

SEQ ID NO: 50692 - DNA, 20 bp, Artificial Sequence
  Description of Artificial Sequence: Synthetic oligonucleotide
  Target: SCN9A; (+) strand; PAM type: NRG; PAM sequence: TAG
gttccattcttgtgaaagtt

SEQ ID NO: 50693 - DNA, 20 bp, Artificial Sequence
  Description of Artificial Sequence: Synthetic oligonucleotide
  Target: SCN9A; (+) strand; PAM type: NRG; PAM sequence: GAG
tccattcttgtgaaagttta

SEQ ID NO: 50694 - DNA, 20 bp, Artificial Sequence
  Description of Artificial Sequence: Synthetic oligonucleotide
  Target: SCN9A; (+) strand; PAM type: NRG; PAM sequence: TAG
aaagtttagagcattaacaa

SEQ ID NO: 50695 - DNA, 20 bp, Artificial Sequence
  Description of Artificial Sequence: Synthetic oligonucleotide
  Target: SCN9A; (+) strand; PAM type: NRG; PAM sequence: AAG
agagcattaacaatagaaac

SEQ ID NO: 50696 - DNA, 20 bp, Artificial Sequence
  Description of Artificial Sequence: Synthetic oligonucleotide
  Target: SCN9A; (+) strand; PAM type: NRG; PAM sequence: AAG
ttttataatcttccaaaaat

SEQ ID NO: 50697 - DNA, 20 bp, Artificial Sequence
  Description of Artificial Sequence: Synthetic oligonucleotide
  Target: SCN9A; (+) strand; PAM type: NRG; PAM sequence: AAG
aaataagataactaactaaa

SEQ ID NO: 50698 - DNA, 20 bp, Artificial Sequence
  Description of Artificial Sequence: Synthetic oligonucleotide
  Target: SCN9A; (+) strand; PAM type: NRG; PAM sequence: TAG
taactaaaaagaatgaaaat

SEQ ID NO: 50699 - DNA, 20 bp, Artificial Sequence
  Description of Artificial Sequence: Synthetic oligonucleotide
  Target: SCN9A; (+) strand; PAM type: NRG; PAM sequence: TAG
gattgccattaaaatttcct

SEQ ID NO: 50700 - DNA, 20 bp, Artificial Sequence
  Description of Artificial Sequence: Synthetic oligonucleotide
  Target: SCN9A; (+) strand; PAM type: NRG; PAM sequence: TAG
tccttagccataattgacac

SEQ ID NO: 50701 - DNA, 20 bp, Artificial Sequence
  Description of Artificial Sequence: Synthetic oligonucleotide
  Target: SCN9A; (+) strand; PAM type: NRG; PAM sequence: CAG
tagaacacaatcaatgcttt

SEQ ID NO: 50702 - DNA, 20 bp, Artificial Sequence
  Description of Artificial Sequence: Synthetic oligonucleotide
  Target: SCN9A; (+) strand; PAM type: NRG; PAM sequence: GAG
atcaatgctttcagtgtgat

SEQ ID NO: 50703 - DNA, 20 bp, Artificial Sequence
  Description of Artificial Sequence: Synthetic oligonucleotide
  Target: SCN9A; (+) strand; PAM type: NRG; PAM sequence: GAG
caatgctttcagtgtgatga

SEQ ID NO: 50704 - DNA, 20 bp, Artificial Sequence
  Description of Artificial Sequence: Synthetic oligonucleotide
  Target: SCN9A; (+) strand; PAM type: NRG; PAM sequence: CAG
tttgaatcaaattctattat

SEQ ID NO: 50705 - DNA, 20 bp, Artificial Sequence
  Description of Artificial Sequence: Synthetic oligonucleotide
  Target: SCN9A; (+) strand; PAM type: NRG; PAM sequence: AAG
ttatcagacaacctattatc

SEQ ID NO: 50706 - DNA, 20 bp, Artificial Sequence
  Description of Artificial Sequence: Synthetic oligonucleotide
  Target: SCN9A; (+) strand; PAM type: NRG; PAM sequence: TGG
caacctattatcaagtgtga

SEQ ID NO: 50707 - DNA, 20 bp, Artificial Sequence
  Description of Artificial Sequence: Synthetic oligonucleotide
  Target: SCN9A; (+) strand; PAM type: NRG; PAM sequence: TAG
tggcaaacaaaatatatttc

SEQ ID NO: 50708 - DNA, 20 bp, Artificial Sequence
  Description of Artificial Sequence: Synthetic oligonucleotide
  Target: SCN9A; (+) strand; PAM type: NRG; PAM sequence: AGG
ggcaaacaaaatatatttct

SEQ ID NO: 50709 - DNA, 20 bp, Artificial Sequence
  Description of Artificial Sequence: Synthetic oligonucleotide
  Target: SCN9A; (+) strand; PAM type: NRG; PAM sequence: AAG
caaaatatatttctaggtat

SEQ ID NO: 50710 - DNA, 20 bp, Artificial Sequence
  Description of Artificial Sequence: Synthetic oligonucleotide
  Target: SCN9A; (+) strand; PAM type: NRG; PAM sequence: AAG
cctttttatctttttttttt

SEQ ID NO: 50711 - DNA, 20 bp, Artificial Sequence
  Description of Artificial Sequence: Synthetic oligonucleotide
  Target: SCN9A; (+) strand; PAM type: NRG; PAM sequence: TGG
cttttttttttaagttactt

SEQ ID NO: 50712 - DNA, 20 bp, Artificial Sequence
  Description of Artificial Sequence: Synthetic oligonucleotide
  Target: SCN9A; (+) strand; PAM type: NRG; PAM sequence: AAG
tttttaagttactttggatt

SEQ ID NO: 50713 - DNA, 20 bp, Artificial Sequence
  Description of Artificial Sequence: Synthetic oligonucleotide
  Target: SCN9A; (+) strand; PAM type: NRG; PAM sequence: AGG
ttttaagttactttggatta

SEQ ID NO: 50714 - DNA, 20 bp, Artificial Sequence
  Description of Artificial Sequence: Synthetic oligonucleotide
  Target: SCN9A; (+) strand; PAM type: NRG; PAM sequence: TAG
taagttactttggattaagg

SEQ ID NO: 50715 - DNA, 20 bp, Artificial Sequence
  Description of Artificial Sequence: Synthetic oligonucleotide
  Target: SCN9A; (+) strand; PAM type: NRG; PAM sequence: GAG
agttactttggattaaggta

SEQ ID NO: 50716 - DNA, 20 bp, Artificial Sequence
  Description of Artificial Sequence: Synthetic oligonucleotide
  Target: SCN9A; (+) strand; PAM type: NRG; PAM sequence: AAG
aaggtagagcaaaaaaaaaa

SEQ ID NO: 50717 - DNA, 20 bp, Artificial Sequence
  Description of Artificial Sequence: Synthetic oligonucleotide
  Target: SCN9A; (+) strand; PAM type: NRG; PAM sequence: TAG
aaaagtacttctaaaacaca

SEQ ID NO: 50718 - DNA, 20 bp, Artificial Sequence
  Description of Artificial Sequence: Synthetic oligonucleotide
  Target: SCN9A; (+) strand; PAM type: NRG; PAM sequence: AAG
ttctaaaacacatagaatac

SEQ ID NO: 50719 - DNA, 20 bp, Artificial Sequence
  Description of Artificial Sequence: Synthetic oligonucleotide
  Target: SCN9A; (+) strand; PAM type: NRG; PAM sequence: TAG
aatacaagatgtttcacaaa

SEQ ID NO: 50720 - DNA, 20 bp, Artificial Sequence
  Description of Artificial Sequence: Synthetic oligonucleotide
  Target: SCN9A; (+) strand; PAM type: NRG; PAM sequence: AAG
ttcacaaatagtgtgaataa

SEQ ID NO: 50721 - DNA, 20 bp, Artificial Sequence
  Description of Artificial Sequence: Synthetic oligonucleotide
  Target: SCN9A; (+) strand; PAM type: NRG; PAM sequence: AAG
aaatagtgtgaataaaagca

SEQ ID NO: 50722 - DNA, 20 bp, Artificial Sequence
  Description of Artificial Sequence: Synthetic oligonucleotide
  Target: SCN9A; (+) strand; PAM type: NRG; PAM sequence: AGG
aatagtgtgaataaaagcaa

SEQ ID NO: 50723 - DNA, 20 bp, Artificial Sequence
  Description of Artificial Sequence: Synthetic oligonucleotide
  Target: SCN9A; (+) strand; PAM type: NRG; PAM sequence: GGG
atagtgtgaataaaagcaaa

SEQ ID NO: 50724 - DNA, 20 bp, Artificial Sequence
  Description of Artificial Sequence: Synthetic oligonucleotide
  Target: SCN9A; (+) strand; PAM type: NRG; PAM sequence: TAG
gcaaagggaatttgtttctt

SEQ ID NO: 50725 - DNA, 20 bp, Artificial Sequence
  Description of Artificial Sequence: Synthetic oligonucleotide
  Target: SCN9A; (+) strand; PAM type: NRG; PAM sequence: TAG
gtttctttagaacgtgtaaa

SEQ ID NO: 50726 - DNA, 20 bp, Artificial Sequence
  Description of Artificial Sequence: Synthetic oligonucleotide
  Target: SCN9A; (+) strand; PAM type: NRG; PAM sequence: TAG
aaatagccatattgtccaaa

SEQ ID NO: 50727 - DNA, 20 bp, Artificial Sequence
  Description of Artificial Sequence: Synthetic oligonucleotide
  Target: SCN9A; (+) strand; PAM type: NRG; PAM sequence: AGG
aatagccatattgtccaaat

SEQ ID NO: 50728 - DNA, 20 bp, Artificial Sequence
  Description of Artificial Sequence: Synthetic oligonucleotide
  Target: SCN9A; (+) strand; PAM type: NRG; PAM sequence: GAG
aataggaatcaattcaaaat

SEQ ID NO: 50729 - DNA, 20 bp, Artificial Sequence
  Description of Artificial Sequence: Synthetic oligonucleotide
  Target: SCN9A; (+) strand; PAM type: NRG; PAM sequence: AGG
ataggaatcaattcaaaatg

SEQ ID NO: 50730 - DNA, 20 bp, Artificial Sequence
  Description of Artificial Sequence: Synthetic oligonucleotide
  Target: SCN9A; (+) strand; PAM type: NRG; PAM sequence: TGG
gaggcatgaacttgaacaac

SEQ ID NO: 50731 - DNA, 20 bp, Artificial Sequence
  Description of Artificial Sequence: Synthetic oligonucleotide
  Target: SCN9A; (+) strand; PAM type: NRG; PAM sequence: TAG
gcatgaacttgaacaactgg

SEQ ID NO: 50732 - DNA, 20 bp, Artificial Sequence
  Description of Artificial Sequence: Synthetic oligonucleotide
  Target: SCN9A; (+) strand; PAM type: NRG; PAM sequence: AAG
ttgaacaactggtagaattg

SEQ ID NO: 50733 - DNA, 20 bp, Artificial Sequence
  Description of Artificial Sequence: Synthetic oligonucleotide
  Target: SCN9A; (+) strand; PAM type: NRG; PAM sequence: CAG
aacaactggtagaattgaag

SEQ ID NO: 50734 - DNA, 20 bp, Artificial Sequence
  Description of Artificial Sequence: Synthetic oligonucleotide
  Target: SCN9A; (+) strand; PAM type: NRG; PAM sequence: GAG
caactggtagaattgaagca

SEQ ID NO: 50735 - DNA, 20 bp, Artificial Sequence
  Description of Artificial Sequence: Synthetic oligonucleotide
  Target: SCN9A; (+) strand; PAM type: NRG; PAM sequence: GAG
actggtagaattgaagcaga

SEQ ID NO: 50736 - DNA, 20 bp, Artificial Sequence
  Description of Artificial Sequence: Synthetic oligonucleotide
  Target: SCN9A; (+) strand; PAM type: NRG; PAM sequence: AGG
ctggtagaattgaagcagag

SEQ ID NO: 50737 - DNA, 20 bp, Artificial Sequence
  Description of Artificial Sequence: Synthetic oligonucleotide
  Target: SCN9A; (+) strand; PAM type: NRG; PAM sequence: GAG
gaagcagagaggatccactt

SEQ ID NO: 50738 - DNA, 20 bp, Artificial Sequence
  Description of Artificial Sequence: Synthetic oligonucleotide
  Target: SCN9A; (+) strand; PAM type: NRG; PAM sequence: AAG
ttgagtttgatgtgttcttc

SEQ ID NO: 50739 - DNA, 20 bp, Artificial Sequence
  Description of Artificial Sequence: Synthetic oligonucleotide
  Target: SCN9A; (+) strand; PAM type: NRG; PAM sequence: TAG
agtttgatgtgttcttcaag

SEQ ID NO: 50740 - DNA, 20 bp, Artificial Sequence
  Description of Artificial Sequence: Synthetic oligonucleotide
  Target: SCN9A; (+) strand; PAM type: NRG; PAM sequence: CAG
ttgatgtgttcttcaagtag

SEQ ID NO: 50741 - DNA, 20 bp, Artificial Sequence
  Description of Artificial Sequence: Synthetic oligonucleotide
  Target: SCN9A; (+) strand; PAM type: NRG; PAM sequence: GAG
gatgtgttcttcaagtagca

SEQ ID NO: 50742 - DNA, 20 bp, Artificial Sequence
  Description of Artificial Sequence: Synthetic oligonucleotide
  Target: SCN9A; (+) strand; PAM type: NRG; PAM sequence: GAG
tcaagtagcagagtttgaat

SEQ ID NO: 50743 - DNA, 20 bp, Artificial Sequence
  Description of Artificial Sequence: Synthetic oligonucleotide
  Target: SCN9A; (+) strand; PAM type: NRG; PAM sequence: GAG
aagtagcagagtttgaatga

SEQ ID NO: 50744 - DNA, 20 bp, Artificial Sequence
  Description of Artificial Sequence: Synthetic oligonucleotide
  Target: SCN9A; (+) strand; PAM type: NRG; PAM sequence: AGG
agtagcagagtttgaatgag

SEQ ID NO: 50745 - DNA, 20 bp, Artificial Sequence
  Description of Artificial Sequence: Synthetic oligonucleotide
  Target: SCN9A; (+) strand; PAM type: NRG; PAM sequence: TAG
agaggtttaaattcctcctc

SEQ ID NO: 50746 - DNA, 20 bp, Artificial Sequence
  Description of Artificial Sequence: Synthetic oligonucleotide
  Target: SCN9A; (+) strand; PAM type: NRG; PAM sequence: CAG
ataatattgttaaattgtat

SEQ ID NO: 50747 - DNA, 20 bp, Artificial Sequence
  Description of Artificial Sequence: Synthetic oligonucleotide
  Target: SCN9A; (+) strand; PAM type: NRG; PAM sequence: AAG
cacaaatgtgccaattacca

SEQ ID NO: 50748 - DNA, 20 bp, Artificial Sequence
  Description of Artificial Sequence: Synthetic oligonucleotide
  Target: SCN9A; (+) strand; PAM type: NRG; PAM sequence: AAG
ccaaagcatatataaaatgt

SEQ ID NO: 50749 - DNA, 20 bp, Artificial Sequence
  Description of Artificial Sequence: Synthetic oligonucleotide
  Target: SCN9A; (+) strand; PAM type: NRG; PAM sequence: TAG
ataaaatgtaagtacaatta

SEQ ID NO: 50750 - DNA, 20 bp, Artificial Sequence
  Description of Artificial Sequence: Synthetic oligonucleotide
  Target: SCN9A; (+) strand; PAM type: NRG; PAM sequence: AAG
tatagaactttatttacaca

SEQ ID NO: 50751 - DNA, 20 bp, Artificial Sequence
  Description of Artificial Sequence: Synthetic oligonucleotide
  Target: SCN9A; (+) strand; PAM type: NRG; PAM sequence: AAG
aactttatttacacaaagac

SEQ ID NO: 50752 - DNA, 20 bp, Artificial Sequence
  Description of Artificial Sequence: Synthetic oligonucleotide
  Target: SCN9A; (+) strand; PAM type: NRG; PAM sequence: CAG
atatatgtgttaaatattat

SEQ ID NO: 50753 - DNA, 20 bp, Artificial Sequence
  Description of Artificial Sequence: Synthetic oligonucleotide
  Target: SCN9A; (+) strand; PAM type: NRG; PAM sequence: AAG
gttaaatattatcagtgtaa

SEQ ID NO: 50754 - DNA, 20 bp, Artificial Sequence
  Description of Artificial Sequence: Synthetic oligonucleotide
  Target: SCN9A; (+) strand; PAM type: NRG; PAM sequence: TGG
tattatcagtgtaaaagtaa

SEQ ID NO: 50755 - DNA, 20 bp, Artificial Sequence
  Description of Artificial Sequence: Synthetic oligonucleotide
  Target: SCN9A; (+) strand; PAM type: NRG; PAM sequence: TAG
tcagtgtaaaagtaatggaa

SEQ ID NO: 50756 - DNA, 20 bp, Artificial Sequence
  Description of Artificial Sequence: Synthetic oligonucleotide
  Target: SCN9A; (+) strand; PAM type: NRG; PAM sequence: GAG
tggaatagcttacaaaaatt

SEQ ID NO: 50757 - DNA, 20 bp, Artificial Sequence
  Description of Artificial Sequence: Synthetic oligonucleotide
  Target: SCN9A; (+) strand; PAM type: NRG; PAM sequence: GAG
gaatagcttacaaaaattga

SEQ ID NO: 50758 - DNA, 20 bp, Artificial Sequence
  Description of Artificial Sequence: Synthetic oligonucleotide
  Target: SCN9A; (+) strand; PAM type: NRG; PAM sequence: AGG
aatagcttacaaaaattgag

SEQ ID NO: 50759 - DNA, 20 bp, Artificial Sequence
  Description of Artificial Sequence: Synthetic oligonucleotide
  Target: SCN9A; (+) strand; PAM type: NRG; PAM sequence: TAG
agcttacaaaaattgagagg

SEQ ID NO: 50760 - DNA, 20 bp, Artificial Sequence
  Description of Artificial Sequence: Synthetic oligonucleotide
  Target: SCN9A; (+) strand; PAM type: NRG; PAM sequence: GAG
cttacaaaaattgagaggta

SEQ ID NO: 50761 - DNA, 20 bp, Artificial Sequence
  Description of Artificial Sequence: Synthetic oligonucleotide
  Target: SCN9A; (+) strand; PAM type: NRG; PAM sequence: AGG
ttacaaaaattgagaggtag

SEQ ID NO: 50762 - DNA, 20 bp, Artificial Sequence
  Description of Artificial Sequence: Synthetic oligonucleotide
  Target: SCN9A; (+) strand; PAM type: NRG; PAM sequence: GGG
tacaaaaattgagaggtaga

SEQ ID NO: 50763 - DNA, 20 bp, Artificial Sequence
  Description of Artificial Sequence: Synthetic oligonucleotide
  Target: SCN9A; (+) strand; PAM type: NRG; PAM sequence: GGG
acaaaaattgagaggtagag

SEQ ID NO: 50764 - DNA, 20 bp, Artificial Sequence
  Description of Artificial Sequence: Synthetic oligonucleotide
  Target: SCN9A; (+) strand; PAM type: NRG; PAM sequence: GGG
caaaaattgagaggtagagg

SEQ ID NO: 50765 - DNA, 20 bp, Artificial Sequence
  Description of Artificial Sequence: Synthetic oligonucleotide
  Target: SCN9A; (+) strand; PAM type: NRG; PAM sequence: TAG
attgagaggtagagggggat

SEQ ID NO: 50766 - DNA, 20 bp, Artificial Sequence
  Description of Artificial Sequence: Synthetic oligonucleotide
  Target: SCN9A; (+) strand; PAM type: NRG; PAM sequence: TGG
gagaggtagagggggattag

SEQ ID NO: 50767 - DNA, 20 bp, Artificial Sequence
  Description of Artificial Sequence: Synthetic oligonucleotide
  Target: SCN9A; (+) strand; PAM type: NRG; PAM sequence: GAG
ggtagagggggattagtggt

SEQ ID NO: 50768 - DNA, 20 bp, Artificial Sequence
  Description of Artificial Sequence: Synthetic oligonucleotide
  Target: SCN9A; (+) strand; PAM type: NRG; PAM sequence: AGG
gtagagggggattagtggtg

SEQ ID NO: 50769 - DNA, 20 bp, Artificial Sequence
  Description of Artificial Sequence: Synthetic oligonucleotide
  Target: SCN9A; (+) strand; PAM type: NRG; PAM sequence: GGG
tagagggggattagtggtga

SEQ ID NO: 50770 - DNA, 20 bp, Artificial Sequence
  Description of Artificial Sequence: Synthetic oligonucleotide
  Target: SCN9A; (+) strand; PAM type: NRG; PAM sequence: AAG
ggggattagtggtgagggaa

SEQ ID NO: 50771 - DNA, 20 bp, Artificial Sequence
  Description of Artificial Sequence: Synthetic oligonucleotide
  Target: SCN9A; (+) strand; PAM type: NRG; PAM sequence: TGG
attagtggtgagggaaaagt

SEQ ID NO: 50772 - DNA, 20 bp, Artificial Sequence
  Description of Artificial Sequence: Synthetic oligonucleotide
  Target: SCN9A; (+) strand; PAM type: NRG; PAM sequence: GAG
tagtggtgagggaaaagttg

SEQ ID NO: 50773 - DNA, 20 bp, Artificial Sequence
  Description of Artificial Sequence: Synthetic oligonucleotide
  Target: SCN9A; (+) strand; PAM type: NRG; PAM sequence: GAG
gtggtgagggaaaagttgga

SEQ ID NO: 50774 - DNA, 20 bp, Artificial Sequence
  Description of Artificial Sequence: Synthetic oligonucleotide
  Target: SCN9A; (+) strand; PAM type: NRG; PAM sequence: AAG
tgaccccttatcttacattg

SEQ ID NO: 50775 - DNA, 20 bp, Artificial Sequence
  Description of Artificial Sequence: Synthetic oligonucleotide
  Target: SCN9A; (+) strand; PAM type: NRG; PAM sequence: AGG
gaccccttatcttacattga

SEQ ID NO: 50776 - DNA, 20 bp, Artificial Sequence
  Description of Artificial Sequence: Synthetic oligonucleotide
  Target: SCN9A; (+) strand; PAM type: NRG; PAM sequence: CAG
cccttatcttacattgaagg

SEQ ID NO: 50777 - DNA, 20 bp, Artificial Sequence
  Description of Artificial Sequence: Synthetic oligonucleotide
  Target: SCN9A; (+) strand; PAM type: NRG; PAM sequence: TAG
tatcttacattgaaggcagt

SEQ ID NO: 50778 - DNA, 20 bp, Artificial Sequence
  Description of Artificial Sequence: Synthetic oligonucleotide
  Target: SCN9A; (+) strand; PAM type: NRG; PAM sequence: TGG
tgaaggcagttagtgcatcc

SEQ ID NO: 50779 - DNA, 20 bp, Artificial Sequence
  Description of Artificial Sequence: Synthetic oligonucleotide
  Target: SCN9A; (+) strand; PAM type: NRG; PAM sequence: AAG
cagttagtgcatcctggcta

SEQ ID NO: 50780 - DNA, 20 bp, Artificial Sequence
  Description of Artificial Sequence: Synthetic oligonucleotide
  Target: SCN9A; (+) strand; PAM type: NRG; PAM sequence: AAG
gtgcatcctggctaaagttt

SEQ ID NO: 50781 - DNA, 20 bp, Artificial Sequence
  Description of Artificial Sequence: Synthetic oligonucleotide
  Target: SCN9A; (+) strand; PAM type: NRG; PAM sequence: AAG
ctggctaaagtttaagtaac

SEQ ID NO: 50782 - DNA, 20 bp, Artificial Sequence
  Description of Artificial Sequence: Synthetic oligonucleotide
  Target: SCN9A; (+) strand; PAM type: NRG; PAM sequence: TAG
aaagtttaagtaacaagaaa

SEQ ID NO: 50783 - DNA, 20 bp, Artificial Sequence
  Description of Artificial Sequence: Synthetic oligonucleotide
  Target: SCN9A; (+) strand; PAM type: NRG; PAM sequence: GAG
agtttaagtaacaagaaata

SEQ ID NO: 50784 - DNA, 20 bp, Artificial Sequence
  Description of Artificial Sequence: Synthetic oligonucleotide
  Target: SCN9A; (+) strand; PAM type: NRG; PAM sequence: AGG
gtttaagtaacaagaaatag

SEQ ID NO: 50785 - DNA, 20 bp, Artificial Sequence
  Description of Artificial Sequence: Synthetic oligonucleotide
  Target: SCN9A; (+) strand; PAM type: NRG; PAM sequence: CAG
agtaacaagaaatagaggtt

SEQ ID NO: 50786 - DNA, 20 bp, Artificial Sequence
  Description of Artificial Sequence: Synthetic oligonucleotide
  Target: SCN9A; (+) strand; PAM type: NRG; PAM sequence: AGG
gtaacaagaaatagaggttc

SEQ ID NO: 50787 - DNA, 20 bp, Artificial Sequence
  Description of Artificial Sequence: Synthetic oligonucleotide
  Target: SCN9A; (+) strand; PAM type: NRG; PAM sequence: AAG
gttcaggtatattccattta

SEQ ID NO: 50788 - DNA, 20 bp, Artificial Sequence
  Description of Artificial Sequence: Synthetic oligonucleotide
  Target: SCN9A; (+) strand; PAM type: NRG; PAM sequence: AGG
ttcaggtatattccatttaa

SEQ ID NO: 50789 - DNA, 20 bp, Artificial Sequence
  Description of Artificial Sequence: Synthetic oligonucleotide
  Target: SCN9A; (+) strand; PAM type: NRG; PAM sequence: TAG
aaaggtataaatccaaccca

SEQ ID NO: 50790 - DNA, 20 bp, Artificial Sequence
  Description of Artificial Sequence: Synthetic oligonucleotide
  Target: SCN9A; (+) strand; PAM type: NRG; PAM sequence: TAG
atccaacccatagaattact

SEQ ID NO: 50791 - DNA, 20 bp, Artificial Sequence
  Description of Artificial Sequence: Synthetic oligonucleotide
  Target: SCN9A; (+) strand; PAM type: NRG; PAM sequence: TGG
gaaatgaaaacataactgct

SEQ ID NO: 50792 - DNA, 20 bp, Artificial Sequence
  Description of Artificial Sequence: Synthetic oligonucleotide
  Target: SCN9A; (+) strand; PAM type: NRG; PAM sequence: GAG
aacataactgcttggaattt

SEQ ID NO: 50793 - DNA, 20 bp, Artificial Sequence
  Description of Artificial Sequence: Synthetic oligonucleotide
  Target: SCN9A; (+) strand; PAM type: NRG; PAM sequence: TGG
aactgcttggaatttgagaa

SEQ ID NO: 50794 - DNA, 20 bp, Artificial Sequence
  Description of Artificial Sequence: Synthetic oligonucleotide
  Target: SCN9A; (+) strand; PAM type: NRG; PAM sequence: GGG
actgcttggaatttgagaat

SEQ ID NO: 50795 - DNA, 20 bp, Artificial Sequence
  Description of Artificial Sequence: Synthetic oligonucleotide
  Target: SCN9A; (+) strand; PAM type: NRG; PAM sequence: GGG
ctgcttggaatttgagaatg

SEQ ID NO: 50796 - DNA, 20 bp, Artificial Sequence
  Description of Artificial Sequence: Synthetic oligonucleotide
  Target: SCN9A; (+) strand; PAM type: NRG; PAM sequence: CAG
cttggaatttgagaatgggg

SEQ ID NO: 50797 - DNA, 20 bp, Artificial Sequence
  Description of Artificial Sequence: Synthetic oligonucleotide
  Target: SCN9A; (+) strand; PAM type: NRG; PAM sequence: AAG
gaatttgagaatggggcaga

SEQ ID NO: 50798 - DNA, 20 bp, Artificial Sequence
  Description of Artificial Sequence: Synthetic oligonucleotide
  Target: SCN9A; (+) strand; PAM type: NRG; PAM sequence: GAG
atttgagaatggggcagaaa

SEQ ID NO: 50799 - DNA, 20 bp, Artificial Sequence
  Description of Artificial Sequence: Synthetic oligonucleotide
  Target: SCN9A; (+) strand; PAM type: NRG; PAM sequence: AAG
agaatggggcagaaagagaa

SEQ ID NO: 50800 - DNA, 20 bp, Artificial Sequence
  Description of Artificial Sequence: Synthetic oligonucleotide
  Target: SCN9A; (+) strand; PAM type: NRG; PAM sequence: TAG
taaattcctcattttcaaat

SEQ ID NO: 50801 - DNA, 20 bp, Artificial Sequence
  Description of Artificial Sequence: Synthetic oligonucleotide
  Target: SCN9A; (+) strand; PAM type: NRG; PAM sequence: AAG
ttcctcattttcaaattaga

SEQ ID NO: 50802 - DNA, 20 bp, Artificial Sequence
  Description of Artificial Sequence: Synthetic oligonucleotide
  Target: SCN9A; (+) strand; PAM type: NRG; PAM sequence: TAG
tcattttcaaattagaaagt

SEQ ID NO: 50803 - DNA, 20 bp, Artificial Sequence
  Description of Artificial Sequence: Synthetic oligonucleotide
  Target: SCN9A; (+) strand; PAM type: NRG; PAM sequence: AAG
aaagttagaaaacattacat

SEQ ID NO: 50804 - DNA, 20 bp, Artificial Sequence
  Description of Artificial Sequence: Synthetic oligonucleotide
  Target: SCN9A; (+) strand; PAM type: NRG; PAM sequence: GAG
taagttgatgaaataaaaat

SEQ ID NO: 50805 - DNA, 20 bp, Artificial Sequence
  Description of Artificial Sequence: Synthetic oligonucleotide
  Target: SCN9A; (+) strand; PAM type: NRG; PAM sequence: AAG
atgaaataaaaatgagacat

SEQ ID NO: 50806 - DNA, 20 bp, Artificial Sequence
  Description of Artificial Sequence: Synthetic oligonucleotide
  Target: SCN9A; (+) strand; PAM type: NRG; PAM sequence: TAG
tgagacataagcatattatt

SEQ ID NO: 50807 - DNA, 20 bp, Artificial Sequence
  Description of Artificial Sequence: Synthetic oligonucleotide
  Target: SCN9A; (+) strand; PAM type: NRG; PAM sequence: GAG
agacataagcatattattta

SEQ ID NO: 50808 - DNA, 20 bp, Artificial Sequence
  Description of Artificial Sequence: Synthetic oligonucleotide
  Target: SCN9A; (+) strand; PAM type: NRG; PAM sequence: AAG
gcatattatttagagataaa

SEQ ID NO: 50809 - DNA, 20 bp, Artificial Sequence
  Description of Artificial Sequence: Synthetic oligonucleotide
  Target: SCN9A; (+) strand; PAM type: NRG; PAM sequence: AGG
catattatttagagataaaa

SEQ ID NO: 50810 - DNA, 20 bp, Artificial Sequence
  Description of Artificial Sequence: Synthetic oligonucleotide
  Target: SCN9A; (+) strand; PAM type: NRG; PAM sequence: CAG
agagataaaaaggaaaatat

SEQ ID NO: 50811 - DNA, 20 bp, Artificial Sequence
  Description of Artificial Sequence: Synthetic oligonucleotide
  Target: SCN9A; (+) strand; PAM type: NRG; PAM sequence: AAG
agaaaaacttttttttaaaa

SEQ ID NO: 50812 - DNA, 20 bp, Artificial Sequence
  Description of Artificial Sequence: Synthetic oligonucleotide
  Target: SCN9A; (+) strand; PAM type: NRG; PAM sequence: CGG
aaaacttttttttaaaaaag

SEQ ID NO: 50813 - DNA, 20 bp, Artificial Sequence
  Description of Artificial Sequence: Synthetic oligonucleotide
  Target: SCN9A; (+) strand; PAM type: NRG; PAM sequence: GGG
aaacttttttttaaaaaagc

SEQ ID NO: 50814 - DNA, 20 bp, Artificial Sequence
  Description of Artificial Sequence: Synthetic oligonucleotide
  Target: SCN9A; (+) strand; PAM type: NRG; PAM sequence: AAG
cttttttttaaaaaagcggg

SEQ ID NO: 50815 - DNA, 20 bp, Artificial Sequence
  Description of Artificial Sequence: Synthetic oligonucleotide
  Target: SCN9A; (+) strand; PAM type: NRG; PAM sequence: TAG
agcgggaagtgattattccc

SEQ ID NO: 50816 - DNA, 20 bp, Artificial Sequence
  Description of Artificial Sequence: Synthetic oligonucleotide
  Target: SCN9A; (+) strand; PAM type: NRG; PAM sequence: TGG
agtgattattccctagataa

SEQ ID NO: 50817 - DNA, 20 bp, Artificial Sequence
  Description of Artificial Sequence: Synthetic oligonucleotide
  Target: SCN9A; (+) strand; PAM type: NRG; PAM sequence: AAG
ttccctagataatggcttta

SEQ ID NO: 50818 - DNA, 20 bp, Artificial Sequence
  Description of Artificial Sequence: Synthetic oligonucleotide
  Target: SCN9A; (+) strand; PAM type: NRG; PAM sequence: AGG
tccctagataatggctttaa

SEQ ID NO: 50819 - DNA, 20 bp, Artificial Sequence
  Description of Artificial Sequence: Synthetic oligonucleotide
  Target: SCN9A; (+) strand; PAM type: NRG; PAM sequence: GGG
ccctagataatggctttaaa

SEQ ID NO: 50820 - DNA, 20 bp, Artificial Sequence
  Description of Artificial Sequence: Synthetic oligonucleotide
  Target: SCN9A; (+) strand; PAM type: NRG; PAM sequence: AAG
ataatggctttaaagggata

SEQ ID NO: 50821 - DNA, 20 bp, Artificial Sequence
  Description of Artificial Sequence: Synthetic oligonucleotide
  Target: SCN9A; (+) strand; PAM type: NRG; PAM sequence: TAG
aaagcaaaaattgtttgaat

SEQ ID NO: 50822 - DNA, 20 bp, Artificial Sequence
  Description of Artificial Sequence: Synthetic oligonucleotide
  Target: SCN9A; (+) strand; PAM type: NRG; PAM sequence: TAG
tgcatttgttaattttataa

SEQ ID NO: 50823 - DNA, 20 bp, Artificial Sequence
  Description of Artificial Sequence: Synthetic oligonucleotide
  Target: SCN9A; (+) strand; PAM type: NRG; PAM sequence: AAG
tagttattattatgattaaa

SEQ ID NO: 50824 - DNA, 20 bp, Artificial Sequence
  Description of Artificial Sequence: Synthetic oligonucleotide
  Target: SCN9A; (+) strand; PAM type: NRG; PAM sequence: AAG
attaaaaagctgtaaaataa

SEQ ID NO: 50825 - DNA, 20 bp, Artificial Sequence
  Description of Artificial Sequence: Synthetic oligonucleotide
  Target: SCN9A; (+) strand; PAM type: NRG; PAM sequence: AAG
aaaaagctgtaaaataaaag

SEQ ID NO: 50826 - DNA, 20 bp, Artificial Sequence
  Description of Artificial Sequence: Synthetic oligonucleotide
  Target: SCN9A; (+) strand; PAM type: NRG; PAM sequence: GAG
agatattatacctctctctt

SEQ ID NO: 50827 - DNA, 20 bp, Artificial Sequence
  Description of Artificial Sequence: Synthetic oligonucleotide
  Target: SCN9A; (+) strand; PAM type: NRG; PAM sequence: AAG
tatacctctctcttgagcca

SEQ ID NO: 50828 - DNA, 20 bp, Artificial Sequence
  Description of Artificial Sequence: Synthetic oligonucleotide
  Target: SCN9A; (+) strand; PAM type: NRG; PAM sequence: CAG
gagccaaagaaaccaacaaa

SEQ ID NO: 50829 - DNA, 20 bp, Artificial Sequence
  Description of Artificial Sequence: Synthetic oligonucleotide
  Target: SCN9A; (+) strand; PAM type: NRG; PAM sequence: AAG
aaaccaacaaacagctgctt

SEQ ID NO: 50830 - DNA, 20 bp, Artificial Sequence
  Description of Artificial Sequence: Synthetic oligonucleotide
  Target: SCN9A; (+) strand; PAM type: NRG; PAM sequence: TAG
ccaacaaacagctgcttaag

SEQ ID NO: 50831 - DNA, 20 bp, Artificial Sequence
  Description of Artificial Sequence: Synthetic oligonucleotide
  Target: SCN9A; (+) strand; PAM type: NRG; PAM sequence: TGG
aactgttctgttaccttcac

SEQ ID NO: 50832 - DNA, 20 bp, Artificial Sequence
  Description of Artificial Sequence: Synthetic oligonucleotide
  Target: SCN9A; (+) strand; PAM type: NRG; PAM sequence: GGG
actgttctgttaccttcact

SEQ ID NO: 50833 - DNA, 20 bp, Artificial Sequence
  Description of Artificial Sequence: Synthetic oligonucleotide
  Target: SCN9A; (+) strand; PAM type: NRG; PAM sequence: TGG
ttcactgggcttgaaaaata

SEQ ID NO: 50834 - DNA, 20 bp, Artificial Sequence
  Description of Artificial Sequence: Synthetic oligonucleotide
  Target: SCN9A; (+) strand; PAM type: NRG; PAM sequence: TAG
cctttcaaacaccatatatt

SEQ ID NO: 50835 - DNA, 20 bp, Artificial Sequence
  Description of Artificial Sequence: Synthetic oligonucleotide
  Target: SCN9A; (+) strand; PAM type: NRG; PAM sequence: CAG
tacattattttgatctcttt

SEQ ID NO: 50836 - DNA, 20 bp, Artificial Sequence
  Description of Artificial Sequence: Synthetic oligonucleotide
  Target: SCN9A; (+) strand; PAM type: NRG; PAM sequence: AGG
acattattttgatctctttc

SEQ ID NO: 50837 - DNA, 20 bp, Artificial Sequence
  Description of Artificial Sequence: Synthetic oligonucleotide
  Target: SCN9A; (+) strand; PAM type: NRG; PAM sequence: TGG
ttgatctctttcaggtaaat

SEQ ID NO: 50838 - DNA, 20 bp, Artificial Sequence
  Description of Artificial Sequence: Synthetic oligonucleotide
  Target: SCN9A; (+) strand; PAM type: NRG; PAM sequence: GAG
gatctctttcaggtaaattg

SEQ ID NO: 50839 - DNA, 20 bp, Artificial Sequence
  Description of Artificial Sequence: Synthetic oligonucleotide
  Target: SCN9A; (+) strand; PAM type: NRG; PAM sequence: AAG
tttattaatatttcttcttc

SEQ ID NO: 50840 - DNA, 20 bp, Artificial Sequence
  Description of Artificial Sequence: Synthetic oligonucleotide
  Target: SCN9A; (+) strand; PAM type: NRG; PAM sequence: AGG
ttattaatatttcttcttca

SEQ ID NO: 50841 - DNA, 20 bp, Artificial Sequence
  Description of Artificial Sequence: Synthetic oligonucleotide
  Target: SCN9A; (+) strand; PAM type: NRG; PAM sequence: GGG
tattaatatttcttcttcaa

SEQ ID NO: 50842 - DNA, 20 bp, Artificial Sequence
  Description of Artificial Sequence: Synthetic oligonucleotide
  Target: SCN9A; (+) strand; PAM type: NRG; PAM sequence: AAG
tgacacactgcaaacactca

SEQ ID NO: 50843 - DNA, 20 bp, Artificial Sequence
  Description of Artificial Sequence: Synthetic oligonucleotide
  Target: SCN9A; (+) strand; PAM type: NRG; PAM sequence: CAG
actgcaaacactcaaagtta

SEQ ID NO: 50844 - DNA, 20 bp, Artificial Sequence
  Description of Artificial Sequence: Synthetic oligonucleotide
  Target: SCN9A; (+) strand; PAM type: NRG; PAM sequence: AAG
aaacactcaaagttacagta

SEQ ID NO: 50845 - DNA, 20 bp, Artificial Sequence
  Description of Artificial Sequence: Synthetic oligonucleotide
  Target: SCN9A; (+) strand; PAM type: NRG; PAM sequence: TAG
tgtcttctactttctctgct

SEQ ID NO: 50846 - DNA, 20 bp, Artificial Sequence
  Description of Artificial Sequence: Synthetic oligonucleotide
  Target: SCN9A; (+) strand; PAM type: NRG; PAM sequence: TGG
atgaatactgaacacttcat

SEQ ID NO: 50847 - DNA, 20 bp, Artificial Sequence
  Description of Artificial Sequence: Synthetic oligonucleotide
  Target: SCN9A; (+) strand; PAM type: NRG; PAM sequence: GGG
tgaatactgaacacttcatt

SEQ ID NO: 50848 - DNA, 20 bp, Artificial Sequence
  Description of Artificial Sequence: Synthetic oligonucleotide
  Target: SCN9A; (+) strand; PAM type: NRG; PAM sequence: TGG
acttcattgggtgctaccaa

SEQ ID NO: 50849 - DNA, 20 bp, Artificial Sequence
  Description of Artificial Sequence: Synthetic oligonucleotide
  Target: SCN9A; (+) strand; PAM type: NRG; PAM sequence: TGG
cattgggtgctaccaatggc

SEQ ID NO: 50850 - DNA, 20 bp, Artificial Sequence
  Description of Artificial Sequence: Synthetic oligonucleotide
  Target: SCN9A; (+) strand; PAM type: NRG; PAM sequence: TGG
tggctggcttgctgaatgca

SEQ ID NO: 50851 - DNA, 20 bp, Artificial Sequence
  Description of Artificial Sequence: Synthetic oligonucleotide
  Target: SCN9A; (+) strand; PAM type: NRG; PAM sequence: TAG
atctgacaccaattcttcca

SEQ ID NO: 50852 - DNA, 20 bp, Artificial Sequence
  Description of Artificial Sequence: Synthetic oligonucleotide
  Target: SCN9A; (+) strand; PAM type: NRG; PAM sequence: GAG
gacaccaattcttccatagt

SEQ ID NO: 50853 - DNA, 20 bp, Artificial Sequence
  Description of Artificial Sequence: Synthetic oligonucleotide
  Target: SCN9A; (+) strand; PAM type: NRG; PAM sequence: GAG
attcttccatagtgagcttt

SEQ ID NO: 50854 - DNA, 20 bp, Artificial Sequence
  Description of Artificial Sequence: Synthetic oligonucleotide
  Target: SCN9A; (+) strand; PAM type: NRG; PAM sequence: TGG
ccatagtgagctttgagatg

SEQ ID NO: 50855 - DNA, 20 bp, Artificial Sequence
  Description of Artificial Sequence: Synthetic oligonucleotide
  Target: SCN9A; (+) strand; PAM type: NRG; PAM sequence: GGG
catagtgagctttgagatgt

SEQ ID NO: 50856 - DNA, 20 bp, Artificial Sequence
  Description of Artificial Sequence: Synthetic oligonucleotide
  Target: SCN9A; (+) strand; PAM type: NRG; PAM sequence: TAG
aaaatccctttcacttatgt

SEQ ID NO: 50857 - DNA, 20 bp, Artificial Sequence
  Description of Artificial Sequence: Synthetic oligonucleotide
  Target: SCN9A; (+) strand; PAM type: NRG; PAM sequence: AGG
aaatccctttcacttatgtt

SEQ ID NO: 50858 - DNA, 20 bp, Artificial Sequence
  Description of Artificial Sequence: Synthetic oligonucleotide
  Target: SCN9A; (+) strand; PAM type: NRG; PAM sequence: CAG
gttaggtaatgttaaaaatg

SEQ ID NO: 50859 - DNA, 20 bp, Artificial Sequence
  Description of Artificial Sequence: Synthetic oligonucleotide
  Target: SCN9A; (+) strand; PAM type: NRG; PAM sequence: AAG
gtaatgttaaaaatgcagct

SEQ ID NO: 50860 - DNA, 20 bp, Artificial Sequence
  Description of Artificial Sequence: Synthetic oligonucleotide
  Target: SCN9A; (+) strand; PAM type: NRG; PAM sequence: TGG
ctaagtatcatttgtctcta

SEQ ID NO: 50861 - DNA, 20 bp, Artificial Sequence
  Description of Artificial Sequence: Synthetic oligonucleotide
  Target: SCN9A; (+) strand; PAM type: NRG; PAM sequence: AAG
catttgtctctatggttgtc

SEQ ID NO: 50862 - DNA, 20 bp, Artificial Sequence
  Description of Artificial Sequence: Synthetic oligonucleotide
  Target: SCN9A; (+) strand; PAM type: NRG; PAM sequence: GAG
tttgtctctatggttgtcaa

SEQ ID NO: 50863 - DNA, 20 bp, Artificial Sequence
  Description of Artificial Sequence: Synthetic oligonucleotide
  Target: SCN9A; (+) strand; PAM type: NRG; PAM sequence: CAG
gttgtcaagagtgtatatat

SEQ ID NO: 50864 - DNA, 20 bp, Artificial Sequence
  Description of Artificial Sequence: Synthetic oligonucleotide
  Target: SCN9A; (+) strand; PAM type: NRG; PAM sequence: CAG
agagtgtatatatcagaatg

SEQ ID NO: 50865 - DNA, 20 bp, Artificial Sequence
  Description of Artificial Sequence: Synthetic oligonucleotide
  Target: SCN9A; (+) strand; PAM type: NRG; PAM sequence: AGG
gagtgtatatatcagaatgc

SEQ ID NO: 50866 - DNA, 20 bp, Artificial Sequence
  Description of Artificial Sequence: Synthetic oligonucleotide
  Target: SCN9A; (+) strand; PAM type: NRG; PAM sequence: TGG
aatgcaggtatactccactg

SEQ ID NO: 50867 - DNA, 20 bp, Artificial Sequence
  Description of Artificial Sequence: Synthetic oligonucleotide
  Target: SCN9A; (+) strand; PAM type: NRG; PAM sequence: CAG
actccactgtggctattgac

SEQ ID NO: 50868 - DNA, 20 bp, Artificial Sequence
  Description of Artificial Sequence: Synthetic oligonucleotide
  Target: SCN9A; (+) strand; PAM type: NRG; PAM sequence: AGG
ctccactgtggctattgacc

SEQ ID NO: 50869 - DNA, 20 bp, Artificial Sequence
  Description of Artificial Sequence: Synthetic oligonucleotide
  Target: SCN9A; (+) strand; PAM type: NRG; PAM sequence: GGG
tccactgtggctattgacca

SEQ ID NO: 50870 - DNA, 20 bp, Artificial Sequence
  Description of Artificial Sequence: Synthetic oligonucleotide
  Target: SCN9A; (+) strand; PAM type: NRG; PAM sequence: CAG
ctgtgtaacctaaaaaaata

SEQ ID NO: 50871 - DNA, 20 bp, Artificial Sequence
  Description of Artificial Sequence: Synthetic oligonucleotide
  Target: SCN9A; (+) strand; PAM type: NRG; PAM sequence: CAG
acctaaaaaaatacagatgc

SEQ ID NO: 50872 - DNA, 20 bp, Artificial Sequence
  Description of Artificial Sequence: Synthetic oligonucleotide
  Target: SCN9A; (+) strand; PAM type: NRG; PAM sequence: AGG
cctaaaaaaatacagatgcc

SEQ ID NO: 50873 - DNA, 20 bp, Artificial Sequence
  Description of Artificial Sequence: Synthetic oligonucleotide
  Target: SCN9A; (+) strand; PAM type: NRG; PAM sequence: GGG
ctaaaaaaatacagatgcca

SEQ ID NO: 50874 - DNA, 20 bp, Artificial Sequence
  Description of Artificial Sequence: Synthetic oligonucleotide
  Target: SCN9A; (+) strand; PAM type: NRG; PAM sequence: AAG
acagatgccagggcttatct

SEQ ID NO: 50875 - DNA, 20 bp, Artificial Sequence
  Description of Artificial Sequence: Synthetic oligonucleotide
  Target: SCN9A; (+) strand; PAM type: NRG; PAM sequence: AAG
tctaagtaatgctgaaataa

SEQ ID NO: 50876 - DNA, 20 bp, Artificial Sequence
  Description of Artificial Sequence: Synthetic oligonucleotide
  Target: SCN9A; (+) strand; PAM type: NRG; PAM sequence: TAG
taatgctgaaataaaagttt

SEQ ID NO: 50877 - DNA, 20 bp, Artificial Sequence
  Description of Artificial Sequence: Synthetic oligonucleotide
  Target: SCN9A; (+) strand; PAM type: NRG; PAM sequence: AGG
aatgctgaaataaaagtttt

SEQ ID NO: 50878 - DNA, 20 bp, Artificial Sequence
  Description of Artificial Sequence: Synthetic oligonucleotide
  Target: SCN9A; (+) strand; PAM type: NRG; PAM sequence: GGG
atgctgaaataaaagtttta

SEQ ID NO: 50879 - DNA, 20 bp, Artificial Sequence
  Description of Artificial Sequence: Synthetic oligonucleotide
  Target: SCN9A; (+) strand; PAM type: NRG; PAM sequence: AAG
ctgaaataaaagttttaggg

SEQ ID NO: 50880 - DNA, 20 bp, Artificial Sequence
  Description of Artificial Sequence: Synthetic oligonucleotide
  Target: SCN9A; (+) strand; PAM type: NRG; PAM sequence: GAG
gaaataaaagttttagggaa

SEQ ID NO: 50881 - DNA, 20 bp, Artificial Sequence
  Description of Artificial Sequence: Synthetic oligonucleotide
  Target: SCN9A; (+) strand; PAM type: NRG; PAM sequence: AAG
aaagttttagggaagagcat

SEQ ID NO: 50882 - DNA, 20 bp, Artificial Sequence
  Description of Artificial Sequence: Synthetic oligonucleotide
  Target: SCN9A; (+) strand; PAM type: NRG; PAM sequence: AAG
taagcatgtctacttttaaa

SEQ ID NO: 50883 - DNA, 20 bp, Artificial Sequence
  Description of Artificial Sequence: Synthetic oligonucleotide
  Target: SCN9A; (+) strand; PAM type: NRG; PAM sequence: CAG
ttttgttaaatcaaaaatat

SEQ ID NO: 50884 - DNA, 20 bp, Artificial Sequence
  Description of Artificial Sequence: Synthetic oligonucleotide
  Target: SCN9A; (+) strand; PAM type: NRG; PAM sequence: GAG
ttaaatcaaaaatatcagat

SEQ ID NO: 50885 - DNA, 20 bp, Artificial Sequence
  Description of Artificial Sequence: Synthetic oligonucleotide
  Target: SCN9A; (+) strand; PAM type: NRG; PAM sequence: CAG
agtacacatacatcaatgac

SEQ ID NO: 50886 - DNA, 20 bp, Artificial Sequence
  Description of Artificial Sequence: Synthetic oligonucleotide
  Target: SCN9A; (+) strand; PAM type: NRG; PAM sequence: AGG
gtacacatacatcaatgacc

SEQ ID NO: 50887 - DNA, 20 bp, Artificial Sequence
  Description of Artificial Sequence: Synthetic oligonucleotide
  Target: SCN9A; (+) strand; PAM type: NRG; PAM sequence: AAG
gaccaggttttattattcaa

SEQ ID NO: 50888 - DNA, 20 bp, Artificial Sequence
  Description of Artificial Sequence: Synthetic oligonucleotide
  Target: SCN9A; (+) strand; PAM type: NRG; PAM sequence: AGG
accaggttttattattcaaa

SEQ ID NO: 50889 - DNA, 20 bp, Artificial Sequence
  Description of Artificial Sequence: Synthetic oligonucleotide
  Target: SCN9A; (+) strand; PAM type: NRG; PAM sequence: GAG
caggttttattattcaaaag

SEQ ID NO: 50890 - DNA, 20 bp, Artificial Sequence
  Description of Artificial Sequence: Synthetic oligonucleotide
  Target: SCN9A; (+) strand; PAM type: NRG; PAM sequence: GAG
ggttttattattcaaaagga

SEQ ID NO: 50891 - DNA, 20 bp, Artificial Sequence
  Description of Artificial Sequence: Synthetic oligonucleotide
  Target: SCN9A; (+) strand; PAM type: NRG; PAM sequence: AAG
gagaaaaaattcaattcaaa

SEQ ID NO: 50892 - DNA, 20 bp, Artificial Sequence
  Description of Artificial Sequence: Synthetic oligonucleotide
  Target: SCN9A; (+) strand; PAM type: NRG; PAM sequence: TAG
aaaaaattcaattcaaaaag

SEQ ID NO: 50893 - DNA, 20 bp, Artificial Sequence
  Description of Artificial Sequence: Synthetic oligonucleotide
  Target: SCN9A; (+) strand; PAM type: NRG; PAM sequence: AAG
attcaattcaaaaagtagaa

SEQ ID NO: 50894 - DNA, 20 bp, Artificial Sequence
  Description of Artificial Sequence: Synthetic oligonucleotide
  Target: SCN9A; (+) strand; PAM type: NRG; PAM sequence: TGG
tcaaaaagtagaaaagtttt

SEQ ID NO: 50895 - DNA, 20 bp, Artificial Sequence
  Description of Artificial Sequence: Synthetic oligonucleotide
  Target: SCN9A; (+) strand; PAM type: NRG; PAM sequence: TGG
aaaagtttttggattttgtt

SEQ ID NO: 50896 - DNA, 20 bp, Artificial Sequence
  Description of Artificial Sequence: Synthetic oligonucleotide
  Target: SCN9A; (+) strand; PAM type: NRG; PAM sequence: AAG
tttggattttgtttggtttg

SEQ ID NO: 50897 - DNA, 20 bp, Artificial Sequence
  Description of Artificial Sequence: Synthetic oligonucleotide
  Target: SCN9A; (+) strand; PAM type: NRG; PAM sequence: AAG
atgtaaaatacacaacttta

SEQ ID NO: 50898 - DNA, 20 bp, Artificial Sequence
  Description of Artificial Sequence: Synthetic oligonucleotide
  Target: SCN9A; (+) strand; PAM type: NRG; PAM sequence: TGG
aaagttaactattttaaaat

SEQ ID NO: 50899 - DNA, 20 bp, Artificial Sequence
  Description of Artificial Sequence: Synthetic oligonucleotide
  Target: SCN9A; (+) strand; PAM type: NRG; PAM sequence: AAG
ttaactattttaaaattgga

SEQ ID NO: 50900 - DNA, 20 bp, Artificial Sequence
  Description of Artificial Sequence: Synthetic oligonucleotide
  Target: SCN9A; (+) strand; PAM type: NRG; PAM sequence: AGG
taactattttaaaattggaa

SEQ ID NO: 50901 - DNA, 20 bp, Artificial Sequence
  Description of Artificial Sequence: Synthetic oligonucleotide
  Target: SCN9A; (+) strand; PAM type: NRG; PAM sequence: TAG
taaacataaattccattcaa

SEQ ID NO: 50902 - DNA, 20 bp, Artificial Sequence
  Description of Artificial Sequence: Synthetic oligonucleotide
  Target: SCN9A; (+) strand; PAM type: NRG; PAM sequence: CAG
ataaattccattcaatagac

SEQ ID NO: 50903 - DNA, 20 bp, Artificial Sequence
  Description of Artificial Sequence: Synthetic oligonucleotide
  Target: SCN9A; (+) strand; PAM type: NRG; PAM sequence: AGG
taaattccattcaatagacc

SEQ ID NO: 50904 - DNA, 20 bp, Artificial Sequence
  Description of Artificial Sequence: Synthetic oligonucleotide
  Target: SCN9A; (+) strand; PAM type: NRG; PAM sequence: CAG
tccattcaatagaccaggca

SEQ ID NO: 50905 - DNA, 20 bp, Artificial Sequence
  Description of Artificial Sequence: Synthetic oligonucleotide
  Target: SCN9A; (+) strand; PAM type: NRG; PAM sequence: TGG
attcaatagaccaggcacag

SEQ ID NO: 50906 - DNA, 20 bp, Artificial Sequence
  Description of Artificial Sequence: Synthetic oligonucleotide
  Target: SCN9A; (+) strand; PAM type: NRG; PAM sequence: CGG
gcctgtaattccaacatttt

SEQ ID NO: 50907 - DNA, 20 bp, Artificial Sequence
  Description of Artificial Sequence: Synthetic oligonucleotide
  Target: SCN9A; (+) strand; PAM type: NRG; PAM sequence: GAG
ctgtaattccaacattttcg

SEQ ID NO: 50908 - DNA, 20 bp, Artificial Sequence
  Description of Artificial Sequence: Synthetic oligonucleotide
  Target: SCN9A; (+) strand; PAM type: NRG; PAM sequence: AGG
tgtaattccaacattttcgg

SEQ ID NO: 50909 - DNA, 20 bp, Artificial Sequence
  Description of Artificial Sequence: Synthetic oligonucleotide
  Target: SCN9A; (+) strand; PAM type: NRG; PAM sequence: AAG
ttccaacattttcggaggcc

SEQ ID NO: 50910 - DNA, 20 bp, Artificial Sequence
  Description of Artificial Sequence: Synthetic oligonucleotide
  Target: SCN9A; (+) strand; PAM type: NRG; PAM sequence: AGG
tccaacattttcggaggcca

SEQ ID NO: 50911 - DNA, 20 bp, Artificial Sequence
  Description of Artificial Sequence: Synthetic oligonucleotide
  Target: SCN9A; (+) strand; PAM type: NRG; PAM sequence: CGG
aacattttcggaggccaagg

SEQ ID NO: 50912 - DNA, 20 bp, Artificial Sequence
  Description of Artificial Sequence: Synthetic oligonucleotide
  Target: SCN9A; (+) strand; PAM type: NRG; PAM sequence: GGG
acattttcggaggccaaggc

SEQ ID NO: 50913 - DNA, 20 bp, Artificial Sequence
  Description of Artificial Sequence: Synthetic oligonucleotide
  Target: SCN9A; (+) strand; PAM type: NRG; PAM sequence: GAG
ccaaggcgggtgaatcactt

SEQ ID NO: 50914 - DNA, 20 bp, Artificial Sequence
  Description of Artificial Sequence: Synthetic oligonucleotide
  Target: SCN9A; (+) strand; PAM type: NRG; PAM sequence: AGG
caaggcgggtgaatcacttg

SEQ ID NO: 50915 - DNA, 20 bp, Artificial Sequence
  Description of Artificial Sequence: Synthetic oligonucleotide
  Target: SCN9A; (+) strand; PAM type: NRG; PAM sequence: GGG
aaggcgggtgaatcacttga

SEQ ID NO: 50916 - DNA, 20 bp, Artificial Sequence
  Description of Artificial Sequence: Synthetic oligonucleotide
  Target: SCN9A; (+) strand; PAM type: NRG; PAM sequence: CAG
gcgggtgaatcacttgaggg

SEQ ID NO: 50917 - DNA, 20 bp, Artificial Sequence
  Description of Artificial Sequence: Synthetic oligonucleotide
  Target: SCN9A; (+) strand; PAM type: NRG; PAM sequence: AGG
cgggtgaatcacttgagggc

SEQ ID NO: 50918 - DNA, 20 bp, Artificial Sequence
  Description of Artificial Sequence: Synthetic oligonucleotide
  Target: SCN9A; (+) strand; PAM type: NRG; PAM sequence: GAG
ggtgaatcacttgagggcag

SEQ ID NO: 50919 - DNA, 20 bp, Artificial Sequence
  Description of Artificial Sequence: Synthetic oligonucleotide
  Target: SCN9A; (+) strand; PAM type: NRG; PAM sequence: AAG
tcacttgagggcaggagttc

SEQ ID NO: 50920 - DNA, 20 bp, Artificial Sequence
  Description of Artificial Sequence: Synthetic oligonucleotide
  Target: SCN9A; (+) strand; PAM type: NRG; PAM sequence: CAG
tgagggcaggagttcaagaa

SEQ ID NO: 50921 - DNA, 20 bp, Artificial Sequence
  Description of Artificial Sequence: Synthetic oligonucleotide
  Target: SCN9A; (+) strand; PAM type: NRG; PAM sequence: TGG
gcaggagttcaagaacagca

SEQ ID NO: 50922 - DNA, 20 bp, Artificial Sequence
  Description of Artificial Sequence: Synthetic oligonucleotide
  Target: SCN9A; (+) strand; PAM type: NRG; PAM sequence: GGG
caggagttcaagaacagcat

SEQ ID NO: 50923 - DNA, 20 bp, Artificial Sequence
  Description of Artificial Sequence: Synthetic oligonucleotide
  Target: SCN9A; (+) strand; PAM type: NRG; PAM sequence: CAG
caagaacagcatgggcaaca

SEQ ID NO: 50924 - DNA, 20 bp, Artificial Sequence
  Description of Artificial Sequence: Synthetic oligonucleotide
  Target: SCN9A; (+) strand; PAM type: NRG; PAM sequence: TAG
acacagtgacaccctgtctc

SEQ ID NO: 50925 - DNA, 20 bp, Artificial Sequence
  Description of Artificial Sequence: Synthetic oligonucleotide
  Target: SCN9A; (+) strand; PAM type: NRG; PAM sequence: AGG
cacagtgacaccctgtctct

SEQ ID NO: 50926 - DNA, 20 bp, Artificial Sequence
  Description of Artificial Sequence: Synthetic oligonucleotide
  Target: SCN9A; (+) strand; PAM type: NRG; PAM sequence: AAG
tgacaccctgtctctaggaa

SEQ ID NO: 50927 - DNA, 20 bp, Artificial Sequence
  Description of Artificial Sequence: Synthetic oligonucleotide
  Target: SCN9A; (+) strand; PAM type: NRG; PAM sequence: TAG
tctaggaaaagtacaaaaat

SEQ ID NO: 50928 - DNA, 20 bp, Artificial Sequence
  Description of Artificial Sequence: Synthetic oligonucleotide
  Target: SCN9A; (+) strand; PAM type: NRG; PAM sequence: CAG
ggaaaagtacaaaaattagc

SEQ ID NO: 50929 - DNA, 20 bp, Artificial Sequence
  Description of Artificial Sequence: Synthetic oligonucleotide
  Target: SCN9A; (+) strand; PAM type: NRG; PAM sequence: AGG
gaaaagtacaaaaattagcc

SEQ ID NO: 50930 - DNA, 20 bp, Artificial Sequence
  Description of Artificial Sequence: Synthetic oligonucleotide
  Target: SCN9A; (+) strand; PAM type: NRG; PAM sequence: TGG
gtacaaaaattagccaggca

SEQ ID NO: 50931 - DNA, 20 bp, Artificial Sequence
  Description of Artificial Sequence: Synthetic oligonucleotide
  Target: SCN9A; (+) strand; PAM type: NRG; PAM sequence: GAG
acaaaaattagccaggcatg

SEQ ID NO: 50932 - DNA, 20 bp, Artificial Sequence
  Description of Artificial Sequence: Synthetic oligonucleotide
  Target: SCN9A; (+) strand; PAM type: NRG; PAM sequence: TAG
ggcatggagctgtgcacctg

SEQ ID NO: 50933 - DNA, 20 bp, Artificial Sequence
  Description of Artificial Sequence: Synthetic oligonucleotide
  Target: SCN9A; (+) strand; PAM type: NRG; PAM sequence: CAG
gagctgtgcacctgtagtct

SEQ ID NO: 50934 - DNA, 20 bp, Artificial Sequence
  Description of Artificial Sequence: Synthetic oligonucleotide
  Target: SCN9A; (+) strand; PAM type: NRG; PAM sequence: GAG
acctgtagtctcagctgctt

SEQ ID NO: 50935 - DNA, 20 bp, Artificial Sequence
  Description of Artificial Sequence: Synthetic oligonucleotide
  Target: SCN9A; (+) strand; PAM type: NRG; PAM sequence: GAG
ctgtagtctcagctgcttga

SEQ ID NO: 50936 - DNA, 20 bp, Artificial Sequence
  Description of Artificial Sequence: Synthetic oligonucleotide
  Target: SCN9A; (+) strand; PAM type: NRG; PAM sequence: TAG
tagtctcagctgcttgagag

SEQ ID NO: 50937 - DNA, 20 bp, Artificial Sequence
  Description of Artificial Sequence: Synthetic oligonucleotide
  Target: SCN9A; (+) strand; PAM type: NRG; PAM sequence: AAG
tcagctgcttgagagtagct

SEQ ID NO: 50938 - DNA, 20 bp, Artificial Sequence
  Description of Artificial Sequence: Synthetic oligonucleotide
  Target: SCN9A; (+) strand; PAM type: NRG; PAM sequence: AGG
cagctgcttgagagtagcta

SEQ ID NO: 50939 - DNA, 20 bp, Artificial Sequence
  Description of Artificial Sequence: Synthetic oligonucleotide
  Target: SCN9A; (+) strand; PAM type: NRG; PAM sequence: TGG
ctgcttgagagtagctaagg

SEQ ID NO: 50940 - DNA, 20 bp, Artificial Sequence
  Description of Artificial Sequence: Synthetic oligonucleotide
  Target: SCN9A; (+) strand; PAM type: NRG; PAM sequence: GGG
tgcttgagagtagctaaggt

SEQ ID NO: 50941 - DNA, 20 bp, Artificial Sequence
  Description of Artificial Sequence: Synthetic oligonucleotide
  Target: SCN9A; (+) strand; PAM type: NRG; PAM sequence: GAG
cttgagagtagctaaggtgg

SEQ ID NO: 50942 - DNA, 20 bp, Artificial Sequence
  Description of Artificial Sequence: Synthetic oligonucleotide
  Target: SCN9A; (+) strand; PAM type: NRG; PAM sequence: AGG
ttgagagtagctaaggtggg

SEQ ID NO: 50943 - DNA, 20 bp, Artificial Sequence
  Description of Artificial Sequence: Synthetic oligonucleotide
  Target: SCN9A; (+) strand; PAM type: NRG; PAM sequence: GAG
ctaaggtgggaggatcacct

SEQ ID NO: 50944 - DNA, 20 bp, Artificial Sequence
  Description of Artificial Sequence: Synthetic oligonucleotide
  Target: SCN9A; (+) strand; PAM type: NRG; PAM sequence: TGG
gtgggaggatcacctgagcc

SEQ ID NO: 50945 - DNA, 20 bp, Artificial Sequence
  Description of Artificial Sequence: Synthetic oligonucleotide
  Target: SCN9A; (+) strand; PAM type: NRG; PAM sequence: GGG
tgggaggatcacctgagcct

SEQ ID NO: 50946 - DNA, 20 bp, Artificial Sequence
  Description of Artificial Sequence: Synthetic oligonucleotide
  Target: SCN9A; (+) strand; PAM type: NRG; PAM sequence: GGG
gggaggatcacctgagcctg

SEQ ID NO: 50947 - DNA, 20 bp, Artificial Sequence
  Description of Artificial Sequence: Synthetic oligonucleotide
  Target: SCN9A; (+) strand; PAM type: NRG; PAM sequence: GAG
gaggatcacctgagcctggg

SEQ ID NO: 50948 - DNA, 20 bp, Artificial Sequence
  Description of Artificial Sequence: Synthetic oligonucleotide
  Target: SCN9A; (+) strand; PAM type: NRG; PAM sequence: AGG
aggatcacctgagcctgggg

SEQ ID NO: 50949 - DNA, 20 bp, Artificial Sequence
  Description of Artificial Sequence: Synthetic oligonucleotide
  Target: SCN9A; (+) strand; PAM type: NRG; PAM sequence: GAG
cacctgagcctggggaggtt

SEQ ID NO: 50950 - DNA, 20 bp, Artificial Sequence
  Description of Artificial Sequence: Synthetic oligonucleotide
  Target: SCN9A; (+) strand; PAM type: NRG; PAM sequence: CAG
gcctggggaggttgagtctg

SEQ ID NO: 50951 - DNA, 20 bp, Artificial Sequence
  Description of Artificial Sequence: Synthetic oligonucleotide
  Target: SCN9A; (+) strand; PAM type: NRG; PAM sequence: GAG
ggggaggttgagtctgcagt

SEQ ID NO: 50952 - DNA, 20 bp, Artificial Sequence
  Description of Artificial Sequence: Synthetic oligonucleotide
  Target: SCN9A; (+) strand; PAM type: NRG; PAM sequence: CGG
gagccatgatcacaccactg

SEQ ID NO: 50953 - DNA, 20 bp, Artificial Sequence
  Description of Artificial Sequence: Synthetic oligonucleotide
  Target: SCN9A; (+) strand; PAM type: NRG; PAM sequence: CAG
atgatcacaccactgcggtc

SEQ ID NO: 50954 - DNA, 20 bp, Artificial Sequence
  Description of Artificial Sequence: Synthetic oligonucleotide
  Target: SCN9A; (+) strand; PAM type: NRG; PAM sequence: TGG
cacaccactgcggtccagct

SEQ ID NO: 50955 - DNA, 20 bp, Artificial Sequence
  Description of Artificial Sequence: Synthetic oligonucleotide
  Target: SCN9A; (+) strand; PAM type: NRG; PAM sequence: CAG
ctgcggtccagcttggatga

SEQ ID NO: 50956 - DNA, 20 bp, Artificial Sequence
  Description of Artificial Sequence: Synthetic oligonucleotide
  Target: SCN9A; (+) strand; PAM type: NRG; PAM sequence: CAG
ggtccagcttggatgacaga

SEQ ID NO: 50957 - DNA, 20 bp, Artificial Sequence
  Description of Artificial Sequence: Synthetic oligonucleotide
  Target: SCN9A; (+) strand; PAM type: NRG; PAM sequence: GAG
tccagcttggatgacagaca

SEQ ID NO: 50958 - DNA, 20 bp, Artificial Sequence
  Description of Artificial Sequence: Synthetic oligonucleotide
  Target: SCN9A; (+) strand; PAM type: NRG; PAM sequence: TAG
aaaaaaatctatcaattcaa

SEQ ID NO: 50959 - DNA, 20 bp, Artificial Sequence
  Description of Artificial Sequence: Synthetic oligonucleotide
  Target: SCN9A; (+) strand; PAM type: NRG; PAM sequence: GAG
caacacatattttgaactcc

SEQ ID NO: 50960 - DNA, 20 bp, Artificial Sequence
  Description of Artificial Sequence: Synthetic oligonucleotide
  Target: SCN9A; (+) strand; PAM type: NRG; PAM sequence: AAG
gtctctattatgttcaatta

SEQ ID NO: 50961 - DNA, 20 bp, Artificial Sequence
  Description of Artificial Sequence: Synthetic oligonucleotide
  Target: SCN9A; (+) strand; PAM type: NRG; PAM sequence: AAG
ctattatgttcaattaaaga

SEQ ID NO: 50962 - DNA, 20 bp, Artificial Sequence
  Description of Artificial Sequence: Synthetic oligonucleotide
  Target: SCN9A; (+) strand; PAM type: NRG; PAM sequence: AAG
ttatgttcaattaaagaaag

SEQ ID NO: 50963 - DNA, 20 bp, Artificial Sequence
  Description of Artificial Sequence: Synthetic oligonucleotide
  Target: SCN9A; (+) strand; PAM type: NRG; PAM sequence: GAG
atgttcaattaaagaaagaa

SEQ ID NO: 50964 - DNA, 20 bp, Artificial Sequence
  Description of Artificial Sequence: Synthetic oligonucleotide
  Target: SCN9A; (+) strand; PAM type: NRG; PAM sequence: TGG
tcaattaaagaaagaagagt

SEQ ID NO: 50965 - DNA, 20 bp, Artificial Sequence
  Description of Artificial Sequence: Synthetic oligonucleotide
  Target: SCN9A; (+) strand; PAM type: NRG; PAM sequence: GAG
aaagaaagaagagttggaat

SEQ ID NO: 50966 - DNA, 20 bp, Artificial Sequence
  Description of Artificial Sequence: Synthetic oligonucleotide
  Target: SCN9A; (+) strand; PAM type: NRG; PAM sequence: AGG
aagaaagaagagttggaatg

SEQ ID NO: 50967 - DNA, 20 bp, Artificial Sequence
  Description of Artificial Sequence: Synthetic oligonucleotide
  Target: SCN9A; (+) strand; PAM type: NRG; PAM sequence: GGG
agaaagaagagttggaatga

SEQ ID NO: 50968 - DNA, 20 bp, Artificial Sequence
  Description of Artificial Sequence: Synthetic oligonucleotide
  Target: SCN9A; (+) strand; PAM type: NRG; PAM sequence: GGG
gaaagaagagttggaatgag

SEQ ID NO: 50969 - DNA, 20 bp, Artificial Sequence
  Description of Artificial Sequence: Synthetic oligonucleotide
  Target: SCN9A; (+) strand; PAM type: NRG; PAM sequence: TGG
gaaaaactgaatgaaaaaaa

SEQ ID NO: 50970 - DNA, 20 bp, Artificial Sequence
  Description of Artificial Sequence: Synthetic oligonucleotide
  Target: SCN9A; (+) strand; PAM type: NRG; PAM sequence: AAG
aaactgaatgaaaaaaatgg

SEQ ID NO: 50971 - DNA, 20 bp, Artificial Sequence
  Description of Artificial Sequence: Synthetic oligonucleotide
  Target: SCN9A; (+) strand; PAM type: NRG; PAM sequence: AAG
aatgaaaaaaatggaagttg

SEQ ID NO: 50972 - DNA, 20 bp, Artificial Sequence
  Description of Artificial Sequence: Synthetic oligonucleotide
  Target: SCN9A; (+) strand; PAM type: NRG; PAM sequence: AGG
atgaaaaaaatggaagttga

SEQ ID NO: 50973 - DNA, 20 bp, Artificial Sequence
  Description of Artificial Sequence: Synthetic oligonucleotide
  Target: SCN9A; (+) strand; PAM type: NRG; PAM sequence: GAG
gaaaaaaatggaagttgaag

SEQ ID NO: 50974 - DNA, 20 bp, Artificial Sequence
  Description of Artificial Sequence: Synthetic oligonucleotide
  Target: SCN9A; (+) strand; PAM type: NRG; PAM sequence: GAG
aaaaaatggaagttgaagga

SEQ ID NO: 50975 - DNA, 20 bp, Artificial Sequence
  Description of Artificial Sequence: Synthetic oligonucleotide
  Target: SCN9A; (+) strand; PAM type: NRG; PAM sequence: AAG
aaatggaagttgaaggagag

SEQ ID NO: 50976 - DNA, 20 bp, Artificial Sequence
  Description of Artificial Sequence: Synthetic oligonucleotide
  Target: SCN9A; (+) strand; PAM type: NRG; PAM sequence: AGG
aatggaagttgaaggagaga

SEQ ID NO: 50977 - DNA, 20 bp, Artificial Sequence
  Description of Artificial Sequence: Synthetic oligonucleotide
  Target: SCN9A; (+) strand; PAM type: NRG; PAM sequence: AAG
ggaagttgaaggagagaagg

SEQ ID NO: 50978 - DNA, 20 bp, Artificial Sequence
  Description of Artificial Sequence: Synthetic oligonucleotide
  Target: SCN9A; (+) strand; PAM type: NRG; PAM sequence: AAG
aaggaagatgataaaccaaa

SEQ ID NO: 50979 - DNA, 20 bp, Artificial Sequence
  Description of Artificial Sequence: Synthetic oligonucleotide
  Target: SCN9A; (+) strand; PAM type: NRG; PAM sequence: AGG
aggaagatgataaaccaaaa

SEQ ID NO: 50980 - DNA, 20 bp, Artificial Sequence
  Description of Artificial Sequence: Synthetic oligonucleotide
  Target: SCN9A; (+) strand; PAM type: NRG; PAM sequence: GGG
ggaagatgataaaccaaaaa

SEQ ID NO: 50981 - DNA, 20 bp, Artificial Sequence
  Description of Artificial Sequence: Synthetic oligonucleotide
  Target: SCN9A; (+) strand; PAM type: NRG; PAM sequence: AAG
aaaccaaaaagggtaaaaaa

SEQ ID NO: 50982 - DNA, 20 bp, Artificial Sequence
  Description of Artificial Sequence: Synthetic oligonucleotide
  Target: SCN9A; (+) strand; PAM type: NRG; PAM sequence: AAG
tttttaattctcaacatttt

SEQ ID NO: 50983 - DNA, 20 bp, Artificial Sequence
  Description of Artificial Sequence: Synthetic oligonucleotide
  Target: SCN9A; (+) strand; PAM type: NRG; PAM sequence: TAG
atatcacttcattccaatta

SEQ ID NO: 50984 - DNA, 20 bp, Artificial Sequence
  Description of Artificial Sequence: Synthetic oligonucleotide
  Target: SCN9A; (+) strand; PAM type: NRG; PAM sequence: TGG
acttcattccaattatagcc

SEQ ID NO: 50985 - DNA, 20 bp, Artificial Sequence
  Description of Artificial Sequence: Synthetic oligonucleotide
  Target: SCN9A; (+) strand; PAM type: NRG; PAM sequence: TGG
tctttttttttttttttttt

SEQ ID NO: 50986 - DNA, 20 bp, Artificial Sequence
  Description of Artificial Sequence: Synthetic oligonucleotide
  Target: SCN9A; (+) strand; PAM type: NRG; PAM sequence: AAG
tggtaactcttattctctcc

SEQ ID NO: 50987 - DNA, 20 bp, Artificial Sequence
  Description of Artificial Sequence: Synthetic oligonucleotide
  Target: SCN9A; (+) strand; PAM type: NRG; PAM sequence: GAG
tattctctccaagttctttt

SEQ ID NO: 50988 - DNA, 20 bp, Artificial Sequence
  Description of Artificial Sequence: Synthetic oligonucleotide
  Target: SCN9A; (+) strand; PAM type: NRG; PAM sequence: AGG
attctctccaagttcttttg

SEQ ID NO: 50989 - DNA, 20 bp, Artificial Sequence
  Description of Artificial Sequence: Synthetic oligonucleotide
  Target: SCN9A; (+) strand; PAM type: NRG; PAM sequence: CAG
ccaagttcttttgaggcatg

SEQ ID NO: 50990 - DNA, 20 bp, Artificial Sequence
  Description of Artificial Sequence: Synthetic oligonucleotide
  Target: SCN9A; (+) strand; PAM type: NRG; PAM sequence: CAG
aggcatgcagtgctcctcct

SEQ ID NO: 50991 - DNA, 20 bp, Artificial Sequence
  Description of Artificial Sequence: Synthetic oligonucleotide
  Target: SCN9A; (+) strand; PAM type: NRG; PAM sequence: GAG
gcatgcagtgctcctcctca

SEQ ID NO: 50992 - DNA, 20 bp, Artificial Sequence
  Description of Artificial Sequence: Synthetic oligonucleotide
  Target: SCN9A; (+) strand; PAM type: NRG; PAM sequence: CAG
ccctcatcctccaaacctgt

SEQ ID NO: 50993 - DNA, 20 bp, Artificial Sequence
  Description of Artificial Sequence: Synthetic oligonucleotide
  Target: SCN9A; (+) strand; PAM type: NRG; PAM sequence: AAG
ctccaaacctgtcagctcta

SEQ ID NO: 50994 - DNA, 20 bp, Artificial Sequence
  Description of Artificial Sequence: Synthetic oligonucleotide
  Target: SCN9A; (+) strand; PAM type: NRG; PAM sequence: CAG
tgtcagctctaaagcatcct

SEQ ID NO: 50995 - DNA, 20 bp, Artificial Sequence
  Description of Artificial Sequence: Synthetic oligonucleotide
  Target: SCN9A; (+) strand; PAM type: NRG; PAM sequence: AAG
tcctcagtcaatctgttgtc

SEQ ID NO: 50996 - DNA, 20 bp, Artificial Sequence
  Description of Artificial Sequence: Synthetic oligonucleotide
  Target: SCN9A; (+) strand; PAM type: NRG; PAM sequence: AAG
tcaatctgttgtcaagcaat

SEQ ID NO: 50997 - DNA, 20 bp, Artificial Sequence
  Description of Artificial Sequence: Synthetic oligonucleotide
  Target: SCN9A; (+) strand; PAM type: NRG; PAM sequence: AAG
tctgttgtcaagcaataagc

SEQ ID NO: 50998 - DNA, 20 bp, Artificial Sequence
  Description of Artificial Sequence: Synthetic oligonucleotide
  Target: SCN9A; (+) strand; PAM type: NRG; PAM sequence: AAG
gttgtcaagcaataagcaag

SEQ ID NO: 50999 - DNA, 20 bp, Artificial Sequence
  Description of Artificial Sequence: Synthetic oligonucleotide
  Target: SCN9A; (+) strand; PAM type: NRG; PAM sequence: AAG
gtcaagcaataagcaagaag

SEQ ID NO: 51000 - DNA, 20 bp, Artificial Sequence
  Description of Artificial Sequence: Synthetic oligonucleotide
  Target: SCN9A; (+) strand; PAM type: NRG; PAM sequence: AGG
tcaagcaataagcaagaaga

SEQ ID NO: 51001 - DNA, 20 bp, Artificial Sequence
  Description of Artificial Sequence: Synthetic oligonucleotide
  Target: SCN9A; (+) strand; PAM type: NRG; PAM sequence: AAG
agcaataagcaagaagaagg

SEQ ID NO: 51002 - DNA, 20 bp, Artificial Sequence
  Description of Artificial Sequence: Synthetic oligonucleotide
  Target: SCN9A; (+) strand; PAM type: NRG; PAM sequence: AAG
cttgatgctgtaaaataatc

SEQ ID NO: 51003 - DNA, 20 bp, Artificial Sequence
  Description of Artificial Sequence: Synthetic oligonucleotide
  Target: SCN9A; (+) strand; PAM type: NRG; PAM sequence: GAG
tgatgctgtaaaataatcaa

SEQ ID NO: 51004 - DNA, 20 bp, Artificial Sequence
  Description of Artificial Sequence: Synthetic oligonucleotide
  Target: SCN9A; (+) strand; PAM type: NRG; PAM sequence: TAG
aaaataatcaagagttacat

SEQ ID NO: 51005 - DNA, 20 bp, Artificial Sequence
  Description of Artificial Sequence: Synthetic oligonucleotide
  Target: SCN9A; (+) strand; PAM type: NRG; PAM sequence: AGG
aaataatcaagagttacatt

SEQ ID NO: 51006 - DNA, 20 bp, Artificial Sequence
  Description of Artificial Sequence: Synthetic oligonucleotide
  Target: SCN9A; (+) strand; PAM type: NRG; PAM sequence: TAG
gagttacattaggtctttcc

SEQ ID NO: 51007 - DNA, 20 bp, Artificial Sequence
  Description of Artificial Sequence: Synthetic oligonucleotide
  Target: SCN9A; (+) strand; PAM type: NRG; PAM sequence: CAG
aacgctgatcttccaacttt

SEQ ID NO: 51008 - DNA, 20 bp, Artificial Sequence
  Description of Artificial Sequence: Synthetic oligonucleotide
  Target: SCN9A; (+) strand; PAM type: NRG; PAM sequence: AGG
acgctgatcttccaactttc

SEQ ID NO: 51009 - DNA, 20 bp, Artificial Sequence
  Description of Artificial Sequence: Synthetic oligonucleotide
  Target: SCN9A; (+) strand; PAM type: NRG; PAM sequence: AAG
aatgtgtaacaacattcaaa

SEQ ID NO: 51010 - DNA, 20 bp, Artificial Sequence
  Description of Artificial Sequence: Synthetic oligonucleotide
  Target: SCN9A; (+) strand; PAM type: NRG; PAM sequence: AAG
tgtaacaacattcaaaaaga

SEQ ID NO: 51011 - DNA, 20 bp, Artificial Sequence
  Description of Artificial Sequence: Synthetic oligonucleotide
  Target: SCN9A; (+) strand; PAM type: NRG; PAM sequence: AGG
gtaacaacattcaaaaagaa

SEQ ID NO: 51012 - DNA, 20 bp, Artificial Sequence
  Description of Artificial Sequence: Synthetic oligonucleotide
  Target: SCN9A; (+) strand; PAM type: NRG; PAM sequence: AAG
acattcaaaaagaaaggaca

SEQ ID NO: 51013 - DNA, 20 bp, Artificial Sequence
  Description of Artificial Sequence: Synthetic oligonucleotide
  Target: SCN9A; (+) strand; PAM type: NRG; PAM sequence: AAG
agaaaggacaaagatactaa

SEQ ID NO: 51014 - DNA, 20 bp, Artificial Sequence
  Description of Artificial Sequence: Synthetic oligonucleotide
  Target: SCN9A; (+) strand; PAM type: NRG; PAM sequence: TAG
gacaaagatactaaaagaaa

SEQ ID NO: 51015 - DNA, 20 bp, Artificial Sequence
  Description of Artificial Sequence: Synthetic oligonucleotide
  Target: SCN9A; (+) strand; PAM type: NRG; PAM sequence: CAG
aagaaatagatttattttat

SEQ ID NO: 51016 - DNA, 20 bp, Artificial Sequence
  Description of Artificial Sequence: Synthetic oligonucleotide
  Target: SCN9A; (+) strand; PAM type: NRG; PAM sequence: TAG
ttactttatgaaacactact

SEQ ID NO: 51017 - DNA, 20 bp, Artificial Sequence
  Description of Artificial Sequence: Synthetic oligonucleotide
  Target: SCN9A; (+) strand; PAM type: NRG; PAM sequence: GAG
aaaaaaatttcattttattt

SEQ ID NO: 51018 - DNA, 20 bp, Artificial Sequence
  Description of Artificial Sequence: Synthetic oligonucleotide
  Target: SCN9A; (+) strand; PAM type: NRG; PAM sequence: TAG
tcattttatttgagtttcta

SEQ ID NO: 51019 - DNA, 20 bp, Artificial Sequence
  Description of Artificial Sequence: Synthetic oligonucleotide
  Target: SCN9A; (+) strand; PAM type: NRG; PAM sequence: TGG
tctatagtttcttcttaatt

SEQ ID NO: 51020 - DNA, 20 bp, Artificial Sequence
  Description of Artificial Sequence: Synthetic oligonucleotide
  Target: SCN9A; (+) strand; PAM type: NRG; PAM sequence: GAG
tatagtttcttcttaatttg

SEQ ID NO: 51021 - DNA, 20 bp, Artificial Sequence
  Description of Artificial Sequence: Synthetic oligonucleotide
  Target: SCN9A; (+) strand; PAM type: NRG; PAM sequence: CAG
tttgtaaaatctttaatata

SEQ ID NO: 51022 - DNA, 20 bp, Artificial Sequence
  Description of Artificial Sequence: Synthetic oligonucleotide
  Target: SCN9A; (+) strand; PAM type: NRG; PAM sequence: CAG
gtaaaatgaataaaatcctt

SEQ ID NO: 51023 - DNA, 20 bp, Artificial Sequence
  Description of Artificial Sequence: Synthetic oligonucleotide
  Target: SCN9A; (+) strand; PAM type: NRG; PAM sequence: CAG
tgaataaaatccttcagcaa

SEQ ID NO: 51024 - DNA, 20 bp, Artificial Sequence
  Description of Artificial Sequence: Synthetic oligonucleotide
  Target: SCN9A; (+) strand; PAM type: NRG; PAM sequence: AAG
cagttacaatatatatcatg

SEQ ID NO: 51025 - DNA, 20 bp, Artificial Sequence
  Description of Artificial Sequence: Synthetic oligonucleotide
  Target: SCN9A; (+) strand; PAM type: NRG; PAM sequence: CAG
aagtgtacttctattccata

SEQ ID NO: 51026 - DNA, 20 bp, Artificial Sequence
  Description of Artificial Sequence: Synthetic oligonucleotide
  Target: SCN9A; (+) strand; PAM type: NRG; PAM sequence: TGG
ccatacagaacaattcacac

SEQ ID NO: 51027 - DNA, 20 bp, Artificial Sequence
  Description of Artificial Sequence: Synthetic oligonucleotide
  Target: SCN9A; (+) strand; PAM type: NRG; PAM sequence: CAG
agaacaattcacactggttt

SEQ ID NO: 51028 - DNA, 20 bp, Artificial Sequence
  Description of Artificial Sequence: Synthetic oligonucleotide
  Target: SCN9A; (+) strand; PAM type: NRG; PAM sequence: TGG
acaattcacactggtttcag

SEQ ID NO: 51029 - DNA, 20 bp, Artificial Sequence
  Description of Artificial Sequence: Synthetic oligonucleotide
  Target: SCN9A; (+) strand; PAM type: NRG; PAM sequence: CAG
acactggtttcagtggctca

SEQ ID NO: 51030 - DNA, 20 bp, Artificial Sequence
  Description of Artificial Sequence: Synthetic oligonucleotide
  Target: SCN9A; (+) strand; PAM type: NRG; PAM sequence: AGG
cactggtttcagtggctcac

SEQ ID NO: 51031 - DNA, 20 bp, Artificial Sequence
  Description of Artificial Sequence: Synthetic oligonucleotide
  Target: SCN9A; (+) strand; PAM type: NRG; PAM sequence: TGG
tcacaggtcaataatcatct

SEQ ID NO: 51032 - DNA, 20 bp, Artificial Sequence
  Description of Artificial Sequence: Synthetic oligonucleotide
  Target: SCN9A; (+) strand; PAM type: NRG; PAM sequence: TAG
acaatttgtgctccacattt

SEQ ID NO: 51033 - DNA, 20 bp, Artificial Sequence
  Description of Artificial Sequence: Synthetic oligonucleotide
  Target: SCN9A; (+) strand; PAM type: NRG; PAM sequence: GAG
aatttgtgctccacatttta

SEQ ID NO: 51034 - DNA, 20 bp, Artificial Sequence
  Description of Artificial Sequence: Synthetic oligonucleotide
  Target: SCN9A; (+) strand; PAM type: NRG; PAM sequence: TGG
ttttagagctgttgaccctg

SEQ ID NO: 51035 - DNA, 20 bp, Artificial Sequence
  Description of Artificial Sequence: Synthetic oligonucleotide
  Target: SCN9A; (+) strand; PAM type: NRG; PAM sequence: GAG
ttagagctgttgaccctgtg

SEQ ID NO: 51036 - DNA, 20 bp, Artificial Sequence
  Description of Artificial Sequence: Synthetic oligonucleotide
  Target: SCN9A; (+) strand; PAM type: NRG; PAM sequence: GAG
ggagatgacataacctctct

SEQ ID NO: 51037 - DNA, 20 bp, Artificial Sequence
  Description of Artificial Sequence: Synthetic oligonucleotide
  Target: SCN9A; (+) strand; PAM type: NRG; PAM sequence: AAG
gacataacctctctgagcct

SEQ ID NO: 51038 - DNA, 20 bp, Artificial Sequence
  Description of Artificial Sequence: Synthetic oligonucleotide
  Target: SCN9A; (+) strand; PAM type: NRG; PAM sequence: TAG
ctctctgagcctaagattcc

SEQ ID NO: 51039 - DNA, 20 bp, Artificial Sequence
  Description of Artificial Sequence: Synthetic oligonucleotide
  Target: SCN9A; (+) strand; PAM type: NRG; PAM sequence: GAG
gattcctagtttgaaaaatt

SEQ ID NO: 51040 - DNA, 20 bp, Artificial Sequence
  Description of Artificial Sequence: Synthetic oligonucleotide
  Target: SCN9A; (+) strand; PAM type: NRG; PAM sequence: AAG
gagttaataatcatgctccg

SEQ ID NO: 51041 - DNA, 20 bp, Artificial Sequence
  Description of Artificial Sequence: Synthetic oligonucleotide
  Target: SCN9A; (+) strand; PAM type: NRG; PAM sequence: GAG
gttaataatcatgctccgaa

SEQ ID NO: 51042 - DNA, 20 bp, Artificial Sequence
  Description of Artificial Sequence: Synthetic oligonucleotide
  Target: SCN9A; (+) strand; PAM type: NRG; PAM sequence: TGG
aataatcatgctccgaagag

SEQ ID NO: 51043 - DNA, 20 bp, Artificial Sequence
  Description of Artificial Sequence: Synthetic oligonucleotide
  Target: SCN9A; (+) strand; PAM type: NRG; PAM sequence: TAG
tcatgctccgaagagtggtt

SEQ ID NO: 51044 - DNA, 20 bp, Artificial Sequence
  Description of Artificial Sequence: Synthetic oligonucleotide
  Target: SCN9A; (+) strand; PAM type: NRG; PAM sequence: TGG
aagagtggtttagattgtga

SEQ ID NO: 51045 - DNA, 20 bp, Artificial Sequence
  Description of Artificial Sequence: Synthetic oligonucleotide
  Target: SCN9A; (+) strand; PAM type: NRG; PAM sequence: AAG
gtgatggttaactgtatata

SEQ ID NO: 51046 - DNA, 20 bp, Artificial Sequence
  Description of Artificial Sequence: Synthetic oligonucleotide
  Target: SCN9A; (+) strand; PAM type: NRG; PAM sequence: CAG
actgtatataaagtgcttaa

SEQ ID NO: 51047 - DNA, 20 bp, Artificial Sequence
  Description of Artificial Sequence: Synthetic oligonucleotide
  Target: SCN9A; (+) strand; PAM type: NRG; PAM sequence: AGG
ctgtatataaagtgcttaac

SEQ ID NO: 51048 - DNA, 20 bp, Artificial Sequence
  Description of Artificial Sequence: Synthetic oligonucleotide
  Target: SCN9A; (+) strand; PAM type: NRG; PAM sequence: AAG
tatataaagtgcttaacagg

SEQ ID NO: 51049 - DNA, 20 bp, Artificial Sequence
  Description of Artificial Sequence: Synthetic oligonucleotide
  Target: SCN9A; (+) strand; PAM type: NRG; PAM sequence: GAG
tataaagtgcttaacaggaa

SEQ ID NO: 51050 - DNA, 20 bp, Artificial Sequence
  Description of Artificial Sequence: Synthetic oligonucleotide
  Target: SCN9A; (+) strand; PAM type: NRG; PAM sequence: TGG
acataatgaacacgtattca

SEQ ID NO: 51051 - DNA, 20 bp, Artificial Sequence
  Description of Artificial Sequence: Synthetic oligonucleotide
  Target: SCN9A; (+) strand; PAM type: NRG; PAM sequence: GAG
ataatgaacacgtattcatg

SEQ ID NO: 51052 - DNA, 20 bp, Artificial Sequence
  Description of Artificial Sequence: Synthetic oligonucleotide
  Target: SCN9A; (+) strand; PAM type: NRG; PAM sequence: AAG
cacgtattcatggagctcat

SEQ ID NO: 51053 - DNA, 20 bp, Artificial Sequence
  Description of Artificial Sequence: Synthetic oligonucleotide
  Target: SCN9A; (+) strand; PAM type: NRG; PAM sequence: TGG
tctattttaattccttgctt

SEQ ID NO: 51054 - DNA, 20 bp, Artificial Sequence
  Description of Artificial Sequence: Synthetic oligonucleotide
  Target: SCN9A; (+) strand; PAM type: NRG; PAM sequence: GAG
atatattaattatattaaat

SEQ ID NO: 51055 - DNA, 20 bp, Artificial Sequence
  Description of Artificial Sequence: Synthetic oligonucleotide
  Target: SCN9A; (+) strand; PAM type: NRG; PAM sequence: AGG
tatattaattatattaaatg

SEQ ID NO: 51056 - DNA, 20 bp, Artificial Sequence
  Description of Artificial Sequence: Synthetic oligonucleotide
  Target: SCN9A; (+) strand; PAM type: NRG; PAM sequence: TGG
aatgaggatatttccattta

SEQ ID NO: 51057 - DNA, 20 bp, Artificial Sequence
  Description of Artificial Sequence: Synthetic oligonucleotide
  Target: SCN9A; (+) strand; PAM type: NRG; PAM sequence: GGG
atgaggatatttccatttat

SEQ ID NO: 51058 - DNA, 20 bp, Artificial Sequence
  Description of Artificial Sequence: Synthetic oligonucleotide
  Target: SCN9A; (+) strand; PAM type: NRG; PAM sequence: TGG
ttccatttatgggaatgtat

SEQ ID NO: 51059 - DNA, 20 bp, Artificial Sequence
  Description of Artificial Sequence: Synthetic oligonucleotide
  Target: SCN9A; (+) strand; PAM type: NRG; PAM sequence: GAG
aaacatgaaacatttcatat

SEQ ID NO: 51060 - DNA, 20 bp, Artificial Sequence
  Description of Artificial Sequence: Synthetic oligonucleotide
  Target: SCN9A; (+) strand; PAM type: NRG; PAM sequence: CAG
tatgagcatgtaatattaaa

SEQ ID NO: 51061 - DNA, 20 bp, Artificial Sequence
  Description of Artificial Sequence: Synthetic oligonucleotide
  Target: SCN9A; (+) strand; PAM type: NRG; PAM sequence: GAG
tgagcatgtaatattaaaca

SEQ ID NO: 51062 - DNA, 20 bp, Artificial Sequence
  Description of Artificial Sequence: Synthetic oligonucleotide
  Target: SCN9A; (+) strand; PAM type: NRG; PAM sequence: TAG
tgtaatattaaacagagatt

SEQ ID NO: 51063 - DNA, 20 bp, Artificial Sequence
  Description of Artificial Sequence: Synthetic oligonucleotide
  Target: SCN9A; (+) strand; PAM type: NRG; PAM sequence: TAG
tattaaacagagatttagtt

SEQ ID NO: 51064 - DNA, 20 bp, Artificial Sequence
  Description of Artificial Sequence: Synthetic oligonucleotide
  Target: SCN9A; (+) strand; PAM type: NRG; PAM sequence: GAG
ttaaacagagatttagttta

SEQ ID NO: 51065 - DNA, 20 bp, Artificial Sequence
  Description of Artificial Sequence: Synthetic oligonucleotide
  Target: SCN9A; (+) strand; PAM type: NRG; PAM sequence: TAG
aacagagatttagtttagag

SEQ ID NO: 51066 - DNA, 20 bp, Artificial Sequence
  Description of Artificial Sequence: Synthetic oligonucleotide
  Target: SCN9A; (+) strand; PAM type: NRG; PAM sequence: GAG
gagatttagtttagagtagt

SEQ ID NO: 51067 - DNA, 20 bp, Artificial Sequence
  Description of Artificial Sequence: Synthetic oligonucleotide
  Target: SCN9A; (+) strand; PAM type: NRG; PAM sequence: TAG
ttagtttagagtagtgagtc

SEQ ID NO: 51068 - DNA, 20 bp, Artificial Sequence
  Description of Artificial Sequence: Synthetic oligonucleotide
  Target: SCN9A; (+) strand; PAM type: NRG; PAM sequence: AGG
tagtttagagtagtgagtct

SEQ ID NO: 51069 - DNA, 20 bp, Artificial Sequence
  Description of Artificial Sequence: Synthetic oligonucleotide
  Target: SCN9A; (+) strand; PAM type: NRG; PAM sequence: AAG
tagagtagtgagtctaggac

SEQ ID NO: 51070 - DNA, 20 bp, Artificial Sequence
  Description of Artificial Sequence: Synthetic oligonucleotide
  Target: SCN9A; (+) strand; PAM type: NRG; PAM sequence: CAG
tagtgagtctaggacaagtt

SEQ ID NO: 51071 - DNA, 20 bp, Artificial Sequence
  Description of Artificial Sequence: Synthetic oligonucleotide
  Target: SCN9A; (+) strand; PAM type: NRG; PAM sequence: AGG
agtgagtctaggacaagttc

SEQ ID NO: 51072 - DNA, 20 bp, Artificial Sequence
  Description of Artificial Sequence: Synthetic oligonucleotide
  Target: SCN9A; (+) strand; PAM type: NRG; PAM sequence: GAG
tgagtctaggacaagttcag

SEQ ID NO: 51073 - DNA, 20 bp, Artificial Sequence
  Description of Artificial Sequence: Synthetic oligonucleotide
  Target: SCN9A; (+) strand; PAM type: NRG; PAM sequence: TAG
tctaggacaagttcaggagc

SEQ ID NO: 51074 - DNA, 20 bp, Artificial Sequence
  Description of Artificial Sequence: Synthetic oligonucleotide
  Target: SCN9A; (+) strand; PAM type: NRG; PAM sequence: AAG
ggacaagttcaggagctaga

SEQ ID NO: 51075 - DNA, 20 bp, Artificial Sequence
  Description of Artificial Sequence: Synthetic oligonucleotide
  Target: SCN9A; (+) strand; PAM type: NRG; PAM sequence: TGG
agttcaggagctagaaagcc

SEQ ID NO: 51076 - DNA, 20 bp, Artificial Sequence
  Description of Artificial Sequence: Synthetic oligonucleotide
  Target: SCN9A; (+) strand; PAM type: NRG; PAM sequence: GGG
gttcaggagctagaaagcct

SEQ ID NO: 51077 - DNA, 20 bp, Artificial Sequence
  Description of Artificial Sequence: Synthetic oligonucleotide
  Target: SCN9A; (+) strand; PAM type: NRG; PAM sequence: TGG
aaagcctgggttttgaatac

SEQ ID NO: 51078 - DNA, 20 bp, Artificial Sequence
  Description of Artificial Sequence: Synthetic oligonucleotide
  Target: SCN9A; (+) strand; PAM type: NRG; PAM sequence: TAG
atactggattcactacttac

SEQ ID NO: 51079 - DNA, 20 bp, Artificial Sequence
  Description of Artificial Sequence: Synthetic oligonucleotide
  Target: SCN9A; (+) strand; PAM type: NRG; PAM sequence: TGG
acttactagctaaatgatct

SEQ ID NO: 51080 - DNA, 20 bp, Artificial Sequence
  Description of Artificial Sequence: Synthetic oligonucleotide
  Target: SCN9A; (+) strand; PAM type: NRG; PAM sequence: CAG
ctaaatgatcttggacatcc

SEQ ID NO: 51081 - DNA, 20 bp, Artificial Sequence
  Description of Artificial Sequence: Synthetic oligonucleotide
  Target: SCN9A; (+) strand; PAM type: NRG; PAM sequence: AAG
tgatcttggacatcccagtt

SEQ ID NO: 51082 - DNA, 20 bp, Artificial Sequence
  Description of Artificial Sequence: Synthetic oligonucleotide
  Target: SCN9A; (+) strand; PAM type: NRG; PAM sequence: GAG
tttctgattctaaaaatgtt

SEQ ID NO: 51083 - DNA, 20 bp, Artificial Sequence
  Description of Artificial Sequence: Synthetic oligonucleotide
  Target: SCN9A; (+) strand; PAM type: NRG; PAM sequence: AGG
ttctgattctaaaaatgttg

SEQ ID NO: 51084 - DNA, 20 bp, Artificial Sequence
  Description of Artificial Sequence: Synthetic oligonucleotide
  Target: SCN9A; (+) strand; PAM type: NRG; PAM sequence: TAG
tctaaaaatgttgaggcatt

SEQ ID NO: 51085 - DNA, 20 bp, Artificial Sequence
  Description of Artificial Sequence: Synthetic oligonucleotide
  Target: SCN9A; (+) strand; PAM type: NRG; PAM sequence: AGG
ctaaaaatgttgaggcattt

SEQ ID NO: 51086 - DNA, 20 bp, Artificial Sequence
  Description of Artificial Sequence: Synthetic oligonucleotide
  Target: SCN9A; (+) strand; PAM type: NRG; PAM sequence: AAG
aatgtaattttaaacaatac

SEQ ID NO: 51087 - DNA, 20 bp, Artificial Sequence
  Description of Artificial Sequence: Synthetic oligonucleotide
  Target: SCN9A; (+) strand; PAM type: NRG; PAM sequence: GAG
tgtaattttaaacaatacaa

SEQ ID NO: 51088 - DNA, 20 bp, Artificial Sequence
  Description of Artificial Sequence: Synthetic oligonucleotide
  Target: SCN9A; (+) strand; PAM type: NRG; PAM sequence: TAG
aaacaatacaagagtatccc

SEQ ID NO: 51089 - DNA, 20 bp, Artificial Sequence
  Description of Artificial Sequence: Synthetic oligonucleotide
  Target: SCN9A; (+) strand; PAM type: NRG; PAM sequence: AAG
gaatgactgttgattgctca

SEQ ID NO: 51090 - DNA, 20 bp, Artificial Sequence
  Description of Artificial Sequence: Synthetic oligonucleotide
  Target: SCN9A; (+) strand; PAM type: NRG; PAM sequence: AGG
aatgactgttgattgctcaa

SEQ ID NO: 51091 - DNA, 20 bp, Artificial Sequence
  Description of Artificial Sequence: Synthetic oligonucleotide
  Target: SCN9A; (+) strand; PAM type: NRG; PAM sequence: TGG
ctgttgattgctcaaaggat

SEQ ID NO: 51092 - DNA, 20 bp, Artificial Sequence
  Description of Artificial Sequence: Synthetic oligonucleotide
  Target: SCN9A; (+) strand; PAM type: NRG; PAM sequence: GGG
tgttgattgctcaaaggatt

SEQ ID NO: 51093 - DNA, 20 bp, Artificial Sequence
  Description of Artificial Sequence: Synthetic oligonucleotide
  Target: SCN9A; (+) strand; PAM type: NRG; PAM sequence: CAG
ctcaaaggattgggtcactg

SEQ ID NO: 51094 - DNA, 20 bp, Artificial Sequence
  Description of Artificial Sequence: Synthetic oligonucleotide
  Target: SCN9A; (+) strand; PAM type: NRG; PAM sequence: AAG
actgcagaatttcctttctt

SEQ ID NO: 51095 - DNA, 20 bp, Artificial Sequence
  Description of Artificial Sequence: Synthetic oligonucleotide
  Target: SCN9A; (+) strand; PAM type: NRG; PAM sequence: AAG
gttgttttgaactttatatg

SEQ ID NO: 51096 - DNA, 20 bp, Artificial Sequence
  Description of Artificial Sequence: Synthetic oligonucleotide
  Target: SCN9A; (+) strand; PAM type: NRG; PAM sequence: TAG
cttgcaaaatattttttaat

SEQ ID NO: 51097 - DNA, 20 bp, Artificial Sequence
  Description of Artificial Sequence: Synthetic oligonucleotide
  Target: SCN9A; (+) strand; PAM type: NRG; PAM sequence: AAG
aaatattttttaattagaca

SEQ ID NO: 51098 - DNA, 20 bp, Artificial Sequence
  Description of Artificial Sequence: Synthetic oligonucleotide
  Target: SCN9A; (+) strand; PAM type: NRG; PAM sequence: TGG
tttaattagacaaagtcatg

SEQ ID NO: 51099 - DNA, 20 bp, Artificial Sequence
  Description of Artificial Sequence: Synthetic oligonucleotide
  Target: SCN9A; (+) strand; PAM type: NRG; PAM sequence: AAG
tagacaaagtcatgtggctc

SEQ ID NO: 51100 - DNA, 20 bp, Artificial Sequence
  Description of Artificial Sequence: Synthetic oligonucleotide
  Target: SCN9A; (+) strand; PAM type: NRG; PAM sequence: AAG
gtggctcaagaactatcatt

SEQ ID NO: 51101 - DNA, 20 bp, Artificial Sequence
  Description of Artificial Sequence: Synthetic oligonucleotide
  Target: SCN9A; (+) strand; PAM type: NRG; PAM sequence: CAG
attcattgaatattgctgaa

SEQ ID NO: 51102 - DNA, 20 bp, Artificial Sequence
  Description of Artificial Sequence: Synthetic oligonucleotide
  Target: SCN9A; (+) strand; PAM type: NRG; PAM sequence: AGG
ttcattgaatattgctgaac

SEQ ID NO: 51103 - DNA, 20 bp, Artificial Sequence
  Description of Artificial Sequence: Synthetic oligonucleotide
  Target: SCN9A; (+) strand; PAM type: NRG; PAM sequence: GGG
tcattgaatattgctgaaca

SEQ ID NO: 51104 - DNA, 20 bp, Artificial Sequence
  Description of Artificial Sequence: Synthetic oligonucleotide
  Target: SCN9A; (+) strand; PAM type: NRG; PAM sequence: AAG
atattgctgaacagggtcaa

SEQ ID NO: 51105 - DNA, 20 bp, Artificial Sequence
  Description of Artificial Sequence: Synthetic oligonucleotide
  Target: SCN9A; (+) strand; PAM type: NRG; PAM sequence: TGG
agcaaataaattccaacact

SEQ ID NO: 51106 - DNA, 20 bp, Artificial Sequence
  Description of Artificial Sequence: Synthetic oligonucleotide
  Target: SCN9A; (+) strand; PAM type: NRG; PAM sequence: GAG
caacacttggtttatcttct

SEQ ID NO: 51107 - DNA, 20 bp, Artificial Sequence
  Description of Artificial Sequence: Synthetic oligonucleotide
  Target: SCN9A; (+) strand; PAM type: NRG; PAM sequence: CAG
tcattaatgtaatctctgaa

SEQ ID NO: 51108 - DNA, 20 bp, Artificial Sequence
  Description of Artificial Sequence: Synthetic oligonucleotide
  Target: SCN9A; (+) strand; PAM type: NRG; PAM sequence: AAG
gtaatctctgaacagaatac

SEQ ID NO: 51109 - DNA, 20 bp, Artificial Sequence
  Description of Artificial Sequence: Synthetic oligonucleotide
  Target: SCN9A; (+) strand; PAM type: NRG; PAM sequence: AAG
caagaatgatcccttccttc

SEQ ID NO: 51110 - DNA, 20 bp, Artificial Sequence
  Description of Artificial Sequence: Synthetic oligonucleotide
  Target: SCN9A; (+) strand; PAM type: NRG; PAM sequence: AAG
atgatcccttccttcaagca

SEQ ID NO: 51111 - DNA, 20 bp, Artificial Sequence
  Description of Artificial Sequence: Synthetic oligonucleotide
  Target: SCN9A; (+) strand; PAM type: NRG; PAM sequence: CAG
cttcaagcaaagaaatatta

SEQ ID NO: 51112 - DNA, 20 bp, Artificial Sequence
  Description of Artificial Sequence: Synthetic oligonucleotide
  Target: SCN9A; (+) strand; PAM type: NRG; PAM sequence: CAG
aagaaatattacagtctctc

SEQ ID NO: 51113 - DNA, 20 bp, Artificial Sequence
  Description of Artificial Sequence: Synthetic oligonucleotide
  Target: SCN9A; (+) strand; PAM type: NRG; PAM sequence: GAG
gaaatattacagtctctcca

SEQ ID NO: 51114 - DNA, 20 bp, Artificial Sequence
  Description of Artificial Sequence: Synthetic oligonucleotide
  Target: SCN9A; (+) strand; PAM type: NRG; PAM sequence: TAG
ttacagtctctccagagttt

SEQ ID NO: 51115 - DNA, 20 bp, Artificial Sequence
  Description of Artificial Sequence: Synthetic oligonucleotide
  Target: SCN9A; (+) strand; PAM type: NRG; PAM sequence: GAG
acagtctctccagagtttta

SEQ ID NO: 51116 - DNA, 20 bp, Artificial Sequence
  Description of Artificial Sequence: Synthetic oligonucleotide
  Target: SCN9A; (+) strand; PAM type: NRG; PAM sequence: TGG
ttttagagactctgtgtgcc

SEQ ID NO: 51117 - DNA, 20 bp, Artificial Sequence
  Description of Artificial Sequence: Synthetic oligonucleotide
  Target: SCN9A; (+) strand; PAM type: NRG; PAM sequence: TGG
gagactctgtgtgcctggta

SEQ ID NO: 51118 - DNA, 20 bp, Artificial Sequence
  Description of Artificial Sequence: Synthetic oligonucleotide
  Target: SCN9A; (+) strand; PAM type: NRG; PAM sequence: TGG
atggctctgaacatactatt

SEQ ID NO: 51119 - DNA, 20 bp, Artificial Sequence
  Description of Artificial Sequence: Synthetic oligonucleotide
  Target: SCN9A; (+) strand; PAM type: NRG; PAM sequence: CGG
tgaacatactatttggaaaa

SEQ ID NO: 51120 - DNA, 20 bp, Artificial Sequence
  Description of Artificial Sequence: Synthetic oligonucleotide
  Target: SCN9A; (+) strand; PAM type: NRG; PAM sequence: AAG
tttggaaaacggtattcttg

SEQ ID NO: 51121 - DNA, 20 bp, Artificial Sequence
  Description of Artificial Sequence: Synthetic oligonucleotide
  Target: SCN9A; (+) strand; PAM type: NRG; PAM sequence: TGG
gtattcttgaagtcaaatat

SEQ ID NO: 51122 - DNA, 20 bp, Artificial Sequence
  Description of Artificial Sequence: Synthetic oligonucleotide
  Target: SCN9A; (+) strand; PAM type: NRG; PAM sequence: AAG
ttcttgaagtcaaatattgg

SEQ ID NO: 51123 - DNA, 20 bp, Artificial Sequence
  Description of Artificial Sequence: Synthetic oligonucleotide
  Target: SCN9A; (+) strand; PAM type: NRG; PAM sequence: CAG
ttgaagtcaaatattggaag

SEQ ID NO: 51124 - DNA, 20 bp, Artificial Sequence
  Description of Artificial Sequence: Synthetic oligonucleotide
  Target: SCN9A; (+) strand; PAM type: NRG; PAM sequence: CAG
caaatattggaagcagacat

SEQ ID NO: 51125 - DNA, 20 bp, Artificial Sequence
  Description of Artificial Sequence: Synthetic oligonucleotide
  Target: SCN9A; (+) strand; PAM type: NRG; PAM sequence: AGG
aaatattggaagcagacatc

SEQ ID NO: 51126 - DNA, 20 bp, Artificial Sequence
  Description of Artificial Sequence: Synthetic oligonucleotide
  Target: SCN9A; (+) strand; PAM type: NRG; PAM sequence: TGG
cagacatcaggaaaattatt

SEQ ID NO: 51127 - DNA, 20 bp, Artificial Sequence
  Description of Artificial Sequence: Synthetic oligonucleotide
  Target: SCN9A; (+) strand; PAM type: NRG; PAM sequence: GGG
agacatcaggaaaattattt

SEQ ID NO: 51128 - DNA, 20 bp, Artificial Sequence
  Description of Artificial Sequence: Synthetic oligonucleotide
  Target: SCN9A; (+) strand; PAM type: NRG; PAM sequence: GGG
gacatcaggaaaattatttg

SEQ ID NO: 51129 - DNA, 20 bp, Artificial Sequence
  Description of Artificial Sequence: Synthetic oligonucleotide
  Target: SCN9A; (+) strand; PAM type: NRG; PAM sequence: GGG
acatcaggaaaattatttgg

SEQ ID NO: 51130 - DNA, 20 bp, Artificial Sequence
  Description of Artificial Sequence: Synthetic oligonucleotide
  Target: SCN9A; (+) strand; PAM type: NRG; PAM sequence: AAG
ggggacttcctttcatcccc

SEQ ID NO: 51131 - DNA, 20 bp, Artificial Sequence
  Description of Artificial Sequence: Synthetic oligonucleotide
  Target: SCN9A; (+) strand; PAM type: NRG; PAM sequence: AGG
gggacttcctttcatcccca

SEQ ID NO: 51132 - DNA, 20 bp, Artificial Sequence
  Description of Artificial Sequence: Synthetic oligonucleotide
  Target: SCN9A; (+) strand; PAM type: NRG; PAM sequence: TAG
tactatgaaaacccttcaca

SEQ ID NO: 51133 - DNA, 20 bp, Artificial Sequence
  Description of Artificial Sequence: Synthetic oligonucleotide
  Target: SCN9A; (+) strand; PAM type: NRG; PAM sequence: AGG
actatgaaaacccttcacat

SEQ ID NO: 51134 - DNA, 20 bp, Artificial Sequence
  Description of Artificial Sequence: Synthetic oligonucleotide
  Target: SCN9A; (+) strand; PAM type: NRG; PAM sequence: GGG
ctatgaaaacccttcacata

SEQ ID NO: 51135 - DNA, 20 bp, Artificial Sequence
  Description of Artificial Sequence: Synthetic oligonucleotide
  Target: SCN9A; (+) strand; PAM type: NRG; PAM sequence: TAG
cttcacatagggaaaatcta

SEQ ID NO: 51136 - DNA, 20 bp, Artificial Sequence
  Description of Artificial Sequence: Synthetic oligonucleotide
  Target: SCN9A; (+) strand; PAM type: NRG; PAM sequence: AGG
ttcacatagggaaaatctat

SEQ ID NO: 51137 - DNA, 20 bp, Artificial Sequence
  Description of Artificial Sequence: Synthetic oligonucleotide
  Target: SCN9A; (+) strand; PAM type: NRG; PAM sequence: GAG
atagggaaaatctataggat

SEQ ID NO: 51138 - DNA, 20 bp, Artificial Sequence
  Description of Artificial Sequence: Synthetic oligonucleotide
  Target: SCN9A; (+) strand; PAM type: NRG; PAM sequence: AGG
tagggaaaatctataggatg

SEQ ID NO: 51139 - DNA, 20 bp, Artificial Sequence
  Description of Artificial Sequence: Synthetic oligonucleotide
  Target: SCN9A; (+) strand; PAM type: NRG; PAM sequence: TGG
ggaaaatctataggatgagg

SEQ ID NO: 51140 - DNA, 20 bp, Artificial Sequence
  Description of Artificial Sequence: Synthetic oligonucleotide
  Target: SCN9A; (+) strand; PAM type: NRG; PAM sequence: GGG
gaaaatctataggatgaggt

SEQ ID NO: 51141 - DNA, 20 bp, Artificial Sequence
  Description of Artificial Sequence: Synthetic oligonucleotide
  Target: SCN9A; (+) strand; PAM type: NRG; PAM sequence: AAG
aatctataggatgaggtggg

SEQ ID NO: 51142 - DNA, 20 bp, Artificial Sequence
  Description of Artificial Sequence: Synthetic oligonucleotide
  Target: SCN9A; (+) strand; PAM type: NRG; PAM sequence: TGG
ctataggatgaggtgggaag

SEQ ID NO: 51143 - DNA, 20 bp, Artificial Sequence
  Description of Artificial Sequence: Synthetic oligonucleotide
  Target: SCN9A; (+) strand; PAM type: NRG; PAM sequence: GGG
tataggatgaggtgggaagt

SEQ ID NO: 51144 - DNA, 20 bp, Artificial Sequence
  Description of Artificial Sequence: Synthetic oligonucleotide
  Target: SCN9A; (+) strand; PAM type: NRG; PAM sequence: AAG
ggtgggaagtgggtttccct

SEQ ID NO: 51145 - DNA, 20 bp, Artificial Sequence
  Description of Artificial Sequence: Synthetic oligonucleotide
  Target: SCN9A; (+) strand; PAM type: NRG; PAM sequence: CAG
tgggtttccctaagtgttca

SEQ ID NO: 51146 - DNA, 20 bp, Artificial Sequence
  Description of Artificial Sequence: Synthetic oligonucleotide
  Target: SCN9A; (+) strand; PAM type: NRG; PAM sequence: AAG
aatcctctaaaaaatcactg

SEQ ID NO: 51147 - DNA, 20 bp, Artificial Sequence
  Description of Artificial Sequence: Synthetic oligonucleotide
  Target: SCN9A; (+) strand; PAM type: NRG; PAM sequence: AAG
aatttttacctaataactaa

SEQ ID NO: 51148 - DNA, 20 bp, Artificial Sequence
  Description of Artificial Sequence: Synthetic oligonucleotide
  Target: SCN9A; (+) strand; PAM type: NRG; PAM sequence: AGG
atttttacctaataactaaa

SEQ ID NO: 51149 - DNA, 20 bp, Artificial Sequence
  Description of Artificial Sequence: Synthetic oligonucleotide
  Target: SCN9A; (+) strand; PAM type: NRG; PAM sequence: GAG
taactaaaaggaaaaaatgt

SEQ ID NO: 51150 - DNA, 20 bp, Artificial Sequence
  Description of Artificial Sequence: Synthetic oligonucleotide
  Target: SCN9A; (+) strand; PAM type: NRG; PAM sequence: TAG
gtgagttgtgcccattatat

SEQ ID NO: 51151 - DNA, 20 bp, Artificial Sequence
  Description of Artificial Sequence: Synthetic oligonucleotide
  Target: SCN9A; (+) strand; PAM type: NRG; PAM sequence: TGG
ttgtgcccattatattagac

SEQ ID NO: 51152 - DNA, 20 bp, Artificial Sequence
  Description of Artificial Sequence: Synthetic oligonucleotide
  Target: SCN9A; (+) strand; PAM type: NRG; PAM sequence: AAG
cccattatattagactggaa

SEQ ID NO: 51153 - DNA, 20 bp, Artificial Sequence
  Description of Artificial Sequence: Synthetic oligonucleotide
  Target: SCN9A; (+) strand; PAM type: NRG; PAM sequence: AGG
ccattatattagactggaaa

SEQ ID NO: 51154 - DNA, 20 bp, Artificial Sequence
  Description of Artificial Sequence: Synthetic oligonucleotide
  Target: SCN9A; (+) strand; PAM type: NRG; PAM sequence: CAG
tattagactggaaaaggtct

SEQ ID NO: 51155 - DNA, 20 bp, Artificial Sequence
  Description of Artificial Sequence: Synthetic oligonucleotide
  Target: SCN9A; (+) strand; PAM type: NRG; PAM sequence: TGG
tagactggaaaaggtctcag

SEQ ID NO: 51156 - DNA, 20 bp, Artificial Sequence
  Description of Artificial Sequence: Synthetic oligonucleotide
  Target: SCN9A; (+) strand; PAM type: NRG; PAM sequence: TGG
agtggcctctattaccttct

SEQ ID NO: 51157 - DNA, 20 bp, Artificial Sequence
  Description of Artificial Sequence: Synthetic oligonucleotide
  Target: SCN9A; (+) strand; PAM type: NRG; PAM sequence: CAG
ttaccttcttggccacataa

SEQ ID NO: 51158 - DNA, 20 bp, Artificial Sequence
  Description of Artificial Sequence: Synthetic oligonucleotide
  Target: SCN9A; (+) strand; PAM type: NRG; PAM sequence: AGG
taccttcttggccacataac

SEQ ID NO: 51159 - DNA, 20 bp, Artificial Sequence
  Description of Artificial Sequence: Synthetic oligonucleotide
  Target: SCN9A; (+) strand; PAM type: NRG; PAM sequence: CAG
gtactaaatactccaaactg

SEQ ID NO: 51160 - DNA, 20 bp, Artificial Sequence
  Description of Artificial Sequence: Synthetic oligonucleotide
  Target: SCN9A; (+) strand; PAM type: NRG; PAM sequence: TAG
gcagttcccaaatgatttat

SEQ ID NO: 51161 - DNA, 20 bp, Artificial Sequence
  Description of Artificial Sequence: Synthetic oligonucleotide
  Target: SCN9A; (+) strand; PAM type: NRG; PAM sequence: CAG
cccaaatgatttattagtgt

SEQ ID NO: 51162 - DNA, 20 bp, Artificial Sequence
  Description of Artificial Sequence: Synthetic oligonucleotide
  Target: SCN9A; (+) strand; PAM type: NRG; PAM sequence: AGG
ccaaatgatttattagtgtc

SEQ ID NO: 51163 - DNA, 20 bp, Artificial Sequence
  Description of Artificial Sequence: Synthetic oligonucleotide
  Target: SCN9A; (+) strand; PAM type: NRG; PAM sequence: GGG
caaatgatttattagtgtca

SEQ ID NO: 51164 - DNA, 20 bp, Artificial Sequence
  Description of Artificial Sequence: Synthetic oligonucleotide
  Target: SCN9A; (+) strand; PAM type: NRG; PAM sequence: TGG
tcagggcaccaattctattg

SEQ ID NO: 51165 - DNA, 20 bp, Artificial Sequence
  Description of Artificial Sequence: Synthetic oligonucleotide
  Target: SCN9A; (+) strand; PAM type: NRG; PAM sequence: CAG
gcaccaattctattgtggct

SEQ ID NO: 51166 - DNA, 20 bp, Artificial Sequence
  Description of Artificial Sequence: Synthetic oligonucleotide
  Target: SCN9A; (+) strand; PAM type: NRG; PAM sequence: TAG
caattctattgtggctcagt

SEQ ID NO: 51167 - DNA, 20 bp, Artificial Sequence
  Description of Artificial Sequence: Synthetic oligonucleotide
  Target: SCN9A; (+) strand; PAM type: NRG; PAM sequence: GAG
attctattgtggctcagtta

SEQ ID NO: 51168 - DNA, 20 bp, Artificial Sequence
  Description of Artificial Sequence: Synthetic oligonucleotide
  Target: SCN9A; (+) strand; PAM type: NRG; PAM sequence: AAG
aatgtttatcttatatatga

SEQ ID NO: 51169 - DNA, 20 bp, Artificial Sequence
  Description of Artificial Sequence: Synthetic oligonucleotide
  Target: SCN9A; (+) strand; PAM type: NRG; PAM sequence: AAG
tatgaaagctatatttattt

SEQ ID NO: 51170 - DNA, 20 bp, Artificial Sequence
  Description of Artificial Sequence: Synthetic oligonucleotide
  Target: SCN9A; (+) strand; PAM type: NRG; PAM sequence: GAG
tgaaagctatatttatttaa

SEQ ID NO: 51171 - DNA, 20 bp, Artificial Sequence
  Description of Artificial Sequence: Synthetic oligonucleotide
  Target: SCN9A; (+) strand; PAM type: NRG; PAM sequence: AAG
ctatatttatttaagagaat

SEQ ID NO: 51172 - DNA, 20 bp, Artificial Sequence
  Description of Artificial Sequence: Synthetic oligonucleotide
  Target: SCN9A; (+) strand; PAM type: NRG; PAM sequence: CAG
attctcttaaaaatatctcc

SEQ ID NO: 51173 - DNA, 20 bp, Artificial Sequence
  Description of Artificial Sequence: Synthetic oligonucleotide
  Target: SCN9A; (+) strand; PAM type: NRG; PAM sequence: CAG
tcccagataattcctttaaa

SEQ ID NO: 51174 - DNA, 20 bp, Artificial Sequence
  Description of Artificial Sequence: Synthetic oligonucleotide
  Target: SCN9A; (+) strand; PAM type: NRG; PAM sequence: TAG
ataacttttgacatctcttg

SEQ ID NO: 51175 - DNA, 20 bp, Artificial Sequence
  Description of Artificial Sequence: Synthetic oligonucleotide
  Target: SCN9A; (+) strand; PAM type: NRG; PAM sequence: AAG
cttttgacatctcttgtaga

SEQ ID NO: 51176 - DNA, 20 bp, Artificial Sequence
  Description of Artificial Sequence: Synthetic oligonucleotide
  Target: SCN9A; (+) strand; PAM type: NRG; PAM sequence: AAG
tgacatctcttgtagaaagc

SEQ ID NO: 51177 - DNA, 20 bp, Artificial Sequence
  Description of Artificial Sequence: Synthetic oligonucleotide
  Target: SCN9A; (+) strand; PAM type: NRG; PAM sequence: TAG
catctcttgtagaaagcaag

SEQ ID NO: 51178 - DNA, 20 bp, Artificial Sequence
  Description of Artificial Sequence: Synthetic oligonucleotide
  Target: SCN9A; (+) strand; PAM type: NRG; PAM sequence: TAG
tttgtttctttaatcttgat

SEQ ID NO: 51179 - DNA, 20 bp, Artificial Sequence
  Description of Artificial Sequence: Synthetic oligonucleotide
  Target: SCN9A; (+) strand; PAM type: NRG; PAM sequence: GAG
tgtttctttaatcttgatta

SEQ ID NO: 51180 - DNA, 20 bp, Artificial Sequence
  Description of Artificial Sequence: Synthetic oligonucleotide
  Target: SCN9A; (+) strand; PAM type: NRG; PAM sequence: AGG
gtttctttaatcttgattag

SEQ ID NO: 51181 - DNA, 20 bp, Artificial Sequence
  Description of Artificial Sequence: Synthetic oligonucleotide
  Target: SCN9A; (+) strand; PAM type: NRG; PAM sequence: GGG
tttctttaatcttgattaga

SEQ ID NO: 51182 - DNA, 20 bp, Artificial Sequence
  Description of Artificial Sequence: Synthetic oligonucleotide
  Target: SCN9A; (+) strand; PAM type: NRG; PAM sequence: AAG
atatgacattttcttatttc

SEQ ID NO: 51183 - DNA, 20 bp, Artificial Sequence
  Description of Artificial Sequence: Synthetic oligonucleotide
  Target: SCN9A; (+) strand; PAM type: NRG; PAM sequence: AGG
tatgacattttcttatttca

SEQ ID NO: 51184 - DNA, 20 bp, Artificial Sequence
  Description of Artificial Sequence: Synthetic oligonucleotide
  Target: SCN9A; (+) strand; PAM type: NRG; PAM sequence: GAG
tgacattttcttatttcaag

SEQ ID NO: 51185 - DNA, 20 bp, Artificial Sequence
  Description of Artificial Sequence: Synthetic oligonucleotide
  Target: SCN9A; (+) strand; PAM type: NRG; PAM sequence: CAG
cattttcttatttcaaggag

SEQ ID NO: 51186 - DNA, 20 bp, Artificial Sequence
  Description of Artificial Sequence: Synthetic oligonucleotide
  Target: SCN9A; (+) strand; PAM type: NRG; PAM sequence: AGG
attttcttatttcaaggagc

SEQ ID NO: 51187 - DNA, 20 bp, Artificial Sequence
  Description of Artificial Sequence: Synthetic oligonucleotide
  Target: SCN9A; (+) strand; PAM type: NRG; PAM sequence: TAG
tatttcaaggagcaggaaaa

SEQ ID NO: 51188 - DNA, 20 bp, Artificial Sequence
  Description of Artificial Sequence: Synthetic oligonucleotide
  Target: SCN9A; (+) strand; PAM type: NRG; PAM sequence: AAG
actctatattttcttatttc

SEQ ID NO: 51189 - DNA, 20 bp, Artificial Sequence
  Description of Artificial Sequence: Synthetic oligonucleotide
  Target: SCN9A; (+) strand; PAM type: NRG; PAM sequence: AGG
ctctatattttcttatttca

SEQ ID NO: 51190 - DNA, 20 bp, Artificial Sequence
  Description of Artificial Sequence: Synthetic oligonucleotide
  Target: SCN9A; (+) strand; PAM type: NRG; PAM sequence: GAG
ctatattttcttatttcaag

SEQ ID NO: 51191 - DNA, 20 bp, Artificial Sequence
  Description of Artificial Sequence: Synthetic oligonucleotide
  Target: SCN9A; (+) strand; PAM type: NRG; PAM sequence: CAG
tattttcttatttcaaggag

SEQ ID NO: 51192 - DNA, 20 bp, Artificial Sequence
  Description of Artificial Sequence: Synthetic oligonucleotide
  Target: SCN9A; (+) strand; PAM type: NRG; PAM sequence: AGG
attttcttatttcaaggagc

SEQ ID NO: 51193 - DNA, 20 bp, Artificial Sequence
  Description of Artificial Sequence: Synthetic oligonucleotide
  Target: SCN9A; (+) strand; PAM type: NRG; PAM sequence: TAG
tatttcaaggagcaggaaaa

SEQ ID NO: 51194 - DNA, 20 bp, Artificial Sequence
  Description of Artificial Sequence: Synthetic oligonucleotide
  Target: SCN9A; (+) strand; PAM type: NRG; PAM sequence: CAG
tcacaactctataataattt

SEQ ID NO: 51195 - DNA, 20 bp, Artificial Sequence
  Description of Artificial Sequence: Synthetic oligonucleotide
  Target: SCN9A; (+) strand; PAM type: NRG; PAM sequence: AGG
cacaactctataataatttc

SEQ ID NO: 51196 - DNA, 20 bp, Artificial Sequence
  Description of Artificial Sequence: Synthetic oligonucleotide
  Target: SCN9A; (+) strand; PAM type: NRG; PAM sequence: GAG
ctgttttgcattccatcact

SEQ ID NO: 51197 - DNA, 20 bp, Artificial Sequence
  Description of Artificial Sequence: Synthetic oligonucleotide
  Target: SCN9A; (+) strand; PAM type: NRG; PAM sequence: TAG
ttcgataaaattacaacaat

SEQ ID NO: 51198 - DNA, 20 bp, Artificial Sequence
  Description of Artificial Sequence: Synthetic oligonucleotide
  Target: SCN9A; (+) strand; PAM type: NRG; PAM sequence: CAG
ataaaattacaacaattagc

SEQ ID NO: 51199 - DNA, 20 bp, Artificial Sequence
  Description of Artificial Sequence: Synthetic oligonucleotide
  Target: SCN9A; (+) strand; PAM type: NRG; PAM sequence: AGG
taaaattacaacaattagcc

SEQ ID NO: 51200 - DNA, 20 bp, Artificial Sequence
  Description of Artificial Sequence: Synthetic oligonucleotide
  Target: SCN9A; (+) strand; PAM type: NRG; PAM sequence: TGG
ttacaacaattagccaggtg

SEQ ID NO: 51201 - DNA, 20 bp, Artificial Sequence
  Description of Artificial Sequence: Synthetic oligonucleotide
  Target: SCN9A; (+) strand; PAM type: NRG; PAM sequence: TGG
acaattagccaggtgtggtg

SEQ ID NO: 51202 - DNA, 20 bp, Artificial Sequence
  Description of Artificial Sequence: Synthetic oligonucleotide
  Target: SCN9A; (+) strand; PAM type: NRG; PAM sequence: GGG
caattagccaggtgtggtgt

SEQ ID NO: 51203 - DNA, 20 bp, Artificial Sequence
  Description of Artificial Sequence: Synthetic oligonucleotide
  Target: SCN9A; (+) strand; PAM type: NRG; PAM sequence: CAG
ggtgtgggcgcctgcaatct

SEQ ID NO: 51204 - DNA, 20 bp, Artificial Sequence
  Description of Artificial Sequence: Synthetic oligonucleotide
  Target: SCN9A; (+) strand; PAM type: NRG; PAM sequence: CAG
cgcctgcaatctcagctact

SEQ ID NO: 51205 - DNA, 20 bp, Artificial Sequence
  Description of Artificial Sequence: Synthetic oligonucleotide
  Target: SCN9A; (+) strand; PAM type: NRG; PAM sequence: AGG
gcctgcaatctcagctactc

SEQ ID NO: 51206 - DNA, 20 bp, Artificial Sequence
  Description of Artificial Sequence: Synthetic oligonucleotide
  Target: SCN9A; (+) strand; PAM type: NRG; PAM sequence: GAG
ctgcaatctcagctactcag

SEQ ID NO: 51207 - DNA, 20 bp, Artificial Sequence
  Description of Artificial Sequence: Synthetic oligonucleotide
  Target: SCN9A; (+) strand; PAM type: NRG; PAM sequence: AGG
tgcaatctcagctactcagg

SEQ ID NO: 51208 - DNA, 20 bp, Artificial Sequence
  Description of Artificial Sequence: Synthetic oligonucleotide
  Target: SCN9A; (+) strand; PAM type: NRG; PAM sequence: GAG
tctcagctactcaggaggct

SEQ ID NO: 51209 - DNA, 20 bp, Artificial Sequence
  Description of Artificial Sequence: Synthetic oligonucleotide
  Target: SCN9A; (+) strand; PAM type: NRG; PAM sequence: AGG
ctcagctactcaggaggctg

SEQ ID NO: 51210 - DNA, 20 bp, Artificial Sequence
  Description of Artificial Sequence: Synthetic oligonucleotide
  Target: SCN9A; (+) strand; PAM type: NRG; PAM sequence: CAG
agctactcaggaggctgagg

SEQ ID NO: 51211 - DNA, 20 bp, Artificial Sequence
  Description of Artificial Sequence: Synthetic oligonucleotide
  Target: SCN9A; (+) strand; PAM type: NRG; PAM sequence: AGG
gctactcaggaggctgaggc

SEQ ID NO: 51212 - DNA, 20 bp, Artificial Sequence
  Description of Artificial Sequence: Synthetic oligonucleotide
  Target: SCN9A; (+) strand; PAM type: NRG; PAM sequence: GAG
tactcaggaggctgaggcag

SEQ ID NO: 51213 - DNA, 20 bp, Artificial Sequence
  Description of Artificial Sequence: Synthetic oligonucleotide
  Target: SCN9A; (+) strand; PAM type: NRG; PAM sequence: CAG
gcaggagaattacttgaacc

SEQ ID NO: 51214 - DNA, 20 bp, Artificial Sequence
  Description of Artificial Sequence: Synthetic oligonucleotide
  Target: SCN9A; (+) strand; PAM type: NRG; PAM sequence: CAG
ggagaattacttgaacccag

SEQ ID NO: 51215 - DNA, 20 bp, Artificial Sequence
  Description of Artificial Sequence: Synthetic oligonucleotide
  Target: SCN9A; (+) strand; PAM type: NRG; PAM sequence: AGG
gagaattacttgaacccagc

SEQ ID NO: 51216 - DNA, 20 bp, Artificial Sequence
  Description of Artificial Sequence: Synthetic oligonucleotide
  Target: SCN9A; (+) strand; PAM type: NRG; PAM sequence: CAG
aattacttgaacccagcagg

SEQ ID NO: 51217 - DNA, 20 bp, Artificial Sequence
  Description of Artificial Sequence: Synthetic oligonucleotide
  Target: SCN9A; (+) strand; PAM type: NRG; PAM sequence: GAG
ttacttgaacccagcaggca

SEQ ID NO: 51218 - DNA, 20 bp, Artificial Sequence
  Description of Artificial Sequence: Synthetic oligonucleotide
  Target: SCN9A; (+) strand; PAM type: NRG; PAM sequence: AGG
tacttgaacccagcaggcag

SEQ ID NO: 51219 - DNA, 20 bp, Artificial Sequence
  Description of Artificial Sequence: Synthetic oligonucleotide
  Target: SCN9A; (+) strand; PAM type: NRG; PAM sequence: CAG
aacccagcaggcagaggttg

SEQ ID NO: 51220 - DNA, 20 bp, Artificial Sequence
  Description of Artificial Sequence: Synthetic oligonucleotide
  Target: SCN9A; (+) strand; PAM type: NRG; PAM sequence: GAG
cagcaggcagaggttgcagt

SEQ ID NO: 51221 - DNA, 20 bp, Artificial Sequence
  Description of Artificial Sequence: Synthetic oligonucleotide
  Target: SCN9A; (+) strand; PAM type: NRG; PAM sequence: GAG
ggcagaggttgcagtgagcc

SEQ ID NO: 51222 - DNA, 20 bp, Artificial Sequence
  Description of Artificial Sequence: Synthetic oligonucleotide
  Target: SCN9A; (+) strand; PAM type: NRG; PAM sequence: CAG
gagatcgcgccactgcactc

SEQ ID NO: 51223 - DNA, 20 bp, Artificial Sequence
  Description of Artificial Sequence: Synthetic oligonucleotide
  Target: SCN9A; (+) strand; PAM type: NRG; PAM sequence: CAG
cactgcactccagcctgaac

SEQ ID NO: 51224 - DNA, 20 bp, Artificial Sequence
  Description of Artificial Sequence: Synthetic oligonucleotide
  Target: SCN9A; (+) strand; PAM type: NRG; PAM sequence: GAG
ctgcactccagcctgaacca

SEQ ID NO: 51225 - DNA, 20 bp, Artificial Sequence
  Description of Artificial Sequence: Synthetic oligonucleotide
  Target: SCN9A; (+) strand; PAM type: NRG; PAM sequence: GAG
gcactccagcctgaaccaga

SEQ ID NO: 51226 - DNA, 20 bp, Artificial Sequence
  Description of Artificial Sequence: Synthetic oligonucleotide
  Target: SCN9A; (+) strand; PAM type: NRG; PAM sequence: CGG
ctccagcctgaaccagagag

SEQ ID NO: 51227 - DNA, 20 bp, Artificial Sequence
  Description of Artificial Sequence: Synthetic oligonucleotide
  Target: SCN9A; (+) strand; PAM type: NRG; PAM sequence: GGG
tccagcctgaaccagagagc

SEQ ID NO: 51228 - DNA, 20 bp, Artificial Sequence
  Description of Artificial Sequence: Synthetic oligonucleotide
  Target: SCN9A; (+) strand; PAM type: NRG; PAM sequence: TGG
taaatttatttatttaaaat

SEQ ID NO: 51229 - DNA, 20 bp, Artificial Sequence
  Description of Artificial Sequence: Synthetic oligonucleotide
  Target: SCN9A; (+) strand; PAM type: NRG; PAM sequence: TGG
aattggtccaattaatcatt

SEQ ID NO: 51230 - DNA, 20 bp, Artificial Sequence
  Description of Artificial Sequence: Synthetic oligonucleotide
  Target: SCN9A; (+) strand; PAM type: NRG; PAM sequence: AAG
tggtccaattaatcatttgg

SEQ ID NO: 51231 - DNA, 20 bp, Artificial Sequence
  Description of Artificial Sequence: Synthetic oligonucleotide
  Target: SCN9A; (+) strand; PAM type: NRG; PAM sequence: GAG
agatctgccaaaatctgaat

SEQ ID NO: 51232 - DNA, 20 bp, Artificial Sequence
  Description of Artificial Sequence: Synthetic oligonucleotide
  Target: SCN9A; (+) strand; PAM type: NRG; PAM sequence: GAG
gccaaaatctgaatgagatt

SEQ ID NO: 51233 - DNA, 20 bp, Artificial Sequence
  Description of Artificial Sequence: Synthetic oligonucleotide
  Target: SCN9A; (+) strand; PAM type: NRG; PAM sequence: CAG
aaatctgaatgagattgagt

SEQ ID NO: 51234 - DNA, 20 bp, Artificial Sequence
  Description of Artificial Sequence: Synthetic oligonucleotide
  Target: SCN9A; (+) strand; PAM type: NRG; PAM sequence: AAG
ttgagtcagtataaatattt

SEQ ID NO: 51235 - DNA, 20 bp, Artificial Sequence
  Description of Artificial Sequence: Synthetic oligonucleotide
  Target: SCN9A; (+) strand; PAM type: NRG; PAM sequence: CAG
gtcagtataaatatttaaga

SEQ ID NO: 51236 - DNA, 20 bp, Artificial Sequence
  Description of Artificial Sequence: Synthetic oligonucleotide
  Target: SCN9A; (+) strand; PAM type: NRG; PAM sequence: TGG
agtataaatatttaagacag

SEQ ID NO: 51237 - DNA, 20 bp, Artificial Sequence
  Description of Artificial Sequence: Synthetic oligonucleotide
  Target: SCN9A; (+) strand; PAM type: NRG; PAM sequence: AAG
taagacagtggacaaatgta

SEQ ID NO: 51238 - DNA, 20 bp, Artificial Sequence
  Description of Artificial Sequence: Synthetic oligonucleotide
  Target: SCN9A; (+) strand; PAM type: NRG; PAM sequence: TAG
ctttgaaaatgtcacttctc

SEQ ID NO: 51239 - DNA, 20 bp, Artificial Sequence
  Description of Artificial Sequence: Synthetic oligonucleotide
  Target: SCN9A; (+) strand; PAM type: NRG; PAM sequence: TAG
gtcacttctctagaaacaca

SEQ ID NO: 51240 - DNA, 20 bp, Artificial Sequence
  Description of Artificial Sequence: Synthetic oligonucleotide
  Target: SCN9A; (+) strand; PAM type: NRG; PAM sequence: CAG
cacatagtgattttttcctg

SEQ ID NO: 51241 - DNA, 20 bp, Artificial Sequence
  Description of Artificial Sequence: Synthetic oligonucleotide
  Target: SCN9A; (+) strand; PAM type: NRG; PAM sequence: AGG
acatagtgattttttcctgc

SEQ ID NO: 51242 - DNA, 20 bp, Artificial Sequence
  Description of Artificial Sequence: Synthetic oligonucleotide
  Target: SCN9A; (+) strand; PAM type: NRG; PAM sequence: AAG
tgcaggtaaaatcttgactg

SEQ ID NO: 51243 - DNA, 20 bp, Artificial Sequence
  Description of Artificial Sequence: Synthetic oligonucleotide
  Target: SCN9A; (+) strand; PAM type: NRG; PAM sequence: AAG
tgaagtaccattaattttta

SEQ ID NO: 51244 - DNA, 20 bp, Artificial Sequence
  Description of Artificial Sequence: Synthetic oligonucleotide
  Target: SCN9A; (+) strand; PAM type: NRG; PAM sequence: AAG
ttaatttttaaagcattctc

SEQ ID NO: 51245 - DNA, 20 bp, Artificial Sequence
  Description of Artificial Sequence: Synthetic oligonucleotide
  Target: SCN9A; (+) strand; PAM type: NRG; PAM sequence: AGG
taatttttaaagcattctca

SEQ ID NO: 51246 - DNA, 20 bp, Artificial Sequence
  Description of Artificial Sequence: Synthetic oligonucleotide
  Target: SCN9A; (+) strand; PAM type: NRG; PAM sequence: TAG
aaagcattctcaaggcacca

SEQ ID NO: 51247 - DNA, 20 bp, Artificial Sequence
  Description of Artificial Sequence: Synthetic oligonucleotide
  Target: SCN9A; (+) strand; PAM type: NRG; PAM sequence: CAG
ttctcaaggcaccatagaat

SEQ ID NO: 51248 - DNA, 20 bp, Artificial Sequence
  Description of Artificial Sequence: Synthetic oligonucleotide
  Target: SCN9A; (+) strand; PAM type: NRG; PAM sequence: GAG
gcaccatagaatcagaacat

SEQ ID NO: 51249 - DNA, 20 bp, Artificial Sequence
  Description of Artificial Sequence: Synthetic oligonucleotide
  Target: SCN9A; (+) strand; PAM type: NRG; PAM sequence: AAG
tcagaacatgagaacctaaa

SEQ ID NO: 51250 - DNA, 20 bp, Artificial Sequence
  Description of Artificial Sequence: Synthetic oligonucleotide
  Target: SCN9A; (+) strand; PAM type: NRG; PAM sequence: TAG
taaaaagtttatttaaatca

SEQ ID NO: 51251 - DNA, 20 bp, Artificial Sequence
  Description of Artificial Sequence: Synthetic oligonucleotide
  Target: SCN9A; (+) strand; PAM type: NRG; PAM sequence: GAG
taccattgatactatgtgat

SEQ ID NO: 51252 - DNA, 20 bp, Artificial Sequence
  Description of Artificial Sequence: Synthetic oligonucleotide
  Target: SCN9A; (+) strand; PAM type: NRG; PAM sequence: TGG
ttgatactatgtgatgagaa

SEQ ID NO: 51253 - DNA, 20 bp, Artificial Sequence
  Description of Artificial Sequence: Synthetic oligonucleotide
  Target: SCN9A; (+) strand; PAM type: NRG; PAM sequence: TAG
atcttccttcccaaaactta

SEQ ID NO: 51254 - DNA, 20 bp, Artificial Sequence
  Description of Artificial Sequence: Synthetic oligonucleotide
  Target: SCN9A; (+) strand; PAM type: NRG; PAM sequence: GAG
tatagccttaatctaaccat

SEQ ID NO: 51255 - DNA, 20 bp, Artificial Sequence
  Description of Artificial Sequence: Synthetic oligonucleotide
  Target: SCN9A; (+) strand; PAM type: NRG; PAM sequence: CAG
tctaaccatgagaaaaatat

SEQ ID NO: 51256 - DNA, 20 bp, Artificial Sequence
  Description of Artificial Sequence: Synthetic oligonucleotide
  Target: SCN9A; (+) strand; PAM type: NRG; PAM sequence: CAG
atatcagacaaataccaatt

SEQ ID NO: 51257 - DNA, 20 bp, Artificial Sequence
  Description of Artificial Sequence: Synthetic oligonucleotide
  Target: SCN9A; (+) strand; PAM type: NRG; PAM sequence: AGG
tatcagacaaataccaattc

SEQ ID NO: 51258 - DNA, 20 bp, Artificial Sequence
  Description of Artificial Sequence: Synthetic oligonucleotide
  Target: SCN9A; (+) strand; PAM type: NRG; PAM sequence: AAG
acctaacctatactcactca

SEQ ID NO: 51259 - DNA, 20 bp, Artificial Sequence
  Description of Artificial Sequence: Synthetic oligonucleotide
  Target: SCN9A; (+) strand; PAM type: NRG; PAM sequence: AAG
gtatcaacatcatcaaaaac

SEQ ID NO: 51260 - DNA, 20 bp, Artificial Sequence
  Description of Artificial Sequence: Synthetic oligonucleotide
  Target: SCN9A; (+) strand; PAM type: NRG; PAM sequence: AGG
tatcaacatcatcaaaaaca

SEQ ID NO: 51261 - DNA, 20 bp, Artificial Sequence
  Description of Artificial Sequence: Synthetic oligonucleotide
  Target: SCN9A; (+) strand; PAM type: NRG; PAM sequence: AAG
aacatcatcaaaaacaagga

SEQ ID NO: 51262 - DNA, 20 bp, Artificial Sequence
  Description of Artificial Sequence: Synthetic oligonucleotide
  Target: SCN9A; (+) strand; PAM type: NRG; PAM sequence: GAG
atcaaaaacaaggaaagcct

SEQ ID NO: 51263 - DNA, 20 bp, Artificial Sequence
  Description of Artificial Sequence: Synthetic oligonucleotide
  Target: SCN9A; (+) strand; PAM type: NRG; PAM sequence: CAG
gaaagcctgagaaattgcga

SEQ ID NO: 51264 - DNA, 20 bp, Artificial Sequence
  Description of Artificial Sequence: Synthetic oligonucleotide
  Target: SCN9A; (+) strand; PAM type: NRG; PAM sequence: TAG
cctgagaaattgcgacagcc

SEQ ID NO: 51265 - DNA, 20 bp, Artificial Sequence
  Description of Artificial Sequence: Synthetic oligonucleotide
  Target: SCN9A; (+) strand; PAM type: NRG; PAM sequence: GAG
tgagaaattgcgacagccta

SEQ ID NO: 51266 - DNA, 20 bp, Artificial Sequence
  Description of Artificial Sequence: Synthetic oligonucleotide
  Target: SCN9A; (+) strand; PAM type: NRG; PAM sequence: AAG
gcgacagcctagagatgctt

SEQ ID NO: 51267 - DNA, 20 bp, Artificial Sequence
  Description of Artificial Sequence: Synthetic oligonucleotide
  Target: SCN9A; (+) strand; PAM type: NRG; PAM sequence: AGG
cgacagcctagagatgctta

SEQ ID NO: 51268 - DNA, 20 bp, Artificial Sequence
  Description of Artificial Sequence: Synthetic oligonucleotide
  Target: SCN9A; (+) strand; PAM type: NRG; PAM sequence: TGG
agatgcttaaggtgatatga

SEQ ID NO: 51269 - DNA, 20 bp, Artificial Sequence
  Description of Artificial Sequence: Synthetic oligonucleotide
  Target: SCN9A; (+) strand; PAM type: NRG; PAM sequence: TGG
aaggtgatatgatggtatga

SEQ ID NO: 51270 - DNA, 20 bp, Artificial Sequence
  Description of Artificial Sequence: Synthetic oligonucleotide
  Target: SCN9A; (+) strand; PAM type: NRG; PAM sequence: TGG
tatgatggttaaatgtaatg

SEQ ID NO: 51271 - DNA, 20 bp, Artificial Sequence
  Description of Artificial Sequence: Synthetic oligonucleotide
  Target: SCN9A; (+) strand; PAM type: NRG; PAM sequence: TAG
gatggttaaatgtaatgtgg

SEQ ID NO: 51272 - DNA, 20 bp, Artificial Sequence
  Description of Artificial Sequence: Synthetic oligonucleotide
  Target: SCN9A; (+) strand; PAM type: NRG; PAM sequence: TGG
ttaaatgtaatgtggtagcc

SEQ ID NO: 51273 - DNA, 20 bp, Artificial Sequence
  Description of Artificial Sequence: Synthetic oligonucleotide
  Target: SCN9A; (+) strand; PAM type: NRG; PAM sequence: GGG
taaatgtaatgtggtagcct

SEQ ID NO: 51274 - DNA, 20 bp, Artificial Sequence
  Description of Artificial Sequence: Synthetic oligonucleotide
  Target: SCN9A; (+) strand; PAM type: NRG; PAM sequence: GAG
tgtaatgtggtagcctgggt

SEQ ID NO: 51275 - DNA, 20 bp, Artificial Sequence
  Description of Artificial Sequence: Synthetic oligonucleotide
  Target: SCN9A; (+) strand; PAM type: NRG; PAM sequence: AAG
tagcctgggtgagatcttga

SEQ ID NO: 51276 - DNA, 20 bp, Artificial Sequence
  Description of Artificial Sequence: Synthetic oligonucleotide
  Target: SCN9A; (+) strand; PAM type: NRG; PAM sequence: GAG
gcctgggtgagatcttgaaa

SEQ ID NO: 51277 - DNA, 20 bp, Artificial Sequence
  Description of Artificial Sequence: Synthetic oligonucleotide
  Target: SCN9A; (+) strand; PAM type: NRG; PAM sequence: AAG
gtgagatcttgaaagagaaa

SEQ ID NO: 51278 - DNA, 20 bp, Artificial Sequence
  Description of Artificial Sequence: Synthetic oligonucleotide
  Target: SCN9A; (+) strand; PAM type: NRG; PAM sequence: AGG
tgagatcttgaaagagaaaa

SEQ ID NO: 51279 - DNA, 20 bp, Artificial Sequence
  Description of Artificial Sequence: Synthetic oligonucleotide
  Target: SCN9A; (+) strand; PAM type: NRG; PAM sequence: TAG
ttgaaagagaaaaaggaaat

SEQ ID NO: 51280 - DNA, 20 bp, Artificial Sequence
  Description of Artificial Sequence: Synthetic oligonucleotide
  Target: SCN9A; (+) strand; PAM type: NRG; PAM sequence: AAG
aaggaaattagtgaaaaact

SEQ ID NO: 51281 - DNA, 20 bp, Artificial Sequence
  Description of Artificial Sequence: Synthetic oligonucleotide
  Target: SCN9A; (+) strand; PAM type: NRG; PAM sequence: AGG
aggaaattagtgaaaaacta

SEQ ID NO: 51282 - DNA, 20 bp, Artificial Sequence
  Description of Artificial Sequence: Synthetic oligonucleotide
  Target: SCN9A; (+) strand; PAM type: NRG; PAM sequence: TAG
aaaaactaaggaactctgaa

SEQ ID NO: 51283 - DNA, 20 bp, Artificial Sequence
  Description of Artificial Sequence: Synthetic oligonucleotide
  Target: SCN9A; (+) strand; PAM type: NRG; PAM sequence: AGG
aaaactaaggaactctgaat

SEQ ID NO: 51284 - DNA, 20 bp, Artificial Sequence
  Description of Artificial Sequence: Synthetic oligonucleotide
  Target: SCN9A; (+) strand; PAM type: NRG; PAM sequence: GGG
aaactaaggaactctgaata

SEQ ID NO: 51285 - DNA, 20 bp, Artificial Sequence
  Description of Artificial Sequence: Synthetic oligonucleotide
  Target: SCN9A; (+) strand; PAM type: NRG; PAM sequence: AAG
taaggaactctgaatagggt

SEQ ID NO: 51286 - DNA, 20 bp, Artificial Sequence
  Description of Artificial Sequence: Synthetic oligonucleotide
  Target: SCN9A; (+) strand; PAM type: NRG; PAM sequence: AGG
aaggaactctgaatagggta

SEQ ID NO: 51287 - DNA, 20 bp, Artificial Sequence
  Description of Artificial Sequence: Synthetic oligonucleotide
  Target: SCN9A; (+) strand; PAM type: NRG; PAM sequence: GGG
aggaactctgaatagggtaa

SEQ ID NO: 51288 - DNA, 20 bp, Artificial Sequence
  Description of Artificial Sequence: Synthetic oligonucleotide
  Target: SCN9A; (+) strand; PAM type: NRG; PAM sequence: TGG
aataataatgatgtatcaca

SEQ ID NO: 51289 - DNA, 20 bp, Artificial Sequence
  Description of Artificial Sequence: Synthetic oligonucleotide
  Target: SCN9A; (+) strand; PAM type: NRG; PAM sequence: CAG
ctaatataaactgttaataa

SEQ ID NO: 51290 - DNA, 20 bp, Artificial Sequence
  Description of Artificial Sequence: Synthetic oligonucleotide
  Target: SCN9A; (+) strand; PAM type: NRG; PAM sequence: AGG
taatataaactgttaataac

SEQ ID NO: 51291 - DNA, 20 bp, Artificial Sequence
  Description of Artificial Sequence: Synthetic oligonucleotide
  Target: SCN9A; (+) strand; PAM type: NRG; PAM sequence: GGG
aatataaactgttaataaca

SEQ ID NO: 51292 - DNA, 20 bp, Artificial Sequence
  Description of Artificial Sequence: Synthetic oligonucleotide
  Target: SCN9A; (+) strand; PAM type: NRG; PAM sequence: GGG
atataaactgttaataacag

SEQ ID NO: 51293 - DNA, 20 bp, Artificial Sequence
  Description of Artificial Sequence: Synthetic oligonucleotide
  Target: SCN9A; (+) strand; PAM type: NRG; PAM sequence: TGG
ctgttaataacaggggaaac

SEQ ID NO: 51294 - DNA, 20 bp, Artificial Sequence
  Description of Artificial Sequence: Synthetic oligonucleotide
  Target: SCN9A; (+) strand; PAM type: NRG; PAM sequence: TGG
ataacaggggaaactggatg

SEQ ID NO: 51295 - DNA, 20 bp, Artificial Sequence
  Description of Artificial Sequence: Synthetic oligonucleotide
  Target: SCN9A; (+) strand; PAM type: NRG; PAM sequence: GGG
taacaggggaaactggatgt

SEQ ID NO: 51296 - DNA, 20 bp, Artificial Sequence
  Description of Artificial Sequence: Synthetic oligonucleotide
  Target: SCN9A; (+) strand; PAM type: NRG; PAM sequence: GGG
aacaggggaaactggatgtg

SEQ ID NO: 51297 - DNA, 20 bp, Artificial Sequence
  Description of Artificial Sequence: Synthetic oligonucleotide
  Target: SCN9A; (+) strand; PAM type: NRG; PAM sequence: AAG
tttttccataaatctattcc

SEQ ID NO: 51298 - DNA, 20 bp, Artificial Sequence
  Description of Artificial Sequence: Synthetic oligonucleotide
  Target: SCN9A; (+) strand; PAM type: NRG; PAM sequence: AAG
ataaatctattccaagacaa

SEQ ID NO: 51299 - DNA, 20 bp, Artificial Sequence
  Description of Artificial Sequence: Synthetic oligonucleotide
  Target: SCN9A; (+) strand; PAM type: NRG; PAM sequence: AAG
ctattccaagacaaaagttt

SEQ ID NO: 51300 - DNA, 20 bp, Artificial Sequence
  Description of Artificial Sequence: Synthetic oligonucleotide
  Target: SCN9A; (+) strand; PAM type: NRG; PAM sequence: AAG
caagacaaaagtttaagcaa

SEQ ID NO: 51301 - DNA, 20 bp, Artificial Sequence
  Description of Artificial Sequence: Synthetic oligonucleotide
  Target: SCN9A; (+) strand; PAM type: NRG; PAM sequence: AGG
aagacaaaagtttaagcaaa

SEQ ID NO: 51302 - DNA, 20 bp, Artificial Sequence
  Description of Artificial Sequence: Synthetic oligonucleotide
  Target: SCN9A; (+) strand; PAM type: NRG; PAM sequence: CAG
gtttaagcaaaaggaaatca

SEQ ID NO: 51303 - DNA, 20 bp, Artificial Sequence
  Description of Artificial Sequence: Synthetic oligonucleotide
  Target: SCN9A; (+) strand; PAM type: NRG; PAM sequence: TAG
gcaaaaggaaatcacagatg

SEQ ID NO: 51304 - DNA, 20 bp, Artificial Sequence
  Description of Artificial Sequence: Synthetic oligonucleotide
  Target: SCN9A; (+) strand; PAM type: NRG; PAM sequence: AAG
aattattctaatattaaata

SEQ ID NO: 51305 - DNA, 20 bp, Artificial Sequence
  Description of Artificial Sequence: Synthetic oligonucleotide
  Target: SCN9A; (+) strand; PAM type: NRG; PAM sequence: AGG
attattctaatattaaataa

SEQ ID NO: 51306 - DNA, 20 bp, Artificial Sequence
  Description of Artificial Sequence: Synthetic oligonucleotide
  Target: SCN9A; (+) strand; PAM type: NRG; PAM sequence: TAG
atattaaataaaggtaataa

SEQ ID NO: 51307 - DNA, 20 bp, Artificial Sequence
  Description of Artificial Sequence: Synthetic oligonucleotide
  Target: SCN9A; (+) strand; PAM type: NRG; PAM sequence: CAG
aaataaaggtaataatagct

SEQ ID NO: 51308 - DNA, 20 bp, Artificial Sequence
  Description of Artificial Sequence: Synthetic oligonucleotide
  Target: SCN9A; (+) strand; PAM type: NRG; PAM sequence: CAG
ctcagtgaatttgaatttat

SEQ ID NO: 51309 - DNA, 20 bp, Artificial Sequence
  Description of Artificial Sequence: Synthetic oligonucleotide
  Target: SCN9A; (+) strand; PAM type: NRG; PAM sequence: AGG
tcagtgaatttgaatttatc

SEQ ID NO: 51310 - DNA, 20 bp, Artificial Sequence
  Description of Artificial Sequence: Synthetic oligonucleotide
  Target: SCN9A; (+) strand; PAM type: NRG; PAM sequence: AAG
atattatctataatatacct

SEQ ID NO: 51311 - DNA, 20 bp, Artificial Sequence
  Description of Artificial Sequence: Synthetic oligonucleotide
  Target: SCN9A; (+) strand; PAM type: NRG; PAM sequence: TAG
ataatatacctaagtgataa

SEQ ID NO: 51312 - DNA, 20 bp, Artificial Sequence
  Description of Artificial Sequence: Synthetic oligonucleotide
  Target: SCN9A; (+) strand; PAM type: NRG; PAM sequence: CAG
ttaaaaatacatattttaca

SEQ ID NO: 51313 - DNA, 20 bp, Artificial Sequence
  Description of Artificial Sequence: Synthetic oligonucleotide
  Target: SCN9A; (+) strand; PAM type: NRG; PAM sequence: TAG
atattttacacagtacaaaa

SEQ ID NO: 51314 - DNA, 20 bp, Artificial Sequence
  Description of Artificial Sequence: Synthetic oligonucleotide
  Target: SCN9A; (+) strand; PAM type: NRG; PAM sequence: TAG
aatagcattgctttgatcaa

SEQ ID NO: 51315 - DNA, 20 bp, Artificial Sequence
  Description of Artificial Sequence: Synthetic oligonucleotide
  Target: SCN9A; (+) strand; PAM type: NRG; PAM sequence: AGG
atagcattgctttgatcaat

SEQ ID NO: 51316 - DNA, 20 bp, Artificial Sequence
  Description of Artificial Sequence: Synthetic oligonucleotide
  Target: SCN9A; (+) strand; PAM type: NRG; PAM sequence: GAG
agcattgctttgatcaatag

SEQ ID NO: 51317 - DNA, 20 bp, Artificial Sequence
  Description of Artificial Sequence: Synthetic oligonucleotide
  Target: SCN9A; (+) strand; PAM type: NRG; PAM sequence: TAG
ttgatcaataggagatccat

SEQ ID NO: 51318 - DNA, 20 bp, Artificial Sequence
  Description of Artificial Sequence: Synthetic oligonucleotide
  Target: SCN9A; (+) strand; PAM type: NRG; PAM sequence: CAG
gatccattagaaatgctgat

SEQ ID NO: 51319 - DNA, 20 bp, Artificial Sequence
  Description of Artificial Sequence: Synthetic oligonucleotide
  Target: SCN9A; (+) strand; PAM type: NRG; PAM sequence: AAG
aatgctgatcagttttctta

SEQ ID NO: 51320 - DNA, 20 bp, Artificial Sequence
  Description of Artificial Sequence: Synthetic oligonucleotide
  Target: SCN9A; (+) strand; PAM type: NRG; PAM sequence: TGG
tttcttaaagtaatcatgcc

SEQ ID NO: 51321 - DNA, 20 bp, Artificial Sequence
  Description of Artificial Sequence: Synthetic oligonucleotide
  Target: SCN9A; (+) strand; PAM type: NRG; PAM sequence: GGG
ttcttaaagtaatcatgcct

SEQ ID NO: 51322 - DNA, 20 bp, Artificial Sequence
  Description of Artificial Sequence: Synthetic oligonucleotide
  Target: SCN9A; (+) strand; PAM type: NRG; PAM sequence: GAG
cttaaagtaatcatgcctgg

SEQ ID NO: 51323 - DNA, 20 bp, Artificial Sequence
  Description of Artificial Sequence: Synthetic oligonucleotide
  Target: SCN9A; (+) strand; PAM type: NRG; PAM sequence: AGG
ttaaagtaatcatgcctggg

SEQ ID NO: 51324 - DNA, 20 bp, Artificial Sequence
  Description of Artificial Sequence: Synthetic oligonucleotide
  Target: SCN9A; (+) strand; PAM type: NRG; PAM sequence: TGG
tttctataaatgcactctcc

SEQ ID NO: 51325 - DNA, 20 bp, Artificial Sequence
  Description of Artificial Sequence: Synthetic oligonucleotide
  Target: SCN9A; (+) strand; PAM type: NRG; PAM sequence: GGG
ttctataaatgcactctcct

SEQ ID NO: 51326 - DNA, 20 bp, Artificial Sequence
  Description of Artificial Sequence: Synthetic oligonucleotide
  Target: SCN9A; (+) strand; PAM type: NRG; PAM sequence: CAG
ataaatgcactctcctgggt

SEQ ID NO: 51327 - DNA, 20 bp, Artificial Sequence
  Description of Artificial Sequence: Synthetic oligonucleotide
  Target: SCN9A; (+) strand; PAM type: NRG; PAM sequence: AGG
taaatgcactctcctgggtc

SEQ ID NO: 51328 - DNA, 20 bp, Artificial Sequence
  Description of Artificial Sequence: Synthetic oligonucleotide
  Target: SCN9A; (+) strand; PAM type: NRG; PAM sequence: GAG
cactctcctgggtcaggaat

SEQ ID NO: 51329 - DNA, 20 bp, Artificial Sequence
  Description of Artificial Sequence: Synthetic oligonucleotide
  Target: SCN9A; (+) strand; PAM type: NRG; PAM sequence: TAG
gagcttatgacttataaaca

SEQ ID NO: 51330 - DNA, 20 bp, Artificial Sequence
  Description of Artificial Sequence: Synthetic oligonucleotide
  Target: SCN9A; (+) strand; PAM type: NRG; PAM sequence: TGG
ttataaacatagaactaaac

SEQ ID NO: 51331 - DNA, 20 bp, Artificial Sequence
  Description of Artificial Sequence: Synthetic oligonucleotide
  Target: SCN9A; (+) strand; PAM type: NRG; PAM sequence: GAG
ataaacatagaactaaactg

SEQ ID NO: 51332 - DNA, 20 bp, Artificial Sequence
  Description of Artificial Sequence: Synthetic oligonucleotide
  Target: SCN9A; (+) strand; PAM type: NRG; PAM sequence: GAG
aaactggagtcacaatgtct

SEQ ID NO: 51333 - DNA, 20 bp, Artificial Sequence
  Description of Artificial Sequence: Synthetic oligonucleotide
  Target: SCN9A; (+) strand; PAM type: NRG; PAM sequence: GAG
tctgagtcctaattatactt

SEQ ID NO: 51334 - DNA, 20 bp, Artificial Sequence
  Description of Artificial Sequence: Synthetic oligonucleotide
  Target: SCN9A; (+) strand; PAM type: NRG; PAM sequence: GAG
tgagtcctaattatacttga

SEQ ID NO: 51335 - DNA, 20 bp, Artificial Sequence
  Description of Artificial Sequence: Synthetic oligonucleotide
  Target: SCN9A; (+) strand; PAM type: NRG; PAM sequence: TAG
gtcattatgtcttattataa

SEQ ID NO: 51336 - DNA, 20 bp, Artificial Sequence
  Description of Artificial Sequence: Synthetic oligonucleotide
  Target: SCN9A; (+) strand; PAM type: NRG; PAM sequence: AGG
tcattatgtcttattataat

SEQ ID NO: 51337 - DNA, 20 bp, Artificial Sequence
  Description of Artificial Sequence: Synthetic oligonucleotide
  Target: SCN9A; (+) strand; PAM type: NRG; PAM sequence: GAG
ggctaaaaaaatacacttat

SEQ ID NO: 51338 - DNA, 20 bp, Artificial Sequence
  Description of Artificial Sequence: Synthetic oligonucleotide
  Target: SCN9A; (+) strand; PAM type: NRG; PAM sequence: AGG
gctaaaaaaatacacttatg

SEQ ID NO: 51339 - DNA, 20 bp, Artificial Sequence
  Description of Artificial Sequence: Synthetic oligonucleotide
  Target: SCN9A; (+) strand; PAM type: NRG; PAM sequence: GGG
ctaaaaaaatacacttatga

SEQ ID NO: 51340 - DNA, 20 bp, Artificial Sequence
  Description of Artificial Sequence: Synthetic oligonucleotide
  Target: SCN9A; (+) strand; PAM type: NRG; PAM sequence: TAG
aatctgtgtgtattttcttt

SEQ ID NO: 51341 - DNA, 20 bp, Artificial Sequence
  Description of Artificial Sequence: Synthetic oligonucleotide
  Target: SCN9A; (+) strand; PAM type: NRG; PAM sequence: AAG
tgtgtattttcttttagaat

SEQ ID NO: 51342 - DNA, 20 bp, Artificial Sequence
  Description of Artificial Sequence: Synthetic oligonucleotide
  Target: SCN9A; (+) strand; PAM type: NRG; PAM sequence: TGG
caatttaactccctcaacca

SEQ ID NO: 51343 - DNA, 20 bp, Artificial Sequence
  Description of Artificial Sequence: Synthetic oligonucleotide
  Target: SCN9A; (+) strand; PAM type: NRG; PAM sequence: AAG
ttaactccctcaaccatggt

SEQ ID NO: 51344 - DNA, 20 bp, Artificial Sequence
  Description of Artificial Sequence: Synthetic oligonucleotide
  Target: SCN9A; (+) strand; PAM type: NRG; PAM sequence: AAG
aagcatactaaatatctttt

SEQ ID NO: 51345 - DNA, 20 bp, Artificial Sequence
  Description of Artificial Sequence: Synthetic oligonucleotide
  Target: SCN9A; (+) strand; PAM type: NRG; PAM sequence: AAG
tcttttaagttgttaaattg

SEQ ID NO: 51346 - DNA, 20 bp, Artificial Sequence
  Description of Artificial Sequence: Synthetic oligonucleotide
  Target: SCN9A; (+) strand; PAM type: NRG; PAM sequence: AAG
tccatcttaatgatgccgtt

SEQ ID NO: 51347 - DNA, 20 bp, Artificial Sequence
  Description of Artificial Sequence: Synthetic oligonucleotide
  Target: SCN9A; (+) strand; PAM type: NRG; PAM sequence: AGG
ccatcttaatgatgccgtta

SEQ ID NO: 51348 - DNA, 20 bp, Artificial Sequence
  Description of Artificial Sequence: Synthetic oligonucleotide
  Target: SCN9A; (+) strand; PAM type: NRG; PAM sequence: AAG
atgatgccgttaaggtacaa

SEQ ID NO: 51349 - DNA, 20 bp, Artificial Sequence
  Description of Artificial Sequence: Synthetic oligonucleotide
  Target: SCN9A; (+) strand; PAM type: NRG; PAM sequence: AGG
tgatgccgttaaggtacaaa

SEQ ID NO: 51350 - DNA, 20 bp, Artificial Sequence
  Description of Artificial Sequence: Synthetic oligonucleotide
  Target: SCN9A; (+) strand; PAM type: NRG; PAM sequence: TAG
ttttgatttctgtgttactt

SEQ ID NO: 51351 - DNA, 20 bp, Artificial Sequence
  Description of Artificial Sequence: Synthetic oligonucleotide
  Target: SCN9A; (+) strand; PAM type: NRG; PAM sequence: AGG
tttgatttctgtgttacttt

SEQ ID NO: 51352 - DNA, 20 bp, Artificial Sequence
  Description of Artificial Sequence: Synthetic oligonucleotide
  Target: SCN9A; (+) strand; PAM type: NRG; PAM sequence: GAG
tgtgttactttaggaactgt

SEQ ID NO: 51353 - DNA, 20 bp, Artificial Sequence
  Description of Artificial Sequence: Synthetic oligonucleotide
  Target: SCN9A; (+) strand; PAM type: NRG; PAM sequence: AGG
gtgttactttaggaactgtg

SEQ ID NO: 51354 - DNA, 20 bp, Artificial Sequence
  Description of Artificial Sequence: Synthetic oligonucleotide
  Target: SCN9A; (+) strand; PAM type: NRG; PAM sequence: TAG
ttaggaactgtgaggtaaca

SEQ ID NO: 51355 - DNA, 20 bp, Artificial Sequence
  Description of Artificial Sequence: Synthetic oligonucleotide
  Target: SCN9A; (+) strand; PAM type: NRG; PAM sequence: GAG
aggaactgtgaggtaacata

SEQ ID NO: 51356 - DNA, 20 bp, Artificial Sequence
  Description of Artificial Sequence: Synthetic oligonucleotide
  Target: SCN9A; (+) strand; PAM type: NRG; PAM sequence: AAG
gtgaggtaacatagagataa

SEQ ID NO: 51357 - DNA, 20 bp, Artificial Sequence
  Description of Artificial Sequence: Synthetic oligonucleotide
  Target: SCN9A; (+) strand; PAM type: NRG; PAM sequence: GAG
aaagaaatgtatttgactct

SEQ ID NO: 51358 - DNA, 20 bp, Artificial Sequence
  Description of Artificial Sequence: Synthetic oligonucleotide
  Target: SCN9A; (+) strand; PAM type: NRG; PAM sequence: GAG
tctgagattctcattttact

SEQ ID NO: 51359 - DNA, 20 bp, Artificial Sequence
  Description of Artificial Sequence: Synthetic oligonucleotide
  Target: SCN9A; (+) strand; PAM type: NRG; PAM sequence: CAG
tgaacacctgataacatcat

SEQ ID NO: 51360 - DNA, 20 bp, Artificial Sequence
  Description of Artificial Sequence: Synthetic oligonucleotide
  Target: SCN9A; (+) strand; PAM type: NRG; PAM sequence: GAG
aacacctgataacatcatca

SEQ ID NO: 51361 - DNA, 20 bp, Artificial Sequence
  Description of Artificial Sequence: Synthetic oligonucleotide
  Target: SCN9A; (+) strand; PAM type: NRG; PAM sequence: AAG
cctgataacatcatcagagc

SEQ ID NO: 51362 - DNA, 20 bp, Artificial Sequence
  Description of Artificial Sequence: Synthetic oligonucleotide
  Target: SCN9A; (+) strand; PAM type: NRG; PAM sequence: CAG
atcagagcaagacaaaaata

SEQ ID NO: 51363 - DNA, 20 bp, Artificial Sequence
  Description of Artificial Sequence: Synthetic oligonucleotide
  Target: SCN9A; (+) strand; PAM type: NRG; PAM sequence: TGG
acaaaaatacagctccactc

SEQ ID NO: 51364 - DNA, 20 bp, Artificial Sequence
  Description of Artificial Sequence: Synthetic oligonucleotide
  Target: SCN9A; (+) strand; PAM type: NRG; PAM sequence: AAG
acagctccactctggctgac

SEQ ID NO: 51365 - DNA, 20 bp, Artificial Sequence
  Description of Artificial Sequence: Synthetic oligonucleotide
  Target: SCN9A; (+) strand; PAM type: NRG; PAM sequence: AGG
cagctccactctggctgaca

SEQ ID NO: 51366 - DNA, 20 bp, Artificial Sequence
  Description of Artificial Sequence: Synthetic oligonucleotide
  Target: SCN9A; (+) strand; PAM type: NRG; PAM sequence: TGG
gacaaggatacgcttaaccc

SEQ ID NO: 51367 - DNA, 20 bp, Artificial Sequence
  Description of Artificial Sequence: Synthetic oligonucleotide
  Target: SCN9A; (+) strand; PAM type: NRG; PAM sequence: AAG
accctggtttataactacaa

SEQ ID NO: 51368 - DNA, 20 bp, Artificial Sequence
  Description of Artificial Sequence: Synthetic oligonucleotide
  Target: SCN9A; (+) strand; PAM type: NRG; PAM sequence: AAG
aacttatctactcataacat

SEQ ID NO: 51369 - DNA, 20 bp, Artificial Sequence
  Description of Artificial Sequence: Synthetic oligonucleotide
  Target: SCN9A; (+) strand; PAM type: NRG; PAM sequence: AAG
cataagacttcccatgataa

SEQ ID NO: 51370 - DNA, 20 bp, Artificial Sequence
  Description of Artificial Sequence: Synthetic oligonucleotide
  Target: SCN9A; (+) strand; PAM type: NRG; PAM sequence: GAG
taagacttcccatgataaaa

SEQ ID NO: 51371 - DNA, 20 bp, Artificial Sequence
  Description of Artificial Sequence: Synthetic oligonucleotide
  Target: SCN9A; (+) strand; PAM type: NRG; PAM sequence: CAG
ataaaagagaaatatgtcat

SEQ ID NO: 51372 - DNA, 20 bp, Artificial Sequence
  Description of Artificial Sequence: Synthetic oligonucleotide
  Target: SCN9A; (+) strand; PAM type: NRG; PAM sequence: AGG
taaaagagaaatatgtcatc

SEQ ID NO: 51373 - DNA, 20 bp, Artificial Sequence
  Description of Artificial Sequence: Synthetic oligonucleotide
  Target: SCN9A; (+) strand; PAM type: NRG; PAM sequence: GAG
aaagagaaatatgtcatcag

SEQ ID NO: 51374 - DNA, 20 bp, Artificial Sequence
  Description of Artificial Sequence: Synthetic oligonucleotide
  Target: SCN9A; (+) strand; PAM type: NRG; PAM sequence: GAG
agagaaatatgtcatcagga

SEQ ID NO: 51375 - DNA, 20 bp, Artificial Sequence
  Description of Artificial Sequence: Synthetic oligonucleotide
  Target: SCN9A; (+) strand; PAM type: NRG; PAM sequence: GAG
aatatgtcatcaggagagat

SEQ ID NO: 51376 - DNA, 20 bp, Artificial Sequence
  Description of Artificial Sequence: Synthetic oligonucleotide
  Target: SCN9A; (+) strand; PAM type: NRG; PAM sequence: GAG
tatgtcatcaggagagatga

SEQ ID NO: 51377 - DNA, 20 bp, Artificial Sequence
  Description of Artificial Sequence: Synthetic oligonucleotide
  Target: SCN9A; (+) strand; PAM type: NRG; PAM sequence: GAG
tgtcatcaggagagatgaga

SEQ ID NO: 51378 - DNA, 20 bp, Artificial Sequence
  Description of Artificial Sequence: Synthetic oligonucleotide
  Target: SCN9A; (+) strand; PAM type: NRG; PAM sequence: AGG
gtcatcaggagagatgagag

SEQ ID NO: 51379 - DNA, 20 bp, Artificial Sequence
  Description of Artificial Sequence: Synthetic oligonucleotide
  Target: SCN9A; (+) strand; PAM type: NRG; PAM sequence: CAG
agagaggcaatgtttccttc

SEQ ID NO: 51380 - DNA, 20 bp, Artificial Sequence
  Description of Artificial Sequence: Synthetic oligonucleotide
  Target: SCN9A; (+) strand; PAM type: NRG; PAM sequence: TAG
ccttccagtatgaactctta

SEQ ID NO: 51381 - DNA, 20 bp, Artificial Sequence
  Description of Artificial Sequence: Synthetic oligonucleotide
  Target: SCN9A; (+) strand; PAM type: NRG; PAM sequence: AGG
cttccagtatgaactcttat

SEQ ID NO: 51382 - DNA, 20 bp, Artificial Sequence
  Description of Artificial Sequence: Synthetic oligonucleotide
  Target: SCN9A; (+) strand; PAM type: NRG; PAM sequence: CAG
taggccttctcccatgaaaa

SEQ ID NO: 51383 - DNA, 20 bp, Artificial Sequence
  Description of Artificial Sequence: Synthetic oligonucleotide
  Target: SCN9A; (+) strand; PAM type: NRG; PAM sequence: CAG
catgaaaacagaaaaatttc

SEQ ID NO: 51384 - DNA, 20 bp, Artificial Sequence
  Description of Artificial Sequence: Synthetic oligonucleotide
  Target: SCN9A; (+) strand; PAM type: NRG; PAM sequence: TGG
aaaacagaaaaatttccaga

SEQ ID NO: 51385 - DNA, 20 bp, Artificial Sequence
  Description of Artificial Sequence: Synthetic oligonucleotide
  Target: SCN9A; (+) strand; PAM type: NRG; PAM sequence: TGG
gaaaactctgttctatgtct

SEQ ID NO: 51386 - DNA, 20 bp, Artificial Sequence
  Description of Artificial Sequence: Synthetic oligonucleotide
  Target: SCN9A; (+) strand; PAM type: NRG; PAM sequence: AAG
ctgttctatgtcttggcacc

SEQ ID NO: 51387 - DNA, 20 bp, Artificial Sequence
  Description of Artificial Sequence: Synthetic oligonucleotide
  Target: SCN9A; (+) strand; PAM type: NRG; PAM sequence: TGG
tcttggcaccaagaaaatat

SEQ ID NO: 51388 - DNA, 20 bp, Artificial Sequence
  Description of Artificial Sequence: Synthetic oligonucleotide
  Target: SCN9A; (+) strand; PAM type: NRG; PAM sequence: GAG
ttggcaccaagaaaatattg

SEQ ID NO: 51389 - DNA, 20 bp, Artificial Sequence
  Description of Artificial Sequence: Synthetic oligonucleotide
  Target: SCN9A; (+) strand; PAM type: NRG; PAM sequence: TGG
attggagtccttcctacacc

SEQ ID NO: 51390 - DNA, 20 bp, Artificial Sequence
  Description of Artificial Sequence: Synthetic oligonucleotide
  Target: SCN9A; (+) strand; PAM type: NRG; PAM sequence: AAG
cacctggcctccgattgaat

SEQ ID NO: 51391 - DNA, 20 bp, Artificial Sequence
  Description of Artificial Sequence: Synthetic oligonucleotide
  Target: SCN9A; (+) strand; PAM type: NRG; PAM sequence: AAG
gattgaataagtgaaatatc

SEQ ID NO: 51392 - DNA, 20 bp, Artificial Sequence
  Description of Artificial Sequence: Synthetic oligonucleotide
  Target: SCN9A; (+) strand; PAM type: NRG; PAM sequence: AAG
aaattctatatgtcaataac

SEQ ID NO: 51393 - DNA, 20 bp, Artificial Sequence
  Description of Artificial Sequence: Synthetic oligonucleotide
  Target: SCN9A; (+) strand; PAM type: NRG; PAM sequence: AAG
tatatgtcaataacaagata

SEQ ID NO: 51394 - DNA, 20 bp, Artificial Sequence
  Description of Artificial Sequence: Synthetic oligonucleotide
  Target: SCN9A; (+) strand; PAM type: NRG; PAM sequence: AAG
agataaagctgaaacattca

SEQ ID NO: 51395 - DNA, 20 bp, Artificial Sequence
  Description of Artificial Sequence: Synthetic oligonucleotide
  Target: SCN9A; (+) strand; PAM type: NRG; PAM sequence: AAG
ctgaaacattcaaagacaat

SEQ ID NO: 51396 - DNA, 20 bp, Artificial Sequence
  Description of Artificial Sequence: Synthetic oligonucleotide
  Target: SCN9A; (+) strand; PAM type: NRG; PAM sequence: AAG
aaacattcaaagacaataag

SEQ ID NO: 51397 - DNA, 20 bp, Artificial Sequence
  Description of Artificial Sequence: Synthetic oligonucleotide
  Target: SCN9A; (+) strand; PAM type: NRG; PAM sequence: TAG
agacaataagaagtacaatt

SEQ ID NO: 51398 - DNA, 20 bp, Artificial Sequence
  Description of Artificial Sequence: Synthetic oligonucleotide
  Target: SCN9A; (+) strand; PAM type: NRG; PAM sequence: TAG
agtacaatttagtcattgaa

SEQ ID NO: 51399 - DNA, 20 bp, Artificial Sequence
  Description of Artificial Sequence: Synthetic oligonucleotide
  Target: SCN9A; (+) strand; PAM type: NRG; PAM sequence: CAG
ttagtcattgaatagctcta

SEQ ID NO: 51400 - DNA, 20 bp, Artificial Sequence
  Description of Artificial Sequence: Synthetic oligonucleotide
  Target: SCN9A; (+) strand; PAM type: NRG; PAM sequence: TAG
cattgaatagctctacagtt

SEQ ID NO: 51401 - DNA, 20 bp, Artificial Sequence
  Description of Artificial Sequence: Synthetic oligonucleotide
  Target: SCN9A; (+) strand; PAM type: NRG; PAM sequence: AAG
aatagctctacagtttagat

SEQ ID NO: 51402 - DNA, 20 bp, Artificial Sequence
  Description of Artificial Sequence: Synthetic oligonucleotide
  Target: SCN9A; (+) strand; PAM type: NRG; PAM sequence: AAG
gctctacagtttagataaga

SEQ ID NO: 51403 - DNA, 20 bp, Artificial Sequence
  Description of Artificial Sequence: Synthetic oligonucleotide
  Target: SCN9A; (+) strand; PAM type: NRG; PAM sequence: AAG
cagtttagataagaaagtca

SEQ ID NO: 51404 - DNA, 20 bp, Artificial Sequence
  Description of Artificial Sequence: Synthetic oligonucleotide
  Target: SCN9A; (+) strand; PAM type: NRG; PAM sequence: AGG
agtttagataagaaagtcaa

SEQ ID NO: 51405 - DNA, 20 bp, Artificial Sequence
  Description of Artificial Sequence: Synthetic oligonucleotide
  Target: SCN9A; (+) strand; PAM type: NRG; PAM sequence: TGG
aggtgcgaaacgattgaatc

SEQ ID NO: 51406 - DNA, 20 bp, Artificial Sequence
  Description of Artificial Sequence: Synthetic oligonucleotide
  Target: SCN9A; (+) strand; PAM type: NRG; PAM sequence: GAG
gtgcgaaacgattgaatctg

SEQ ID NO: 51407 - DNA, 20 bp, Artificial Sequence
  Description of Artificial Sequence: Synthetic oligonucleotide
  Target: SCN9A; (+) strand; PAM type: NRG; PAM sequence: CAG
acgattgaatctggagaata

SEQ ID NO: 51408 - DNA, 20 bp, Artificial Sequence
  Description of Artificial Sequence: Synthetic oligonucleotide
  Target: SCN9A; (+) strand; PAM type: NRG; PAM sequence: AGG
cgattgaatctggagaatac

SEQ ID NO: 51409 - DNA, 20 bp, Artificial Sequence
  Description of Artificial Sequence: Synthetic oligonucleotide
  Target: SCN9A; (+) strand; PAM type: NRG; PAM sequence: GGG
gattgaatctggagaataca

SEQ ID NO: 51410 - DNA, 20 bp, Artificial Sequence
  Description of Artificial Sequence: Synthetic oligonucleotide
  Target: SCN9A; (+) strand; PAM type: NRG; PAM sequence: GGG
attgaatctggagaatacag

SEQ ID NO: 51411 - DNA, 20 bp, Artificial Sequence
  Description of Artificial Sequence: Synthetic oligonucleotide
  Target: SCN9A; (+) strand; PAM type: NRG; PAM sequence: AAG
ggaaaaataatacttaaacc

SEQ ID NO: 51412 - DNA, 20 bp, Artificial Sequence
  Description of Artificial Sequence: Synthetic oligonucleotide
  Target: SCN9A; (+) strand; PAM type: NRG; PAM sequence: AAG
ctatgtgctccttgaattat

SEQ ID NO: 51413 - DNA, 20 bp, Artificial Sequence
  Description of Artificial Sequence: Synthetic oligonucleotide
  Target: SCN9A; (+) strand; PAM type: NRG; PAM sequence: AGG
tatgtgctccttgaattata

SEQ ID NO: 51414 - DNA, 20 bp, Artificial Sequence
  Description of Artificial Sequence: Synthetic oligonucleotide
  Target: SCN9A; (+) strand; PAM type: NRG; PAM sequence: GGG
atgtgctccttgaattataa

SEQ ID NO: 51415 - DNA, 20 bp, Artificial Sequence
  Description of Artificial Sequence: Synthetic oligonucleotide
  Target: SCN9A; (+) strand; PAM type: NRG; PAM sequence: CAG
cttgaattataagggtatct

SEQ ID NO: 51416 - DNA, 20 bp, Artificial Sequence
  Description of Artificial Sequence: Synthetic oligonucleotide
  Target: SCN9A; (+) strand; PAM type: NRG; PAM sequence: TGG
taaatacctgataacatctt

SEQ ID NO: 51417 - DNA, 20 bp, Artificial Sequence
  Description of Artificial Sequence: Synthetic oligonucleotide
  Target: SCN9A; (+) strand; PAM type: NRG; PAM sequence: GAG
aatacctgataacatctttg

SEQ ID NO: 51418 - DNA, 20 bp, Artificial Sequence
  Description of Artificial Sequence: Synthetic oligonucleotide
  Target: SCN9A; (+) strand; PAM type: NRG; PAM sequence: AGG
atacctgataacatctttgg

SEQ ID NO: 51419 - DNA, 20 bp, Artificial Sequence
  Description of Artificial Sequence: Synthetic oligonucleotide
  Target: SCN9A; (+) strand; PAM type: NRG; PAM sequence: AAG
cctgataacatctttggagg

SEQ ID NO: 51420 - DNA, 20 bp, Artificial Sequence
  Description of Artificial Sequence: Synthetic oligonucleotide
  Target: SCN9A; (+) strand; PAM type: NRG; PAM sequence: AGG
ctgataacatctttggagga

SEQ ID NO: 51421 - DNA, 20 bp, Artificial Sequence
  Description of Artificial Sequence: Synthetic oligonucleotide
  Target: SCN9A; (+) strand; PAM type: NRG; PAM sequence: TAG
acatctttggaggaaggaaa

SEQ ID NO: 51422 - DNA, 20 bp, Artificial Sequence
  Description of Artificial Sequence: Synthetic oligonucleotide
  Target: SCN9A; (+) strand; PAM type: NRG; PAM sequence: CAG
ctttggaggaaggaaataga

SEQ ID NO: 51423 - DNA, 20 bp, Artificial Sequence
  Description of Artificial Sequence: Synthetic oligonucleotide
  Target: SCN9A; (+) strand; PAM type: NRG; PAM sequence: TAG
ggaaatagacagctctaccc

SEQ ID NO: 51424 - DNA, 20 bp, Artificial Sequence
  Description of Artificial Sequence: Synthetic oligonucleotide
  Target: SCN9A; (+) strand; PAM type: NRG; PAM sequence: CAG
gacagctctaccctagctgt

SEQ ID NO: 51425 - DNA, 20 bp, Artificial Sequence
  Description of Artificial Sequence: Synthetic oligonucleotide
  Target: SCN9A; (+) strand; PAM type: NRG; PAM sequence: AGG
acagctctaccctagctgtc

SEQ ID NO: 51426 - DNA, 20 bp, Artificial Sequence
  Description of Artificial Sequence: Synthetic oligonucleotide
  Target: SCN9A; (+) strand; PAM type: NRG; PAM sequence: GGG
cagctctaccctagctgtca

SEQ ID NO: 51427 - DNA, 20 bp, Artificial Sequence
  Description of Artificial Sequence: Synthetic oligonucleotide
  Target: SCN9A; (+) strand; PAM type: NRG; PAM sequence: TGG
tataaatttgattcaatcct

SEQ ID NO: 51428 - DNA, 20 bp, Artificial Sequence
  Description of Artificial Sequence: Synthetic oligonucleotide
  Target: SCN9A; (+) strand; PAM type: NRG; PAM sequence: CAG
aaatttgattcaatccttgg

SEQ ID NO: 51429 - DNA, 20 bp, Artificial Sequence
  Description of Artificial Sequence: Synthetic oligonucleotide
  Target: SCN9A; (+) strand; PAM type: NRG; PAM sequence: AGG
aatttgattcaatccttggc

SEQ ID NO: 51430 - DNA, 20 bp, Artificial Sequence
  Description of Artificial Sequence: Synthetic oligonucleotide
  Target: SCN9A; (+) strand; PAM type: NRG; PAM sequence: CAG
aatccttggcaggatgtcta

SEQ ID NO: 51431 - DNA, 20 bp, Artificial Sequence
  Description of Artificial Sequence: Synthetic oligonucleotide
  Target: SCN9A; (+) strand; PAM type: NRG; PAM sequence: AAG
gtctacagcatttatgttcc

SEQ ID NO: 51432 - DNA, 20 bp, Artificial Sequence
  Description of Artificial Sequence: Synthetic oligonucleotide
  Target: SCN9A; (+) strand; PAM type: NRG; PAM sequence: CAG
acagcatttatgttccaagc

SEQ ID NO: 51433 - DNA, 20 bp, Artificial Sequence
  Description of Artificial Sequence: Synthetic oligonucleotide
  Target: SCN9A; (+) strand; PAM type: NRG; PAM sequence: AGG
cagcatttatgttccaagcc

SEQ ID NO: 51434 - DNA, 20 bp, Artificial Sequence
  Description of Artificial Sequence: Synthetic oligonucleotide
  Target: SCN9A; (+) strand; PAM type: NRG; PAM sequence: AAG
ccaagccaggattttgtgtc

SEQ ID NO: 51435 - DNA, 20 bp, Artificial Sequence
  Description of Artificial Sequence: Synthetic oligonucleotide
  Target: SCN9A; (+) strand; PAM type: NRG; PAM sequence: CAG
agaataaatgctacacaaca

SEQ ID NO: 51436 - DNA, 20 bp, Artificial Sequence
  Description of Artificial Sequence: Synthetic oligonucleotide
  Target: SCN9A; (+) strand; PAM type: NRG; PAM sequence: AAG
tacacaacacagaaaatacc

SEQ ID NO: 51437 - DNA, 20 bp, Artificial Sequence
  Description of Artificial Sequence: Synthetic oligonucleotide
  Target: SCN9A; (+) strand; PAM type: NRG; PAM sequence: CAG
caacacagaaaataccaaga

SEQ ID NO: 51438 - DNA, 20 bp, Artificial Sequence
  Description of Artificial Sequence: Synthetic oligonucleotide
  Target: SCN9A; (+) strand; PAM type: NRG; PAM sequence: CAG
cacagaaaataccaagacag

SEQ ID NO: 51439 - DNA, 20 bp, Artificial Sequence
  Description of Artificial Sequence: Synthetic oligonucleotide
  Target: SCN9A; (+) strand; PAM type: NRG; PAM sequence: AGG
acagaaaataccaagacagc

SEQ ID NO: 51440 - DNA, 20 bp, Artificial Sequence
  Description of Artificial Sequence: Synthetic oligonucleotide
  Target: SCN9A; (+) strand; PAM type: NRG; PAM sequence: TGG
caagacagcaggaatgacct

SEQ ID NO: 51441 - DNA, 20 bp, Artificial Sequence
  Description of Artificial Sequence: Synthetic oligonucleotide
  Target: SCN9A; (+) strand; PAM type: NRG; PAM sequence: TAG
ggaatgaccttggactgttc

SEQ ID NO: 51442 - DNA, 20 bp, Artificial Sequence
  Description of Artificial Sequence: Synthetic oligonucleotide
  Target: SCN9A; (+) strand; PAM type: NRG; PAM sequence: AGG
gaatgaccttggactgttct

SEQ ID NO: 51443 - DNA, 20 bp, Artificial Sequence
  Description of Artificial Sequence: Synthetic oligonucleotide
  Target: SCN9A; (+) strand; PAM type: NRG; PAM sequence: AAG
gaccttggactgttctaggc

SEQ ID NO: 51444 - DNA, 20 bp, Artificial Sequence
  Description of Artificial Sequence: Synthetic oligonucleotide
  Target: SCN9A; (+) strand; PAM type: NRG; PAM sequence: TAG
tggactgttctaggcaagct

SEQ ID NO: 51445 - DNA, 20 bp, Artificial Sequence
  Description of Artificial Sequence: Synthetic oligonucleotide
  Target: SCN9A; (+) strand; PAM type: NRG; PAM sequence: GAG
tatatgatgatcttaccatt

SEQ ID NO: 51446 - DNA, 20 bp, Artificial Sequence
  Description of Artificial Sequence: Synthetic oligonucleotide
  Target: SCN9A; (+) strand; PAM type: NRG; PAM sequence: GAG
tatgatgatcttaccattga

SEQ ID NO: 51447 - DNA, 20 bp, Artificial Sequence
  Description of Artificial Sequence: Synthetic oligonucleotide
  Target: SCN9A; (+) strand; PAM type: NRG; PAM sequence: TGG
tcttaccattgagagatcct

SEQ ID NO: 51448 - DNA, 20 bp, Artificial Sequence
  Description of Artificial Sequence: Synthetic oligonucleotide
  Target: SCN9A; (+) strand; PAM type: NRG; PAM sequence: GAG
ttaccattgagagatccttg

SEQ ID NO: 51449 - DNA, 20 bp, Artificial Sequence
  Description of Artificial Sequence: Synthetic oligonucleotide
  Target: SCN9A; (+) strand; PAM type: NRG; PAM sequence: TAG
ttgagagatccttggagaaa

SEQ ID NO: 51450 - DNA, 20 bp, Artificial Sequence
  Description of Artificial Sequence: Synthetic oligonucleotide
  Target: SCN9A; (+) strand; PAM type: NRG; PAM sequence: TAG
tccttggagaaatagccaaa

SEQ ID NO: 51451 - DNA, 20 bp, Artificial Sequence
  Description of Artificial Sequence: Synthetic oligonucleotide
  Target: SCN9A; (+) strand; PAM type: NRG; PAM sequence: AGG
ccttggagaaatagccaaat

SEQ ID NO: 51452 - DNA, 20 bp, Artificial Sequence
  Description of Artificial Sequence: Synthetic oligonucleotide
  Target: SCN9A; (+) strand; PAM type: NRG; PAM sequence: AAG
gaaatagccaaataggaccc

SEQ ID NO: 51453 - DNA, 20 bp, Artificial Sequence
  Description of Artificial Sequence: Synthetic oligonucleotide
  Target: SCN9A; (+) strand; PAM type: NRG; PAM sequence: AGG
aaatagccaaataggaccca

SEQ ID NO: 51454 - DNA, 20 bp, Artificial Sequence
  Description of Artificial Sequence: Synthetic oligonucleotide
  Target: SCN9A; (+) strand; PAM type: NRG; PAM sequence: TGG
ccaaataggacccaaggtcc

SEQ ID NO: 51455 - DNA, 20 bp, Artificial Sequence
  Description of Artificial Sequence: Synthetic oligonucleotide
  Target: SCN9A; (+) strand; PAM type: NRG; PAM sequence: GAG
taatacttttctttttttat

SEQ ID NO: 51456 - DNA, 20 bp, Artificial Sequence
  Description of Artificial Sequence: Synthetic oligonucleotide
  Target: SCN9A; (+) strand; PAM type: NRG; PAM sequence: GAG
atacttttctttttttatga

SEQ ID NO: 51457 - DNA, 20 bp, Artificial Sequence
  Description of Artificial Sequence: Synthetic oligonucleotide
  Target: SCN9A; (+) strand; PAM type: NRG; PAM sequence: TAG
ctttttttatgagagcatat

SEQ ID NO: 51458 - DNA, 20 bp, Artificial Sequence
  Description of Artificial Sequence: Synthetic oligonucleotide
  Target: SCN9A; (+) strand; PAM type: NRG; PAM sequence: AAG
ctactgactattctttatca

SEQ ID NO: 51459 - DNA, 20 bp, Artificial Sequence
  Description of Artificial Sequence: Synthetic oligonucleotide
  Target: SCN9A; (+) strand; PAM type: NRG; PAM sequence: AAG
tgactattctttatcaaagt

SEQ ID NO: 51460 - DNA, 20 bp, Artificial Sequence
  Description of Artificial Sequence: Synthetic oligonucleotide
  Target: SCN9A; (+) strand; PAM type: NRG; PAM sequence: TAG
ttctttatcaaagtaagcca

SEQ ID NO: 51461 - DNA, 20 bp, Artificial Sequence
  Description of Artificial Sequence: Synthetic oligonucleotide
  Target: SCN9A; (+) strand; PAM type: NRG; PAM sequence: AAG
gttattgtgaacttttctga

SEQ ID NO: 51462 - DNA, 20 bp, Artificial Sequence
  Description of Artificial Sequence: Synthetic oligonucleotide
  Target: SCN9A; (+) strand; PAM type: NRG; PAM sequence: TGG
aacttttctgaaagattttg

SEQ ID NO: 51463 - DNA, 20 bp, Artificial Sequence
  Description of Artificial Sequence: Synthetic oligonucleotide
  Target: SCN9A; (+) strand; PAM type: NRG; PAM sequence: CAG
aagattttgtggctgcacaa

SEQ ID NO: 51464 - DNA, 20 bp, Artificial Sequence
  Description of Artificial Sequence: Synthetic oligonucleotide
  Target: SCN9A; (+) strand; PAM type: NRG; PAM sequence: TAG
gtggctgcacaacagtgctg

SEQ ID NO: 51465 - DNA, 20 bp, Artificial Sequence
  Description of Artificial Sequence: Synthetic oligonucleotide
  Target: SCN9A; (+) strand; PAM type: NRG; PAM sequence: AAG
ctgcacaacagtgctgtagt

SEQ ID NO: 51466 - DNA, 20 bp, Artificial Sequence
  Description of Artificial Sequence: Synthetic oligonucleotide
  Target: SCN9A; (+) strand; PAM type: NRG; PAM sequence: CAG
cacaacagtgctgtagtaag

SEQ ID NO: 51467 - DNA, 20 bp, Artificial Sequence
  Description of Artificial Sequence: Synthetic oligonucleotide
  Target: SCN9A; (+) strand; PAM type: NRG; PAM sequence: TAG
agatgtcatatattaatcac

SEQ ID NO: 51468 - DNA, 20 bp, Artificial Sequence
  Description of Artificial Sequence: Synthetic oligonucleotide
  Target: SCN9A; (+) strand; PAM type: NRG; PAM sequence: TGG
atatattaatcactagtgtt

SEQ ID NO: 51469 - DNA, 20 bp, Artificial Sequence
  Description of Artificial Sequence: Synthetic oligonucleotide
  Target: SCN9A; (+) strand; PAM type: NRG; PAM sequence: TAG
actttgcttaaataacatcc

SEQ ID NO: 51470 - DNA, 20 bp, Artificial Sequence
  Description of Artificial Sequence: Synthetic oligonucleotide
  Target: SCN9A; (+) strand; PAM type: NRG; PAM sequence: AGG
ctttgcttaaataacatcct

SEQ ID NO: 51471 - DNA, 20 bp, Artificial Sequence
  Description of Artificial Sequence: Synthetic oligonucleotide
  Target: SCN9A; (+) strand; PAM type: NRG; PAM sequence: GGG
tttgcttaaataacatccta

SEQ ID NO: 51472 - DNA, 20 bp, Artificial Sequence
  Description of Artificial Sequence: Synthetic oligonucleotide
  Target: SCN9A; (+) strand; PAM type: NRG; PAM sequence: GAG
tgcttaaataacatcctagg

SEQ ID NO: 51473 - DNA, 20 bp, Artificial Sequence
  Description of Artificial Sequence: Synthetic oligonucleotide
  Target: SCN9A; (+) strand; PAM type: NRG; PAM sequence: TGG
aataacatcctagggagtct

SEQ ID NO: 51474 - DNA, 20 bp, Artificial Sequence
  Description of Artificial Sequence: Synthetic oligonucleotide
  Target: SCN9A; (+) strand; PAM type: NRG; PAM sequence: GAG
taacatcctagggagtcttg

SEQ ID NO: 51475 - DNA, 20 bp, Artificial Sequence
  Description of Artificial Sequence: Synthetic oligonucleotide
  Target: SCN9A; (+) strand; PAM type: NRG; PAM sequence: GAG
cctagggagtcttggagctt

SEQ ID NO: 51476 - DNA, 20 bp, Artificial Sequence
  Description of Artificial Sequence: Synthetic oligonucleotide
  Target: SCN9A; (+) strand; PAM type: NRG; PAM sequence: CAG
tcttggagcttgagaacatt

SEQ ID NO: 51477 - DNA, 20 bp, Artificial Sequence
  Description of Artificial Sequence: Synthetic oligonucleotide
  Target: SCN9A; (+) strand; PAM type: NRG; PAM sequence: AAG
tgagaacattcagataacta

SEQ ID NO: 51478 - DNA, 20 bp, Artificial Sequence
  Description of Artificial Sequence: Synthetic oligonucleotide
  Target: SCN9A; (+) strand; PAM type: NRG; PAM sequence: AGG
gagaacattcagataactaa

SEQ ID NO: 51479 - DNA, 20 bp, Artificial Sequence
  Description of Artificial Sequence: Synthetic oligonucleotide
  Target: SCN9A; (+) strand; PAM type: NRG; PAM sequence: CAG
taactaaaggttcttgactt

SEQ ID NO: 51480 - DNA, 20 bp, Artificial Sequence
  Description of Artificial Sequence: Synthetic oligonucleotide
  Target: SCN9A; (+) strand; PAM type: NRG; PAM sequence: AGG
aactaaaggttcttgacttc

SEQ ID NO: 51481 - DNA, 20 bp, Artificial Sequence
  Description of Artificial Sequence: Synthetic oligonucleotide
  Target: SCN9A; (+) strand; PAM type: NRG; PAM sequence: AAG
aggttcttgacttcaggctg

SEQ ID NO: 51482 - DNA, 20 bp, Artificial Sequence
  Description of Artificial Sequence: Synthetic oligonucleotide
  Target: SCN9A; (+) strand; PAM type: NRG; PAM sequence: TGG
cttgacttcaggctgaagac

SEQ ID NO: 51483 - DNA, 20 bp, Artificial Sequence
  Description of Artificial Sequence: Synthetic oligonucleotide
  Target: SCN9A; (+) strand; PAM type: NRG; PAM sequence: GGG
ttgacttcaggctgaagact

SEQ ID NO: 51484 - DNA, 20 bp, Artificial Sequence
  Description of Artificial Sequence: Synthetic oligonucleotide
  Target: SCN9A; (+) strand; PAM type: NRG; PAM sequence: TGG
gctgaagactgggaccacta

SEQ ID NO: 51485 - DNA, 20 bp, Artificial Sequence
  Description of Artificial Sequence: Synthetic oligonucleotide
  Target: SCN9A; (+) strand; PAM type: NRG; PAM sequence: GGG
ctgaagactgggaccactat

SEQ ID NO: 51486 - DNA, 20 bp, Artificial Sequence
  Description of Artificial Sequence: Synthetic oligonucleotide
  Target: SCN9A; (+) strand; PAM type: NRG; PAM sequence: TAG
ggttatcttcaaatattgtt

SEQ ID NO: 51487 - DNA, 20 bp, Artificial Sequence
  Description of Artificial Sequence: Synthetic oligonucleotide
  Target: SCN9A; (+) strand; PAM type: NRG; PAM sequence: AAG
ttgcaattaaaattcaatga

SEQ ID NO: 51488 - DNA, 20 bp, Artificial Sequence
  Description of Artificial Sequence: Synthetic oligonucleotide
  Target: SCN9A; (+) strand; PAM type: NRG; PAM sequence: AGG
tgcaattaaaattcaatgaa

SEQ ID NO: 51489 - DNA, 20 bp, Artificial Sequence
  Description of Artificial Sequence: Synthetic oligonucleotide
  Target: SCN9A; (+) strand; PAM type: NRG; PAM sequence: GAG
aacttttcattttctgtctt

SEQ ID NO: 51490 - DNA, 20 bp, Artificial Sequence
  Description of Artificial Sequence: Synthetic oligonucleotide
  Target: SCN9A; (+) strand; PAM type: NRG; PAM sequence: CAG
ttaatattgcgtttatacca

SEQ ID NO: 51491 - DNA, 20 bp, Artificial Sequence
  Description of Artificial Sequence: Synthetic oligonucleotide
  Target: SCN9A; (+) strand; PAM type: NRG; PAM sequence: AAG
atattgcgtttataccacag

SEQ ID NO: 51492 - DNA, 20 bp, Artificial Sequence
  Description of Artificial Sequence: Synthetic oligonucleotide
  Target: SCN9A; (+) strand; PAM type: NRG; PAM sequence: AGG
tattgcgtttataccacaga

SEQ ID NO: 51493 - DNA, 20 bp, Artificial Sequence
  Description of Artificial Sequence: Synthetic oligonucleotide
  Target: SCN9A; (+) strand; PAM type: NRG; PAM sequence: GAG
ttgcgtttataccacagaag

SEQ ID NO: 51494 - DNA, 20 bp, Artificial Sequence
  Description of Artificial Sequence: Synthetic oligonucleotide
  Target: SCN9A; (+) strand; PAM type: NRG; PAM sequence: AGG
tgcgtttataccacagaagg

SEQ ID NO: 51495 - DNA, 20 bp, Artificial Sequence
  Description of Artificial Sequence: Synthetic oligonucleotide
  Target: SCN9A; (+) strand; PAM type: NRG; PAM sequence: CAG
gtttataccacagaaggagg

SEQ ID NO: 51496 - DNA, 20 bp, Artificial Sequence
  Description of Artificial Sequence: Synthetic oligonucleotide
  Target: SCN9A; (+) strand; PAM type: NRG; PAM sequence: TGG
agaaggaggcagctgtaata

SEQ ID NO: 51497 - DNA, 20 bp, Artificial Sequence
  Description of Artificial Sequence: Synthetic oligonucleotide
  Target: SCN9A; (+) strand; PAM type: NRG; PAM sequence: GGG
gaaggaggcagctgtaatat

SEQ ID NO: 51498 - DNA, 20 bp, Artificial Sequence
  Description of Artificial Sequence: Synthetic oligonucleotide
  Target: SCN9A; (+) strand; PAM type: NRG; PAM sequence: CAG
ggaggcagctgtaatatggg

SEQ ID NO: 51499 - DNA, 20 bp, Artificial Sequence
  Description of Artificial Sequence: Synthetic oligonucleotide
  Target: SCN9A; (+) strand; PAM type: NRG; PAM sequence: AAG
gcagctgtaatatgggcaga

SEQ ID NO: 51500 - DNA, 20 bp, Artificial Sequence
  Description of Artificial Sequence: Synthetic oligonucleotide
  Target: SCN9A; (+) strand; PAM type: NRG; PAM sequence: GAG
gtaatatgggcagaaagtat

SEQ ID NO: 51501 - DNA, 20 bp, Artificial Sequence
  Description of Artificial Sequence: Synthetic oligonucleotide
  Target: SCN9A; (+) strand; PAM type: NRG; PAM sequence: AAG
gtatgagtttaaatttttga

SEQ ID NO: 51502 - DNA, 20 bp, Artificial Sequence
  Description of Artificial Sequence: Synthetic oligonucleotide
  Target: SCN9A; (+) strand; PAM type: NRG; PAM sequence: AGG
tatgagtttaaatttttgaa

SEQ ID NO: 51503 - DNA, 20 bp, Artificial Sequence
  Description of Artificial Sequence: Synthetic oligonucleotide
  Target: SCN9A; (+) strand; PAM type: NRG; PAM sequence: AAG
ataaattttcttataaacac

SEQ ID NO: 51504 - DNA, 20 bp, Artificial Sequence
  Description of Artificial Sequence: Synthetic oligonucleotide
  Target: SCN9A; (+) strand; PAM type: NRG; PAM sequence: AGG
taaattttcttataaacaca

SEQ ID NO: 51505 - DNA, 20 bp, Artificial Sequence
  Description of Artificial Sequence: Synthetic oligonucleotide
  Target: SCN9A; (+) strand; PAM type: NRG; PAM sequence: CAG
gtctcactcactctgttgcc

SEQ ID NO: 51506 - DNA, 20 bp, Artificial Sequence
  Description of Artificial Sequence: Synthetic oligonucleotide
  Target: SCN9A; (+) strand; PAM type: NRG; PAM sequence: AGG
tctcactcactctgttgccc

SEQ ID NO: 51507 - DNA, 20 bp, Artificial Sequence
  Description of Artificial Sequence: Synthetic oligonucleotide
  Target: SCN9A; (+) strand; PAM type: NRG; PAM sequence: CAG
tcactctgttgcccaggttg

SEQ ID NO: 51508 - DNA, 20 bp, Artificial Sequence
  Description of Artificial Sequence: Synthetic oligonucleotide
  Target: SCN9A; (+) strand; PAM type: NRG; PAM sequence: CGG
gcagtgcaatactgtgatca

SEQ ID NO: 51509 - DNA, 20 bp, Artificial Sequence
  Description of Artificial Sequence: Synthetic oligonucleotide
  Target: SCN9A; (+) strand; PAM type: NRG; PAM sequence: TGG
atactgtgatcacggctcac

SEQ ID NO: 51510 - DNA, 20 bp, Artificial Sequence
  Description of Artificial Sequence: Synthetic oligonucleotide
  Target: SCN9A; (+) strand; PAM type: NRG; PAM sequence: GAG
actgtgatcacggctcactg

SEQ ID NO: 51511 - DNA, 20 bp, Artificial Sequence
  Description of Artificial Sequence: Synthetic oligonucleotide
  Target: SCN9A; (+) strand; PAM type: NRG; PAM sequence: AAG
agcatcatcctcgtgcactc

SEQ ID NO: 51512 - DNA, 20 bp, Artificial Sequence
  Description of Artificial Sequence: Synthetic oligonucleotide
  Target: SCN9A; (+) strand; PAM type: NRG; PAM sequence: AAG
aagcgacctcccaccttccc

SEQ ID NO: 51513 - DNA, 20 bp, Artificial Sequence
  Description of Artificial Sequence: Synthetic oligonucleotide
  Target: SCN9A; (+) strand; PAM type: NRG; PAM sequence: TAG
cgacctcccaccttcccaag

SEQ ID NO: 51514 - DNA, 20 bp, Artificial Sequence
  Description of Artificial Sequence: Synthetic oligonucleotide
  Target: SCN9A; (+) strand; PAM type: NRG; PAM sequence: TGG
ctcccaccttcccaagtagc

SEQ ID NO: 51515 - DNA, 20 bp, Artificial Sequence
  Description of Artificial Sequence: Synthetic oligonucleotide
  Target: SCN9A; (+) strand; PAM type: NRG; PAM sequence: GGG
tcccaccttcccaagtagct

SEQ ID NO: 51516 - DNA, 20 bp, Artificial Sequence
  Description of Artificial Sequence: Synthetic oligonucleotide
  Target: SCN9A; (+) strand; PAM type: NRG; PAM sequence: CAG
ttcccaagtagctgggacca

SEQ ID NO: 51517 - DNA, 20 bp, Artificial Sequence
  Description of Artificial Sequence: Synthetic oligonucleotide
  Target: SCN9A; (+) strand; PAM type: NRG; PAM sequence: AGG
tcccaagtagctgggaccac

SEQ ID NO: 51518 - DNA, 20 bp, Artificial Sequence
  Description of Artificial Sequence: Synthetic oligonucleotide
  Target: SCN9A; (+) strand; PAM type: NRG; PAM sequence: TGG
acaggtgcgtgccaccatgc

SEQ ID NO: 51519 - DNA, 20 bp, Artificial Sequence
  Description of Artificial Sequence: Synthetic oligonucleotide
  Target: SCN9A; (+) strand; PAM type: NRG; PAM sequence: GGG
caggtgcgtgccaccatgct

SEQ ID NO: 51520 - DNA, 20 bp, Artificial Sequence
  Description of Artificial Sequence: Synthetic oligonucleotide
  Target: SCN9A; (+) strand; PAM type: NRG; PAM sequence: AAG
catgctgggctaatttttta

SEQ ID NO: 51521 - DNA, 20 bp, Artificial Sequence
  Description of Artificial Sequence: Synthetic oligonucleotide
  Target: SCN9A; (+) strand; PAM type: NRG; PAM sequence: TAG
attttttaaagcattttttg

SEQ ID NO: 51522 - DNA, 20 bp, Artificial Sequence
  Description of Artificial Sequence: Synthetic oligonucleotide
  Target: SCN9A; (+) strand; PAM type: NRG; PAM sequence: GAG
tttttaaagcattttttgta

SEQ ID NO: 51523 - DNA, 20 bp, Artificial Sequence
  Description of Artificial Sequence: Synthetic oligonucleotide
  Target: SCN9A; (+) strand; PAM type: NRG; PAM sequence: AAG
aaagcattttttgtagagac

SEQ ID NO: 51524 - DNA, 20 bp, Artificial Sequence
  Description of Artificial Sequence: Synthetic oligonucleotide
  Target: SCN9A; (+) strand; PAM type: NRG; PAM sequence: AGG
aagcattttttgtagagaca

SEQ ID NO: 51525 - DNA, 20 bp, Artificial Sequence
  Description of Artificial Sequence: Synthetic oligonucleotide
  Target: SCN9A; (+) strand; PAM type: NRG; PAM sequence: CAG
caaggtctcaccatgttgcc

SEQ ID NO: 51526 - DNA, 20 bp, Artificial Sequence
  Description of Artificial Sequence: Synthetic oligonucleotide
  Target: SCN9A; (+) strand; PAM type: NRG; PAM sequence: AGG
aaggtctcaccatgttgccc

SEQ ID NO: 51527 - DNA, 20 bp, Artificial Sequence
  Description of Artificial Sequence: Synthetic oligonucleotide
  Target: SCN9A; (+) strand; PAM type: NRG; PAM sequence: TGG
ccaggctcgtcttgaactcc

SEQ ID NO: 51528 - DNA, 20 bp, Artificial Sequence
  Description of Artificial Sequence: Synthetic oligonucleotide
  Target: SCN9A; (+) strand; PAM type: NRG; PAM sequence: GGG
caggctcgtcttgaactcct

SEQ ID NO: 51529 - DNA, 20 bp, Artificial Sequence
  Description of Artificial Sequence: Synthetic oligonucleotide
  Target: SCN9A; (+) strand; PAM type: NRG; PAM sequence: AAG
cgtcttgaactcctgggctc

SEQ ID NO: 51530 - DNA, 20 bp, Artificial Sequence
  Description of Artificial Sequence: Synthetic oligonucleotide
  Target: SCN9A; (+) strand; PAM type: NRG; PAM sequence: TGG
ctcaagtgatctgccctcct

SEQ ID NO: 51531 - DNA, 20 bp, Artificial Sequence
  Description of Artificial Sequence: Synthetic oligonucleotide
  Target: SCN9A; (+) strand; PAM type: NRG; PAM sequence: AAG
ctgccctccttggcctccca

SEQ ID NO: 51532 - DNA, 20 bp, Artificial Sequence
  Description of Artificial Sequence: Synthetic oligonucleotide
  Target: SCN9A; (+) strand; PAM type: NRG; PAM sequence: TGG
tccttggcctcccaaagtgc

SEQ ID NO: 51533 - DNA, 20 bp, Artificial Sequence
  Description of Artificial Sequence: Synthetic oligonucleotide
  Target: SCN9A; (+) strand; PAM type: NRG; PAM sequence: GGG
ccttggcctcccaaagtgct

SEQ ID NO: 51534 - DNA, 20 bp, Artificial Sequence
  Description of Artificial Sequence: Synthetic oligonucleotide
  Target: SCN9A; (+) strand; PAM type: NRG; PAM sequence: GGG
cttggcctcccaaagtgctg

SEQ ID NO: 51535 - DNA, 20 bp, Artificial Sequence
  Description of Artificial Sequence: Synthetic oligonucleotide
  Target: SCN9A; (+) strand; PAM type: NRG; PAM sequence: CAG
ctcccaaagtgctggggtta

SEQ ID NO: 51536 - DNA, 20 bp, Artificial Sequence
  Description of Artificial Sequence: Synthetic oligonucleotide
  Target: SCN9A; (+) strand; PAM type: NRG; PAM sequence: AGG
tcccaaagtgctggggttac

SEQ ID NO: 51537 - DNA, 20 bp, Artificial Sequence
  Description of Artificial Sequence: Synthetic oligonucleotide
  Target: SCN9A; (+) strand; PAM type: NRG; PAM sequence: GAG
ggttacaggcatcaaccact

SEQ ID NO: 51538 - DNA, 20 bp, Artificial Sequence
  Description of Artificial Sequence: Synthetic oligonucleotide
  Target: SCN9A; (+) strand; PAM type: NRG; PAM sequence: TGG
caggcatcaaccactgagcc

SEQ ID NO: 51539 - DNA, 20 bp, Artificial Sequence
  Description of Artificial Sequence: Synthetic oligonucleotide
  Target: SCN9A; (+) strand; PAM type: NRG; PAM sequence: TAG
gttttatcttactcttcccc

SEQ ID NO: 51540 - DNA, 20 bp, Artificial Sequence
  Description of Artificial Sequence: Synthetic oligonucleotide
  Target: SCN9A; (+) strand; PAM type: NRG; PAM sequence: TAG
atcttactcttcccctagtc

SEQ ID NO: 51541 - DNA, 20 bp, Artificial Sequence
  Description of Artificial Sequence: Synthetic oligonucleotide
  Target: SCN9A; (+) strand; PAM type: NRG; PAM sequence: CAG
ctcttcccctagtctagatt

SEQ ID NO: 51542 - DNA, 20 bp, Artificial Sequence
  Description of Artificial Sequence: Synthetic oligonucleotide
  Target: SCN9A; (+) strand; PAM type: NRG; PAM sequence: TGG
tctagattcagtaaaaacaa

SEQ ID NO: 51543 - DNA, 20 bp, Artificial Sequence
  Description of Artificial Sequence: Synthetic oligonucleotide
  Target: SCN9A; (+) strand; PAM type: NRG; PAM sequence: TAG
tggttgtaatttattatatt

SEQ ID NO: 51544 - DNA, 20 bp, Artificial Sequence
  Description of Artificial Sequence: Synthetic oligonucleotide
  Target: SCN9A; (+) strand; PAM type: NRG; PAM sequence: AGG
ggttgtaatttattatattt

SEQ ID NO: 51545 - DNA, 20 bp, Artificial Sequence
  Description of Artificial Sequence: Synthetic oligonucleotide
  Target: SCN9A; (+) strand; PAM type: NRG; PAM sequence: GGG
gttgtaatttattatattta

SEQ ID NO: 51546 - DNA, 20 bp, Artificial Sequence
  Description of Artificial Sequence: Synthetic oligonucleotide
  Target: SCN9A; (+) strand; PAM type: NRG; PAM sequence: AAG
ttaaccaaatctatacactt

SEQ ID NO: 51547 - DNA, 20 bp, Artificial Sequence
  Description of Artificial Sequence: Synthetic oligonucleotide
  Target: SCN9A; (+) strand; PAM type: NRG; PAM sequence: TAG
accaaatctatacacttaag

SEQ ID NO: 51548 - DNA, 20 bp, Artificial Sequence
  Description of Artificial Sequence: Synthetic oligonucleotide
  Target: SCN9A; (+) strand; PAM type: NRG; PAM sequence: GAG
caaatctatacacttaagta

SEQ ID NO: 51549 - DNA, 20 bp, Artificial Sequence
  Description of Artificial Sequence: Synthetic oligonucleotide
  Target: SCN9A; (+) strand; PAM type: NRG; PAM sequence: TGG
cttaagtagagtaaaaacac

SEQ ID NO: 51550 - DNA, 20 bp, Artificial Sequence
  Description of Artificial Sequence: Synthetic oligonucleotide
  Target: SCN9A; (+) strand; PAM type: NRG; PAM sequence: GAG
agagtaaaaacactggaatt

SEQ ID NO: 51551 - DNA, 20 bp, Artificial Sequence
  Description of Artificial Sequence: Synthetic oligonucleotide
  Target: SCN9A; (+) strand; PAM type: NRG; PAM sequence: CAG
taaaaacactggaattgagc

SEQ ID NO: 51552 - DNA, 20 bp, Artificial Sequence
  Description of Artificial Sequence: Synthetic oligonucleotide
  Target: SCN9A; (+) strand; PAM type: NRG; PAM sequence: TAG
taatctttttataatcttat

SEQ ID NO: 51553 - DNA, 20 bp, Artificial Sequence
  Description of Artificial Sequence: Synthetic oligonucleotide
  Target: SCN9A; (+) strand; PAM type: NRG; PAM sequence: CAG
ataatcttattagaaataaa

SEQ ID NO: 51554 - DNA, 20 bp, Artificial Sequence
  Description of Artificial Sequence: Synthetic oligonucleotide
  Target: SCN9A; (+) strand; PAM type: NRG; PAM sequence: CAG
atcttcactatgaatttgtc

SEQ ID NO: 51555 - DNA, 20 bp, Artificial Sequence
  Description of Artificial Sequence: Synthetic oligonucleotide
  Target: SCN9A; (+) strand; PAM type: NRG; PAM sequence: AGG
tcttcactatgaatttgtcc

SEQ ID NO: 51556 - DNA, 20 bp, Artificial Sequence
  Description of Artificial Sequence: Synthetic oligonucleotide
  Target: SCN9A; (+) strand; PAM type: NRG; PAM sequence: AAG
tgtccaggccatttcactaa

SEQ ID NO: 51557 - DNA, 20 bp, Artificial Sequence
  Description of Artificial Sequence: Synthetic oligonucleotide
  Target: SCN9A; (+) strand; PAM type: NRG; PAM sequence: TAG
aggccatttcactaaaagac

SEQ ID NO: 51558 - DNA, 20 bp, Artificial Sequence
  Description of Artificial Sequence: Synthetic oligonucleotide
  Target: SCN9A; (+) strand; PAM type: NRG; PAM sequence: GAG
tttcactaaaagactagcat

SEQ ID NO: 51559 - DNA, 20 bp, Artificial Sequence
  Description of Artificial Sequence: Synthetic oligonucleotide
  Target: SCN9A; (+) strand; PAM type: NRG; PAM sequence: CAG
actaaaagactagcatgagc

SEQ ID NO: 51560 - DNA, 20 bp, Artificial Sequence
  Description of Artificial Sequence: Synthetic oligonucleotide
  Target: SCN9A; (+) strand; PAM type: NRG; PAM sequence: AGG
ctaaaagactagcatgagcc

SEQ ID NO: 51561 - DNA, 20 bp, Artificial Sequence
  Description of Artificial Sequence: Synthetic oligonucleotide
  Target: SCN9A; (+) strand; PAM type: NRG; PAM sequence: CAG
tgagccaggataactctccc

SEQ ID NO: 51562 - DNA, 20 bp, Artificial Sequence
  Description of Artificial Sequence: Synthetic oligonucleotide
  Target: SCN9A; (+) strand; PAM type: NRG; PAM sequence: TAG
gataactctccccagacctc

SEQ ID NO: 51563 - DNA, 20 bp, Artificial Sequence
  Description of Artificial Sequence: Synthetic oligonucleotide
  Target: SCN9A; (+) strand; PAM type: NRG; PAM sequence: TAG
cctctagccctgataactct

SEQ ID NO: 51564 - DNA, 20 bp, Artificial Sequence
  Description of Artificial Sequence: Synthetic oligonucleotide
  Target: SCN9A; (+) strand; PAM type: NRG; PAM sequence: AAG
cttcacatctcattgatact

SEQ ID NO: 51565 - DNA, 20 bp, Artificial Sequence
  Description of Artificial Sequence: Synthetic oligonucleotide
  Target: SCN9A; (+) strand; PAM type: NRG; PAM sequence: AGG
ttcacatctcattgatacta

SEQ ID NO: 51566 - DNA, 20 bp, Artificial Sequence
  Description of Artificial Sequence: Synthetic oligonucleotide
  Target: SCN9A; (+) strand; PAM type: NRG; PAM sequence: GAG
cacatctcattgatactaag

SEQ ID NO: 51567 - DNA, 20 bp, Artificial Sequence
  Description of Artificial Sequence: Synthetic oligonucleotide
  Target: SCN9A; (+) strand; PAM type: NRG; PAM sequence: AAG
actaaggagctttctctaac

SEQ ID NO: 51568 - DNA, 20 bp, Artificial Sequence
  Description of Artificial Sequence: Synthetic oligonucleotide
  Target: SCN9A; (+) strand; PAM type: NRG; PAM sequence: AGG
ctaaggagctttctctaaca

SEQ ID NO: 51569 - DNA, 20 bp, Artificial Sequence
  Description of Artificial Sequence: Synthetic oligonucleotide
  Target: SCN9A; (+) strand; PAM type: NRG; PAM sequence: TAG
agctttctctaacaaggtgc

SEQ ID NO: 51570 - DNA, 20 bp, Artificial Sequence
  Description of Artificial Sequence: Synthetic oligonucleotide
  Target: SCN9A; (+) strand; PAM type: NRG; PAM sequence: AGG
gctttctctaacaaggtgct

SEQ ID NO: 51571 - DNA, 20 bp, Artificial Sequence
  Description of Artificial Sequence: Synthetic oligonucleotide
  Target: SCN9A; (+) strand; PAM type: NRG; PAM sequence: CAG
aactattgtccatgaataca

SEQ ID NO: 51572 - DNA, 20 bp, Artificial Sequence
  Description of Artificial Sequence: Synthetic oligonucleotide
  Target: SCN9A; (+) strand; PAM type: NRG; PAM sequence: TAG
cacagcttcatttaactaat

SEQ ID NO: 51573 - DNA, 20 bp, Artificial Sequence
  Description of Artificial Sequence: Synthetic oligonucleotide
  Target: SCN9A; (+) strand; PAM type: NRG; PAM sequence: TAG
agcttcatttaactaattag

SEQ ID NO: 51574 - DNA, 20 bp, Artificial Sequence
  Description of Artificial Sequence: Synthetic oligonucleotide
  Target: SCN9A; (+) strand; PAM type: NRG; PAM sequence: TGG
ttagtagaattttatgtacc

SEQ ID NO: 51575 - DNA, 20 bp, Artificial Sequence
  Description of Artificial Sequence: Synthetic oligonucleotide
  Target: SCN9A; (+) strand; PAM type: NRG; PAM sequence: GGG
tagtagaattttatgtacct

SEQ ID NO: 51576 - DNA, 20 bp, Artificial Sequence
  Description of Artificial Sequence: Synthetic oligonucleotide
  Target: SCN9A; (+) strand; PAM type: NRG; PAM sequence: AAG
ttatgtacctgggaactttt

SEQ ID NO: 51577 - DNA, 20 bp, Artificial Sequence
  Description of Artificial Sequence: Synthetic oligonucleotide
  Target: SCN9A; (+) strand; PAM type: NRG; PAM sequence: GAG
atgtacctgggaacttttaa

SEQ ID NO: 51578 - DNA, 20 bp, Artificial Sequence
  Description of Artificial Sequence: Synthetic oligonucleotide
  Target: SCN9A; (+) strand; PAM type: NRG; PAM sequence: AAG
ttaagagtatgaaatcctac

SEQ ID NO: 51579 - DNA, 20 bp, Artificial Sequence
  Description of Artificial Sequence: Synthetic oligonucleotide
  Target: SCN9A; (+) strand; PAM type: NRG; PAM sequence: CAG
agagtatgaaatcctacaag

SEQ ID NO: 51580 - DNA, 20 bp, Artificial Sequence
  Description of Artificial Sequence: Synthetic oligonucleotide
  Target: SCN9A; (+) strand; PAM type: NRG; PAM sequence: TAG
tcctacaagcagtgtatctt

SEQ ID NO: 51581 - DNA, 20 bp, Artificial Sequence
  Description of Artificial Sequence: Synthetic oligonucleotide
  Target: SCN9A; (+) strand; PAM type: NRG; PAM sequence: TGG
ctttagcctgtaacattgct

SEQ ID NO: 51582 - DNA, 20 bp, Artificial Sequence
  Description of Artificial Sequence: Synthetic oligonucleotide
  Target: SCN9A; (+) strand; PAM type: NRG; PAM sequence: AAG
ctgtaacattgcttggaaca

SEQ ID NO: 51583 - DNA, 20 bp, Artificial Sequence
  Description of Artificial Sequence: Synthetic oligonucleotide
  Target: SCN9A; (+) strand; PAM type: NRG; PAM sequence: CAG
taacattgcttggaacaaag

SEQ ID NO: 51584 - DNA, 20 bp, Artificial Sequence
  Description of Artificial Sequence: Synthetic oligonucleotide
  Target: SCN9A; (+) strand; PAM type: NRG; PAM sequence: TGG
aacaaagcagacctgtcatt

SEQ ID NO: 51585 - DNA, 20 bp, Artificial Sequence
  Description of Artificial Sequence: Synthetic oligonucleotide
  Target: SCN9A; (+) strand; PAM type: NRG; PAM sequence: TAG
agacctgtcatttggttttg

SEQ ID NO: 51586 - DNA, 20 bp, Artificial Sequence
  Description of Artificial Sequence: Synthetic oligonucleotide
  Target: SCN9A; (+) strand; PAM type: NRG; PAM sequence: TAG
atttggttttgtagcctttg

SEQ ID NO: 51587 - DNA, 20 bp, Artificial Sequence
  Description of Artificial Sequence: Synthetic oligonucleotide
  Target: SCN9A; (+) strand; PAM type: NRG; PAM sequence: TGG
ctttgtagtccctgacactc

SEQ ID NO: 51588 - DNA, 20 bp, Artificial Sequence
  Description of Artificial Sequence: Synthetic oligonucleotide
  Target: SCN9A; (+) strand; PAM type: NRG; PAM sequence: TAG
tccctgacactctggaacat

SEQ ID NO: 51589 - DNA, 20 bp, Artificial Sequence
  Description of Artificial Sequence: Synthetic oligonucleotide
  Target: SCN9A; (+) strand; PAM type: NRG; PAM sequence: GAG
cctgacactctggaacatta

SEQ ID NO: 51590 - DNA, 20 bp, Artificial Sequence
  Description of Artificial Sequence: Synthetic oligonucleotide
  Target: SCN9A; (+) strand; PAM type: NRG; PAM sequence: GAG
tgacactctggaacattaga

SEQ ID NO: 51591 - DNA, 20 bp, Artificial Sequence
  Description of Artificial Sequence: Synthetic oligonucleotide
  Target: SCN9A; (+) strand; PAM type: NRG; PAM sequence: GAG
acactctggaacattagaga

SEQ ID NO: 51592 - DNA, 20 bp, Artificial Sequence
  Description of Artificial Sequence: Synthetic oligonucleotide
  Target: SCN9A; (+) strand; PAM type: NRG; PAM sequence: TAG
agagagtgaaaatattattc

SEQ ID NO: 51593 - DNA, 20 bp, Artificial Sequence
  Description of Artificial Sequence: Synthetic oligonucleotide
  Target: SCN9A; (+) strand; PAM type: NRG; PAM sequence: GAG
agagtgaaaatattattcta

SEQ ID NO: 51594 - DNA, 20 bp, Artificial Sequence
  Description of Artificial Sequence: Synthetic oligonucleotide
  Target: SCN9A; (+) strand; PAM type: NRG; PAM sequence: AAG
gaaaatattattctagagtg

SEQ ID NO: 51595 - DNA, 20 bp, Artificial Sequence
  Description of Artificial Sequence: Synthetic oligonucleotide
  Target: SCN9A; (+) strand; PAM type: NRG; PAM sequence: AGG
aaaatattattctagagtga

SEQ ID NO: 51596 - DNA, 20 bp, Artificial Sequence
  Description of Artificial Sequence: Synthetic oligonucleotide
  Target: SCN9A; (+) strand; PAM type: NRG; PAM sequence: CAG
ggaattctgtgttttcatcc

SEQ ID NO: 51597 - DNA, 20 bp, Artificial Sequence
  Description of Artificial Sequence: Synthetic oligonucleotide
  Target: SCN9A; (+) strand; PAM type: NRG; PAM sequence: TGG
ctgtgttttcatcccagtat

SEQ ID NO: 51598 - DNA, 20 bp, Artificial Sequence
  Description of Artificial Sequence: Synthetic oligonucleotide
  Target: SCN9A; (+) strand; PAM type: NRG; PAM sequence: TGG
tcatcccagtattggttaca

SEQ ID NO: 51599 - DNA, 20 bp, Artificial Sequence
  Description of Artificial Sequence: Synthetic oligonucleotide
  Target: SCN9A; (+) strand; PAM type: NRG; PAM sequence: AAG
catggtttgtttcgtttgtg

SEQ ID NO: 51600 - DNA, 20 bp, Artificial Sequence
  Description of Artificial Sequence: Synthetic oligonucleotide
  Target: SCN9A; (+) strand; PAM type: NRG; PAM sequence: TAG
aattcatcaaactatatttt

SEQ ID NO: 51601 - DNA, 20 bp, Artificial Sequence
  Description of Artificial Sequence: Synthetic oligonucleotide
  Target: SCN9A; (+) strand; PAM type: NRG; PAM sequence: AGG
attcatcaaactatattttt

SEQ ID NO: 51602 - DNA, 20 bp, Artificial Sequence
  Description of Artificial Sequence: Synthetic oligonucleotide
  Target: SCN9A; (+) strand; PAM type: NRG; PAM sequence: AAG
ttttttttaacttttatttt

SEQ ID NO: 51603 - DNA, 20 bp, Artificial Sequence
  Description of Artificial Sequence: Synthetic oligonucleotide
  Target: SCN9A; (+) strand; PAM type: NRG; PAM sequence: CAG
tttaacttttattttaagtt

SEQ ID NO: 51604 - DNA, 20 bp, Artificial Sequence
  Description of Artificial Sequence: Synthetic oligonucleotide
  Target: SCN9A; (+) strand; PAM type: NRG; PAM sequence: AGG
ttaacttttattttaagttc

SEQ ID NO: 51605 - DNA, 20 bp, Artificial Sequence
  Description of Artificial Sequence: Synthetic oligonucleotide
  Target: SCN9A; (+) strand; PAM type: NRG; PAM sequence: GAG
aacttttattttaagttcag

SEQ ID NO: 51606 - DNA, 20 bp, Artificial Sequence
  Description of Artificial Sequence: Synthetic oligonucleotide
  Target: SCN9A; (+) strand; PAM type: NRG; PAM sequence: AAG
tattttaagttcaggagtac

SEQ ID NO: 51607 - DNA, 20 bp, Artificial Sequence
  Description of Artificial Sequence: Synthetic oligonucleotide
  Target: SCN9A; (+) strand; PAM type: NRG; PAM sequence: CAG
taagttcaggagtacaagtc

SEQ ID NO: 51608 - DNA, 20 bp, Artificial Sequence
  Description of Artificial Sequence: Synthetic oligonucleotide
  Target: SCN9A; (+) strand; PAM type: NRG; PAM sequence: AGG
aagttcaggagtacaagtcc

SEQ ID NO: 51609 - DNA, 20 bp, Artificial Sequence
  Description of Artificial Sequence: Synthetic oligonucleotide
  Target: SCN9A; (+) strand; PAM type: NRG; PAM sequence: TAG
acaagtccaggtttgttaca

SEQ ID NO: 51610 - DNA, 20 bp, Artificial Sequence
  Description of Artificial Sequence: Synthetic oligonucleotide
  Target: SCN9A; (+) strand; PAM type: NRG; PAM sequence: AGG
caagtccaggtttgttacat

SEQ ID NO: 51611 - DNA, 20 bp, Artificial Sequence
  Description of Artificial Sequence: Synthetic oligonucleotide
  Target: SCN9A; (+) strand; PAM type: NRG; PAM sequence: TGG
acataggtaaacttgtgtca

SEQ ID NO: 51612 - DNA, 20 bp, Artificial Sequence
  Description of Artificial Sequence: Synthetic oligonucleotide
  Target: SCN9A; (+) strand; PAM type: NRG; PAM sequence: GGG
cataggtaaacttgtgtcat

SEQ ID NO: 51613 - DNA, 20 bp, Artificial Sequence
  Description of Artificial Sequence: Synthetic oligonucleotide
  Target: SCN9A; (+) strand; PAM type: NRG; PAM sequence: GGG
ataggtaaacttgtgtcatg

SEQ ID NO: 51614 - DNA, 20 bp, Artificial Sequence
  Description of Artificial Sequence: Synthetic oligonucleotide
  Target: SCN9A; (+) strand; PAM type: NRG; PAM sequence: GGG
taggtaaacttgtgtcatgg

SEQ ID NO: 51615 - DNA, 20 bp, Artificial Sequence
  Description of Artificial Sequence: Synthetic oligonucleotide
  Target: SCN9A; (+) strand; PAM type: NRG; PAM sequence: CAG
tgtcatgggggtttgtttta

SEQ ID NO: 51616 - DNA, 20 bp, Artificial Sequence
  Description of Artificial Sequence: Synthetic oligonucleotide
  Target: SCN9A; (+) strand; PAM type: NRG; PAM sequence: CAG
ttacagcttatttcatcacc

SEQ ID NO: 51617 - DNA, 20 bp, Artificial Sequence
  Description of Artificial Sequence: Synthetic oligonucleotide
  Target: SCN9A; (+) strand; PAM type: NRG; PAM sequence: AGG
tacagcttatttcatcaccc

SEQ ID NO: 51618 - DNA, 20 bp, Artificial Sequence
  Description of Artificial Sequence: Synthetic oligonucleotide
  Target: SCN9A; (+) strand; PAM type: NRG; PAM sequence: TAG
ttatttcatcacccaggtat

SEQ ID NO: 51619 - DNA, 20 bp, Artificial Sequence
  Description of Artificial Sequence: Synthetic oligonucleotide
  Target: SCN9A; (+) strand; PAM type: NRG; PAM sequence: TAG
catcacccaggtattagacc

SEQ ID NO: 51620 - DNA, 20 bp, Artificial Sequence
  Description of Artificial Sequence: Synthetic oligonucleotide
  Target: SCN9A; (+) strand; PAM type: NRG; PAM sequence: TGG
gtattagacctagtactcat

SEQ ID NO: 51621 - DNA, 20 bp, Artificial Sequence
  Description of Artificial Sequence: Synthetic oligonucleotide
  Target: SCN9A; (+) strand; PAM type: NRG; PAM sequence: AAG
ccaccctctactgtatttga

SEQ ID NO: 51622 - DNA, 20 bp, Artificial Sequence
  Description of Artificial Sequence: Synthetic oligonucleotide
  Target: SCN9A; (+) strand; PAM type: NRG; PAM sequence: AGG
caccctctactgtatttgaa

SEQ ID NO: 51623 - DNA, 20 bp, Artificial Sequence
  Description of Artificial Sequence: Synthetic oligonucleotide
  Target: SCN9A; (+) strand; PAM type: NRG; PAM sequence: CAG
ctactgtatttgaaaggttc

SEQ ID NO: 51624 - DNA, 20 bp, Artificial Sequence
  Description of Artificial Sequence: Synthetic oligonucleotide
  Target: SCN9A; (+) strand; PAM type: NRG; PAM sequence: AAG
cctctatgtgtctcacttat

SEQ ID NO: 51625 - DNA, 20 bp, Artificial Sequence
  Description of Artificial Sequence: Synthetic oligonucleotide
  Target: SCN9A; (+) strand; PAM type: NRG; PAM sequence: GAG
tatgtgtctcacttataagc

SEQ ID NO: 51626 - DNA, 20 bp, Artificial Sequence
  Description of Artificial Sequence: Synthetic oligonucleotide
  Target: SCN9A; (+) strand; PAM type: NRG; PAM sequence: AAG
tgatatatgcatttttattt

SEQ ID NO: 51627 - DNA, 20 bp, Artificial Sequence
  Description of Artificial Sequence: Synthetic oligonucleotide
  Target: SCN9A; (+) strand; PAM type: NRG; PAM sequence: AAG
agtatgttatacttaatgaa

SEQ ID NO: 51628 - DNA, 20 bp, Artificial Sequence
  Description of Artificial Sequence: Synthetic oligonucleotide
  Target: SCN9A; (+) strand; PAM type: NRG; PAM sequence: AAG
atacttaatgaaaagttaaa

SEQ ID NO: 51629 - DNA, 20 bp, Artificial Sequence
  Description of Artificial Sequence: Synthetic oligonucleotide
  Target: SCN9A; (+) strand; PAM type: NRG; PAM sequence: AAG
acttctttttctgaaaactc

SEQ ID NO: 51630 - DNA, 20 bp, Artificial Sequence
  Description of Artificial Sequence: Synthetic oligonucleotide
  Target: SCN9A; (+) strand; PAM type: NRG; PAM sequence: GAG
tttttctgaaaactcaagtt

SEQ ID NO: 51631 - DNA, 20 bp, Artificial Sequence
  Description of Artificial Sequence: Synthetic oligonucleotide
  Target: SCN9A; (+) strand; PAM type: NRG; PAM sequence: GAG
tttctgaaaactcaagttga

SEQ ID NO: 51632 - DNA, 20 bp, Artificial Sequence
  Description of Artificial Sequence: Synthetic oligonucleotide
  Target: SCN9A; (+) strand; PAM type: NRG; PAM sequence: AAG
ttgtactaaaatatacacta

SEQ ID NO: 51633 - DNA, 20 bp, Artificial Sequence
  Description of Artificial Sequence: Synthetic oligonucleotide
  Target: SCN9A; (+) strand; PAM type: NRG; PAM sequence: AGG
tgtactaaaatatacactaa

SEQ ID NO: 51634 - DNA, 20 bp, Artificial Sequence
  Description of Artificial Sequence: Synthetic oligonucleotide
  Target: SCN9A; (+) strand; PAM type: NRG; PAM sequence: AAG
actaaaatatacactaaagg

SEQ ID NO: 51635 - DNA, 20 bp, Artificial Sequence
  Description of Artificial Sequence: Synthetic oligonucleotide
  Target: SCN9A; (+) strand; PAM type: NRG; PAM sequence: TAG
atacactaaaggaagtactt

SEQ ID NO: 51636 - DNA, 20 bp, Artificial Sequence
  Description of Artificial Sequence: Synthetic oligonucleotide
  Target: SCN9A; (+) strand; PAM type: NRG; PAM sequence: AGG
tacactaaaggaagtacttt

SEQ ID NO: 51637 - DNA, 20 bp, Artificial Sequence
  Description of Artificial Sequence: Synthetic oligonucleotide
  Target: SCN9A; (+) strand; PAM type: NRG; PAM sequence: CAG
actaaaggaagtactttagg

SEQ ID NO: 51638 - DNA, 20 bp, Artificial Sequence
  Description of Artificial Sequence: Synthetic oligonucleotide
  Target: SCN9A; (+) strand; PAM type: NRG; PAM sequence: AAG
aaaggaagtactttaggcag

SEQ ID NO: 51639 - DNA, 20 bp, Artificial Sequence
  Description of Artificial Sequence: Synthetic oligonucleotide
  Target: SCN9A; (+) strand; PAM type: NRG; PAM sequence: AGG
aaggaagtactttaggcaga

SEQ ID NO: 51640 - DNA, 20 bp, Artificial Sequence
  Description of Artificial Sequence: Synthetic oligonucleotide
  Target: SCN9A; (+) strand; PAM type: NRG; PAM sequence: AAG
agtactttaggcagaaggaa

SEQ ID NO: 51641 - DNA, 20 bp, Artificial Sequence
  Description of Artificial Sequence: Synthetic oligonucleotide
  Target: SCN9A; (+) strand; PAM type: NRG; PAM sequence: TAG
taggcagaaggaaaagatct

SEQ ID NO: 51642 - DNA, 20 bp, Artificial Sequence
  Description of Artificial Sequence: Synthetic oligonucleotide
  Target: SCN9A; (+) strand; PAM type: NRG; PAM sequence: AAG
aggaaaagatcttagacaaa

SEQ ID NO: 51643 - DNA, 20 bp, Artificial Sequence
  Description of Artificial Sequence: Synthetic oligonucleotide
  Target: SCN9A; (+) strand; PAM type: NRG; PAM sequence: TGG
aagatcttagacaaaaagaa

SEQ ID NO: 51644 - DNA, 20 bp, Artificial Sequence
  Description of Artificial Sequence: Synthetic oligonucleotide
  Target: SCN9A; (+) strand; PAM type: NRG; PAM sequence: CAG
agacaaaaagaatggaaaca

SEQ ID NO: 51645 - DNA, 20 bp, Artificial Sequence
  Description of Artificial Sequence: Synthetic oligonucleotide
  Target: SCN9A; (+) strand; PAM type: NRG; PAM sequence: AAG
aaaaagaatggaaacacagc

SEQ ID NO: 51646 - DNA, 20 bp, Artificial Sequence
  Description of Artificial Sequence: Synthetic oligonucleotide
  Target: SCN9A; (+) strand; PAM type: NRG; PAM sequence: AAG
tggaaacacagcaagaaatg

SEQ ID NO: 51647 - DNA, 20 bp, Artificial Sequence
  Description of Artificial Sequence: Synthetic oligonucleotide
  Target: SCN9A; (+) strand; PAM type: NRG; PAM sequence: TAG
cagcaagaaatgaagaatat

SEQ ID NO: 51648 - DNA, 20 bp, Artificial Sequence
  Description of Artificial Sequence: Synthetic oligonucleotide
  Target: SCN9A; (+) strand; PAM type: NRG; PAM sequence: TAG
agaaatgaagaatattagaa

SEQ ID NO: 51649 - DNA, 20 bp, Artificial Sequence
  Description of Artificial Sequence: Synthetic oligonucleotide
  Target: SCN9A; (+) strand; PAM type: NRG; PAM sequence: AGG
gaaatgaagaatattagaat

SEQ ID NO: 51650 - DNA, 20 bp, Artificial Sequence
  Description of Artificial Sequence: Synthetic oligonucleotide
  Target: SCN9A; (+) strand; PAM type: NRG; PAM sequence: AAG
ataggcgcctgtttacatgt

SEQ ID NO: 51651 - DNA, 20 bp, Artificial Sequence
  Description of Artificial Sequence: Synthetic oligonucleotide
  Target: SCN9A; (+) strand; PAM type: NRG; PAM sequence: AGG
taggcgcctgtttacatgta

SEQ ID NO: 51652 - DNA, 20 bp, Artificial Sequence
  Description of Artificial Sequence: Synthetic oligonucleotide
  Target: SCN9A; (+) strand; PAM type: NRG; PAM sequence: TGG
tgtttacatgtaaggaaaaa

SEQ ID NO: 51653 - DNA, 20 bp, Artificial Sequence
  Description of Artificial Sequence: Synthetic oligonucleotide
  Target: SCN9A; (+) strand; PAM type: NRG; PAM sequence: AAG
aaggaaaaatggactctaca

SEQ ID NO: 51654 - DNA, 20 bp, Artificial Sequence
  Description of Artificial Sequence: Synthetic oligonucleotide
  Target: SCN9A; (+) strand; PAM type: NRG; PAM sequence: AGG
aggaaaaatggactctacaa

SEQ ID NO: 51655 - DNA, 20 bp, Artificial Sequence
  Description of Artificial Sequence: Synthetic oligonucleotide
  Target: SCN9A; (+) strand; PAM type: NRG; PAM sequence: AAG
aggtgaaaaatgactacaca

SEQ ID NO: 51656 - DNA, 20 bp, Artificial Sequence
  Description of Artificial Sequence: Synthetic oligonucleotide
  Target: SCN9A; (+) strand; PAM type: NRG; PAM sequence: AAG
aaatgactacacaaagcaat

SEQ ID NO: 51657 - DNA, 20 bp, Artificial Sequence
  Description of Artificial Sequence: Synthetic oligonucleotide
  Target: SCN9A; (+) strand; PAM type: NRG; PAM sequence: AGG
aatgactacacaaagcaata

SEQ ID NO: 51658 - DNA, 20 bp, Artificial Sequence
  Description of Artificial Sequence: Synthetic oligonucleotide
  Target: SCN9A; (+) strand; PAM type: NRG; PAM sequence: TGG
gcaataaggtttatgtttta

SEQ ID NO: 51659 - DNA, 20 bp, Artificial Sequence
  Description of Artificial Sequence: Synthetic oligonucleotide
  Target: SCN9A; (+) strand; PAM type: NRG; PAM sequence: TAG
ttatggttttcaaaactata

SEQ ID NO: 51660 - DNA, 20 bp, Artificial Sequence
  Description of Artificial Sequence: Synthetic oligonucleotide
  Target: SCN9A; (+) strand; PAM type: NRG; PAM sequence: AGG
tatggttttcaaaactatat

SEQ ID NO: 51661 - DNA, 20 bp, Artificial Sequence
  Description of Artificial Sequence: Synthetic oligonucleotide
  Target: SCN9A; (+) strand; PAM type: NRG; PAM sequence: AAG
tatataggttaaaatgcatt

SEQ ID NO: 51662 - DNA, 20 bp, Artificial Sequence
  Description of Artificial Sequence: Synthetic oligonucleotide
  Target: SCN9A; (+) strand; PAM type: NRG; PAM sequence: TAG
attttgactttcaattattt

SEQ ID NO: 51663 - DNA, 20 bp, Artificial Sequence
  Description of Artificial Sequence: Synthetic oligonucleotide
  Target: SCN9A; (+) strand; PAM type: NRG; PAM sequence: GAG
tattttagtctacaacattt

SEQ ID NO: 51664 - DNA, 20 bp, Artificial Sequence
  Description of Artificial Sequence: Synthetic oligonucleotide
  Target: SCN9A; (+) strand; PAM type: NRG; PAM sequence: TGG
caacatttgagtgatttaat

SEQ ID NO: 51665 - DNA, 20 bp, Artificial Sequence
  Description of Artificial Sequence: Synthetic oligonucleotide
  Target: SCN9A; (+) strand; PAM type: NRG; PAM sequence: AAG
tttgagtgatttaattggta

SEQ ID NO: 51666 - DNA, 20 bp, Artificial Sequence
  Description of Artificial Sequence: Synthetic oligonucleotide
  Target: SCN9A; (+) strand; PAM type: NRG; PAM sequence: CAG
attggtaaagtaattgctct

SEQ ID NO: 51667 - DNA, 20 bp, Artificial Sequence
  Description of Artificial Sequence: Synthetic oligonucleotide
  Target: SCN9A; (+) strand; PAM type: NRG; PAM sequence: AGG
ttggtaaagtaattgctctc

SEQ ID NO: 51668 - DNA, 20 bp, Artificial Sequence
  Description of Artificial Sequence: Synthetic oligonucleotide
  Target: SCN9A; (+) strand; PAM type: NRG; PAM sequence: TAG
aaaattttttctctgttgtg

SEQ ID NO: 51669 - DNA, 20 bp, Artificial Sequence
  Description of Artificial Sequence: Synthetic oligonucleotide
  Target: SCN9A; (+) strand; PAM type: NRG; PAM sequence: TAG
aattcccttaatgtacaata

SEQ ID NO: 51670 - DNA, 20 bp, Artificial Sequence
  Description of Artificial Sequence: Synthetic oligonucleotide
  Target: SCN9A; (+) strand; PAM type: NRG; PAM sequence: AAG
taaaaattatttttttacaa

SEQ ID NO: 51671 - DNA, 20 bp, Artificial Sequence
  Description of Artificial Sequence: Synthetic oligonucleotide
  Target: SCN9A; (+) strand; PAM type: NRG; PAM sequence: TAG
aaattatttttttacaaaag

SEQ ID NO: 51672 - DNA, 20 bp, Artificial Sequence
  Description of Artificial Sequence: Synthetic oligonucleotide
  Target: SCN9A; (+) strand; PAM type: NRG; PAM sequence: AAG
caaaagtagccttattttga

SEQ ID NO: 51673 - DNA, 20 bp, Artificial Sequence
  Description of Artificial Sequence: Synthetic oligonucleotide
  Target: SCN9A; (+) strand; PAM type: NRG; PAM sequence: TAG
accttttaataactgaaaat

SEQ ID NO: 51674 - DNA, 20 bp, Artificial Sequence
  Description of Artificial Sequence: Synthetic oligonucleotide
  Target: SCN9A; (+) strand; PAM type: NRG; PAM sequence: AAG
tttaataactgaaaattaga

SEQ ID NO: 51675 - DNA, 20 bp, Artificial Sequence
  Description of Artificial Sequence: Synthetic oligonucleotide
  Target: SCN9A; (+) strand; PAM type: NRG; PAM sequence: AAG
gaaaattagaaagcgatctt

SEQ ID NO: 51676 - DNA, 20 bp, Artificial Sequence
  Description of Artificial Sequence: Synthetic oligonucleotide
  Target: SCN9A; (+) strand; PAM type: NRG; PAM sequence: CAG
agaaagcgatcttaagtgac

SEQ ID NO: 51677 - DNA, 20 bp, Artificial Sequence
  Description of Artificial Sequence: Synthetic oligonucleotide
  Target: SCN9A; (+) strand; PAM type: NRG; PAM sequence: TAG
atgccatcataataacttgc

SEQ ID NO: 51678 - DNA, 20 bp, Artificial Sequence
  Description of Artificial Sequence: Synthetic oligonucleotide
  Target: SCN9A; (+) strand; PAM type: NRG; PAM sequence: CAG
taacttgctagcacaattaa

SEQ ID NO: 51679 - DNA, 20 bp, Artificial Sequence
  Description of Artificial Sequence: Synthetic oligonucleotide
  Target: SCN9A; (+) strand; PAM type: NRG; PAM sequence: TAG
ctagcacaattaacagaatg

SEQ ID NO: 51680 - DNA, 20 bp, Artificial Sequence
  Description of Artificial Sequence: Synthetic oligonucleotide
  Target: SCN9A; (+) strand; PAM type: NRG; PAM sequence: TGG
acaattaacagaatgtagtt

SEQ ID NO: 51681 - DNA, 20 bp, Artificial Sequence
  Description of Artificial Sequence: Synthetic oligonucleotide
  Target: SCN9A; (+) strand; PAM type: NRG; PAM sequence: AAG
ttttctttattaaactacaa

SEQ ID NO: 51682 - DNA, 20 bp, Artificial Sequence
  Description of Artificial Sequence: Synthetic oligonucleotide
  Target: SCN9A; (+) strand; PAM type: NRG; PAM sequence: AAG
tattaaactacaaaagatta

SEQ ID NO: 51683 - DNA, 20 bp, Artificial Sequence
  Description of Artificial Sequence: Synthetic oligonucleotide
  Target: SCN9A; (+) strand; PAM type: NRG; PAM sequence: CGG
aaaaaatgcctaaatattat

SEQ ID NO: 51684 - DNA, 20 bp, Artificial Sequence
  Description of Artificial Sequence: Synthetic oligonucleotide
  Target: SCN9A; (+) strand; PAM type: NRG; PAM sequence: AAG
caaattaccaaaacaaaatg

SEQ ID NO: 51685 - DNA, 20 bp, Artificial Sequence
  Description of Artificial Sequence: Synthetic oligonucleotide
  Target: SCN9A; (+) strand; PAM type: NRG; PAM sequence: AGG
aaattaccaaaacaaaatga

SEQ ID NO: 51686 - DNA, 20 bp, Artificial Sequence
  Description of Artificial Sequence: Synthetic oligonucleotide
  Target: SCN9A; (+) strand; PAM type: NRG; PAM sequence: TAG
ttaccaaaacaaaatgaagg

SEQ ID NO: 51687 - DNA, 20 bp, Artificial Sequence
  Description of Artificial Sequence: Synthetic oligonucleotide
  Target: SCN9A; (+) strand; PAM type: NRG; PAM sequence: AAG
atgaaggtagtcttgatttt

SEQ ID NO: 51688 - DNA, 20 bp, Artificial Sequence
  Description of Artificial Sequence: Synthetic oligonucleotide
  Target: SCN9A; (+) strand; PAM type: NRG; PAM sequence: AGG
tgaaggtagtcttgatttta

SEQ ID NO: 51689 - DNA, 20 bp, Artificial Sequence
  Description of Artificial Sequence: Synthetic oligonucleotide
  Target: SCN9A; (+) strand; PAM type: NRG; PAM sequence: CAG
gattttaaggtttacccccg

SEQ ID NO: 51690 - DNA, 20 bp, Artificial Sequence
  Description of Artificial Sequence: Synthetic oligonucleotide
  Target: SCN9A; (+) strand; PAM type: NRG; PAM sequence: AAG
ttaaggtttacccccgcagc

SEQ ID NO: 51691 - DNA, 20 bp, Artificial Sequence
  Description of Artificial Sequence: Synthetic oligonucleotide
  Target: SCN9A; (+) strand; PAM type: NRG; PAM sequence: TGG
gcagcaagttatgaaaataa

SEQ ID NO: 51692 - DNA, 20 bp, Artificial Sequence
  Description of Artificial Sequence: Synthetic oligonucleotide
  Target: SCN9A; (+) strand; PAM type: NRG; PAM sequence: TAG
ttatactgatattcctttaa

SEQ ID NO: 51693 - DNA, 20 bp, Artificial Sequence
  Description of Artificial Sequence: Synthetic oligonucleotide
  Target: SCN9A; (+) strand; PAM type: NRG; PAM sequence: AGG
tatactgatattcctttaat

SEQ ID NO: 51694 - DNA, 20 bp, Artificial Sequence
  Description of Artificial Sequence: Synthetic oligonucleotide
  Target: SCN9A; (+) strand; PAM type: NRG; PAM sequence: CAG
tcattttacttactcttcaa

SEQ ID NO: 51695 - DNA, 20 bp, Artificial Sequence
  Description of Artificial Sequence: Synthetic oligonucleotide
  Target: SCN9A; (+) strand; PAM type: NRG; PAM sequence: AAG
acactttattgtgtatattt

SEQ ID NO: 51696 - DNA, 20 bp, Artificial Sequence
  Description of Artificial Sequence: Synthetic oligonucleotide
  Target: SCN9A; (+) strand; PAM type: NRG; PAM sequence: AGG
cactttattgtgtatattta

SEQ ID NO: 51697 - DNA, 20 bp, Artificial Sequence
  Description of Artificial Sequence: Synthetic oligonucleotide
  Target: SCN9A; (+) strand; PAM type: NRG; PAM sequence: TGG
ggtatacaacatgatgctat

SEQ ID NO: 51698 - DNA, 20 bp, Artificial Sequence
  Description of Artificial Sequence: Synthetic oligonucleotide
  Target: SCN9A; (+) strand; PAM type: NRG; PAM sequence: TAG
atgatgctattggatacatg

SEQ ID NO: 51699 - DNA, 20 bp, Artificial Sequence
  Description of Artificial Sequence: Synthetic oligonucleotide
  Target: SCN9A; (+) strand; PAM type: NRG; PAM sequence: TAG
tgctattggatacatgtaga

SEQ ID NO: 51700 - DNA, 20 bp, Artificial Sequence
  Description of Artificial Sequence: Synthetic oligonucleotide
  Target: SCN9A; (+) strand; PAM type: NRG; PAM sequence: AAG
tacatgtagatagtaaaaaa

SEQ ID NO: 51701 - DNA, 20 bp, Artificial Sequence
  Description of Artificial Sequence: Synthetic oligonucleotide
  Target: SCN9A; (+) strand; PAM type: NRG; PAM sequence: AGG
acatgtagatagtaaaaaaa

SEQ ID NO: 51702 - DNA, 20 bp, Artificial Sequence
  Description of Artificial Sequence: Synthetic oligonucleotide
  Target: SCN9A; (+) strand; PAM type: NRG; PAM sequence: TAG
tagtaaaaaaaaggttacca

SEQ ID NO: 51703 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaggttaccatagta

SEQ ID NO: 51704 - DNA, 20 bp, Artificial Sequence
  Description of Artificial Sequence: Synthetic oligonucleotide
  Target: SCN9A; (+) strand; PAM type: NRG; PAM sequence: AGG
aaaaaaggttaccatagtaa

SEQ ID NO: 51705 - DNA, 20 bp, Artificial Sequence
  Description of Artificial Sequence: Synthetic oligonucleotide
  Target: SCN9A; (+) strand; PAM type: NRG; PAM sequence: TAG
attaacatatctaccatctc

SEQ ID NO: 51706 - DNA, 20 bp, Artificial Sequence
  Description of Artificial Sequence: Synthetic oligonucleotide
  Target: SCN9A; (+) strand; PAM type: NRG; PAM sequence: TGG
tttttgttgtttgttattgt

SEQ ID NO: 51707 - DNA, 20 bp, Artificial Sequence
  Description of Artificial Sequence: Synthetic oligonucleotide
  Target: SCN9A; (+) strand; PAM type: NRG; PAM sequence: GGG
ttttgttgtttgttattgtt

SEQ ID NO: 51708 - DNA, 20 bp, Artificial Sequence
  Description of Artificial Sequence: Synthetic oligonucleotide
  Target: SCN9A; (+) strand; PAM type: NRG; PAM sequence: GGG
tttgttgtttgttattgttg

SEQ ID NO: 51709 - DNA, 20 bp, Artificial Sequence
  Description of Artificial Sequence: Synthetic oligonucleotide
  Target: SCN9A; (+) strand; PAM type: NRG; PAM sequence: GGG
ttgttgtttgttattgttgg

SEQ ID NO: 51710 - DNA, 20 bp, Artificial Sequence
  Description of Artificial Sequence: Synthetic oligonucleotide
  Target: SCN9A; (+) strand; PAM type: NRG; PAM sequence: GGG
tgttgtttgttattgttggg

SEQ ID NO: 51711 - DNA, 20 bp, Artificial Sequence
  Description of Artificial Sequence: Synthetic oligonucleotide
  Target: SCN9A; (+) strand; PAM type: NRG; PAM sequence: GGG
gttgtttgttattgttgggg

SEQ ID NO: 51712 - DNA, 20 bp, Artificial Sequence
  Description of Artificial Sequence: Synthetic oligonucleotide
  Target: SCN9A; (+) strand; PAM type: NRG; PAM sequence: GGG
ttgtttgttattgttggggg

SEQ ID NO: 51713 - DNA, 20 bp, Artificial Sequence
  Description of Artificial Sequence: Synthetic oligonucleotide
  Target: SCN9A; (+) strand; PAM type: NRG; PAM sequence: GGG
tgtttgttattgttgggggg

SEQ ID NO: 51714 - DNA, 20 bp, Artificial Sequence
  Description of Artificial Sequence: Synthetic oligonucleotide
  Target: SCN9A; (+) strand; PAM type: NRG; PAM sequence: TGG
ggggggttgttgttgttgtt

SEQ ID NO: 51715 - DNA, 20 bp, Artificial Sequence
  Description of Artificial Sequence: Synthetic oligonucleotide
  Target: SCN9A; (+) strand; PAM type: NRG; PAM sequence: GAG
ggggttgttgttgttgtttg

SEQ ID NO: 51716 - DNA, 20 bp, Artificial Sequence
  Description of Artificial Sequence: Synthetic oligonucleotide
  Target: SCN9A; (+) strand; PAM type: NRG; PAM sequence: AGG
gggttgttgttgttgtttgg

SEQ ID NO: 51717 - DNA, 20 bp, Artificial Sequence
  Description of Artificial Sequence: Synthetic oligonucleotide
  Target: SCN9A; (+) strand; PAM type: NRG; PAM sequence: AAG
tgttgttgttgtttggaggt

SEQ ID NO: 51718 - DNA, 20 bp, Artificial Sequence
  Description of Artificial Sequence: Synthetic oligonucleotide
  Target: SCN9A; (+) strand; PAM type: NRG; PAM sequence: GAG
ttgttgttgtttggaggtaa

SEQ ID NO: 51719 - DNA, 20 bp, Artificial Sequence
  Description of Artificial Sequence: Synthetic oligonucleotide
  Target: SCN9A; (+) strand; PAM type: NRG; PAM sequence: AAG
taagagcaacaaatattttt

SEQ ID NO: 51720 - DNA, 20 bp, Artificial Sequence
  Description of Artificial Sequence: Synthetic oligonucleotide
  Target: SCN9A; (+) strand; PAM type: NRG; PAM sequence: AGG
aagagcaacaaatattttta

SEQ ID NO: 51721 - DNA, 20 bp, Artificial Sequence
  Description of Artificial Sequence: Synthetic oligonucleotide
  Target: SCN9A; (+) strand; PAM type: NRG; PAM sequence: CAG
aacaaatatttttaaggtgc

SEQ ID NO: 51722 - DNA, 20 bp, Artificial Sequence
  Description of Artificial Sequence: Synthetic oligonucleotide
  Target: SCN9A; (+) strand; PAM type: NRG; PAM sequence: AGG
acaaatatttttaaggtgcc

SEQ ID NO: 51723 - DNA, 20 bp, Artificial Sequence
  Description of Artificial Sequence: Synthetic oligonucleotide
  Target: SCN9A; (+) strand; PAM type: NRG; PAM sequence: TGG
tttttaaggtgccaggtgcc

SEQ ID NO: 51724 - DNA, 20 bp, Artificial Sequence
  Description of Artificial Sequence: Synthetic oligonucleotide
  Target: SCN9A; (+) strand; PAM type: NRG; PAM sequence: GGG
ttttaaggtgccaggtgcct

SEQ ID NO: 51725 - DNA, 20 bp, Artificial Sequence
  Description of Artificial Sequence: Synthetic oligonucleotide
  Target: SCN9A; (+) strand; PAM type: NRG; PAM sequence: TAG
gcctgggacacaatactaac

SEQ ID NO: 51726 - DNA, 20 bp, Artificial Sequence
  Description of Artificial Sequence: Synthetic oligonucleotide
  Target: SCN9A; (+) strand; PAM type: NRG; PAM sequence: AGG
cctgggacacaatactaact

SEQ ID NO: 51727 - DNA, 20 bp, Artificial Sequence
  Description of Artificial Sequence: Synthetic oligonucleotide
  Target: SCN9A; (+) strand; PAM type: NRG; PAM sequence: TGG
gggacacaatactaactagg

SEQ ID NO: 51728 - DNA, 20 bp, Artificial Sequence
  Description of Artificial Sequence: Synthetic oligonucleotide
  Target: SCN9A; (+) strand; PAM type: NRG; PAM sequence: TAG
tggccttgatccttgtcctc

SEQ ID NO: 51729 - DNA, 20 bp, Artificial Sequence
  Description of Artificial Sequence: Synthetic oligonucleotide
  Target: SCN9A; (+) strand; PAM type: NRG; PAM sequence: AGG
ggccttgatccttgtcctct

SEQ ID NO: 51730 - DNA, 20 bp, Artificial Sequence
  Description of Artificial Sequence: Synthetic oligonucleotide
  Target: SCN9A; (+) strand; PAM type: NRG; PAM sequence: GGG
gccttgatccttgtcctcta

SEQ ID NO: 51731 - DNA, 20 bp, Artificial Sequence
  Description of Artificial Sequence: Synthetic oligonucleotide
  Target: SCN9A; (+) strand; PAM type: NRG; PAM sequence: CAG
tccttgtcctctagggctta

SEQ ID NO: 51732 - DNA, 20 bp, Artificial Sequence
  Description of Artificial Sequence: Synthetic oligonucleotide
  Target: SCN9A; (+) strand; PAM type: NRG; PAM sequence: TGG
ctctagggcttacagtctgt

SEQ ID NO: 51733 - DNA, 20 bp, Artificial Sequence
  Description of Artificial Sequence: Synthetic oligonucleotide
  Target: SCN9A; (+) strand; PAM type: NRG; PAM sequence: GGG
tctagggcttacagtctgtt

SEQ ID NO: 51734 - DNA, 20 bp, Artificial Sequence
  Description of Artificial Sequence: Synthetic oligonucleotide
  Target: SCN9A; (+) strand; PAM type: NRG; PAM sequence: GGG
ctagggcttacagtctgttg

SEQ ID NO: 51735 - DNA, 20 bp, Artificial Sequence
  Description of Artificial Sequence: Synthetic oligonucleotide
  Target: SCN9A; (+) strand; PAM type: NRG; PAM sequence: CAG
tacagtctgttggggaaaac

SEQ ID NO: 51736 - DNA, 20 bp, Artificial Sequence
  Description of Artificial Sequence: Synthetic oligonucleotide
  Target: SCN9A; (+) strand; PAM type: NRG; PAM sequence: CAG
agtctgttggggaaaaccag

SEQ ID NO: 51737 - DNA, 20 bp, Artificial Sequence
  Description of Artificial Sequence: Synthetic oligonucleotide
  Target: SCN9A; (+) strand; PAM type: NRG; PAM sequence: AGG
gtctgttggggaaaaccagc

SEQ ID NO: 51738 - DNA, 20 bp, Artificial Sequence
  Description of Artificial Sequence: Synthetic oligonucleotide
  Target: SCN9A; (+) strand; PAM type: NRG; PAM sequence: GAG
ttacaacacacctactatat

SEQ ID NO: 51739 - DNA, 20 bp, Artificial Sequence
  Description of Artificial Sequence: Synthetic oligonucleotide
  Target: SCN9A; (+) strand; PAM type: NRG; PAM sequence: GAG
acaacacacctactatatga

SEQ ID NO: 51740 - DNA, 20 bp, Artificial Sequence
  Description of Artificial Sequence: Synthetic oligonucleotide
  Target: SCN9A; (+) strand; PAM type: NRG; PAM sequence: GAG
acctactatatgagagcaat

SEQ ID NO: 51741 - DNA, 20 bp, Artificial Sequence
  Description of Artificial Sequence: Synthetic oligonucleotide
  Target: SCN9A; (+) strand; PAM type: NRG; PAM sequence: CAG
atgagagcaatgagaacaca

SEQ ID NO: 51742 - DNA, 20 bp, Artificial Sequence
  Description of Artificial Sequence: Synthetic oligonucleotide
  Target: SCN9A; (+) strand; PAM type: NRG; PAM sequence: AAG
agcaatgagaacacacagaa

SEQ ID NO: 51743 - DNA, 20 bp, Artificial Sequence
  Description of Artificial Sequence: Synthetic oligonucleotide
  Target: SCN9A; (+) strand; PAM type: NRG; PAM sequence: AGG
gcaatgagaacacacagaaa

SEQ ID NO: 51744 - DNA, 20 bp, Artificial Sequence
  Description of Artificial Sequence: Synthetic oligonucleotide
  Target: SCN9A; (+) strand; PAM type: NRG; PAM sequence: TGG
cacagaaaaggcacctaact

SEQ ID NO: 51745 - DNA, 20 bp, Artificial Sequence
  Description of Artificial Sequence: Synthetic oligonucleotide
  Target: SCN9A; (+) strand; PAM type: NRG; PAM sequence: TAG
aaaggcacctaacttggact

SEQ ID NO: 51746 - DNA, 20 bp, Artificial Sequence
  Description of Artificial Sequence: Synthetic oligonucleotide
  Target: SCN9A; (+) strand; PAM type: NRG; PAM sequence: AGG
aaggcacctaacttggactt

SEQ ID NO: 51747 - DNA, 20 bp, Artificial Sequence
  Description of Artificial Sequence: Synthetic oligonucleotide
  Target: SCN9A; (+) strand; PAM type: NRG; PAM sequence: AAG
gcacctaacttggacttagg

SEQ ID NO: 51748 - DNA, 20 bp, Artificial Sequence
  Description of Artificial Sequence: Synthetic oligonucleotide
  Target: SCN9A; (+) strand; PAM type: NRG; PAM sequence: AAG
ctaacttggacttaggaaga

SEQ ID NO: 51749 - DNA, 20 bp, Artificial Sequence
  Description of Artificial Sequence: Synthetic oligonucleotide
  Target: SCN9A; (+) strand; PAM type: NRG; PAM sequence: TGG
ggacttaggaagaaagattt

SEQ ID NO: 51750 - DNA, 20 bp, Artificial Sequence
  Description of Artificial Sequence: Synthetic oligonucleotide
  Target: SCN9A; (+) strand; PAM type: NRG; PAM sequence: CAG
ttaggaagaaagattttggt

SEQ ID NO: 51751 - DNA, 20 bp, Artificial Sequence
  Description of Artificial Sequence: Synthetic oligonucleotide
  Target: SCN9A; (+) strand; PAM type: NRG; PAM sequence: AGG
taggaagaaagattttggtc

SEQ ID NO: 51752 - DNA, 20 bp, Artificial Sequence
  Description of Artificial Sequence: Synthetic oligonucleotide
  Target: SCN9A; (+) strand; PAM type: NRG; PAM sequence: GGG
aggaagaaagattttggtca

SEQ ID NO: 51753 - DNA, 20 bp, Artificial Sequence
  Description of Artificial Sequence: Synthetic oligonucleotide
  Target: SCN9A; (+) strand; PAM type: NRG; PAM sequence: AAG
aagaaagattttggtcaggg

SEQ ID NO: 51754 - DNA, 20 bp, Artificial Sequence
  Description of Artificial Sequence: Synthetic oligonucleotide
  Target: SCN9A; (+) strand; PAM type: NRG; PAM sequence: AGG
agaaagattttggtcaggga

SEQ ID NO: 51755 - DNA, 20 bp, Artificial Sequence
  Description of Artificial Sequence: Synthetic oligonucleotide
  Target: SCN9A; (+) strand; PAM type: NRG; PAM sequence: AAG
aagattttggtcagggaagg

SEQ ID NO: 51756 - DNA, 20 bp, Artificial Sequence
  Description of Artificial Sequence: Synthetic oligonucleotide
  Target: SCN9A; (+) strand; PAM type: NRG; PAM sequence: GAG
tttggtcagggaaggaagat

SEQ ID NO: 51757 - DNA, 20 bp, Artificial Sequence
  Description of Artificial Sequence: Synthetic oligonucleotide
  Target: SCN9A; (+) strand; PAM type: NRG; PAM sequence: TAG
ggtcagggaaggaagatgag

SEQ ID NO: 51758 - DNA, 20 bp, Artificial Sequence
  Description of Artificial Sequence: Synthetic oligonucleotide
  Target: SCN9A; (+) strand; PAM type: NRG; PAM sequence: TGG
gaagatgagtagaaatttgc

SEQ ID NO: 51759 - DNA, 20 bp, Artificial Sequence
  Description of Artificial Sequence: Synthetic oligonucleotide
  Target: SCN9A; (+) strand; PAM type: NRG; PAM sequence: CAG
tttgctggtctgtactatga

SEQ ID NO: 51760 - DNA, 20 bp, Artificial Sequence
  Description of Artificial Sequence: Synthetic oligonucleotide
  Target: SCN9A; (+) strand; PAM type: NRG; PAM sequence: AGG
ttgctggtctgtactatgac

SEQ ID NO: 51761 - DNA, 20 bp, Artificial Sequence
  Description of Artificial Sequence: Synthetic oligonucleotide
  Target: SCN9A; (+) strand; PAM type: NRG; PAM sequence: CAG
attcctccctcttgtgttaa

SEQ ID NO: 51762 - DNA, 20 bp, Artificial Sequence
  Description of Artificial Sequence: Synthetic oligonucleotide
  Target: SCN9A; (+) strand; PAM type: NRG; PAM sequence: CAG
gttaacagtttgctatgatc

SEQ ID NO: 51763 - DNA, 20 bp, Artificial Sequence
  Description of Artificial Sequence: Synthetic oligonucleotide
  Target: SCN9A; (+) strand; PAM type: NRG; PAM sequence: AGG
ttaacagtttgctatgatcc

SEQ ID NO: 51764 - DNA, 20 bp, Artificial Sequence
  Description of Artificial Sequence: Synthetic oligonucleotide
  Target: SCN9A; (+) strand; PAM type: NRG; PAM sequence: GAG
aacagtttgctatgatccag

SEQ ID NO: 51765 - DNA, 20 bp, Artificial Sequence
  Description of Artificial Sequence: Synthetic oligonucleotide
  Target: SCN9A; (+) strand; PAM type: NRG; PAM sequence: TGG
ggagctgtctccttcatttt

SEQ ID NO: 51766 - DNA, 20 bp, Artificial Sequence
  Description of Artificial Sequence: Synthetic oligonucleotide
  Target: SCN9A; (+) strand; PAM type: NRG; PAM sequence: AAG
tcatttttggctttgtcatc

SEQ ID NO: 51767 - DNA, 20 bp, Artificial Sequence
  Description of Artificial Sequence: Synthetic oligonucleotide
  Target: SCN9A; (+) strand; PAM type: NRG; PAM sequence: AAG
tactctcaacttttccaaac

SEQ ID NO: 51768 - DNA, 20 bp, Artificial Sequence
  Description of Artificial Sequence: Synthetic oligonucleotide
  Target: SCN9A; (+) strand; PAM type: NRG; PAM sequence: TGG
acaagaaaaaaaatcatctt

SEQ ID NO: 51769 - DNA, 20 bp, Artificial Sequence
  Description of Artificial Sequence: Synthetic oligonucleotide
  Target: SCN9A; (+) strand; PAM type: NRG; PAM sequence: TGG
tctttggctttgtccttcga

SEQ ID NO: 51770 - DNA, 20 bp, Artificial Sequence
  Description of Artificial Sequence: Synthetic oligonucleotide
  Target: SCN9A; (+) strand; PAM type: NRG; PAM sequence: TAG
tcgatggaatttgaaatata

SEQ ID NO: 51771 - DNA, 20 bp, Artificial Sequence
  Description of Artificial Sequence: Synthetic oligonucleotide
  Target: SCN9A; (+) strand; PAM type: NRG; PAM sequence: TAG
atatagcttcataaactctc

SEQ ID NO: 51772 - DNA, 20 bp, Artificial Sequence
  Description of Artificial Sequence: Synthetic oligonucleotide
  Target: SCN9A; (+) strand; PAM type: NRG; PAM sequence: TAG
tttctattcctgtacttgtc

SEQ ID NO: 51773 - DNA, 20 bp, Artificial Sequence
  Description of Artificial Sequence: Synthetic oligonucleotide
  Target: SCN9A; (+) strand; PAM type: NRG; PAM sequence: AAG
tattctaattaaaaatttta

SEQ ID NO: 51774 - DNA, 20 bp, Artificial Sequence
  Description of Artificial Sequence: Synthetic oligonucleotide
  Target: SCN9A; (+) strand; PAM type: NRG; PAM sequence: AGG
attctaattaaaaattttaa

SEQ ID NO: 51775 - DNA, 20 bp, Artificial Sequence
  Description of Artificial Sequence: Synthetic oligonucleotide
  Target: SCN9A; (+) strand; PAM type: NRG; PAM sequence: AAG
aaaattttaaaggatgcaca

SEQ ID NO: 51776 - DNA, 20 bp, Artificial Sequence
  Description of Artificial Sequence: Synthetic oligonucleotide
  Target: SCN9A; (+) strand; PAM type: NRG; PAM sequence: AAG
caaagcttattttccttcta

SEQ ID NO: 51777 - DNA, 20 bp, Artificial Sequence
  Description of Artificial Sequence: Synthetic oligonucleotide
  Target: SCN9A; (+) strand; PAM type: NRG; PAM sequence: AGG
aaagcttattttccttctaa

SEQ ID NO: 51778 - DNA, 20 bp, Artificial Sequence
  Description of Artificial Sequence: Synthetic oligonucleotide
  Target: SCN9A; (+) strand; PAM type: NRG; PAM sequence: TGG
atcataacttacttgtattg

SEQ ID NO: 51779 - DNA, 20 bp, Artificial Sequence
  Description of Artificial Sequence: Synthetic oligonucleotide
  Target: SCN9A; (+) strand; PAM type: NRG; PAM sequence: AAG
attgtggataatatcaacca

SEQ ID NO: 51780 - DNA, 20 bp, Artificial Sequence
  Description of Artificial Sequence: Synthetic oligonucleotide
  Target: SCN9A; (+) strand; PAM type: NRG; PAM sequence: CAG
accaaagttcctgcattcta

SEQ ID NO: 51781 - DNA, 20 bp, Artificial Sequence
  Description of Artificial Sequence: Synthetic oligonucleotide
  Target: SCN9A; (+) strand; PAM type: NRG; PAM sequence: AAG
ctacagatttttttaacctc

SEQ ID NO: 51782 - DNA, 20 bp, Artificial Sequence
  Description of Artificial Sequence: Synthetic oligonucleotide
  Target: SCN9A; (+) strand; PAM type: NRG; PAM sequence: CAG
atttttttaacctcaagttc

SEQ ID NO: 51783 - DNA, 20 bp, Artificial Sequence
  Description of Artificial Sequence: Synthetic oligonucleotide
  Target: SCN9A; (+) strand; PAM type: NRG; PAM sequence: AGG
tttttttaacctcaagttcc

SEQ ID NO: 51784 - DNA, 20 bp, Artificial Sequence
  Description of Artificial Sequence: Synthetic oligonucleotide
  Target: SCN9A; (+) strand; PAM type: NRG; PAM sequence: CAG
caagttccaggttaaattcc

SEQ ID NO: 51785 - DNA, 20 bp, Artificial Sequence
  Description of Artificial Sequence: Synthetic oligonucleotide
  Target: SCN9A; (+) strand; PAM type: NRG; PAM sequence: TGG
caggttaaattcccagtttg

SEQ ID NO: 51786 - DNA, 20 bp, Artificial Sequence
  Description of Artificial Sequence: Synthetic oligonucleotide
  Target: SCN9A; (+) strand; PAM type: NRG; PAM sequence: TGG
ttgtggccaattgttatcat

SEQ ID NO: 51787 - DNA, 20 bp, Artificial Sequence
  Description of Artificial Sequence: Synthetic oligonucleotide
  Target: SCN9A; (+) strand; PAM type: NRG; PAM sequence: AAG
ttgttatcattggccatgca

SEQ ID NO: 51788 - DNA, 20 bp, Artificial Sequence
  Description of Artificial Sequence: Synthetic oligonucleotide
  Target: SCN9A; (+) strand; PAM type: NRG; PAM sequence: TAG
ctgtttttcattcccatgct

SEQ ID NO: 51789 - DNA, 20 bp, Artificial Sequence
  Description of Artificial Sequence: Synthetic oligonucleotide
  Target: SCN9A; (+) strand; PAM type: NRG; PAM sequence: AAG
attgtttgtttttatttact

SEQ ID NO: 51790 - DNA, 20 bp, Artificial Sequence
  Description of Artificial Sequence: Synthetic oligonucleotide
  Target: SCN9A; (+) strand; PAM type: NRG; PAM sequence: AAG
ttactaagcactatgattta

SEQ ID NO: 51791 - DNA, 20 bp, Artificial Sequence
  Description of Artificial Sequence: Synthetic oligonucleotide
  Target: SCN9A; (+) strand; PAM type: NRG; PAM sequence: TAG
gcactatgatttaaagtact

SEQ ID NO: 51792 - DNA, 20 bp, Artificial Sequence
  Description of Artificial Sequence: Synthetic oligonucleotide
  Target: SCN9A; (+) strand; PAM type: NRG; PAM sequence: CAG
ctaactactgcataatattc

SEQ ID NO: 51793 - DNA, 20 bp, Artificial Sequence
  Description of Artificial Sequence: Synthetic oligonucleotide
  Target: SCN9A; (+) strand; PAM type: NRG; PAM sequence: CAG
aatattccagtgtatattac

SEQ ID NO: 51794 - DNA, 20 bp, Artificial Sequence
  Description of Artificial Sequence: Synthetic oligonucleotide
  Target: SCN9A; (+) strand; PAM type: NRG; PAM sequence: TAG
attttacctatttgctctct

SEQ ID NO: 51795 - DNA, 20 bp, Artificial Sequence
  Description of Artificial Sequence: Synthetic oligonucleotide
  Target: SCN9A; (+) strand; PAM type: NRG; PAM sequence: TGG
gctctcttagtgataacacc

SEQ ID NO: 51796 - DNA, 20 bp, Artificial Sequence
  Description of Artificial Sequence: Synthetic oligonucleotide
  Target: SCN9A; (+) strand; PAM type: NRG; PAM sequence: CAG
agtgataacacctggcaatc

SEQ ID NO: 51797 - DNA, 20 bp, Artificial Sequence
  Description of Artificial Sequence: Synthetic oligonucleotide
  Target: SCN9A; (+) strand; PAM type: NRG; PAM sequence: CAG
gataacacctggcaatccag

SEQ ID NO: 51798 - DNA, 20 bp, Artificial Sequence
  Description of Artificial Sequence: Synthetic oligonucleotide
  Target: SCN9A; (+) strand; PAM type: NRG; PAM sequence: TGG
ccagcagtccccaaccttct

SEQ ID NO: 51799 - DNA, 20 bp, Artificial Sequence
  Description of Artificial Sequence: Synthetic oligonucleotide
  Target: SCN9A; (+) strand; PAM type: NRG; PAM sequence: AAG
tccccaaccttcttggaacc

SEQ ID NO: 51800 - DNA, 20 bp, Artificial Sequence
  Description of Artificial Sequence: Synthetic oligonucleotide
  Target: SCN9A; (+) strand; PAM type: NRG; PAM sequence: AGG
ccccaaccttcttggaacca

SEQ ID NO: 51801 - DNA, 20 bp, Artificial Sequence
  Description of Artificial Sequence: Synthetic oligonucleotide
  Target: SCN9A; (+) strand; PAM type: NRG; PAM sequence: TGG
accttcttggaaccaaggac

SEQ ID NO: 51802 - DNA, 20 bp, Artificial Sequence
  Description of Artificial Sequence: Synthetic oligonucleotide
  Target: SCN9A; (+) strand; PAM type: NRG; PAM sequence: TGG
ggaaccaaggactggtttca

SEQ ID NO: 51803 - DNA, 20 bp, Artificial Sequence
  Description of Artificial Sequence: Synthetic oligonucleotide
  Target: SCN9A; (+) strand; PAM type: NRG; PAM sequence: AAG
accaaggactggtttcatgg

SEQ ID NO: 51804 - DNA, 20 bp, Artificial Sequence
  Description of Artificial Sequence: Synthetic oligonucleotide
  Target: SCN9A; (+) strand; PAM type: NRG; PAM sequence: CAG
ttcatggaagacaatttttt

SEQ ID NO: 51805 - DNA, 20 bp, Artificial Sequence
  Description of Artificial Sequence: Synthetic oligonucleotide
  Target: SCN9A; (+) strand; PAM type: NRG; PAM sequence: AGG
tcatggaagacaattttttc

SEQ ID NO: 51806 - DNA, 20 bp, Artificial Sequence
  Description of Artificial Sequence: Synthetic oligonucleotide
  Target: SCN9A; (+) strand; PAM type: NRG; PAM sequence: GGG
catggaagacaattttttca

SEQ ID NO: 51807 - DNA, 20 bp, Artificial Sequence
  Description of Artificial Sequence: Synthetic oligonucleotide
  Target: SCN9A; (+) strand; PAM type: NRG; PAM sequence: CAG
ggaagacaattttttcaggg

SEQ ID NO: 51808 - DNA, 20 bp, Artificial Sequence
  Description of Artificial Sequence: Synthetic oligonucleotide
  Target: SCN9A; (+) strand; PAM type: NRG; PAM sequence: CAG
agacaattttttcagggcag

SEQ ID NO: 51809 - DNA, 20 bp, Artificial Sequence
  Description of Artificial Sequence: Synthetic oligonucleotide
  Target: SCN9A; (+) strand; PAM type: NRG; PAM sequence: AGG
gacaattttttcagggcagc

SEQ ID NO: 51810 - DNA, 20 bp, Artificial Sequence
  Description of Artificial Sequence: Synthetic oligonucleotide
  Target: SCN9A; (+) strand; PAM type: NRG; PAM sequence: GGG
acaattttttcagggcagca

SEQ ID NO: 51811 - DNA, 20 bp, Artificial Sequence
  Description of Artificial Sequence: Synthetic oligonucleotide
  Target: SCN9A; (+) strand; PAM type: NRG; PAM sequence: AAG
attttttcagggcagcaggg

SEQ ID NO: 51812 - DNA, 20 bp, Artificial Sequence
  Description of Artificial Sequence: Synthetic oligonucleotide
  Target: SCN9A; (+) strand; PAM type: NRG; PAM sequence: AGG
ttttttcagggcagcaggga

SEQ ID NO: 51813 - DNA, 20 bp, Artificial Sequence
  Description of Artificial Sequence: Synthetic oligonucleotide
  Target: SCN9A; (+) strand; PAM type: NRG; PAM sequence: GAG
ttttcagggcagcagggaag

SEQ ID NO: 51814 - DNA, 20 bp, Artificial Sequence
  Description of Artificial Sequence: Synthetic oligonucleotide
  Target: SCN9A; (+) strand; PAM type: NRG; PAM sequence: AGG
tttcagggcagcagggaagg

SEQ ID NO: 51815 - DNA, 20 bp, Artificial Sequence
  Description of Artificial Sequence: Synthetic oligonucleotide
  Target: SCN9A; (+) strand; PAM type: NRG; PAM sequence: TAG
cagggcagcagggaaggagg

SEQ ID NO: 51816 - DNA, 20 bp, Artificial Sequence
  Description of Artificial Sequence: Synthetic oligonucleotide
  Target: SCN9A; (+) strand; PAM type: NRG; PAM sequence: AGG
agggcagcagggaaggaggt

SEQ ID NO: 51817 - DNA, 20 bp, Artificial Sequence
  Description of Artificial Sequence: Synthetic oligonucleotide
  Target: SCN9A; (+) strand; PAM type: NRG; PAM sequence: TGG
gcagggaaggaggtaggttt

SEQ ID NO: 51818 - DNA, 20 bp, Artificial Sequence
  Description of Artificial Sequence: Synthetic oligonucleotide
  Target: SCN9A; (+) strand; PAM type: NRG; PAM sequence: GGG
cagggaaggaggtaggtttt

SEQ ID NO: 51819 - DNA, 20 bp, Artificial Sequence
  Description of Artificial Sequence: Synthetic oligonucleotide
  Target: SCN9A; (+) strand; PAM type: NRG; PAM sequence: CAG
gggacgaaactattccactt

SEQ ID NO: 51820 - DNA, 20 bp, Artificial Sequence
  Description of Artificial Sequence: Synthetic oligonucleotide
  Target: SCN9A; (+) strand; PAM type: NRG; PAM sequence: CAG
actattccacttcagatgat

SEQ ID NO: 51821 - DNA, 20 bp, Artificial Sequence
  Description of Artificial Sequence: Synthetic oligonucleotide
  Target: SCN9A; (+) strand; PAM type: NRG; PAM sequence: AGG
ctattccacttcagatgatc

SEQ ID NO: 51822 - DNA, 20 bp, Artificial Sequence
  Description of Artificial Sequence: Synthetic oligonucleotide
  Target: SCN9A; (+) strand; PAM type: NRG; PAM sequence: TAG
cacttcagatgatcaggcat

SEQ ID NO: 51823 - DNA, 20 bp, Artificial Sequence
  Description of Artificial Sequence: Synthetic oligonucleotide
  Target: SCN9A; (+) strand; PAM type: NRG; PAM sequence: TAG
tcagatgatcaggcattagt

SEQ ID NO: 51824 - DNA, 20 bp, Artificial Sequence
  Description of Artificial Sequence: Synthetic oligonucleotide
  Target: SCN9A; (+) strand; PAM type: NRG; PAM sequence: GAG
agatgatcaggcattagtta

SEQ ID NO: 51825 - DNA, 20 bp, Artificial Sequence
  Description of Artificial Sequence: Synthetic oligonucleotide
  Target: SCN9A; (+) strand; PAM type: NRG; PAM sequence: AAG
ggcattagttagagtctcat

SEQ ID NO: 51826 - DNA, 20 bp, Artificial Sequence
  Description of Artificial Sequence: Synthetic oligonucleotide
  Target: SCN9A; (+) strand; PAM type: NRG; PAM sequence: AGG
gcattagttagagtctcata

SEQ ID NO: 51827 - DNA, 20 bp, Artificial Sequence
  Description of Artificial Sequence: Synthetic oligonucleotide
  Target: SCN9A; (+) strand; PAM type: NRG; PAM sequence: GAG
attagttagagtctcataag

SEQ ID NO: 51828 - DNA, 20 bp, Artificial Sequence
  Description of Artificial Sequence: Synthetic oligonucleotide
  Target: SCN9A; (+) strand; PAM type: NRG; PAM sequence: TAG
ctcataaggagtgtgcaact

SEQ ID NO: 51829 - DNA, 20 bp, Artificial Sequence
  Description of Artificial Sequence: Synthetic oligonucleotide
  Target: SCN9A; (+) strand; PAM type: NRG; PAM sequence: CAG
acttagatccctcgtatgtg

SEQ ID NO: 51830 - DNA, 20 bp, Artificial Sequence
  Description of Artificial Sequence: Synthetic oligonucleotide
  Target: SCN9A; (+) strand; PAM type: NRG; PAM sequence: AAG
cgtatgtgcagttcacaata

SEQ ID NO: 51831 - DNA, 20 bp, Artificial Sequence
  Description of Artificial Sequence: Synthetic oligonucleotide
  Target: SCN9A; (+) strand; PAM type: NRG; PAM sequence: GAG
aataaagcttgcacttctct

SEQ ID NO: 51832 - DNA, 20 bp, Artificial Sequence
  Description of Artificial Sequence: Synthetic oligonucleotide
  Target: SCN9A; (+) strand; PAM type: NRG; PAM sequence: GAG
taaagcttgcacttctctga

SEQ ID NO: 51833 - DNA, 20 bp, Artificial Sequence
  Description of Artificial Sequence: Synthetic oligonucleotide
  Target: SCN9A; (+) strand; PAM type: NRG; PAM sequence: AAG
ttctctgagagtctaatgcc

SEQ ID NO: 51834 - DNA, 20 bp, Artificial Sequence
  Description of Artificial Sequence: Synthetic oligonucleotide
  Target: SCN9A; (+) strand; PAM type: NRG; PAM sequence: AGG
tctctgagagtctaatgcca

SEQ ID NO: 51835 - DNA, 20 bp, Artificial Sequence
  Description of Artificial Sequence: Synthetic oligonucleotide
  Target: SCN9A; (+) strand; PAM type: NRG; PAM sequence: CAG
taatgccaaggctgatctaa

SEQ ID NO: 51836 - DNA, 20 bp, Artificial Sequence
  Description of Artificial Sequence: Synthetic oligonucleotide
  Target: SCN9A; (+) strand; PAM type: NRG; PAM sequence: AGG
aatgccaaggctgatctaac

SEQ ID NO: 51837 - DNA, 20 bp, Artificial Sequence
  Description of Artificial Sequence: Synthetic oligonucleotide
  Target: SCN9A; (+) strand; PAM type: NRG; PAM sequence: GAG
tgccaaggctgatctaacag

SEQ ID NO: 51838 - DNA, 20 bp, Artificial Sequence
  Description of Artificial Sequence: Synthetic oligonucleotide
  Target: SCN9A; (+) strand; PAM type: NRG; PAM sequence: AGG
gccaaggctgatctaacagg

SEQ ID NO: 51839 - DNA, 20 bp, Artificial Sequence
  Description of Artificial Sequence: Synthetic oligonucleotide
  Target: SCN9A; (+) strand; PAM type: NRG; PAM sequence: AAG
aaggctgatctaacaggagg

SEQ ID NO: 51840 - DNA, 20 bp, Artificial Sequence
  Description of Artificial Sequence: Synthetic oligonucleotide
  Target: SCN9A; (+) strand; PAM type: NRG; PAM sequence: CAG
atctaacaggaggaagaact

SEQ ID NO: 51841 - DNA, 20 bp, Artificial Sequence
  Description of Artificial Sequence: Synthetic oligonucleotide
  Target: SCN9A; (+) strand; PAM type: NRG; PAM sequence: AGG
tctaacaggaggaagaactc

SEQ ID NO: 51842 - DNA, 20 bp, Artificial Sequence
  Description of Artificial Sequence: Synthetic oligonucleotide
  Target: SCN9A; (+) strand; PAM type: NRG; PAM sequence: TGG
aacaggaggaagaactcagg

SEQ ID NO: 51843 - DNA, 20 bp, Artificial Sequence
  Description of Artificial Sequence: Synthetic oligonucleotide
  Target: SCN9A; (+) strand; PAM type: NRG; PAM sequence: TGG
actcaggtggtaatgttcac

SEQ ID NO: 51844 - DNA, 20 bp, Artificial Sequence
  Description of Artificial Sequence: Synthetic oligonucleotide
  Target: SCN9A; (+) strand; PAM type: NRG; PAM sequence: GGG
ctcaggtggtaatgttcact

SEQ ID NO: 51845 - DNA, 20 bp, Artificial Sequence
  Description of Artificial Sequence: Synthetic oligonucleotide
  Target: SCN9A; (+) strand; PAM type: NRG; PAM sequence: CAG
gctgctcacctcctgctgtg

SEQ ID NO: 51846 - DNA, 20 bp, Artificial Sequence
  Description of Artificial Sequence: Synthetic oligonucleotide
  Target: SCN9A; (+) strand; PAM type: NRG; PAM sequence: TGG
tcacctcctgctgtgcagcc

SEQ ID NO: 51847 - DNA, 20 bp, Artificial Sequence
  Description of Artificial Sequence: Synthetic oligonucleotide
  Target: SCN9A; (+) strand; PAM type: NRG; PAM sequence: CAG
ctgtgcagcctggttcctaa

SEQ ID NO: 51848 - DNA, 20 bp, Artificial Sequence
  Description of Artificial Sequence: Synthetic oligonucleotide
  Target: SCN9A; (+) strand; PAM type: NRG; PAM sequence: AGG
tgtgcagcctggttcctaac

SEQ ID NO: 51849 - DNA, 20 bp, Artificial Sequence
  Description of Artificial Sequence: Synthetic oligonucleotide
  Target: SCN9A; (+) strand; PAM type: NRG; PAM sequence: TGG
gcctggttcctaacaggcca

SEQ ID NO: 51850 - DNA, 20 bp, Artificial Sequence
  Description of Artificial Sequence: Synthetic oligonucleotide
  Target: SCN9A; (+) strand; PAM type: NRG; PAM sequence: CAG
gttcctaacaggccatggac

SEQ ID NO: 51851 - DNA, 20 bp, Artificial Sequence
  Description of Artificial Sequence: Synthetic oligonucleotide
  Target: SCN9A; (+) strand; PAM type: NRG; PAM sequence: TGG
catggaccagtatctgtcac

SEQ ID NO: 51852 - DNA, 20 bp, Artificial Sequence
  Description of Artificial Sequence: Synthetic oligonucleotide
  Target: SCN9A; (+) strand; PAM type: NRG; PAM sequence: CAG
accagtatctgtcactggcc

SEQ ID NO: 51853 - DNA, 20 bp, Artificial Sequence
  Description of Artificial Sequence: Synthetic oligonucleotide
  Target: SCN9A; (+) strand; PAM type: NRG; PAM sequence: AGG
ccagtatctgtcactggccc

SEQ ID NO: 51854 - DNA, 20 bp, Artificial Sequence
  Description of Artificial Sequence: Synthetic oligonucleotide
  Target: SCN9A; (+) strand; PAM type: NRG; PAM sequence: GGG
cagtatctgtcactggccca

SEQ ID NO: 51855 - DNA, 20 bp, Artificial Sequence
  Description of Artificial Sequence: Synthetic oligonucleotide
  Target: SCN9A; (+) strand; PAM type: NRG; PAM sequence: GGG
agtatctgtcactggcccag

SEQ ID NO: 51856 - DNA, 20 bp, Artificial Sequence
  Description of Artificial Sequence: Synthetic oligonucleotide
  Target: SCN9A; (+) strand; PAM type: NRG; PAM sequence: TGG
tctgtcactggcccagggga

SEQ ID NO: 51857 - DNA, 20 bp, Artificial Sequence
  Description of Artificial Sequence: Synthetic oligonucleotide
  Target: SCN9A; (+) strand; PAM type: NRG; PAM sequence: TGG
acccctgatctaacccactg

SEQ ID NO: 51858 - DNA, 20 bp, Artificial Sequence
  Description of Artificial Sequence: Synthetic oligonucleotide
  Target: SCN9A; (+) strand; PAM type: NRG; PAM sequence: CAG
aacccactgtggcctataaa

SEQ ID NO: 51859 - DNA, 20 bp, Artificial Sequence
  Description of Artificial Sequence: Synthetic oligonucleotide
  Target: SCN9A; (+) strand; PAM type: NRG; PAM sequence: CAG
ctgtggcctataaacagatc

SEQ ID NO: 51860 - DNA, 20 bp, Artificial Sequence
  Description of Artificial Sequence: Synthetic oligonucleotide
  Target: SCN9A; (+) strand; PAM type: NRG; PAM sequence: AGG
tgtggcctataaacagatcc

SEQ ID NO: 51861 - DNA, 20 bp, Artificial Sequence
  Description of Artificial Sequence: Synthetic oligonucleotide
  Target: SCN9A; (+) strand; PAM type: NRG; PAM sequence: TGG
ataaacagatccaggtttta

SEQ ID NO: 51862 - DNA, 20 bp, Artificial Sequence
  Description of Artificial Sequence: Synthetic oligonucleotide
  Target: SCN9A; (+) strand; PAM type: NRG; PAM sequence: TGG
atccaggttttatggatctg

SEQ ID NO: 51863 - DNA, 20 bp, Artificial Sequence
  Description of Artificial Sequence: Synthetic oligonucleotide
  Target: SCN9A; (+) strand; PAM type: NRG; PAM sequence: TGG
ggatctgtggcttatacaac

SEQ ID NO: 51864 - DNA, 20 bp, Artificial Sequence
  Description of Artificial Sequence: Synthetic oligonucleotide
  Target: SCN9A; (+) strand; PAM type: NRG; PAM sequence: GGG
gatctgtggcttatacaact

SEQ ID NO: 51865 - DNA, 20 bp, Artificial Sequence
  Description of Artificial Sequence: Synthetic oligonucleotide
  Target: SCN9A; (+) strand; PAM type: NRG; PAM sequence: GGG
atctgtggcttatacaactg

SEQ ID NO: 51866 - DNA, 20 bp, Artificial Sequence
  Description of Artificial Sequence: Synthetic oligonucleotide
  Target: SCN9A; (+) strand; PAM type: NRG; PAM sequence: GGG
tctgtggcttatacaactgg

SEQ ID NO: 51867 - DNA, 20 bp, Artificial Sequence
  Description of Artificial Sequence: Synthetic oligonucleotide
  Target: SCN9A; (+) strand; PAM type: NRG; PAM sequence: GAG
tgtggcttatacaactgggg

SEQ ID NO: 51868 - DNA, 20 bp, Artificial Sequence
  Description of Artificial Sequence: Synthetic oligonucleotide
  Target: SCN9A; (+) strand; PAM type: NRG; PAM sequence: AGG
gtggcttatacaactggggg

SEQ ID NO: 51869 - DNA, 20 bp, Artificial Sequence
  Description of Artificial Sequence: Synthetic oligonucleotide
  Target: SCN9A; (+) strand; PAM type: NRG; PAM sequence: GAG
ggcttatacaactgggggag

SEQ ID NO: 51870 - DNA, 20 bp, Artificial Sequence
  Description of Artificial Sequence: Synthetic oligonucleotide
  Target: SCN9A; (+) strand; PAM type: NRG; PAM sequence: AGG
gcttatacaactgggggagg

SEQ ID NO: 51871 - DNA, 20 bp, Artificial Sequence
  Description of Artificial Sequence: Synthetic oligonucleotide
  Target: SCN9A; (+) strand; PAM type: NRG; PAM sequence: GAG
tacaactgggggaggaggtt

SEQ ID NO: 51872 - DNA, 20 bp, Artificial Sequence
  Description of Artificial Sequence: Synthetic oligonucleotide
  Target: SCN9A; (+) strand; PAM type: NRG; PAM sequence: AAG
gagaaaaaatgcaaaaatac

SEQ ID NO: 51873 - DNA, 20 bp, Artificial Sequence
  Description of Artificial Sequence: Synthetic oligonucleotide
  Target: SCN9A; (+) strand; PAM type: NRG; PAM sequence: AGG
agaaaaaatgcaaaaataca

SEQ ID NO: 51874 - DNA, 20 bp, Artificial Sequence
  Description of Artificial Sequence: Synthetic oligonucleotide
  Target: SCN9A; (+) strand; PAM type: NRG; PAM sequence: GGG
gaaaaaatgcaaaaatacaa

SEQ ID NO: 51875 - DNA, 20 bp, Artificial Sequence
  Description of Artificial Sequence: Synthetic oligonucleotide
  Target: SCN9A; (+) strand; PAM type: NRG; PAM sequence: TAG
gcaaaaatacaagggcaaat

SEQ ID NO: 51876 - DNA, 20 bp, Artificial Sequence
  Description of Artificial Sequence: Synthetic oligonucleotide
  Target: SCN9A; (+) strand; PAM type: NRG; PAM sequence: AGG
caaaaatacaagggcaaatt

SEQ ID NO: 51877 - DNA, 20 bp, Artificial Sequence
  Description of Artificial Sequence: Synthetic oligonucleotide
  Target: SCN9A; (+) strand; PAM type: NRG; PAM sequence: AAG
caagggcaaattaggcacaa

SEQ ID NO: 51878 - DNA, 20 bp, Artificial Sequence
  Description of Artificial Sequence: Synthetic oligonucleotide
  Target: SCN9A; (+) strand; PAM type: NRG; PAM sequence: CAG
ggcaaattaggcacaaaaga

SEQ ID NO: 51879 - DNA, 20 bp, Artificial Sequence
  Description of Artificial Sequence: Synthetic oligonucleotide
  Target: SCN9A; (+) strand; PAM type: NRG; PAM sequence: AAG
caaaagacagattaatataa

SEQ ID NO: 51880 - DNA, 20 bp, Artificial Sequence
  Description of Artificial Sequence: Synthetic oligonucleotide
  Target: SCN9A; (+) strand; PAM type: NRG; PAM sequence: AAG
taaaagtgaatgtttattaa

SEQ ID NO: 51881 - DNA, 20 bp, Artificial Sequence
  Description of Artificial Sequence: Synthetic oligonucleotide
  Target: SCN9A; (+) strand; PAM type: NRG; PAM sequence: GAG
agtgaatgtttattaaaagt

SEQ ID NO: 51882 - DNA, 20 bp, Artificial Sequence
  Description of Artificial Sequence: Synthetic oligonucleotide
  Target: SCN9A; (+) strand; PAM type: NRG; PAM sequence: AAG
agtgagaacaaaaattaaat

SEQ ID NO: 51883 - DNA, 20 bp, Artificial Sequence
  Description of Artificial Sequence: Synthetic oligonucleotide
  Target: SCN9A; (+) strand; PAM type: NRG; PAM sequence: TAG
tactccttaacacatttctt

SEQ ID NO: 51884 - DNA, 20 bp, Artificial Sequence
  Description of Artificial Sequence: Synthetic oligonucleotide
  Target: SCN9A; (+) strand; PAM type: NRG; PAM sequence: AGG
actccttaacacatttcttt

SEQ ID NO: 51885 - DNA, 20 bp, Artificial Sequence
  Description of Artificial Sequence: Synthetic oligonucleotide
  Target: SCN9A; (+) strand; PAM type: NRG; PAM sequence: TGG
ttaggacttcccttcatttt

SEQ ID NO: 51886 - DNA, 20 bp, Artificial Sequence
  Description of Artificial Sequence: Synthetic oligonucleotide
  Target: SCN9A; (+) strand; PAM type: NRG; PAM sequence: TGG
actttgtatcaattttgtaa

SEQ ID NO: 51887 - DNA, 20 bp, Artificial Sequence
  Description of Artificial Sequence: Synthetic oligonucleotide
  Target: SCN9A; (+) strand; PAM type: NRG; PAM sequence: GAG
tttgtatcaattttgtaatg

SEQ ID NO: 51888 - DNA, 20 bp, Artificial Sequence
  Description of Artificial Sequence: Synthetic oligonucleotide
  Target: SCN9A; (+) strand; PAM type: NRG; PAM sequence: AAG
gtatcaattttgtaatggag

SEQ ID NO: 51889 - DNA, 20 bp, Artificial Sequence
  Description of Artificial Sequence: Synthetic oligonucleotide
  Target: SCN9A; (+) strand; PAM type: NRG; PAM sequence: TAG
caattttgtaatggagaaga

SEQ ID NO: 51890 - DNA, 20 bp, Artificial Sequence
  Description of Artificial Sequence: Synthetic oligonucleotide
  Target: SCN9A; (+) strand; PAM type: NRG; PAM sequence: TAG
atggagaagatagaaaaatt

SEQ ID NO: 51891 - DNA, 20 bp, Artificial Sequence
  Description of Artificial Sequence: Synthetic oligonucleotide
  Target: SCN9A; (+) strand; PAM type: NRG; PAM sequence: GAG
gtctttcttttaccacaact

SEQ ID NO: 51892 - DNA, 20 bp, Artificial Sequence
  Description of Artificial Sequence: Synthetic oligonucleotide
  Target: SCN9A; (+) strand; PAM type: NRG; PAM sequence: TAG
tcttttaccacaactgagta

SEQ ID NO: 51893 - DNA, 20 bp, Artificial Sequence
  Description of Artificial Sequence: Synthetic oligonucleotide
  Target: SCN9A; (+) strand; PAM type: NRG; PAM sequence: TAG
gtgtgtatgttcattactga

SEQ ID NO: 51894 - DNA, 20 bp, Artificial Sequence
  Description of Artificial Sequence: Synthetic oligonucleotide
  Target: SCN9A; (+) strand; PAM type: NRG; PAM sequence: GAG
tatgttcattactgatagtt

SEQ ID NO: 51895 - DNA, 20 bp, Artificial Sequence
  Description of Artificial Sequence: Synthetic oligonucleotide
  Target: SCN9A; (+) strand; PAM type: NRG; PAM sequence: GAG
atagttgagcaaatttctct

SEQ ID NO: 51896 - DNA, 20 bp, Artificial Sequence
  Description of Artificial Sequence: Synthetic oligonucleotide
  Target: SCN9A; (+) strand; PAM type: NRG; PAM sequence: TGG
tgagttttacaacttgtttt

SEQ ID NO: 51897 - DNA, 20 bp, Artificial Sequence
  Description of Artificial Sequence: Synthetic oligonucleotide
  Target: SCN9A; (+) strand; PAM type: NRG; PAM sequence: TGG
ttacaacttgtttttggtaa

SEQ ID NO: 51898 - DNA, 20 bp, Artificial Sequence
  Description of Artificial Sequence: Synthetic oligonucleotide
  Target: SCN9A; (+) strand; PAM type: NRG; PAM sequence: CAG
ggtaatggcatgaaaatttt

SEQ ID NO: 51899 - DNA, 20 bp, Artificial Sequence
  Description of Artificial Sequence: Synthetic oligonucleotide
  Target: SCN9A; (+) strand; PAM type: NRG; PAM sequence: TGG
ttcagtattactgtcaaatt

SEQ ID NO: 51900 - DNA, 20 bp, Artificial Sequence
  Description of Artificial Sequence: Synthetic oligonucleotide
  Target: SCN9A; (+) strand; PAM type: NRG; PAM sequence: GGG
tcagtattactgtcaaattt

SEQ ID NO: 51901 - DNA, 20 bp, Artificial Sequence
  Description of Artificial Sequence: Synthetic oligonucleotide
  Target: SCN9A; (+) strand; PAM type: NRG; PAM sequence: AAG
aatttgggaacacctccatc

SEQ ID NO: 51902 - DNA, 20 bp, Artificial Sequence
  Description of Artificial Sequence: Synthetic oligonucleotide
  Target: SCN9A; (+) strand; PAM type: NRG; PAM sequence: GAG
atcaagtttctttcacatat

SEQ ID NO: 51903 - DNA, 20 bp, Artificial Sequence
  Description of Artificial Sequence: Synthetic oligonucleotide
  Target: SCN9A; (+) strand; PAM type: NRG; PAM sequence: AAG
ttctttcacatatgagttgt

SEQ ID NO: 51904 - DNA, 20 bp, Artificial Sequence
  Description of Artificial Sequence: Synthetic oligonucleotide
  Target: SCN9A; (+) strand; PAM type: NRG; PAM sequence: CAG
acatatgagttgtaagatat

SEQ ID NO: 51905 - DNA, 20 bp, Artificial Sequence
  Description of Artificial Sequence: Synthetic oligonucleotide
  Target: SCN9A; (+) strand; PAM type: NRG; PAM sequence: GAG
atatgagttgtaagatatca

SEQ ID NO: 51906 - DNA, 20 bp, Artificial Sequence
  Description of Artificial Sequence: Synthetic oligonucleotide
  Target: SCN9A; (+) strand; PAM type: NRG; PAM sequence: CAG
gtaagatatcagagcctgta

SEQ ID NO: 51907 - DNA, 20 bp, Artificial Sequence
  Description of Artificial Sequence: Synthetic oligonucleotide
  Target: SCN9A; (+) strand; PAM type: NRG; PAM sequence: CAG
gcctgtacagtgtccttatt

SEQ ID NO: 51908 - DNA, 20 bp, Artificial Sequence
  Description of Artificial Sequence: Synthetic oligonucleotide
  Target: SCN9A; (+) strand; PAM type: NRG; PAM sequence: AAG
tgtacagtgtccttattcag

SEQ ID NO: 51909 - DNA, 20 bp, Artificial Sequence
  Description of Artificial Sequence: Synthetic oligonucleotide
  Target: SCN9A; (+) strand; PAM type: NRG; PAM sequence: TAG
tgttatcaatatcctcaatg

SEQ ID NO: 51910 - DNA, 20 bp, Artificial Sequence
  Description of Artificial Sequence: Synthetic oligonucleotide
  Target: SCN9A; (+) strand; PAM type: NRG; PAM sequence: AAG
cctcaatgtagtgatgtatg

SEQ ID NO: 51911 - DNA, 20 bp, Artificial Sequence
  Description of Artificial Sequence: Synthetic oligonucleotide
  Target: SCN9A; (+) strand; PAM type: NRG; PAM sequence: GAG
tcaatgtagtgatgtatgaa

SEQ ID NO: 51912 - DNA, 20 bp, Artificial Sequence
  Description of Artificial Sequence: Synthetic oligonucleotide
  Target: SCN9A; (+) strand; PAM type: NRG; PAM sequence: TGG
gtttgttatctcaacatgtt

SEQ ID NO: 51913 - DNA, 20 bp, Artificial Sequence
  Description of Artificial Sequence: Synthetic oligonucleotide
  Target: SCN9A; (+) strand; PAM type: NRG; PAM sequence: TGG
caacatgtttggccatttta

SEQ ID NO: 51914 - DNA, 20 bp, Artificial Sequence
  Description of Artificial Sequence: Synthetic oligonucleotide
  Target: SCN9A; (+) strand; PAM type: NRG; PAM sequence: GAG
ttggccattttatggcaaat

SEQ ID NO: 51915 - DNA, 20 bp, Artificial Sequence
  Description of Artificial Sequence: Synthetic oligonucleotide
  Target: SCN9A; (+) strand; PAM type: NRG; PAM sequence: AAG
ccattttatggcaaatgagc

SEQ ID NO: 51916 - DNA, 20 bp, Artificial Sequence
  Description of Artificial Sequence: Synthetic oligonucleotide
  Target: SCN9A; (+) strand; PAM type: NRG; PAM sequence: TGG
attcactcttctttataaac

SEQ ID NO: 51917 - DNA, 20 bp, Artificial Sequence
  Description of Artificial Sequence: Synthetic oligonucleotide
  Target: SCN9A; (+) strand; PAM type: NRG; PAM sequence: AAG
actggattattacacaatcc

SEQ ID NO: 51918 - DNA, 20 bp, Artificial Sequence
  Description of Artificial Sequence: Synthetic oligonucleotide
  Target: SCN9A; (+) strand; PAM type: NRG; PAM sequence: TAG
caatccaagaatttatttaa

SEQ ID NO: 51919 - DNA, 20 bp, Artificial Sequence
  Description of Artificial Sequence: Synthetic oligonucleotide
  Target: SCN9A; (+) strand; PAM type: NRG; PAM sequence: AAG
aatttatttaatagtgctat

SEQ ID NO: 51920 - DNA, 20 bp, Artificial Sequence
  Description of Artificial Sequence: Synthetic oligonucleotide
  Target: SCN9A; (+) strand; PAM type: NRG; PAM sequence: GAG
tttatttaatagtgctataa

SEQ ID NO: 51921 - DNA, 20 bp, Artificial Sequence
  Description of Artificial Sequence: Synthetic oligonucleotide
  Target: SCN9A; (+) strand; PAM type: NRG; PAM sequence: GAG
ttaatagtgctataagagat

SEQ ID NO: 51922 - DNA, 20 bp, Artificial Sequence
  Description of Artificial Sequence: Synthetic oligonucleotide
  Target: SCN9A; (+) strand; PAM type: NRG; PAM sequence: GAG
agatgagtgtcttcttcttt

SEQ ID NO: 51923 - DNA, 20 bp, Artificial Sequence
  Description of Artificial Sequence: Synthetic oligonucleotide
  Target: SCN9A; (+) strand; PAM type: NRG; PAM sequence: TGG
atactttttacttttgcttc

SEQ ID NO: 51924 - DNA, 20 bp, Artificial Sequence
  Description of Artificial Sequence: Synthetic oligonucleotide
  Target: SCN9A; (+) strand; PAM type: NRG; PAM sequence: TAG
ggtatgacaaaactttgtta

SEQ ID NO: 51925 - DNA, 20 bp, Artificial Sequence
  Description of Artificial Sequence: Synthetic oligonucleotide
  Target: SCN9A; (+) strand; PAM type: NRG; PAM sequence: AAG
catcactactttaatataaa

SEQ ID NO: 51926 - DNA, 20 bp, Artificial Sequence
  Description of Artificial Sequence: Synthetic oligonucleotide
  Target: SCN9A; (+) strand; PAM type: NRG; PAM sequence: AAG
ataaaaagtcaaaaatgaca

SEQ ID NO: 51927 - DNA, 20 bp, Artificial Sequence
  Description of Artificial Sequence: Synthetic oligonucleotide
  Target: SCN9A; (+) strand; PAM type: NRG; PAM sequence: TAG
atccaatcttccttcttatc

SEQ ID NO: 51928 - DNA, 20 bp, Artificial Sequence
  Description of Artificial Sequence: Synthetic oligonucleotide
  Target: SCN9A; (+) strand; PAM type: NRG; PAM sequence: CAG
tccttcttatctagaatgaa

SEQ ID NO: 51929 - DNA, 20 bp, Artificial Sequence
  Description of Artificial Sequence: Synthetic oligonucleotide
  Target: SCN9A; (+) strand; PAM type: NRG; PAM sequence: AGG
ccttcttatctagaatgaac

SEQ ID NO: 51930 - DNA, 20 bp, Artificial Sequence
  Description of Artificial Sequence: Synthetic oligonucleotide
  Target: SCN9A; (+) strand; PAM type: NRG; PAM sequence: TAG
caggtatttcccattgtgtg

SEQ ID NO: 51931 - DNA, 20 bp, Artificial Sequence
  Description of Artificial Sequence: Synthetic oligonucleotide
  Target: SCN9A; (+) strand; PAM type: NRG; PAM sequence: TGG
gtatttcccattgtgtgtag

SEQ ID NO: 51932 - DNA, 20 bp, Artificial Sequence
  Description of Artificial Sequence: Synthetic oligonucleotide
  Target: SCN9A; (+) strand; PAM type: NRG; PAM sequence: TGG
cccattgtgtgtagtggtga

SEQ ID NO: 51933 - DNA, 20 bp, Artificial Sequence
  Description of Artificial Sequence: Synthetic oligonucleotide
  Target: SCN9A; (+) strand; PAM type: NRG; PAM sequence: CAG
tgtgtagtggtgatggaatt

SEQ ID NO: 51934 - DNA, 20 bp, Artificial Sequence
  Description of Artificial Sequence: Synthetic oligonucleotide
  Target: SCN9A; (+) strand; PAM type: NRG; PAM sequence: GAG
tgtagtggtgatggaattca

SEQ ID NO: 51935 - DNA, 20 bp, Artificial Sequence
  Description of Artificial Sequence: Synthetic oligonucleotide
  Target: SCN9A; (+) strand; PAM type: NRG; PAM sequence: TGG
cagagccttgacacctgccg

SEQ ID NO: 51936 - DNA, 20 bp, Artificial Sequence
  Description of Artificial Sequence: Synthetic oligonucleotide
  Target: SCN9A; (+) strand; PAM type: NRG; PAM sequence: AAG
gccttgacacctgccgtgga

SEQ ID NO: 51937 - DNA, 20 bp, Artificial Sequence
  Description of Artificial Sequence: Synthetic oligonucleotide
  Target: SCN9A; (+) strand; PAM type: NRG; PAM sequence: AAG
acacctgccgtggaaagcta

SEQ ID NO: 51938 - DNA, 20 bp, Artificial Sequence
  Description of Artificial Sequence: Synthetic oligonucleotide
  Target: SCN9A; (+) strand; PAM type: NRG; PAM sequence: AAG
gtggaaagctaaagtgacta

SEQ ID NO: 51939 - DNA, 20 bp, Artificial Sequence
  Description of Artificial Sequence: Synthetic oligonucleotide
  Target: SCN9A; (+) strand; PAM type: NRG; PAM sequence: AAG
cattccactcctgttatttt

SEQ ID NO: 51940 - DNA, 20 bp, Artificial Sequence
  Description of Artificial Sequence: Synthetic oligonucleotide
  Target: SCN9A; (+) strand; PAM type: NRG; PAM sequence: TGG
tccactcctgttattttaag

SEQ ID NO: 51941 - DNA, 20 bp, Artificial Sequence
  Description of Artificial Sequence: Synthetic oligonucleotide
  Target: SCN9A; (+) strand; PAM type: NRG; PAM sequence: GAG
ctcctgttattttaagtggt

SEQ ID NO: 51942 - DNA, 20 bp, Artificial Sequence
  Description of Artificial Sequence: Synthetic oligonucleotide
  Target: SCN9A; (+) strand; PAM type: NRG; PAM sequence: AGG
tcctgttattttaagtggtg

SEQ ID NO: 51943 - DNA, 20 bp, Artificial Sequence
  Description of Artificial Sequence: Synthetic oligonucleotide
  Target: SCN9A; (+) strand; PAM type: NRG; PAM sequence: AAG
tggtgaggccatcatctcct

SEQ ID NO: 51944 - DNA, 20 bp, Artificial Sequence
  Description of Artificial Sequence: Synthetic oligonucleotide
  Target: SCN9A; (+) strand; PAM type: NRG; PAM sequence: TGG
atctcctaagcttattcaaa

SEQ ID NO: 51945 - DNA, 20 bp, Artificial Sequence
  Description of Artificial Sequence: Synthetic oligonucleotide
  Target: SCN9A; (+) strand; PAM type: NRG; PAM sequence: TGG
gttgccctttactttgaact

SEQ ID NO: 51946 - DNA, 20 bp, Artificial Sequence
  Description of Artificial Sequence: Synthetic oligonucleotide
  Target: SCN9A; (+) strand; PAM type: NRG; PAM sequence: AAG
tactttgaacttggtgaatg

SEQ ID NO: 51947 - DNA, 20 bp, Artificial Sequence
  Description of Artificial Sequence: Synthetic oligonucleotide
  Target: SCN9A; (+) strand; PAM type: NRG; PAM sequence: AAG
ttggtgaatgaagccaaata

SEQ ID NO: 51948 - DNA, 20 bp, Artificial Sequence
  Description of Artificial Sequence: Synthetic oligonucleotide
  Target: SCN9A; (+) strand; PAM type: NRG; PAM sequence: AGG
tggtgaatgaagccaaataa

SEQ ID NO: 51949 - DNA, 20 bp, Artificial Sequence
  Description of Artificial Sequence: Synthetic oligonucleotide
  Target: SCN9A; (+) strand; PAM type: NRG; PAM sequence: AAG
tgaatgaagccaaataaagg

SEQ ID NO: 51950 - DNA, 20 bp, Artificial Sequence
  Description of Artificial Sequence: Synthetic oligonucleotide
  Target: SCN9A; (+) strand; PAM type: NRG; PAM sequence: TGG
ttattgaaattcccttgtgc

SEQ ID NO: 51951 - DNA, 20 bp, Artificial Sequence
  Description of Artificial Sequence: Synthetic oligonucleotide
  Target: SCN9A; (+) strand; PAM type: NRG; PAM sequence: GGG
tattgaaattcccttgtgct

SEQ ID NO: 51952 - DNA, 20 bp, Artificial Sequence
  Description of Artificial Sequence: Synthetic oligonucleotide
  Target: SCN9A; (+) strand; PAM type: NRG; PAM sequence: CAG
ccttgtgctgggtctatgta

SEQ ID NO: 51953 - DNA, 20 bp, Artificial Sequence
  Description of Artificial Sequence: Synthetic oligonucleotide
  Target: SCN9A; (+) strand; PAM type: NRG; PAM sequence: TAG
gctgggtctatgtacagcta

SEQ ID NO: 51954 - DNA, 20 bp, Artificial Sequence
  Description of Artificial Sequence: Synthetic oligonucleotide
  Target: SCN9A; (+) strand; PAM type: NRG; PAM sequence: TAG
gggtctatgtacagctatag

SEQ ID NO: 51955 - DNA, 20 bp, Artificial Sequence
  Description of Artificial Sequence: Synthetic oligonucleotide
  Target: SCN9A; (+) strand; PAM type: NRG; PAM sequence: TGG
agctatagtagaatcctgtg

SEQ ID NO: 51956 - DNA, 20 bp, Artificial Sequence
  Description of Artificial Sequence: Synthetic oligonucleotide
  Target: SCN9A; (+) strand; PAM type: NRG; PAM sequence: CAG
tatagtagaatcctgtgtgg

SEQ ID NO: 51957 - DNA, 20 bp, Artificial Sequence
  Description of Artificial Sequence: Synthetic oligonucleotide
  Target: SCN9A; (+) strand; PAM type: NRG; PAM sequence: CAG
agtagaatcctgtgtggcag

SEQ ID NO: 51958 - DNA, 20 bp, Artificial Sequence
  Description of Artificial Sequence: Synthetic oligonucleotide
  Target: SCN9A; (+) strand; PAM type: NRG; PAM sequence: CAG
tcctgtgtggcagcagtgac

SEQ ID NO: 51959 - DNA, 20 bp, Artificial Sequence
  Description of Artificial Sequence: Synthetic oligonucleotide
  Target: SCN9A; (+) strand; PAM type: NRG; PAM sequence: TAG
tgtgtggcagcagtgaccag

SEQ ID NO: 51960 - DNA, 20 bp, Artificial Sequence
  Description of Artificial Sequence: Synthetic oligonucleotide
  Target: SCN9A; (+) strand; PAM type: NRG; PAM sequence: TAG
ggcagcagtgaccagtagtc

SEQ ID NO: 51961 - DNA, 20 bp, Artificial Sequence
  Description of Artificial Sequence: Synthetic oligonucleotide
  Target: SCN9A; (+) strand; PAM type: NRG; PAM sequence: CAG
gcagtgaccagtagtctagc

SEQ ID NO: 51962 - DNA, 20 bp, Artificial Sequence
  Description of Artificial Sequence: Synthetic oligonucleotide
  Target: SCN9A; (+) strand; PAM type: NRG; PAM sequence: TGG
tgaccagtagtctagccagc

SEQ ID NO: 51963 - DNA, 20 bp, Artificial Sequence
  Description of Artificial Sequence: Synthetic oligonucleotide
  Target: SCN9A; (+) strand; PAM type: NRG; PAM sequence: GGG
gaccagtagtctagccagct

SEQ ID NO: 51964 - DNA, 20 bp, Artificial Sequence
  Description of Artificial Sequence: Synthetic oligonucleotide
  Target: SCN9A; (+) strand; PAM type: NRG; PAM sequence: CAG
agccagctgggtctgccaaa

SEQ ID NO: 51965 - DNA, 20 bp, Artificial Sequence
  Description of Artificial Sequence: Synthetic oligonucleotide
  Target: SCN9A; (+) strand; PAM type: NRG; PAM sequence: TAG
tgggtctgccaaacagcctc

SEQ ID NO: 51966 - DNA, 20 bp, Artificial Sequence
  Description of Artificial Sequence: Synthetic oligonucleotide
  Target: SCN9A; (+) strand; PAM type: NRG; PAM sequence: CAG
cctctagatttcccttttgt

SEQ ID NO: 51967 - DNA, 20 bp, Artificial Sequence
  Description of Artificial Sequence: Synthetic oligonucleotide
  Target: SCN9A; (+) strand; PAM type: NRG; PAM sequence: CAG
tgtcagctcattttcctata

SEQ ID NO: 51968 - DNA, 20 bp, Artificial Sequence
  Description of Artificial Sequence: Synthetic oligonucleotide
  Target: SCN9A; (+) strand; PAM type: NRG; PAM sequence: TAG
attttcctatacagctgctc

SEQ ID NO: 51969 - DNA, 20 bp, Artificial Sequence
  Description of Artificial Sequence: Synthetic oligonucleotide
  Target: SCN9A; (+) strand; PAM type: NRG; PAM sequence: AAG
acagctgctctagtttccca

SEQ ID NO: 51970 - DNA, 20 bp, Artificial Sequence
  Description of Artificial Sequence: Synthetic oligonucleotide
  Target: SCN9A; (+) strand; PAM type: NRG; PAM sequence: GAG
aagccttccaatgaatgcat

SEQ ID NO: 51971 - DNA, 20 bp, Artificial Sequence
  Description of Artificial Sequence: Synthetic oligonucleotide
  Target: SCN9A; (+) strand; PAM type: NRG; PAM sequence: TGG
acttccaataaatctccatt

SEQ ID NO: 51972 - DNA, 20 bp, Artificial Sequence
  Description of Artificial Sequence: Synthetic oligonucleotide
  Target: SCN9A; (+) strand; PAM type: NRG; PAM sequence: TGG
caataaatctccatttggct

SEQ ID NO: 51973 - DNA, 20 bp, Artificial Sequence
  Description of Artificial Sequence: Synthetic oligonucleotide
  Target: SCN9A; (+) strand; PAM type: NRG; PAM sequence: GGG
aataaatctccatttggctt

SEQ ID NO: 51974 - DNA, 20 bp, Artificial Sequence
  Description of Artificial Sequence: Synthetic oligonucleotide
  Target: SCN9A; (+) strand; PAM type: NRG; PAM sequence: CAG
aatctccatttggcttggga

SEQ ID NO: 51975 - DNA, 20 bp, Artificial Sequence
  Description of Artificial Sequence: Synthetic oligonucleotide
  Target: SCN9A; (+) strand; PAM type: NRG; PAM sequence: CAG
tccatttggcttgggacagc

SEQ ID NO: 51976 - DNA, 20 bp, Artificial Sequence
  Description of Artificial Sequence: Synthetic oligonucleotide
  Target: SCN9A; (+) strand; PAM type: NRG; PAM sequence: GAG
tcaatatctttgcttaatat

SEQ ID NO: 51977 - DNA, 20 bp, Artificial Sequence
  Description of Artificial Sequence: Synthetic oligonucleotide
  Target: SCN9A; (+) strand; PAM type: NRG; PAM sequence: TGG
ttaatatgagaaattacttt

SEQ ID NO: 51978 - DNA, 20 bp, Artificial Sequence
  Description of Artificial Sequence: Synthetic oligonucleotide
  Target: SCN9A; (+) strand; PAM type: NRG; PAM sequence: TGG
attacttttggctcactttg

SEQ ID NO: 51979 - DNA, 20 bp, Artificial Sequence
  Description of Artificial Sequence: Synthetic oligonucleotide
  Target: SCN9A; (+) strand; PAM type: NRG; PAM sequence: GGG
ttacttttggctcactttgt

SEQ ID NO: 51980 - DNA, 20 bp, Artificial Sequence
  Description of Artificial Sequence: Synthetic oligonucleotide
  Target: SCN9A; (+) strand; PAM type: NRG; PAM sequence: TAG
ttggctcactttgtgggaac

SEQ ID NO: 51981 - DNA, 20 bp, Artificial Sequence
  Description of Artificial Sequence: Synthetic oligonucleotide
  Target: SCN9A; (+) strand; PAM type: NRG; PAM sequence: AGG
tggctcactttgtgggaact

SEQ ID NO: 51982 - DNA, 20 bp, Artificial Sequence
  Description of Artificial Sequence: Synthetic oligonucleotide
  Target: SCN9A; (+) strand; PAM type: NRG; PAM sequence: AAG
aactaggttatgaccaaaac

SEQ ID NO: 51983 - DNA, 20 bp, Artificial Sequence
  Description of Artificial Sequence: Synthetic oligonucleotide
  Target: SCN9A; (+) strand; PAM type: NRG; PAM sequence: TGG
tgaccaaaacaagctccttt

SEQ ID NO: 51984 - DNA, 20 bp, Artificial Sequence
  Description of Artificial Sequence: Synthetic oligonucleotide
  Target: SCN9A; (+) strand; PAM type: NRG; PAM sequence: CAG
caagctccttttggctatga

SEQ ID NO: 51985 - DNA, 20 bp, Artificial Sequence
  Description of Artificial Sequence: Synthetic oligonucleotide
  Target: SCN9A; (+) strand; PAM type: NRG; PAM sequence: AAG
ttggctatgacagttttgct

SEQ ID NO: 51986 - DNA, 20 bp, Artificial Sequence
  Description of Artificial Sequence: Synthetic oligonucleotide
  Target: SCN9A; (+) strand; PAM type: NRG; PAM sequence: AAG
acagttttgctaagtgatta

SEQ ID NO: 51987 - DNA, 20 bp, Artificial Sequence
  Description of Artificial Sequence: Synthetic oligonucleotide
  Target: SCN9A; (+) strand; PAM type: NRG; PAM sequence: CAG
gaaaattaatcacttgacct

SEQ ID NO: 51988 - DNA, 20 bp, Artificial Sequence
  Description of Artificial Sequence: Synthetic oligonucleotide
  Target: SCN9A; (+) strand; PAM type: NRG; PAM sequence: AAG
aattaatcacttgacctcag

SEQ ID NO: 51989 - DNA, 20 bp, Artificial Sequence
  Description of Artificial Sequence: Synthetic oligonucleotide
  Target: SCN9A; (+) strand; PAM type: NRG; PAM sequence: TAG
taatcacttgacctcagaag

SEQ ID NO: 51990 - DNA, 20 bp, Artificial Sequence
  Description of Artificial Sequence: Synthetic oligonucleotide
  Target: SCN9A; (+) strand; PAM type: NRG; PAM sequence: AAG
cctcagaagtagtgatttaa

SEQ ID NO: 51991 - DNA, 20 bp, Artificial Sequence
  Description of Artificial Sequence: Synthetic oligonucleotide
  Target: SCN9A; (+) strand; PAM type: NRG; PAM sequence: CAG
gatttaaaagaaacataatg

SEQ ID NO: 51992 - DNA, 20 bp, Artificial Sequence
  Description of Artificial Sequence: Synthetic oligonucleotide
  Target: SCN9A; (+) strand; PAM type: NRG; PAM sequence: CAG
cataatgcagtctgtaaatg

SEQ ID NO: 51993 - DNA, 20 bp, Artificial Sequence
  Description of Artificial Sequence: Synthetic oligonucleotide
  Target: SCN9A; (+) strand; PAM type: NRG; PAM sequence: TAG
ttacttcttatactataaaa

SEQ ID NO: 51994 - DNA, 20 bp, Artificial Sequence
  Description of Artificial Sequence: Synthetic oligonucleotide
  Target: SCN9A; (+) strand; PAM type: NRG; PAM sequence: CAG
taatatttctgcaatatcca

SEQ ID NO: 51995 - DNA, 20 bp, Artificial Sequence
  Description of Artificial Sequence: Synthetic oligonucleotide
  Target: SCN9A; (+) strand; PAM type: NRG; PAM sequence: TGG
acagtccaaaacttttattt

SEQ ID NO: 51996 - DNA, 20 bp, Artificial Sequence
  Description of Artificial Sequence: Synthetic oligonucleotide
  Target: SCN9A; (+) strand; PAM type: NRG; PAM sequence: AAG
caaaacttttattttggact

SEQ ID NO: 51997 - DNA, 20 bp, Artificial Sequence
  Description of Artificial Sequence: Synthetic oligonucleotide
  Target: SCN9A; (+) strand; PAM type: NRG; PAM sequence: TAG
atcttctacactattattct

SEQ ID NO: 51998 - DNA, 20 bp, Artificial Sequence
  Description of Artificial Sequence: Synthetic oligonucleotide
  Target: SCN9A; (+) strand; PAM type: NRG; PAM sequence: CAG
agtttttaaaaatgaaatca

SEQ ID NO: 51999 - DNA, 20 bp, Artificial Sequence
  Description of Artificial Sequence: Synthetic oligonucleotide
  Target: SCN9A; (+) strand; PAM type: NRG; PAM sequence: AAG
gatgtaaatataacaaaacc

SEQ ID NO: 52000 - DNA, 20 bp, Artificial Sequence
  Description of Artificial Sequence: Synthetic oligonucleotide
  Target: SCN9A; (+) strand; PAM type: NRG; PAM sequence: CAG
caagccattatttaatcttg

SEQ ID NO: 52001 - DNA, 20 bp, Artificial Sequence
  Description of Artificial Sequence: Synthetic oligonucleotide
  Target: SCN9A; (+) strand; PAM type: NRG; PAM sequence: AGG
aagccattatttaatcttgc

SEQ ID NO: 52002 - DNA, 20 bp, Artificial Sequence
  Description of Artificial Sequence: Synthetic oligonucleotide
  Target: SCN9A; (+) strand; PAM type: NRG; PAM sequence: AAG
atttaatcttgcaggaccat

SEQ ID NO: 52003 - DNA, 20 bp, Artificial Sequence
  Description of Artificial Sequence: Synthetic oligonucleotide
  Target: SCN9A; (+) strand; PAM type: NRG; PAM sequence: AAG
caggaccataagccttccat

SEQ ID NO: 52004 - DNA, 20 bp, Artificial Sequence
  Description of Artificial Sequence: Synthetic oligonucleotide
  Target: SCN9A; (+) strand; PAM type: NRG; PAM sequence: AAG
tcaaaaatatttttgtcctc

SEQ ID NO: 52005 - DNA, 20 bp, Artificial Sequence
  Description of Artificial Sequence: Synthetic oligonucleotide
  Target: SCN9A; (+) strand; PAM type: NRG; PAM sequence: TGG
tttttgtcctcaagaaaata

SEQ ID NO: 52006 - DNA, 20 bp, Artificial Sequence
  Description of Artificial Sequence: Synthetic oligonucleotide
  Target: SCN9A; (+) strand; PAM type: NRG; PAM sequence: AAG
caagaaaatatggcaaatcc

SEQ ID NO: 52007 - DNA, 20 bp, Artificial Sequence
  Description of Artificial Sequence: Synthetic oligonucleotide
  Target: SCN9A; (+) strand; PAM type: NRG; PAM sequence: AAG
tccaagaatatatttatttt

SEQ ID NO: 52008 - DNA, 20 bp, Artificial Sequence
  Description of Artificial Sequence: Synthetic oligonucleotide
  Target: SCN9A; (+) strand; PAM type: NRG; PAM sequence: TAG
tttattttaagaaatataaa

SEQ ID NO: 52009 - DNA, 20 bp, Artificial Sequence
  Description of Artificial Sequence: Synthetic oligonucleotide
  Target: SCN9A; (+) strand; PAM type: NRG; PAM sequence: AAG
gaaatataaatagtataata

SEQ ID NO: 52010 - DNA, 20 bp, Artificial Sequence
  Description of Artificial Sequence: Synthetic oligonucleotide
  Target: SCN9A; (+) strand; PAM type: NRG; PAM sequence: AAG
agttattaaataataattgt

SEQ ID NO: 52011 - DNA, 20 bp, Artificial Sequence
  Description of Artificial Sequence: Synthetic oligonucleotide
  Target: SCN9A; (+) strand; PAM type: NRG; PAM sequence: TGG
aatgctataatattttatct

SEQ ID NO: 52012 - DNA, 20 bp, Artificial Sequence
  Description of Artificial Sequence: Synthetic oligonucleotide
  Target: SCN9A; (+) strand; PAM type: NRG; PAM sequence: CAG
tattttatcttggtctaaac

SEQ ID NO: 52013 - DNA, 20 bp, Artificial Sequence
  Description of Artificial Sequence: Synthetic oligonucleotide
  Target: SCN9A; (+) strand; PAM type: NRG; PAM sequence: TGG
tttatcttggtctaaaccag

SEQ ID NO: 52014 - DNA, 20 bp, Artificial Sequence
  Description of Artificial Sequence: Synthetic oligonucleotide
  Target: SCN9A; (+) strand; PAM type: NRG; PAM sequence: CAG
tctaaaccagtggtcctcaa

SEQ ID NO: 52015 - DNA, 20 bp, Artificial Sequence
  Description of Artificial Sequence: Synthetic oligonucleotide
  Target: SCN9A; (+) strand; PAM type: NRG; PAM sequence: AGG
ctaaaccagtggtcctcaac

SEQ ID NO: 52016 - DNA, 20 bp, Artificial Sequence
  Description of Artificial Sequence: Synthetic oligonucleotide
  Target: SCN9A; (+) strand; PAM type: NRG; PAM sequence: CAG
ggataattcttccctacctc

SEQ ID NO: 52017 - DNA, 20 bp, Artificial Sequence
  Description of Artificial Sequence: Synthetic oligonucleotide
  Target: SCN9A; (+) strand; PAM type: NRG; PAM sequence: AGG
gataattcttccctacctcc

SEQ ID NO: 52018 - DNA, 20 bp, Artificial Sequence
  Description of Artificial Sequence: Synthetic oligonucleotide
  Target: SCN9A; (+) strand; PAM type: NRG; PAM sequence: TGG
aattcttccctacctccagg

SEQ ID NO: 52019 - DNA, 20 bp, Artificial Sequence
  Description of Artificial Sequence: Synthetic oligonucleotide
  Target: SCN9A; (+) strand; PAM type: NRG; PAM sequence: GAG
ttcttccctacctccaggtg

SEQ ID NO: 52020 - DNA, 20 bp, Artificial Sequence
  Description of Artificial Sequence: Synthetic oligonucleotide
  Target: SCN9A; (+) strand; PAM type: NRG; PAM sequence: CAG
ctacctccaggtggagttac

SEQ ID NO: 52021 - DNA, 20 bp, Artificial Sequence
  Description of Artificial Sequence: Synthetic oligonucleotide
  Target: SCN9A; (+) strand; PAM type: NRG; PAM sequence: GAG
acctccaggtggagttacca

SEQ ID NO: 52022 - DNA, 20 bp, Artificial Sequence
  Description of Artificial Sequence: Synthetic oligonucleotide
  Target: SCN9A; (+) strand; PAM type: NRG; PAM sequence: TAG
ccaggtggagttaccagagt

SEQ ID NO: 52023 - DNA, 20 bp, Artificial Sequence
  Description of Artificial Sequence: Synthetic oligonucleotide
  Target: SCN9A; (+) strand; PAM type: NRG; PAM sequence: AAG
gagttaccagagttagcaaa

SEQ ID NO: 52024 - DNA, 20 bp, Artificial Sequence
  Description of Artificial Sequence: Synthetic oligonucleotide
  Target: SCN9A; (+) strand; PAM type: NRG; PAM sequence: CAG
gagttagcaaaaagaataca

SEQ ID NO: 52025 - DNA, 20 bp, Artificial Sequence
  Description of Artificial Sequence: Synthetic oligonucleotide
  Target: SCN9A; (+) strand; PAM type: NRG; PAM sequence: CAG
tagcaaaaagaatacacagt

SEQ ID NO: 52026 - DNA, 20 bp, Artificial Sequence
  Description of Artificial Sequence: Synthetic oligonucleotide
  Target: SCN9A; (+) strand; PAM type: NRG; PAM sequence: TGG
atacatattctgaccataaa

SEQ ID NO: 52027 - DNA, 20 bp, Artificial Sequence
  Description of Artificial Sequence: Synthetic oligonucleotide
  Target: SCN9A; (+) strand; PAM type: NRG; PAM sequence: CAG
cataaatggaaatgttttta

SEQ ID NO: 52028 - DNA, 20 bp, Artificial Sequence
  Description of Artificial Sequence: Synthetic oligonucleotide
  Target: SCN9A; (+) strand; PAM type: NRG; PAM sequence: CAG
atggaaatgtttttacagaa

SEQ ID NO: 52029 - DNA, 20 bp, Artificial Sequence
  Description of Artificial Sequence: Synthetic oligonucleotide
  Target: SCN9A; (+) strand; PAM type: NRG; PAM sequence: CAG
gtttatctaaaataaatgat

SEQ ID NO: 52030 - DNA, 20 bp, Artificial Sequence
  Description of Artificial Sequence: Synthetic oligonucleotide
  Target: SCN9A; (+) strand; PAM type: NRG; PAM sequence: TAG
taaatgatcagtatgtaaat

SEQ ID NO: 52031 - DNA, 20 bp, Artificial Sequence
  Description of Artificial Sequence: Synthetic oligonucleotide
  Target: SCN9A; (+) strand; PAM type: NRG; PAM sequence: GAG
aatgatcagtatgtaaatta

SEQ ID NO: 52032 - DNA, 20 bp, Artificial Sequence
  Description of Artificial Sequence: Synthetic oligonucleotide
  Target: SCN9A; (+) strand; PAM type: NRG; PAM sequence: TGG
ctgaaaatttcctcgatgat

SEQ ID NO: 52033 - DNA, 20 bp, Artificial Sequence
  Description of Artificial Sequence: Synthetic oligonucleotide
  Target: SCN9A; (+) strand; PAM type: NRG; PAM sequence: CAG
cgatgattggctttcattaa

SEQ ID NO: 52034 - DNA, 20 bp, Artificial Sequence
  Description of Artificial Sequence: Synthetic oligonucleotide
  Target: SCN9A; (+) strand; PAM type: NRG; PAM sequence: CAG
attaacagctccttgttttg

SEQ ID NO: 52035 - DNA, 20 bp, Artificial Sequence
  Description of Artificial Sequence: Synthetic oligonucleotide
  Target: SCN9A; (+) strand; PAM type: NRG; PAM sequence: GAG
taacagctccttgttttgca

SEQ ID NO: 52036 - DNA, 20 bp, Artificial Sequence
  Description of Artificial Sequence: Synthetic oligonucleotide
  Target: SCN9A; (+) strand; PAM type: NRG; PAM sequence: TAG
ttgacttataaaattcctta

SEQ ID NO: 52037 - DNA, 20 bp, Artificial Sequence
  Description of Artificial Sequence: Synthetic oligonucleotide
  Target: SCN9A; (+) strand; PAM type: NRG; PAM sequence: AAG
tataaaattccttatagtta

SEQ ID NO: 52038 - DNA, 20 bp, Artificial Sequence
  Description of Artificial Sequence: Synthetic oligonucleotide
  Target: SCN9A; (+) strand; PAM type: NRG; PAM sequence: TAG
acaatgtaacatgtcttcca

SEQ ID NO: 52039 - DNA, 20 bp, Artificial Sequence
  Description of Artificial Sequence: Synthetic oligonucleotide
  Target: SCN9A; (+) strand; PAM type: NRG; PAM sequence: TGG
atgtaacatgtcttccatag

SEQ ID NO: 52040 - DNA, 20 bp, Artificial Sequence
  Description of Artificial Sequence: Synthetic oligonucleotide
  Target: SCN9A; (+) strand; PAM type: NRG; PAM sequence: GAG
tccattcaacattcattaat

SEQ ID NO: 52041 - DNA, 20 bp, Artificial Sequence
  Description of Artificial Sequence: Synthetic oligonucleotide
  Target: SCN9A; (+) strand; PAM type: NRG; PAM sequence: AAG
tcattaatgagaacatcgtg

SEQ ID NO: 52042 - DNA, 20 bp, Artificial Sequence
  Description of Artificial Sequence: Synthetic oligonucleotide
  Target: SCN9A; (+) strand; PAM type: NRG; PAM sequence: CAG
aatgagaacatcgtgaagtc

SEQ ID NO: 52043 - DNA, 20 bp, Artificial Sequence
  Description of Artificial Sequence: Synthetic oligonucleotide
  Target: SCN9A; (+) strand; PAM type: NRG; PAM sequence: AAG
catcgtgaagtccagcttat

SEQ ID NO: 52044 - DNA, 20 bp, Artificial Sequence
  Description of Artificial Sequence: Synthetic oligonucleotide
  Target: SCN9A; (+) strand; PAM type: NRG; PAM sequence: CAG
tgaagtccagcttataagtc

SEQ ID NO: 52045 - DNA, 20 bp, Artificial Sequence
  Description of Artificial Sequence: Synthetic oligonucleotide
  Target: SCN9A; (+) strand; PAM type: NRG; PAM sequence: CAG
tccagcttattgaacatgtt

SEQ ID NO: 52046 - DNA, 20 bp, Artificial Sequence
  Description of Artificial Sequence: Synthetic oligonucleotide
  Target: SCN9A; (+) strand; PAM type: NRG; PAM sequence: TAG
ttattgaacatgttcagtgt

SEQ ID NO: 52047 - DNA, 20 bp, Artificial Sequence
  Description of Artificial Sequence: Synthetic oligonucleotide
  Target: SCN9A; (+) strand; PAM type: NRG; PAM sequence: AAG
atgttcagtgttagccttat

SEQ ID NO: 52048 - DNA, 20 bp, Artificial Sequence
  Description of Artificial Sequence: Synthetic oligonucleotide
  Target: SCN9A; (+) strand; PAM type: NRG; PAM sequence: TGG
tcagtgttagccttataagc

SEQ ID NO: 52049 - DNA, 20 bp, Artificial Sequence
  Description of Artificial Sequence: Synthetic oligonucleotide
  Target: SCN9A; (+) strand; PAM type: NRG; PAM sequence: AAG
tctgaacatgtattgactta

SEQ ID NO: 52050 - DNA, 20 bp, Artificial Sequence
  Description of Artificial Sequence: Synthetic oligonucleotide
  Target: SCN9A; (+) strand; PAM type: NRG; PAM sequence: TGG
tattgacttaaagttaactc

SEQ ID NO: 52051 - DNA, 20 bp, Artificial Sequence
  Description of Artificial Sequence: Synthetic oligonucleotide
  Target: SCN9A; (+) strand; PAM type: NRG; PAM sequence: GGG
attgacttaaagttaactct

SEQ ID NO: 52052 - DNA, 20 bp, Artificial Sequence
  Description of Artificial Sequence: Synthetic oligonucleotide
  Target: SCN9A; (+) strand; PAM type: NRG; PAM sequence: AAG
tgggacttactcttttgcta

SEQ ID NO: 52053 - DNA, 20 bp, Artificial Sequence
  Description of Artificial Sequence: Synthetic oligonucleotide
  Target: SCN9A; (+) strand; PAM type: NRG; PAM sequence: CAG
acttgtttttttttattttt

SEQ ID NO: 52054 - DNA, 20 bp, Artificial Sequence
  Description of Artificial Sequence: Synthetic oligonucleotide
  Target: SCN9A; (+) strand; PAM type: NRG; PAM sequence: AGG
cttgtttttttttatttttc

SEQ ID NO: 52055 - DNA, 20 bp, Artificial Sequence
  Description of Artificial Sequence: Synthetic oligonucleotide
  Target: SCN9A; (+) strand; PAM type: NRG; PAM sequence: TAG
ttttttttatttttcaggat

SEQ ID NO: 52056 - DNA, 20 bp, Artificial Sequence
  Description of Artificial Sequence: Synthetic oligonucleotide
  Target: SCN9A; (+) strand; PAM type: NRG; PAM sequence: CAG
aatattttccactgacaaaa

SEQ ID NO: 52057 - DNA, 20 bp, Artificial Sequence
  Description of Artificial Sequence: Synthetic oligonucleotide
  Target: SCN9A; (+) strand; PAM type: NRG; PAM sequence: GAG
gaatttttattcccttcttt

SEQ ID NO: 52058 - DNA, 20 bp, Artificial Sequence
  Description of Artificial Sequence: Synthetic oligonucleotide
  Target: SCN9A; (+) strand; PAM type: NRG; PAM sequence: AAG
taatttctcctgttccatta

SEQ ID NO: 52059 - DNA, 20 bp, Artificial Sequence
  Description of Artificial Sequence: Synthetic oligonucleotide
  Target: SCN9A; (+) strand; PAM type: NRG; PAM sequence: AGG
aatttctcctgttccattaa

SEQ ID NO: 52060 - DNA, 20 bp, Artificial Sequence
  Description of Artificial Sequence: Synthetic oligonucleotide
  Target: SCN9A; (+) strand; PAM type: NRG; PAM sequence: AAG
attaaaggatcaaattcttc

SEQ ID NO: 52061 - DNA, 20 bp, Artificial Sequence
  Description of Artificial Sequence: Synthetic oligonucleotide
  Target: SCN9A; (+) strand; PAM type: NRG; PAM sequence: AGG
ttaaaggatcaaattcttca

SEQ ID NO: 52062 - DNA, 20 bp, Artificial Sequence
  Description of Artificial Sequence: Synthetic oligonucleotide
  Target: SCN9A; (+) strand; PAM type: NRG; PAM sequence: GGG
taaaggatcaaattcttcaa

SEQ ID NO: 52063 - DNA, 20 bp, Artificial Sequence
  Description of Artificial Sequence: Synthetic oligonucleotide
  Target: SCN9A; (+) strand; PAM type: NRG; PAM sequence: CGG
aataattatccacttcaata

SEQ ID NO: 52064 - DNA, 20 bp, Artificial Sequence
  Description of Artificial Sequence: Synthetic oligonucleotide
  Target: SCN9A; (+) strand; PAM type: NRG; PAM sequence: AAG
cggactttttccctgtccct

SEQ ID NO: 52065 - DNA, 20 bp, Artificial Sequence
  Description of Artificial Sequence: Synthetic oligonucleotide
  Target: SCN9A; (+) strand; PAM type: NRG; PAM sequence: CAG
ttgtgttgttcctcttaaaa

SEQ ID NO: 52066 - DNA, 20 bp, Artificial Sequence
  Description of Artificial Sequence: Synthetic oligonucleotide
  Target: SCN9A; (+) strand; PAM type: NRG; PAM sequence: TGG
tgttcctcttaaaacagcct

SEQ ID NO: 52067 - DNA, 20 bp, Artificial Sequence
  Description of Artificial Sequence: Synthetic oligonucleotide
  Target: SCN9A; (+) strand; PAM type: NRG; PAM sequence: AAG
ttaaaacagccttggcatac

SEQ ID NO: 52068 - DNA, 20 bp, Artificial Sequence
  Description of Artificial Sequence: Synthetic oligonucleotide
  Target: SCN9A; (+) strand; PAM type: NRG; PAM sequence: AGG
taaaacagccttggcataca

SEQ ID NO: 52069 - DNA, 20 bp, Artificial Sequence
  Description of Artificial Sequence: Synthetic oligonucleotide
  Target: SCN9A; (+) strand; PAM type: NRG; PAM sequence: GGG
aaaacagccttggcatacaa

SEQ ID NO: 52070 - DNA, 20 bp, Artificial Sequence
  Description of Artificial Sequence: Synthetic oligonucleotide
  Target: SCN9A; (+) strand; PAM type: NRG; PAM sequence: AAG
tacattcaacaactctttgt

SEQ ID NO: 52071 - DNA, 20 bp, Artificial Sequence
  Description of Artificial Sequence: Synthetic oligonucleotide
  Target: SCN9A; (+) strand; PAM type: NRG; PAM sequence: TGG
caacaactctttgtaagcaa

SEQ ID NO: 52072 - DNA, 20 bp, Artificial Sequence
  Description of Artificial Sequence: Synthetic oligonucleotide
  Target: SCN9A; (+) strand; PAM type: NRG; PAM sequence: GAG
acaactctttgtaagcaatg

SEQ ID NO: 52073 - DNA, 20 bp, Artificial Sequence
  Description of Artificial Sequence: Synthetic oligonucleotide
  Target: SCN9A; (+) strand; PAM type: NRG; PAM sequence: AGG
caactctttgtaagcaatgg

SEQ ID NO: 52074 - DNA, 20 bp, Artificial Sequence
  Description of Artificial Sequence: Synthetic oligonucleotide
  Target: SCN9A; (+) strand; PAM type: NRG; PAM sequence: GGG
aactctttgtaagcaatgga

SEQ ID NO: 52075 - DNA, 20 bp, Artificial Sequence
  Description of Artificial Sequence: Synthetic oligonucleotide
  Target: SCN9A; (+) strand; PAM type: NRG; PAM sequence: AAG
ttgcataatcctattgctaa

SEQ ID NO: 52076 - DNA, 20 bp, Artificial Sequence
  Description of Artificial Sequence: Synthetic oligonucleotide
  Target: SCN9A; (+) strand; PAM type: NRG; PAM sequence: TGG
aatcctattgctaaaagata

SEQ ID NO: 52077 - DNA, 20 bp, Artificial Sequence
  Description of Artificial Sequence: Synthetic oligonucleotide
  Target: SCN9A; (+) strand; PAM type: NRG; PAM sequence: GAG
taaaagatatggaatgctat

SEQ ID NO: 52078 - DNA, 20 bp, Artificial Sequence
  Description of Artificial Sequence: Synthetic oligonucleotide
  Target: SCN9A; (+) strand; PAM type: NRG; PAM sequence: AAG
agatatggaatgctatgagc

SEQ ID NO: 52079 - DNA, 20 bp, Artificial Sequence
  Description of Artificial Sequence: Synthetic oligonucleotide
  Target: SCN9A; (+) strand; PAM type: NRG; PAM sequence: AAG
gaatgctatgagcaagaaat

SEQ ID NO: 52080 - DNA, 20 bp, Artificial Sequence
  Description of Artificial Sequence: Synthetic oligonucleotide
  Target: SCN9A; (+) strand; PAM type: NRG; PAM sequence: TAG
tgctatgagcaagaaataag

SEQ ID NO: 52081 - DNA, 20 bp, Artificial Sequence
  Description of Artificial Sequence: Synthetic oligonucleotide
  Target: SCN9A; (+) strand; PAM type: NRG; PAM sequence: TGG
aataagtagtctttactcaa

SEQ ID NO: 52082 - DNA, 20 bp, Artificial Sequence
  Description of Artificial Sequence: Synthetic oligonucleotide
  Target: SCN9A; (+) strand; PAM type: NRG; PAM sequence: GGG
ataagtagtctttactcaat

SEQ ID NO: 52083 - DNA, 20 bp, Artificial Sequence
  Description of Artificial Sequence: Synthetic oligonucleotide
  Target: SCN9A; (+) strand; PAM type: NRG; PAM sequence: AAG
tactcaatgggttattttaa

SEQ ID NO: 52084 - DNA, 20 bp, Artificial Sequence
  Description of Artificial Sequence: Synthetic oligonucleotide
  Target: SCN9A; (+) strand; PAM type: NRG; PAM sequence: CAG
caatgggttattttaaaagt

SEQ ID NO: 52085 - DNA, 20 bp, Artificial Sequence
  Description of Artificial Sequence: Synthetic oligonucleotide
  Target: SCN9A; (+) strand; PAM type: NRG; PAM sequence: AAG
gggttattttaaaagtcagc

SEQ ID NO: 52086 - DNA, 20 bp, Artificial Sequence
  Description of Artificial Sequence: Synthetic oligonucleotide
  Target: SCN9A; (+) strand; PAM type: NRG; PAM sequence: GAG
aaaagtcagcaagaatttgt

SEQ ID NO: 52087 - DNA, 20 bp, Artificial Sequence
  Description of Artificial Sequence: Synthetic oligonucleotide
  Target: SCN9A; (+) strand; PAM type: NRG; PAM sequence: CAG
aatttgtgagaccttttctt

SEQ ID NO: 52088 - DNA, 20 bp, Artificial Sequence
  Description of Artificial Sequence: Synthetic oligonucleotide
  Target: SCN9A; (+) strand; PAM type: NRG; PAM sequence: AAG
agaccttttcttcagaatta

SEQ ID NO: 52089 - DNA, 20 bp, Artificial Sequence
  Description of Artificial Sequence: Synthetic oligonucleotide
  Target: SCN9A; (+) strand; PAM type: NRG; PAM sequence: CGG
tcagaattaaagtatgattt

SEQ ID NO: 52090 - DNA, 20 bp, Artificial Sequence
  Description of Artificial Sequence: Synthetic oligonucleotide
  Target: SCN9A; (+) strand; PAM type: NRG; PAM sequence: AAG
ttcggtgctttaaataaact

SEQ ID NO: 52091 - DNA, 20 bp, Artificial Sequence
  Description of Artificial Sequence: Synthetic oligonucleotide
  Target: SCN9A; (+) strand; PAM type: NRG; PAM sequence: AAG
tctctcaactgcatctatta

SEQ ID NO: 52092 - DNA, 20 bp, Artificial Sequence
  Description of Artificial Sequence: Synthetic oligonucleotide
  Target: SCN9A; (+) strand; PAM type: NRG; PAM sequence: GAG
tctcaactgcatctattaaa

SEQ ID NO: 52093 - DNA, 20 bp, Artificial Sequence
  Description of Artificial Sequence: Synthetic oligonucleotide
  Target: SCN9A; (+) strand; PAM type: NRG; PAM sequence: GAG
tcaactgcatctattaaaga

SEQ ID NO: 52094 - DNA, 20 bp, Artificial Sequence
  Description of Artificial Sequence: Synthetic oligonucleotide
  Target: SCN9A; (+) strand; PAM type: NRG; PAM sequence: CAG
ctgcatctattaaagagagc

SEQ ID NO: 52095 - DNA, 20 bp, Artificial Sequence
  Description of Artificial Sequence: Synthetic oligonucleotide
  Target: SCN9A; (+) strand; PAM type: NRG; PAM sequence: AAG
cagtgaattttaaaatgtga

SEQ ID NO: 52096 - DNA, 20 bp, Artificial Sequence
  Description of Artificial Sequence: Synthetic oligonucleotide
  Target: SCN9A; (+) strand; PAM type: NRG; PAM sequence: TAG
aaattacaaaaattcttcat

SEQ ID NO: 52097 - DNA, 20 bp, Artificial Sequence
  Description of Artificial Sequence: Synthetic oligonucleotide
  Target: SCN9A; (+) strand; PAM type: NRG; PAM sequence: TAG
ttacaaaaattcttcattag

SEQ ID NO: 52098 - DNA, 20 bp, Artificial Sequence
  Description of Artificial Sequence: Synthetic oligonucleotide
  Target: SCN9A; (+) strand; PAM type: NRG; PAM sequence: GAG
acaaaaattcttcattagta

SEQ ID NO: 52099 - DNA, 20 bp, Artificial Sequence
  Description of Artificial Sequence: Synthetic oligonucleotide
  Target: SCN9A; (+) strand; PAM type: NRG; PAM sequence: CAG
cttcattagtagagtctgaa

SEQ ID NO: 52100 - DNA, 20 bp, Artificial Sequence
  Description of Artificial Sequence: Synthetic oligonucleotide
  Target: SCN9A; (+) strand; PAM type: NRG; PAM sequence: TAG
gaacagaataaatgctgaaa

SEQ ID NO: 52101 - DNA, 20 bp, Artificial Sequence
  Description of Artificial Sequence: Synthetic oligonucleotide
  Target: SCN9A; (+) strand; PAM type: NRG; PAM sequence: TGG
tttcttgacaatttctttac

SEQ ID NO: 52102 - DNA, 20 bp, Artificial Sequence
  Description of Artificial Sequence: Synthetic oligonucleotide
  Target: SCN9A; (+) strand; PAM type: NRG; PAM sequence: CAG
ggcaattactttactgatat

SEQ ID NO: 52103 - DNA, 20 bp, Artificial Sequence
  Description of Artificial Sequence: Synthetic oligonucleotide
  Target: SCN9A; (+) strand; PAM type: NRG; PAM sequence: GAG
actgatatcagatgctgttt

SEQ ID NO: 52104 - DNA, 20 bp, Artificial Sequence
  Description of Artificial Sequence: Synthetic oligonucleotide
  Target: SCN9A; (+) strand; PAM type: NRG; PAM sequence: CAG
gatatcagatgctgtttgag

SEQ ID NO: 52105 - DNA, 20 bp, Artificial Sequence
  Description of Artificial Sequence: Synthetic oligonucleotide
  Target: SCN9A; (+) strand; PAM type: NRG; PAM sequence: TAG
gctgtttgagcagcgtcatg

SEQ ID NO: 52106 - DNA, 20 bp, Artificial Sequence
  Description of Artificial Sequence: Synthetic oligonucleotide
  Target: SCN9A; (+) strand; PAM type: NRG; PAM sequence: TGG
gagcagcgtcatgtagaata

SEQ ID NO: 52107 - DNA, 20 bp, Artificial Sequence
  Description of Artificial Sequence: Synthetic oligonucleotide
  Target: SCN9A; (+) strand; PAM type: NRG; PAM sequence: CAG
cagcgtcatgtagaatatgg

SEQ ID NO: 52108 - DNA, 20 bp, Artificial Sequence
  Description of Artificial Sequence: Synthetic oligonucleotide
  Target: SCN9A; (+) strand; PAM type: NRG; PAM sequence: AAG
cgtcatgtagaatatggcag

SEQ ID NO: 52109 - DNA, 20 bp, Artificial Sequence
  Description of Artificial Sequence: Synthetic oligonucleotide
  Target: SCN9A; (+) strand; PAM type: NRG; PAM sequence: GAG
tcatgtagaatatggcagaa

SEQ ID NO: 52110 - DNA, 20 bp, Artificial Sequence
  Description of Artificial Sequence: Synthetic oligonucleotide
  Target: SCN9A; (+) strand; PAM type: NRG; PAM sequence: AGG
catgtagaatatggcagaag

SEQ ID NO: 52111 - DNA, 20 bp, Artificial Sequence
  Description of Artificial Sequence: Synthetic oligonucleotide
  Target: SCN9A; (+) strand; PAM type: NRG; PAM sequence: TAG
agaagaggcaacactgttca

SEQ ID NO: 52112 - DNA, 20 bp, Artificial Sequence
  Description of Artificial Sequence: Synthetic oligonucleotide
  Target: SCN9A; (+) strand; PAM type: NRG; PAM sequence: AAG
ttgtattacctccacaaaat

SEQ ID NO: 52113 - DNA, 20 bp, Artificial Sequence
  Description of Artificial Sequence: Synthetic oligonucleotide
  Target: SCN9A; (+) strand; PAM type: NRG; PAM sequence: TAG
tatgactactaactcaatca

SEQ ID NO: 52114 - DNA, 20 bp, Artificial Sequence
  Description of Artificial Sequence: Synthetic oligonucleotide
  Target: SCN9A; (+) strand; PAM type: NRG; PAM sequence: AGG
atgactactaactcaatcat

SEQ ID NO: 52115 - DNA, 20 bp, Artificial Sequence
  Description of Artificial Sequence: Synthetic oligonucleotide
  Target: SCN9A; (+) strand; PAM type: NRG; PAM sequence: GGG
tgactactaactcaatcata

SEQ ID NO: 52116 - DNA, 20 bp, Artificial Sequence
  Description of Artificial Sequence: Synthetic oligonucleotide
  Target: SCN9A; (+) strand; PAM type: NRG; PAM sequence: AAG
acaatttcttgttgtttctg

SEQ ID NO: 52117 - DNA, 20 bp, Artificial Sequence
  Description of Artificial Sequence: Synthetic oligonucleotide
  Target: SCN9A; (+) strand; PAM type: NRG; PAM sequence: TGG
gttgtttctgaagactcatc

SEQ ID NO: 52118 - DNA, 20 bp, Artificial Sequence
  Description of Artificial Sequence: Synthetic oligonucleotide
  Target: SCN9A; (+) strand; PAM type: NRG; PAM sequence: AAG
gtttctgaagactcatctgg

SEQ ID NO: 52119 - DNA, 20 bp, Artificial Sequence
  Description of Artificial Sequence: Synthetic oligonucleotide
  Target: SCN9A; (+) strand; PAM type: NRG; PAM sequence: AGG
tttctgaagactcatctgga

SEQ ID NO: 52120 - DNA, 20 bp, Artificial Sequence
  Description of Artificial Sequence: Synthetic oligonucleotide
  Target: SCN9A; (+) strand; PAM type: NRG; PAM sequence: TAG
atctggaaggcgtgttacaa

SEQ ID NO: 52121 - DNA, 20 bp, Artificial Sequence
  Description of Artificial Sequence: Synthetic oligonucleotide
  Target: SCN9A; (+) strand; PAM type: NRG; PAM sequence: AAG
gcgtgttacaatagccttgt

SEQ ID NO: 52122 - DNA, 20 bp, Artificial Sequence
  Description of Artificial Sequence: Synthetic oligonucleotide
  Target: SCN9A; (+) strand; PAM type: NRG; PAM sequence: AAG
gttacaatagccttgtaagc

SEQ ID NO: 52123 - DNA, 20 bp, Artificial Sequence
  Description of Artificial Sequence: Synthetic oligonucleotide
  Target: SCN9A; (+) strand; PAM type: NRG; PAM sequence: GAG
ttgtaagcaagtctttttat

SEQ ID NO: 52124 - DNA, 20 bp, Artificial Sequence
  Description of Artificial Sequence: Synthetic oligonucleotide
  Target: SCN9A; (+) strand; PAM type: NRG; PAM sequence: GAG
ttatgagaaaattattatac

SEQ ID NO: 52125 - DNA, 20 bp, Artificial Sequence
  Description of Artificial Sequence: Synthetic oligonucleotide
  Target: SCN9A; (+) strand; PAM type: NRG; PAM sequence: AAG
agaaaattattatacgagta

SEQ ID NO: 52126 - DNA, 20 bp, Artificial Sequence
  Description of Artificial Sequence: Synthetic oligonucleotide
  Target: SCN9A; (+) strand; PAM type: NRG; PAM sequence: AGG
gaaaattattatacgagtaa

SEQ ID NO: 52127 - DNA, 20 bp, Artificial Sequence
  Description of Artificial Sequence: Synthetic oligonucleotide
  Target: SCN9A; (+) strand; PAM type: NRG; PAM sequence: TGG
attgtgattacttgcattca

SEQ ID NO: 52128 - DNA, 20 bp, Artificial Sequence
  Description of Artificial Sequence: Synthetic oligonucleotide
  Target: SCN9A; (+) strand; PAM type: NRG; PAM sequence: AAG
ttcatggctatgccataaaa

SEQ ID NO: 52129 - DNA, 20 bp, Artificial Sequence
  Description of Artificial Sequence: Synthetic oligonucleotide
  Target: SCN9A; (+) strand; PAM type: NRG; PAM sequence: GAG
cataaaaaagtaaaacattt

SEQ ID NO: 52130 - DNA, 20 bp, Artificial Sequence
  Description of Artificial Sequence: Synthetic oligonucleotide
  Target: SCN9A; (+) strand; PAM type: NRG; PAM sequence: TGG
aaagtaaaacatttgagctg

SEQ ID NO: 52131 - DNA, 20 bp, Artificial Sequence
  Description of Artificial Sequence: Synthetic oligonucleotide
  Target: SCN9A; (+) strand; PAM type: NRG; PAM sequence: CAG
agctgtggtaatctctgtaa

SEQ ID NO: 52132 - DNA, 20 bp, Artificial Sequence
  Description of Artificial Sequence: Synthetic oligonucleotide
  Target: SCN9A; (+) strand; PAM type: NRG; PAM sequence: TGG
gtaatctctgtaacagtaaa

SEQ ID NO: 52133 - DNA, 20 bp, Artificial Sequence
  Description of Artificial Sequence: Synthetic oligonucleotide
  Target: SCN9A; (+) strand; PAM type: NRG; PAM sequence: GAG
aatctctgtaacagtaaatg

SEQ ID NO: 52134 - DNA, 20 bp, Artificial Sequence
  Description of Artificial Sequence: Synthetic oligonucleotide
  Target: SCN9A; (+) strand; PAM type: NRG; PAM sequence: CGG
agttattctaatttttatta

SEQ ID NO: 52135 - DNA, 20 bp, Artificial Sequence
  Description of Artificial Sequence: Synthetic oligonucleotide
  Target: SCN9A; (+) strand; PAM type: NRG; PAM sequence: CAG
tattctaatttttattacgg

SEQ ID NO: 52136 - DNA, 20 bp, Artificial Sequence
  Description of Artificial Sequence: Synthetic oligonucleotide
  Target: SCN9A; (+) strand; PAM type: NRG; PAM sequence: TAG
tctaatttttattacggcag

SEQ ID NO: 52137 - DNA, 20 bp, Artificial Sequence
  Description of Artificial Sequence: Synthetic oligonucleotide
  Target: SCN9A; (+) strand; PAM type: NRG; PAM sequence: TAG
cggcagtagattttgtccta

SEQ ID NO: 52138 - DNA, 20 bp, Artificial Sequence
  Description of Artificial Sequence: Synthetic oligonucleotide
  Target: SCN9A; (+) strand; PAM type: NRG; PAM sequence: TAG
tagattttgtcctatagcac

SEQ ID NO: 52139 - DNA, 20 bp, Artificial Sequence
  Description of Artificial Sequence: Synthetic oligonucleotide
  Target: SCN9A; (+) strand; PAM type: NRG; PAM sequence: TAG
tttgcattaaaaaatacttg

SEQ ID NO: 52140 - DNA, 20 bp, Artificial Sequence
  Description of Artificial Sequence: Synthetic oligonucleotide
  Target: SCN9A; (+) strand; PAM type: NRG; PAM sequence: AAG
cttgtagcacaattcaaatt

SEQ ID NO: 52141 - DNA, 20 bp, Artificial Sequence
  Description of Artificial Sequence: Synthetic oligonucleotide
  Target: SCN9A; (+) strand; PAM type: NRG; PAM sequence: GAG
caattcaaattaagtcatgt

SEQ ID NO: 52142 - DNA, 20 bp, Artificial Sequence
  Description of Artificial Sequence: Synthetic oligonucleotide
  Target: SCN9A; (+) strand; PAM type: NRG; PAM sequence: AAG
aaaaccttgtatgatataca

SEQ ID NO: 52143 - DNA, 20 bp, Artificial Sequence
  Description of Artificial Sequence: Synthetic oligonucleotide
  Target: SCN9A; (+) strand; PAM type: NRG; PAM sequence: TGG
accttgtatgatatacaaag

SEQ ID NO: 52144 - DNA, 20 bp, Artificial Sequence
  Description of Artificial Sequence: Synthetic oligonucleotide
  Target: SCN9A; (+) strand; PAM type: NRG; PAM sequence: AAG
ttgtatgatatacaaagtgg

SEQ ID NO: 52145 - DNA, 20 bp, Artificial Sequence
  Description of Artificial Sequence: Synthetic oligonucleotide
  Target: SCN9A; (+) strand; PAM type: NRG; PAM sequence: AAG
tcatctgaatttctttcaat

SEQ ID NO: 52146 - DNA, 20 bp, Artificial Sequence
  Description of Artificial Sequence: Synthetic oligonucleotide
  Target: SCN9A; (+) strand; PAM type: NRG; PAM sequence: TGG
tgtgattttattactttctt

SEQ ID NO: 52147 - DNA, 20 bp, Artificial Sequence
  Description of Artificial Sequence: Synthetic oligonucleotide
  Target: SCN9A; (+) strand; PAM type: NRG; PAM sequence: AAG
tttattactttctttggtac

SEQ ID NO: 52148 - DNA, 20 bp, Artificial Sequence
  Description of Artificial Sequence: Synthetic oligonucleotide
  Target: SCN9A; (+) strand; PAM type: NRG; PAM sequence: GAG
tactttctttggtacaagtt

SEQ ID NO: 52149 - DNA, 20 bp, Artificial Sequence
  Description of Artificial Sequence: Synthetic oligonucleotide
  Target: SCN9A; (+) strand; PAM type: NRG; PAM sequence: AGG
actttctttggtacaagttg

SEQ ID NO: 52150 - DNA, 20 bp, Artificial Sequence
  Description of Artificial Sequence: Synthetic oligonucleotide
  Target: SCN9A; (+) strand; PAM type: NRG; PAM sequence: TAG
aaatcatacatctatttgct

SEQ ID NO: 52151 - DNA, 20 bp, Artificial Sequence
  Description of Artificial Sequence: Synthetic oligonucleotide
  Target: SCN9A; (+) strand; PAM type: NRG; PAM sequence: TAG
acatctatttgcttagctgt

SEQ ID NO: 52152 - DNA, 20 bp, Artificial Sequence
  Description of Artificial Sequence: Synthetic oligonucleotide
  Target: SCN9A; (+) strand; PAM type: NRG; PAM sequence: TGG
gcttagctgttagtatttgc

SEQ ID NO: 52153 - DNA, 20 bp, Artificial Sequence
  Description of Artificial Sequence: Synthetic oligonucleotide
  Target: SCN9A; (+) strand; PAM type: NRG; PAM sequence: AAG
gtatttgctggcttacatcc

SEQ ID NO: 52154 - DNA, 20 bp, Artificial Sequence
  Description of Artificial Sequence: Synthetic oligonucleotide
  Target: SCN9A; (+) strand; PAM type: NRG; PAM sequence: TAG
gttttcaccattttcaatat

SEQ ID NO: 52155 - DNA, 20 bp, Artificial Sequence
  Description of Artificial Sequence: Synthetic oligonucleotide
  Target: SCN9A; (+) strand; PAM type: NRG; PAM sequence: AAG
aaacaattgtatgctgcaca

SEQ ID NO: 52156 - DNA, 20 bp, Artificial Sequence
  Description of Artificial Sequence: Synthetic oligonucleotide
  Target: SCN9A; (+) strand; PAM type: NRG; PAM sequence: GAG
acaattgtatgctgcacaaa

SEQ ID NO: 52157 - DNA, 20 bp, Artificial Sequence
  Description of Artificial Sequence: Synthetic oligonucleotide
  Target: SCN9A; (+) strand; PAM type: NRG; PAM sequence: AAG
tgctgcacaaagagcttcaa

SEQ ID NO: 52158 - DNA, 20 bp, Artificial Sequence
  Description of Artificial Sequence: Synthetic oligonucleotide
  Target: SCN9A; (+) strand; PAM type: NRG; PAM sequence: AGG
gctgcacaaagagcttcaaa

SEQ ID NO: 52159 - DNA, 20 bp, Artificial Sequence
  Description of Artificial Sequence: Synthetic oligonucleotide
  Target: SCN9A; (+) strand; PAM type: NRG; PAM sequence: GAG
tgcacaaagagcttcaaaag

SEQ ID NO: 52160 - DNA, 20 bp, Artificial Sequence
  Description of Artificial Sequence: Synthetic oligonucleotide
  Target: SCN9A; (+) strand; PAM type: NRG; PAM sequence: GAG
acttgcattttgacattttt

SEQ ID NO: 52161 - DNA, 20 bp, Artificial Sequence
  Description of Artificial Sequence: Synthetic oligonucleotide
  Target: SCN9A; (+) strand; PAM type: NRG; PAM sequence: TGG
acttctacacaaataaaaaa

SEQ ID NO: 52162 - DNA, 20 bp, Artificial Sequence
  Description of Artificial Sequence: Synthetic oligonucleotide
  Target: SCN9A; (+) strand; PAM type: NRG; PAM sequence: TAG
cacaaataaaaaatggatat

SEQ ID NO: 52163 - DNA, 20 bp, Artificial Sequence
  Description of Artificial Sequence: Synthetic oligonucleotide
  Target: SCN9A; (+) strand; PAM type: NRG; PAM sequence: CAG
atggatattagtaattgacc

SEQ ID NO: 52164 - DNA, 20 bp, Artificial Sequence
  Description of Artificial Sequence: Synthetic oligonucleotide
  Target: SCN9A; (+) strand; PAM type: NRG; PAM sequence: AGG
tggatattagtaattgaccc

SEQ ID NO: 52165 - DNA, 20 bp, Artificial Sequence
  Description of Artificial Sequence: Synthetic oligonucleotide
  Target: SCN9A; (+) strand; PAM type: NRG; PAM sequence: AAG
taattgacccaggaattgaa

SEQ ID NO: 52166 - DNA, 20 bp, Artificial Sequence
  Description of Artificial Sequence: Synthetic oligonucleotide
  Target: SCN9A; (+) strand; PAM type: NRG; PAM sequence: CAG
gattgaatttgataatctca

SEQ ID NO: 52167 - DNA, 20 bp, Artificial Sequence
  Description of Artificial Sequence: Synthetic oligonucleotide
  Target: SCN9A; (+) strand; PAM type: NRG; PAM sequence: CAG
tctcacagctttgtcactgt

SEQ ID NO: 52168 - DNA, 20 bp, Artificial Sequence
  Description of Artificial Sequence: Synthetic oligonucleotide
  Target: SCN9A; (+) strand; PAM type: NRG; PAM sequence: CAG
ttgtcactgtcagtcactca

SEQ ID NO: 52169 - DNA, 20 bp, Artificial Sequence
  Description of Artificial Sequence: Synthetic oligonucleotide
  Target: SCN9A; (+) strand; PAM type: NRG; PAM sequence: AGG
tgtcactgtcagtcactcac

SEQ ID NO: 52170 - DNA, 20 bp, Artificial Sequence
  Description of Artificial Sequence: Synthetic oligonucleotide
  Target: SCN9A; (+) strand; PAM type: NRG; PAM sequence: AAG
actcataactaaacataaac

SEQ ID NO: 52171 - DNA, 20 bp, Artificial Sequence
  Description of Artificial Sequence: Synthetic oligonucleotide
  Target: SCN9A; (+) strand; PAM type: NRG; PAM sequence: GAG
tcataactaaacataaacaa

SEQ ID NO: 52172 - DNA, 20 bp, Artificial Sequence
  Description of Artificial Sequence: Synthetic oligonucleotide
  Target: SCN9A; (+) strand; PAM type: NRG; PAM sequence: GAG
actaaacataaacaagagtt

SEQ ID NO: 52173 - DNA, 20 bp, Artificial Sequence
  Description of Artificial Sequence: Synthetic oligonucleotide
  Target: SCN9A; (+) strand; PAM type: NRG; PAM sequence: AAG
aacaagagttgagccaatga

SEQ ID NO: 52174 - DNA, 20 bp, Artificial Sequence
  Description of Artificial Sequence: Synthetic oligonucleotide
  Target: SCN9A; (+) strand; PAM type: NRG; PAM sequence: AGG
acaagagttgagccaatgaa

SEQ ID NO: 52175 - DNA, 20 bp, Artificial Sequence
  Description of Artificial Sequence: Synthetic oligonucleotide
  Target: SCN9A; (+) strand; PAM type: NRG; PAM sequence: CAG
attgcaaacttgtgaactta

SEQ ID NO: 52176 - DNA, 20 bp, Artificial Sequence
  Description of Artificial Sequence: Synthetic oligonucleotide
  Target: SCN9A; (+) strand; PAM type: NRG; PAM sequence: TGG
cagtaaattgaactaaatat

SEQ ID NO: 52177 - DNA, 20 bp, Artificial Sequence
  Description of Artificial Sequence: Synthetic oligonucleotide
  Target: SCN9A; (+) strand; PAM type: NRG; PAM sequence: CAG
aatctaaacgttctgtttgc

SEQ ID NO: 52178 - DNA, 20 bp, Artificial Sequence
  Description of Artificial Sequence: Synthetic oligonucleotide
  Target: SCN9A; (+) strand; PAM type: NRG; PAM sequence: AAG
taaacgttctgtttgccagc

SEQ ID NO: 52179 - DNA, 20 bp, Artificial Sequence
  Description of Artificial Sequence: Synthetic oligonucleotide
  Target: SCN9A; (+) strand; PAM type: NRG; PAM sequence: GAG
aacgttctgtttgccagcaa

SEQ ID NO: 52180 - DNA, 20 bp, Artificial Sequence
  Description of Artificial Sequence: Synthetic oligonucleotide
  Target: SCN9A; (+) strand; PAM type: NRG; PAM sequence: GAG
cgttctgtttgccagcaaga

SEQ ID NO: 52181 - DNA, 20 bp, Artificial Sequence
  Description of Artificial Sequence: Synthetic oligonucleotide
  Target: SCN9A; (+) strand; PAM type: NRG; PAM sequence: GAG
caagagagaactgtatttgt

SEQ ID NO: 52182 - DNA, 20 bp, Artificial Sequence
  Description of Artificial Sequence: Synthetic oligonucleotide
  Target: SCN9A; (+) strand; PAM type: NRG; PAM sequence: GAG
agagagaactgtatttgtga

SEQ ID NO: 52183 - DNA, 20 bp, Artificial Sequence
  Description of Artificial Sequence: Synthetic oligonucleotide
  Target: SCN9A; (+) strand; PAM type: NRG; PAM sequence: AAG
gaactgtatttgtgagagat

SEQ ID NO: 52184 - DNA, 20 bp, Artificial Sequence
  Description of Artificial Sequence: Synthetic oligonucleotide
  Target: SCN9A; (+) strand; PAM type: NRG; PAM sequence: TGG
atttgtgagagataagttcc

SEQ ID NO: 52185 - DNA, 20 bp, Artificial Sequence
  Description of Artificial Sequence: Synthetic oligonucleotide
  Target: SCN9A; (+) strand; PAM type: NRG; PAM sequence: AAG
agagataagttcctggaaca

SEQ ID NO: 52186 - DNA, 20 bp, Artificial Sequence
  Description of Artificial Sequence: Synthetic oligonucleotide
  Target: SCN9A; (+) strand; PAM type: NRG; PAM sequence: CAG
aagttcctggaacaaagcca

SEQ ID NO: 52187 - DNA, 20 bp, Artificial Sequence
  Description of Artificial Sequence: Synthetic oligonucleotide
  Target: SCN9A; (+) strand; PAM type: NRG; PAM sequence: AAG
agccacagctgacattatat

SEQ ID NO: 52188 - DNA, 20 bp, Artificial Sequence
  Description of Artificial Sequence: Synthetic oligonucleotide
  Target: SCN9A; (+) strand; PAM type: NRG; PAM sequence: AGG
gccacagctgacattatata

SEQ ID NO: 52189 - DNA, 20 bp, Artificial Sequence
  Description of Artificial Sequence: Synthetic oligonucleotide
  Target: SCN9A; (+) strand; PAM type: NRG; PAM sequence: TGG
agctgacattatataaggtt

SEQ ID NO: 52190 - DNA, 20 bp, Artificial Sequence
  Description of Artificial Sequence: Synthetic oligonucleotide
  Target: SCN9A; (+) strand; PAM type: NRG; PAM sequence: GGG
gctgacattatataaggttt

SEQ ID NO: 52191 - DNA, 20 bp, Artificial Sequence
  Description of Artificial Sequence: Synthetic oligonucleotide
  Target: SCN9A; (+) strand; PAM type: NRG; PAM sequence: GGG
ctgacattatataaggtttg

SEQ ID NO: 52192 - DNA, 20 bp, Artificial Sequence
  Description of Artificial Sequence: Synthetic oligonucleotide
  Target: SCN9A; (+) strand; PAM type: NRG; PAM sequence: CAG
ataaggtttggggaaatgtg

SEQ ID NO: 52193 - DNA, 20 bp, Artificial Sequence
  Description of Artificial Sequence: Synthetic oligonucleotide
  Target: SCN9A; (+) strand; PAM type: NRG; PAM sequence: GAG
aaggtttggggaaatgtgca

SEQ ID NO: 52194 - DNA, 20 bp, Artificial Sequence
  Description of Artificial Sequence: Synthetic oligonucleotide
  Target: SCN9A; (+) strand; PAM type: NRG; PAM sequence: TAG
ggggaaatgtgcagagtgtt

SEQ ID NO: 52195 - DNA, 20 bp, Artificial Sequence
  Description of Artificial Sequence: Synthetic oligonucleotide
  Target: SCN9A; (+) strand; PAM type: NRG; PAM sequence: GAG
ggaaatgtgcagagtgttta

SEQ ID NO: 52196 - DNA, 20 bp, Artificial Sequence
  Description of Artificial Sequence: Synthetic oligonucleotide
  Target: SCN9A; (+) strand; PAM type: NRG; PAM sequence: AAG
tgcagagtgtttagagactc

SEQ ID NO: 52197 - DNA, 20 bp, Artificial Sequence
  Description of Artificial Sequence: Synthetic oligonucleotide
  Target: SCN9A; (+) strand; PAM type: NRG; PAM sequence: AGG
gcagagtgtttagagactca

SEQ ID NO: 52198 - DNA, 20 bp, Artificial Sequence
  Description of Artificial Sequence: Synthetic oligonucleotide
  Target: SCN9A; (+) strand; PAM type: NRG; PAM sequence: CAG
tttagagactcaaggacttc

SEQ ID NO: 52199 - DNA, 20 bp, Artificial Sequence
  Description of Artificial Sequence: Synthetic oligonucleotide
  Target: SCN9A; (+) strand; PAM type: NRG; PAM sequence: TAG
tcaaggacttccagctgtgt

SEQ ID NO: 52200 - DNA, 20 bp, Artificial Sequence
  Description of Artificial Sequence: Synthetic oligonucleotide
  Target: SCN9A; (+) strand; PAM type: NRG; PAM sequence: TGG
gacttccagctgtgttagtg

SEQ ID NO: 52201 - DNA, 20 bp, Artificial Sequence
  Description of Artificial Sequence: Synthetic oligonucleotide
  Target: SCN9A; (+) strand; PAM type: NRG; PAM sequence: TGG
agctgtgttagtgtggacac

SEQ ID NO: 52202 - DNA, 20 bp, Artificial Sequence
  Description of Artificial Sequence: Synthetic oligonucleotide
  Target: SCN9A; (+) strand; PAM type: NRG; PAM sequence: GAG
ctgtgttagtgtggacactg

SEQ ID NO: 52203 - DNA, 20 bp, Artificial Sequence
  Description of Artificial Sequence: Synthetic oligonucleotide
  Target: SCN9A; (+) strand; PAM type: NRG; PAM sequence: AAG
gttagtgtggacactggagt

SEQ ID NO: 52204 - DNA, 20 bp, Artificial Sequence
  Description of Artificial Sequence: Synthetic oligonucleotide
  Target: SCN9A; (+) strand; PAM type: NRG; PAM sequence: TGG
gccgttgaccttctaaattt

SEQ ID NO: 52205 - DNA, 20 bp, Artificial Sequence
  Description of Artificial Sequence: Synthetic oligonucleotide
  Target: SCN9A; (+) strand; PAM type: NRG; PAM sequence: TGG
ccttctaaattttggaaaca

SEQ ID NO: 52206 - DNA, 20 bp, Artificial Sequence
  Description of Artificial Sequence: Synthetic oligonucleotide
  Target: SCN9A; (+) strand; PAM type: NRG; PAM sequence: TAG
aattttggaaacatggtcac

SEQ ID NO: 52207 - DNA, 20 bp, Artificial Sequence
  Description of Artificial Sequence: Synthetic oligonucleotide
  Target: SCN9A; (+) strand; PAM type: NRG; PAM sequence: GAG
ttttggaaacatggtcacta

SEQ ID NO: 52208 - DNA, 20 bp, Artificial Sequence
  Description of Artificial Sequence: Synthetic oligonucleotide
  Target: SCN9A; (+) strand; PAM type: NRG; PAM sequence: TGG
tggaaacatggtcactagag

SEQ ID NO: 52209 - DNA, 20 bp, Artificial Sequence
  Description of Artificial Sequence: Synthetic oligonucleotide
  Target: SCN9A; (+) strand; PAM type: NRG; PAM sequence: GGG
ggaaacatggtcactagagt

SEQ ID NO: 52210 - DNA, 20 bp, Artificial Sequence
  Description of Artificial Sequence: Synthetic oligonucleotide
  Target: SCN9A; (+) strand; PAM type: NRG; PAM sequence: TGG
agagtgggacacttactgat

SEQ ID NO: 52211 - DNA, 20 bp, Artificial Sequence
  Description of Artificial Sequence: Synthetic oligonucleotide
  Target: SCN9A; (+) strand; PAM type: NRG; PAM sequence: TAG
cttactgattggctgttctc

SEQ ID NO: 52212 - DNA, 20 bp, Artificial Sequence
  Description of Artificial Sequence: Synthetic oligonucleotide
  Target: SCN9A; (+) strand; PAM type: NRG; PAM sequence: TAG
ttggctgttctctagcacca

SEQ ID NO: 52213 - DNA, 20 bp, Artificial Sequence
  Description of Artificial Sequence: Synthetic oligonucleotide
  Target: SCN9A; (+) strand; PAM type: NRG; PAM sequence: AGG
tggctgttctctagcaccat

SEQ ID NO: 52214 - DNA, 20 bp, Artificial Sequence
  Description of Artificial Sequence: Synthetic oligonucleotide
  Target: SCN9A; (+) strand; PAM type: NRG; PAM sequence: GGG
ggctgttctctagcaccata

SEQ ID NO: 52215 - DNA, 20 bp, Artificial Sequence
  Description of Artificial Sequence: Synthetic oligonucleotide
  Target: SCN9A; (+) strand; PAM type: NRG; PAM sequence: GGG
gctgttctctagcaccatag

SEQ ID NO: 52216 - DNA, 20 bp, Artificial Sequence
  Description of Artificial Sequence: Synthetic oligonucleotide
  Target: SCN9A; (+) strand; PAM type: NRG; PAM sequence: CAG
gttctctagcaccatagggg

SEQ ID NO: 52217 - DNA, 20 bp, Artificial Sequence
  Description of Artificial Sequence: Synthetic oligonucleotide
  Target: SCN9A; (+) strand; PAM type: NRG; PAM sequence: AGG
ttctctagcaccataggggc

SEQ ID NO: 52218 - DNA, 20 bp, Artificial Sequence
  Description of Artificial Sequence: Synthetic oligonucleotide
  Target: SCN9A; (+) strand; PAM type: NRG; PAM sequence: CAG
accataggggcaggcactga

SEQ ID NO: 52219 - DNA, 20 bp, Artificial Sequence
  Description of Artificial Sequence: Synthetic oligonucleotide
  Target: SCN9A; (+) strand; PAM type: NRG; PAM sequence: AGG
ccataggggcaggcactgac

SEQ ID NO: 52220 - DNA, 20 bp, Artificial Sequence
  Description of Artificial Sequence: Synthetic oligonucleotide
  Target: SCN9A; (+) strand; PAM type: NRG; PAM sequence: GGG
cataggggcaggcactgaca

SEQ ID NO: 52221 - DNA, 20 bp, Artificial Sequence
  Description of Artificial Sequence: Synthetic oligonucleotide
  Target: SCN9A; (+) strand; PAM type: NRG; PAM sequence: CGG
ggcactgacagggtgatgtt

SEQ ID NO: 52222 - DNA, 20 bp, Artificial Sequence
  Description of Artificial Sequence: Synthetic oligonucleotide
  Target: SCN9A; (+) strand; PAM type: NRG; PAM sequence: GGG
gcactgacagggtgatgttc

SEQ ID NO: 52223 - DNA, 20 bp, Artificial Sequence
  Description of Artificial Sequence: Synthetic oligonucleotide
  Target: SCN9A; (+) strand; PAM type: NRG; PAM sequence: TGG
gacagggtgatgttcgggac

SEQ ID NO: 52224 - DNA, 20 bp, Artificial Sequence
  Description of Artificial Sequence: Synthetic oligonucleotide
  Target: SCN9A; (+) strand; PAM type: NRG; PAM sequence: GGG
acagggtgatgttcgggact

SEQ ID NO: 52225 - DNA, 20 bp, Artificial Sequence
  Description of Artificial Sequence: Synthetic oligonucleotide
  Target: SCN9A; (+) strand; PAM type: NRG; PAM sequence: GAG
agggtgatgttcgggactgg

SEQ ID NO: 52226 - DNA, 20 bp, Artificial Sequence
  Description of Artificial Sequence: Synthetic oligonucleotide
  Target: SCN9A; (+) strand; PAM type: NRG; PAM sequence: TAG
cgggactgggagtttatcat

SEQ ID NO: 52227 - DNA, 20 bp, Artificial Sequence
  Description of Artificial Sequence: Synthetic oligonucleotide
  Target: SCN9A; (+) strand; PAM type: NRG; PAM sequence: CAG
gactgggagtttatcattag

SEQ ID NO: 52228 - DNA, 20 bp, Artificial Sequence
  Description of Artificial Sequence: Synthetic oligonucleotide
  Target: SCN9A; (+) strand; PAM type: NRG; PAM sequence: AAG
tatcattagcagactttcaa

SEQ ID NO: 52229 - DNA, 20 bp, Artificial Sequence
  Description of Artificial Sequence: Synthetic oligonucleotide
  Target: SCN9A; (+) strand; PAM type: NRG; PAM sequence: TGG
ttagcagactttcaaaagct

SEQ ID NO: 52230 - DNA, 20 bp, Artificial Sequence
  Description of Artificial Sequence: Synthetic oligonucleotide
  Target: SCN9A; (+) strand; PAM type: NRG; PAM sequence: TGG
agactttcaaaagcttggac

SEQ ID NO: 52231 - DNA, 20 bp, Artificial Sequence
  Description of Artificial Sequence: Synthetic oligonucleotide
  Target: SCN9A; (+) strand; PAM type: NRG; PAM sequence: CAG
ggccttcacttgctaacttt

SEQ ID NO: 52232 - DNA, 20 bp, Artificial Sequence
  Description of Artificial Sequence: Synthetic oligonucleotide
  Target: SCN9A; (+) strand; PAM type: NRG; PAM sequence: AAG
cttcacttgctaactttcag

SEQ ID NO: 52233 - DNA, 20 bp, Artificial Sequence
  Description of Artificial Sequence: Synthetic oligonucleotide
  Target: SCN9A; (+) strand; PAM type: NRG; PAM sequence: TAG
cttgctaactttcagaagca

SEQ ID NO: 52234 - DNA, 20 bp, Artificial Sequence
  Description of Artificial Sequence: Synthetic oligonucleotide
  Target: SCN9A; (+) strand; PAM type: NRG; PAM sequence: TGG
actttcagaagcatagttac

SEQ ID NO: 52235 - DNA, 20 bp, Artificial Sequence
  Description of Artificial Sequence: Synthetic oligonucleotide
  Target: SCN9A; (+) strand; PAM type: NRG; PAM sequence: GAG
tttcagaagcatagttactg

SEQ ID NO: 52236 - DNA, 20 bp, Artificial Sequence
  Description of Artificial Sequence: Synthetic oligonucleotide
  Target: SCN9A; (+) strand; PAM type: NRG; PAM sequence: GAG
agaagcatagttactggagt

SEQ ID NO: 52237 - DNA, 20 bp, Artificial Sequence
  Description of Artificial Sequence: Synthetic oligonucleotide
  Target: SCN9A; (+) strand; PAM type: NRG; PAM sequence: AGG
gaagcatagttactggagtg

SEQ ID NO: 52238 - DNA, 20 bp, Artificial Sequence
  Description of Artificial Sequence: Synthetic oligonucleotide
  Target: SCN9A; (+) strand; PAM type: NRG; PAM sequence: CAG
gcatagttactggagtgagg

SEQ ID NO: 52239 - DNA, 20 bp, Artificial Sequence
  Description of Artificial Sequence: Synthetic oligonucleotide
  Target: SCN9A; (+) strand; PAM type: NRG; PAM sequence: TGG
ggagtgaggcagttattgac

SEQ ID NO: 52240 - DNA, 20 bp, Artificial Sequence
  Description of Artificial Sequence: Synthetic oligonucleotide
  Target: SCN9A; (+) strand; PAM type: NRG; PAM sequence: CAG
gttattgactggtttatttt

SEQ ID NO: 52241 - DNA, 20 bp, Artificial Sequence
  Description of Artificial Sequence: Synthetic oligonucleotide
  Target: SCN9A; (+) strand; PAM type: NRG; PAM sequence: TGG
ctggtttattttcagaaaca

SEQ ID NO: 52242 - DNA, 20 bp, Artificial Sequence
  Description of Artificial Sequence: Synthetic oligonucleotide
  Target: SCN9A; (+) strand; PAM type: NRG; PAM sequence: TGG
attttcagaaacatggccac

SEQ ID NO: 52243 - DNA, 20 bp, Artificial Sequence
  Description of Artificial Sequence: Synthetic oligonucleotide
  Target: SCN9A; (+) strand; PAM type: NRG; PAM sequence: GAG
agaaacatggccactggaat

SEQ ID NO: 52244 - DNA, 20 bp, Artificial Sequence
  Description of Artificial Sequence: Synthetic oligonucleotide
  Target: SCN9A; (+) strand; PAM type: NRG; PAM sequence: CAG
ccactggaatgagaatttca

SEQ ID NO: 52245 - DNA, 20 bp, Artificial Sequence
  Description of Artificial Sequence: Synthetic oligonucleotide
  Target: SCN9A; (+) strand; PAM type: NRG; PAM sequence: TAG
gaatgagaatttcacagatt

SEQ ID NO: 52246 - DNA, 20 bp, Artificial Sequence
  Description of Artificial Sequence: Synthetic oligonucleotide
  Target: SCN9A; (+) strand; PAM type: NRG; PAM sequence: CAG
tcacagatttagctgatttt

SEQ ID NO: 52247 - DNA, 20 bp, Artificial Sequence
  Description of Artificial Sequence: Synthetic oligonucleotide
  Target: SCN9A; (+) strand; PAM type: NRG; PAM sequence: GAG
acagatttagctgattttca

SEQ ID NO: 52248 - DNA, 20 bp, Artificial Sequence
  Description of Artificial Sequence: Synthetic oligonucleotide
  Target: SCN9A; (+) strand; PAM type: NRG; PAM sequence: GAG
agagcctgtgtactgattct

SEQ ID NO: 52249 - DNA, 20 bp, Artificial Sequence
  Description of Artificial Sequence: Synthetic oligonucleotide
  Target: SCN9A; (+) strand; PAM type: NRG; PAM sequence: TGG
cctgttcacaacttgaaact

SEQ ID NO: 52250 - DNA, 20 bp, Artificial Sequence
  Description of Artificial Sequence: Synthetic oligonucleotide
  Target: SCN9A; (+) strand; PAM type: NRG; PAM sequence: GGG
ctgttcacaacttgaaactt

SEQ ID NO: 52251 - DNA, 20 bp, Artificial Sequence
  Description of Artificial Sequence: Synthetic oligonucleotide
  Target: SCN9A; (+) strand; PAM type: NRG; PAM sequence: AAG
caacttgaaacttgggctta

SEQ ID NO: 52252 - DNA, 20 bp, Artificial Sequence
  Description of Artificial Sequence: Synthetic oligonucleotide
  Target: SCN9A; (+) strand; PAM type: NRG; PAM sequence: AAG
ctttcttgaatatgaaaaat

SEQ ID NO: 52253 - DNA, 20 bp, Artificial Sequence
  Description of Artificial Sequence: Synthetic oligonucleotide
  Target: SCN9A; (+) strand; PAM type: NRG; PAM sequence: CAG
ttgaatatgaaaaataagca

SEQ ID NO: 52254 - DNA, 20 bp, Artificial Sequence
  Description of Artificial Sequence: Synthetic oligonucleotide
  Target: SCN9A; (+) strand; PAM type: NRG; PAM sequence: GAG
atgaaaaataagcacagtct

SEQ ID NO: 52255 - DNA, 20 bp, Artificial Sequence
  Description of Artificial Sequence: Synthetic oligonucleotide
  Target: SCN9A; (+) strand; PAM type: NRG; PAM sequence: CAG
aagcacagtctgagcatgta

SEQ ID NO: 52256 - DNA, 20 bp, Artificial Sequence
  Description of Artificial Sequence: Synthetic oligonucleotide
  Target: SCN9A; (+) strand; PAM type: NRG; PAM sequence: GAG
gcacagtctgagcatgtaca

SEQ ID NO: 52257 - DNA, 20 bp, Artificial Sequence
  Description of Artificial Sequence: Synthetic oligonucleotide
  Target: SCN9A; (+) strand; PAM type: NRG; PAM sequence: CAG
tcattatttcctaatgaatg

SEQ ID NO: 52258 - DNA, 20 bp, Artificial Sequence
  Description of Artificial Sequence: Synthetic oligonucleotide
  Target: SCN9A; (+) strand; PAM type: NRG; PAM sequence: TGG
cagaataacaacaattacat

SEQ ID NO: 52259 - DNA, 20 bp, Artificial Sequence
  Description of Artificial Sequence: Synthetic oligonucleotide
  Target: SCN9A; (+) strand; PAM type: NRG; PAM sequence: TAG
taacaacaattacattggat

SEQ ID NO: 52260 - DNA, 20 bp, Artificial Sequence
  Description of Artificial Sequence: Synthetic oligonucleotide
  Target: SCN9A; (+) strand; PAM type: NRG; PAM sequence: AGG
aacaacaattacattggatt

SEQ ID NO: 52261 - DNA, 20 bp, Artificial Sequence
  Description of Artificial Sequence: Synthetic oligonucleotide
  Target: SCN9A; (+) strand; PAM type: NRG; PAM sequence: AAG
tacattggattaggtattat

SEQ ID NO: 52262 - DNA, 20 bp, Artificial Sequence
  Description of Artificial Sequence: Synthetic oligonucleotide
  Target: SCN9A; (+) strand; PAM type: NRG; PAM sequence: TAG
attaggtattataagtaatc

SEQ ID NO: 52263 - DNA, 20 bp, Artificial Sequence
  Description of Artificial Sequence: Synthetic oligonucleotide
  Target: SCN9A; (+) strand; PAM type: NRG; PAM sequence: GAG
taggtattataagtaatcta

SEQ ID NO: 52264 - DNA, 20 bp, Artificial Sequence
  Description of Artificial Sequence: Synthetic oligonucleotide
  Target: SCN9A; (+) strand; PAM type: NRG; PAM sequence: AAG
agtaatctagagatgattta

SEQ ID NO: 52265 - DNA, 20 bp, Artificial Sequence
  Description of Artificial Sequence: Synthetic oligonucleotide
  Target: SCN9A; (+) strand; PAM type: NRG; PAM sequence: CGG
tagagatgatttaaagtata

SEQ ID NO: 52266 - DNA, 20 bp, Artificial Sequence
  Description of Artificial Sequence: Synthetic oligonucleotide
  Target: SCN9A; (+) strand; PAM type: NRG; PAM sequence: TAG
agatgatttaaagtatacgg

SEQ ID NO: 52267 - DNA, 20 bp, Artificial Sequence
  Description of Artificial Sequence: Synthetic oligonucleotide
  Target: SCN9A; (+) strand; PAM type: NRG; PAM sequence: AGG
gatgatttaaagtatacggt

SEQ ID NO: 52268 - DNA, 20 bp, Artificial Sequence
  Description of Artificial Sequence: Synthetic oligonucleotide
  Target: SCN9A; (+) strand; PAM type: NRG; PAM sequence: TAG
agtatacggtaggatgtgaa

SEQ ID NO: 52269 - DNA, 20 bp, Artificial Sequence
  Description of Artificial Sequence: Synthetic oligonucleotide
  Target: SCN9A; (+) strand; PAM type: NRG; PAM sequence: AAG
atgttacaccattttatgta

SEQ ID NO: 52270 - DNA, 20 bp, Artificial Sequence
  Description of Artificial Sequence: Synthetic oligonucleotide
  Target: SCN9A; (+) strand; PAM type: NRG; PAM sequence: GAG
ccattttatgtaaagaactt

SEQ ID NO: 52271 - DNA, 20 bp, Artificial Sequence
  Description of Artificial Sequence: Synthetic oligonucleotide
  Target: SCN9A; (+) strand; PAM type: NRG; PAM sequence: CAG
gtaaagaacttgagcatctc

SEQ ID NO: 52272 - DNA, 20 bp, Artificial Sequence
  Description of Artificial Sequence: Synthetic oligonucleotide
  Target: SCN9A; (+) strand; PAM type: NRG; PAM sequence: CAG
acttgagcatctccagattt

SEQ ID NO: 52273 - DNA, 20 bp, Artificial Sequence
  Description of Artificial Sequence: Synthetic oligonucleotide
  Target: SCN9A; (+) strand; PAM type: NRG; PAM sequence: GAG
tccagatttcagtatctcat

SEQ ID NO: 52274 - DNA, 20 bp, Artificial Sequence
  Description of Artificial Sequence: Synthetic oligonucleotide
  Target: SCN9A; (+) strand; PAM type: NRG; PAM sequence: AGG
ccagatttcagtatctcatg

SEQ ID NO: 52275 - DNA, 20 bp, Artificial Sequence
  Description of Artificial Sequence: Synthetic oligonucleotide
  Target: SCN9A; (+) strand; PAM type: NRG; PAM sequence: TAG
ttcagtatctcatgaggtcc

SEQ ID NO: 52276 - DNA, 20 bp, Artificial Sequence
  Description of Artificial Sequence: Synthetic oligonucleotide
  Target: SCN9A; (+) strand; PAM type: NRG; PAM sequence: GAG
accaatccctcactgatact

SEQ ID NO: 52277 - DNA, 20 bp, Artificial Sequence
  Description of Artificial Sequence: Synthetic oligonucleotide
  Target: SCN9A; (+) strand; PAM type: NRG; PAM sequence: AGG
ccaatccctcactgatactg

SEQ ID NO: 52278 - DNA, 20 bp, Artificial Sequence
  Description of Artificial Sequence: Synthetic oligonucleotide
  Target: SCN9A; (+) strand; PAM type: NRG; PAM sequence: GGG
caatccctcactgatactga

SEQ ID NO: 52279 - DNA, 20 bp, Artificial Sequence
  Description of Artificial Sequence: Synthetic oligonucleotide
  Target: SCN9A; (+) strand; PAM type: NRG; PAM sequence: TGG
taattttctgcctgtgcttt

SEQ ID NO: 52280 - DNA, 20 bp, Artificial Sequence
  Description of Artificial Sequence: Synthetic oligonucleotide
  Target: SCN9A; (+) strand; PAM type: NRG; PAM sequence: TAG
ctgtgcttttggtgttccct

SEQ ID NO: 52281 - DNA, 20 bp, Artificial Sequence
  Description of Artificial Sequence: Synthetic oligonucleotide
  Target: SCN9A; (+) strand; PAM type: NRG; PAM sequence: TAG
gttcccttagccaaacctgc

SEQ ID NO: 52282 - DNA, 20 bp, Artificial Sequence
  Description of Artificial Sequence: Synthetic oligonucleotide
  Target: SCN9A; (+) strand; PAM type: NRG; PAM sequence: AAG
ccttagccaaacctgctaga

SEQ ID NO: 52283 - DNA, 20 bp, Artificial Sequence
  Description of Artificial Sequence: Synthetic oligonucleotide
  Target: SCN9A; (+) strand; PAM type: NRG; PAM sequence: GAG
ttagccaaacctgctagaaa

SEQ ID NO: 52284 - DNA, 20 bp, Artificial Sequence
  Description of Artificial Sequence: Synthetic oligonucleotide
  Target: SCN9A; (+) strand; PAM type: NRG; PAM sequence: AGG
tagccaaacctgctagaaag

SEQ ID NO: 52285 - DNA, 20 bp, Artificial Sequence
  Description of Artificial Sequence: Synthetic oligonucleotide
  Target: SCN9A; (+) strand; PAM type: NRG; PAM sequence: TAG
caaacctgctagaaagagga

SEQ ID NO: 52286 - DNA, 20 bp, Artificial Sequence
  Description of Artificial Sequence: Synthetic oligonucleotide
  Target: SCN9A; (+) strand; PAM type: NRG; PAM sequence: AGG
aaacctgctagaaagaggat

SEQ ID NO: 52287 - DNA, 20 bp, Artificial Sequence
  Description of Artificial Sequence: Synthetic oligonucleotide
  Target: SCN9A; (+) strand; PAM type: NRG; PAM sequence: GGG
aacctgctagaaagaggata

SEQ ID NO: 52288 - DNA, 20 bp, Artificial Sequence
  Description of Artificial Sequence: Synthetic oligonucleotide
  Target: SCN9A; (+) strand; PAM type: NRG; PAM sequence: AAG
gaaagaggatagggattgta

SEQ ID NO: 52289 - DNA, 20 bp, Artificial Sequence
  Description of Artificial Sequence: Synthetic oligonucleotide
  Target: SCN9A; (+) strand; PAM type: NRG; PAM sequence: TAG
attgtaaagattctcatttg

SEQ ID NO: 52290 - DNA, 20 bp, Artificial Sequence
  Description of Artificial Sequence: Synthetic oligonucleotide
  Target: SCN9A; (+) strand; PAM type: NRG; PAM sequence: GAG
tgtaaagattctcatttgta

SEQ ID NO: 52291 - DNA, 20 bp, Artificial Sequence
  Description of Artificial Sequence: Synthetic oligonucleotide
  Target: SCN9A; (+) strand; PAM type: NRG; PAM sequence: AGG
gtaaagattctcatttgtag

SEQ ID NO: 52292 - DNA, 20 bp, Artificial Sequence
  Description of Artificial Sequence: Synthetic oligonucleotide
  Target: SCN9A; (+) strand; PAM type: NRG; PAM sequence: TGG
atttgtagaggtaaacattt

SEQ ID NO: 52293 - DNA, 20 bp, Artificial Sequence
  Description of Artificial Sequence: Synthetic oligonucleotide
  Target: SCN9A; (+) strand; PAM type: NRG; PAM sequence: TGG
gtaaacattttggctaatgt

SEQ ID NO: 52294 - DNA, 20 bp, Artificial Sequence
  Description of Artificial Sequence: Synthetic oligonucleotide
  Target: SCN9A; (+) strand; PAM type: NRG; PAM sequence: AAG
tttggctaatgttggcattt

SEQ ID NO: 52295 - DNA, 20 bp, Artificial Sequence
  Description of Artificial Sequence: Synthetic oligonucleotide
  Target: SCN9A; (+) strand; PAM type: NRG; PAM sequence: CAG
ttaatcaccaattactgtcg

SEQ ID NO: 52296 - DNA, 20 bp, Artificial Sequence
  Description of Artificial Sequence: Synthetic oligonucleotide
  Target: SCN9A; (+) strand; PAM type: NRG; PAM sequence: TGG
caattactgtcgcagaaaaa

SEQ ID NO: 52297 - DNA, 20 bp, Artificial Sequence
  Description of Artificial Sequence: Synthetic oligonucleotide
  Target: SCN9A; (+) strand; PAM type: NRG; PAM sequence: AAG
tttttgtaatttattgaaaa

SEQ ID NO: 52298 - DNA, 20 bp, Artificial Sequence
  Description of Artificial Sequence: Synthetic oligonucleotide
  Target: SCN9A; (+) strand; PAM type: NRG; PAM sequence: AAG
gtaatttattgaaaaaagct

SEQ ID NO: 52299 - DNA, 20 bp, Artificial Sequence
  Description of Artificial Sequence: Synthetic oligonucleotide
  Target: SCN9A; (+) strand; PAM type: NRG; PAM sequence: CAG
tattgaaaaaagctaagata

SEQ ID NO: 52300 - DNA, 20 bp, Artificial Sequence
  Description of Artificial Sequence: Synthetic oligonucleotide
  Target: SCN9A; (+) strand; PAM type: NRG; PAM sequence: AGG
attgaaaaaagctaagatac

SEQ ID NO: 52301 - DNA, 20 bp, Artificial Sequence
  Description of Artificial Sequence: Synthetic oligonucleotide
  Target: SCN9A; (+) strand; PAM type: NRG; PAM sequence: TAG
aagctaagatacaggaaatt

SEQ ID NO: 52302 - DNA, 20 bp, Artificial Sequence
  Description of Artificial Sequence: Synthetic oligonucleotide
  Target: SCN9A; (+) strand; PAM type: NRG; PAM sequence: AGG
agctaagatacaggaaattt

SEQ ID NO: 52303 - DNA, 20 bp, Artificial Sequence
  Description of Artificial Sequence: Synthetic oligonucleotide
  Target: SCN9A; (+) strand; PAM type: NRG; PAM sequence: AAG
aaatttaggctgtcttgaca

SEQ ID NO: 52304 - DNA, 20 bp, Artificial Sequence
  Description of Artificial Sequence: Synthetic oligonucleotide
  Target: SCN9A; (+) strand; PAM type: NRG; PAM sequence: AAG
ctgtcttgacaaagccaata

SEQ ID NO: 52305 - DNA, 20 bp, Artificial Sequence
  Description of Artificial Sequence: Synthetic oligonucleotide
  Target: SCN9A; (+) strand; PAM type: NRG; PAM sequence: AGG
tgtcttgacaaagccaataa

SEQ ID NO: 52306 - DNA, 20 bp, Artificial Sequence
  Description of Artificial Sequence: Synthetic oligonucleotide
  Target: SCN9A; (+) strand; PAM type: NRG; PAM sequence: GGG
gtcttgacaaagccaataaa

SEQ ID NO: 52307 - DNA, 20 bp, Artificial Sequence
  Description of Artificial Sequence: Synthetic oligonucleotide
  Target: SCN9A; (+) strand; PAM type: NRG; PAM sequence: CAG
gacaaagccaataaagggtg

SEQ ID NO: 52308 - DNA, 20 bp, Artificial Sequence
  Description of Artificial Sequence: Synthetic oligonucleotide
  Target: SCN9A; (+) strand; PAM type: NRG; PAM sequence: AGG
acaaagccaataaagggtgc

SEQ ID NO: 52309 - DNA, 20 bp, Artificial Sequence
  Description of Artificial Sequence: Synthetic oligonucleotide
  Target: SCN9A; (+) strand; PAM type: NRG; PAM sequence: TAG
aaatcattacatacatttcc

SEQ ID NO: 52310 - DNA, 20 bp, Artificial Sequence
  Description of Artificial Sequence: Synthetic oligonucleotide
  Target: SCN9A; (+) strand; PAM type: NRG; PAM sequence: TAG
tcctagtttcatatactgta

SEQ ID NO: 52311 - DNA, 20 bp, Artificial Sequence
  Description of Artificial Sequence: Synthetic oligonucleotide
  Target: SCN9A; (+) strand; PAM type: NRG; PAM sequence: CGG
ttcatatactgtatagatat

SEQ ID NO: 52312 - DNA, 20 bp, Artificial Sequence
  Description of Artificial Sequence: Synthetic oligonucleotide
  Target: SCN9A; (+) strand; PAM type: NRG; PAM sequence: TGG
tatcggactctcctccctca

SEQ ID NO: 52313 - DNA, 20 bp, Artificial Sequence
  Description of Artificial Sequence: Synthetic oligonucleotide
  Target: SCN9A; (+) strand; PAM type: NRG; PAM sequence: GGG
atcggactctcctccctcat

SEQ ID NO: 52314 - DNA, 20 bp, Artificial Sequence
  Description of Artificial Sequence: Synthetic oligonucleotide
  Target: SCN9A; (+) strand; PAM type: NRG; PAM sequence: TGG
tctcctccctcatgggaaca

SEQ ID NO: 52315 - DNA, 20 bp, Artificial Sequence
  Description of Artificial Sequence: Synthetic oligonucleotide
  Target: SCN9A; (+) strand; PAM type: NRG; PAM sequence: GAG
tcctccctcatgggaacatg

SEQ ID NO: 52316 - DNA, 20 bp, Artificial Sequence
  Description of Artificial Sequence: Synthetic oligonucleotide
  Target: SCN9A; (+) strand; PAM type: NRG; PAM sequence: AGG
cctccctcatgggaacatgg

SEQ ID NO: 52317 - DNA, 20 bp, Artificial Sequence
  Description of Artificial Sequence: Synthetic oligonucleotide
  Target: SCN9A; (+) strand; PAM type: NRG; PAM sequence: AAG
ccctcatgggaacatggagg

SEQ ID NO: 52318 - DNA, 20 bp, Artificial Sequence
  Description of Artificial Sequence: Synthetic oligonucleotide
  Target: SCN9A; (+) strand; PAM type: NRG; PAM sequence: AAG
tcatgggaacatggaggaag

SEQ ID NO: 52319 - DNA, 20 bp, Artificial Sequence
  Description of Artificial Sequence: Synthetic oligonucleotide
  Target: SCN9A; (+) strand; PAM type: NRG; PAM sequence: AGG
catgggaacatggaggaaga

SEQ ID NO: 52320 - DNA, 20 bp, Artificial Sequence
  Description of Artificial Sequence: Synthetic oligonucleotide
  Target: SCN9A; (+) strand; PAM type: NRG; PAM sequence: GGG
atgggaacatggaggaagaa

SEQ ID NO: 52321 - DNA, 20 bp, Artificial Sequence
  Description of Artificial Sequence: Synthetic oligonucleotide
  Target: SCN9A; (+) strand; PAM type: NRG; PAM sequence: TGG
aggaagaagggtgcttgcta

SEQ ID NO: 52322 - DNA, 20 bp, Artificial Sequence
  Description of Artificial Sequence: Synthetic oligonucleotide
  Target: SCN9A; (+) strand; PAM type: NRG; PAM sequence: TGG
gggtgcttgctatggacacc

SEQ ID NO: 52323 - DNA, 20 bp, Artificial Sequence
  Description of Artificial Sequence: Synthetic oligonucleotide
  Target: SCN9A; (+) strand; PAM type: NRG; PAM sequence: TGG
tgcttgctatggacacctgg

SEQ ID NO: 52324 - DNA, 20 bp, Artificial Sequence
  Description of Artificial Sequence: Synthetic oligonucleotide
  Target: SCN9A; (+) strand; PAM type: NRG; PAM sequence: GGG
gcttgctatggacacctggt

SEQ ID NO: 52325 - DNA, 20 bp, Artificial Sequence
  Description of Artificial Sequence: Synthetic oligonucleotide
  Target: SCN9A; (+) strand; PAM type: NRG; PAM sequence: TAG
tgctatggacacctggtggg

SEQ ID NO: 52326 - DNA, 20 bp, Artificial Sequence
  Description of Artificial Sequence: Synthetic oligonucleotide
  Target: SCN9A; (+) strand; PAM type: NRG; PAM sequence: GAG
ctatggacacctggtgggta

SEQ ID NO: 52327 - DNA, 20 bp, Artificial Sequence
  Description of Artificial Sequence: Synthetic oligonucleotide
  Target: SCN9A; (+) strand; PAM type: NRG; PAM sequence: AGG
tatggacacctggtgggtag

SEQ ID NO: 52328 - DNA, 20 bp, Artificial Sequence
  Description of Artificial Sequence: Synthetic oligonucleotide
  Target: SCN9A; (+) strand; PAM type: NRG; PAM sequence: CAG
gacacctggtgggtagagga

SEQ ID NO: 52329 - DNA, 20 bp, Artificial Sequence
  Description of Artificial Sequence: Synthetic oligonucleotide
  Target: SCN9A; (+) strand; PAM type: NRG; PAM sequence: GAG
cacctggtgggtagaggaca

SEQ ID NO: 52330 - DNA, 20 bp, Artificial Sequence
  Description of Artificial Sequence: Synthetic oligonucleotide
  Target: SCN9A; (+) strand; PAM type: NRG; PAM sequence: GAG
cctggtgggtagaggacaga

SEQ ID NO: 52331 - DNA, 20 bp, Artificial Sequence
  Description of Artificial Sequence: Synthetic oligonucleotide
  Target: SCN9A; (+) strand; PAM type: NRG; PAM sequence: AGG
ctggtgggtagaggacagag

SEQ ID NO: 52332 - DNA, 20 bp, Artificial Sequence
  Description of Artificial Sequence: Synthetic oligonucleotide
  Target: SCN9A; (+) strand; PAM type: NRG; PAM sequence: AAG
agaggacagagaggctgcta

SEQ ID NO: 52333 - DNA, 20 bp, Artificial Sequence
  Description of Artificial Sequence: Synthetic oligonucleotide
  Target: SCN9A; (+) strand; PAM type: NRG; PAM sequence: TAG
agaggctgctaaagttccta

SEQ ID NO: 52334 - DNA, 20 bp, Artificial Sequence
  Description of Artificial Sequence: Synthetic oligonucleotide
  Target: SCN9A; (+) strand; PAM type: NRG; PAM sequence: AGG
gaggctgctaaagttcctat

SEQ ID NO: 52335 - DNA, 20 bp, Artificial Sequence
  Description of Artificial Sequence: Synthetic oligonucleotide
  Target: SCN9A; (+) strand; PAM type: NRG; PAM sequence: AAG
gaatgcccccaaaatcgatt

SEQ ID NO: 52336 - DNA, 20 bp, Artificial Sequence
  Description of Artificial Sequence: Synthetic oligonucleotide
  Target: SCN9A; (+) strand; PAM type: NRG; PAM sequence: GAG
cccccaaaatcgattaagct

SEQ ID NO: 52337 - DNA, 20 bp, Artificial Sequence
  Description of Artificial Sequence: Synthetic oligonucleotide
  Target: SCN9A; (+) strand; PAM type: NRG; PAM sequence: AGG
ccccaaaatcgattaagctg

SEQ ID NO: 52338 - DNA, 20 bp, Artificial Sequence
  Description of Artificial Sequence: Synthetic oligonucleotide
  Target: SCN9A; (+) strand; PAM type: NRG; PAM sequence: GAG
aaatcgattaagctgaggtt

SEQ ID NO: 52339 - DNA, 20 bp, Artificial Sequence
  Description of Artificial Sequence: Synthetic oligonucleotide
  Target: SCN9A; (+) strand; PAM type: NRG; PAM sequence: TAG
gaggttgagaaacctatgct

SEQ ID NO: 52340 - DNA, 20 bp, Artificial Sequence
  Description of Artificial Sequence: Synthetic oligonucleotide
  Target: SCN9A; (+) strand; PAM type: NRG; PAM sequence: TGG
gcttagaccacaatttcacc

SEQ ID NO: 52341 - DNA, 20 bp, Artificial Sequence
  Description of Artificial Sequence: Synthetic oligonucleotide
  Target: SCN9A; (+) strand; PAM type: NRG; PAM sequence: GAG
ttagaccacaatttcacctg

SEQ ID NO: 52342 - DNA, 20 bp, Artificial Sequence
  Description of Artificial Sequence: Synthetic oligonucleotide
  Target: SCN9A; (+) strand; PAM type: NRG; PAM sequence: AGG
tagaccacaatttcacctgg

SEQ ID NO: 52343 - DNA, 20 bp, Artificial Sequence
  Description of Artificial Sequence: Synthetic oligonucleotide
  Target: SCN9A; (+) strand; PAM type: NRG; PAM sequence: CAG
ctttttccatttaacaatgc

SEQ ID NO: 52344 - DNA, 20 bp, Artificial Sequence
  Description of Artificial Sequence: Synthetic oligonucleotide
  Target: SCN9A; (+) strand; PAM type: NRG; PAM sequence: AGG
tttttccatttaacaatgcc

SEQ ID NO: 52345 - DNA, 20 bp, Artificial Sequence
  Description of Artificial Sequence: Synthetic oligonucleotide
  Target: SCN9A; (+) strand; PAM type: NRG; PAM sequence: GGG
ttttccatttaacaatgcca

SEQ ID NO: 52346 - DNA, 20 bp, Artificial Sequence
  Description of Artificial Sequence: Synthetic oligonucleotide
  Target: SCN9A; (+) strand; PAM type: NRG; PAM sequence: TAG
tttaacaatgccagggtcct

SEQ ID NO: 52347 - DNA, 20 bp, Artificial Sequence
  Description of Artificial Sequence: Synthetic oligonucleotide
  Target: SCN9A; (+) strand; PAM type: NRG; PAM sequence: TGG
ttagaacttacttgctcctt

SEQ ID NO: 52348 - DNA, 20 bp, Artificial Sequence
  Description of Artificial Sequence: Synthetic oligonucleotide
  Target: SCN9A; (+) strand; PAM type: NRG; PAM sequence: CGG
tgctttgtttacactgtaaa

SEQ ID NO: 52349 - DNA, 20 bp, Artificial Sequence
  Description of Artificial Sequence: Synthetic oligonucleotide
  Target: SCN9A; (+) strand; PAM type: NRG; PAM sequence: GAG
gtttacactgtaaacggcct

SEQ ID NO: 52350 - DNA, 20 bp, Artificial Sequence
  Description of Artificial Sequence: Synthetic oligonucleotide
  Target: SCN9A; (+) strand; PAM type: NRG; PAM sequence: GAG
ttacactgtaaacggcctga

SEQ ID NO: 52351 - DNA, 20 bp, Artificial Sequence
  Description of Artificial Sequence: Synthetic oligonucleotide
  Target: SCN9A; (+) strand; PAM type: NRG; PAM sequence: AGG
tacactgtaaacggcctgag

SEQ ID NO: 52352 - DNA, 20 bp, Artificial Sequence
  Description of Artificial Sequence: Synthetic oligonucleotide
  Target: SCN9A; (+) strand; PAM type: NRG; PAM sequence: TGG
ctgtaaacggcctgagaggc

SEQ ID NO: 52353 - DNA, 20 bp, Artificial Sequence
  Description of Artificial Sequence: Synthetic oligonucleotide
  Target: SCN9A; (+) strand; PAM type: NRG; PAM sequence: TGG
aaacggcctgagaggctggc

SEQ ID NO: 52354 - DNA, 20 bp, Artificial Sequence
  Description of Artificial Sequence: Synthetic oligonucleotide
  Target: SCN9A; (+) strand; PAM type: NRG; PAM sequence: GGG
aacggcctgagaggctggct

SEQ ID NO: 52355 - DNA, 20 bp, Artificial Sequence
  Description of Artificial Sequence: Synthetic oligonucleotide
  Target: SCN9A; (+) strand; PAM type: NRG; PAM sequence: TAG
tgagaggctggctgggtttt

SEQ ID NO: 52356 - DNA, 20 bp, Artificial Sequence
  Description of Artificial Sequence: Synthetic oligonucleotide
  Target: SCN9A; (+) strand; PAM type: NRG; PAM sequence: GAG
tttttagttctatatcttct

SEQ ID NO: 52357 - DNA, 20 bp, Artificial Sequence
  Description of Artificial Sequence: Synthetic oligonucleotide
  Target: SCN9A; (+) strand; PAM type: NRG; PAM sequence: GAG
tttagttctatatcttctga

SEQ ID NO: 52358 - DNA, 20 bp, Artificial Sequence
  Description of Artificial Sequence: Synthetic oligonucleotide
  Target: SCN9A; (+) strand; PAM type: NRG; PAM sequence: AGG
ttagttctatatcttctgag

SEQ ID NO: 52359 - DNA, 20 bp, Artificial Sequence
  Description of Artificial Sequence: Synthetic oligonucleotide
  Target: SCN9A; (+) strand; PAM type: NRG; PAM sequence: TAG
atatcttctgagaggtattc

SEQ ID NO: 52360 - DNA, 20 bp, Artificial Sequence
  Description of Artificial Sequence: Synthetic oligonucleotide
  Target: SCN9A; (+) strand; PAM type: NRG; PAM sequence: AGG
tatcttctgagaggtattct

SEQ ID NO: 52361 - DNA, 20 bp, Artificial Sequence
  Description of Artificial Sequence: Synthetic oligonucleotide
  Target: SCN9A; (+) strand; PAM type: NRG; PAM sequence: AAG
aggcttccaatatatccacc

SEQ ID NO: 52362 - DNA, 20 bp, Artificial Sequence
  Description of Artificial Sequence: Synthetic oligonucleotide
  Target: SCN9A; (+) strand; PAM type: NRG; PAM sequence: AGG
ggcttccaatatatccacca

SEQ ID NO: 52363 - DNA, 20 bp, Artificial Sequence
  Description of Artificial Sequence: Synthetic oligonucleotide
  Target: SCN9A; (+) strand; PAM type: NRG; PAM sequence: CAG
ggctaatcactaactgtttt

SEQ ID NO: 52364 - DNA, 20 bp, Artificial Sequence
  Description of Artificial Sequence: Synthetic oligonucleotide
  Target: SCN9A; (+) strand; PAM type: NRG; PAM sequence: CAG
gttttcagttgtaatcattc

SEQ ID NO: 52365 - DNA, 20 bp, Artificial Sequence
  Description of Artificial Sequence: Synthetic oligonucleotide
  Target: SCN9A; (+) strand; PAM type: NRG; PAM sequence: CAG
gtaatcattccagtgtcatc

SEQ ID NO: 52366 - DNA, 20 bp, Artificial Sequence
  Description of Artificial Sequence: Synthetic oligonucleotide
  Target: SCN9A; (+) strand; PAM type: NRG; PAM sequence: AAG
tccagtgtcatccagtgatt

SEQ ID NO: 52367 - DNA, 20 bp, Artificial Sequence
  Description of Artificial Sequence: Synthetic oligonucleotide
  Target: SCN9A; (+) strand; PAM type: NRG; PAM sequence: AAG
tcatccagtgattaagctct

SEQ ID NO: 52368 - DNA, 20 bp, Artificial Sequence
  Description of Artificial Sequence: Synthetic oligonucleotide
  Target: SCN9A; (+) strand; PAM type: NRG; PAM sequence: TGG
agtgattaagctctaagctt

SEQ ID NO: 52369 - DNA, 20 bp, Artificial Sequence
  Description of Artificial Sequence: Synthetic oligonucleotide
  Target: SCN9A; (+) strand; PAM type: NRG; PAM sequence: TAG
aagctttggtactcctttta

SEQ ID NO: 52370 - DNA, 20 bp, Artificial Sequence
  Description of Artificial Sequence: Synthetic oligonucleotide
  Target: SCN9A; (+) strand; PAM type: NRG; PAM sequence: AAG
cttttatagtacacttaata

SEQ ID NO: 52371 - DNA, 20 bp, Artificial Sequence
  Description of Artificial Sequence: Synthetic oligonucleotide
  Target: SCN9A; (+) strand; PAM type: NRG; PAM sequence: AGG
ttttatagtacacttaataa

SEQ ID NO: 52372 - DNA, 20 bp, Artificial Sequence
  Description of Artificial Sequence: Synthetic oligonucleotide
  Target: SCN9A; (+) strand; PAM type: NRG; PAM sequence: GAG
taataaaggatacctgtgct

SEQ ID NO: 52373 - DNA, 20 bp, Artificial Sequence
  Description of Artificial Sequence: Synthetic oligonucleotide
  Target: SCN9A; (+) strand; PAM type: NRG; PAM sequence: TAG
aggatacctgtgctgagttg

SEQ ID NO: 52374 - DNA, 20 bp, Artificial Sequence
  Description of Artificial Sequence: Synthetic oligonucleotide
  Target: SCN9A; (+) strand; PAM type: NRG; PAM sequence: TGG
ctgtgctgagttgtagaccc

SEQ ID NO: 52375 - DNA, 20 bp, Artificial Sequence
  Description of Artificial Sequence: Synthetic oligonucleotide
  Target: SCN9A; (+) strand; PAM type: NRG; PAM sequence: GGG
tgtgctgagttgtagaccct

SEQ ID NO: 52376 - DNA, 20 bp, Artificial Sequence
  Description of Artificial Sequence: Synthetic oligonucleotide
  Target: SCN9A; (+) strand; PAM type: NRG; PAM sequence: TGG
gggcattgacactaactcat

SEQ ID NO: 52377 - DNA, 20 bp, Artificial Sequence
  Description of Artificial Sequence: Synthetic oligonucleotide
  Target: SCN9A; (+) strand; PAM type: NRG; PAM sequence: AAG
tgattattttcattattttt

SEQ ID NO: 52378 - DNA, 20 bp, Artificial Sequence
  Description of Artificial Sequence: Synthetic oligonucleotide
  Target: SCN9A; (+) strand; PAM type: NRG; PAM sequence: AGG
gattattttcattattttta

SEQ ID NO: 52379 - DNA, 20 bp, Artificial Sequence
  Description of Artificial Sequence: Synthetic oligonucleotide
  Target: SCN9A; (+) strand; PAM type: NRG; PAM sequence: GGG
attattttcattatttttaa

SEQ ID NO: 52380 - DNA, 20 bp, Artificial Sequence
  Description of Artificial Sequence: Synthetic oligonucleotide
  Target: SCN9A; (+) strand; PAM type: NRG; PAM sequence: AAG
aagggactatttccttaaca

SEQ ID NO: 52381 - DNA, 20 bp, Artificial Sequence
  Description of Artificial Sequence: Synthetic oligonucleotide
  Target: SCN9A; (+) strand; PAM type: NRG; PAM sequence: AAG
gactatttccttaacaaaga

SEQ ID NO: 52382 - DNA, 20 bp, Artificial Sequence
  Description of Artificial Sequence: Synthetic oligonucleotide
  Target: SCN9A; (+) strand; PAM type: NRG; PAM sequence: TGG
tatttccttaacaaagaaag

SEQ ID NO: 52383 - DNA, 20 bp, Artificial Sequence
  Description of Artificial Sequence: Synthetic oligonucleotide
  Target: SCN9A; (+) strand; PAM type: NRG; PAM sequence: GAG
tttccttaacaaagaaagtg

SEQ ID NO: 52384 - DNA, 20 bp, Artificial Sequence
  Description of Artificial Sequence: Synthetic oligonucleotide
  Target: SCN9A; (+) strand; PAM type: NRG; PAM sequence: GAG
tccttaacaaagaaagtgga

SEQ ID NO: 52385 - DNA, 20 bp, Artificial Sequence
  Description of Artificial Sequence: Synthetic oligonucleotide
  Target: SCN9A; (+) strand; PAM type: NRG; PAM sequence: AAG
taacaaagaaagtggagaga

SEQ ID NO: 52386 - DNA, 20 bp, Artificial Sequence
  Description of Artificial Sequence: Synthetic oligonucleotide
  Target: SCN9A; (+) strand; PAM type: NRG; PAM sequence: AGG
aacaaagaaagtggagagaa

SEQ ID NO: 52387 - DNA, 20 bp, Artificial Sequence
  Description of Artificial Sequence: Synthetic oligonucleotide
  Target: SCN9A; (+) strand; PAM type: NRG; PAM sequence: GGG
acaaagaaagtggagagaaa

SEQ ID NO: 52388 - DNA, 20 bp, Artificial Sequence
  Description of Artificial Sequence: Synthetic oligonucleotide
  Target: SCN9A; (+) strand; PAM type: NRG; PAM sequence: GGG
caaagaaagtggagagaaag

SEQ ID NO: 52389 - DNA, 20 bp, Artificial Sequence
  Description of Artificial Sequence: Synthetic oligonucleotide
  Target: SCN9A; (+) strand; PAM type: NRG; PAM sequence: GGG
aaagaaagtggagagaaagg

SEQ ID NO: 52390 - DNA, 20 bp, Artificial Sequence
  Description of Artificial Sequence: Synthetic oligonucleotide
  Target: SCN9A; (+) strand; PAM type: NRG; PAM sequence: CAG
aagtggagagaaagggggtc

SEQ ID NO: 52391 - DNA, 20 bp, Artificial Sequence
  Description of Artificial Sequence: Synthetic oligonucleotide
  Target: SCN9A; (+) strand; PAM type: NRG; PAM sequence: GAG
gtggagagaaagggggtcca

SEQ ID NO: 52392 - DNA, 20 bp, Artificial Sequence
  Description of Artificial Sequence: Synthetic oligonucleotide
  Target: SCN9A; (+) strand; PAM type: NRG; PAM sequence: AGG
tggagagaaagggggtccag

SEQ ID NO: 52393 - DNA, 20 bp, Artificial Sequence
  Description of Artificial Sequence: Synthetic oligonucleotide
  Target: SCN9A; (+) strand; PAM type: NRG; PAM sequence: AAG
agagaaagggggtccagagg

SEQ ID NO: 52394 - DNA, 20 bp, Artificial Sequence
  Description of Artificial Sequence: Synthetic oligonucleotide
  Target: SCN9A; (+) strand; PAM type: NRG; PAM sequence: AGG
gagaaagggggtccagagga

SEQ ID NO: 52395 - DNA, 20 bp, Artificial Sequence
  Description of Artificial Sequence: Synthetic oligonucleotide
  Target: SCN9A; (+) strand; PAM type: NRG; PAM sequence: TAG
aaagggggtccagaggaagg

SEQ ID NO: 52396 - DNA, 20 bp, Artificial Sequence
  Description of Artificial Sequence: Synthetic oligonucleotide
  Target: SCN9A; (+) strand; PAM type: NRG; PAM sequence: AAG
aaggtagatgtatgattttg

SEQ ID NO: 52397 - DNA, 20 bp, Artificial Sequence
  Description of Artificial Sequence: Synthetic oligonucleotide
  Target: SCN9A; (+) strand; PAM type: NRG; PAM sequence: GAG
ggtagatgtatgattttgaa

SEQ ID NO: 52398 - DNA, 20 bp, Artificial Sequence
  Description of Artificial Sequence: Synthetic oligonucleotide
  Target: SCN9A; (+) strand; PAM type: NRG; PAM sequence: AAG
tgtatgattttgaagagatt

SEQ ID NO: 52399 - DNA, 20 bp, Artificial Sequence
  Description of Artificial Sequence: Synthetic oligonucleotide
  Target: SCN9A; (+) strand; PAM type: NRG; PAM sequence: CAG
atgattttgaagagattaag

SEQ ID NO: 52400 - DNA, 20 bp, Artificial Sequence
  Description of Artificial Sequence: Synthetic oligonucleotide
  Target: SCN9A; (+) strand; PAM type: NRG; PAM sequence: AGG
tgattttgaagagattaagc

SEQ ID NO: 52401 - DNA, 20 bp, Artificial Sequence
  Description of Artificial Sequence: Synthetic oligonucleotide
  Target: SCN9A; (+) strand; PAM type: NRG; PAM sequence: AAG
gattaagcaggaaaatgatc

SEQ ID NO: 52402 - DNA, 20 bp, Artificial Sequence
  Description of Artificial Sequence: Synthetic oligonucleotide
  Target: SCN9A; (+) strand; PAM type: NRG; PAM sequence: TAG
tgtaaaactcacttttcaca

SEQ ID NO: 52403 - DNA, 20 bp, Artificial Sequence
  Description of Artificial Sequence: Synthetic oligonucleotide
  Target: SCN9A; (+) strand; PAM type: NRG; PAM sequence: TAG
aactcacttttcacatagtc

SEQ ID NO: 52404 - DNA, 20 bp, Artificial Sequence
  Description of Artificial Sequence: Synthetic oligonucleotide
  Target: SCN9A; (+) strand; PAM type: NRG; PAM sequence: GAG
ctcacttttcacatagtcta

SEQ ID NO: 52405 - DNA, 20 bp, Artificial Sequence
  Description of Artificial Sequence: Synthetic oligonucleotide
  Target: SCN9A; (+) strand; PAM type: NRG; PAM sequence: AGG
tcacttttcacatagtctag

SEQ ID NO: 52406 - DNA, 20 bp, Artificial Sequence
  Description of Artificial Sequence: Synthetic oligonucleotide
  Target: SCN9A; (+) strand; PAM type: NRG; PAM sequence: GGG
cacttttcacatagtctaga

SEQ ID NO: 52407 - DNA, 20 bp, Artificial Sequence
  Description of Artificial Sequence: Synthetic oligonucleotide
  Target: SCN9A; (+) strand; PAM type: NRG; PAM sequence: CAG
tagtctagagggtaaattta

SEQ ID NO: 52408 - DNA, 20 bp, Artificial Sequence
  Description of Artificial Sequence: Synthetic oligonucleotide
  Target: SCN9A; (+) strand; PAM type: NRG; PAM sequence: CAG
tctagagggtaaatttacag

SEQ ID NO: 52409 - DNA, 20 bp, Artificial Sequence
  Description of Artificial Sequence: Synthetic oligonucleotide
  Target: SCN9A; (+) strand; PAM type: NRG; PAM sequence: AAG
gagggtaaatttacagcaga

SEQ ID NO: 52410 - DNA, 20 bp, Artificial Sequence
  Description of Artificial Sequence: Synthetic oligonucleotide
  Target: SCN9A; (+) strand; PAM type: NRG; PAM sequence: CGG
taaatttacagcagaaagat

SEQ ID NO: 52411 - DNA, 20 bp, Artificial Sequence
  Description of Artificial Sequence: Synthetic oligonucleotide
  Target: SCN9A; (+) strand; PAM type: NRG; PAM sequence: AAG
cagcagaaagatcggttacc

SEQ ID NO: 52412 - DNA, 20 bp, Artificial Sequence
  Description of Artificial Sequence: Synthetic oligonucleotide
  Target: SCN9A; (+) strand; PAM type: NRG; PAM sequence: TGG
gtgaataaaactgatatgat

SEQ ID NO: 52413 - DNA, 20 bp, Artificial Sequence
  Description of Artificial Sequence: Synthetic oligonucleotide
  Target: SCN9A; (+) strand; PAM type: NRG; PAM sequence: TGG
aataaaactgatatgattgg

SEQ ID NO: 52414 - DNA, 20 bp, Artificial Sequence
  Description of Artificial Sequence: Synthetic oligonucleotide
  Target: SCN9A; (+) strand; PAM type: NRG; PAM sequence: GGG
ataaaactgatatgattggt

SEQ ID NO: 52415 - DNA, 20 bp, Artificial Sequence
  Description of Artificial Sequence: Synthetic oligonucleotide
  Target: SCN9A; (+) strand; PAM type: NRG; PAM sequence: GGG
taaaactgatatgattggtg

SEQ ID NO: 52416 - DNA, 20 bp, Artificial Sequence
  Description of Artificial Sequence: Synthetic oligonucleotide
  Target: SCN9A; (+) strand; PAM type: NRG; PAM sequence: GGG
aaaactgatatgattggtgg

SEQ ID NO: 52417 - DNA, 20 bp, Artificial Sequence
  Description of Artificial Sequence: Synthetic oligonucleotide
  Target: SCN9A; (+) strand; PAM type: NRG; PAM sequence: TGG
tgatatgattggtgggggta

SEQ ID NO: 52418 - DNA, 20 bp, Artificial Sequence
  Description of Artificial Sequence: Synthetic oligonucleotide
  Target: SCN9A; (+) strand; PAM type: NRG; PAM sequence: GAG
tgggggtatggaaacatatt

SEQ ID NO: 52419 - DNA, 20 bp, Artificial Sequence
  Description of Artificial Sequence: Synthetic oligonucleotide
  Target: SCN9A; (+) strand; PAM type: NRG; PAM sequence: AGG
gggggtatggaaacatattg

SEQ ID NO: 52420 - DNA, 20 bp, Artificial Sequence
  Description of Artificial Sequence: Synthetic oligonucleotide
  Target: SCN9A; (+) strand; PAM type: NRG; PAM sequence: TAG
tatggaaacatattgaggta

SEQ ID NO: 52421 - DNA, 20 bp, Artificial Sequence
  Description of Artificial Sequence: Synthetic oligonucleotide
  Target: SCN9A; (+) strand; PAM type: NRG; PAM sequence: AGG
atggaaacatattgaggtat

SEQ ID NO: 52422 - DNA, 20 bp, Artificial Sequence
  Description of Artificial Sequence: Synthetic oligonucleotide
  Target: SCN9A; (+) strand; PAM type: NRG; PAM sequence: TGG
catattgaggtataggtatg

SEQ ID NO: 52423 - DNA, 20 bp, Artificial Sequence
  Description of Artificial Sequence: Synthetic oligonucleotide
  Target: SCN9A; (+) strand; PAM type: NRG; PAM sequence: AAG
aggtatgtggttacatttga

SEQ ID NO: 52424 - DNA, 20 bp, Artificial Sequence
  Description of Artificial Sequence: Synthetic oligonucleotide
  Target: SCN9A; (+) strand; PAM type: NRG; PAM sequence: AAG
ttacatttgaaagataatga

SEQ ID NO: 52425 - DNA, 20 bp, Artificial Sequence
  Description of Artificial Sequence: Synthetic oligonucleotide
  Target: SCN9A; (+) strand; PAM type: NRG; PAM sequence: AGG
tacatttgaaagataatgaa

SEQ ID NO: 52426 - DNA, 20 bp, Artificial Sequence
  Description of Artificial Sequence: Synthetic oligonucleotide
  Target: SCN9A; (+) strand; PAM type: NRG; PAM sequence: TGG
tttgaaagataatgaaaggc

SEQ ID NO: 52427 - DNA, 20 bp, Artificial Sequence
  Description of Artificial Sequence: Synthetic oligonucleotide
  Target: SCN9A; (+) strand; PAM type: NRG; PAM sequence: TGG
agataatgaaaggctggaaa

SEQ ID NO: 52428 - DNA, 20 bp, Artificial Sequence
  Description of Artificial Sequence: Synthetic oligonucleotide
  Target: SCN9A; (+) strand; PAM type: NRG; PAM sequence: CAG
taatgaaaggctggaaatgg

SEQ ID NO: 52429 - DNA, 20 bp, Artificial Sequence
  Description of Artificial Sequence: Synthetic oligonucleotide
  Target: SCN9A; (+) strand; PAM type: NRG; PAM sequence: CGG
ctggaaatggcagttgaact

SEQ ID NO: 52430 - DNA, 20 bp, Artificial Sequence
  Description of Artificial Sequence: Synthetic oligonucleotide
  Target: SCN9A; (+) strand; PAM type: NRG; PAM sequence: GGG
tggaaatggcagttgaactc

SEQ ID NO: 52431 - DNA, 20 bp, Artificial Sequence
  Description of Artificial Sequence: Synthetic oligonucleotide
  Target: SCN9A; (+) strand; PAM type: NRG; PAM sequence: CAG
ggcagttgaactcgggattc

SEQ ID NO: 52432 - DNA, 20 bp, Artificial Sequence
  Description of Artificial Sequence: Synthetic oligonucleotide
  Target: SCN9A; (+) strand; PAM type: NRG; PAM sequence: AAG
agttgaactcgggattccag

SEQ ID NO: 52433 - DNA, 20 bp, Artificial Sequence
  Description of Artificial Sequence: Synthetic oligonucleotide
  Target: SCN9A; (+) strand; PAM type: NRG; PAM sequence: GAG
gaactcgggattccagaagt

SEQ ID NO: 52434 - DNA, 20 bp, Artificial Sequence
  Description of Artificial Sequence: Synthetic oligonucleotide
  Target: SCN9A; (+) strand; PAM type: NRG; PAM sequence: GAG
cgggattccagaagtgagat

SEQ ID NO: 52435 - DNA, 20 bp, Artificial Sequence
  Description of Artificial Sequence: Synthetic oligonucleotide
  Target: SCN9A; (+) strand; PAM type: NRG; PAM sequence: AAG
cagaagtgagatgagcatcc

SEQ ID NO: 52436 - DNA, 20 bp, Artificial Sequence
  Description of Artificial Sequence: Synthetic oligonucleotide
  Target: SCN9A; (+) strand; PAM type: NRG; PAM sequence: CAG
tgagcatccaagattacttt

SEQ ID NO: 52437 - DNA, 20 bp, Artificial Sequence
  Description of Artificial Sequence: Synthetic oligonucleotide
  Target: SCN9A; (+) strand; PAM type: NRG; PAM sequence: AGG
gagcatccaagattactttc

SEQ ID NO: 52438 - DNA, 20 bp, Artificial Sequence
  Description of Artificial Sequence: Synthetic oligonucleotide
  Target: SCN9A; (+) strand; PAM type: NRG; PAM sequence: TGG
ttactttcaggtatctgact

SEQ ID NO: 52439 - DNA, 20 bp, Artificial Sequence
  Description of Artificial Sequence: Synthetic oligonucleotide
  Target: SCN9A; (+) strand; PAM type: NRG; PAM sequence: AAG
ggtatctgacttggcctgcc

SEQ ID NO: 52440 - DNA, 20 bp, Artificial Sequence
  Description of Artificial Sequence: Synthetic oligonucleotide
  Target: SCN9A; (+) strand; PAM type: NRG; PAM sequence: CAG
ggcctgccaagttaatactc

SEQ ID NO: 52441 - DNA, 20 bp, Artificial Sequence
  Description of Artificial Sequence: Synthetic oligonucleotide
  Target: SCN9A; (+) strand; PAM type: NRG; PAM sequence: GAG
atactccagtgatttcttat

SEQ ID NO: 52442 - DNA, 20 bp, Artificial Sequence
  Description of Artificial Sequence: Synthetic oligonucleotide
  Target: SCN9A; (+) strand; PAM type: NRG; PAM sequence: GAG
actccagtgatttcttatga

SEQ ID NO: 52443 - DNA, 20 bp, Artificial Sequence
  Description of Artificial Sequence: Synthetic oligonucleotide
  Target: SCN9A; (+) strand; PAM type: NRG; PAM sequence: AGG
ctccagtgatttcttatgag

SEQ ID NO: 52444 - DNA, 20 bp, Artificial Sequence
  Description of Artificial Sequence: Synthetic oligonucleotide
  Target: SCN9A; (+) strand; PAM type: NRG; PAM sequence: TAG
gatttcttatgagaggaaac

SEQ ID NO: 52445 - DNA, 20 bp, Artificial Sequence
  Description of Artificial Sequence: Synthetic oligonucleotide
  Target: SCN9A; (+) strand; PAM type: NRG; PAM sequence: AGG
atttcttatgagaggaaact

SEQ ID NO: 52446 - DNA, 20 bp, Artificial Sequence
  Description of Artificial Sequence: Synthetic oligonucleotide
  Target: SCN9A; (+) strand; PAM type: NRG; PAM sequence: GAG
ttcttatgagaggaaactag

SEQ ID NO: 52447 - DNA, 20 bp, Artificial Sequence
  Description of Artificial Sequence: Synthetic oligonucleotide
  Target: SCN9A; (+) strand; PAM type: NRG; PAM sequence: AGG
tcttatgagaggaaactagg

SEQ ID NO: 52448 - DNA, 20 bp, Artificial Sequence
  Description of Artificial Sequence: Synthetic oligonucleotide
  Target: SCN9A; (+) strand; PAM type: NRG; PAM sequence: GAG
tgagaggaaactaggaggat

SEQ ID NO: 52449 - DNA, 20 bp, Artificial Sequence
  Description of Artificial Sequence: Synthetic oligonucleotide
  Target: SCN9A; (+) strand; PAM type: NRG; PAM sequence: AGG
gagaggaaactaggaggatg

SEQ ID NO: 52450 - DNA, 20 bp, Artificial Sequence
  Description of Artificial Sequence: Synthetic oligonucleotide
  Target: SCN9A; (+) strand; PAM type: NRG; PAM sequence: AAG
aactaggaggatgaggctta

SEQ ID NO: 52451 - DNA, 20 bp, Artificial Sequence
  Description of Artificial Sequence: Synthetic oligonucleotide
  Target: SCN9A; (+) strand; PAM type: NRG; PAM sequence: CAG
ggaggatgaggcttaaagaa

SEQ ID NO: 52452 - DNA, 20 bp, Artificial Sequence
  Description of Artificial Sequence: Synthetic oligonucleotide
  Target: SCN9A; (+) strand; PAM type: NRG; PAM sequence: AGG
gaggatgaggcttaaagaac

SEQ ID NO: 52453 - DNA, 20 bp, Artificial Sequence
  Description of Artificial Sequence: Synthetic oligonucleotide
  Target: SCN9A; (+) strand; PAM type: NRG; PAM sequence: GGG
aggatgaggcttaaagaaca

SEQ ID NO: 52454 - DNA, 20 bp, Artificial Sequence
  Description of Artificial Sequence: Synthetic oligonucleotide
  Target: SCN9A; (+) strand; PAM type: NRG; PAM sequence: AAG
atgaggcttaaagaacaggg

SEQ ID NO: 52455 - DNA, 20 bp, Artificial Sequence
  Description of Artificial Sequence: Synthetic oligonucleotide
  Target: SCN9A; (+) strand; PAM type: NRG; PAM sequence: TGG
aaaaatgataaatccaattt

SEQ ID NO: 52456 - DNA, 20 bp, Artificial Sequence
  Description of Artificial Sequence: Synthetic oligonucleotide
  Target: SCN9A; (+) strand; PAM type: NRG; PAM sequence: GAG
attttggacatcctgtgttt

SEQ ID NO: 52457 - DNA, 20 bp, Artificial Sequence
  Description of Artificial Sequence: Synthetic oligonucleotide
  Target: SCN9A; (+) strand; PAM type: NRG; PAM sequence: TGG
catcctgtgtttgagatgcc

SEQ ID NO: 52458 - DNA, 20 bp, Artificial Sequence
  Description of Artificial Sequence: Synthetic oligonucleotide
  Target: SCN9A; (+) strand; PAM type: NRG; PAM sequence: GGG
atcctgtgtttgagatgcct

SEQ ID NO: 52459 - DNA, 20 bp, Artificial Sequence
  Description of Artificial Sequence: Synthetic oligonucleotide
  Target: SCN9A; (+) strand; PAM type: NRG; PAM sequence: GAG
cctgtgtttgagatgcctgg

SEQ ID NO: 52460 - DNA, 20 bp, Artificial Sequence
  Description of Artificial Sequence: Synthetic oligonucleotide
  Target: SCN9A; (+) strand; PAM type: NRG; PAM sequence: AAG
tgagatgcctgggagacaca

SEQ ID NO: 52461 - DNA, 20 bp, Artificial Sequence
  Description of Artificial Sequence: Synthetic oligonucleotide
  Target: SCN9A; (+) strand; PAM type: NRG; PAM sequence: TAG
gatgcctgggagacacaaag

SEQ ID NO: 52462 - DNA, 20 bp, Artificial Sequence
  Description of Artificial Sequence: Synthetic oligonucleotide
  Target: SCN9A; (+) strand; PAM type: NRG; PAM sequence: CAG
cctgggagacacaaagtaga

SEQ ID NO: 52463 - DNA, 20 bp, Artificial Sequence
  Description of Artificial Sequence: Synthetic oligonucleotide
  Target: SCN9A; (+) strand; PAM type: NRG; PAM sequence: AGG
ctgggagacacaaagtagac

SEQ ID NO: 52464 - DNA, 20 bp, Artificial Sequence
  Description of Artificial Sequence: Synthetic oligonucleotide
  Target: SCN9A; (+) strand; PAM type: NRG; PAM sequence: AAG
acaaagtagacaggtccaat

SEQ ID NO: 52465 - DNA, 20 bp, Artificial Sequence
  Description of Artificial Sequence: Synthetic oligonucleotide
  Target: SCN9A; (+) strand; PAM type: NRG; PAM sequence: TAG
aagtagacaggtccaataag

SEQ ID NO: 52466 - DNA, 20 bp, Artificial Sequence
  Description of Artificial Sequence: Synthetic oligonucleotide
  Target: SCN9A; (+) strand; PAM type: NRG; PAM sequence: TGG
agtagctaaccatgttactc

SEQ ID NO: 52467 - DNA, 20 bp, Artificial Sequence
  Description of Artificial Sequence: Synthetic oligonucleotide
  Target: SCN9A; (+) strand; PAM type: NRG; PAM sequence: TGG
tgttactctggaacttaaaa

SEQ ID NO: 52468 - DNA, 20 bp, Artificial Sequence
  Description of Artificial Sequence: Synthetic oligonucleotide
  Target: SCN9A; (+) strand; PAM type: NRG; PAM sequence: GGG
gttactctggaacttaaaat

SEQ ID NO: 52469 - DNA, 20 bp, Artificial Sequence
  Description of Artificial Sequence: Synthetic oligonucleotide
  Target: SCN9A; (+) strand; PAM type: NRG; PAM sequence: GAG
tactctggaacttaaaatgg

SEQ ID NO: 52470 - DNA, 20 bp, Artificial Sequence
  Description of Artificial Sequence: Synthetic oligonucleotide
  Target: SCN9A; (+) strand; PAM type: NRG; PAM sequence: AGG
actctggaacttaaaatggg

SEQ ID NO: 52471 - DNA, 20 bp, Artificial Sequence
  Description of Artificial Sequence: Synthetic oligonucleotide
  Target: SCN9A; (+) strand; PAM type: NRG; PAM sequence: TGG
tggaacttaaaatgggaggc

SEQ ID NO: 52472 - DNA, 20 bp, Artificial Sequence
  Description of Artificial Sequence: Synthetic oligonucleotide
  Target: SCN9A; (+) strand; PAM type: NRG; PAM sequence: GGG
ggaacttaaaatgggaggct

SEQ ID NO: 52473 - DNA, 20 bp, Artificial Sequence
  Description of Artificial Sequence: Synthetic oligonucleotide
  Target: SCN9A; (+) strand; PAM type: NRG; PAM sequence: TGG
cttaaaatgggaggctgggt

SEQ ID NO: 52474 - DNA, 20 bp, Artificial Sequence
  Description of Artificial Sequence: Synthetic oligonucleotide
  Target: SCN9A; (+) strand; PAM type: NRG; PAM sequence: TAG
atgggaggctgggttggaaa

SEQ ID NO: 52475 - DNA, 20 bp, Artificial Sequence
  Description of Artificial Sequence: Synthetic oligonucleotide
  Target: SCN9A; (+) strand; PAM type: NRG; PAM sequence: TGG
tgggttggaaatagtaactt

SEQ ID NO: 52476 - DNA, 20 bp, Artificial Sequence
  Description of Artificial Sequence: Synthetic oligonucleotide
  Target: SCN9A; (+) strand; PAM type: NRG; PAM sequence: GAG
ggttggaaatagtaactttg

SEQ ID NO: 52477 - DNA, 20 bp, Artificial Sequence
  Description of Artificial Sequence: Synthetic oligonucleotide
  Target: SCN9A; (+) strand; PAM type: NRG; PAM sequence: CAG
aatagtaactttggagacac

SEQ ID NO: 52478 - DNA, 20 bp, Artificial Sequence
  Description of Artificial Sequence: Synthetic oligonucleotide
  Target: SCN9A; (+) strand; PAM type: NRG; PAM sequence: AAG
tttggagacaccagcatata

SEQ ID NO: 52479 - DNA, 20 bp, Artificial Sequence
  Description of Artificial Sequence: Synthetic oligonucleotide
  Target: SCN9A; (+) strand; PAM type: NRG; PAM sequence: GAG
tggagacaccagcatataaa

SEQ ID NO: 52480 - DNA, 20 bp, Artificial Sequence
  Description of Artificial Sequence: Synthetic oligonucleotide
  Target: SCN9A; (+) strand; PAM type: NRG; PAM sequence: CAG
aagagtattttgacattgcc

SEQ ID NO: 52481 - DNA, 20 bp, Artificial Sequence
  Description of Artificial Sequence: Synthetic oligonucleotide
  Target: SCN9A; (+) strand; PAM type: NRG; PAM sequence: AGG
agagtattttgacattgccc

SEQ ID NO: 52482 - DNA, 20 bp, Artificial Sequence
  Description of Artificial Sequence: Synthetic oligonucleotide
  Target: SCN9A; (+) strand; PAM type: NRG; PAM sequence: TAG
acattgcccaggaatattcc

SEQ ID NO: 52483 - DNA, 20 bp, Artificial Sequence
  Description of Artificial Sequence: Synthetic oligonucleotide
  Target: SCN9A; (+) strand; PAM type: NRG; PAM sequence: AAG
ccaggaatattcctagtccc

SEQ ID NO: 52484 - DNA, 20 bp, Artificial Sequence
  Description of Artificial Sequence: Synthetic oligonucleotide
  Target: SCN9A; (+) strand; PAM type: NRG; PAM sequence: GAG
aggaatattcctagtcccaa

SEQ ID NO: 52485 - DNA, 20 bp, Artificial Sequence
  Description of Artificial Sequence: Synthetic oligonucleotide
  Target: SCN9A; (+) strand; PAM type: NRG; PAM sequence: AGG
ggaatattcctagtcccaag

SEQ ID NO: 52486 - DNA, 20 bp, Artificial Sequence
  Description of Artificial Sequence: Synthetic oligonucleotide
  Target: SCN9A; (+) strand; PAM type: NRG; PAM sequence: TGG
tcctagtcccaagaggctaa

SEQ ID NO: 52487 - DNA, 20 bp, Artificial Sequence
  Description of Artificial Sequence: Synthetic oligonucleotide
  Target: SCN9A; (+) strand; PAM type: NRG; PAM sequence: AAG
ccaagaggctaatggttttt

SEQ ID NO: 52488 - DNA, 20 bp, Artificial Sequence
  Description of Artificial Sequence: Synthetic oligonucleotide
  Target: SCN9A; (+) strand; PAM type: NRG; PAM sequence: AAG
gaggctaatggtttttaaga

SEQ ID NO: 52489 - DNA, 20 bp, Artificial Sequence
  Description of Artificial Sequence: Synthetic oligonucleotide
  Target: SCN9A; (+) strand; PAM type: NRG; PAM sequence: TAG
gacgtgtacataaatgatca

SEQ ID NO: 52490 - DNA, 20 bp, Artificial Sequence
  Description of Artificial Sequence: Synthetic oligonucleotide
  Target: SCN9A; (+) strand; PAM type: NRG; PAM sequence: TGG
aatgatcatagtacaaaaca

SEQ ID NO: 52491 - DNA, 20 bp, Artificial Sequence
  Description of Artificial Sequence: Synthetic oligonucleotide
  Target: SCN9A; (+) strand; PAM type: NRG; PAM sequence: CAG
tagtacaaaacatggcaaaa

SEQ ID NO: 52492 - DNA, 20 bp, Artificial Sequence
  Description of Artificial Sequence: Synthetic oligonucleotide
  Target: SCN9A; (+) strand; PAM type: NRG; PAM sequence: TGG
acatggcaaaacagcttgaa

SEQ ID NO: 52493 - DNA, 20 bp, Artificial Sequence
  Description of Artificial Sequence: Synthetic oligonucleotide
  Target: SCN9A; (+) strand; PAM type: NRG; PAM sequence: AAG
tggcaaaacagcttgaatgg

SEQ ID NO: 52494 - DNA, 20 bp, Artificial Sequence
  Description of Artificial Sequence: Synthetic oligonucleotide
  Target: SCN9A; (+) strand; PAM type: NRG; PAM sequence: AAG
cttgaatggaagtattttaa

SEQ ID NO: 52495 - DNA, 20 bp, Artificial Sequence
  Description of Artificial Sequence: Synthetic oligonucleotide
  Target: SCN9A; (+) strand; PAM type: NRG; PAM sequence: TGG
gaagtattttaaaagtacct

SEQ ID NO: 52496 - DNA, 20 bp, Artificial Sequence
  Description of Artificial Sequence: Synthetic oligonucleotide
  Target: SCN9A; (+) strand; PAM type: NRG; PAM sequence: AAG
taaaagtaccttggaaacac

SEQ ID NO: 52497 - DNA, 20 bp, Artificial Sequence
  Description of Artificial Sequence: Synthetic oligonucleotide
  Target: SCN9A; (+) strand; PAM type: NRG; PAM sequence: AGG
aaaagtaccttggaaacaca

SEQ ID NO: 52498 - DNA, 20 bp, Artificial Sequence
  Description of Artificial Sequence: Synthetic oligonucleotide
  Target: SCN9A; (+) strand; PAM type: NRG; PAM sequence: GGG
aaagtaccttggaaacacaa

SEQ ID NO: 52499 - DNA, 20 bp, Artificial Sequence
  Description of Artificial Sequence: Synthetic oligonucleotide
  Target: SCN9A; (+) strand; PAM type: NRG; PAM sequence: GGG
aagtaccttggaaacacaag

SEQ ID NO: 52500 - DNA, 20 bp, Artificial Sequence
  Description of Artificial Sequence: Synthetic oligonucleotide
  Target: SCN9A; (+) strand; PAM type: NRG; PAM sequence: TAG
accttggaaacacaaggggt

SEQ ID NO: 52501 - DNA, 20 bp, Artificial Sequence
  Description of Artificial Sequence: Synthetic oligonucleotide
  Target: SCN9A; (+) strand; PAM type: NRG; PAM sequence: TGG
aaacacaaggggttagaaat

SEQ ID NO: 52502 - DNA, 20 bp, Artificial Sequence
  Description of Artificial Sequence: Synthetic oligonucleotide
  Target: SCN9A; (+) strand; PAM type: NRG; PAM sequence: GAG
aaggggttagaaattggttt

SEQ ID NO: 52503 - DNA, 20 bp, Artificial Sequence
  Description of Artificial Sequence: Synthetic oligonucleotide
  Target: SCN9A; (+) strand; PAM type: NRG; PAM sequence: TGG
ggttagaaattggtttgagc

SEQ ID NO: 52504 - DNA, 20 bp, Artificial Sequence
  Description of Artificial Sequence: Synthetic oligonucleotide
  Target: SCN9A; (+) strand; PAM type: NRG; PAM sequence: TAG
gaaattggtttgagctggta

SEQ ID NO: 52505 - DNA, 20 bp, Artificial Sequence
  Description of Artificial Sequence: Synthetic oligonucleotide
  Target: SCN9A; (+) strand; PAM type: NRG; PAM sequence: AGG
aaattggtttgagctggtat

SEQ ID NO: 52506 - DNA, 20 bp, Artificial Sequence
  Description of Artificial Sequence: Synthetic oligonucleotide
  Target: SCN9A; (+) strand; PAM type: NRG; PAM sequence: AAG
tggtttgagctggtatagga

SEQ ID NO: 52507 - DNA, 20 bp, Artificial Sequence
  Description of Artificial Sequence: Synthetic oligonucleotide
  Target: SCN9A; (+) strand; PAM type: NRG; PAM sequence: AAG
tttgagctggtataggaaag

SEQ ID NO: 52508 - DNA, 20 bp, Artificial Sequence
  Description of Artificial Sequence: Synthetic oligonucleotide
  Target: SCN9A; (+) strand; PAM type: NRG; PAM sequence: AGG
ttgagctggtataggaaaga

SEQ ID NO: 52509 - DNA, 20 bp, Artificial Sequence
  Description of Artificial Sequence: Synthetic oligonucleotide
  Target: SCN9A; (+) strand; PAM type: NRG; PAM sequence: AAG
gctggtataggaaagaagga

SEQ ID NO: 52510 - DNA, 20 bp, Artificial Sequence
  Description of Artificial Sequence: Synthetic oligonucleotide
  Target: SCN9A; (+) strand; PAM type: NRG; PAM sequence: GAG
tataggaaagaaggaaagtt

SEQ ID NO: 52511 - DNA, 20 bp, Artificial Sequence
  Description of Artificial Sequence: Synthetic oligonucleotide
  Target: SCN9A; (+) strand; PAM type: NRG; PAM sequence: TGG
ggaaagaaggaaagttgagt

SEQ ID NO: 52512 - DNA, 20 bp, Artificial Sequence
  Description of Artificial Sequence: Synthetic oligonucleotide
  Target: SCN9A; (+) strand; PAM type: NRG; PAM sequence: CAG
aggaaagttgagttggaatt

SEQ ID NO: 52513 - DNA, 20 bp, Artificial Sequence
  Description of Artificial Sequence: Synthetic oligonucleotide
  Target: SCN9A; (+) strand; PAM type: NRG; PAM sequence: CAG
aaagttgagttggaattcag

SEQ ID NO: 52514 - DNA, 20 bp, Artificial Sequence
  Description of Artificial Sequence: Synthetic oligonucleotide
  Target: SCN9A; (+) strand; PAM type: NRG; PAM sequence: TGG
ttgagttggaattcagcaga

SEQ ID NO: 52515 - DNA, 20 bp, Artificial Sequence
  Description of Artificial Sequence: Synthetic oligonucleotide
  Target: SCN9A; (+) strand; PAM type: NRG; PAM sequence: TGG
tggaattcagcagatggata

SEQ ID NO: 52516 - DNA, 20 bp, Artificial Sequence
  Description of Artificial Sequence: Synthetic oligonucleotide
  Target: SCN9A; (+) strand; PAM type: NRG; PAM sequence: AAG
tggtcgtatgtatatttcta

SEQ ID NO: 52517 - DNA, 20 bp, Artificial Sequence
  Description of Artificial Sequence: Synthetic oligonucleotide
  Target: SCN9A; (+) strand; PAM type: NRG; PAM sequence: AGG
ggtcgtatgtatatttctaa

SEQ ID NO: 52518 - DNA, 20 bp, Artificial Sequence
  Description of Artificial Sequence: Synthetic oligonucleotide
  Target: SCN9A; (+) strand; PAM type: NRG; PAM sequence: AAG
gtatatttctaaaggctgaa

SEQ ID NO: 52519 - DNA, 20 bp, Artificial Sequence
  Description of Artificial Sequence: Synthetic oligonucleotide
  Target: SCN9A; (+) strand; PAM type: NRG; PAM sequence: AAG
ttctaaaggctgaaaagtgc

SEQ ID NO: 52520 - DNA, 20 bp, Artificial Sequence
  Description of Artificial Sequence: Synthetic oligonucleotide
  Target: SCN9A; (+) strand; PAM type: NRG; PAM sequence: CAG
aaaggctgaaaagtgcaagc

SEQ ID NO: 52521 - DNA, 20 bp, Artificial Sequence
  Description of Artificial Sequence: Synthetic oligonucleotide
  Target: SCN9A; (+) strand; PAM type: NRG; PAM sequence: AGG
aaggctgaaaagtgcaagcc

SEQ ID NO: 52522 - DNA, 20 bp, Artificial Sequence
  Description of Artificial Sequence: Synthetic oligonucleotide
  Target: SCN9A; (+) strand; PAM type: NRG; PAM sequence: CAG
aggctaccttctttttaatc

SEQ ID NO: 52523 - DNA, 20 bp, Artificial Sequence
  Description of Artificial Sequence: Synthetic oligonucleotide
  Target: SCN9A; (+) strand; PAM type: NRG; PAM sequence: AAG
atccagactccaacactgaa

SEQ ID NO: 52524 - DNA, 20 bp, Artificial Sequence
  Description of Artificial Sequence: Synthetic oligonucleotide
  Target: SCN9A; (+) strand; PAM type: NRG; PAM sequence: TAG
agactccaacactgaaaagc

SEQ ID NO: 52525 - DNA, 20 bp, Artificial Sequence
  Description of Artificial Sequence: Synthetic oligonucleotide
  Target: SCN9A; (+) strand; PAM type: NRG; PAM sequence: AGG
gactccaacactgaaaagct

SEQ ID NO: 52526 - DNA, 20 bp, Artificial Sequence
  Description of Artificial Sequence: Synthetic oligonucleotide
  Target: SCN9A; (+) strand; PAM type: NRG; PAM sequence: TAG
actgaaaagctaggtcacct

SEQ ID NO: 52527 - DNA, 20 bp, Artificial Sequence
  Description of Artificial Sequence: Synthetic oligonucleotide
  Target: SCN9A; (+) strand; PAM type: NRG; PAM sequence: AAG
aaagctaggtcaccttagtt

SEQ ID NO: 52528 - DNA, 20 bp, Artificial Sequence
  Description of Artificial Sequence: Synthetic oligonucleotide
  Target: SCN9A; (+) strand; PAM type: NRG; PAM sequence: CAG
agttacttaactgtgtatct

SEQ ID NO: 52529 - DNA, 20 bp, Artificial Sequence
  Description of Artificial Sequence: Synthetic oligonucleotide
  Target: SCN9A; (+) strand; PAM type: NRG; PAM sequence: CGG
gtgtatctcagtttactcat

SEQ ID NO: 52530 - DNA, 20 bp, Artificial Sequence
  Description of Artificial Sequence: Synthetic oligonucleotide
  Target: SCN9A; (+) strand; PAM type: NRG; PAM sequence: GAG
agtttactcatcggtaaaat

SEQ ID NO: 52531 - DNA, 20 bp, Artificial Sequence
  Description of Artificial Sequence: Synthetic oligonucleotide
  Target: SCN9A; (+) strand; PAM type: NRG; PAM sequence: AAG
atcggtaaaatgagtatgaa

SEQ ID NO: 52532 - DNA, 20 bp, Artificial Sequence
  Description of Artificial Sequence: Synthetic oligonucleotide
  Target: SCN9A; (+) strand; PAM type: NRG; PAM sequence: AGG
tcggtaaaatgagtatgaaa

SEQ ID NO: 52533 - DNA, 20 bp, Artificial Sequence
  Description of Artificial Sequence: Synthetic oligonucleotide
  Target: SCN9A; (+) strand; PAM type: NRG; PAM sequence: GAG
aggattttgaatatttaaat

SEQ ID NO: 52534 - DNA, 20 bp, Artificial Sequence
  Description of Artificial Sequence: Synthetic oligonucleotide
  Target: SCN9A; (+) strand; PAM type: NRG; PAM sequence: TAG
gttaatgcatataaacactc

SEQ ID NO: 52535 - DNA, 20 bp, Artificial Sequence
  Description of Artificial Sequence: Synthetic oligonucleotide
  Target: SCN9A; (+) strand; PAM type: NRG; PAM sequence: AAG
agaatcatacttgaaccaat

SEQ ID NO: 52536 - DNA, 20 bp, Artificial Sequence
  Description of Artificial Sequence: Synthetic oligonucleotide
  Target: SCN9A; (+) strand; PAM type: NRG; PAM sequence: TAG
attattgttattatcattat

SEQ ID NO: 52537 - DNA, 20 bp, Artificial Sequence
  Description of Artificial Sequence: Synthetic oligonucleotide
  Target: SCN9A; (+) strand; PAM type: NRG; PAM sequence: AGG
ttattgttattatcattatt

SEQ ID NO: 52538 - DNA, 20 bp, Artificial Sequence
  Description of Artificial Sequence: Synthetic oligonucleotide
  Target: SCN9A; (+) strand; PAM type: NRG; PAM sequence: CAG
ttgttattatcattattagg

SEQ ID NO: 52539 - DNA, 20 bp, Artificial Sequence
  Description of Artificial Sequence: Synthetic oligonucleotide
  Target: SCN9A; (+) strand; PAM type: NRG; PAM sequence: AGG
tgttattatcattattaggc

SEQ ID NO: 52540 - DNA, 20 bp, Artificial Sequence
  Description of Artificial Sequence: Synthetic oligonucleotide
  Target: SCN9A; (+) strand; PAM type: NRG; PAM sequence: GGG
gttattatcattattaggca

SEQ ID NO: 52541 - DNA, 20 bp, Artificial Sequence
  Description of Artificial Sequence: Synthetic oligonucleotide
  Target: SCN9A; (+) strand; PAM type: NRG; PAM sequence: GGG
ttattatcattattaggcag

SEQ ID NO: 52542 - DNA, 20 bp, Artificial Sequence
  Description of Artificial Sequence: Synthetic oligonucleotide
  Target: SCN9A; (+) strand; PAM type: NRG; PAM sequence: GGG
tattatcattattaggcagg

SEQ ID NO: 52543 - DNA, 20 bp, Artificial Sequence
  Description of Artificial Sequence: Synthetic oligonucleotide
  Target: SCN9A; (+) strand; PAM type: NRG; PAM sequence: GAG
ttatcattattaggcagggg

SEQ ID NO: 52544 - DNA, 20 bp, Artificial Sequence
  Description of Artificial Sequence: Synthetic oligonucleotide
  Target: SCN9A; (+) strand; PAM type: NRG; PAM sequence: CAG
taaatgcttcaaaatgtaca

SEQ ID NO: 52545 - DNA, 20 bp, Artificial Sequence
  Description of Artificial Sequence: Synthetic oligonucleotide
  Target: SCN9A; (+) strand; PAM type: NRG; PAM sequence: AAG
tgcttcaaaatgtacacagc

SEQ ID NO: 52546 - DNA, 20 bp, Artificial Sequence
  Description of Artificial Sequence: Synthetic oligonucleotide
  Target: SCN9A; (+) strand; PAM type: NRG; PAM sequence: AAG
caaaatgtacacagcaagtt

SEQ ID NO: 52547 - DNA, 20 bp, Artificial Sequence
  Description of Artificial Sequence: Synthetic oligonucleotide
  Target: SCN9A; (+) strand; PAM type: NRG; PAM sequence: AGG
aaaatgtacacagcaagtta

SEQ ID NO: 52548 - DNA, 20 bp, Artificial Sequence
  Description of Artificial Sequence: Synthetic oligonucleotide
  Target: SCN9A; (+) strand; PAM type: NRG; PAM sequence: AAG
acacagcaagttaaggaaat

SEQ ID NO: 52549 - DNA, 20 bp, Artificial Sequence
  Description of Artificial Sequence: Synthetic oligonucleotide
  Target: SCN9A; (+) strand; PAM type: NRG; PAM sequence: AAG
cagcaagttaaggaaataag

SEQ ID NO: 52550 - DNA, 20 bp, Artificial Sequence
  Description of Artificial Sequence: Synthetic oligonucleotide
  Target: SCN9A; (+) strand; PAM type: NRG; PAM sequence: GAG
gcaagttaaggaaataagaa

SEQ ID NO: 52551 - DNA, 20 bp, Artificial Sequence
  Description of Artificial Sequence: Synthetic oligonucleotide
  Target: SCN9A; (+) strand; PAM type: NRG; PAM sequence: AGG
caagttaaggaaataagaag

SEQ ID NO: 52552 - DNA, 20 bp, Artificial Sequence
  Description of Artificial Sequence: Synthetic oligonucleotide
  Target: SCN9A; (+) strand; PAM type: NRG; PAM sequence: TGG
aggaaataagaagaggtcta

SEQ ID NO: 52553 - DNA, 20 bp, Artificial Sequence
  Description of Artificial Sequence: Synthetic oligonucleotide
  Target: SCN9A; (+) strand; PAM type: NRG; PAM sequence: TGG
gaagaggtctatggactact

SEQ ID NO: 52554 - DNA, 20 bp, Artificial Sequence
  Description of Artificial Sequence: Synthetic oligonucleotide
  Target: SCN9A; (+) strand; PAM type: NRG; PAM sequence: CAG
gaggtctatggactacttgg

SEQ ID NO: 52555 - DNA, 20 bp, Artificial Sequence
  Description of Artificial Sequence: Synthetic oligonucleotide
  Target: SCN9A; (+) strand; PAM type: NRG; PAM sequence: CAG
ctacttggcagcactcttcc

SEQ ID NO: 52556 - DNA, 20 bp, Artificial Sequence
  Description of Artificial Sequence: Synthetic oligonucleotide
  Target: SCN9A; (+) strand; PAM type: NRG; PAM sequence: AGG
tacttggcagcactcttccc

SEQ ID NO: 52557 - DNA, 20 bp, Artificial Sequence
  Description of Artificial Sequence: Synthetic oligonucleotide
  Target: SCN9A; (+) strand; PAM type: NRG; PAM sequence: AAG
cagcactcttcccaggatac

SEQ ID NO: 52558 - DNA, 20 bp, Artificial Sequence
  Description of Artificial Sequence: Synthetic oligonucleotide
  Target: SCN9A; (+) strand; PAM type: NRG; PAM sequence: GAG
gcactcttcccaggatacaa

SEQ ID NO: 52559 - DNA, 20 bp, Artificial Sequence
  Description of Artificial Sequence: Synthetic oligonucleotide
  Target: SCN9A; (+) strand; PAM type: NRG; PAM sequence: GAG
actcttcccaggatacaaga

SEQ ID NO: 52560 - DNA, 20 bp, Artificial Sequence
  Description of Artificial Sequence: Synthetic oligonucleotide
  Target: SCN9A; (+) strand; PAM type: NRG; PAM sequence: CAG
ccaggatacaagagagaaac

SEQ ID NO: 52561 - DNA, 20 bp, Artificial Sequence
  Description of Artificial Sequence: Synthetic oligonucleotide
  Target: SCN9A; (+) strand; PAM type: NRG; PAM sequence: GAG
aggatacaagagagaaacca

SEQ ID NO: 52562 - DNA, 20 bp, Artificial Sequence
  Description of Artificial Sequence: Synthetic oligonucleotide
  Target: SCN9A; (+) strand; PAM type: NRG; PAM sequence: CGG
gagaaaccagagctttcaaa

SEQ ID NO: 52563 - DNA, 20 bp, Artificial Sequence
  Description of Artificial Sequence: Synthetic oligonucleotide
  Target: SCN9A; (+) strand; PAM type: NRG; PAM sequence: GAG
gaaaccagagctttcaaacg

SEQ ID NO: 52564 - DNA, 20 bp, Artificial Sequence
  Description of Artificial Sequence: Synthetic oligonucleotide
  Target: SCN9A; (+) strand; PAM type: NRG; PAM sequence: AGG
aaaccagagctttcaaacgg

SEQ ID NO: 52565 - DNA, 20 bp, Artificial Sequence
  Description of Artificial Sequence: Synthetic oligonucleotide
  Target: SCN9A; (+) strand; PAM type: NRG; PAM sequence: GAG
accagagctttcaaacggag

SEQ ID NO: 52566 - DNA, 20 bp, Artificial Sequence
  Description of Artificial Sequence: Synthetic oligonucleotide
  Target: SCN9A; (+) strand; PAM type: NRG; PAM sequence: TAG
agagctttcaaacggaggag

SEQ ID NO: 52567 - DNA, 20 bp, Artificial Sequence
  Description of Artificial Sequence: Synthetic oligonucleotide
  Target: SCN9A; (+) strand; PAM type: NRG; PAM sequence: CAG
ttcaaacggaggagtagtgc

SEQ ID NO: 52568 - DNA, 20 bp, Artificial Sequence
  Description of Artificial Sequence: Synthetic oligonucleotide
  Target: SCN9A; (+) strand; PAM type: NRG; PAM sequence: AGG
tcaaacggaggagtagtgcc

SEQ ID NO: 52569 - DNA, 20 bp, Artificial Sequence
  Description of Artificial Sequence: Synthetic oligonucleotide
  Target: SCN9A; (+) strand; PAM type: NRG; PAM sequence: TGG
tgccaggcattctccttgta

SEQ ID NO: 52570 - DNA, 20 bp, Artificial Sequence
  Description of Artificial Sequence: Synthetic oligonucleotide
  Target: SCN9A; (+) strand; PAM type: NRG; PAM sequence: GGG
gccaggcattctccttgtat

SEQ ID NO: 52571 - DNA, 20 bp, Artificial Sequence
  Description of Artificial Sequence: Synthetic oligonucleotide
  Target: SCN9A; (+) strand; PAM type: NRG; PAM sequence: GAG
caggcattctccttgtatgg

SEQ ID NO: 52572 - DNA, 20 bp, Artificial Sequence
  Description of Artificial Sequence: Synthetic oligonucleotide
  Target: SCN9A; (+) strand; PAM type: NRG; PAM sequence: CAG
tccttgtatgggagtctttt

SEQ ID NO: 52573 - DNA, 20 bp, Artificial Sequence
  Description of Artificial Sequence: Synthetic oligonucleotide
  Target: SCN9A; (+) strand; PAM type: NRG; PAM sequence: CAG
gagtcttttcagcaattttg

SEQ ID NO: 52574 - DNA, 20 bp, Artificial Sequence
  Description of Artificial Sequence: Synthetic oligonucleotide
  Target: SCN9A; (+) strand; PAM type: NRG; PAM sequence: CAG
caattttgcagcaatccatg

SEQ ID NO: 52575 - DNA, 20 bp, Artificial Sequence
  Description of Artificial Sequence: Synthetic oligonucleotide
  Target: SCN9A; (+) strand; PAM type: NRG; PAM sequence: AAG
ttgcagcaatccatgcagca

SEQ ID NO: 52576 - DNA, 20 bp, Artificial Sequence
  Description of Artificial Sequence: Synthetic oligonucleotide
  Target: SCN9A; (+) strand; PAM type: NRG; PAM sequence: AAG
aagcatatctatgcaaatac

SEQ ID NO: 52577 - DNA, 20 bp, Artificial Sequence
  Description of Artificial Sequence: Synthetic oligonucleotide
  Target: SCN9A; (+) strand; PAM type: NRG; PAM sequence: AGG
agcatatctatgcaaataca

SEQ ID NO: 52578 - DNA, 20 bp, Artificial Sequence
  Description of Artificial Sequence: Synthetic oligonucleotide
  Target: SCN9A; (+) strand; PAM type: NRG; PAM sequence: GAG
catatctatgcaaatacaag

SEQ ID NO: 52579 - DNA, 20 bp, Artificial Sequence
  Description of Artificial Sequence: Synthetic oligonucleotide
  Target: SCN9A; (+) strand; PAM type: NRG; PAM sequence: GAG
ctatgcaaatacaaggagat

SEQ ID NO: 52580 - DNA, 20 bp, Artificial Sequence
  Description of Artificial Sequence: Synthetic oligonucleotide
  Target: SCN9A; (+) strand; PAM type: NRG; PAM sequence: AGG
tatgcaaatacaaggagatg

SEQ ID NO: 52581 - DNA, 20 bp, Artificial Sequence
  Description of Artificial Sequence: Synthetic oligonucleotide
  Target: SCN9A; (+) strand; PAM type: NRG; PAM sequence: GAG
aaggagatgaggtccacatt

SEQ ID NO: 52582 - DNA, 20 bp, Artificial Sequence
  Description of Artificial Sequence: Synthetic oligonucleotide
  Target: SCN9A; (+) strand; PAM type: NRG; PAM sequence: CAG
gagatgaggtccacattgag

SEQ ID NO: 52583 - DNA, 20 bp, Artificial Sequence
  Description of Artificial Sequence: Synthetic oligonucleotide
  Target: SCN9A; (+) strand; PAM type: NRG; PAM sequence: TGG
aggtccacattgagcagttg

SEQ ID NO: 52584 - DNA, 20 bp, Artificial Sequence
  Description of Artificial Sequence: Synthetic oligonucleotide
  Target: SCN9A; (+) strand; PAM type: NRG; PAM sequence: GGG
ggtccacattgagcagttgt

SEQ ID NO: 52585 - DNA, 20 bp, Artificial Sequence
  Description of Artificial Sequence: Synthetic oligonucleotide
  Target: SCN9A; (+) strand; PAM type: NRG; PAM sequence: GAG
tccacattgagcagttgtgg

SEQ ID NO: 52586 - DNA, 20 bp, Artificial Sequence
  Description of Artificial Sequence: Synthetic oligonucleotide
  Target: SCN9A; (+) strand; PAM type: NRG; PAM sequence: AAG
acaactgcaactctgtatga

SEQ ID NO: 52587 - DNA, 20 bp, Artificial Sequence
  Description of Artificial Sequence: Synthetic oligonucleotide
  Target: SCN9A; (+) strand; PAM type: NRG; PAM sequence: AGG
caactgcaactctgtatgaa

SEQ ID NO: 52588 - DNA, 20 bp, Artificial Sequence
  Description of Artificial Sequence: Synthetic oligonucleotide
  Target: SCN9A; (+) strand; PAM type: NRG; PAM sequence: GGG
aactgcaactctgtatgaaa

SEQ ID NO: 52589 - DNA, 20 bp, Artificial Sequence
  Description of Artificial Sequence: Synthetic oligonucleotide
  Target: SCN9A; (+) strand; PAM type: NRG; PAM sequence: CAG
gaaagggacatgcccactta

SEQ ID NO: 52590 - DNA, 20 bp, Artificial Sequence
  Description of Artificial Sequence: Synthetic oligonucleotide
  Target: SCN9A; (+) strand; PAM type: NRG; PAM sequence: AGG
aaagggacatgcccacttac

SEQ ID NO: 52591 - DNA, 20 bp, Artificial Sequence
  Description of Artificial Sequence: Synthetic oligonucleotide
  Target: SCN9A; (+) strand; PAM type: NRG; PAM sequence: GAG
agggacatgcccacttacag

SEQ ID NO: 52592 - DNA, 20 bp, Artificial Sequence
  Description of Artificial Sequence: Synthetic oligonucleotide
  Target: SCN9A; (+) strand; PAM type: NRG; PAM sequence: AAG
cttacaggagtcactgcatt

SEQ ID NO: 52593 - DNA, 20 bp, Artificial Sequence
  Description of Artificial Sequence: Synthetic oligonucleotide
  Target: SCN9A; (+) strand; PAM type: NRG; PAM sequence: AGG
ttacaggagtcactgcatta

SEQ ID NO: 52594 - DNA, 20 bp, Artificial Sequence
  Description of Artificial Sequence: Synthetic oligonucleotide
  Target: SCN9A; (+) strand; PAM type: NRG; PAM sequence: GGG
tacaggagtcactgcattaa

SEQ ID NO: 52595 - DNA, 20 bp, Artificial Sequence
  Description of Artificial Sequence: Synthetic oligonucleotide
  Target: SCN9A; (+) strand; PAM type: NRG; PAM sequence: GGG
acaggagtcactgcattaag

SEQ ID NO: 52596 - DNA, 20 bp, Artificial Sequence
  Description of Artificial Sequence: Synthetic oligonucleotide
  Target: SCN9A; (+) strand; PAM type: NRG; PAM sequence: GGG
caggagtcactgcattaagg

SEQ ID NO: 52597 - DNA, 20 bp, Artificial Sequence
  Description of Artificial Sequence: Synthetic oligonucleotide
  Target: SCN9A; (+) strand; PAM type: NRG; PAM sequence: AAG
actgcattaagggggttcca

SEQ ID NO: 52598 - DNA, 20 bp, Artificial Sequence
  Description of Artificial Sequence: Synthetic oligonucleotide
  Target: SCN9A; (+) strand; PAM type: NRG; PAM sequence: AAG
cattaagggggttccaaaga

SEQ ID NO: 52599 - DNA, 20 bp, Artificial Sequence
  Description of Artificial Sequence: Synthetic oligonucleotide
  Target: SCN9A; (+) strand; PAM type: NRG; PAM sequence: CGG
ccaaagaaagatgacaccct

SEQ ID NO: 52600 - DNA, 20 bp, Artificial Sequence
  Description of Artificial Sequence: Synthetic oligonucleotide
  Target: SCN9A; (+) strand; PAM type: NRG; PAM sequence: TAG
tgacaccctcggcattgatt

SEQ ID NO: 52601 - DNA, 20 bp, Artificial Sequence
  Description of Artificial Sequence: Synthetic oligonucleotide
  Target: SCN9A; (+) strand; PAM type: NRG; PAM sequence: AGG
gacaccctcggcattgattt

SEQ ID NO: 52602 - DNA, 20 bp, Artificial Sequence
  Description of Artificial Sequence: Synthetic oligonucleotide
  Target: SCN9A; (+) strand; PAM type: NRG; PAM sequence: GGG
acaccctcggcattgattta

SEQ ID NO: 52603 - DNA, 20 bp, Artificial Sequence
  Description of Artificial Sequence: Synthetic oligonucleotide
  Target: SCN9A; (+) strand; PAM type: NRG; PAM sequence: CGG
gcttatttttttttctcttt

SEQ ID NO: 52604 - DNA, 20 bp, Artificial Sequence
  Description of Artificial Sequence: Synthetic oligonucleotide
  Target: SCN9A; (+) strand; PAM type: NRG; PAM sequence: AAG
tctttatattaaaattatac

SEQ ID NO: 52605 - DNA, 20 bp, Artificial Sequence
  Description of Artificial Sequence: Synthetic oligonucleotide
  Target: SCN9A; (+) strand; PAM type: NRG; PAM sequence: CAG
aacgcccatgtgtacaaaaa

SEQ ID NO: 52606 - DNA, 20 bp, Artificial Sequence
  Description of Artificial Sequence: Synthetic oligonucleotide
  Target: SCN9A; (+) strand; PAM type: NRG; PAM sequence: TGG
tctatacttatgctatttgt

SEQ ID NO: 52607 - DNA, 20 bp, Artificial Sequence
  Description of Artificial Sequence: Synthetic oligonucleotide
  Target: SCN9A; (+) strand; PAM type: NRG; PAM sequence: GAG
ttttttaaattttttattgt

SEQ ID NO: 52608 - DNA, 20 bp, Artificial Sequence
  Description of Artificial Sequence: Synthetic oligonucleotide
  Target: SCN9A; (+) strand; PAM type: NRG; PAM sequence: TAG
tttttattgtgagctaatta

SEQ ID NO: 52609 - DNA, 20 bp, Artificial Sequence
  Description of Artificial Sequence: Synthetic oligonucleotide
  Target: SCN9A; (+) strand; PAM type: NRG; PAM sequence: AGG
ttttattgtgagctaattat

SEQ ID NO: 52610 - DNA, 20 bp, Artificial Sequence
  Description of Artificial Sequence: Synthetic oligonucleotide
  Target: SCN9A; (+) strand; PAM type: NRG; PAM sequence: AAG
attgtgagctaattatagga

SEQ ID NO: 52611 - DNA, 20 bp, Artificial Sequence
  Description of Artificial Sequence: Synthetic oligonucleotide
  Target: SCN9A; (+) strand; PAM type: NRG; PAM sequence: AGG
ttgtgagctaattataggaa

SEQ ID NO: 52612 - DNA, 20 bp, Artificial Sequence
  Description of Artificial Sequence: Synthetic oligonucleotide
  Target: SCN9A; (+) strand; PAM type: NRG; PAM sequence: GAG
gtgagctaattataggaaag

SEQ ID NO: 52613 - DNA, 20 bp, Artificial Sequence
  Description of Artificial Sequence: Synthetic oligonucleotide
  Target: SCN9A; (+) strand; PAM type: NRG; PAM sequence: TAG
ttataggaaaggagcaaaaa

SEQ ID NO: 52614 - DNA, 20 bp, Artificial Sequence
  Description of Artificial Sequence: Synthetic oligonucleotide
  Target: SCN9A; (+) strand; PAM type: NRG; PAM sequence: TAG
tgttaacaattatataacca

SEQ ID NO: 52615 - DNA, 20 bp, Artificial Sequence
  Description of Artificial Sequence: Synthetic oligonucleotide
  Target: SCN9A; (+) strand; PAM type: NRG; PAM sequence: AAG
attatataaccatagtaatc

SEQ ID NO: 52616 - DNA, 20 bp, Artificial Sequence
  Description of Artificial Sequence: Synthetic oligonucleotide
  Target: SCN9A; (+) strand; PAM type: NRG; PAM sequence: CAG
gtaatcaagaaaattaacac

SEQ ID NO: 52617 - DNA, 20 bp, Artificial Sequence
  Description of Artificial Sequence: Synthetic oligonucleotide
  Target: SCN9A; (+) strand; PAM type: NRG; PAM sequence: TAG
acatcattttttattgcatt

SEQ ID NO: 52618 - DNA, 20 bp, Artificial Sequence
  Description of Artificial Sequence: Synthetic oligonucleotide
  Target: SCN9A; (+) strand; PAM type: NRG; PAM sequence: TAG
atttagttgttatacctcat

SEQ ID NO: 52619 - DNA, 20 bp, Artificial Sequence
  Description of Artificial Sequence: Synthetic oligonucleotide
  Target: SCN9A; (+) strand; PAM type: NRG; PAM sequence: CAG
tagtctctttttatctgcaa

SEQ ID NO: 52620 - DNA, 20 bp, Artificial Sequence
  Description of Artificial Sequence: Synthetic oligonucleotide
  Target: SCN9A; (+) strand; PAM type: NRG; PAM sequence: TGG
ttctttcgtgacctgacaat

SEQ ID NO: 52621 - DNA, 20 bp, Artificial Sequence
  Description of Artificial Sequence: Synthetic oligonucleotide
  Target: SCN9A; (+) strand; PAM type: NRG; PAM sequence: GGG
tctttcgtgacctgacaatt

SEQ ID NO: 52622 - DNA, 20 bp, Artificial Sequence
  Description of Artificial Sequence: Synthetic oligonucleotide
  Target: SCN9A; (+) strand; PAM type: NRG; PAM sequence: CAG
ttcgtgacctgacaattggg

SEQ ID NO: 52623 - DNA, 20 bp, Artificial Sequence
  Description of Artificial Sequence: Synthetic oligonucleotide
  Target: SCN9A; (+) strand; PAM type: NRG; PAM sequence: CAG
caattgggcagaatacaaat

SEQ ID NO: 52624 - DNA, 20 bp, Artificial Sequence
  Description of Artificial Sequence: Synthetic oligonucleotide
  Target: SCN9A; (+) strand; PAM type: NRG; PAM sequence: TAG
aatacaaatcagttattttg

SEQ ID NO: 52625 - DNA, 20 bp, Artificial Sequence
  Description of Artificial Sequence: Synthetic oligonucleotide
  Target: SCN9A; (+) strand; PAM type: NRG; PAM sequence: TGG
ttgtagaatgcgtctcaact

SEQ ID NO: 52626 - DNA, 20 bp, Artificial Sequence
  Description of Artificial Sequence: Synthetic oligonucleotide
  Target: SCN9A; (+) strand; PAM type: NRG; PAM sequence: GGG
tgtagaatgcgtctcaactt

SEQ ID NO: 52627 - DNA, 20 bp, Artificial Sequence
  Description of Artificial Sequence: Synthetic oligonucleotide
  Target: SCN9A; (+) strand; PAM type: NRG; PAM sequence: AAG
gaatttttcaattcacaact

SEQ ID NO: 52628 - DNA, 20 bp, Artificial Sequence
  Description of Artificial Sequence: Synthetic oligonucleotide
  Target: SCN9A; (+) strand; PAM type: NRG; PAM sequence: AGG
aatttttcaattcacaacta

SEQ ID NO: 52629 - DNA, 20 bp, Artificial Sequence
  Description of Artificial Sequence: Synthetic oligonucleotide
  Target: SCN9A; (+) strand; PAM type: NRG; PAM sequence: AAG
attcacaactaaggaaacta

SEQ ID NO: 52630 - DNA, 20 bp, Artificial Sequence
  Description of Artificial Sequence: Synthetic oligonucleotide
  Target: SCN9A; (+) strand; PAM type: NRG; PAM sequence: TGG
ggaaactaaagcgttatcta

SEQ ID NO: 52631 - DNA, 20 bp, Artificial Sequence
  Description of Artificial Sequence: Synthetic oligonucleotide
  Target: SCN9A; (+) strand; PAM type: NRG; PAM sequence: TAG
taaagcgttatctatggaat

SEQ ID NO: 52632 - DNA, 20 bp, Artificial Sequence
  Description of Artificial Sequence: Synthetic oligonucleotide
  Target: SCN9A; (+) strand; PAM type: NRG; PAM sequence: AAG
tggaattagatactttgctc

SEQ ID NO: 52633 - DNA, 20 bp, Artificial Sequence
  Description of Artificial Sequence: Synthetic oligonucleotide
  Target: SCN9A; (+) strand; PAM type: NRG; PAM sequence: AGG
ggaattagatactttgctca

SEQ ID NO: 52634 - DNA, 20 bp, Artificial Sequence
  Description of Artificial Sequence: Synthetic oligonucleotide
  Target: SCN9A; (+) strand; PAM type: NRG; PAM sequence: CAG
atactttgctcaaggtaaca

SEQ ID NO: 52635 - DNA, 20 bp, Artificial Sequence
  Description of Artificial Sequence: Synthetic oligonucleotide
  Target: SCN9A; (+) strand; PAM type: NRG; PAM sequence: TAG
caaggtaacacagctgtgtg

SEQ ID NO: 52636 - DNA, 20 bp, Artificial Sequence
  Description of Artificial Sequence: Synthetic oligonucleotide
  Target: SCN9A; (+) strand; PAM type: NRG; PAM sequence: CAG
ggtaacacagctgtgtgtag

SEQ ID NO: 52637 - DNA, 20 bp, Artificial Sequence
  Description of Artificial Sequence: Synthetic oligonucleotide
  Target: SCN9A; (+) strand; PAM type: NRG; PAM sequence: GAG
taacacagctgtgtgtagca

SEQ ID NO: 52638 - DNA, 20 bp, Artificial Sequence
  Description of Artificial Sequence: Synthetic oligonucleotide
  Target: SCN9A; (+) strand; PAM type: NRG; PAM sequence: CAG
acagctgtgtgtagcagagc

SEQ ID NO: 52639 - DNA, 20 bp, Artificial Sequence
  Description of Artificial Sequence: Synthetic oligonucleotide
  Target: SCN9A; (+) strand; PAM type: NRG; PAM sequence: AGG
cagctgtgtgtagcagagcc

SEQ ID NO: 52640 - DNA, 20 bp, Artificial Sequence
  Description of Artificial Sequence: Synthetic oligonucleotide
  Target: SCN9A; (+) strand; PAM type: NRG; PAM sequence: AAG
gcagagccaggatttgaact

SEQ ID NO: 52641 - DNA, 20 bp, Artificial Sequence
  Description of Artificial Sequence: Synthetic oligonucleotide
  Target: SCN9A; (+) strand; PAM type: NRG; PAM sequence: CAG
aactaagatctgttactccc

SEQ ID NO: 52642 - DNA, 20 bp, Artificial Sequence
  Description of Artificial Sequence: Synthetic oligonucleotide
  Target: SCN9A; (+) strand; PAM type: NRG; PAM sequence: AGG
actaagatctgttactcccc

SEQ ID NO: 52643 - DNA, 20 bp, Artificial Sequence
  Description of Artificial Sequence: Synthetic oligonucleotide
  Target: SCN9A; (+) strand; PAM type: NRG; PAM sequence: CAG
agatctgttactccccaggc

SEQ ID NO: 52644 - DNA, 20 bp, Artificial Sequence
  Description of Artificial Sequence: Synthetic oligonucleotide
  Target: SCN9A; (+) strand; PAM type: NRG; PAM sequence: TAG
tgttactccccaggccagta

SEQ ID NO: 52645 - DNA, 20 bp, Artificial Sequence
  Description of Artificial Sequence: Synthetic oligonucleotide
  Target: SCN9A; (+) strand; PAM type: NRG; PAM sequence: AAG
ccaggccagtatagaaaaaa

SEQ ID NO: 52646 - DNA, 20 bp, Artificial Sequence
  Description of Artificial Sequence: Synthetic oligonucleotide
  Target: SCN9A; (+) strand; PAM type: NRG; PAM sequence: TAG
atagaaaaaaaagataacat

SEQ ID NO: 52647 - DNA, 20 bp, Artificial Sequence
  Description of Artificial Sequence: Synthetic oligonucleotide
  Target: SCN9A; (+) strand; PAM type: NRG; PAM sequence: GAG
agaaaaaaaagataacatta

SEQ ID NO: 52648 - DNA, 20 bp, Artificial Sequence
  Description of Artificial Sequence: Synthetic oligonucleotide
  Target: SCN9A; (+) strand; PAM type: NRG; PAM sequence: AGG
gaaaaaaaagataacattag

SEQ ID NO: 52649 - DNA, 20 bp, Artificial Sequence
  Description of Artificial Sequence: Synthetic oligonucleotide
  Target: SCN9A; (+) strand; PAM type: NRG; PAM sequence: AAG
aaaaaagataacattagagg

SEQ ID NO: 52650 - DNA, 20 bp, Artificial Sequence
  Description of Artificial Sequence: Synthetic oligonucleotide
  Target: SCN9A; (+) strand; PAM type: NRG; PAM sequence: AGG
aaaaagataacattagagga

SEQ ID NO: 52651 - DNA, 20 bp, Artificial Sequence
  Description of Artificial Sequence: Synthetic oligonucleotide
  Target: SCN9A; (+) strand; PAM type: NRG; PAM sequence: CAG
tgttttaaaactttaaaatg

SEQ ID NO: 52652 - DNA, 20 bp, Artificial Sequence
  Description of Artificial Sequence: Synthetic oligonucleotide
  Target: SCN9A; (+) strand; PAM type: NRG; PAM sequence: TGG
ctttaaaatgcagaaataca

SEQ ID NO: 52653 - DNA, 20 bp, Artificial Sequence
  Description of Artificial Sequence: Synthetic oligonucleotide
  Target: SCN9A; (+) strand; PAM type: NRG; PAM sequence: TAG
aaatgcagaaatacatggct

SEQ ID NO: 52654 - DNA, 20 bp, Artificial Sequence
  Description of Artificial Sequence: Synthetic oligonucleotide
  Target: SCN9A; (+) strand; PAM type: NRG; PAM sequence: GAG
atgcagaaatacatggctta

SEQ ID NO: 52655 - DNA, 20 bp, Artificial Sequence
  Description of Artificial Sequence: Synthetic oligonucleotide
  Target: SCN9A; (+) strand; PAM type: NRG; PAM sequence: AAG
tagagtatgtacctgttgca

SEQ ID NO: 52656 - DNA, 20 bp, Artificial Sequence
  Description of Artificial Sequence: Synthetic oligonucleotide
  Target: SCN9A; (+) strand; PAM type: NRG; PAM sequence: AGG
agagtatgtacctgttgcaa

SEQ ID NO: 52657 - DNA, 20 bp, Artificial Sequence
  Description of Artificial Sequence: Synthetic oligonucleotide
  Target: SCN9A; (+) strand; PAM type: NRG; PAM sequence: TGG
tgtacctgttgcaaaggtct

SEQ ID NO: 52658 - DNA, 20 bp, Artificial Sequence
  Description of Artificial Sequence: Synthetic oligonucleotide
  Target: SCN9A; (+) strand; PAM type: NRG; PAM sequence: TGG
atttttatcgatgactcatt

SEQ ID NO: 52659 - DNA, 20 bp, Artificial Sequence
  Description of Artificial Sequence: Synthetic oligonucleotide
  Target: SCN9A; (+) strand; PAM type: NRG; PAM sequence: CAG
atgactcatttggctttatt

SEQ ID NO: 52660 - DNA, 20 bp, Artificial Sequence
  Description of Artificial Sequence: Synthetic oligonucleotide
  Target: SCN9A; (+) strand; PAM type: NRG; PAM sequence: CAG
actcatttggctttattcag

SEQ ID NO: 52661 - DNA, 20 bp, Artificial Sequence
  Description of Artificial Sequence: Synthetic oligonucleotide
  Target: SCN9A; (+) strand; PAM type: NRG; PAM sequence: GAG
tggctttattcagcagactt

SEQ ID NO: 52662 - DNA, 20 bp, Artificial Sequence
  Description of Artificial Sequence: Synthetic oligonucleotide
  Target: SCN9A; (+) strand; PAM type: NRG; PAM sequence: TAG
ttattcagcagacttgagtt

SEQ ID NO: 52663 - DNA, 20 bp, Artificial Sequence
  Description of Artificial Sequence: Synthetic oligonucleotide
  Target: SCN9A; (+) strand; PAM type: NRG; PAM sequence: CAG
cttgagtttagaaattcaat

SEQ ID NO: 52664 - DNA, 20 bp, Artificial Sequence
  Description of Artificial Sequence: Synthetic oligonucleotide
  Target: SCN9A; (+) strand; PAM type: NRG; PAM sequence: GAG
agtttagaaattcaatcagt

SEQ ID NO: 52665 - DNA, 20 bp, Artificial Sequence
  Description of Artificial Sequence: Synthetic oligonucleotide
  Target: SCN9A; (+) strand; PAM type: NRG; PAM sequence: TAG
ttagaaattcaatcagtgag

SEQ ID NO: 52666 - DNA, 20 bp, Artificial Sequence
  Description of Artificial Sequence: Synthetic oligonucleotide
  Target: SCN9A; (+) strand; PAM type: NRG; PAM sequence: TGG
caatcagtgagtagtttatc

SEQ ID NO: 52667 - DNA, 20 bp, Artificial Sequence
  Description of Artificial Sequence: Synthetic oligonucleotide
  Target: SCN9A; (+) strand; PAM type: NRG; PAM sequence: CAG
taattaaataaaacaatccc

SEQ ID NO: 52668 - DNA, 20 bp, Artificial Sequence
  Description of Artificial Sequence: Synthetic oligonucleotide
  Target: SCN9A; (+) strand; PAM type: NRG; PAM sequence: AGG
aattaaataaaacaatcccc

SEQ ID NO: 52669 - DNA, 20 bp, Artificial Sequence
  Description of Artificial Sequence: Synthetic oligonucleotide
  Target: SCN9A; (+) strand; PAM type: NRG; PAM sequence: AAG
taaataaaacaatccccagg

SEQ ID NO: 52670 - DNA, 20 bp, Artificial Sequence
  Description of Artificial Sequence: Synthetic oligonucleotide
  Target: SCN9A; (+) strand; PAM type: NRG; PAM sequence: AAG
cccaggaagttaattgaaaa

SEQ ID NO: 52671 - DNA, 20 bp, Artificial Sequence
  Description of Artificial Sequence: Synthetic oligonucleotide
  Target: SCN9A; (+) strand; PAM type: NRG; PAM sequence: CAG
attgaaaaaagcctgcccat

SEQ ID NO: 52672 - DNA, 20 bp, Artificial Sequence
  Description of Artificial Sequence: Synthetic oligonucleotide
  Target: SCN9A; (+) strand; PAM type: NRG; PAM sequence: AGG
ttgaaaaaagcctgcccatc

SEQ ID NO: 52673 - DNA, 20 bp, Artificial Sequence
  Description of Artificial Sequence: Synthetic oligonucleotide
  Target: SCN9A; (+) strand; PAM type: NRG; PAM sequence: TAG
gcctgcccatcaggaacacc

SEQ ID NO: 52674 - DNA, 20 bp, Artificial Sequence
  Description of Artificial Sequence: Synthetic oligonucleotide
  Target: SCN9A; (+) strand; PAM type: NRG; PAM sequence: AAG
tgcccatcaggaacacctag

SEQ ID NO: 52675 - DNA, 20 bp, Artificial Sequence
  Description of Artificial Sequence: Synthetic oligonucleotide
  Target: SCN9A; (+) strand; PAM type: NRG; PAM sequence: TGG
acctagaagccacgctttgt

SEQ ID NO: 52676 - DNA, 20 bp, Artificial Sequence
  Description of Artificial Sequence: Synthetic oligonucleotide
  Target: SCN9A; (+) strand; PAM type: NRG; PAM sequence: AAG
cacgctttgttggtctgttt

SEQ ID NO: 52677 - DNA, 20 bp, Artificial Sequence
  Description of Artificial Sequence: Synthetic oligonucleotide
  Target: SCN9A; (+) strand; PAM type: NRG; PAM sequence: TGG
gtctgtttaagccaaatttc

SEQ ID NO: 52678 - DNA, 20 bp, Artificial Sequence
  Description of Artificial Sequence: Synthetic oligonucleotide
  Target: SCN9A; (+) strand; PAM type: NRG; PAM sequence: CGG
atttctggcacactgctctt

SEQ ID NO: 52679 - DNA, 20 bp, Artificial Sequence
  Description of Artificial Sequence: Synthetic oligonucleotide
  Target: SCN9A; (+) strand; PAM type: NRG; PAM sequence: CAG
ggaaatcaaatttaaaatga

SEQ ID NO: 52680 - DNA, 20 bp, Artificial Sequence
  Description of Artificial Sequence: Synthetic oligonucleotide
  Target: SCN9A; (+) strand; PAM type: NRG; PAM sequence: AGG
gaaatcaaatttaaaatgac

SEQ ID NO: 52681 - DNA, 20 bp, Artificial Sequence
  Description of Artificial Sequence: Synthetic oligonucleotide
  Target: SCN9A; (+) strand; PAM type: NRG; PAM sequence: AAG
tcaaatttaaaatgacaggt

SEQ ID NO: 52682 - DNA, 20 bp, Artificial Sequence
  Description of Artificial Sequence: Synthetic oligonucleotide
  Target: SCN9A; (+) strand; PAM type: NRG; PAM sequence: TGG
atttaaaatgacaggtaagt

SEQ ID NO: 52683 - DNA, 20 bp, Artificial Sequence
  Description of Artificial Sequence: Synthetic oligonucleotide
  Target: SCN9A; (+) strand; PAM type: NRG; PAM sequence: AAG
agttggtcttaactttctta

SEQ ID NO: 52684 - DNA, 20 bp, Artificial Sequence
  Description of Artificial Sequence: Synthetic oligonucleotide
  Target: SCN9A; (+) strand; PAM type: NRG; PAM sequence: AGG
gttggtcttaactttcttaa

SEQ ID NO: 52685 - DNA, 20 bp, Artificial Sequence
  Description of Artificial Sequence: Synthetic oligonucleotide
  Target: SCN9A; (+) strand; PAM type: NRG; PAM sequence: AAG
actttcttaaaggcacaaac

SEQ ID NO: 52686 - DNA, 20 bp, Artificial Sequence
  Description of Artificial Sequence: Synthetic oligonucleotide
  Target: SCN9A; (+) strand; PAM type: NRG; PAM sequence: TAG
ttaaaggcacaaacaagtaa

SEQ ID NO: 52687 - DNA, 20 bp, Artificial Sequence
  Description of Artificial Sequence: Synthetic oligonucleotide
  Target: SCN9A; (+) strand; PAM type: NRG; PAM sequence: CAG
ctctgatatataatgtatca

SEQ ID NO: 52688 - DNA, 20 bp, Artificial Sequence
  Description of Artificial Sequence: Synthetic oligonucleotide
  Target: SCN9A; (+) strand; PAM type: NRG; PAM sequence: AAG
atatataatgtatcacagaa

SEQ ID NO: 52689 - DNA, 20 bp, Artificial Sequence
  Description of Artificial Sequence: Synthetic oligonucleotide
  Target: SCN9A; (+) strand; PAM type: NRG; PAM sequence: AGG
tatataatgtatcacagaaa

SEQ ID NO: 52690 - DNA, 20 bp, Artificial Sequence
  Description of Artificial Sequence: Synthetic oligonucleotide
  Target: SCN9A; (+) strand; PAM type: NRG; PAM sequence: TAG
gaaaaggctgatttcacatg

SEQ ID NO: 52691 - DNA, 20 bp, Artificial Sequence
  Description of Artificial Sequence: Synthetic oligonucleotide
  Target: SCN9A; (+) strand; PAM type: NRG; PAM sequence: TGG
aaggctgatttcacatgtag

SEQ ID NO: 52692 - DNA, 20 bp, Artificial Sequence
  Description of Artificial Sequence: Synthetic oligonucleotide
  Target: SCN9A; (+) strand; PAM type: NRG; PAM sequence: CAG
atgtagtggccttttatcaa

SEQ ID NO: 52693 - DNA, 20 bp, Artificial Sequence
  Description of Artificial Sequence: Synthetic oligonucleotide
  Target: SCN9A; (+) strand; PAM type: NRG; PAM sequence: TGG
ttatcaacagcaacataatt

SEQ ID NO: 52694 - DNA, 20 bp, Artificial Sequence
  Description of Artificial Sequence: Synthetic oligonucleotide
  Target: SCN9A; (+) strand; PAM type: NRG; PAM sequence: GGG
tatcaacagcaacataattt

SEQ ID NO: 52695 - DNA, 20 bp, Artificial Sequence
  Description of Artificial Sequence: Synthetic oligonucleotide
  Target: SCN9A; (+) strand; PAM type: NRG; PAM sequence: TAG
gaatttctaaatttttaatt

SEQ ID NO: 52696 - DNA, 20 bp, Artificial Sequence
  Description of Artificial Sequence: Synthetic oligonucleotide
  Target: SCN9A; (+) strand; PAM type: NRG; PAM sequence: AAG
tttaatttagatcttacttt

SEQ ID NO: 52697 - DNA, 20 bp, Artificial Sequence
  Description of Artificial Sequence: Synthetic oligonucleotide
  Target: SCN9A; (+) strand; PAM type: NRG; PAM sequence: TAG
tactttaagatatgaaaaaa

SEQ ID NO: 52698 - DNA, 20 bp, Artificial Sequence
  Description of Artificial Sequence: Synthetic oligonucleotide
  Target: SCN9A; (+) strand; PAM type: NRG; PAM sequence: AGG
actttaagatatgaaaaaat

SEQ ID NO: 52699 - DNA, 20 bp, Artificial Sequence
  Description of Artificial Sequence: Synthetic oligonucleotide
  Target: SCN9A; (+) strand; PAM type: NRG; PAM sequence: GAG
tttaagatatgaaaaaatag

SEQ ID NO: 52700 - DNA, 20 bp, Artificial Sequence
  Description of Artificial Sequence: Synthetic oligonucleotide
  Target: SCN9A; (+) strand; PAM type: NRG; PAM sequence: AGG
ttaagatatgaaaaaatagg

SEQ ID NO: 52701 - DNA, 20 bp, Artificial Sequence
  Description of Artificial Sequence: Synthetic oligonucleotide
  Target: SCN9A; (+) strand; PAM type: NRG; PAM sequence: GAG
aagatatgaaaaaataggag

SEQ ID NO: 52702 - DNA, 20 bp, Artificial Sequence
  Description of Artificial Sequence: Synthetic oligonucleotide
  Target: SCN9A; (+) strand; PAM type: NRG; PAM sequence: AGG
agatatgaaaaaataggagg

SEQ ID NO: 52703 - DNA, 20 bp, Artificial Sequence
  Description of Artificial Sequence: Synthetic oligonucleotide
  Target: SCN9A; (+) strand; PAM type: NRG; PAM sequence: GGG
gatatgaaaaaataggagga

SEQ ID NO: 52704 - DNA, 20 bp, Artificial Sequence
  Description of Artificial Sequence: Synthetic oligonucleotide
  Target: SCN9A; (+) strand; PAM type: NRG; PAM sequence: GAG
tatgaaaaaataggaggagg

SEQ ID NO: 52705 - DNA, 20 bp, Artificial Sequence
  Description of Artificial Sequence: Synthetic oligonucleotide
  Target: SCN9A; (+) strand; PAM type: NRG; PAM sequence: AGG
atgaaaaaataggaggaggg

SEQ ID NO: 52706 - DNA, 20 bp, Artificial Sequence
  Description of Artificial Sequence: Synthetic oligonucleotide
  Target: SCN9A; (+) strand; PAM type: NRG; PAM sequence: GGG
tgaaaaaataggaggaggga

SEQ ID NO: 52707 - DNA, 20 bp, Artificial Sequence
  Description of Artificial Sequence: Synthetic oligonucleotide
  Target: SCN9A; (+) strand; PAM type: NRG; PAM sequence: GGG
gaaaaaataggaggagggag

SEQ ID NO: 52708 - DNA, 20 bp, Artificial Sequence
  Description of Artificial Sequence: Synthetic oligonucleotide
  Target: SCN9A; (+) strand; PAM type: NRG; PAM sequence: AAG
aaaataggaggagggagggg

SEQ ID NO: 52709 - DNA, 20 bp, Artificial Sequence
  Description of Artificial Sequence: Synthetic oligonucleotide
  Target: SCN9A; (+) strand; PAM type: NRG; PAM sequence: TGG
gggaggggaagctaaatgcc

SEQ ID NO: 52710 - DNA, 20 bp, Artificial Sequence
  Description of Artificial Sequence: Synthetic oligonucleotide
  Target: SCN9A; (+) strand; PAM type: NRG; PAM sequence: GGG
ggaggggaagctaaatgcct

SEQ ID NO: 52711 - DNA, 20 bp, Artificial Sequence
  Description of Artificial Sequence: Synthetic oligonucleotide
  Target: SCN9A; (+) strand; PAM type: NRG; PAM sequence: GGG
gaggggaagctaaatgcctg

SEQ ID NO: 52712 - DNA, 20 bp, Artificial Sequence
  Description of Artificial Sequence: Synthetic oligonucleotide
  Target: SCN9A; (+) strand; PAM type: NRG; PAM sequence: AAG
ggaagctaaatgcctgggga

SEQ ID NO: 52713 - DNA, 20 bp, Artificial Sequence
  Description of Artificial Sequence: Synthetic oligonucleotide
  Target: SCN9A; (+) strand; PAM type: NRG; PAM sequence: TAG
gggaaagacatgcatgttct

SEQ ID NO: 52714 - DNA, 20 bp, Artificial Sequence
  Description of Artificial Sequence: Synthetic oligonucleotide
  Target: SCN9A; (+) strand; PAM type: NRG; PAM sequence: TAG
gcatgttcttagaattttgt

SEQ ID NO: 52715 - DNA, 20 bp, Artificial Sequence
  Description of Artificial Sequence: Synthetic oligonucleotide
  Target: SCN9A; (+) strand; PAM type: NRG; PAM sequence: GAG
gaattttgttagaatgtaat

SEQ ID NO: 52716 - DNA, 20 bp, Artificial Sequence
  Description of Artificial Sequence: Synthetic oligonucleotide
  Target: SCN9A; (+) strand; PAM type: NRG; PAM sequence: TAG
tgtaatgagtccctatgtcc

SEQ ID NO: 52717 - DNA, 20 bp, Artificial Sequence
  Description of Artificial Sequence: Synthetic oligonucleotide
  Target: SCN9A; (+) strand; PAM type: NRG; PAM sequence: TAG
cctatgtcctagtattttta

SEQ ID NO: 52718 - DNA, 20 bp, Artificial Sequence
  Description of Artificial Sequence: Synthetic oligonucleotide
  Target: SCN9A; (+) strand; PAM type: NRG; PAM sequence: TAG
tctgttaactataatgaatt

SEQ ID NO: 52719 - DNA, 20 bp, Artificial Sequence
  Description of Artificial Sequence: Synthetic oligonucleotide
  Target: SCN9A; (+) strand; PAM type: NRG; PAM sequence: AGG
ctgttaactataatgaattt

SEQ ID NO: 52720 - DNA, 20 bp, Artificial Sequence
  Description of Artificial Sequence: Synthetic oligonucleotide
  Target: SCN9A; (+) strand; PAM type: NRG; PAM sequence: AAG
ttaactataatgaatttagg

SEQ ID NO: 52721 - DNA, 20 bp, Artificial Sequence
  Description of Artificial Sequence: Synthetic oligonucleotide
  Target: SCN9A; (+) strand; PAM type: NRG; PAM sequence: AGG
taactataatgaatttagga

SEQ ID NO: 52722 - DNA, 20 bp, Artificial Sequence
  Description of Artificial Sequence: Synthetic oligonucleotide
  Target: SCN9A; (+) strand; PAM type: NRG; PAM sequence: TGG
ctataatgaatttaggaagg

SEQ ID NO: 52723 - DNA, 20 bp, Artificial Sequence
  Description of Artificial Sequence: Synthetic oligonucleotide
  Target: SCN9A; (+) strand; PAM type: NRG; PAM sequence: GGG
tataatgaatttaggaaggt

SEQ ID NO: 52724 - DNA, 20 bp, Artificial Sequence
  Description of Artificial Sequence: Synthetic oligonucleotide
  Target: SCN9A; (+) strand; PAM type: NRG; PAM sequence: GAG
atgaatttaggaaggtgggt

SEQ ID NO: 52725 - DNA, 20 bp, Artificial Sequence
  Description of Artificial Sequence: Synthetic oligonucleotide
  Target: SCN9A; (+) strand; PAM type: NRG; PAM sequence: AAG
aatttaggaaggtgggtgag

SEQ ID NO: 52726 - DNA, 20 bp, Artificial Sequence
  Description of Artificial Sequence: Synthetic oligonucleotide
  Target: SCN9A; (+) strand; PAM type: NRG; PAM sequence: AGG
atttaggaaggtgggtgaga

SEQ ID NO: 52727 - DNA, 20 bp, Artificial Sequence
  Description of Artificial Sequence: Synthetic oligonucleotide
  Target: SCN9A; (+) strand; PAM type: NRG; PAM sequence: AAG
tcaccccaataaatgatatc

SEQ ID NO: 52728 - DNA, 20 bp, Artificial Sequence
  Description of Artificial Sequence: Synthetic oligonucleotide
  Target: SCN9A; (+) strand; PAM type: NRG; PAM sequence: TGG
atatttaaattaacaaaaac

SEQ ID NO: 52729 - DNA, 20 bp, Artificial Sequence
  Description of Artificial Sequence: Synthetic oligonucleotide
  Target: SCN9A; (+) strand; PAM type: NRG; PAM sequence: GAG
atttaaattaacaaaaactg

SEQ ID NO: 52730 - DNA, 20 bp, Artificial Sequence
  Description of Artificial Sequence: Synthetic oligonucleotide
  Target: SCN9A; (+) strand; PAM type: NRG; PAM sequence: TGG
ttaacaaaaactggagtccc

SEQ ID NO: 52731 - DNA, 20 bp, Artificial Sequence
  Description of Artificial Sequence: Synthetic oligonucleotide
  Target: SCN9A; (+) strand; PAM type: NRG; PAM sequence: AAG
ggagtccctggcacctgaac

SEQ ID NO: 52732 - DNA, 20 bp, Artificial Sequence
  Description of Artificial Sequence: Synthetic oligonucleotide
  Target: SCN9A; (+) strand; PAM type: NRG; PAM sequence: CAG
tgaacaagtgcttgctcaaa

SEQ ID NO: 52733 - DNA, 20 bp, Artificial Sequence
  Description of Artificial Sequence: Synthetic oligonucleotide
  Target: SCN9A; (+) strand; PAM type: NRG; PAM sequence: TAG
ttgttaattacttgtaaatg

SEQ ID NO: 52734 - DNA, 20 bp, Artificial Sequence
  Description of Artificial Sequence: Synthetic oligonucleotide
  Target: SCN9A; (+) strand; PAM type: NRG; PAM sequence: AAG
acttgtaaatgtagcacttc

SEQ ID NO: 52735 - DNA, 20 bp, Artificial Sequence
  Description of Artificial Sequence: Synthetic oligonucleotide
  Target: SCN9A; (+) strand; PAM type: NRG; PAM sequence: AGG
cttgtaaatgtagcacttca

SEQ ID NO: 52736 - DNA, 20 bp, Artificial Sequence
  Description of Artificial Sequence: Synthetic oligonucleotide
  Target: SCN9A; (+) strand; PAM type: NRG; PAM sequence: GAG
tgtaaatgtagcacttcaag

SEQ ID NO: 52737 - DNA, 20 bp, Artificial Sequence
  Description of Artificial Sequence: Synthetic oligonucleotide
  Target: SCN9A; (+) strand; PAM type: NRG; PAM sequence: AGG
gtaaatgtagcacttcaagg

SEQ ID NO: 52738 - DNA, 20 bp, Artificial Sequence
  Description of Artificial Sequence: Synthetic oligonucleotide
  Target: SCN9A; (+) strand; PAM type: NRG; PAM sequence: GAG
aaatgtagcacttcaaggag

SEQ ID NO: 52739 - DNA, 20 bp, Artificial Sequence
  Description of Artificial Sequence: Synthetic oligonucleotide
  Target: SCN9A; (+) strand; PAM type: NRG; PAM sequence: GAG
atgtagcacttcaaggagga

SEQ ID NO: 52740 - DNA, 20 bp, Artificial Sequence
  Description of Artificial Sequence: Synthetic oligonucleotide
  Target: SCN9A; (+) strand; PAM type: NRG; PAM sequence: TAG
acttcaaggaggagagttaa

SEQ ID NO: 52741 - DNA, 20 bp, Artificial Sequence
  Description of Artificial Sequence: Synthetic oligonucleotide
  Target: SCN9A; (+) strand; PAM type: NRG; PAM sequence: AAG
ggaggagagttaatagtata

SEQ ID NO: 52742 - DNA, 20 bp, Artificial Sequence
  Description of Artificial Sequence: Synthetic oligonucleotide
  Target: SCN9A; (+) strand; PAM type: NRG; PAM sequence: AGG
gaggagagttaatagtataa

SEQ ID NO: 52743 - DNA, 20 bp, Artificial Sequence
  Description of Artificial Sequence: Synthetic oligonucleotide
  Target: SCN9A; (+) strand; PAM type: NRG; PAM sequence: CAG
tataaaggttaccttaaaat

SEQ ID NO: 52744 - DNA, 20 bp, Artificial Sequence
  Description of Artificial Sequence: Synthetic oligonucleotide
  Target: SCN9A; (+) strand; PAM type: NRG; PAM sequence: TGG
ataacttctatgtaataata

SEQ ID NO: 52745 - DNA, 20 bp, Artificial Sequence
  Description of Artificial Sequence: Synthetic oligonucleotide
  Target: SCN9A; (+) strand; PAM type: NRG; PAM sequence: TGG
acttctatgtaataatatgg

SEQ ID NO: 52746 - DNA, 20 bp, Artificial Sequence
  Description of Artificial Sequence: Synthetic oligonucleotide
  Target: SCN9A; (+) strand; PAM type: NRG; PAM sequence: TAG
taatatggtggaaaataaaa

SEQ ID NO: 52747 - DNA, 20 bp, Artificial Sequence
  Description of Artificial Sequence: Synthetic oligonucleotide
  Target: SCN9A; (+) strand; PAM type: NRG; PAM sequence: GAG
tggtggaaaataaaatagat

SEQ ID NO: 52748 - DNA, 20 bp, Artificial Sequence
  Description of Artificial Sequence: Synthetic oligonucleotide
  Target: SCN9A; (+) strand; PAM type: NRG; PAM sequence: TAG
aataaaatagatgagaacct

SEQ ID NO: 52749 - DNA, 20 bp, Artificial Sequence
  Description of Artificial Sequence: Synthetic oligonucleotide
  Target: SCN9A; (+) strand; PAM type: NRG; PAM sequence: TAG
aatagatgagaaccttagtg

SEQ ID NO: 52750 - DNA, 20 bp, Artificial Sequence
  Description of Artificial Sequence: Synthetic oligonucleotide
  Target: SCN9A; (+) strand; PAM type: NRG; PAM sequence: TGG
gagaaccttagtgtagaata

SEQ ID NO: 52751 - DNA, 20 bp, Artificial Sequence
  Description of Artificial Sequence: Synthetic oligonucleotide
  Target: SCN9A; (+) strand; PAM type: NRG; PAM sequence: TAG
tgaaatttaattctactatc

SEQ ID NO: 52752 - DNA, 20 bp, Artificial Sequence
  Description of Artificial Sequence: Synthetic oligonucleotide
  Target: SCN9A; (+) strand; PAM type: NRG; PAM sequence: GAG
aaatttaattctactatcta

SEQ ID NO: 52753 - DNA, 20 bp, Artificial Sequence
  Description of Artificial Sequence: Synthetic oligonucleotide
  Target: SCN9A; (+) strand; PAM type: NRG; PAM sequence: GAG
atttaattctactatctaga

SEQ ID NO: 52754 - DNA, 20 bp, Artificial Sequence
  Description of Artificial Sequence: Synthetic oligonucleotide
  Target: SCN9A; (+) strand; PAM type: NRG; PAM sequence: AGG
tttaattctactatctagag

SEQ ID NO: 52755 - DNA, 20 bp, Artificial Sequence
  Description of Artificial Sequence: Synthetic oligonucleotide
  Target: SCN9A; (+) strand; PAM type: NRG; PAM sequence: TAG
aattctactatctagagagg

SEQ ID NO: 52756 - DNA, 20 bp, Artificial Sequence
  Description of Artificial Sequence: Synthetic oligonucleotide
  Target: SCN9A; (+) strand; PAM type: NRG; PAM sequence: TAG
tctagagaggtagcatattg

SEQ ID NO: 52757 - DNA, 20 bp, Artificial Sequence
  Description of Artificial Sequence: Synthetic oligonucleotide
  Target: SCN9A; (+) strand; PAM type: NRG; PAM sequence: AGG
ctagagaggtagcatattgt

SEQ ID NO: 52758 - DNA, 20 bp, Artificial Sequence
  Description of Artificial Sequence: Synthetic oligonucleotide
  Target: SCN9A; (+) strand; PAM type: NRG; PAM sequence: AAG
agcatattgtaggaaattat

SEQ ID NO: 52759 - DNA, 20 bp, Artificial Sequence
  Description of Artificial Sequence: Synthetic oligonucleotide
  Target: SCN9A; (+) strand; PAM type: NRG; PAM sequence: TGG
gaaattataagtccaaatgt

SEQ ID NO: 52760 - DNA, 20 bp, Artificial Sequence
  Description of Artificial Sequence: Synthetic oligonucleotide
  Target: SCN9A; (+) strand; PAM type: NRG; PAM sequence: GAG
taccactcttgtatgaacct

SEQ ID NO: 52761 - DNA, 20 bp, Artificial Sequence
  Description of Artificial Sequence: Synthetic oligonucleotide
  Target: SCN9A; (+) strand; PAM type: NRG; PAM sequence: CAG
ctgagtaaatgatttaacct

SEQ ID NO: 52762 - DNA, 20 bp, Artificial Sequence
  Description of Artificial Sequence: Synthetic oligonucleotide
  Target: SCN9A; (+) strand; PAM type: NRG; PAM sequence: AGG
tgagtaaatgatttaacctc

SEQ ID NO: 52763 - DNA, 20 bp, Artificial Sequence
  Description of Artificial Sequence: Synthetic oligonucleotide
  Target: SCN9A; (+) strand; PAM type: NRG; PAM sequence: TGG
aactatgtctcctatttcac

SEQ ID NO: 52764 - DNA, 20 bp, Artificial Sequence
  Description of Artificial Sequence: Synthetic oligonucleotide
  Target: SCN9A; (+) strand; PAM type: NRG; PAM sequence: GAG
atgtctcctatttcactggt

SEQ ID NO: 52765 - DNA, 20 bp, Artificial Sequence
  Description of Artificial Sequence: Synthetic oligonucleotide
  Target: SCN9A; (+) strand; PAM type: NRG; PAM sequence: AGG
tgtctcctatttcactggtg

SEQ ID NO: 52766 - DNA, 20 bp, Artificial Sequence
  Description of Artificial Sequence: Synthetic oligonucleotide
  Target: SCN9A; (+) strand; PAM type: NRG; PAM sequence: AAG
ctcctatttcactggtgagg

SEQ ID NO: 52767 - DNA, 20 bp, Artificial Sequence
  Description of Artificial Sequence: Synthetic oligonucleotide
  Target: SCN9A; (+) strand; PAM type: NRG; PAM sequence: CGG
tcactggtgaggaagttaca

SEQ ID NO: 52768 - DNA, 20 bp, Artificial Sequence
  Description of Artificial Sequence: Synthetic oligonucleotide
  Target: SCN9A; (+) strand; PAM type: NRG; PAM sequence: GGG
cactggtgaggaagttacac

SEQ ID NO: 52769 - DNA, 20 bp, Artificial Sequence
  Description of Artificial Sequence: Synthetic oligonucleotide
  Target: SCN9A; (+) strand; PAM type: NRG; PAM sequence: TAG
tggtgaggaagttacacggg

SEQ ID NO: 52770 - DNA, 20 bp, Artificial Sequence
  Description of Artificial Sequence: Synthetic oligonucleotide
  Target: SCN9A; (+) strand; PAM type: NRG; PAM sequence: TAG
aagttacacgggtagtctgt

SEQ ID NO: 52771 - DNA, 20 bp, Artificial Sequence
  Description of Artificial Sequence: Synthetic oligonucleotide
  Target: SCN9A; (+) strand; PAM type: NRG; PAM sequence: AAG
tacacgggtagtctgttaga

SEQ ID NO: 52772 - DNA, 20 bp, Artificial Sequence
  Description of Artificial Sequence: Synthetic oligonucleotide
  Target: SCN9A; (+) strand; PAM type: NRG; PAM sequence: GAG
cacgggtagtctgttagaaa

SEQ ID NO: 52773 - DNA, 20 bp, Artificial Sequence
  Description of Artificial Sequence: Synthetic oligonucleotide
  Target: SCN9A; (+) strand; PAM type: NRG; PAM sequence: AGG
acgggtagtctgttagaaag

SEQ ID NO: 52774 - DNA, 20 bp, Artificial Sequence
  Description of Artificial Sequence: Synthetic oligonucleotide
  Target: SCN9A; (+) strand; PAM type: NRG; PAM sequence: GGG
cgggtagtctgttagaaaga

SEQ ID NO: 52775 - DNA, 20 bp, Artificial Sequence
  Description of Artificial Sequence: Synthetic oligonucleotide
  Target: SCN9A; (+) strand; PAM type: NRG; PAM sequence: GGG
gggtagtctgttagaaagag

SEQ ID NO: 52776 - DNA, 20 bp, Artificial Sequence
  Description of Artificial Sequence: Synthetic oligonucleotide
  Target: SCN9A; (+) strand; PAM type: NRG; PAM sequence: AAG
tctgttagaaagaggggatg

SEQ ID NO: 52777 - DNA, 20 bp, Artificial Sequence
  Description of Artificial Sequence: Synthetic oligonucleotide
  Target: SCN9A; (+) strand; PAM type: NRG; PAM sequence: AAG
ttagaaagaggggatgaagt

SEQ ID NO: 52778 - DNA, 20 bp, Artificial Sequence
  Description of Artificial Sequence: Synthetic oligonucleotide
  Target: SCN9A; (+) strand; PAM type: NRG; PAM sequence: AGG
tagaaagaggggatgaagta

SEQ ID NO: 52779 - DNA, 20 bp, Artificial Sequence
  Description of Artificial Sequence: Synthetic oligonucleotide
  Target: SCN9A; (+) strand; PAM type: NRG; PAM sequence: CAG
aaagaggggatgaagtaagg

SEQ ID NO: 52780 - DNA, 20 bp, Artificial Sequence
  Description of Artificial Sequence: Synthetic oligonucleotide
  Target: SCN9A; (+) strand; PAM type: NRG; PAM sequence: AGG
aagaggggatgaagtaaggc

SEQ ID NO: 52781 - DNA, 20 bp, Artificial Sequence
  Description of Artificial Sequence: Synthetic oligonucleotide
  Target: SCN9A; (+) strand; PAM type: NRG; PAM sequence: AAG
gggatgaagtaaggcaggac

SEQ ID NO: 52782 - DNA, 20 bp, Artificial Sequence
  Description of Artificial Sequence: Synthetic oligonucleotide
  Target: SCN9A; (+) strand; PAM type: NRG; PAM sequence: TGG
agtaaggcaggacaagcacc

SEQ ID NO: 52783 - DNA, 20 bp, Artificial Sequence
  Description of Artificial Sequence: Synthetic oligonucleotide
  Target: SCN9A; (+) strand; PAM type: NRG; PAM sequence: TAG
aggcaggacaagcacctggc

SEQ ID NO: 52784 - DNA, 20 bp, Artificial Sequence
  Description of Artificial Sequence: Synthetic oligonucleotide
  Target: SCN9A; (+) strand; PAM type: NRG; PAM sequence: AGG
ggcaggacaagcacctggct

SEQ ID NO: 52785 - DNA, 20 bp, Artificial Sequence
  Description of Artificial Sequence: Synthetic oligonucleotide
  Target: SCN9A; (+) strand; PAM type: NRG; PAM sequence: GGG
gcaggacaagcacctggcta

SEQ ID NO: 52786 - DNA, 20 bp, Artificial Sequence
  Description of Artificial Sequence: Synthetic oligonucleotide
  Target: SCN9A; (+) strand; PAM type: NRG; PAM sequence: CAG
cctggctagggtttactcta

SEQ ID NO: 52787 - DNA, 20 bp, Artificial Sequence
  Description of Artificial Sequence: Synthetic oligonucleotide
  Target: SCN9A; (+) strand; PAM type: NRG; PAM sequence: CAG
gggtttactctacagtatta

SEQ ID NO: 52788 - DNA, 20 bp, Artificial Sequence
  Description of Artificial Sequence: Synthetic oligonucleotide
  Target: SCN9A; (+) strand; PAM type: NRG; PAM sequence: AAG
agtattacagcttgaaaaca

SEQ ID NO: 52789 - DNA, 20 bp, Artificial Sequence
  Description of Artificial Sequence: Synthetic oligonucleotide
  Target: SCN9A; (+) strand; PAM type: NRG; PAM sequence: AAG
tacagcttgaaaacaaagaa

SEQ ID NO: 52790 - DNA, 20 bp, Artificial Sequence
  Description of Artificial Sequence: Synthetic oligonucleotide
  Target: SCN9A; (+) strand; PAM type: NRG; PAM sequence: GAG
cagcttgaaaacaaagaaaa

SEQ ID NO: 52791 - DNA, 20 bp, Artificial Sequence
  Description of Artificial Sequence: Synthetic oligonucleotide
  Target: SCN9A; (+) strand; PAM type: NRG; PAM sequence: TGG
caaagaaaagagaaaacaaa

SEQ ID NO: 52792 - DNA, 20 bp, Artificial Sequence
  Description of Artificial Sequence: Synthetic oligonucleotide
  Target: SCN9A; (+) strand; PAM type: NRG; PAM sequence: GGG
aaagaaaagagaaaacaaat

SEQ ID NO: 52793 - DNA, 20 bp, Artificial Sequence
  Description of Artificial Sequence: Synthetic oligonucleotide
  Target: SCN9A; (+) strand; PAM type: NRG; PAM sequence: CAG
agagaaaacaaatgggaaac

SEQ ID NO: 52794 - DNA, 20 bp, Artificial Sequence
  Description of Artificial Sequence: Synthetic oligonucleotide
  Target: SCN9A; (+) strand; PAM type: NRG; PAM sequence: GAG
ccagtctccttaatgaaaat

SEQ ID NO: 52795 - DNA, 20 bp, Artificial Sequence
  Description of Artificial Sequence: Synthetic oligonucleotide
  Target: SCN9A; (+) strand; PAM type: NRG; PAM sequence: AAG
ctccttaatgaaaatgagtg

SEQ ID NO: 52796 - DNA, 20 bp, Artificial Sequence
  Description of Artificial Sequence: Synthetic oligonucleotide
  Target: SCN9A; (+) strand; PAM type: NRG; PAM sequence: AAG
atgaaaatgagtgaagacaa

SEQ ID NO: 52797 - DNA, 20 bp, Artificial Sequence
  Description of Artificial Sequence: Synthetic oligonucleotide
  Target: SCN9A; (+) strand; PAM type: NRG; PAM sequence: TGG
aagcctcaaataacacatct

SEQ ID NO: 52798 - DNA, 20 bp, Artificial Sequence
  Description of Artificial Sequence: Synthetic oligonucleotide
  Target: SCN9A; (+) strand; PAM type: NRG; PAM sequence: GGG
agcctcaaataacacatctt

SEQ ID NO: 52799 - DNA, 20 bp, Artificial Sequence
  Description of Artificial Sequence: Synthetic oligonucleotide
  Target: SCN9A; (+) strand; PAM type: NRG; PAM sequence: AAG
ctcaaataacacatcttggg

SEQ ID NO: 52800 - DNA, 20 bp, Artificial Sequence
  Description of Artificial Sequence: Synthetic oligonucleotide
  Target: SCN9A; (+) strand; PAM type: NRG; PAM sequence: CAG
catcttgggaagaatgtact

SEQ ID NO: 52801 - DNA, 20 bp, Artificial Sequence
  Description of Artificial Sequence: Synthetic oligonucleotide
  Target: SCN9A; (+) strand; PAM type: NRG; PAM sequence: GAG
tttataatttataattatct

SEQ ID NO: 52802 - DNA, 20 bp, Artificial Sequence
  Description of Artificial Sequence: Synthetic oligonucleotide
  Target: SCN9A; (+) strand; PAM type: NRG; PAM sequence: TGG
tttatatcgactatttgaca

SEQ ID NO: 52803 - DNA, 20 bp, Artificial Sequence
  Description of Artificial Sequence: Synthetic oligonucleotide
  Target: SCN9A; (+) strand; PAM type: NRG; PAM sequence: GGG
ttatatcgactatttgacat

SEQ ID NO: 52804 - DNA, 20 bp, Artificial Sequence
  Description of Artificial Sequence: Synthetic oligonucleotide
  Target: SCN9A; (+) strand; PAM type: NRG; PAM sequence: AAG
attgacatatctattacttg

SEQ ID NO: 52805 - DNA, 20 bp, Artificial Sequence
  Description of Artificial Sequence: Synthetic oligonucleotide
  Target: SCN9A; (+) strand; PAM type: NRG; PAM sequence: AGG
ttgacatatctattacttga

SEQ ID NO: 52806 - DNA, 20 bp, Artificial Sequence
  Description of Artificial Sequence: Synthetic oligonucleotide
  Target: SCN9A; (+) strand; PAM type: NRG; PAM sequence: AAG
atatctattacttgaaggtc

SEQ ID NO: 52807 - DNA, 20 bp, Artificial Sequence
  Description of Artificial Sequence: Synthetic oligonucleotide
  Target: SCN9A; (+) strand; PAM type: NRG; PAM sequence: AAG
attacttgaaggtcaagtac

SEQ ID NO: 52808 - DNA, 20 bp, Artificial Sequence
  Description of Artificial Sequence: Synthetic oligonucleotide
  Target: SCN9A; (+) strand; PAM type: NRG; PAM sequence: TAG
tacaagtgcattttaccaaa

SEQ ID NO: 52809 - DNA, 20 bp, Artificial Sequence
  Description of Artificial Sequence: Synthetic oligonucleotide
  Target: SCN9A; (+) strand; PAM type: NRG; PAM sequence: CAG
ttgcaaaactacttttcact

SEQ ID NO: 52810 - DNA, 20 bp, Artificial Sequence
  Description of Artificial Sequence: Synthetic oligonucleotide
  Target: SCN9A; (+) strand; PAM type: NRG; PAM sequence: TGG
caactactactactgattct

SEQ ID NO: 52811 - DNA, 20 bp, Artificial Sequence
  Description of Artificial Sequence: Synthetic oligonucleotide
  Target: SCN9A; (+) strand; PAM type: NRG; PAM sequence: CAG
tttttgaattttttaaaaat

SEQ ID NO: 52812 - DNA, 20 bp, Artificial Sequence
  Description of Artificial Sequence: Synthetic oligonucleotide
  Target: SCN9A; (+) strand; PAM type: NRG; PAM sequence: AGG
ttttgaattttttaaaaatc

SEQ ID NO: 52813 - DNA, 20 bp, Artificial Sequence
  Description of Artificial Sequence: Synthetic oligonucleotide
  Target: SCN9A; (+) strand; PAM type: NRG; PAM sequence: AAG
aaatcaggcttctaatcgtt

SEQ ID NO: 52814 - DNA, 20 bp, Artificial Sequence
  Description of Artificial Sequence: Synthetic oligonucleotide
  Target: SCN9A; (+) strand; PAM type: NRG; PAM sequence: TAG
ggcttctaatcgttaagact

SEQ ID NO: 52815 - DNA, 20 bp, Artificial Sequence
  Description of Artificial Sequence: Synthetic oligonucleotide
  Target: SCN9A; (+) strand; PAM type: NRG; PAM sequence: TAG
ttctcttctttcttttttga

SEQ ID NO: 52816 - DNA, 20 bp, Artificial Sequence
  Description of Artificial Sequence: Synthetic oligonucleotide
  Target: SCN9A; (+) strand; PAM type: NRG; PAM sequence: CAG
tagtgtatttctgtgtcacc

SEQ ID NO: 52817 - DNA, 20 bp, Artificial Sequence
  Description of Artificial Sequence: Synthetic oligonucleotide
  Target: SCN9A; (+) strand; PAM type: NRG; PAM sequence: AGG
agtgtatttctgtgtcaccc

SEQ ID NO: 52818 - DNA, 20 bp, Artificial Sequence
  Description of Artificial Sequence: Synthetic oligonucleotide
  Target: SCN9A; (+) strand; PAM type: NRG; PAM sequence: TAG
tttctgtgtcacccaggctg

SEQ ID NO: 52819 - DNA, 20 bp, Artificial Sequence
  Description of Artificial Sequence: Synthetic oligonucleotide
  Target: SCN9A; (+) strand; PAM type: NRG; PAM sequence: CAG
gtgtcacccaggctgtagtg

SEQ ID NO: 52820 - DNA, 20 bp, Artificial Sequence
  Description of Artificial Sequence: Synthetic oligonucleotide
  Target: SCN9A; (+) strand; PAM type: NRG; PAM sequence: TAG
tcacccaggctgtagtgcag

SEQ ID NO: 52821 - DNA, 20 bp, Artificial Sequence
  Description of Artificial Sequence: Synthetic oligonucleotide
  Target: SCN9A; (+) strand; PAM type: NRG; PAM sequence: CAG
gtagtgcagtagtgcattga

SEQ ID NO: 52822 - DNA, 20 bp, Artificial Sequence
  Description of Artificial Sequence: Synthetic oligonucleotide
  Target: SCN9A; (+) strand; PAM type: NRG; PAM sequence: CAG
agtgcattgacagctcactg

SEQ ID NO: 52823 - DNA, 20 bp, Artificial Sequence
  Description of Artificial Sequence: Synthetic oligonucleotide
  Target: SCN9A; (+) strand; PAM type: NRG; PAM sequence: TGG
ctcactgcagcctccacctc

SEQ ID NO: 52824 - DNA, 20 bp, Artificial Sequence
  Description of Artificial Sequence: Synthetic oligonucleotide
  Target: SCN9A; (+) strand; PAM type: NRG; PAM sequence: GGG
tcactgcagcctccacctct

SEQ ID NO: 52825 - DNA, 20 bp, Artificial Sequence
  Description of Artificial Sequence: Synthetic oligonucleotide
  Target: SCN9A; (+) strand; PAM type: NRG; PAM sequence: AAG
agcctccacctctgggattc

SEQ ID NO: 52826 - DNA, 20 bp, Artificial Sequence
  Description of Artificial Sequence: Synthetic oligonucleotide
  Target: SCN9A; (+) strand; PAM type: NRG; PAM sequence: CAG
ttcaagtgaccctcccacct

SEQ ID NO: 52827 - DNA, 20 bp, Artificial Sequence
  Description of Artificial Sequence: Synthetic oligonucleotide
  Target: SCN9A; (+) strand; PAM type: NRG; PAM sequence: AAG
ccctcccacctcagcctctc

SEQ ID NO: 52828 - DNA, 20 bp, Artificial Sequence
  Description of Artificial Sequence: Synthetic oligonucleotide
  Target: SCN9A; (+) strand; PAM type: NRG; PAM sequence: TAG
tcccacctcagcctctcaag

SEQ ID NO: 52829 - DNA, 20 bp, Artificial Sequence
  Description of Artificial Sequence: Synthetic oligonucleotide
  Target: SCN9A; (+) strand; PAM type: NRG; PAM sequence: TAG
acctcagcctctcaagtagc

SEQ ID NO: 52830 - DNA, 20 bp, Artificial Sequence
  Description of Artificial Sequence: Synthetic oligonucleotide
  Target: SCN9A; (+) strand; PAM type: NRG; PAM sequence: AGG
cctcagcctctcaagtagct

SEQ ID NO: 52831 - DNA, 20 bp, Artificial Sequence
  Description of Artificial Sequence: Synthetic oligonucleotide
  Target: SCN9A; (+) strand; PAM type: NRG; PAM sequence: CAG
ctctcaagtagctaggactg

SEQ ID NO: 52832 - DNA, 20 bp, Artificial Sequence
  Description of Artificial Sequence: Synthetic oligonucleotide
  Target: SCN9A; (+) strand; PAM type: NRG; PAM sequence: AGG
tctcaagtagctaggactgc

SEQ ID NO: 52833 - DNA, 20 bp, Artificial Sequence
  Description of Artificial Sequence: Synthetic oligonucleotide
  Target: SCN9A; (+) strand; PAM type: NRG; PAM sequence: CAG
caagtagctaggactgcagg

SEQ ID NO: 52834 - DNA, 20 bp, Artificial Sequence
  Description of Artificial Sequence: Synthetic oligonucleotide
  Target: SCN9A; (+) strand; PAM type: NRG; PAM sequence: AGG
aagtagctaggactgcaggc

SEQ ID NO: 52835 - DNA, 20 bp, Artificial Sequence
  Description of Artificial Sequence: Synthetic oligonucleotide
  Target: SCN9A; (+) strand; PAM type: NRG; PAM sequence: CGG
caggcaggcgccacaacacc

SEQ ID NO: 52836 - DNA, 20 bp, Artificial Sequence
  Description of Artificial Sequence: Synthetic oligonucleotide
  Target: SCN9A; (+) strand; PAM type: NRG; PAM sequence: AAG
aggcgccacaacacccggct

SEQ ID NO: 52837 - DNA, 20 bp, Artificial Sequence
  Description of Artificial Sequence: Synthetic oligonucleotide
  Target: SCN9A; (+) strand; PAM type: NRG; PAM sequence: TAG
taagttttgtctatttttta

SEQ ID NO: 52838 - DNA, 20 bp, Artificial Sequence
  Description of Artificial Sequence: Synthetic oligonucleotide
  Target: SCN9A; (+) strand; PAM type: NRG; PAM sequence: TGG
ttgtctattttttatagaaa

SEQ ID NO: 52839 - DNA, 20 bp, Artificial Sequence
  Description of Artificial Sequence: Synthetic oligonucleotide
  Target: SCN9A; (+) strand; PAM type: NRG; PAM sequence: GGG
tgtctattttttatagaaat

SEQ ID NO: 52840 - DNA, 20 bp, Artificial Sequence
  Description of Artificial Sequence: Synthetic oligonucleotide
  Target: SCN9A; (+) strand; PAM type: NRG; PAM sequence: GGG
gtctattttttatagaaatg

SEQ ID NO: 52841 - DNA, 20 bp, Artificial Sequence
  Description of Artificial Sequence: Synthetic oligonucleotide
  Target: SCN9A; (+) strand; PAM type: NRG; PAM sequence: CGG
ggggtcttactatgttgccc

SEQ ID NO: 52842 - DNA, 20 bp, Artificial Sequence
  Description of Artificial Sequence: Synthetic oligonucleotide
  Target: SCN9A; (+) strand; PAM type: NRG; PAM sequence: TGG
tcttactatgttgccccggc

SEQ ID NO: 52843 - DNA, 20 bp, Artificial Sequence
  Description of Artificial Sequence: Synthetic oligonucleotide
  Target: SCN9A; (+) strand; PAM type: NRG; PAM sequence: TGG
cccggctggtcttgaactcc

SEQ ID NO: 52844 - DNA, 20 bp, Artificial Sequence
  Description of Artificial Sequence: Synthetic oligonucleotide
  Target: SCN9A; (+) strand; PAM type: NRG; PAM sequence: GGG
ccggctggtcttgaactcct

SEQ ID NO: 52845 - DNA, 20 bp, Artificial Sequence
  Description of Artificial Sequence: Synthetic oligonucleotide
  Target: SCN9A; (+) strand; PAM type: NRG; PAM sequence: AAG
ggtcttgaactcctgggctc

SEQ ID NO: 52846 - DNA, 20 bp, Artificial Sequence
  Description of Artificial Sequence: Synthetic oligonucleotide
  Target: SCN9A; (+) strand; PAM type: NRG; PAM sequence: CAG
ctcaagtgatccacccacct

SEQ ID NO: 52847 - DNA, 20 bp, Artificial Sequence
  Description of Artificial Sequence: Synthetic oligonucleotide
  Target: SCN9A; (+) strand; PAM type: NRG; PAM sequence: AAG
ccacccacctcagcctccca

SEQ ID NO: 52848 - DNA, 20 bp, Artificial Sequence
  Description of Artificial Sequence: Synthetic oligonucleotide
  Target: SCN9A; (+) strand; PAM type: NRG; PAM sequence: TGG
acctcagcctcccaaagtgc

SEQ ID NO: 52849 - DNA, 20 bp, Artificial Sequence
  Description of Artificial Sequence: Synthetic oligonucleotide
  Target: SCN9A; (+) strand; PAM type: NRG; PAM sequence: GGG
cctcagcctcccaaagtgct

SEQ ID NO: 52850 - DNA, 20 bp, Artificial Sequence
  Description of Artificial Sequence: Synthetic oligonucleotide
  Target: SCN9A; (+) strand; PAM type: NRG; PAM sequence: CAG
ctcccaaagtgctgggattg

SEQ ID NO: 52851 - DNA, 20 bp, Artificial Sequence
  Description of Artificial Sequence: Synthetic oligonucleotide
  Target: SCN9A; (+) strand; PAM type: NRG; PAM sequence: AGG
tcccaaagtgctgggattgc

SEQ ID NO: 52852 - DNA, 20 bp, Artificial Sequence
  Description of Artificial Sequence: Synthetic oligonucleotide
  Target: SCN9A; (+) strand; PAM type: NRG; PAM sequence: GAG
agtgctgggattgcaggcat

SEQ ID NO: 52853 - DNA, 20 bp, Artificial Sequence
  Description of Artificial Sequence: Synthetic oligonucleotide
  Target: SCN9A; (+) strand; PAM type: NRG; PAM sequence: TGG
caggcatgagccgtcctgcc

SEQ ID NO: 52854 - DNA, 20 bp, Artificial Sequence
  Description of Artificial Sequence: Synthetic oligonucleotide
  Target: SCN9A; (+) strand; PAM type: NRG; PAM sequence: AAG
agccgtcctgcctggctttg

SEQ ID NO: 52855 - DNA, 20 bp, Artificial Sequence
  Description of Artificial Sequence: Synthetic oligonucleotide
  Target: SCN9A; (+) strand; PAM type: NRG; PAM sequence: AAG
ttcatgtacaaatatatgcc

SEQ ID NO: 52856 - DNA, 20 bp, Artificial Sequence
  Description of Artificial Sequence: Synthetic oligonucleotide
  Target: SCN9A; (+) strand; PAM type: NRG; PAM sequence: TGG
acaaatatatgccaagaata

SEQ ID NO: 52857 - DNA, 20 bp, Artificial Sequence
  Description of Artificial Sequence: Synthetic oligonucleotide
  Target: SCN9A; (+) strand; PAM type: NRG; PAM sequence: TAG
aatatatgccaagaatatgg

SEQ ID NO: 52858 - DNA, 20 bp, Artificial Sequence
  Description of Artificial Sequence: Synthetic oligonucleotide
  Target: SCN9A; (+) strand; PAM type: NRG; PAM sequence: AAG
ttatgtgcattgatatacta

SEQ ID NO: 52859 - DNA, 20 bp, Artificial Sequence
  Description of Artificial Sequence: Synthetic oligonucleotide
  Target: SCN9A; (+) strand; PAM type: NRG; PAM sequence: AAG
atatactaaagtattttcta

SEQ ID NO: 52860 - DNA, 20 bp, Artificial Sequence
  Description of Artificial Sequence: Synthetic oligonucleotide
  Target: SCN9A; (+) strand; PAM type: NRG; PAM sequence: TGG
ttctaaagaactatttcctt

SEQ ID NO: 52861 - DNA, 20 bp, Artificial Sequence
  Description of Artificial Sequence: Synthetic oligonucleotide
  Target: SCN9A; (+) strand; PAM type: NRG; PAM sequence: TAG
cttaattgaccttacctttt

SEQ ID NO: 52862 - DNA, 20 bp, Artificial Sequence
  Description of Artificial Sequence: Synthetic oligonucleotide
  Target: SCN9A; (+) strand; PAM type: NRG; PAM sequence: AAG
aattgaccttacctttttag

SEQ ID NO: 52863 - DNA, 20 bp, Artificial Sequence
  Description of Artificial Sequence: Synthetic oligonucleotide
  Target: SCN9A; (+) strand; PAM type: NRG; PAM sequence: AAG
accttacctttttagaagaa

SEQ ID NO: 52864 - DNA, 20 bp, Artificial Sequence
  Description of Artificial Sequence: Synthetic oligonucleotide
  Target: SCN9A; (+) strand; PAM type: NRG; PAM sequence: TGG
ttagaagaaaagttgaaaac

SEQ ID NO: 52865 - DNA, 20 bp, Artificial Sequence
  Description of Artificial Sequence: Synthetic oligonucleotide
  Target: SCN9A; (+) strand; PAM type: NRG; PAM sequence: GGG
tagaagaaaagttgaaaact

SEQ ID NO: 52866 - DNA, 20 bp, Artificial Sequence
  Description of Artificial Sequence: Synthetic oligonucleotide
  Target: SCN9A; (+) strand; PAM type: NRG; PAM sequence: TGG
agaaaagttgaaaactgggc

SEQ ID NO: 52867 - DNA, 20 bp, Artificial Sequence
  Description of Artificial Sequence: Synthetic oligonucleotide
  Target: SCN9A; (+) strand; PAM type: NRG; PAM sequence: GGG
gaaaagttgaaaactgggct

SEQ ID NO: 52868 - DNA, 20 bp, Artificial Sequence
  Description of Artificial Sequence: Synthetic oligonucleotide
  Target: SCN9A; (+) strand; PAM type: NRG; PAM sequence: GGG
aaaagttgaaaactgggctg

SEQ ID NO: 52869 - DNA, 20 bp, Artificial Sequence
  Description of Artificial Sequence: Synthetic oligonucleotide
  Target: SCN9A; (+) strand; PAM type: NRG; PAM sequence: TGG
aaactgggctggggaacaaa

SEQ ID NO: 52870 - DNA, 20 bp, Artificial Sequence
  Description of Artificial Sequence: Synthetic oligonucleotide
  Target: SCN9A; (+) strand; PAM type: NRG; PAM sequence: AAG
ctggggaacaaatggaaaat

SEQ ID NO: 52871 - DNA, 20 bp, Artificial Sequence
  Description of Artificial Sequence: Synthetic oligonucleotide
  Target: SCN9A; (+) strand; PAM type: NRG; PAM sequence: TAG
tttaactatcatgtatgtaa

SEQ ID NO: 52872 - DNA, 20 bp, Artificial Sequence
  Description of Artificial Sequence: Synthetic oligonucleotide
  Target: SCN9A; (+) strand; PAM type: NRG; PAM sequence: GAG
taactatcatgtatgtaata

SEQ ID NO: 52873 - DNA, 20 bp, Artificial Sequence
  Description of Artificial Sequence: Synthetic oligonucleotide
  Target: SCN9A; (+) strand; PAM type: NRG; PAM sequence: AAG
gtaatagagtgacatttgtc

SEQ ID NO: 52874 - DNA, 20 bp, Artificial Sequence
  Description of Artificial Sequence: Synthetic oligonucleotide
  Target: SCN9A; (+) strand; PAM type: NRG; PAM sequence: TGG
agtgacatttgtcaagcaaa

SEQ ID NO: 52875 - DNA, 20 bp, Artificial Sequence
  Description of Artificial Sequence: Synthetic oligonucleotide
  Target: SCN9A; (+) strand; PAM type: NRG; PAM sequence: AAG
caaatggaaatttcacattc

SEQ ID NO: 52876 - DNA, 20 bp, Artificial Sequence
  Description of Artificial Sequence: Synthetic oligonucleotide
  Target: SCN9A; (+) strand; PAM type: NRG; PAM sequence: TAG
tttcacattcaagaataact

SEQ ID NO: 52877 - DNA, 20 bp, Artificial Sequence
  Description of Artificial Sequence: Synthetic oligonucleotide
  Target: SCN9A; (+) strand; PAM type: NRG; PAM sequence: TGG
gacatatctatataatgaca

SEQ ID NO: 52878 - DNA, 20 bp, Artificial Sequence
  Description of Artificial Sequence: Synthetic oligonucleotide
  Target: SCN9A; (+) strand; PAM type: NRG; PAM sequence: GAG
tatctatataatgacatggt

SEQ ID NO: 52879 - DNA, 20 bp, Artificial Sequence
  Description of Artificial Sequence: Synthetic oligonucleotide
  Target: SCN9A; (+) strand; PAM type: NRG; PAM sequence: TGG
aatgacatggtgagttacac

SEQ ID NO: 52880 - DNA, 20 bp, Artificial Sequence
  Description of Artificial Sequence: Synthetic oligonucleotide
  Target: SCN9A; (+) strand; PAM type: NRG; PAM sequence: CAG
acactggtttataattttca

SEQ ID NO: 52881 - DNA, 20 bp, Artificial Sequence
  Description of Artificial Sequence: Synthetic oligonucleotide
  Target: SCN9A; (+) strand; PAM type: NRG; PAM sequence: TAG
tttcacagctctttcacata

SEQ ID NO: 52882 - DNA, 20 bp, Artificial Sequence
  Description of Artificial Sequence: Synthetic oligonucleotide
  Target: SCN9A; (+) strand; PAM type: NRG; PAM sequence: AAG
gctctaaaatataaactgca

SEQ ID NO: 52883 - DNA, 20 bp, Artificial Sequence
  Description of Artificial Sequence: Synthetic oligonucleotide
  Target: SCN9A; (+) strand; PAM type: NRG; PAM sequence: AAG
tcctttcatttttcttacca

SEQ ID NO: 52884 - DNA, 20 bp, Artificial Sequence
  Description of Artificial Sequence: Synthetic oligonucleotide
  Target: SCN9A; (+) strand; PAM type: NRG; PAM sequence: AGG
cctttcatttttcttaccaa

SEQ ID NO: 52885 - DNA, 20 bp, Artificial Sequence
  Description of Artificial Sequence: Synthetic oligonucleotide
  Target: SCN9A; (+) strand; PAM type: NRG; PAM sequence: GAG
ttcttaccaaaggtgacatt

SEQ ID NO: 52886 - DNA, 20 bp, Artificial Sequence
  Description of Artificial Sequence: Synthetic oligonucleotide
  Target: SCN9A; (+) strand; PAM type: NRG; PAM sequence: AAG
aggtgacattgagatttaca

SEQ ID NO: 52887 - DNA, 20 bp, Artificial Sequence
  Description of Artificial Sequence: Synthetic oligonucleotide
  Target: SCN9A; (+) strand; PAM type: NRG; PAM sequence: TGG
acattgagatttacaaagtt

SEQ ID NO: 52888 - DNA, 20 bp, Artificial Sequence
  Description of Artificial Sequence: Synthetic oligonucleotide
  Target: SCN9A; (+) strand; PAM type: NRG; PAM sequence: AAG
aaagtttggtgcttgttacc

SEQ ID NO: 52889 - DNA, 20 bp, Artificial Sequence
  Description of Artificial Sequence: Synthetic oligonucleotide
  Target: SCN9A; (+) strand; PAM type: NRG; PAM sequence: AAG
cttgttaccaagtcatgttt

SEQ ID NO: 52890 - DNA, 20 bp, Artificial Sequence
  Description of Artificial Sequence: Synthetic oligonucleotide
  Target: SCN9A; (+) strand; PAM type: NRG; PAM sequence: AGG
ttgttaccaagtcatgttta

SEQ ID NO: 52891 - DNA, 20 bp, Artificial Sequence
  Description of Artificial Sequence: Synthetic oligonucleotide
  Target: SCN9A; (+) strand; PAM type: NRG; PAM sequence: AAG
tcatgtttaaggaaacattg

SEQ ID NO: 52892 - DNA, 20 bp, Artificial Sequence
  Description of Artificial Sequence: Synthetic oligonucleotide
  Target: SCN9A; (+) strand; PAM type: NRG; PAM sequence: CAG
ggaaacattgaagctatgac

SEQ ID NO: 52893 - DNA, 20 bp, Artificial Sequence
  Description of Artificial Sequence: Synthetic oligonucleotide
  Target: SCN9A; (+) strand; PAM type: NRG; PAM sequence: AAG
aacattgaagctatgaccag

SEQ ID NO: 52894 - DNA, 20 bp, Artificial Sequence
  Description of Artificial Sequence: Synthetic oligonucleotide
  Target: SCN9A; (+) strand; PAM type: NRG; PAM sequence: CAG
ttgaagctatgaccagaagt

SEQ ID NO: 52895 - DNA, 20 bp, Artificial Sequence
  Description of Artificial Sequence: Synthetic oligonucleotide
  Target: SCN9A; (+) strand; PAM type: NRG; PAM sequence: AGG
tgaagctatgaccagaagtc

SEQ ID NO: 52896 - DNA, 20 bp, Artificial Sequence
  Description of Artificial Sequence: Synthetic oligonucleotide
  Target: SCN9A; (+) strand; PAM type: NRG; PAM sequence: GAG
atgaccagaagtcaggcttt

SEQ ID NO: 52897 - DNA, 20 bp, Artificial Sequence
  Description of Artificial Sequence: Synthetic oligonucleotide
  Target: SCN9A; (+) strand; PAM type: NRG; PAM sequence: GAG
gaagtcaggctttgagcttt

SEQ ID NO: 52898 - DNA, 20 bp, Artificial Sequence
  Description of Artificial Sequence: Synthetic oligonucleotide
  Target: SCN9A; (+) strand; PAM type: NRG; PAM sequence: CAG
caggctttgagctttgagtt

SEQ ID NO: 52899 - DNA, 20 bp, Artificial Sequence
  Description of Artificial Sequence: Synthetic oligonucleotide
  Target: SCN9A; (+) strand; PAM type: NRG; PAM sequence: TGG
gctttgagctttgagttcag

SEQ ID NO: 52900 - DNA, 20 bp, Artificial Sequence
  Description of Artificial Sequence: Synthetic oligonucleotide
  Target: SCN9A; (+) strand; PAM type: NRG; PAM sequence: AAG
tctcccactttataccgtct

SEQ ID NO: 52901 - DNA, 20 bp, Artificial Sequence
  Description of Artificial Sequence: Synthetic oligonucleotide
  Target: SCN9A; (+) strand; PAM type: NRG; PAM sequence: AAG
cactttataccgtctaagaa

SEQ ID NO: 52902 - DNA, 20 bp, Artificial Sequence
  Description of Artificial Sequence: Synthetic oligonucleotide
  Target: SCN9A; (+) strand; PAM type: NRG; PAM sequence: TAG
tctaagaaaagttaatttga

SEQ ID NO: 52903 - DNA, 20 bp, Artificial Sequence
  Description of Artificial Sequence: Synthetic oligonucleotide
  Target: SCN9A; (+) strand; PAM type: NRG; PAM sequence: AAG
aagaaaagttaatttgatag

SEQ ID NO: 52904 - DNA, 20 bp, Artificial Sequence
  Description of Artificial Sequence: Synthetic oligonucleotide
  Target: SCN9A; (+) strand; PAM type: NRG; PAM sequence: AAG
aatttgatagaagacaatga

SEQ ID NO: 52905 - DNA, 20 bp, Artificial Sequence
  Description of Artificial Sequence: Synthetic oligonucleotide
  Target: SCN9A; (+) strand; PAM type: NRG; PAM sequence: TGG
atagaagacaatgaaagaat

SEQ ID NO: 52906 - DNA, 20 bp, Artificial Sequence
  Description of Artificial Sequence: Synthetic oligonucleotide
  Target: SCN9A; (+) strand; PAM type: NRG; PAM sequence: TAG
aatgaaagaattggcaacaa

SEQ ID NO: 52907 - DNA, 20 bp, Artificial Sequence
  Description of Artificial Sequence: Synthetic oligonucleotide
  Target: SCN9A; (+) strand; PAM type: NRG; PAM sequence: CAG
aattggcaacaatagacctg

SEQ ID NO: 52908 - DNA, 20 bp, Artificial Sequence
  Description of Artificial Sequence: Synthetic oligonucleotide
  Target: SCN9A; (+) strand; PAM type: NRG; PAM sequence: AAG
tagacctgcagatgttttaa

SEQ ID NO: 52909 - DNA, 20 bp, Artificial Sequence
  Description of Artificial Sequence: Synthetic oligonucleotide
  Target: SCN9A; (+) strand; PAM type: NRG; PAM sequence: AGG
agacctgcagatgttttaaa

SEQ ID NO: 52910 - DNA, 20 bp, Artificial Sequence
  Description of Artificial Sequence: Synthetic oligonucleotide
  Target: SCN9A; (+) strand; PAM type: NRG; PAM sequence: TAG
gcagatgttttaaaaggcac

SEQ ID NO: 52911 - DNA, 20 bp, Artificial Sequence
  Description of Artificial Sequence: Synthetic oligonucleotide
  Target: SCN9A; (+) strand; PAM type: NRG; PAM sequence: TAG
tgttttaaaaggcactagtt

SEQ ID NO: 52912 - DNA, 20 bp, Artificial Sequence
  Description of Artificial Sequence: Synthetic oligonucleotide
  Target: SCN9A; (+) strand; PAM type: NRG; PAM sequence: TGG
aatatgcctaaatatgtaca

SEQ ID NO: 52913 - DNA, 20 bp, Artificial Sequence
  Description of Artificial Sequence: Synthetic oligonucleotide
  Target: SCN9A; (+) strand; PAM type: NRG; PAM sequence: GGG
atatgcctaaatatgtacat

SEQ ID NO: 52914 - DNA, 20 bp, Artificial Sequence
  Description of Artificial Sequence: Synthetic oligonucleotide
  Target: SCN9A; (+) strand; PAM type: NRG; PAM sequence: AAG
atatgtacatgggtctcttt

SEQ ID NO: 52915 - DNA, 20 bp, Artificial Sequence
  Description of Artificial Sequence: Synthetic oligonucleotide
  Target: SCN9A; (+) strand; PAM type: NRG; PAM sequence: AAG
ggtctctttaagactccaca

SEQ ID NO: 52916 - DNA, 20 bp, Artificial Sequence
  Description of Artificial Sequence: Synthetic oligonucleotide
  Target: SCN9A; (+) strand; PAM type: NRG; PAM sequence: GAG
tctctttaagactccacaaa

SEQ ID NO: 52917 - DNA, 20 bp, Artificial Sequence
  Description of Artificial Sequence: Synthetic oligonucleotide
  Target: SCN9A; (+) strand; PAM type: NRG; PAM sequence: AAG
ctccacaaagagacactgct

SEQ ID NO: 52918 - DNA, 20 bp, Artificial Sequence
  Description of Artificial Sequence: Synthetic oligonucleotide
  Target: SCN9A; (+) strand; PAM type: NRG; PAM sequence: GAG
ccacaaagagacactgctaa

SEQ ID NO: 52919 - DNA, 20 bp, Artificial Sequence
  Description of Artificial Sequence: Synthetic oligonucleotide
  Target: SCN9A; (+) strand; PAM type: NRG; PAM sequence: TGG
gagacactgctaagagttac

SEQ ID NO: 52920 - DNA, 20 bp, Artificial Sequence
  Description of Artificial Sequence: Synthetic oligonucleotide
  Target: SCN9A; (+) strand; PAM type: NRG; PAM sequence: CAG
gagttactggaaacaaacta

SEQ ID NO: 52921 - DNA, 20 bp, Artificial Sequence
  Description of Artificial Sequence: Synthetic oligonucleotide
  Target: SCN9A; (+) strand; PAM type: NRG; PAM sequence: TAG
ctgctctgtgaataaattct

SEQ ID NO: 52922 - DNA, 20 bp, Artificial Sequence
  Description of Artificial Sequence: Synthetic oligonucleotide
  Target: SCN9A; (+) strand; PAM type: NRG; PAM sequence: CAG
gtgaataaattcttagttca

SEQ ID NO: 52923 - DNA, 20 bp, Artificial Sequence
  Description of Artificial Sequence: Synthetic oligonucleotide
  Target: SCN9A; (+) strand; PAM type: NRG; PAM sequence: TGG
ttcttagttcacagttgctg

SEQ ID NO: 52924 - DNA, 20 bp, Artificial Sequence
  Description of Artificial Sequence: Synthetic oligonucleotide
  Target: SCN9A; (+) strand; PAM type: NRG; PAM sequence: GGG
tcttagttcacagttgctgt

SEQ ID NO: 52925 - DNA, 20 bp, Artificial Sequence
  Description of Artificial Sequence: Synthetic oligonucleotide
  Target: SCN9A; (+) strand; PAM type: NRG; PAM sequence: AAG
gttgctgtgggaaaaaatga

SEQ ID NO: 52926 - DNA, 20 bp, Artificial Sequence
  Description of Artificial Sequence: Synthetic oligonucleotide
  Target: SCN9A; (+) strand; PAM type: NRG; PAM sequence: AAG
aaatgaaagatccaattaca

SEQ ID NO: 52927 - DNA, 20 bp, Artificial Sequence
  Description of Artificial Sequence: Synthetic oligonucleotide
  Target: SCN9A; (+) strand; PAM type: NRG; PAM sequence: TGG
aaagatccaattacaaagtc

SEQ ID NO: 52928 - DNA, 20 bp, Artificial Sequence
  Description of Artificial Sequence: Synthetic oligonucleotide
  Target: SCN9A; (+) strand; PAM type: NRG; PAM sequence: GGG
aagatccaattacaaagtct

SEQ ID NO: 52929 - DNA, 20 bp, Artificial Sequence
  Description of Artificial Sequence: Synthetic oligonucleotide
  Target: SCN9A; (+) strand; PAM type: NRG; PAM sequence: GAG
gatccaattacaaagtctgg

SEQ ID NO: 52930 - DNA, 20 bp, Artificial Sequence
  Description of Artificial Sequence: Synthetic oligonucleotide
  Target: SCN9A; (+) strand; PAM type: NRG; PAM sequence: TAG
tctgggagatttcctataat

SEQ ID NO: 52931 - DNA, 20 bp, Artificial Sequence
  Description of Artificial Sequence: Synthetic oligonucleotide
  Target: SCN9A; (+) strand; PAM type: NRG; PAM sequence: CAG
atattacttttgctatgaca

SEQ ID NO: 52932 - DNA, 20 bp, Artificial Sequence
  Description of Artificial Sequence: Synthetic oligonucleotide
  Target: SCN9A; (+) strand; PAM type: NRG; PAM sequence: CAG
acttttgctatgacacagta

SEQ ID NO: 52933 - DNA, 20 bp, Artificial Sequence
  Description of Artificial Sequence: Synthetic oligonucleotide
  Target: SCN9A; (+) strand; PAM type: NRG; PAM sequence: AAG
tttgctatgacacagtacag

SEQ ID NO: 52934 - DNA, 20 bp, Artificial Sequence
  Description of Artificial Sequence: Synthetic oligonucleotide
  Target: SCN9A; (+) strand; PAM type: NRG; PAM sequence: AAG
ctatgacacagtacagaaga

SEQ ID NO: 52935 - DNA, 20 bp, Artificial Sequence
  Description of Artificial Sequence: Synthetic oligonucleotide
  Target: SCN9A; (+) strand; PAM type: NRG; PAM sequence: AGG
tatgacacagtacagaagaa

SEQ ID NO: 52936 - DNA, 20 bp, Artificial Sequence
  Description of Artificial Sequence: Synthetic oligonucleotide
  Target: SCN9A; (+) strand; PAM type: NRG; PAM sequence: AAG
acagtacagaagaaaggaaa

SEQ ID NO: 52937 - DNA, 20 bp, Artificial Sequence
  Description of Artificial Sequence: Synthetic oligonucleotide
  Target: SCN9A; (+) strand; PAM type: NRG; PAM sequence: AGG
cagtacagaagaaaggaaaa

SEQ ID NO: 52938 - DNA, 20 bp, Artificial Sequence
  Description of Artificial Sequence: Synthetic oligonucleotide
  Target: SCN9A; (+) strand; PAM type: NRG; PAM sequence: AAG
tacagaagaaaggaaaaagg

SEQ ID NO: 52939 - DNA, 20 bp, Artificial Sequence
  Description of Artificial Sequence: Synthetic oligonucleotide
  Target: SCN9A; (+) strand; PAM type: NRG; PAM sequence: GAG
cagaagaaaggaaaaaggaa

SEQ ID NO: 52940 - DNA, 20 bp, Artificial Sequence
  Description of Artificial Sequence: Synthetic oligonucleotide
  Target: SCN9A; (+) strand; PAM type: NRG; PAM sequence: AGG
agaagaaaggaaaaaggaag

SEQ ID NO: 52941 - DNA, 20 bp, Artificial Sequence
  Description of Artificial Sequence: Synthetic oligonucleotide
  Target: SCN9A; (+) strand; PAM type: NRG; PAM sequence: CAG
cttaattgcttttttactaa

SEQ ID NO: 52942 - DNA, 20 bp, Artificial Sequence
  Description of Artificial Sequence: Synthetic oligonucleotide
  Target: SCN9A; (+) strand; PAM type: NRG; PAM sequence: AAG
ttactaacagcctgtgtctc

SEQ ID NO: 52943 - DNA, 20 bp, Artificial Sequence
  Description of Artificial Sequence: Synthetic oligonucleotide
  Target: SCN9A; (+) strand; PAM type: NRG; PAM sequence: AGG
tactaacagcctgtgtctca

SEQ ID NO: 52944 - DNA, 20 bp, Artificial Sequence
  Description of Artificial Sequence: Synthetic oligonucleotide
  Target: SCN9A; (+) strand; PAM type: NRG; PAM sequence: AAG
taacagcctgtgtctcaagg

SEQ ID NO: 52945 - DNA, 20 bp, Artificial Sequence
  Description of Artificial Sequence: Synthetic oligonucleotide
  Target: SCN9A; (+) strand; PAM type: NRG; PAM sequence: AAG
gcctgtgtctcaaggaagcc

SEQ ID NO: 52946 - DNA, 20 bp, Artificial Sequence
  Description of Artificial Sequence: Synthetic oligonucleotide
  Target: SCN9A; (+) strand; PAM type: NRG; PAM sequence: CAG
cattaatctgtcatttcatt

SEQ ID NO: 52947 - DNA, 20 bp, Artificial Sequence
  Description of Artificial Sequence: Synthetic oligonucleotide
  Target: SCN9A; (+) strand; PAM type: NRG; PAM sequence: AGG
attaatctgtcatttcattc

SEQ ID NO: 52948 - DNA, 20 bp, Artificial Sequence
  Description of Artificial Sequence: Synthetic oligonucleotide
  Target: SCN9A; (+) strand; PAM type: NRG; PAM sequence: AAG
tcatttcattcaggaaatac

SEQ ID NO: 52949 - DNA, 20 bp, Artificial Sequence
  Description of Artificial Sequence: Synthetic oligonucleotide
  Target: SCN9A; (+) strand; PAM type: NRG; PAM sequence: AAG
ttcattcaggaaatacaaga

SEQ ID NO: 52950 - DNA, 20 bp, Artificial Sequence
  Description of Artificial Sequence: Synthetic oligonucleotide
  Target: SCN9A; (+) strand; PAM type: NRG; PAM sequence: AGG
tcattcaggaaatacaagaa

SEQ ID NO: 52951 - DNA, 20 bp, Artificial Sequence
  Description of Artificial Sequence: Synthetic oligonucleotide
  Target: SCN9A; (+) strand; PAM type: NRG; PAM sequence: CGG
aggaaatacaagaaaggttt

SEQ ID NO: 52952 - DNA, 20 bp, Artificial Sequence
  Description of Artificial Sequence: Synthetic oligonucleotide
  Target: SCN9A; (+) strand; PAM type: NRG; PAM sequence: AAG
aaggtttcggttttaacctt

SEQ ID NO: 52953 - DNA, 20 bp, Artificial Sequence
  Description of Artificial Sequence: Synthetic oligonucleotide
  Target: SCN9A; (+) strand; PAM type: NRG; PAM sequence: TAG
ggttttaaccttaagaatac

SEQ ID NO: 52954 - DNA, 20 bp, Artificial Sequence
  Description of Artificial Sequence: Synthetic oligonucleotide
  Target: SCN9A; (+) strand; PAM type: NRG; PAM sequence: AGG
gttttaaccttaagaatact

SEQ ID NO: 52955 - DNA, 20 bp, Artificial Sequence
  Description of Artificial Sequence: Synthetic oligonucleotide
  Target: SCN9A; (+) strand; PAM type: NRG; PAM sequence: AAG
tctctcttatattgttttgt

SEQ ID NO: 52956 - DNA, 20 bp, Artificial Sequence
  Description of Artificial Sequence: Synthetic oligonucleotide
  Target: SCN9A; (+) strand; PAM type: NRG; PAM sequence: CAG
ttgttttgtaagcatacttg

SEQ ID NO: 52957 - DNA, 20 bp, Artificial Sequence
  Description of Artificial Sequence: Synthetic oligonucleotide
  Target: SCN9A; (+) strand; PAM type: NRG; PAM sequence: TAG
tgcagaataatgtcaataca

SEQ ID NO: 52958 - DNA, 20 bp, Artificial Sequence
  Description of Artificial Sequence: Synthetic oligonucleotide
  Target: SCN9A; (+) strand; PAM type: NRG; PAM sequence: AGG
gcagaataatgtcaatacat

SEQ ID NO: 52959 - DNA, 20 bp, Artificial Sequence
  Description of Artificial Sequence: Synthetic oligonucleotide
  Target: SCN9A; (+) strand; PAM type: NRG; PAM sequence: GGG
cagaataatgtcaatacata

SEQ ID NO: 52960 - DNA, 20 bp, Artificial Sequence
  Description of Artificial Sequence: Synthetic oligonucleotide
  Target: SCN9A; (+) strand; PAM type: NRG; PAM sequence: GAG
gaataatgtcaatacatagg

SEQ ID NO: 52961 - DNA, 20 bp, Artificial Sequence
  Description of Artificial Sequence: Synthetic oligonucleotide
  Target: SCN9A; (+) strand; PAM type: NRG; PAM sequence: AGG
aataatgtcaatacataggg

SEQ ID NO: 52962 - DNA, 20 bp, Artificial Sequence
  Description of Artificial Sequence: Synthetic oligonucleotide
  Target: SCN9A; (+) strand; PAM type: NRG; PAM sequence: GGG
ataatgtcaatacataggga

SEQ ID NO: 52963 - DNA, 20 bp, Artificial Sequence
  Description of Artificial Sequence: Synthetic oligonucleotide
  Target: SCN9A; (+) strand; PAM type: NRG; PAM sequence: CAG
tcaatacatagggagggttg

SEQ ID NO: 52964 - DNA, 20 bp, Artificial Sequence
  Description of Artificial Sequence: Synthetic oligonucleotide
  Target: SCN9A; (+) strand; PAM type: NRG; PAM sequence: TGG
gacttgtgtttctgcatgtg

SEQ ID NO: 52965 - DNA, 20 bp, Artificial Sequence
  Description of Artificial Sequence: Synthetic oligonucleotide
  Target: SCN9A; (+) strand; PAM type: NRG; PAM sequence: AAG
atgtatactatgttgttccc

SEQ ID NO: 52966 - DNA, 20 bp, Artificial Sequence
  Description of Artificial Sequence: Synthetic oligonucleotide
  Target: SCN9A; (+) strand; PAM type: NRG; PAM sequence: GAG
ttatattataccttatattt

SEQ ID NO: 52967 - DNA, 20 bp, Artificial Sequence
  Description of Artificial Sequence: Synthetic oligonucleotide
  Target: SCN9A; (+) strand; PAM type: NRG; PAM sequence: TAG
aaattatgatgccctataaa

SEQ ID NO: 52968 - DNA, 20 bp, Artificial Sequence
  Description of Artificial Sequence: Synthetic oligonucleotide
  Target: SCN9A; (+) strand; PAM type: NRG; PAM sequence: GAG
attatgatgccctataaata

SEQ ID NO: 52969 - DNA, 20 bp, Artificial Sequence
  Description of Artificial Sequence: Synthetic oligonucleotide
  Target: SCN9A; (+) strand; PAM type: NRG; PAM sequence: AAG
gatgccctataaatagagaa

SEQ ID NO: 52970 - DNA, 20 bp, Artificial Sequence
  Description of Artificial Sequence: Synthetic oligonucleotide
  Target: SCN9A; (+) strand; PAM type: NRG; PAM sequence: CAG
agaaaagcgcacaaacacat

SEQ ID NO: 52971 - DNA, 20 bp, Artificial Sequence
  Description of Artificial Sequence: Synthetic oligonucleotide
  Target: SCN9A; (+) strand; PAM type: NRG; PAM sequence: TAG
aacacatcagcacgtatgta

SEQ ID NO: 52972 - DNA, 20 bp, Artificial Sequence
  Description of Artificial Sequence: Synthetic oligonucleotide
  Target: SCN9A; (+) strand; PAM type: NRG; PAM sequence: TAG
gcatttactttaaaatcgtt

SEQ ID NO: 52973 - DNA, 20 bp, Artificial Sequence
  Description of Artificial Sequence: Synthetic oligonucleotide
  Target: SCN9A; (+) strand; PAM type: NRG; PAM sequence: TGG
ttaaaatcgtttagaatctt

SEQ ID NO: 52974 - DNA, 20 bp, Artificial Sequence
  Description of Artificial Sequence: Synthetic oligonucleotide
  Target: SCN9A; (+) strand; PAM type: NRG; PAM sequence: GGG
taaaatcgtttagaatcttt

SEQ ID NO: 52975 - DNA, 20 bp, Artificial Sequence
  Description of Artificial Sequence: Synthetic oligonucleotide
  Target: SCN9A; (+) strand; PAM type: NRG; PAM sequence: AAG
tagaatctttgggctattta

SEQ ID NO: 52976 - DNA, 20 bp, Artificial Sequence
  Description of Artificial Sequence: Synthetic oligonucleotide
  Target: SCN9A; (+) strand; PAM type: NRG; PAM sequence: CAG
aaaacacaaatgacttcaat

SEQ ID NO: 52977 - DNA, 20 bp, Artificial Sequence
  Description of Artificial Sequence: Synthetic oligonucleotide
  Target: SCN9A; (+) strand; PAM type: NRG; PAM sequence: TAG
caaatgacttcaatcagtaa

SEQ ID NO: 52978 - DNA, 20 bp, Artificial Sequence
  Description of Artificial Sequence: Synthetic oligonucleotide
  Target: SCN9A; (+) strand; PAM type: NRG; PAM sequence: TAG
aatcagtaatagaaccaatc

SEQ ID NO: 52979 - DNA, 20 bp, Artificial Sequence
  Description of Artificial Sequence: Synthetic oligonucleotide
  Target: SCN9A; (+) strand; PAM type: NRG; PAM sequence: TGG
tctagtcaatgaatgccata

SEQ ID NO: 52980 - DNA, 20 bp, Artificial Sequence
  Description of Artificial Sequence: Synthetic oligonucleotide
  Target: SCN9A; (+) strand; PAM type: NRG; PAM sequence: GAG
tagtcaatgaatgccatatg

SEQ ID NO: 52981 - DNA, 20 bp, Artificial Sequence
  Description of Artificial Sequence: Synthetic oligonucleotide
  Target: SCN9A; (+) strand; PAM type: NRG; PAM sequence: TGG
catatggagatgtccctgtt

SEQ ID NO: 52982 - DNA, 20 bp, Artificial Sequence
  Description of Artificial Sequence: Synthetic oligonucleotide
  Target: SCN9A; (+) strand; PAM type: NRG; PAM sequence: CAG
ttggtcactttttgacactg

SEQ ID NO: 52983 - DNA, 20 bp, Artificial Sequence
  Description of Artificial Sequence: Synthetic oligonucleotide
  Target: SCN9A; (+) strand; PAM type: NRG; PAM sequence: AGG
tggtcactttttgacactgc

SEQ ID NO: 52984 - DNA, 20 bp, Artificial Sequence
  Description of Artificial Sequence: Synthetic oligonucleotide
  Target: SCN9A; (+) strand; PAM type: NRG; PAM sequence: CAG
cactttttgacactgcaggc

SEQ ID NO: 52985 - DNA, 20 bp, Artificial Sequence
  Description of Artificial Sequence: Synthetic oligonucleotide
  Target: SCN9A; (+) strand; PAM type: NRG; PAM sequence: TGG
tgaccccttcaatgtgccaa

SEQ ID NO: 52986 - DNA, 20 bp, Artificial Sequence
  Description of Artificial Sequence: Synthetic oligonucleotide
  Target: SCN9A; (+) strand; PAM type: NRG; PAM sequence: CAG
gtgccaatggtcaactactg

SEQ ID NO: 52987 - DNA, 20 bp, Artificial Sequence
  Description of Artificial Sequence: Synthetic oligonucleotide
  Target: SCN9A; (+) strand; PAM type: NRG; PAM sequence: TAG
caatggtcaactactgcagt

SEQ ID NO: 52988 - DNA, 20 bp, Artificial Sequence
  Description of Artificial Sequence: Synthetic oligonucleotide
  Target: SCN9A; (+) strand; PAM type: NRG; PAM sequence: AAG
tagctttcctgcctttcctt

SEQ ID NO: 52989 - DNA, 20 bp, Artificial Sequence
  Description of Artificial Sequence: Synthetic oligonucleotide
  Target: SCN9A; (+) strand; PAM type: NRG; PAM sequence: AGG
agctttcctgcctttcctta

SEQ ID NO: 52990 - DNA, 20 bp, Artificial Sequence
  Description of Artificial Sequence: Synthetic oligonucleotide
  Target: SCN9A; (+) strand; PAM type: NRG; PAM sequence: TAG
ccttaaggtgataatatcta

SEQ ID NO: 52991 - DNA, 20 bp, Artificial Sequence
  Description of Artificial Sequence: Synthetic oligonucleotide
  Target: SCN9A; (+) strand; PAM type: NRG; PAM sequence: AGG
cttaaggtgataatatctat

SEQ ID NO: 52992 - DNA, 20 bp, Artificial Sequence
  Description of Artificial Sequence: Synthetic oligonucleotide
  Target: SCN9A; (+) strand; PAM type: NRG; PAM sequence: AAG
gtgataatatctataggacc

SEQ ID NO: 52993 - DNA, 20 bp, Artificial Sequence
  Description of Artificial Sequence: Synthetic oligonucleotide
  Target: SCN9A; (+) strand; PAM type: NRG; PAM sequence: AAG
agttttccatccttataatt

SEQ ID NO: 52994 - DNA, 20 bp, Artificial Sequence
  Description of Artificial Sequence: Synthetic oligonucleotide
  Target: SCN9A; (+) strand; PAM type: NRG; PAM sequence: TGG
attaagtgttacaaacatta

SEQ ID NO: 52995 - DNA, 20 bp, Artificial Sequence
  Description of Artificial Sequence: Synthetic oligonucleotide
  Target: SCN9A; (+) strand; PAM type: NRG; PAM sequence: TAG
aaacattatggctttaatta

SEQ ID NO: 52996 - DNA, 20 bp, Artificial Sequence
  Description of Artificial Sequence: Synthetic oligonucleotide
  Target: SCN9A; (+) strand; PAM type: NRG; PAM sequence: TGG
ttatggctttaattatagtg

SEQ ID NO: 52997 - DNA, 20 bp, Artificial Sequence
  Description of Artificial Sequence: Synthetic oligonucleotide
  Target: SCN9A; (+) strand; PAM type: NRG; PAM sequence: AAG
gtggcttaaactgtttttta

SEQ ID NO: 52998 - DNA, 20 bp, Artificial Sequence
  Description of Artificial Sequence: Synthetic oligonucleotide
  Target: SCN9A; (+) strand; PAM type: NRG; PAM sequence: TAG
ttttttaaagattaaaccat

SEQ ID NO: 52999 - DNA, 20 bp, Artificial Sequence
  Description of Artificial Sequence: Synthetic oligonucleotide
  Target: SCN9A; (+) strand; PAM type: NRG; PAM sequence: GAG
ttttaaagattaaaccatta

SEQ ID NO: 53000 - DNA, 20 bp, Artificial Sequence
  Description of Artificial Sequence: Synthetic oligonucleotide
  Target: SCN9A; (+) strand; PAM type: NRG; PAM sequence: CAG
aaagattaaaccattagagt

SEQ ID NO: 53001 - DNA, 20 bp, Artificial Sequence
  Description of Artificial Sequence: Synthetic oligonucleotide
  Target: SCN9A; (+) strand; PAM type: NRG; PAM sequence: GAG
agattaaaccattagagtca

SEQ ID NO: 53002 - DNA, 20 bp, Artificial Sequence
  Description of Artificial Sequence: Synthetic oligonucleotide
  Target: SCN9A; (+) strand; PAM type: NRG; PAM sequence: TAG
aaaattttctacctcacgtt

SEQ ID NO: 53003 - DNA, 20 bp, Artificial Sequence
  Description of Artificial Sequence: Synthetic oligonucleotide
  Target: SCN9A; (+) strand; PAM type: NRG; PAM sequence: TAG
tttctacctcacgtttagaa

SEQ ID NO: 53004 - DNA, 20 bp, Artificial Sequence
  Description of Artificial Sequence: Synthetic oligonucleotide
  Target: SCN9A; (+) strand; PAM type: NRG; PAM sequence: GAG
tctacctcacgtttagaata

SEQ ID NO: 53005 - DNA, 20 bp, Artificial Sequence
  Description of Artificial Sequence: Synthetic oligonucleotide
  Target: SCN9A; (+) strand; PAM type: NRG; PAM sequence: CAG
tttttgatcatcacccttac

SEQ ID NO: 53006 - DNA, 20 bp, Artificial Sequence
  Description of Artificial Sequence: Synthetic oligonucleotide
  Target: SCN9A; (+) strand; PAM type: NRG; PAM sequence: TAG
cacccttaccagctcaataa

SEQ ID NO: 53007 - DNA, 20 bp, Artificial Sequence
  Description of Artificial Sequence: Synthetic oligonucleotide
  Target: SCN9A; (+) strand; PAM type: NRG; PAM sequence: AAG
agcaataccaataataataa

SEQ ID NO: 53008 - DNA, 20 bp, Artificial Sequence
  Description of Artificial Sequence: Synthetic oligonucleotide
  Target: SCN9A; (+) strand; PAM type: NRG; PAM sequence: CAG
ttataaacaatctacacatg

SEQ ID NO: 53009 - DNA, 20 bp, Artificial Sequence
  Description of Artificial Sequence: Synthetic oligonucleotide
  Target: SCN9A; (+) strand; PAM type: NRG; PAM sequence: AAG
gaataaaattgaaactttta

SEQ ID NO: 53010 - DNA, 20 bp, Artificial Sequence
  Description of Artificial Sequence: Synthetic oligonucleotide
  Target: SCN9A; (+) strand; PAM type: NRG; PAM sequence: AAG
aaattgaaacttttaaagat

SEQ ID NO: 53011 - DNA, 20 bp, Artificial Sequence
  Description of Artificial Sequence: Synthetic oligonucleotide
  Target: SCN9A; (+) strand; PAM type: NRG; PAM sequence: AAG
aacttttaaagataagaatg

SEQ ID NO: 53012 - DNA, 20 bp, Artificial Sequence
  Description of Artificial Sequence: Synthetic oligonucleotide
  Target: SCN9A; (+) strand; PAM type: NRG; PAM sequence: AAG
taaagataagaatgaagaca

SEQ ID NO: 53013 - DNA, 20 bp, Artificial Sequence
  Description of Artificial Sequence: Synthetic oligonucleotide
  Target: SCN9A; (+) strand; PAM type: NRG; PAM sequence: CAG
gaatgaagacaaagctcttc

SEQ ID NO: 53014 - DNA, 20 bp, Artificial Sequence
  Description of Artificial Sequence: Synthetic oligonucleotide
  Target: SCN9A; (+) strand; PAM type: NRG; PAM sequence: TAG
agctcttccagcattgttct

SEQ ID NO: 53015 - DNA, 20 bp, Artificial Sequence
  Description of Artificial Sequence: Synthetic oligonucleotide
  Target: SCN9A; (+) strand; PAM type: NRG; PAM sequence: AGG
gctcttccagcattgttctt

SEQ ID NO: 53016 - DNA, 20 bp, Artificial Sequence
  Description of Artificial Sequence: Synthetic oligonucleotide
  Target: SCN9A; (+) strand; PAM type: NRG; PAM sequence: TGG
taggtgtgcatattcaactt

SEQ ID NO: 53017 - DNA, 20 bp, Artificial Sequence
  Description of Artificial Sequence: Synthetic oligonucleotide
  Target: SCN9A; (+) strand; PAM type: NRG; PAM sequence: CAG
atattcaactttggaaacca

SEQ ID NO: 53018 - DNA, 20 bp, Artificial Sequence
  Description of Artificial Sequence: Synthetic oligonucleotide
  Target: SCN9A; (+) strand; PAM type: NRG; PAM sequence: AAG
tttgcatacatccaccacca

SEQ ID NO: 53019 - DNA, 20 bp, Artificial Sequence
  Description of Artificial Sequence: Synthetic oligonucleotide
  Target: SCN9A; (+) strand; PAM type: NRG; PAM sequence: TGG
atccaccaccaaagcttccc

SEQ ID NO: 53020 - DNA, 20 bp, Artificial Sequence
  Description of Artificial Sequence: Synthetic oligonucleotide
  Target: SCN9A; (+) strand; PAM type: NRG; PAM sequence: GAG
ccaccaccaaagcttccctg

SEQ ID NO: 53021 - DNA, 20 bp, Artificial Sequence
  Description of Artificial Sequence: Synthetic oligonucleotide
  Target: SCN9A; (+) strand; PAM type: NRG; PAM sequence: CAG
caaagcttccctggagaact

SEQ ID NO: 53022 - DNA, 20 bp, Artificial Sequence
  Description of Artificial Sequence: Synthetic oligonucleotide
  Target: SCN9A; (+) strand; PAM type: NRG; PAM sequence: AGG
aaagcttccctggagaactc

SEQ ID NO: 53023 - DNA, 20 bp, Artificial Sequence
  Description of Artificial Sequence: Synthetic oligonucleotide
  Target: SCN9A; (+) strand; PAM type: NRG; PAM sequence: TAG
tcatgctgcaaaaacgtttt

SEQ ID NO: 53024 - DNA, 20 bp, Artificial Sequence
  Description of Artificial Sequence: Synthetic oligonucleotide
  Target: SCN9A; (+) strand; PAM type: NRG; PAM sequence: TAG
gcaaaaacgtttttagcaca

SEQ ID NO: 53025 - DNA, 20 bp, Artificial Sequence
  Description of Artificial Sequence: Synthetic oligonucleotide
  Target: SCN9A; (+) strand; PAM type: NRG; PAM sequence: GAG
aaaaacgtttttagcacata

SEQ ID NO: 53026 - DNA, 20 bp, Artificial Sequence
  Description of Artificial Sequence: Synthetic oligonucleotide
  Target: SCN9A; (+) strand; PAM type: NRG; PAM sequence: GAG
tttagcacatagagtgcatt

SEQ ID NO: 53027 - DNA, 20 bp, Artificial Sequence
  Description of Artificial Sequence: Synthetic oligonucleotide
  Target: SCN9A; (+) strand; PAM type: NRG; PAM sequence: TAG
agtgcattgagttttaaaac

SEQ ID NO: 53028 - DNA, 20 bp, Artificial Sequence
  Description of Artificial Sequence: Synthetic oligonucleotide
  Target: SCN9A; (+) strand; PAM type: NRG; PAM sequence: CAG
aactagcattctttcaacat

SEQ ID NO: 53029 - DNA, 20 bp, Artificial Sequence
  Description of Artificial Sequence: Synthetic oligonucleotide
  Target: SCN9A; (+) strand; PAM type: NRG; PAM sequence: TAG
tctcttgcataacatctttc

SEQ ID NO: 53030 - DNA, 20 bp, Artificial Sequence
  Description of Artificial Sequence: Synthetic oligonucleotide
  Target: SCN9A; (+) strand; PAM type: NRG; PAM sequence: GAG
tcttgcataacatctttcta

SEQ ID NO: 53031 - DNA, 20 bp, Artificial Sequence
  Description of Artificial Sequence: Synthetic oligonucleotide
  Target: SCN9A; (+) strand; PAM type: NRG; PAM sequence: TAG
gtaaaattaactaaataatg

SEQ ID NO: 53032 - DNA, 20 bp, Artificial Sequence
  Description of Artificial Sequence: Synthetic oligonucleotide
  Target: SCN9A; (+) strand; PAM type: NRG; PAM sequence: CAG
attaactaaataatgtagtg

SEQ ID NO: 53033 - DNA, 20 bp, Artificial Sequence
  Description of Artificial Sequence: Synthetic oligonucleotide
  Target: SCN9A; (+) strand; PAM type: NRG; PAM sequence: AGG
ttaactaaataatgtagtgc

SEQ ID NO: 53034 - DNA, 20 bp, Artificial Sequence
  Description of Artificial Sequence: Synthetic oligonucleotide
  Target: SCN9A; (+) strand; PAM type: NRG; PAM sequence: AAG
aataatgtagtgcaggtaaa

SEQ ID NO: 53035 - DNA, 20 bp, Artificial Sequence
  Description of Artificial Sequence: Synthetic oligonucleotide
  Target: SCN9A; (+) strand; PAM type: NRG; PAM sequence: TGG
aataattacactaattttct

SEQ ID NO: 53036 - DNA, 20 bp, Artificial Sequence
  Description of Artificial Sequence: Synthetic oligonucleotide
  Target: SCN9A; (+) strand; PAM type: NRG; PAM sequence: GAG
attacactaattttcttggt

SEQ ID NO: 53037 - DNA, 20 bp, Artificial Sequence
  Description of Artificial Sequence: Synthetic oligonucleotide
  Target: SCN9A; (+) strand; PAM type: NRG; PAM sequence: AGG
ttacactaattttcttggtg

SEQ ID NO: 53038 - DNA, 20 bp, Artificial Sequence
  Description of Artificial Sequence: Synthetic oligonucleotide
  Target: SCN9A; (+) strand; PAM type: NRG; PAM sequence: AAG
ttttcttggtgaggtgaaaa

SEQ ID NO: 53039 - DNA, 20 bp, Artificial Sequence
  Description of Artificial Sequence: Synthetic oligonucleotide
  Target: SCN9A; (+) strand; PAM type: NRG; PAM sequence: GAG
ttcttggtgaggtgaaaaaa

SEQ ID NO: 53040 - DNA, 20 bp, Artificial Sequence
  Description of Artificial Sequence: Synthetic oligonucleotide
  Target: SCN9A; (+) strand; PAM type: NRG; PAM sequence: TAG
catatactttgcttgtttta

SEQ ID NO: 53041 - DNA, 20 bp, Artificial Sequence
  Description of Artificial Sequence: Synthetic oligonucleotide
  Target: SCN9A; (+) strand; PAM type: NRG; PAM sequence: AGG
atatactttgcttgttttat

SEQ ID NO: 53042 - DNA, 20 bp, Artificial Sequence
  Description of Artificial Sequence: Synthetic oligonucleotide
  Target: SCN9A; (+) strand; PAM type: NRG; PAM sequence: TAG
gttttataggaaaaaaatta

SEQ ID NO: 53043 - DNA, 20 bp, Artificial Sequence
  Description of Artificial Sequence: Synthetic oligonucleotide
  Target: SCN9A; (+) strand; PAM type: NRG; PAM sequence: TAG
tagatttgtgataacctatt

SEQ ID NO: 53044 - DNA, 20 bp, Artificial Sequence
  Description of Artificial Sequence: Synthetic oligonucleotide
  Target: SCN9A; (+) strand; PAM type: NRG; PAM sequence: AAG
aatcaatgttttatttcaaa

SEQ ID NO: 53045 - DNA, 20 bp, Artificial Sequence
  Description of Artificial Sequence: Synthetic oligonucleotide
  Target: SCN9A; (+) strand; PAM type: NRG; PAM sequence: CAG
gttttatttcaaaaagaaaa

SEQ ID NO: 53046 - DNA, 20 bp, Artificial Sequence
  Description of Artificial Sequence: Synthetic oligonucleotide
  Target: SCN9A; (+) strand; PAM type: NRG; PAM sequence: AAG
ttatttcaaaaagaaaacag

SEQ ID NO: 53047 - DNA, 20 bp, Artificial Sequence
  Description of Artificial Sequence: Synthetic oligonucleotide
  Target: SCN9A; (+) strand; PAM type: NRG; PAM sequence: AAG
tcaaaaagaaaacagaagta

SEQ ID NO: 53048 - DNA, 20 bp, Artificial Sequence
  Description of Artificial Sequence: Synthetic oligonucleotide
  Target: SCN9A; (+) strand; PAM type: NRG; PAM sequence: AGG
caaaaagaaaacagaagtaa

SEQ ID NO: 53049 - DNA, 20 bp, Artificial Sequence
  Description of Artificial Sequence: Synthetic oligonucleotide
  Target: SCN9A; (+) strand; PAM type: NRG; PAM sequence: AAG
gcttcacatataaaaaccca

SEQ ID NO: 53050 - DNA, 20 bp, Artificial Sequence
  Description of Artificial Sequence: Synthetic oligonucleotide
  Target: SCN9A; (+) strand; PAM type: NRG; PAM sequence: TAG
atataaaaacccaaagcttt

SEQ ID NO: 53051 - DNA, 20 bp, Artificial Sequence
  Description of Artificial Sequence: Synthetic oligonucleotide
  Target: SCN9A; (+) strand; PAM type: NRG; PAM sequence: AGG
tataaaaacccaaagctttt

SEQ ID NO: 53052 - DNA, 20 bp, Artificial Sequence
  Description of Artificial Sequence: Synthetic oligonucleotide
  Target: SCN9A; (+) strand; PAM type: NRG; PAM sequence: GAG
taaaaacccaaagcttttag

SEQ ID NO: 53053 - DNA, 20 bp, Artificial Sequence
  Description of Artificial Sequence: Synthetic oligonucleotide
  Target: SCN9A; (+) strand; PAM type: NRG; PAM sequence: TAG
ttacatatgttgatatttta

SEQ ID NO: 53054 - DNA, 20 bp, Artificial Sequence
  Description of Artificial Sequence: Synthetic oligonucleotide
  Target: SCN9A; (+) strand; PAM type: NRG; PAM sequence: TAG
atgttgatattttatagaac

SEQ ID NO: 53055 - DNA, 20 bp, Artificial Sequence
  Description of Artificial Sequence: Synthetic oligonucleotide
  Target: SCN9A; (+) strand; PAM type: NRG; PAM sequence: AGG
tgttgatattttatagaact

SEQ ID NO: 53056 - DNA, 20 bp, Artificial Sequence
  Description of Artificial Sequence: Synthetic oligonucleotide
  Target: SCN9A; (+) strand; PAM type: NRG; PAM sequence: TAG
gaatgcttgtattttcaaaa

SEQ ID NO: 53057 - DNA, 20 bp, Artificial Sequence
  Description of Artificial Sequence: Synthetic oligonucleotide
  Target: SCN9A; (+) strand; PAM type: NRG; PAM sequence: AAG
tgcttgtattttcaaaatag

SEQ ID NO: 53058 - DNA, 20 bp, Artificial Sequence
  Description of Artificial Sequence: Synthetic oligonucleotide
  Target: SCN9A; (+) strand; PAM type: NRG; PAM sequence: TAG
ttttgattgatacaaaatac

SEQ ID NO: 53059 - DNA, 20 bp, Artificial Sequence
  Description of Artificial Sequence: Synthetic oligonucleotide
  Target: SCN9A; (+) strand; PAM type: NRG; PAM sequence: TGG
aaaatactagattacttttc

SEQ ID NO: 53060 - DNA, 20 bp, Artificial Sequence
  Description of Artificial Sequence: Synthetic oligonucleotide
  Target: SCN9A; (+) strand; PAM type: NRG; PAM sequence: GGG
aaatactagattacttttct

SEQ ID NO: 53061 - DNA, 20 bp, Artificial Sequence
  Description of Artificial Sequence: Synthetic oligonucleotide
  Target: SCN9A; (+) strand; PAM type: NRG; PAM sequence: AAG
tagattacttttctgggaaa

SEQ ID NO: 53062 - DNA, 20 bp, Artificial Sequence
  Description of Artificial Sequence: Synthetic oligonucleotide
  Target: SCN9A; (+) strand; PAM type: NRG; PAM sequence: AAG
taaaatatttattttatttc

SEQ ID NO: 53063 - DNA, 20 bp, Artificial Sequence
  Description of Artificial Sequence: Synthetic oligonucleotide
  Target: SCN9A; (+) strand; PAM type: NRG; PAM sequence: GAG
aaatatttattttatttcaa

SEQ ID NO: 53064 - DNA, 20 bp, Artificial Sequence
  Description of Artificial Sequence: Synthetic oligonucleotide
  Target: SCN9A; (+) strand; PAM type: NRG; PAM sequence: AAG
tgattctatacatcatctca

SEQ ID NO: 53065 - DNA, 20 bp, Artificial Sequence
  Description of Artificial Sequence: Synthetic oligonucleotide
  Target: SCN9A; (+) strand; PAM type: NRG; PAM sequence: AAG
ctatacatcatctcaaagtc

SEQ ID NO: 53066 - DNA, 20 bp, Artificial Sequence
  Description of Artificial Sequence: Synthetic oligonucleotide
  Target: SCN9A; (+) strand; PAM type: NRG; PAM sequence: AAG
acatcatctcaaagtcaagc

SEQ ID NO: 53067 - DNA, 20 bp, Artificial Sequence
  Description of Artificial Sequence: Synthetic oligonucleotide
  Target: SCN9A; (+) strand; PAM type: NRG; PAM sequence: GAG
atcatctcaaagtcaagcaa

SEQ ID NO: 53068 - DNA, 20 bp, Artificial Sequence
  Description of Artificial Sequence: Synthetic oligonucleotide
  Target: SCN9A; (+) strand; PAM type: NRG; PAM sequence: AGG
tcatctcaaagtcaagcaag

SEQ ID NO: 53069 - DNA, 20 bp, Artificial Sequence
  Description of Artificial Sequence: Synthetic oligonucleotide
  Target: SCN9A; (+) strand; PAM type: NRG; PAM sequence: GGG
catctcaaagtcaagcaaga

SEQ ID NO: 53070 - DNA, 20 bp, Artificial Sequence
  Description of Artificial Sequence: Synthetic oligonucleotide
  Target: SCN9A; (+) strand; PAM type: NRG; PAM sequence: TGG
gtcaagcaagagggaacctt

SEQ ID NO: 53071 - DNA, 20 bp, Artificial Sequence
  Description of Artificial Sequence: Synthetic oligonucleotide
  Target: SCN9A; (+) strand; PAM type: NRG; PAM sequence: GAG
caagagggaacctttggttt

SEQ ID NO: 53072 - DNA, 20 bp, Artificial Sequence
  Description of Artificial Sequence: Synthetic oligonucleotide
  Target: SCN9A; (+) strand; PAM type: NRG; PAM sequence: AGG
aagagggaacctttggtttg

SEQ ID NO: 53073 - DNA, 20 bp, Artificial Sequence
  Description of Artificial Sequence: Synthetic oligonucleotide
  Target: SCN9A; (+) strand; PAM type: NRG; PAM sequence: TAG
aacctttggtttgaggacta

SEQ ID NO: 53074 - DNA, 20 bp, Artificial Sequence
  Description of Artificial Sequence: Synthetic oligonucleotide
  Target: SCN9A; (+) strand; PAM type: NRG; PAM sequence: AGG
acctttggtttgaggactat

SEQ ID NO: 53075 - DNA, 20 bp, Artificial Sequence
  Description of Artificial Sequence: Synthetic oligonucleotide
  Target: SCN9A; (+) strand; PAM type: NRG; PAM sequence: TGG
ttggtttgaggactatagga

SEQ ID NO: 53076 - DNA, 20 bp, Artificial Sequence
  Description of Artificial Sequence: Synthetic oligonucleotide
  Target: SCN9A; (+) strand; PAM type: NRG; PAM sequence: AAG
gaggactataggatggtatt

SEQ ID NO: 53077 - DNA, 20 bp, Artificial Sequence
  Description of Artificial Sequence: Synthetic oligonucleotide
  Target: SCN9A; (+) strand; PAM type: NRG; PAM sequence: GAG
aggatggtattaagaactat

SEQ ID NO: 53078 - DNA, 20 bp, Artificial Sequence
  Description of Artificial Sequence: Synthetic oligonucleotide
  Target: SCN9A; (+) strand; PAM type: NRG; PAM sequence: AAG
tggtattaagaactatgaga

SEQ ID NO: 53079 - DNA, 20 bp, Artificial Sequence
  Description of Artificial Sequence: Synthetic oligonucleotide
  Target: SCN9A; (+) strand; PAM type: NRG; PAM sequence: CAG
aaagaacctgatttgaattg

SEQ ID NO: 53080 - DNA, 20 bp, Artificial Sequence
  Description of Artificial Sequence: Synthetic oligonucleotide
  Target: SCN9A; (+) strand; PAM type: NRG; PAM sequence: CGG
gtctttacttctctaaacca

SEQ ID NO: 53081 - DNA, 20 bp, Artificial Sequence
  Description of Artificial Sequence: Synthetic oligonucleotide
  Target: SCN9A; (+) strand; PAM type: NRG; PAM sequence: AAG
ccacggtttcctcattgaaa

SEQ ID NO: 53082 - DNA, 20 bp, Artificial Sequence
  Description of Artificial Sequence: Synthetic oligonucleotide
  Target: SCN9A; (+) strand; PAM type: NRG; PAM sequence: TGG
cggtttcctcattgaaaaag

SEQ ID NO: 53083 - DNA, 20 bp, Artificial Sequence
  Description of Artificial Sequence: Synthetic oligonucleotide
  Target: SCN9A; (+) strand; PAM type: NRG; PAM sequence: AAG
tttcctcattgaaaaagtgg

SEQ ID NO: 53084 - DNA, 20 bp, Artificial Sequence
  Description of Artificial Sequence: Synthetic oligonucleotide
  Target: SCN9A; (+) strand; PAM type: NRG; PAM sequence: AGG
ttcctcattgaaaaagtgga

SEQ ID NO: 53085 - DNA, 20 bp, Artificial Sequence
  Description of Artificial Sequence: Synthetic oligonucleotide
  Target: SCN9A; (+) strand; PAM type: NRG; PAM sequence: CAG
tcattgaaaaagtggaaggc

SEQ ID NO: 53086 - DNA, 20 bp, Artificial Sequence
  Description of Artificial Sequence: Synthetic oligonucleotide
  Target: SCN9A; (+) strand; PAM type: NRG; PAM sequence: AGG
cattgaaaaagtggaaggcc

SEQ ID NO: 53087 - DNA, 20 bp, Artificial Sequence
  Description of Artificial Sequence: Synthetic oligonucleotide
  Target: SCN9A; (+) strand; PAM type: NRG; PAM sequence: TGG
aagtggaaggccaggtgtga

SEQ ID NO: 53088 - DNA, 20 bp, Artificial Sequence
  Description of Artificial Sequence: Synthetic oligonucleotide
  Target: SCN9A; (+) strand; PAM type: NRG; PAM sequence: CAG
atggctcatgcctataatcc

SEQ ID NO: 53089 - DNA, 20 bp, Artificial Sequence
  Description of Artificial Sequence: Synthetic oligonucleotide
  Target: SCN9A; (+) strand; PAM type: NRG; PAM sequence: TGG
tgcctataatcccagcactt

SEQ ID NO: 53090 - DNA, 20 bp, Artificial Sequence
  Description of Artificial Sequence: Synthetic oligonucleotide
  Target: SCN9A; (+) strand; PAM type: NRG; PAM sequence: GGG
gcctataatcccagcacttt

SEQ ID NO: 53091 - DNA, 20 bp, Artificial Sequence
  Description of Artificial Sequence: Synthetic oligonucleotide
  Target: SCN9A; (+) strand; PAM type: NRG; PAM sequence: GAG
ctataatcccagcactttgg

SEQ ID NO: 53092 - DNA, 20 bp, Artificial Sequence
  Description of Artificial Sequence: Synthetic oligonucleotide
  Target: SCN9A; (+) strand; PAM type: NRG; PAM sequence: AGG
tataatcccagcactttggg

SEQ ID NO: 53093 - DNA, 20 bp, Artificial Sequence
  Description of Artificial Sequence: Synthetic oligonucleotide
  Target: SCN9A; (+) strand; PAM type: NRG; PAM sequence: GAG
tcccagcactttgggaggcc

SEQ ID NO: 53094 - DNA, 20 bp, Artificial Sequence
  Description of Artificial Sequence: Synthetic oligonucleotide
  Target: SCN9A; (+) strand; PAM type: NRG; PAM sequence: AGG
cccagcactttgggaggccg

SEQ ID NO: 53095 - DNA, 20 bp, Artificial Sequence
  Description of Artificial Sequence: Synthetic oligonucleotide
  Target: SCN9A; (+) strand; PAM type: NRG; PAM sequence: GGG
ccagcactttgggaggccga

SEQ ID NO: 53096 - DNA, 20 bp, Artificial Sequence
  Description of Artificial Sequence: Synthetic oligonucleotide
  Target: SCN9A; (+) strand; PAM type: NRG; PAM sequence: GGG
cagcactttgggaggccgag

SEQ ID NO: 53097 - DNA, 20 bp, Artificial Sequence
  Description of Artificial Sequence: Synthetic oligonucleotide
  Target: SCN9A; (+) strand; PAM type: NRG; PAM sequence: GAG
gcactttgggaggccgaggg

SEQ ID NO: 53098 - DNA, 20 bp, Artificial Sequence
  Description of Artificial Sequence: Synthetic oligonucleotide
  Target: SCN9A; (+) strand; PAM type: NRG; PAM sequence: TGG
ctttgggaggccgaggggag

SEQ ID NO: 53099 - DNA, 20 bp, Artificial Sequence
  Description of Artificial Sequence: Synthetic oligonucleotide
  Target: SCN9A; (+) strand; PAM type: NRG; PAM sequence: CAG
aggccgaggggagtggatct

SEQ ID NO: 53100 - DNA, 20 bp, Artificial Sequence
  Description of Artificial Sequence: Synthetic oligonucleotide
  Target: SCN9A; (+) strand; PAM type: NRG; PAM sequence: AAG
ggagtggatctcagctactc

SEQ ID NO: 53101 - DNA, 20 bp, Artificial Sequence
  Description of Artificial Sequence: Synthetic oligonucleotide
  Target: SCN9A; (+) strand; PAM type: NRG; PAM sequence: GAG
agtggatctcagctactcaa

SEQ ID NO: 53102 - DNA, 20 bp, Artificial Sequence
  Description of Artificial Sequence: Synthetic oligonucleotide
  Target: SCN9A; (+) strand; PAM type: NRG; PAM sequence: AGG
gtggatctcagctactcaag

SEQ ID NO: 53103 - DNA, 20 bp, Artificial Sequence
  Description of Artificial Sequence: Synthetic oligonucleotide
  Target: SCN9A; (+) strand; PAM type: NRG; PAM sequence: GAG
tctcagctactcaagaggct

SEQ ID NO: 53104 - DNA, 20 bp, Artificial Sequence
  Description of Artificial Sequence: Synthetic oligonucleotide
  Target: SCN9A; (+) strand; PAM type: NRG; PAM sequence: CAG
agctactcaagaggctgaga

SEQ ID NO: 53105 - DNA, 20 bp, Artificial Sequence
  Description of Artificial Sequence: Synthetic oligonucleotide
  Target: SCN9A; (+) strand; PAM type: NRG; PAM sequence: AGG
gctactcaagaggctgagac

SEQ ID NO: 53106 - DNA, 20 bp, Artificial Sequence
  Description of Artificial Sequence: Synthetic oligonucleotide
  Target: SCN9A; (+) strand; PAM type: NRG; PAM sequence: GAG
ctgagacaggatgtttgctt

SEQ ID NO: 53107 - DNA, 20 bp, Artificial Sequence
  Description of Artificial Sequence: Synthetic oligonucleotide
  Target: SCN9A; (+) strand; PAM type: NRG; PAM sequence: TGG
aggatgtttgcttgagcccc

SEQ ID NO: 53108 - DNA, 20 bp, Artificial Sequence
  Description of Artificial Sequence: Synthetic oligonucleotide
  Target: SCN9A; (+) strand; PAM type: NRG; PAM sequence: GGG
ggatgtttgcttgagcccct

SEQ ID NO: 53109 - DNA, 20 bp, Artificial Sequence
  Description of Artificial Sequence: Synthetic oligonucleotide
  Target: SCN9A; (+) strand; PAM type: NRG; PAM sequence: GGG
gatgtttgcttgagcccctg

SEQ ID NO: 53110 - DNA, 20 bp, Artificial Sequence
  Description of Artificial Sequence: Synthetic oligonucleotide
  Target: SCN9A; (+) strand; PAM type: NRG; PAM sequence: TGG
tttgcttgagcccctgggga

SEQ ID NO: 53111 - DNA, 20 bp, Artificial Sequence
  Description of Artificial Sequence: Synthetic oligonucleotide
  Target: SCN9A; (+) strand; PAM type: NRG; PAM sequence: GAG
tgcttgagcccctggggatg

SEQ ID NO: 53112 - DNA, 20 bp, Artificial Sequence
  Description of Artificial Sequence: Synthetic oligonucleotide
  Target: SCN9A; (+) strand; PAM type: NRG; PAM sequence: AGG
gcttgagcccctggggatgg

SEQ ID NO: 53113 - DNA, 20 bp, Artificial Sequence
  Description of Artificial Sequence: Synthetic oligonucleotide
  Target: SCN9A; (+) strand; PAM type: NRG; PAM sequence: CAG
gcccctggggatggaggttg

SEQ ID NO: 53114 - DNA, 20 bp, Artificial Sequence
  Description of Artificial Sequence: Synthetic oligonucleotide
  Target: SCN9A; (+) strand; PAM type: NRG; PAM sequence: CAG
tgtgactgtgccactgcact

SEQ ID NO: 53115 - DNA, 20 bp, Artificial Sequence
  Description of Artificial Sequence: Synthetic oligonucleotide
  Target: SCN9A; (+) strand; PAM type: NRG; PAM sequence: TGG
ctgtgccactgcactcagcc

SEQ ID NO: 53116 - DNA, 20 bp, Artificial Sequence
  Description of Artificial Sequence: Synthetic oligonucleotide
  Target: SCN9A; (+) strand; PAM type: NRG; PAM sequence: GGG
tgtgccactgcactcagcct

SEQ ID NO: 53117 - DNA, 20 bp, Artificial Sequence
  Description of Artificial Sequence: Synthetic oligonucleotide
  Target: SCN9A; (+) strand; PAM type: NRG; PAM sequence: GAG
tgccactgcactcagcctgg

SEQ ID NO: 53118 - DNA, 20 bp, Artificial Sequence
  Description of Artificial Sequence: Synthetic oligonucleotide
  Target: SCN9A; (+) strand; PAM type: NRG; PAM sequence: CAG
actgcactcagcctgggaga

SEQ ID NO: 53119 - DNA, 20 bp, Artificial Sequence
  Description of Artificial Sequence: Synthetic oligonucleotide
  Target: SCN9A; (+) strand; PAM type: NRG; PAM sequence: GAG
tgcactcagcctgggagaca

SEQ ID NO: 53120 - DNA, 20 bp, Artificial Sequence
  Description of Artificial Sequence: Synthetic oligonucleotide
  Target: SCN9A; (+) strand; PAM type: NRG; PAM sequence: GAG
ctcagcctgggagacagagt

SEQ ID NO: 53121 - DNA, 20 bp, Artificial Sequence
  Description of Artificial Sequence: Synthetic oligonucleotide
  Target: SCN9A; (+) strand; PAM type: NRG; PAM sequence: AAG
gtgagattgtgtttcaaaaa

SEQ ID NO: 53122 - DNA, 20 bp, Artificial Sequence
  Description of Artificial Sequence: Synthetic oligonucleotide
  Target: SCN9A; (+) strand; PAM type: NRG; PAM sequence: AAG
attgtgtttcaaaaaaagaa

SEQ ID NO: 53123 - DNA, 20 bp, Artificial Sequence
  Description of Artificial Sequence: Synthetic oligonucleotide
  Target: SCN9A; (+) strand; PAM type: NRG; PAM sequence: AAG
gtttcaaaaaaagaaaagaa

SEQ ID NO: 53124 - DNA, 20 bp, Artificial Sequence
  Description of Artificial Sequence: Synthetic oligonucleotide
  Target: SCN9A; (+) strand; PAM type: NRG; PAM sequence: AAG
aaaaaaagaaaagaaaagaa

SEQ ID NO: 53125 - DNA, 20 bp, Artificial Sequence
  Description of Artificial Sequence: Synthetic oligonucleotide
  Target: SCN9A; (+) strand; PAM type: NRG; PAM sequence: AAG
aagaaaagaaaagaaaagaa

SEQ ID NO: 53126 - DNA, 20 bp, Artificial Sequence
  Description of Artificial Sequence: Synthetic oligonucleotide
  Target: SCN9A; (+) strand; PAM type: NRG; PAM sequence: AAG
agaaaagaaaagaaaagaaa

SEQ ID NO: 53127 - DNA, 20 bp, Artificial Sequence
  Description of Artificial Sequence: Synthetic oligonucleotide
  Target: SCN9A; (+) strand; PAM type: NRG; PAM sequence: TGG
aaagaaaagaaaagaaaaag

SEQ ID NO: 53128 - DNA, 20 bp, Artificial Sequence
  Description of Artificial Sequence: Synthetic oligonucleotide
  Target: SCN9A; (+) strand; PAM type: NRG; PAM sequence: GAG
agaaaagaaaagaaaaagtg

SEQ ID NO: 53129 - DNA, 20 bp, Artificial Sequence
  Description of Artificial Sequence: Synthetic oligonucleotide
  Target: SCN9A; (+) strand; PAM type: NRG; PAM sequence: TAG
aagaaaagaaaaagtggaga

SEQ ID NO: 53130 - DNA, 20 bp, Artificial Sequence
  Description of Artificial Sequence: Synthetic oligonucleotide
  Target: SCN9A; (+) strand; PAM type: NRG; PAM sequence: TAG
tattattgtgtgcattacaa

SEQ ID NO: 53131 - DNA, 20 bp, Artificial Sequence
  Description of Artificial Sequence: Synthetic oligonucleotide
  Target: SCN9A; (+) strand; PAM type: NRG; PAM sequence: TAG
aatgtacaaatcattttatg

SEQ ID NO: 53132 - DNA, 20 bp, Artificial Sequence
  Description of Artificial Sequence: Synthetic oligonucleotide
  Target: SCN9A; (+) strand; PAM type: NRG; PAM sequence: AAG
tgtagatgctttataatgta

SEQ ID NO: 53133 - DNA, 20 bp, Artificial Sequence
  Description of Artificial Sequence: Synthetic oligonucleotide
  Target: SCN9A; (+) strand; PAM type: NRG; PAM sequence: GAG
gatgctttataatgtaaagt

SEQ ID NO: 53134 - DNA, 20 bp, Artificial Sequence
  Description of Artificial Sequence: Synthetic oligonucleotide
  Target: SCN9A; (+) strand; PAM type: NRG; PAM sequence: TAG
gctttataatgtaaagtgag

SEQ ID NO: 53135 - DNA, 20 bp, Artificial Sequence
  Description of Artificial Sequence: Synthetic oligonucleotide
  Target: SCN9A; (+) strand; PAM type: NRG; PAM sequence: GAG
tttataatgtaaagtgagta

SEQ ID NO: 53136 - DNA, 20 bp, Artificial Sequence
  Description of Artificial Sequence: Synthetic oligonucleotide
  Target: SCN9A; (+) strand; PAM type: NRG; PAM sequence: AGG
ttataatgtaaagtgagtag

SEQ ID NO: 53137 - DNA, 20 bp, Artificial Sequence
  Description of Artificial Sequence: Synthetic oligonucleotide
  Target: SCN9A; (+) strand; PAM type: NRG; PAM sequence: GGG
tataatgtaaagtgagtaga

SEQ ID NO: 53138 - DNA, 20 bp, Artificial Sequence
  Description of Artificial Sequence: Synthetic oligonucleotide
  Target: SCN9A; (+) strand; PAM type: NRG; PAM sequence: GGG
ataatgtaaagtgagtagag

SEQ ID NO: 53139 - DNA, 20 bp, Artificial Sequence
  Description of Artificial Sequence: Synthetic oligonucleotide
  Target: SCN9A; (+) strand; PAM type: NRG; PAM sequence: AAG
gtaaagtgagtagaggggca

SEQ ID NO: 53140 - DNA, 20 bp, Artificial Sequence
  Description of Artificial Sequence: Synthetic oligonucleotide
  Target: SCN9A; (+) strand; PAM type: NRG; PAM sequence: AAG
tgagtagaggggcaaagcac

SEQ ID NO: 53141 - DNA, 20 bp, Artificial Sequence
  Description of Artificial Sequence: Synthetic oligonucleotide
  Target: SCN9A; (+) strand; PAM type: NRG; PAM sequence: AAG
atattaaatctcaaaatgct

SEQ ID NO: 53142 - DNA, 20 bp, Artificial Sequence
  Description of Artificial Sequence: Synthetic oligonucleotide
  Target: SCN9A; (+) strand; PAM type: NRG; PAM sequence: GAG
agtgtcaattctttacttgt

SEQ ID NO: 53143 - DNA, 20 bp, Artificial Sequence
  Description of Artificial Sequence: Synthetic oligonucleotide
  Target: SCN9A; (+) strand; PAM type: NRG; PAM sequence: CAG
attctttacttgtgagataa

SEQ ID NO: 53144 - DNA, 20 bp, Artificial Sequence
  Description of Artificial Sequence: Synthetic oligonucleotide
  Target: SCN9A; (+) strand; PAM type: NRG; PAM sequence: TAG
ttacttgtgagataacagat

SEQ ID NO: 53145 - DNA, 20 bp, Artificial Sequence
  Description of Artificial Sequence: Synthetic oligonucleotide
  Target: SCN9A; (+) strand; PAM type: NRG; PAM sequence: AGG
tacttgtgagataacagatt

SEQ ID NO: 53146 - DNA, 20 bp, Artificial Sequence
  Description of Artificial Sequence: Synthetic oligonucleotide
  Target: SCN9A; (+) strand; PAM type: NRG; PAM sequence: TGG
gagataacagattaggatca

SEQ ID NO: 53147 - DNA, 20 bp, Artificial Sequence
  Description of Artificial Sequence: Synthetic oligonucleotide
  Target: SCN9A; (+) strand; PAM type: NRG; PAM sequence: GAG
gataacagattaggatcatg

SEQ ID NO: 53148 - DNA, 20 bp, Artificial Sequence
  Description of Artificial Sequence: Synthetic oligonucleotide
  Target: SCN9A; (+) strand; PAM type: NRG; PAM sequence: AAG
gatcatggagaattatctaa

SEQ ID NO: 53149 - DNA, 20 bp, Artificial Sequence
  Description of Artificial Sequence: Synthetic oligonucleotide
  Target: SCN9A; (+) strand; PAM type: NRG; PAM sequence: TGG
aaagtacatatgcctttcta

SEQ ID NO: 53150 - DNA, 20 bp, Artificial Sequence
  Description of Artificial Sequence: Synthetic oligonucleotide
  Target: SCN9A; (+) strand; PAM type: NRG; PAM sequence: GAG
agtacatatgcctttctatg

SEQ ID NO: 53151 - DNA, 20 bp, Artificial Sequence
  Description of Artificial Sequence: Synthetic oligonucleotide
  Target: SCN9A; (+) strand; PAM type: NRG; PAM sequence: AAG
cctttctatggagaaatgct

SEQ ID NO: 53152 - DNA, 20 bp, Artificial Sequence
  Description of Artificial Sequence: Synthetic oligonucleotide
  Target: SCN9A; (+) strand; PAM type: NRG; PAM sequence: CAG
agaaatgctaagtcttttta

SEQ ID NO: 53153 - DNA, 20 bp, Artificial Sequence
  Description of Artificial Sequence: Synthetic oligonucleotide
  Target: SCN9A; (+) strand; PAM type: NRG; PAM sequence: AGG
gaaatgctaagtctttttac

SEQ ID NO: 53154 - DNA, 20 bp, Artificial Sequence
  Description of Artificial Sequence: Synthetic oligonucleotide
  Target: SCN9A; (+) strand; PAM type: NRG; PAM sequence: TAG
caggaatccaaactttgctt

SEQ ID NO: 53155 - DNA, 20 bp, Artificial Sequence
  Description of Artificial Sequence: Synthetic oligonucleotide
  Target: SCN9A; (+) strand; PAM type: NRG; PAM sequence: CAG
tccaaactttgctttagtta

SEQ ID NO: 53156 - DNA, 20 bp, Artificial Sequence
  Description of Artificial Sequence: Synthetic oligonucleotide
  Target: SCN9A; (+) strand; PAM type: NRG; PAM sequence: TAG
tccaatcaactaaactaaac

SEQ ID NO: 53157 - DNA, 20 bp, Artificial Sequence
  Description of Artificial Sequence: Synthetic oligonucleotide
  Target: SCN9A; (+) strand; PAM type: NRG; PAM sequence: CAG
tcaactaaactaaactagca

SEQ ID NO: 53158 - DNA, 20 bp, Artificial Sequence
  Description of Artificial Sequence: Synthetic oligonucleotide
  Target: SCN9A; (+) strand; PAM type: NRG; PAM sequence: AAG
actaaactagcacagacaaa

SEQ ID NO: 53159 - DNA, 20 bp, Artificial Sequence
  Description of Artificial Sequence: Synthetic oligonucleotide
  Target: SCN9A; (+) strand; PAM type: NRG; PAM sequence: AAG
actagcacagacaaaaagaa

SEQ ID NO: 53160 - DNA, 20 bp, Artificial Sequence
  Description of Artificial Sequence: Synthetic oligonucleotide
  Target: SCN9A; (+) strand; PAM type: NRG; PAM sequence: TAG
attgatcacatcacattact

SEQ ID NO: 53161 - DNA, 20 bp, Artificial Sequence
  Description of Artificial Sequence: Synthetic oligonucleotide
  Target: SCN9A; (+) strand; PAM type: NRG; PAM sequence: AAG
cacattacttagaataaatg

SEQ ID NO: 53162 - DNA, 20 bp, Artificial Sequence
  Description of Artificial Sequence: Synthetic oligonucleotide
  Target: SCN9A; (+) strand; PAM type: NRG; PAM sequence: AAG
acttagaataaatgaagtat

SEQ ID NO: 53163 - DNA, 20 bp, Artificial Sequence
  Description of Artificial Sequence: Synthetic oligonucleotide
  Target: SCN9A; (+) strand; PAM type: NRG; PAM sequence: AGG
cttagaataaatgaagtata

SEQ ID NO: 53164 - DNA, 20 bp, Artificial Sequence
  Description of Artificial Sequence: Synthetic oligonucleotide
  Target: SCN9A; (+) strand; PAM type: NRG; PAM sequence: AAG
taaatgaagtataaggttaa

SEQ ID NO: 53165 - DNA, 20 bp, Artificial Sequence
  Description of Artificial Sequence: Synthetic oligonucleotide
  Target: SCN9A; (+) strand; PAM type: NRG; PAM sequence: AAG
atgacattaataatactaaa

SEQ ID NO: 53166 - DNA, 20 bp, Artificial Sequence
  Description of Artificial Sequence: Synthetic oligonucleotide
  Target: SCN9A; (+) strand; PAM type: NRG; PAM sequence: AAG
taatactaaaaagccttata

SEQ ID NO: 53167 - DNA, 20 bp, Artificial Sequence
  Description of Artificial Sequence: Synthetic oligonucleotide
  Target: SCN9A; (+) strand; PAM type: NRG; PAM sequence: AAG
caaaatatgacattaataat

SEQ ID NO: 53168 - DNA, 20 bp, Artificial Sequence
  Description of Artificial Sequence: Synthetic oligonucleotide
  Target: SCN9A; (+) strand; PAM type: NRG; PAM sequence: AGG
aaaatatgacattaataata

SEQ ID NO: 53169 - DNA, 20 bp, Artificial Sequence
  Description of Artificial Sequence: Synthetic oligonucleotide
  Target: SCN9A; (+) strand; PAM type: NRG; PAM sequence: AAG
attatctattatttcatttg

SEQ ID NO: 53170 - DNA, 20 bp, Artificial Sequence
  Description of Artificial Sequence: Synthetic oligonucleotide
  Target: SCN9A; (+) strand; PAM type: NRG; PAM sequence: TAG
atttcatttgaagctgataa

SEQ ID NO: 53171 - DNA, 20 bp, Artificial Sequence
  Description of Artificial Sequence: Synthetic oligonucleotide
  Target: SCN9A; (+) strand; PAM type: NRG; PAM sequence: AAG
tgataatagcactactaaaa

SEQ ID NO: 53172 - DNA, 20 bp, Artificial Sequence
  Description of Artificial Sequence: Synthetic oligonucleotide
  Target: SCN9A; (+) strand; PAM type: NRG; PAM sequence: TGG
agataccattaactatcacc

SEQ ID NO: 53173 - DNA, 20 bp, Artificial Sequence
  Description of Artificial Sequence: Synthetic oligonucleotide
  Target: SCN9A; (+) strand; PAM type: NRG; PAM sequence: GGG
gataccattaactatcacct

SEQ ID NO: 53174 - DNA, 20 bp, Artificial Sequence
  Description of Artificial Sequence: Synthetic oligonucleotide
  Target: SCN9A; (+) strand; PAM type: NRG; PAM sequence: GAG
taccattaactatcacctgg

SEQ ID NO: 53175 - DNA, 20 bp, Artificial Sequence
  Description of Artificial Sequence: Synthetic oligonucleotide
  Target: SCN9A; (+) strand; PAM type: NRG; PAM sequence: GAG
tcaacatgaatatgaaatat

SEQ ID NO: 53176 - DNA, 20 bp, Artificial Sequence
  Description of Artificial Sequence: Synthetic oligonucleotide
  Target: SCN9A; (+) strand; PAM type: NRG; PAM sequence: AAG
atgaaatatgagaaaccaca

SEQ ID NO: 53177 - DNA, 20 bp, Artificial Sequence
  Description of Artificial Sequence: Synthetic oligonucleotide
  Target: SCN9A; (+) strand; PAM type: NRG; PAM sequence: AAG
atatgagaaaccacaaagaa

SEQ ID NO: 53178 - DNA, 20 bp, Artificial Sequence
  Description of Artificial Sequence: Synthetic oligonucleotide
  Target: SCN9A; (+) strand; PAM type: NRG; PAM sequence: CAG
aagaaaagcctttgatgaaa

SEQ ID NO: 53179 - DNA, 20 bp, Artificial Sequence
  Description of Artificial Sequence: Synthetic oligonucleotide
  Target: SCN9A; (+) strand; PAM type: NRG; PAM sequence: AAG
aaacagcatcttacgaaact

SEQ ID NO: 53180 - DNA, 20 bp, Artificial Sequence
  Description of Artificial Sequence: Synthetic oligonucleotide
  Target: SCN9A; (+) strand; PAM type: NRG; PAM sequence: AGG
aacagcatcttacgaaacta

SEQ ID NO: 53181 - DNA, 20 bp, Artificial Sequence
  Description of Artificial Sequence: Synthetic oligonucleotide
  Target: SCN9A; (+) strand; PAM type: NRG; PAM sequence: TAG
ttgtaatttgtacattcgct

SEQ ID NO: 53182 - DNA, 20 bp, Artificial Sequence
  Description of Artificial Sequence: Synthetic oligonucleotide
  Target: SCN9A; (+) strand; PAM type: NRG; PAM sequence: TAG
ttgtacattcgcttagaaaa

SEQ ID NO: 53183 - DNA, 20 bp, Artificial Sequence
  Description of Artificial Sequence: Synthetic oligonucleotide
  Target: SCN9A; (+) strand; PAM type: NRG; PAM sequence: AAG
cgcttagaaaatagtccttc

SEQ ID NO: 53184 - DNA, 20 bp, Artificial Sequence
  Description of Artificial Sequence: Synthetic oligonucleotide
  Target: SCN9A; (+) strand; PAM type: NRG; PAM sequence: TAG
tccttcaagtcatccgccat

SEQ ID NO: 53185 - DNA, 20 bp, Artificial Sequence
  Description of Artificial Sequence: Synthetic oligonucleotide
  Target: SCN9A; (+) strand; PAM type: NRG; PAM sequence: AAG
ttagaattgtttaaccttgc

SEQ ID NO: 53186 - DNA, 20 bp, Artificial Sequence
  Description of Artificial Sequence: Synthetic oligonucleotide
  Target: SCN9A; (+) strand; PAM type: NRG; PAM sequence: GAG
agaattgtttaaccttgcaa

SEQ ID NO: 53187 - DNA, 20 bp, Artificial Sequence
  Description of Artificial Sequence: Synthetic oligonucleotide
  Target: SCN9A; (+) strand; PAM type: NRG; PAM sequence: TGG
gtttaaccttgcaagagtac

SEQ ID NO: 53188 - DNA, 20 bp, Artificial Sequence
  Description of Artificial Sequence: Synthetic oligonucleotide
  Target: SCN9A; (+) strand; PAM type: NRG; PAM sequence: GGG
tttaaccttgcaagagtact

SEQ ID NO: 53189 - DNA, 20 bp, Artificial Sequence
  Description of Artificial Sequence: Synthetic oligonucleotide
  Target: SCN9A; (+) strand; PAM type: NRG; PAM sequence: TGG
ccttgcaagagtactgggct

SEQ ID NO: 53190 - DNA, 20 bp, Artificial Sequence
  Description of Artificial Sequence: Synthetic oligonucleotide
  Target: SCN9A; (+) strand; PAM type: NRG; PAM sequence: AAG
agagtactgggcttggtcaa

SEQ ID NO: 53191 - DNA, 20 bp, Artificial Sequence
  Description of Artificial Sequence: Synthetic oligonucleotide
  Target: SCN9A; (+) strand; PAM type: NRG; PAM sequence: CAG
gggcttggtcaaaagaaact

SEQ ID NO: 53192 - DNA, 20 bp, Artificial Sequence
  Description of Artificial Sequence: Synthetic oligonucleotide
  Target: SCN9A; (+) strand; PAM type: NRG; PAM sequence: TAG
tctataaatcatcattatac

SEQ ID NO: 53193 - DNA, 20 bp, Artificial Sequence
  Description of Artificial Sequence: Synthetic oligonucleotide
  Target: SCN9A; (+) strand; PAM type: NRG; PAM sequence: CAG
tcattatactagcaattcat

SEQ ID NO: 53194 - DNA, 20 bp, Artificial Sequence
  Description of Artificial Sequence: Synthetic oligonucleotide
  Target: SCN9A; (+) strand; PAM type: NRG; PAM sequence: TAG
ctagcaattcatcagcatgt

SEQ ID NO: 53195 - DNA, 20 bp, Artificial Sequence
  Description of Artificial Sequence: Synthetic oligonucleotide
  Target: SCN9A; (+) strand; PAM type: NRG; PAM sequence: AAG
gcatgttagatcttgtgtaa

SEQ ID NO: 53196 - DNA, 20 bp, Artificial Sequence
  Description of Artificial Sequence: Synthetic oligonucleotide
  Target: SCN9A; (+) strand; PAM type: NRG; PAM sequence: AGG
catgttagatcttgtgtaaa

SEQ ID NO: 53197 - DNA, 20 bp, Artificial Sequence
  Description of Artificial Sequence: Synthetic oligonucleotide
  Target: SCN9A; (+) strand; PAM type: NRG; PAM sequence: AAG
aaataatctaatttgttttg

SEQ ID NO: 53198 - DNA, 20 bp, Artificial Sequence
  Description of Artificial Sequence: Synthetic oligonucleotide
  Target: SCN9A; (+) strand; PAM type: NRG; PAM sequence: TAG
atttgttttgaagctccttt

SEQ ID NO: 53199 - DNA, 20 bp, Artificial Sequence
  Description of Artificial Sequence: Synthetic oligonucleotide
  Target: SCN9A; (+) strand; PAM type: NRG; PAM sequence: TGG
tccttttcatgtctcttttc

SEQ ID NO: 53200 - DNA, 20 bp, Artificial Sequence
  Description of Artificial Sequence: Synthetic oligonucleotide
  Target: SCN9A; (+) strand; PAM type: NRG; PAM sequence: AAG
tttcatgtctcttttctgga

SEQ ID NO: 53201 - DNA, 20 bp, Artificial Sequence
  Description of Artificial Sequence: Synthetic oligonucleotide
  Target: SCN9A; (+) strand; PAM type: NRG; PAM sequence: CAG
cctacaatcctttgtgcaaa

SEQ ID NO: 53202 - DNA, 20 bp, Artificial Sequence
  Description of Artificial Sequence: Synthetic oligonucleotide
  Target: SCN9A; (+) strand; PAM type: NRG; PAM sequence: AGG
ctacaatcctttgtgcaaac

SEQ ID NO: 53203 - DNA, 20 bp, Artificial Sequence
  Description of Artificial Sequence: Synthetic oligonucleotide
  Target: SCN9A; (+) strand; PAM type: NRG; PAM sequence: GGG
tacaatcctttgtgcaaaca

SEQ ID NO: 53204 - DNA, 20 bp, Artificial Sequence
  Description of Artificial Sequence: Synthetic oligonucleotide
  Target: SCN9A; (+) strand; PAM type: NRG; PAM sequence: AAG
atcctttgtgcaaacaggga

SEQ ID NO: 53205 - DNA, 20 bp, Artificial Sequence
  Description of Artificial Sequence: Synthetic oligonucleotide
  Target: SCN9A; (+) strand; PAM type: NRG; PAM sequence: AAG
cagggaaagaaaaaacaatc

SEQ ID NO: 53206 - DNA, 20 bp, Artificial Sequence
  Description of Artificial Sequence: Synthetic oligonucleotide
  Target: SCN9A; (+) strand; PAM type: NRG; PAM sequence: AAG
aacaatcaagataccaaact

SEQ ID NO: 53207 - DNA, 20 bp, Artificial Sequence
  Description of Artificial Sequence: Synthetic oligonucleotide
  Target: SCN9A; (+) strand; PAM type: NRG; PAM sequence: GAG
caatcaagataccaaactaa

SEQ ID NO: 53208 - DNA, 20 bp, Artificial Sequence
  Description of Artificial Sequence: Synthetic oligonucleotide
  Target: SCN9A; (+) strand; PAM type: NRG; PAM sequence: AGG
aatcaagataccaaactaag

SEQ ID NO: 53209 - DNA, 20 bp, Artificial Sequence
  Description of Artificial Sequence: Synthetic oligonucleotide
  Target: SCN9A; (+) strand; PAM type: NRG; PAM sequence: TGG
caagataccaaactaagagg

SEQ ID NO: 53210 - DNA, 20 bp, Artificial Sequence
  Description of Artificial Sequence: Synthetic oligonucleotide
  Target: SCN9A; (+) strand; PAM type: NRG; PAM sequence: TAG
aatttccatcactgacatca

SEQ ID NO: 53211 - DNA, 20 bp, Artificial Sequence
  Description of Artificial Sequence: Synthetic oligonucleotide
  Target: SCN9A; (+) strand; PAM type: NRG; PAM sequence: TAG
tgacatcatagctgtatgat

SEQ ID NO: 53212 - DNA, 20 bp, Artificial Sequence
  Description of Artificial Sequence: Synthetic oligonucleotide
  Target: SCN9A; (+) strand; PAM type: NRG; PAM sequence: GAG
tcatagctgtatgattagat

SEQ ID NO: 53213 - DNA, 20 bp, Artificial Sequence
  Description of Artificial Sequence: Synthetic oligonucleotide
  Target: SCN9A; (+) strand; PAM type: NRG; PAM sequence: TGG
atgagaaaacccaaaatatg

SEQ ID NO: 53214 - DNA, 20 bp, Artificial Sequence
  Description of Artificial Sequence: Synthetic oligonucleotide
  Target: SCN9A; (+) strand; PAM type: NRG; PAM sequence: GGG
tgagaaaacccaaaatatgt

SEQ ID NO: 53215 - DNA, 20 bp, Artificial Sequence
  Description of Artificial Sequence: Synthetic oligonucleotide
  Target: SCN9A; (+) strand; PAM type: NRG; PAM sequence: GAG
agaaaacccaaaatatgtgg

SEQ ID NO: 53216 - DNA, 20 bp, Artificial Sequence
  Description of Artificial Sequence: Synthetic oligonucleotide
  Target: SCN9A; (+) strand; PAM type: NRG; PAM sequence: AGG
gaaaacccaaaatatgtggg

SEQ ID NO: 53217 - DNA, 20 bp, Artificial Sequence
  Description of Artificial Sequence: Synthetic oligonucleotide
  Target: SCN9A; (+) strand; PAM type: NRG; PAM sequence: GAG
aaacccaaaatatgtgggag

SEQ ID NO: 53218 - DNA, 20 bp, Artificial Sequence
  Description of Artificial Sequence: Synthetic oligonucleotide
  Target: SCN9A; (+) strand; PAM type: NRG; PAM sequence: AAG
cccaaaatatgtgggaggag

SEQ ID NO: 53219 - DNA, 20 bp, Artificial Sequence
  Description of Artificial Sequence: Synthetic oligonucleotide
  Target: SCN9A; (+) strand; PAM type: NRG; PAM sequence: AGG
ccaaaatatgtgggaggaga

SEQ ID NO: 53220 - DNA, 20 bp, Artificial Sequence
  Description of Artificial Sequence: Synthetic oligonucleotide
  Target: SCN9A; (+) strand; PAM type: NRG; PAM sequence: AAG
aatcctctgcccctgatgtg

SEQ ID NO: 53221 - DNA, 20 bp, Artificial Sequence
  Description of Artificial Sequence: Synthetic oligonucleotide
  Target: SCN9A; (+) strand; PAM type: NRG; PAM sequence: CAG
cctctgcccctgatgtgaag

SEQ ID NO: 53222 - DNA, 20 bp, Artificial Sequence
  Description of Artificial Sequence: Synthetic oligonucleotide
  Target: SCN9A; (+) strand; PAM type: NRG; PAM sequence: CAG
ctgcccctgatgtgaagcag

SEQ ID NO: 53223 - DNA, 20 bp, Artificial Sequence
  Description of Artificial Sequence: Synthetic oligonucleotide
  Target: SCN9A; (+) strand; PAM type: NRG; PAM sequence: AAG
ctgatgtgaagcagcagtgt

SEQ ID NO: 53224 - DNA, 20 bp, Artificial Sequence
  Description of Artificial Sequence: Synthetic oligonucleotide
  Target: SCN9A; (+) strand; PAM type: NRG; PAM sequence: CAG
tgtgaagcagcagtgtaaga

SEQ ID NO: 53225 - DNA, 20 bp, Artificial Sequence
  Description of Artificial Sequence: Synthetic oligonucleotide
  Target: SCN9A; (+) strand; PAM type: NRG; PAM sequence: AAG
aagcagcagtgtaagacaga

SEQ ID NO: 53226 - DNA, 20 bp, Artificial Sequence
  Description of Artificial Sequence: Synthetic oligonucleotide
  Target: SCN9A; (+) strand; PAM type: NRG; PAM sequence: CAG
atgtcctttgttatctttgc

SEQ ID NO: 53227 - DNA, 20 bp, Artificial Sequence
  Description of Artificial Sequence: Synthetic oligonucleotide
  Target: SCN9A; (+) strand; PAM type: NRG; PAM sequence: AAG
tcctttgttatctttgccag

SEQ ID NO: 53228 - DNA, 20 bp, Artificial Sequence
  Description of Artificial Sequence: Synthetic oligonucleotide
  Target: SCN9A; (+) strand; PAM type: NRG; PAM sequence: GAG
tttgccagaagctttttctc

SEQ ID NO: 53229 - DNA, 20 bp, Artificial Sequence
  Description of Artificial Sequence: Synthetic oligonucleotide
  Target: SCN9A; (+) strand; PAM type: NRG; PAM sequence: AGG
ttgccagaagctttttctcg

SEQ ID NO: 53230 - DNA, 20 bp, Artificial Sequence
  Description of Artificial Sequence: Synthetic oligonucleotide
  Target: SCN9A; (+) strand; PAM type: NRG; PAM sequence: TGG
ctttttctcgaggaactaaa

SEQ ID NO: 53231 - DNA, 20 bp, Artificial Sequence
  Description of Artificial Sequence: Synthetic oligonucleotide
  Target: SCN9A; (+) strand; PAM type: NRG; PAM sequence: AAG
tttctcgaggaactaaatgg

SEQ ID NO: 53232 - DNA, 20 bp, Artificial Sequence
  Description of Artificial Sequence: Synthetic oligonucleotide
  Target: SCN9A; (+) strand; PAM type: NRG; PAM sequence: CAG
tggaagctttgactacattt

SEQ ID NO: 53233 - DNA, 20 bp, Artificial Sequence
  Description of Artificial Sequence: Synthetic oligonucleotide
  Target: SCN9A; (+) strand; PAM type: NRG; PAM sequence: AAG
ctacatttcagacctcatga

SEQ ID NO: 53234 - DNA, 20 bp, Artificial Sequence
  Description of Artificial Sequence: Synthetic oligonucleotide
  Target: SCN9A; (+) strand; PAM type: NRG; PAM sequence: TAG
acctcatgaaagaaataaat

SEQ ID NO: 53235 - DNA, 20 bp, Artificial Sequence
  Description of Artificial Sequence: Synthetic oligonucleotide
  Target: SCN9A; (+) strand; PAM type: NRG; PAM sequence: GAG
gaaagaaataaattagattt

SEQ ID NO: 53236 - DNA, 20 bp, Artificial Sequence
  Description of Artificial Sequence: Synthetic oligonucleotide
  Target: SCN9A; (+) strand; PAM type: NRG; PAM sequence: CAG
tgaatataccccaattactc

SEQ ID NO: 53237 - DNA, 20 bp, Artificial Sequence
  Description of Artificial Sequence: Synthetic oligonucleotide
  Target: SCN9A; (+) strand; PAM type: NRG; PAM sequence: AGG
gaatataccccaattactcc

SEQ ID NO: 53238 - DNA, 20 bp, Artificial Sequence
  Description of Artificial Sequence: Synthetic oligonucleotide
  Target: SCN9A; (+) strand; PAM type: NRG; PAM sequence: GAG
atataccccaattactccag

SEQ ID NO: 53239 - DNA, 20 bp, Artificial Sequence
  Description of Artificial Sequence: Synthetic oligonucleotide
  Target: SCN9A; (+) strand; PAM type: NRG; PAM sequence: CAG
ctccaggagttaaaatatta

SEQ ID NO: 53240 - DNA, 20 bp, Artificial Sequence
  Description of Artificial Sequence: Synthetic oligonucleotide
  Target: SCN9A; (+) strand; PAM type: NRG; PAM sequence: AAG
aaatattacagcctgtgtat

SEQ ID NO: 53241 - DNA, 20 bp, Artificial Sequence
  Description of Artificial Sequence: Synthetic oligonucleotide
  Target: SCN9A; (+) strand; PAM type: NRG; PAM sequence: TGG
attacagcctgtgtataaga

SEQ ID NO: 53242 - DNA, 20 bp, Artificial Sequence
  Description of Artificial Sequence: Synthetic oligonucleotide
  Target: SCN9A; (+) strand; PAM type: NRG; PAM sequence: GGG
ttacagcctgtgtataagat

SEQ ID NO: 53243 - DNA, 20 bp, Artificial Sequence
  Description of Artificial Sequence: Synthetic oligonucleotide
  Target: SCN9A; (+) strand; PAM type: NRG; PAM sequence: TAG
ctgtgtataagatgggtatc

SEQ ID NO: 53244 - DNA, 20 bp, Artificial Sequence
  Description of Artificial Sequence: Synthetic oligonucleotide
  Target: SCN9A; (+) strand; PAM type: NRG; PAM sequence: TGG
tgtataagatgggtatctag

SEQ ID NO: 53245 - DNA, 20 bp, Artificial Sequence
  Description of Artificial Sequence: Synthetic oligonucleotide
  Target: SCN9A; (+) strand; PAM type: NRG; PAM sequence: CAG
agatgggtatctagtggctt

SEQ ID NO: 53246 - DNA, 20 bp, Artificial Sequence
  Description of Artificial Sequence: Synthetic oligonucleotide
  Target: SCN9A; (+) strand; PAM type: NRG; PAM sequence: TAG
tgggtatctagtggcttcag

SEQ ID NO: 53247 - DNA, 20 bp, Artificial Sequence
  Description of Artificial Sequence: Synthetic oligonucleotide
  Target: SCN9A; (+) strand; PAM type: NRG; PAM sequence: GAG
ggtatctagtggcttcagta

SEQ ID NO: 53248 - DNA, 20 bp, Artificial Sequence
  Description of Artificial Sequence: Synthetic oligonucleotide
  Target: SCN9A; (+) strand; PAM type: NRG; PAM sequence: TGG
gtctttaactatcatccatg

SEQ ID NO: 53249 - DNA, 20 bp, Artificial Sequence
  Description of Artificial Sequence: Synthetic oligonucleotide
  Target: SCN9A; (+) strand; PAM type: NRG; PAM sequence: AAG
tttaactatcatccatgtgg

SEQ ID NO: 53250 - DNA, 20 bp, Artificial Sequence
  Description of Artificial Sequence: Synthetic oligonucleotide
  Target: SCN9A; (+) strand; PAM type: NRG; PAM sequence: AGG
ttaactatcatccatgtgga

SEQ ID NO: 53251 - DNA, 20 bp, Artificial Sequence
  Description of Artificial Sequence: Synthetic oligonucleotide
  Target: SCN9A; (+) strand; PAM type: NRG; PAM sequence: GGG
taactatcatccatgtggaa

SEQ ID NO: 53252 - DNA, 20 bp, Artificial Sequence
  Description of Artificial Sequence: Synthetic oligonucleotide
  Target: SCN9A; (+) strand; PAM type: NRG; PAM sequence: TAG
ctatcatccatgtggaaggg

SEQ ID NO: 53253 - DNA, 20 bp, Artificial Sequence
  Description of Artificial Sequence: Synthetic oligonucleotide
  Target: SCN9A; (+) strand; PAM type: NRG; PAM sequence: AAG
aatgaatcaatcaatgaatc

SEQ ID NO: 53254 - DNA, 20 bp, Artificial Sequence
  Description of Artificial Sequence: Synthetic oligonucleotide
  Target: SCN9A; (+) strand; PAM type: NRG; PAM sequence: TGG
acatatatatcttgattatg

SEQ ID NO: 53255 - DNA, 20 bp, Artificial Sequence
  Description of Artificial Sequence: Synthetic oligonucleotide
  Target: SCN9A; (+) strand; PAM type: NRG; PAM sequence: CAG
tggtactcaatgttctttca

SEQ ID NO: 53256 - DNA, 20 bp, Artificial Sequence
  Description of Artificial Sequence: Synthetic oligonucleotide
  Target: SCN9A; (+) strand; PAM type: NRG; PAM sequence: TAG
tttcacagaatctctatttt

SEQ ID NO: 53257 - DNA, 20 bp, Artificial Sequence
  Description of Artificial Sequence: Synthetic oligonucleotide
  Target: SCN9A; (+) strand; PAM type: NRG; PAM sequence: AGG
ttcacagaatctctattttt

SEQ ID NO: 53258 - DNA, 20 bp, Artificial Sequence
  Description of Artificial Sequence: Synthetic oligonucleotide
  Target: SCN9A; (+) strand; PAM type: NRG; PAM sequence: CAG
ctctatttttaggatttctt

SEQ ID NO: 53259 - DNA, 20 bp, Artificial Sequence
  Description of Artificial Sequence: Synthetic oligonucleotide
  Target: SCN9A; (+) strand; PAM type: NRG; PAM sequence: AGG
tctatttttaggatttcttc

SEQ ID NO: 53260 - DNA, 20 bp, Artificial Sequence
  Description of Artificial Sequence: Synthetic oligonucleotide
  Target: SCN9A; (+) strand; PAM type: NRG; PAM sequence: TAG
tcaggacatcatgacaaaat

SEQ ID NO: 53261 - DNA, 20 bp, Artificial Sequence
  Description of Artificial Sequence: Synthetic oligonucleotide
  Target: SCN9A; (+) strand; PAM type: NRG; PAM sequence: TGG
acaaaattagtactgaattg

SEQ ID NO: 53262 - DNA, 20 bp, Artificial Sequence
  Description of Artificial Sequence: Synthetic oligonucleotide
  Target: SCN9A; (+) strand; PAM type: NRG; PAM sequence: TAG
gaattgtggtgtgcataact

SEQ ID NO: 53263 - DNA, 20 bp, Artificial Sequence
  Description of Artificial Sequence: Synthetic oligonucleotide
  Target: SCN9A; (+) strand; PAM type: NRG; PAM sequence: AAG
cttagaaaaaaatatgcata

SEQ ID NO: 53264 - DNA, 20 bp, Artificial Sequence
  Description of Artificial Sequence: Synthetic oligonucleotide
  Target: SCN9A; (+) strand; PAM type: NRG; PAM sequence: CAG
agaaaaaaatatgcataaag

SEQ ID NO: 53265 - DNA, 20 bp, Artificial Sequence
  Description of Artificial Sequence: Synthetic oligonucleotide
  Target: SCN9A; (+) strand; PAM type: NRG; PAM sequence: TAG
gtaattttttctataacaat

SEQ ID NO: 53266 - DNA, 20 bp, Artificial Sequence
  Description of Artificial Sequence: Synthetic oligonucleotide
  Target: SCN9A; (+) strand; PAM type: NRG; PAM sequence: TGG
attatcctcattttaattca

SEQ ID NO: 53267 - DNA, 20 bp, Artificial Sequence
  Description of Artificial Sequence: Synthetic oligonucleotide
  Target: SCN9A; (+) strand; PAM type: NRG; PAM sequence: GAG
tatcctcattttaattcatg

SEQ ID NO: 53268 - DNA, 20 bp, Artificial Sequence
  Description of Artificial Sequence: Synthetic oligonucleotide
  Target: SCN9A; (+) strand; PAM type: NRG; PAM sequence: GAG
tcctcattttaattcatgga

SEQ ID NO: 53269 - DNA, 20 bp, Artificial Sequence
  Description of Artificial Sequence: Synthetic oligonucleotide
  Target: SCN9A; (+) strand; PAM type: NRG; PAM sequence: CAG
ttttaattcatggagagtta

SEQ ID NO: 53270 - DNA, 20 bp, Artificial Sequence
  Description of Artificial Sequence: Synthetic oligonucleotide
  Target: SCN9A; (+) strand; PAM type: NRG; PAM sequence: GAG
agagttacagatgttcattt

SEQ ID NO: 53271 - DNA, 20 bp, Artificial Sequence
  Description of Artificial Sequence: Synthetic oligonucleotide
  Target: SCN9A; (+) strand; PAM type: NRG; PAM sequence: TAG
ttacagatgttcatttgaga

SEQ ID NO: 53272 - DNA, 20 bp, Artificial Sequence
  Description of Artificial Sequence: Synthetic oligonucleotide
  Target: SCN9A; (+) strand; PAM type: NRG; PAM sequence: CAG
gatgttcatttgagatagat

SEQ ID NO: 53273 - DNA, 20 bp, Artificial Sequence
  Description of Artificial Sequence: Synthetic oligonucleotide
  Target: SCN9A; (+) strand; PAM type: NRG; PAM sequence: AGG
atgttcatttgagatagatc

SEQ ID NO: 53274 - DNA, 20 bp, Artificial Sequence
  Description of Artificial Sequence: Synthetic oligonucleotide
  Target: SCN9A; (+) strand; PAM type: NRG; PAM sequence: GAG
gttcatttgagatagatcag

SEQ ID NO: 53275 - DNA, 20 bp, Artificial Sequence
  Description of Artificial Sequence: Synthetic oligonucleotide
  Target: SCN9A; (+) strand; PAM type: NRG; PAM sequence: TGG
catttgagatagatcaggag

SEQ ID NO: 53276 - DNA, 20 bp, Artificial Sequence
  Description of Artificial Sequence: Synthetic oligonucleotide
  Target: SCN9A; (+) strand; PAM type: NRG; PAM sequence: GGG
atttgagatagatcaggagt

SEQ ID NO: 53277 - DNA, 20 bp, Artificial Sequence
  Description of Artificial Sequence: Synthetic oligonucleotide
  Target: SCN9A; (+) strand; PAM type: NRG; PAM sequence: CAG
tgagatagatcaggagtggg

SEQ ID NO: 53278 - DNA, 20 bp, Artificial Sequence
  Description of Artificial Sequence: Synthetic oligonucleotide
  Target: SCN9A; (+) strand; PAM type: NRG; PAM sequence: GAG
agatagatcaggagtgggca

SEQ ID NO: 53279 - DNA, 20 bp, Artificial Sequence
  Description of Artificial Sequence: Synthetic oligonucleotide
  Target: SCN9A; (+) strand; PAM type: NRG; PAM sequence: AGG
gatagatcaggagtgggcag

SEQ ID NO: 53280 - DNA, 20 bp, Artificial Sequence
  Description of Artificial Sequence: Synthetic oligonucleotide
  Target: SCN9A; (+) strand; PAM type: NRG; PAM sequence: CAG
agatcaggagtgggcagagg

SEQ ID NO: 53281 - DNA, 20 bp, Artificial Sequence
  Description of Artificial Sequence: Synthetic oligonucleotide
  Target: SCN9A; (+) strand; PAM type: NRG; PAM sequence: AGG
gatcaggagtgggcagaggc

SEQ ID NO: 53282 - DNA, 20 bp, Artificial Sequence
  Description of Artificial Sequence: Synthetic oligonucleotide
  Target: SCN9A; (+) strand; PAM type: NRG; PAM sequence: AAG
agtgggcagaggcaggtttt

SEQ ID NO: 53283 - DNA, 20 bp, Artificial Sequence
  Description of Artificial Sequence: Synthetic oligonucleotide
  Target: SCN9A; (+) strand; PAM type: NRG; PAM sequence: GAG
ttgaaaactttcaccacgtt

SEQ ID NO: 53284 - DNA, 20 bp, Artificial Sequence
  Description of Artificial Sequence: Synthetic oligonucleotide
  Target: SCN9A; (+) strand; PAM type: NRG; PAM sequence: AGG
tgaaaactttcaccacgttg

SEQ ID NO: 53285 - DNA, 20 bp, Artificial Sequence
  Description of Artificial Sequence: Synthetic oligonucleotide
  Target: SCN9A; (+) strand; PAM type: NRG; PAM sequence: CAG
aactttcaccacgttgaggt

SEQ ID NO: 53286 - DNA, 20 bp, Artificial Sequence
  Description of Artificial Sequence: Synthetic oligonucleotide
  Target: SCN9A; (+) strand; PAM type: NRG; PAM sequence: AAG
gtcagtatgctcttgaaaaa

SEQ ID NO: 53287 - DNA, 20 bp, Artificial Sequence
  Description of Artificial Sequence: Synthetic oligonucleotide
  Target: SCN9A; (+) strand; PAM type: NRG; PAM sequence: AAG
tgaaaaaaagtaacaaaaaa

SEQ ID NO: 53288 - DNA, 20 bp, Artificial Sequence
  Description of Artificial Sequence: Synthetic oligonucleotide
  Target: SCN9A; (+) strand; PAM type: NRG; PAM sequence: TAG
aaaaaagtaacaaaaaaaag

SEQ ID NO: 53289 - DNA, 20 bp, Artificial Sequence
  Description of Artificial Sequence: Synthetic oligonucleotide
  Target: SCN9A; (+) strand; PAM type: NRG; PAM sequence: AGG
aaaaagtaacaaaaaaaagt

SEQ ID NO: 53290 - DNA, 20 bp, Artificial Sequence
  Description of Artificial Sequence: Synthetic oligonucleotide
  Target: SCN9A; (+) strand; PAM type: NRG; PAM sequence: GGG
aaaagtaacaaaaaaaagta

SEQ ID NO: 53291 - DNA, 20 bp, Artificial Sequence
  Description of Artificial Sequence: Synthetic oligonucleotide
  Target: SCN9A; (+) strand; PAM type: NRG; PAM sequence: AAG
taacaaaaaaaagtagggaa

SEQ ID NO: 53292 - DNA, 20 bp, Artificial Sequence
  Description of Artificial Sequence: Synthetic oligonucleotide
  Target: SCN9A; (+) strand; PAM type: NRG; PAM sequence: AGG
aacaaaaaaaagtagggaaa

SEQ ID NO: 53293 - DNA, 20 bp, Artificial Sequence
  Description of Artificial Sequence: Synthetic oligonucleotide
  Target: SCN9A; (+) strand; PAM type: NRG; PAM sequence: GGG
acaaaaaaaagtagggaaaa

SEQ ID NO: 53294 - DNA, 20 bp, Artificial Sequence
  Description of Artificial Sequence: Synthetic oligonucleotide
  Target: SCN9A; (+) strand; PAM type: NRG; PAM sequence: GGG
caaaaaaaagtagggaaaag

SEQ ID NO: 53295 - DNA, 20 bp, Artificial Sequence
  Description of Artificial Sequence: Synthetic oligonucleotide
  Target: SCN9A; (+) strand; PAM type: NRG; PAM sequence: AAG
ttattgattgatataaaact

SEQ ID NO: 53296 - DNA, 20 bp, Artificial Sequence
  Description of Artificial Sequence: Synthetic oligonucleotide
  Target: SCN9A; (+) strand; PAM type: NRG; PAM sequence: CAG
attgatataaaactaagttc

SEQ ID NO: 53297 - DNA, 20 bp, Artificial Sequence
  Description of Artificial Sequence: Synthetic oligonucleotide
  Target: SCN9A; (+) strand; PAM type: NRG; PAM sequence: TAG
taagttccagaaaaacaatc

SEQ ID NO: 53298 - DNA, 20 bp, Artificial Sequence
  Description of Artificial Sequence: Synthetic oligonucleotide
  Target: SCN9A; (+) strand; PAM type: NRG; PAM sequence: AGG
aagttccagaaaaacaatct

SEQ ID NO: 53299 - DNA, 20 bp, Artificial Sequence
  Description of Artificial Sequence: Synthetic oligonucleotide
  Target: SCN9A; (+) strand; PAM type: NRG; PAM sequence: TAG
atctaggcatttcaaattaa

SEQ ID NO: 53300 - DNA, 20 bp, Artificial Sequence
  Description of Artificial Sequence: Synthetic oligonucleotide
  Target: SCN9A; (+) strand; PAM type: NRG; PAM sequence: GAG
ctaggcatttcaaattaata

SEQ ID NO: 53301 - DNA, 20 bp, Artificial Sequence
  Description of Artificial Sequence: Synthetic oligonucleotide
  Target: SCN9A; (+) strand; PAM type: NRG; PAM sequence: AGG
taggcatttcaaattaatag

SEQ ID NO: 53302 - DNA, 20 bp, Artificial Sequence
  Description of Artificial Sequence: Synthetic oligonucleotide
  Target: SCN9A; (+) strand; PAM type: NRG; PAM sequence: CAG
aacaaacatacaaacaaaaa

SEQ ID NO: 53303 - DNA, 20 bp, Artificial Sequence
  Description of Artificial Sequence: Synthetic oligonucleotide
  Target: SCN9A; (+) strand; PAM type: NRG; PAM sequence: CAG
acaaaaacagatataattgc

SEQ ID NO: 53304 - DNA, 20 bp, Artificial Sequence
  Description of Artificial Sequence: Synthetic oligonucleotide
  Target: SCN9A; (+) strand; PAM type: NRG; PAM sequence: AAG
attgccagaaaatcctgttg

SEQ ID NO: 53305 - DNA, 20 bp, Artificial Sequence
  Description of Artificial Sequence: Synthetic oligonucleotide
  Target: SCN9A; (+) strand; PAM type: NRG; PAM sequence: AAG
agaaaatcctgttgaagatg

SEQ ID NO: 53306 - DNA, 20 bp, Artificial Sequence
  Description of Artificial Sequence: Synthetic oligonucleotide
  Target: SCN9A; (+) strand; PAM type: NRG; PAM sequence: AGG
gaaaatcctgttgaagatga

SEQ ID NO: 53307 - DNA, 20 bp, Artificial Sequence
  Description of Artificial Sequence: Synthetic oligonucleotide
  Target: SCN9A; (+) strand; PAM type: NRG; PAM sequence: GAG
ttattgctttccttcttcct

SEQ ID NO: 53308 - DNA, 20 bp, Artificial Sequence
  Description of Artificial Sequence: Synthetic oligonucleotide
  Target: SCN9A; (+) strand; PAM type: NRG; PAM sequence: AAG
tcctgagctcctgatgttgt

SEQ ID NO: 53309 - DNA, 20 bp, Artificial Sequence
  Description of Artificial Sequence: Synthetic oligonucleotide
  Target: SCN9A; (+) strand; PAM type: NRG; PAM sequence: TAG
atgttgtaagttgtcatcat

SEQ ID NO: 53310 - DNA, 20 bp, Artificial Sequence
  Description of Artificial Sequence: Synthetic oligonucleotide
  Target: SCN9A; (+) strand; PAM type: NRG; PAM sequence: AAG
agttgtcatcattagtaatg

SEQ ID NO: 53311 - DNA, 20 bp, Artificial Sequence
  Description of Artificial Sequence: Synthetic oligonucleotide
  Target: SCN9A; (+) strand; PAM type: NRG; PAM sequence: TGG
gtcatcattagtaatgaaga

SEQ ID NO: 53312 - DNA, 20 bp, Artificial Sequence
  Description of Artificial Sequence: Synthetic oligonucleotide
  Target: SCN9A; (+) strand; PAM type: NRG; PAM sequence: TGG
agtaatgaagatggtatcgc

SEQ ID NO: 53313 - DNA, 20 bp, Artificial Sequence
  Description of Artificial Sequence: Synthetic oligonucleotide
  Target: SCN9A; (+) strand; PAM type: NRG; PAM sequence: CGG
tcctccccaaataaaataaa

SEQ ID NO: 53314 - DNA, 20 bp, Artificial Sequence
  Description of Artificial Sequence: Synthetic oligonucleotide
  Target: SCN9A; (+) strand; PAM type: NRG; PAM sequence: GGG
cctccccaaataaaataaac

SEQ ID NO: 53315 - DNA, 20 bp, Artificial Sequence
  Description of Artificial Sequence: Synthetic oligonucleotide
  Target: SCN9A; (+) strand; PAM type: NRG; PAM sequence: GGG
ctccccaaataaaataaacg

SEQ ID NO: 53316 - DNA, 20 bp, Artificial Sequence
  Description of Artificial Sequence: Synthetic oligonucleotide
  Target: SCN9A; (+) strand; PAM type: NRG; PAM sequence: AAG
tatctttttattttcatccc

SEQ ID NO: 53317 - DNA, 20 bp, Artificial Sequence
  Description of Artificial Sequence: Synthetic oligonucleotide
  Target: SCN9A; (+) strand; PAM type: NRG; PAM sequence: GAG
tctttttattttcatcccaa

SEQ ID NO: 53318 - DNA, 20 bp, Artificial Sequence
  Description of Artificial Sequence: Synthetic oligonucleotide
  Target: SCN9A; (+) strand; PAM type: NRG; PAM sequence: TAG
aagagaatatcttctaacga

SEQ ID NO: 53319 - DNA, 20 bp, Artificial Sequence
  Description of Artificial Sequence: Synthetic oligonucleotide
  Target: SCN9A; (+) strand; PAM type: NRG; PAM sequence: AAG
agaatatcttctaacgatag

SEQ ID NO: 53320 - DNA, 20 bp, Artificial Sequence
  Description of Artificial Sequence: Synthetic oligonucleotide
  Target: SCN9A; (+) strand; PAM type: NRG; PAM sequence: TAG
acgatagaagtttatcatgt

SEQ ID NO: 53321 - DNA, 20 bp, Artificial Sequence
  Description of Artificial Sequence: Synthetic oligonucleotide
  Target: SCN9A; (+) strand; PAM type: NRG; PAM sequence: AGG
cgatagaagtttatcatgtt

SEQ ID NO: 53322 - DNA, 20 bp, Artificial Sequence
  Description of Artificial Sequence: Synthetic oligonucleotide
  Target: SCN9A; (+) strand; PAM type: NRG; PAM sequence: AAG
tagaagtttatcatgttagg

SEQ ID NO: 53323 - DNA, 20 bp, Artificial Sequence
  Description of Artificial Sequence: Synthetic oligonucleotide
  Target: SCN9A; (+) strand; PAM type: NRG; PAM sequence: AAG
agtttatcatgttaggaaga

SEQ ID NO: 53324 - DNA, 20 bp, Artificial Sequence
  Description of Artificial Sequence: Synthetic oligonucleotide
  Target: SCN9A; (+) strand; PAM type: NRG; PAM sequence: TGG
agaaagcaactgtttaaaca

SEQ ID NO: 53325 - DNA, 20 bp, Artificial Sequence
  Description of Artificial Sequence: Synthetic oligonucleotide
  Target: SCN9A; (+) strand; PAM type: NRG; PAM sequence: GGG
gaaagcaactgtttaaacat

SEQ ID NO: 53326 - DNA, 20 bp, Artificial Sequence
  Description of Artificial Sequence: Synthetic oligonucleotide
  Target: SCN9A; (+) strand; PAM type: NRG; PAM sequence: TAG
tactgaaaaacaactgaatc

SEQ ID NO: 53327 - DNA, 20 bp, Artificial Sequence
  Description of Artificial Sequence: Synthetic oligonucleotide
  Target: SCN9A; (+) strand; PAM type: NRG; PAM sequence: TGG
tctagcttcctccctgaatt

SEQ ID NO: 53328 - DNA, 20 bp, Artificial Sequence
  Description of Artificial Sequence: Synthetic oligonucleotide
  Target: SCN9A; (+) strand; PAM type: NRG; PAM sequence: GGG
ctagcttcctccctgaattt

SEQ ID NO: 53329 - DNA, 20 bp, Artificial Sequence
  Description of Artificial Sequence: Synthetic oligonucleotide
  Target: SCN9A; (+) strand; PAM type: NRG; PAM sequence: GAG
agcttcctccctgaatttgg

SEQ ID NO: 53330 - DNA, 20 bp, Artificial Sequence
  Description of Artificial Sequence: Synthetic oligonucleotide
  Target: SCN9A; (+) strand; PAM type: NRG; PAM sequence: TGG
gggagtattctgcactaaaa

SEQ ID NO: 53331 - DNA, 20 bp, Artificial Sequence
  Description of Artificial Sequence: Synthetic oligonucleotide
  Target: SCN9A; (+) strand; PAM type: NRG; PAM sequence: AAG
tcatctgccttgaaacaaca

SEQ ID NO: 53332 - DNA, 20 bp, Artificial Sequence
  Description of Artificial Sequence: Synthetic oligonucleotide
  Target: SCN9A; (+) strand; PAM type: NRG; PAM sequence: TGG
ctgccttgaaacaacaaaga

SEQ ID NO: 53333 - DNA, 20 bp, Artificial Sequence
  Description of Artificial Sequence: Synthetic oligonucleotide
  Target: SCN9A; (+) strand; PAM type: NRG; PAM sequence: GAG
gccttgaaacaacaaagatg

SEQ ID NO: 53334 - DNA, 20 bp, Artificial Sequence
  Description of Artificial Sequence: Synthetic oligonucleotide
  Target: SCN9A; (+) strand; PAM type: NRG; PAM sequence: AAG
ttgaaacaacaaagatggag

SEQ ID NO: 53335 - DNA, 20 bp, Artificial Sequence
  Description of Artificial Sequence: Synthetic oligonucleotide
  Target: SCN9A; (+) strand; PAM type: NRG; PAM sequence: AAG
taccttactgaaatatgaat

SEQ ID NO: 53336 - DNA, 20 bp, Artificial Sequence
  Description of Artificial Sequence: Synthetic oligonucleotide
  Target: SCN9A; (+) strand; PAM type: NRG; PAM sequence: AGG
accttactgaaatatgaata

SEQ ID NO: 53337 - DNA, 20 bp, Artificial Sequence
  Description of Artificial Sequence: Synthetic oligonucleotide
  Target: SCN9A; (+) strand; PAM type: NRG; PAM sequence: TGG
gtctcattctcctgctcctc

SEQ ID NO: 53338 - DNA, 20 bp, Artificial Sequence
  Description of Artificial Sequence: Synthetic oligonucleotide
  Target: SCN9A; (+) strand; PAM type: NRG; PAM sequence: GGG
tctcattctcctgctcctct

SEQ ID NO: 53339 - DNA, 20 bp, Artificial Sequence
  Description of Artificial Sequence: Synthetic oligonucleotide
  Target: SCN9A; (+) strand; PAM type: NRG; PAM sequence: GAG
tcctgctcctctgggctttt

SEQ ID NO: 53340 - DNA, 20 bp, Artificial Sequence
  Description of Artificial Sequence: Synthetic oligonucleotide
  Target: SCN9A; (+) strand; PAM type: NRG; PAM sequence: TGG
ttgagtaacctgtgctgctg

SEQ ID NO: 53341 - DNA, 20 bp, Artificial Sequence
  Description of Artificial Sequence: Synthetic oligonucleotide
  Target: SCN9A; (+) strand; PAM type: NRG; PAM sequence: GGG
tgagtaacctgtgctgctgt

SEQ ID NO: 53342 - DNA, 20 bp, Artificial Sequence
  Description of Artificial Sequence: Synthetic oligonucleotide
  Target: SCN9A; (+) strand; PAM type: NRG; PAM sequence: GAG
agtaacctgtgctgctgtgg

SEQ ID NO: 53343 - DNA, 20 bp, Artificial Sequence
  Description of Artificial Sequence: Synthetic oligonucleotide
  Target: SCN9A; (+) strand; PAM type: NRG; PAM sequence: AGG
gtaacctgtgctgctgtggg

SEQ ID NO: 53344 - DNA, 20 bp, Artificial Sequence
  Description of Artificial Sequence: Synthetic oligonucleotide
  Target: SCN9A; (+) strand; PAM type: NRG; PAM sequence: AAG
ttgtattaccacttcgtgaa

SEQ ID NO: 53345 - DNA, 20 bp, Artificial Sequence
  Description of Artificial Sequence: Synthetic oligonucleotide
  Target: SCN9A; (+) strand; PAM type: NRG; PAM sequence: GAG
gtattaccacttcgtgaaaa

SEQ ID NO: 53346 - DNA, 20 bp, Artificial Sequence
  Description of Artificial Sequence: Synthetic oligonucleotide
  Target: SCN9A; (+) strand; PAM type: NRG; PAM sequence: AAG
acttcgtgaaaagagtaaac

SEQ ID NO: 53347 - DNA, 20 bp, Artificial Sequence
  Description of Artificial Sequence: Synthetic oligonucleotide
  Target: SCN9A; (+) strand; PAM type: NRG; PAM sequence: AAG
cgtgaaaagagtaaacaagc

SEQ ID NO: 53348 - DNA, 20 bp, Artificial Sequence
  Description of Artificial Sequence: Synthetic oligonucleotide
  Target: SCN9A; (+) strand; PAM type: NRG; PAM sequence: AAG
gagtaaacaagcaagaaaac

SEQ ID NO: 53349 - DNA, 20 bp, Artificial Sequence
  Description of Artificial Sequence: Synthetic oligonucleotide
  Target: SCN9A; (+) strand; PAM type: NRG; PAM sequence: GAG
gtaaacaagcaagaaaacaa

SEQ ID NO: 53350 - DNA, 20 bp, Artificial Sequence
  Description of Artificial Sequence: Synthetic oligonucleotide
  Target: SCN9A; (+) strand; PAM type: NRG; PAM sequence: CAG
acaagcaagaaaacaagagt

SEQ ID NO: 53351 - DNA, 20 bp, Artificial Sequence
  Description of Artificial Sequence: Synthetic oligonucleotide
  Target: SCN9A; (+) strand; PAM type: NRG; PAM sequence: AAG
gccttaatcaatttctcaaa

SEQ ID NO: 53352 - DNA, 20 bp, Artificial Sequence
  Description of Artificial Sequence: Synthetic oligonucleotide
  Target: SCN9A; (+) strand; PAM type: NRG; PAM sequence: TAG
tcaatttctcaaaaagacca

SEQ ID NO: 53353 - DNA, 20 bp, Artificial Sequence
  Description of Artificial Sequence: Synthetic oligonucleotide
  Target: SCN9A; (+) strand; PAM type: NRG; PAM sequence: AGG
caatttctcaaaaagaccat

SEQ ID NO: 53354 - DNA, 20 bp, Artificial Sequence
  Description of Artificial Sequence: Synthetic oligonucleotide
  Target: SCN9A; (+) strand; PAM type: NRG; PAM sequence: TAG
cataggccataaaaattgaa

SEQ ID NO: 53355 - DNA, 20 bp, Artificial Sequence
  Description of Artificial Sequence: Synthetic oligonucleotide
  Target: SCN9A; (+) strand; PAM type: NRG; PAM sequence: AAG
aattgaatagatcatcacaa

SEQ ID NO: 53356 - DNA, 20 bp, Artificial Sequence
  Description of Artificial Sequence: Synthetic oligonucleotide
  Target: SCN9A; (+) strand; PAM type: NRG; PAM sequence: TAG
acaaaagtcttctcattatt

SEQ ID NO: 53357 - DNA, 20 bp, Artificial Sequence
  Description of Artificial Sequence: Synthetic oligonucleotide
  Target: SCN9A; (+) strand; PAM type: NRG; PAM sequence: AGG
caaaagtcttctcattattt

SEQ ID NO: 53358 - DNA, 20 bp, Artificial Sequence
  Description of Artificial Sequence: Synthetic oligonucleotide
  Target: SCN9A; (+) strand; PAM type: NRG; PAM sequence: TAG
taactaaattccaaatgcaa

SEQ ID NO: 53359 - DNA, 20 bp, Artificial Sequence
  Description of Artificial Sequence: Synthetic oligonucleotide
  Target: SCN9A; (+) strand; PAM type: NRG; PAM sequence: AAG
aaattccaaatgcaatagca

SEQ ID NO: 53360 - DNA, 20 bp, Artificial Sequence
  Description of Artificial Sequence: Synthetic oligonucleotide
  Target: SCN9A; (+) strand; PAM type: NRG; PAM sequence: TAG
aaatgcaatagcaaagatca

SEQ ID NO: 53361 - DNA, 20 bp, Artificial Sequence
  Description of Artificial Sequence: Synthetic oligonucleotide
  Target: SCN9A; (+) strand; PAM type: NRG; PAM sequence: TAG
aaacttttcttctccctcat

SEQ ID NO: 53362 - DNA, 20 bp, Artificial Sequence
  Description of Artificial Sequence: Synthetic oligonucleotide
  Target: SCN9A; (+) strand; PAM type: NRG; PAM sequence: TGG
ttagtgaacctgttgtaact

SEQ ID NO: 53363 - DNA, 20 bp, Artificial Sequence
  Description of Artificial Sequence: Synthetic oligonucleotide
  Target: SCN9A; (+) strand; PAM type: NRG; PAM sequence: TGG
ggcatttctcatacttgtct

SEQ ID NO: 53364 - DNA, 20 bp, Artificial Sequence
  Description of Artificial Sequence: Synthetic oligonucleotide
  Target: SCN9A; (+) strand; PAM type: NRG; PAM sequence: AAG
ttctcatacttgtcttggaa

SEQ ID NO: 53365 - DNA, 20 bp, Artificial Sequence
  Description of Artificial Sequence: Synthetic oligonucleotide
  Target: SCN9A; (+) strand; PAM type: NRG; PAM sequence: CAG
tgaataccttttatttatct

SEQ ID NO: 53366 - DNA, 20 bp, Artificial Sequence
  Description of Artificial Sequence: Synthetic oligonucleotide
  Target: SCN9A; (+) strand; PAM type: NRG; PAM sequence: AAG
accttttatttatctcagca

SEQ ID NO: 53367 - DNA, 20 bp, Artificial Sequence
  Description of Artificial Sequence: Synthetic oligonucleotide
  Target: SCN9A; (+) strand; PAM type: NRG; PAM sequence: AAG
tttatttatctcagcaaagt

SEQ ID NO: 53368 - DNA, 20 bp, Artificial Sequence
  Description of Artificial Sequence: Synthetic oligonucleotide
  Target: SCN9A; (+) strand; PAM type: NRG; PAM sequence: CAG
taaaacaactcaatactgtc

SEQ ID NO: 53369 - DNA, 20 bp, Artificial Sequence
  Description of Artificial Sequence: Synthetic oligonucleotide
  Target: SCN9A; (+) strand; PAM type: NRG; PAM sequence: TAG
aacaactcaatactgtccag

SEQ ID NO: 53370 - DNA, 20 bp, Artificial Sequence
  Description of Artificial Sequence: Synthetic oligonucleotide
  Target: SCN9A; (+) strand; PAM type: NRG; PAM sequence: AAG
aaaatgtattaaacttctta

SEQ ID NO: 53371 - DNA, 20 bp, Artificial Sequence
  Description of Artificial Sequence: Synthetic oligonucleotide
  Target: SCN9A; (+) strand; PAM type: NRG; PAM sequence: GAG
tcttaaagtacataatactt

SEQ ID NO: 53372 - DNA, 20 bp, Artificial Sequence
  Description of Artificial Sequence: Synthetic oligonucleotide
  Target: SCN9A; (+) strand; PAM type: NRG; PAM sequence: AAG
acataatacttgagccgtca

SEQ ID NO: 53373 - DNA, 20 bp, Artificial Sequence
  Description of Artificial Sequence: Synthetic oligonucleotide
  Target: SCN9A; (+) strand; PAM type: NRG; PAM sequence: CAG
cttgagccgtcaaagacaca

SEQ ID NO: 53374 - DNA, 20 bp, Artificial Sequence
  Description of Artificial Sequence: Synthetic oligonucleotide
  Target: SCN9A; (+) strand; PAM type: NRG; PAM sequence: TGG
agccgtcaaagacacacaga

SEQ ID NO: 53375 - DNA, 20 bp, Artificial Sequence
  Description of Artificial Sequence: Synthetic oligonucleotide
  Target: SCN9A; (+) strand; PAM type: NRG; PAM sequence: GGG
gccgtcaaagacacacagat

SEQ ID NO: 53376 - DNA, 20 bp, Artificial Sequence
  Description of Artificial Sequence: Synthetic oligonucleotide
  Target: SCN9A; (+) strand; PAM type: NRG; PAM sequence: TAG
aagacacacagatgggcctc

SEQ ID NO: 53377 - DNA, 20 bp, Artificial Sequence
  Description of Artificial Sequence: Synthetic oligonucleotide
  Target: SCN9A; (+) strand; PAM type: NRG; PAM sequence: AGG
agacacacagatgggcctct

SEQ ID NO: 53378 - DNA, 20 bp, Artificial Sequence
  Description of Artificial Sequence: Synthetic oligonucleotide
  Target: SCN9A; (+) strand; PAM type: NRG; PAM sequence: GGG
gacacacagatgggcctcta

SEQ ID NO: 53379 - DNA, 20 bp, Artificial Sequence
  Description of Artificial Sequence: Synthetic oligonucleotide
  Target: SCN9A; (+) strand; PAM type: NRG; PAM sequence: GGG
acacacagatgggcctctag

SEQ ID NO: 53380 - DNA, 20 bp, Artificial Sequence
  Description of Artificial Sequence: Synthetic oligonucleotide
  Target: SCN9A; (+) strand; PAM type: NRG; PAM sequence: GAG
gcatttctcctaataaatgt

SEQ ID NO: 53381 - DNA, 20 bp, Artificial Sequence
  Description of Artificial Sequence: Synthetic oligonucleotide
  Target: SCN9A; (+) strand; PAM type: NRG; PAM sequence: AAG
aaatgtgagatgctctgctc

SEQ ID NO: 53382 - DNA, 20 bp, Artificial Sequence
  Description of Artificial Sequence: Synthetic oligonucleotide
  Target: SCN9A; (+) strand; PAM type: NRG; PAM sequence: TGG
gtgagatgctctgctcaagc

SEQ ID NO: 53383 - DNA, 20 bp, Artificial Sequence
  Description of Artificial Sequence: Synthetic oligonucleotide
  Target: SCN9A; (+) strand; PAM type: NRG; PAM sequence: GGG
tgagatgctctgctcaagct

SEQ ID NO: 53384 - DNA, 20 bp, Artificial Sequence
  Description of Artificial Sequence: Synthetic oligonucleotide
  Target: SCN9A; (+) strand; PAM type: NRG; PAM sequence: AAG
tatgtatctcctgtttgtga

SEQ ID NO: 53385 - DNA, 20 bp, Artificial Sequence
  Description of Artificial Sequence: Synthetic oligonucleotide
  Target: SCN9A; (+) strand; PAM type: NRG; PAM sequence: TGG
tctcctgtttgtgaaagata

SEQ ID NO: 53386 - DNA, 20 bp, Artificial Sequence
  Description of Artificial Sequence: Synthetic oligonucleotide
  Target: SCN9A; (+) strand; PAM type: NRG; PAM sequence: CAG
tgtttgtgaaagatatggtt

SEQ ID NO: 53387 - DNA, 20 bp, Artificial Sequence
  Description of Artificial Sequence: Synthetic oligonucleotide
  Target: SCN9A; (+) strand; PAM type: NRG; PAM sequence: AAG
gctaccctgacaacaaaacc

SEQ ID NO: 53388 - DNA, 20 bp, Artificial Sequence
  Description of Artificial Sequence: Synthetic oligonucleotide
  Target: SCN9A; (+) strand; PAM type: NRG; PAM sequence: TAG
gacaacaaaaccaagcacat

SEQ ID NO: 53389 - DNA, 20 bp, Artificial Sequence
  Description of Artificial Sequence: Synthetic oligonucleotide
  Target: SCN9A; (+) strand; PAM type: NRG; PAM sequence: AAG
accaagcacattagtgacct

SEQ ID NO: 53390 - DNA, 20 bp, Artificial Sequence
  Description of Artificial Sequence: Synthetic oligonucleotide
  Target: SCN9A; (+) strand; PAM type: NRG; PAM sequence: AGG
ccaagcacattagtgaccta

SEQ ID NO: 53391 - DNA, 20 bp, Artificial Sequence
  Description of Artificial Sequence: Synthetic oligonucleotide
  Target: SCN9A; (+) strand; PAM type: NRG; PAM sequence: GGG
caagcacattagtgacctaa

SEQ ID NO: 53392 - DNA, 20 bp, Artificial Sequence
  Description of Artificial Sequence: Synthetic oligonucleotide
  Target: SCN9A; (+) strand; PAM type: NRG; PAM sequence: CAG
attagtgacctaagggactg

SEQ ID NO: 53393 - DNA, 20 bp, Artificial Sequence
  Description of Artificial Sequence: Synthetic oligonucleotide
  Target: SCN9A; (+) strand; PAM type: NRG; PAM sequence: GAG
tagtgacctaagggactgca

SEQ ID NO: 53394 - DNA, 20 bp, Artificial Sequence
  Description of Artificial Sequence: Synthetic oligonucleotide
  Target: SCN9A; (+) strand; PAM type: NRG; PAM sequence: AAG
ctgctattgtttgacaccaa

SEQ ID NO: 53395 - DNA, 20 bp, Artificial Sequence
  Description of Artificial Sequence: Synthetic oligonucleotide
  Target: SCN9A; (+) strand; PAM type: NRG; PAM sequence: AGG
tgctattgtttgacaccaaa

SEQ ID NO: 53396 - DNA, 20 bp, Artificial Sequence
  Description of Artificial Sequence: Synthetic oligonucleotide
  Target: SCN9A; (+) strand; PAM type: NRG; PAM sequence: TGG
tgtttgacaccaaaaggaat

SEQ ID NO: 53397 - DNA, 20 bp, Artificial Sequence
  Description of Artificial Sequence: Synthetic oligonucleotide
  Target: SCN9A; (+) strand; PAM type: NRG; PAM sequence: TGG
aattggaaacttactaaata

SEQ ID NO: 53398 - DNA, 20 bp, Artificial Sequence
  Description of Artificial Sequence: Synthetic oligonucleotide
  Target: SCN9A; (+) strand; PAM type: NRG; PAM sequence: GAG
ttggaaacttactaaatatg

SEQ ID NO: 53399 - DNA, 20 bp, Artificial Sequence
  Description of Artificial Sequence: Synthetic oligonucleotide
  Target: SCN9A; (+) strand; PAM type: NRG; PAM sequence: CAG
gaaacttactaaatatggag

SEQ ID NO: 53400 - DNA, 20 bp, Artificial Sequence
  Description of Artificial Sequence: Synthetic oligonucleotide
  Target: SCN9A; (+) strand; PAM type: NRG; PAM sequence: AGG
aaacttactaaatatggagc

SEQ ID NO: 53401 - DNA, 20 bp, Artificial Sequence
  Description of Artificial Sequence: Synthetic oligonucleotide
  Target: SCN9A; (+) strand; PAM type: NRG; PAM sequence: CAG
tactaaatatggagcaggtg

SEQ ID NO: 53402 - DNA, 20 bp, Artificial Sequence
  Description of Artificial Sequence: Synthetic oligonucleotide
  Target: SCN9A; (+) strand; PAM type: NRG; PAM sequence: GAG
ctaaatatggagcaggtgca

SEQ ID NO: 53403 - DNA, 20 bp, Artificial Sequence
  Description of Artificial Sequence: Synthetic oligonucleotide
  Target: SCN9A; (+) strand; PAM type: NRG; PAM sequence: AAG
acctatcattgttctctcta

SEQ ID NO: 53404 - DNA, 20 bp, Artificial Sequence
  Description of Artificial Sequence: Synthetic oligonucleotide
  Target: SCN9A; (+) strand; PAM type: NRG; PAM sequence: TGG
tcattgttctctctaaagcg

SEQ ID NO: 53405 - DNA, 20 bp, Artificial Sequence
  Description of Artificial Sequence: Synthetic oligonucleotide
  Target: SCN9A; (+) strand; PAM type: NRG; PAM sequence: GGG
cattgttctctctaaagcgt

SEQ ID NO: 53406 - DNA, 20 bp, Artificial Sequence
  Description of Artificial Sequence: Synthetic oligonucleotide
  Target: SCN9A; (+) strand; PAM type: NRG; PAM sequence: CAG
ttctctctaaagcgtgggtt

SEQ ID NO: 53407 - DNA, 20 bp, Artificial Sequence
  Description of Artificial Sequence: Synthetic oligonucleotide
  Target: SCN9A; (+) strand; PAM type: NRG; PAM sequence: AGG
tctctctaaagcgtgggttc

SEQ ID NO: 53408 - DNA, 20 bp, Artificial Sequence
  Description of Artificial Sequence: Synthetic oligonucleotide
  Target: SCN9A; (+) strand; PAM type: NRG; PAM sequence: TGG
ctctaaagcgtgggttcagg

SEQ ID NO: 53409 - DNA, 20 bp, Artificial Sequence
  Description of Artificial Sequence: Synthetic oligonucleotide
  Target: SCN9A; (+) strand; PAM type: NRG; PAM sequence: GGG
tctaaagcgtgggttcaggt

SEQ ID NO: 53410 - DNA, 20 bp, Artificial Sequence
  Description of Artificial Sequence: Synthetic oligonucleotide
  Target: SCN9A; (+) strand; PAM type: NRG; PAM sequence: AAG
cgtgggttcaggtgggaatc

SEQ ID NO: 53411 - DNA, 20 bp, Artificial Sequence
  Description of Artificial Sequence: Synthetic oligonucleotide
  Target: SCN9A; (+) strand; PAM type: NRG; PAM sequence: AAG
tgggaatcaagctcattgaa

SEQ ID NO: 53412 - DNA, 20 bp, Artificial Sequence
  Description of Artificial Sequence: Synthetic oligonucleotide
  Target: SCN9A; (+) strand; PAM type: NRG; PAM sequence: AAG
gaaaagtatatgatatataa

SEQ ID NO: 53413 - DNA, 20 bp, Artificial Sequence
  Description of Artificial Sequence: Synthetic oligonucleotide
  Target: SCN9A; (+) strand; PAM type: NRG; PAM sequence: AAG
atatataaaagtacataata

SEQ ID NO: 53414 - DNA, 20 bp, Artificial Sequence
  Description of Artificial Sequence: Synthetic oligonucleotide
  Target: SCN9A; (+) strand; PAM type: NRG; PAM sequence: TAG
ataaagtatgtaatttgtga

SEQ ID NO: 53415 - DNA, 20 bp, Artificial Sequence
  Description of Artificial Sequence: Synthetic oligonucleotide
  Target: SCN9A; (+) strand; PAM type: NRG; PAM sequence: TAG
aagtatgtaatttgtgatag

SEQ ID NO: 53416 - DNA, 20 bp, Artificial Sequence
  Description of Artificial Sequence: Synthetic oligonucleotide
  Target: SCN9A; (+) strand; PAM type: NRG; PAM sequence: AGG
agtatgtaatttgtgatagt

SEQ ID NO: 53417 - DNA, 20 bp, Artificial Sequence
  Description of Artificial Sequence: Synthetic oligonucleotide
  Target: SCN9A; (+) strand; PAM type: NRG; PAM sequence: AAG
aatttgtgatagtaggtgaa

SEQ ID NO: 53418 - DNA, 20 bp, Artificial Sequence
  Description of Artificial Sequence: Synthetic oligonucleotide
  Target: SCN9A; (+) strand; PAM type: NRG; PAM sequence: CAG
tgtgatagtaggtgaaaagc

SEQ ID NO: 53419 - DNA, 20 bp, Artificial Sequence
  Description of Artificial Sequence: Synthetic oligonucleotide
  Target: SCN9A; (+) strand; PAM type: NRG; PAM sequence: AGG
gtgatagtaggtgaaaagcc

SEQ ID NO: 53420 - DNA, 20 bp, Artificial Sequence
  Description of Artificial Sequence: Synthetic oligonucleotide
  Target: SCN9A; (+) strand; PAM type: NRG; PAM sequence: GAG
gatagtaggtgaaaagccag

SEQ ID NO: 53421 - DNA, 20 bp, Artificial Sequence
  Description of Artificial Sequence: Synthetic oligonucleotide
  Target: SCN9A; (+) strand; PAM type: NRG; PAM sequence: GAG
tagtaggtgaaaagccagga

SEQ ID NO: 53422 - DNA, 20 bp, Artificial Sequence
  Description of Artificial Sequence: Synthetic oligonucleotide
  Target: SCN9A; (+) strand; PAM type: NRG; PAM sequence: AGG
agtaggtgaaaagccaggag

SEQ ID NO: 53423 - DNA, 20 bp, Artificial Sequence
  Description of Artificial Sequence: Synthetic oligonucleotide
  Target: SCN9A; (+) strand; PAM type: NRG; PAM sequence: CAG
aaaagccaggagaggaacat

SEQ ID NO: 53424 - DNA, 20 bp, Artificial Sequence
  Description of Artificial Sequence: Synthetic oligonucleotide
  Target: SCN9A; (+) strand; PAM type: NRG; PAM sequence: AAG
gccaggagaggaacatcaga

SEQ ID NO: 53425 - DNA, 20 bp, Artificial Sequence
  Description of Artificial Sequence: Synthetic oligonucleotide
  Target: SCN9A; (+) strand; PAM type: NRG; PAM sequence: CAG
atcagaaagacacaaaaata

SEQ ID NO: 53426 - DNA, 20 bp, Artificial Sequence
  Description of Artificial Sequence: Synthetic oligonucleotide
  Target: SCN9A; (+) strand; PAM type: NRG; PAM sequence: CAG
gacacaaaaatacagaaaaa

SEQ ID NO: 53427 - DNA, 20 bp, Artificial Sequence
  Description of Artificial Sequence: Synthetic oligonucleotide
  Target: SCN9A; (+) strand; PAM type: NRG; PAM sequence: TAG
aaaaacagacatttgcacaa

SEQ ID NO: 53428 - DNA, 20 bp, Artificial Sequence
  Description of Artificial Sequence: Synthetic oligonucleotide
  Target: SCN9A; (+) strand; PAM type: NRG; PAM sequence: GAG
gacatttgcacaatagtttt

SEQ ID NO: 53429 - DNA, 20 bp, Artificial Sequence
  Description of Artificial Sequence: Synthetic oligonucleotide
  Target: SCN9A; (+) strand; PAM type: NRG; PAM sequence: AAG
ttgcacaatagttttgagaa

SEQ ID NO: 53430 - DNA, 20 bp, Artificial Sequence
  Description of Artificial Sequence: Synthetic oligonucleotide
  Target: SCN9A; (+) strand; PAM type: NRG; PAM sequence: TAG
aaattgtttgaacctcacac

SEQ ID NO: 53431 - DNA, 20 bp, Artificial Sequence
  Description of Artificial Sequence: Synthetic oligonucleotide
  Target: SCN9A; (+) strand; PAM type: NRG; PAM sequence: CAG
tgtttgaacctcacactaga

SEQ ID NO: 53432 - DNA, 20 bp, Artificial Sequence
  Description of Artificial Sequence: Synthetic oligonucleotide
  Target: SCN9A; (+) strand; PAM type: NRG; PAM sequence: AAG
tcacactagacagaactctg

SEQ ID NO: 53433 - DNA, 20 bp, Artificial Sequence
  Description of Artificial Sequence: Synthetic oligonucleotide
  Target: SCN9A; (+) strand; PAM type: NRG; PAM sequence: GAG
acactagacagaactctgaa

SEQ ID NO: 53434 - DNA, 20 bp, Artificial Sequence
  Description of Artificial Sequence: Synthetic oligonucleotide
  Target: SCN9A; (+) strand; PAM type: NRG; PAM sequence: TGG
tagacagaactctgaagaga

SEQ ID NO: 53435 - DNA, 20 bp, Artificial Sequence
  Description of Artificial Sequence: Synthetic oligonucleotide
  Target: SCN9A; (+) strand; PAM type: NRG; PAM sequence: TAG
tttcaaatgaaaaaataaaa

SEQ ID NO: 53436 - DNA, 20 bp, Artificial Sequence
  Description of Artificial Sequence: Synthetic oligonucleotide
  Target: SCN9A; (+) strand; PAM type: NRG; PAM sequence: AGG
ttcaaatgaaaaaataaaat

SEQ ID NO: 53437 - DNA, 20 bp, Artificial Sequence
  Description of Artificial Sequence: Synthetic oligonucleotide
  Target: SCN9A; (+) strand; PAM type: NRG; PAM sequence: GGG
tcaaatgaaaaaataaaata

SEQ ID NO: 53438 - DNA, 20 bp, Artificial Sequence
  Description of Artificial Sequence: Synthetic oligonucleotide
  Target: SCN9A; (+) strand; PAM type: NRG; PAM sequence: TGG
gaaaaaataaaatagggaat

SEQ ID NO: 53439 - DNA, 20 bp, Artificial Sequence
  Description of Artificial Sequence: Synthetic oligonucleotide
  Target: SCN9A; (+) strand; PAM type: NRG; PAM sequence: GGG
aaaaaataaaatagggaatt

SEQ ID NO: 53440 - DNA, 20 bp, Artificial Sequence
  Description of Artificial Sequence: Synthetic oligonucleotide
  Target: SCN9A; (+) strand; PAM type: NRG; PAM sequence: TGG
ataaaatagggaattgggac

SEQ ID NO: 53441 - DNA, 20 bp, Artificial Sequence
  Description of Artificial Sequence: Synthetic oligonucleotide
  Target: SCN9A; (+) strand; PAM type: NRG; PAM sequence: GGG
taaaatagggaattgggact

SEQ ID NO: 53442 - DNA, 20 bp, Artificial Sequence
  Description of Artificial Sequence: Synthetic oligonucleotide
  Target: SCN9A; (+) strand; PAM type: NRG; PAM sequence: GAG
aaatagggaattgggactgg

SEQ ID NO: 53443 - DNA, 20 bp, Artificial Sequence
  Description of Artificial Sequence: Synthetic oligonucleotide
  Target: SCN9A; (+) strand; PAM type: NRG; PAM sequence: GAG
agggaattgggactgggagt

SEQ ID NO: 53444 - DNA, 20 bp, Artificial Sequence
  Description of Artificial Sequence: Synthetic oligonucleotide
  Target: SCN9A; (+) strand; PAM type: NRG; PAM sequence: TAG
tccactttttaaaatatttt

SEQ ID NO: 53445 - DNA, 20 bp, Artificial Sequence
  Description of Artificial Sequence: Synthetic oligonucleotide
  Target: SCN9A; (+) strand; PAM type: NRG; PAM sequence: CAG
taaaatatttttagttatta

SEQ ID NO: 53446 - DNA, 20 bp, Artificial Sequence
  Description of Artificial Sequence: Synthetic oligonucleotide
  Target: SCN9A; (+) strand; PAM type: NRG; PAM sequence: AAG
tacagtgatgctgaactaat

SEQ ID NO: 53447 - DNA, 20 bp, Artificial Sequence
  Description of Artificial Sequence: Synthetic oligonucleotide
  Target: SCN9A; (+) strand; PAM type: NRG; PAM sequence: TGG
tgatgctgaactaataagaa

SEQ ID NO: 53448 - DNA, 20 bp, Artificial Sequence
  Description of Artificial Sequence: Synthetic oligonucleotide
  Target: SCN9A; (+) strand; PAM type: NRG; PAM sequence: TAG
gaactaataagaatggtgtt

SEQ ID NO: 53449 - DNA, 20 bp, Artificial Sequence
  Description of Artificial Sequence: Synthetic oligonucleotide
  Target: SCN9A; (+) strand; PAM type: NRG; PAM sequence: GAG
actaataagaatggtgttta

SEQ ID NO: 53450 - DNA, 20 bp, Artificial Sequence
  Description of Artificial Sequence: Synthetic oligonucleotide
  Target: SCN9A; (+) strand; PAM type: NRG; PAM sequence: GAG
taataagaatggtgtttaga

SEQ ID NO: 53451 - DNA, 20 bp, Artificial Sequence
  Description of Artificial Sequence: Synthetic oligonucleotide
  Target: SCN9A; (+) strand; PAM type: NRG; PAM sequence: AAG
atggtgtttagagagaacat

SEQ ID NO: 53452 - DNA, 20 bp, Artificial Sequence
  Description of Artificial Sequence: Synthetic oligonucleotide
  Target: SCN9A; (+) strand; PAM type: NRG; PAM sequence: AAG
gtgtttagagagaacataag

SEQ ID NO: 53453 - DNA, 20 bp, Artificial Sequence
  Description of Artificial Sequence: Synthetic oligonucleotide
  Target: SCN9A; (+) strand; PAM type: NRG; PAM sequence: GAG
gtttagagagaacataagaa

SEQ ID NO: 53454 - DNA, 20 bp, Artificial Sequence
  Description of Artificial Sequence: Synthetic oligonucleotide
  Target: SCN9A; (+) strand; PAM type: NRG; PAM sequence: GAG
aacataagaagagtaaattt

SEQ ID NO: 53455 - DNA, 20 bp, Artificial Sequence
  Description of Artificial Sequence: Synthetic oligonucleotide
  Target: SCN9A; (+) strand; PAM type: NRG; PAM sequence: GAG
cataagaagagtaaatttga

SEQ ID NO: 53456 - DNA, 20 bp, Artificial Sequence
  Description of Artificial Sequence: Synthetic oligonucleotide
  Target: SCN9A; (+) strand; PAM type: NRG; PAM sequence: TAG
gagagtctgtctaaaatctt

SEQ ID NO: 53457 - DNA, 20 bp, Artificial Sequence
  Description of Artificial Sequence: Synthetic oligonucleotide
  Target: SCN9A; (+) strand; PAM type: NRG; PAM sequence: AGG
agagtctgtctaaaatcttt

SEQ ID NO: 53458 - DNA, 20 bp, Artificial Sequence
  Description of Artificial Sequence: Synthetic oligonucleotide
  Target: SCN9A; (+) strand; PAM type: NRG; PAM sequence: TGG
tgtctaaaatctttaggcac

SEQ ID NO: 53459 - DNA, 20 bp, Artificial Sequence
  Description of Artificial Sequence: Synthetic oligonucleotide
  Target: SCN9A; (+) strand; PAM type: NRG; PAM sequence: TAG
catcactcttgccgtcttta

SEQ ID NO: 53460 - DNA, 20 bp, Artificial Sequence
  Description of Artificial Sequence: Synthetic oligonucleotide
  Target: SCN9A; (+) strand; PAM type: NRG; PAM sequence: TGG
tctttcttcttattctcctt

SEQ ID NO: 53461 - DNA, 20 bp, Artificial Sequence
  Description of Artificial Sequence: Synthetic oligonucleotide
  Target: SCN9A; (+) strand; PAM type: NRG; PAM sequence: GGG
ctttcttcttattctccttt

SEQ ID NO: 53462 - DNA, 20 bp, Artificial Sequence
  Description of Artificial Sequence: Synthetic oligonucleotide
  Target: SCN9A; (+) strand; PAM type: NRG; PAM sequence: GAG
ttgggatcttttattttttt

SEQ ID NO: 53463 - DNA, 20 bp, Artificial Sequence
  Description of Artificial Sequence: Synthetic oligonucleotide
  Target: SCN9A; (+) strand; PAM type: NRG; PAM sequence: TGG
ccaattacacctacaacttc

SEQ ID NO: 53464 - DNA, 20 bp, Artificial Sequence
  Description of Artificial Sequence: Synthetic oligonucleotide
  Target: SCN9A; (+) strand; PAM type: NRG; PAM sequence: TAG
aaaaatataaaatactttaa

SEQ ID NO: 53465 - DNA, 20 bp, Artificial Sequence
  Description of Artificial Sequence: Synthetic oligonucleotide
  Target: SCN9A; (+) strand; PAM type: NRG; PAM sequence: AGG
aaaatataaaatactttaat

SEQ ID NO: 53466 - DNA, 20 bp, Artificial Sequence
  Description of Artificial Sequence: Synthetic oligonucleotide
  Target: SCN9A; (+) strand; PAM type: NRG; PAM sequence: AAG
aaatactttaataggacatc

SEQ ID NO: 53467 - DNA, 20 bp, Artificial Sequence
  Description of Artificial Sequence: Synthetic oligonucleotide
  Target: SCN9A; (+) strand; PAM type: NRG; PAM sequence: CAG
aggacatcaagtaattattt

SEQ ID NO: 53468 - DNA, 20 bp, Artificial Sequence
  Description of Artificial Sequence: Synthetic oligonucleotide
  Target: SCN9A; (+) strand; PAM type: NRG; PAM sequence: CAG
caagtaattatttcagaata

SEQ ID NO: 53469 - DNA, 20 bp, Artificial Sequence
  Description of Artificial Sequence: Synthetic oligonucleotide
  Target: SCN9A; (+) strand; PAM type: NRG; PAM sequence: TAG
tacagatgaaaataatttca

SEQ ID NO: 53470 - DNA, 20 bp, Artificial Sequence
  Description of Artificial Sequence: Synthetic oligonucleotide
  Target: SCN9A; (+) strand; PAM type: NRG; PAM sequence: CAG
tcatagcattgtcctaaatc

SEQ ID NO: 53471 - DNA, 20 bp, Artificial Sequence
  Description of Artificial Sequence: Synthetic oligonucleotide
  Target: SCN9A; (+) strand; PAM type: NRG; PAM sequence: GAG
atagcattgtcctaaatcca

SEQ ID NO: 53472 - DNA, 20 bp, Artificial Sequence
  Description of Artificial Sequence: Synthetic oligonucleotide
  Target: SCN9A; (+) strand; PAM type: NRG; PAM sequence: AGG
tagcattgtcctaaatccag

SEQ ID NO: 53473 - DNA, 20 bp, Artificial Sequence
  Description of Artificial Sequence: Synthetic oligonucleotide
  Target: SCN9A; (+) strand; PAM type: NRG; PAM sequence: GGG
agcattgtcctaaatccaga

SEQ ID NO: 53474 - DNA, 20 bp, Artificial Sequence
  Description of Artificial Sequence: Synthetic oligonucleotide
  Target: SCN9A; (+) strand; PAM type: NRG; PAM sequence: TAG
ggttcatgaatcattgctct

SEQ ID NO: 53475 - DNA, 20 bp, Artificial Sequence
  Description of Artificial Sequence: Synthetic oligonucleotide
  Target: SCN9A; (+) strand; PAM type: NRG; PAM sequence: AAG
catgaatcattgctcttaga

SEQ ID NO: 53476 - DNA, 20 bp, Artificial Sequence
  Description of Artificial Sequence: Synthetic oligonucleotide
  Target: SCN9A; (+) strand; PAM type: NRG; PAM sequence: CAG
cttagaaagctcttgacacc

SEQ ID NO: 53477 - DNA, 20 bp, Artificial Sequence
  Description of Artificial Sequence: Synthetic oligonucleotide
  Target: SCN9A; (+) strand; PAM type: NRG; PAM sequence: AGG
ttagaaagctcttgacaccc

SEQ ID NO: 53478 - DNA, 20 bp, Artificial Sequence
  Description of Artificial Sequence: Synthetic oligonucleotide
  Target: SCN9A; (+) strand; PAM type: NRG; PAM sequence: GGG
tagaaagctcttgacaccca

SEQ ID NO: 53479 - DNA, 20 bp, Artificial Sequence
  Description of Artificial Sequence: Synthetic oligonucleotide
  Target: SCN9A; (+) strand; PAM type: NRG; PAM sequence: GGG
agaaagctcttgacacccag

SEQ ID NO: 53480 - DNA, 20 bp, Artificial Sequence
  Description of Artificial Sequence: Synthetic oligonucleotide
  Target: SCN9A; (+) strand; PAM type: NRG; PAM sequence: TAG
agctcttgacacccagggga

SEQ ID NO: 53481 - DNA, 20 bp, Artificial Sequence
  Description of Artificial Sequence: Synthetic oligonucleotide
  Target: SCN9A; (+) strand; PAM type: NRG; PAM sequence: AGG
gctcttgacacccaggggat

SEQ ID NO: 53482 - DNA, 20 bp, Artificial Sequence
  Description of Artificial Sequence: Synthetic oligonucleotide
  Target: SCN9A; (+) strand; PAM type: NRG; PAM sequence: CAG
ccaggggataggttttcatg

SEQ ID NO: 53483 - DNA, 20 bp, Artificial Sequence
  Description of Artificial Sequence: Synthetic oligonucleotide
  Target: SCN9A; (+) strand; PAM type: NRG; PAM sequence: TGG
tttcatgcagaaaatcaccc

SEQ ID NO: 53484 - DNA, 20 bp, Artificial Sequence
  Description of Artificial Sequence: Synthetic oligonucleotide
  Target: SCN9A; (+) strand; PAM type: NRG; PAM sequence: GGG
ttcatgcagaaaatcaccct

SEQ ID NO: 53485 - DNA, 20 bp, Artificial Sequence
  Description of Artificial Sequence: Synthetic oligonucleotide
  Target: SCN9A; (+) strand; PAM type: NRG; PAM sequence: GAG
catgcagaaaatcaccctgg

SEQ ID NO: 53486 - DNA, 20 bp, Artificial Sequence
  Description of Artificial Sequence: Synthetic oligonucleotide
  Target: SCN9A; (+) strand; PAM type: NRG; PAM sequence: TAG
ccctgggagatcaacatgcc

SEQ ID NO: 53487 - DNA, 20 bp, Artificial Sequence
  Description of Artificial Sequence: Synthetic oligonucleotide
  Target: SCN9A; (+) strand; PAM type: NRG; PAM sequence: TGG
tgggagatcaacatgcctag

SEQ ID NO: 53488 - DNA, 20 bp, Artificial Sequence
  Description of Artificial Sequence: Synthetic oligonucleotide
  Target: SCN9A; (+) strand; PAM type: NRG; PAM sequence: AAG
ggttgatgtacctcatgtac

SEQ ID NO: 53489 - DNA, 20 bp, Artificial Sequence
  Description of Artificial Sequence: Synthetic oligonucleotide
  Target: SCN9A; (+) strand; PAM type: NRG; PAM sequence: TAG
tgtgtttgtttctcctgact

SEQ ID NO: 53490 - DNA, 20 bp, Artificial Sequence
  Description of Artificial Sequence: Synthetic oligonucleotide
  Target: SCN9A; (+) strand; PAM type: NRG; PAM sequence: AAG
ttgtttctcctgacttagta

SEQ ID NO: 53491 - DNA, 20 bp, Artificial Sequence
  Description of Artificial Sequence: Synthetic oligonucleotide
  Target: SCN9A; (+) strand; PAM type: NRG; PAM sequence: GAG
gtttctcctgacttagtaaa

SEQ ID NO: 53492 - DNA, 20 bp, Artificial Sequence
  Description of Artificial Sequence: Synthetic oligonucleotide
  Target: SCN9A; (+) strand; PAM type: NRG; PAM sequence: AAG
gacttagtaaagagctattt

SEQ ID NO: 53493 - DNA, 20 bp, Artificial Sequence
  Description of Artificial Sequence: Synthetic oligonucleotide
  Target: SCN9A; (+) strand; PAM type: NRG; PAM sequence: TGG
ttagtaaagagctatttaag

SEQ ID NO: 53494 - DNA, 20 bp, Artificial Sequence
  Description of Artificial Sequence: Synthetic oligonucleotide
  Target: SCN9A; (+) strand; PAM type: NRG; PAM sequence: TGG
gagctatttaagtggacccc

SEQ ID NO: 53495 - DNA, 20 bp, Artificial Sequence
  Description of Artificial Sequence: Synthetic oligonucleotide
  Target: SCN9A; (+) strand; PAM type: NRG; PAM sequence: TGG
tatttaagtggacccctggt

SEQ ID NO: 53496 - DNA, 20 bp, Artificial Sequence
  Description of Artificial Sequence: Synthetic oligonucleotide
  Target: SCN9A; (+) strand; PAM type: NRG; PAM sequence: GGG
atttaagtggacccctggtt

SEQ ID NO: 53497 - DNA, 20 bp, Artificial Sequence
  Description of Artificial Sequence: Synthetic oligonucleotide
  Target: SCN9A; (+) strand; PAM type: NRG; PAM sequence: GGG
tttaagtggacccctggttg

SEQ ID NO: 53498 - DNA, 20 bp, Artificial Sequence
  Description of Artificial Sequence: Synthetic oligonucleotide
  Target: SCN9A; (+) strand; PAM type: NRG; PAM sequence: GAG
taagtggacccctggttggg

SEQ ID NO: 53499 - DNA, 20 bp, Artificial Sequence
  Description of Artificial Sequence: Synthetic oligonucleotide
  Target: SCN9A; (+) strand; PAM type: NRG; PAM sequence: AGG
aagtggacccctggttgggg

SEQ ID NO: 53500 - DNA, 20 bp, Artificial Sequence
  Description of Artificial Sequence: Synthetic oligonucleotide
  Target: SCN9A; (+) strand; PAM type: NRG; PAM sequence: AAG
ggacccctggttggggagga

SEQ ID NO: 53501 - DNA, 20 bp, Artificial Sequence
  Description of Artificial Sequence: Synthetic oligonucleotide
  Target: SCN9A; (+) strand; PAM type: NRG; PAM sequence: GAG
tggttggggaggaaagcctt

SEQ ID NO: 53502 - DNA, 20 bp, Artificial Sequence
  Description of Artificial Sequence: Synthetic oligonucleotide
  Target: SCN9A; (+) strand; PAM type: NRG; PAM sequence: TAG
gccttgagttctgtgctatt

SEQ ID NO: 53503 - DNA, 20 bp, Artificial Sequence
  Description of Artificial Sequence: Synthetic oligonucleotide
  Target: SCN9A; (+) strand; PAM type: NRG; PAM sequence: TGG
taatgttcacaacacacctg

SEQ ID NO: 53504 - DNA, 20 bp, Artificial Sequence
  Description of Artificial Sequence: Synthetic oligonucleotide
  Target: SCN9A; (+) strand; PAM type: NRG; PAM sequence: GAG
actattccatcatttttcct

SEQ ID NO: 53505 - DNA, 20 bp, Artificial Sequence
  Description of Artificial Sequence: Synthetic oligonucleotide
  Target: SCN9A; (+) strand; PAM type: NRG; PAM sequence: AAG
tcctgagtaataaacacatt

SEQ ID NO: 53506 - DNA, 20 bp, Artificial Sequence
  Description of Artificial Sequence: Synthetic oligonucleotide
  Target: SCN9A; (+) strand; PAM type: NRG; PAM sequence: AAG
acacattaagactttatatg

SEQ ID NO: 53507 - DNA, 20 bp, Artificial Sequence
  Description of Artificial Sequence: Synthetic oligonucleotide
  Target: SCN9A; (+) strand; PAM type: NRG; PAM sequence: CGG
gtaatcaataaatgatgaca

SEQ ID NO: 53508 - DNA, 20 bp, Artificial Sequence
  Description of Artificial Sequence: Synthetic oligonucleotide
  Target: SCN9A; (+) strand; PAM type: NRG; PAM sequence: CAG
gatgacacggaaaacaaatc

SEQ ID NO: 53509 - DNA, 20 bp, Artificial Sequence
  Description of Artificial Sequence: Synthetic oligonucleotide
  Target: SCN9A; (+) strand; PAM type: NRG; PAM sequence: AGG
atgacacggaaaacaaatcc

SEQ ID NO: 53510 - DNA, 20 bp, Artificial Sequence
  Description of Artificial Sequence: Synthetic oligonucleotide
  Target: SCN9A; (+) strand; PAM type: NRG; PAM sequence: AAG
acacggaaaacaaatccagg

SEQ ID NO: 53511 - DNA, 20 bp, Artificial Sequence
  Description of Artificial Sequence: Synthetic oligonucleotide
  Target: SCN9A; (+) strand; PAM type: NRG; PAM sequence: TGG
caggaagtgtctaaattacc

SEQ ID NO: 53512 - DNA, 20 bp, Artificial Sequence
  Description of Artificial Sequence: Synthetic oligonucleotide
  Target: SCN9A; (+) strand; PAM type: NRG; PAM sequence: TGG
ctaaattacctggaattcac

SEQ ID NO: 53513 - DNA, 20 bp, Artificial Sequence
  Description of Artificial Sequence: Synthetic oligonucleotide
  Target: SCN9A; (+) strand; PAM type: NRG; PAM sequence: TAG
aattacctggaattcactgg

SEQ ID NO: 53514 - DNA, 20 bp, Artificial Sequence
  Description of Artificial Sequence: Synthetic oligonucleotide
  Target: SCN9A; (+) strand; PAM type: NRG; PAM sequence: CAG
actggtagccaatcgtaacc

SEQ ID NO: 53515 - DNA, 20 bp, Artificial Sequence
  Description of Artificial Sequence: Synthetic oligonucleotide
  Target: SCN9A; (+) strand; PAM type: NRG; PAM sequence: CAG
taacccagccccattcttca

SEQ ID NO: 53516 - DNA, 20 bp, Artificial Sequence
  Description of Artificial Sequence: Synthetic oligonucleotide
  Target: SCN9A; (+) strand; PAM type: NRG; PAM sequence: AGG
aacccagccccattcttcac

SEQ ID NO: 53517 - DNA, 20 bp, Artificial Sequence
  Description of Artificial Sequence: Synthetic oligonucleotide
  Target: SCN9A; (+) strand; PAM type: NRG; PAM sequence: AAG
ccattcttcacaggcattta

SEQ ID NO: 53518 - DNA, 20 bp, Artificial Sequence
  Description of Artificial Sequence: Synthetic oligonucleotide
  Target: SCN9A; (+) strand; PAM type: NRG; PAM sequence: CAG
ggcatttaaagttcatgcca

SEQ ID NO: 53519 - DNA, 20 bp, Artificial Sequence
  Description of Artificial Sequence: Synthetic oligonucleotide
  Target: SCN9A; (+) strand; PAM type: NRG; PAM sequence: AAG
agttcatgccacagaattta

SEQ ID NO: 53520 - DNA, 20 bp, Artificial Sequence
  Description of Artificial Sequence: Synthetic oligonucleotide
  Target: SCN9A; (+) strand; PAM type: NRG; PAM sequence: GAG
ttcatgccacagaatttaaa

SEQ ID NO: 53521 - DNA, 20 bp, Artificial Sequence
  Description of Artificial Sequence: Synthetic oligonucleotide
  Target: SCN9A; (+) strand; PAM type: NRG; PAM sequence: AGG
tcatgccacagaatttaaag

SEQ ID NO: 53522 - DNA, 20 bp, Artificial Sequence
  Description of Artificial Sequence: Synthetic oligonucleotide
  Target: SCN9A; (+) strand; PAM type: NRG; PAM sequence: TAG
gaggctgttacactctgatc

SEQ ID NO: 53523 - DNA, 20 bp, Artificial Sequence
  Description of Artificial Sequence: Synthetic oligonucleotide
  Target: SCN9A; (+) strand; PAM type: NRG; PAM sequence: AAG
tgatctagaacttgtataat

SEQ ID NO: 53524 - DNA, 20 bp, Artificial Sequence
  Description of Artificial Sequence: Synthetic oligonucleotide
  Target: SCN9A; (+) strand; PAM type: NRG; PAM sequence: AGG
gatctagaacttgtataata

SEQ ID NO: 53525 - DNA, 20 bp, Artificial Sequence
  Description of Artificial Sequence: Synthetic oligonucleotide
  Target: SCN9A; (+) strand; PAM type: NRG; PAM sequence: AAG
acttgtataataaggtcatg

SEQ ID NO: 53526 - DNA, 20 bp, Artificial Sequence
  Description of Artificial Sequence: Synthetic oligonucleotide
  Target: SCN9A; (+) strand; PAM type: NRG; PAM sequence: GAG
ttgtataataaggtcatgaa

SEQ ID NO: 53527 - DNA, 20 bp, Artificial Sequence
  Description of Artificial Sequence: Synthetic oligonucleotide
  Target: SCN9A; (+) strand; PAM type: NRG; PAM sequence: AAG
aataaggtcatgaagagaca

SEQ ID NO: 53528 - DNA, 20 bp, Artificial Sequence
  Description of Artificial Sequence: Synthetic oligonucleotide
  Target: SCN9A; (+) strand; PAM type: NRG; PAM sequence: AGG
ataaggtcatgaagagacaa

SEQ ID NO: 53529 - DNA, 20 bp, Artificial Sequence
  Description of Artificial Sequence: Synthetic oligonucleotide
  Target: SCN9A; (+) strand; PAM type: NRG; PAM sequence: GAG
aaggtcatgaagagacaaag

SEQ ID NO: 53530 - DNA, 20 bp, Artificial Sequence
  Description of Artificial Sequence: Synthetic oligonucleotide
  Target: SCN9A; (+) strand; PAM type: NRG; PAM sequence: AGG
aggtcatgaagagacaaagg

SEQ ID NO: 53531 - DNA, 20 bp, Artificial Sequence
  Description of Artificial Sequence: Synthetic oligonucleotide
  Target: SCN9A; (+) strand; PAM type: NRG; PAM sequence: TAG
aatatttaaaaaaaaacaca

SEQ ID NO: 53532 - DNA, 20 bp, Artificial Sequence
  Description of Artificial Sequence: Synthetic oligonucleotide
  Target: SCN9A; (+) strand; PAM type: NRG; PAM sequence: AGG
atatttaaaaaaaaacacat

SEQ ID NO: 53533 - DNA, 20 bp, Artificial Sequence
  Description of Artificial Sequence: Synthetic oligonucleotide
  Target: SCN9A; (+) strand; PAM type: NRG; PAM sequence: CGG
taaaaaaaaacacataggat

SEQ ID NO: 53534 - DNA, 20 bp, Artificial Sequence
  Description of Artificial Sequence: Synthetic oligonucleotide
  Target: SCN9A; (+) strand; PAM type: NRG; PAM sequence: GAG
aaaaaaaacacataggatcg

SEQ ID NO: 53535 - DNA, 20 bp, Artificial Sequence
  Description of Artificial Sequence: Synthetic oligonucleotide
  Target: SCN9A; (+) strand; PAM type: NRG; PAM sequence: CAG
aacacataggatcggagtgc

SEQ ID NO: 53536 - DNA, 20 bp, Artificial Sequence
  Description of Artificial Sequence: Synthetic oligonucleotide
  Target: SCN9A; (+) strand; PAM type: NRG; PAM sequence: TGG
ggagtgccagataaaataca

SEQ ID NO: 53537 - DNA, 20 bp, Artificial Sequence
  Description of Artificial Sequence: Synthetic oligonucleotide
  Target: SCN9A; (+) strand; PAM type: NRG; PAM sequence: TAG
cagataaaatacatggtgtc

SEQ ID NO: 53538 - DNA, 20 bp, Artificial Sequence
  Description of Artificial Sequence: Synthetic oligonucleotide
  Target: SCN9A; (+) strand; PAM type: NRG; PAM sequence: CAG
gtctagtcatatttgaattc

SEQ ID NO: 53539 - DNA, 20 bp, Artificial Sequence
  Description of Artificial Sequence: Synthetic oligonucleotide
  Target: SCN9A; (+) strand; PAM type: NRG; PAM sequence: AAG
gtcatatttgaattccagat

SEQ ID NO: 53540 - DNA, 20 bp, Artificial Sequence
  Description of Artificial Sequence: Synthetic oligonucleotide
  Target: SCN9A; (+) strand; PAM type: NRG; PAM sequence: CAG
atttgaattccagataagtc

SEQ ID NO: 53541 - DNA, 20 bp, Artificial Sequence
  Description of Artificial Sequence: Synthetic oligonucleotide
  Target: SCN9A; (+) strand; PAM type: NRG; PAM sequence: AGG
tttgaattccagataagtcc

SEQ ID NO: 53542 - DNA, 20 bp, Artificial Sequence
  Description of Artificial Sequence: Synthetic oligonucleotide
  Target: SCN9A; (+) strand; PAM type: NRG; PAM sequence: TAG
agataagtccaggacctaca

SEQ ID NO: 53543 - DNA, 20 bp, Artificial Sequence
  Description of Artificial Sequence: Synthetic oligonucleotide
  Target: SCN9A; (+) strand; PAM type: NRG; PAM sequence: AGG
gataagtccaggacctacat

SEQ ID NO: 53544 - DNA, 20 bp, Artificial Sequence
  Description of Artificial Sequence: Synthetic oligonucleotide
  Target: SCN9A; (+) strand; PAM type: NRG; PAM sequence: TGG
ccaggacctacataggaaat

SEQ ID NO: 53545 - DNA, 20 bp, Artificial Sequence
  Description of Artificial Sequence: Synthetic oligonucleotide
  Target: SCN9A; (+) strand; PAM type: NRG; PAM sequence: CAG
aggaaattggcaacttttca

SEQ ID NO: 53546 - DNA, 20 bp, Artificial Sequence
  Description of Artificial Sequence: Synthetic oligonucleotide
  Target: SCN9A; (+) strand; PAM type: NRG; PAM sequence: AGG
ggaaattggcaacttttcac

SEQ ID NO: 53547 - DNA, 20 bp, Artificial Sequence
  Description of Artificial Sequence: Synthetic oligonucleotide
  Target: SCN9A; (+) strand; PAM type: NRG; PAM sequence: CAG
aacttttcacaggcatgttc

SEQ ID NO: 53548 - DNA, 20 bp, Artificial Sequence
  Description of Artificial Sequence: Synthetic oligonucleotide
  Target: SCN9A; (+) strand; PAM type: NRG; PAM sequence: AAG
ttttcacaggcatgttccag

SEQ ID NO: 53549 - DNA, 20 bp, Artificial Sequence
  Description of Artificial Sequence: Synthetic oligonucleotide
  Target: SCN9A; (+) strand; PAM type: NRG; PAM sequence: AGG
tttcacaggcatgttccaga

SEQ ID NO: 53550 - DNA, 20 bp, Artificial Sequence
  Description of Artificial Sequence: Synthetic oligonucleotide
  Target: SCN9A; (+) strand; PAM type: NRG; PAM sequence: TGG
aggaccaaacctttttccta

SEQ ID NO: 53551 - DNA, 20 bp, Artificial Sequence
  Description of Artificial Sequence: Synthetic oligonucleotide
  Target: SCN9A; (+) strand; PAM type: NRG; PAM sequence: AAG
ccaaacctttttcctatggc

SEQ ID NO: 53552 - DNA, 20 bp, Artificial Sequence
  Description of Artificial Sequence: Synthetic oligonucleotide
  Target: SCN9A; (+) strand; PAM type: NRG; PAM sequence: TGG
acctttttcctatggcaaga

SEQ ID NO: 53553 - DNA, 20 bp, Artificial Sequence
  Description of Artificial Sequence: Synthetic oligonucleotide
  Target: SCN9A; (+) strand; PAM type: NRG; PAM sequence: TAG
tttttcctatggcaagatgg

SEQ ID NO: 53554 - DNA, 20 bp, Artificial Sequence
  Description of Artificial Sequence: Synthetic oligonucleotide
  Target: SCN9A; (+) strand; PAM type: NRG; PAM sequence: AGG
ttttcctatggcaagatggt

SEQ ID NO: 53555 - DNA, 20 bp, Artificial Sequence
  Description of Artificial Sequence: Synthetic oligonucleotide
  Target: SCN9A; (+) strand; PAM type: NRG; PAM sequence: CAG
ggcaagatggtaggttcttc

SEQ ID NO: 53556 - DNA, 20 bp, Artificial Sequence
  Description of Artificial Sequence: Synthetic oligonucleotide
  Target: SCN9A; (+) strand; PAM type: NRG; PAM sequence: TGG
gcttctctgctaacaatctg

SEQ ID NO: 53557 - DNA, 20 bp, Artificial Sequence
  Description of Artificial Sequence: Synthetic oligonucleotide
  Target: SCN9A; (+) strand; PAM type: NRG; PAM sequence: CAG
ctgctaacaatctgtggctc

SEQ ID NO: 53558 - DNA, 20 bp, Artificial Sequence
  Description of Artificial Sequence: Synthetic oligonucleotide
  Target: SCN9A; (+) strand; PAM type: NRG; PAM sequence: GAG
gctaacaatctgtggctcca

SEQ ID NO: 53559 - DNA, 20 bp, Artificial Sequence
  Description of Artificial Sequence: Synthetic oligonucleotide
  Target: SCN9A; (+) strand; PAM type: NRG; PAM sequence: GAG
taacaatctgtggctccaga

SEQ ID NO: 53560 - DNA, 20 bp, Artificial Sequence
  Description of Artificial Sequence: Synthetic oligonucleotide
  Target: SCN9A; (+) strand; PAM type: NRG; PAM sequence: AGG
aacaatctgtggctccagag

SEQ ID NO: 53561 - DNA, 20 bp, Artificial Sequence
  Description of Artificial Sequence: Synthetic oligonucleotide
  Target: SCN9A; (+) strand; PAM type: NRG; PAM sequence: AAG
aatctgtggctccagagagg

SEQ ID NO: 53562 - DNA, 20 bp, Artificial Sequence
  Description of Artificial Sequence: Synthetic oligonucleotide
  Target: SCN9A; (+) strand; PAM type: NRG; PAM sequence: GAG
tctgtggctccagagaggaa

SEQ ID NO: 53563 - DNA, 20 bp, Artificial Sequence
  Description of Artificial Sequence: Synthetic oligonucleotide
  Target: SCN9A; (+) strand; PAM type: NRG; PAM sequence: AGG
ctgtggctccagagaggaag

SEQ ID NO: 53564 - DNA, 20 bp, Artificial Sequence
  Description of Artificial Sequence: Synthetic oligonucleotide
  Target: SCN9A; (+) strand; PAM type: NRG; PAM sequence: AAG
ggctccagagaggaagaggc

SEQ ID NO: 53565 - DNA, 20 bp, Artificial Sequence
  Description of Artificial Sequence: Synthetic oligonucleotide
  Target: SCN9A; (+) strand; PAM type: NRG; PAM sequence: GAG
ctccagagaggaagaggcaa

SEQ ID NO: 53566 - DNA, 20 bp, Artificial Sequence
  Description of Artificial Sequence: Synthetic oligonucleotide
  Target: SCN9A; (+) strand; PAM type: NRG; PAM sequence: AGG
tccagagaggaagaggcaag

SEQ ID NO: 53567 - DNA, 20 bp, Artificial Sequence
  Description of Artificial Sequence: Synthetic oligonucleotide
  Target: SCN9A; (+) strand; PAM type: NRG; PAM sequence: CAG
aggaagaggcaagaggatgc

SEQ ID NO: 53568 - DNA, 20 bp, Artificial Sequence
  Description of Artificial Sequence: Synthetic oligonucleotide
  Target: SCN9A; (+) strand; PAM type: NRG; PAM sequence: AGG
ggaagaggcaagaggatgcc

SEQ ID NO: 53569 - DNA, 20 bp, Artificial Sequence
  Description of Artificial Sequence: Synthetic oligonucleotide
  Target: SCN9A; (+) strand; PAM type: NRG; PAM sequence: TAG
agaggcaagaggatgccagg

SEQ ID NO: 53570 - DNA, 20 bp, Artificial Sequence
  Description of Artificial Sequence: Synthetic oligonucleotide
  Target: SCN9A; (+) strand; PAM type: NRG; PAM sequence: GAG
ccaggtagcatgtaactcat

SEQ ID NO: 53571 - DNA, 20 bp, Artificial Sequence
  Description of Artificial Sequence: Synthetic oligonucleotide
  Target: SCN9A; (+) strand; PAM type: NRG; PAM sequence: TAG
actcatgagccaatgaaaat

SEQ ID NO: 53572 - DNA, 20 bp, Artificial Sequence
  Description of Artificial Sequence: Synthetic oligonucleotide
  Target: SCN9A; (+) strand; PAM type: NRG; PAM sequence: TAG
aattagttaatataccacct

SEQ ID NO: 53573 - DNA, 20 bp, Artificial Sequence
  Description of Artificial Sequence: Synthetic oligonucleotide
  Target: SCN9A; (+) strand; PAM type: NRG; PAM sequence: CGG
ccaccttagcacatgtgtaa

SEQ ID NO: 53574 - DNA, 20 bp, Artificial Sequence
  Description of Artificial Sequence: Synthetic oligonucleotide
  Target: SCN9A; (+) strand; PAM type: NRG; PAM sequence: AAG
gtacatttttcctacaaact

SEQ ID NO: 53575 - DNA, 20 bp, Artificial Sequence
  Description of Artificial Sequence: Synthetic oligonucleotide
  Target: SCN9A; (+) strand; PAM type: NRG; PAM sequence: TAG
tttttcctacaaactaagaa

SEQ ID NO: 53576 - DNA, 20 bp, Artificial Sequence
  Description of Artificial Sequence: Synthetic oligonucleotide
  Target: SCN9A; (+) strand; PAM type: NRG; PAM sequence: AAG
tcctacaaactaagaataga

SEQ ID NO: 53577 - DNA, 20 bp, Artificial Sequence
  Description of Artificial Sequence: Synthetic oligonucleotide
  Target: SCN9A; (+) strand; PAM type: NRG; PAM sequence: AAG
cattaaaaaaaaaaaatgac

SEQ ID NO: 53578 - DNA, 20 bp, Artificial Sequence
  Description of Artificial Sequence: Synthetic oligonucleotide
  Target: SCN9A; (+) strand; PAM type: NRG; PAM sequence: TAG
taaaaaaaaaaaatgacaag

SEQ ID NO: 53579 - DNA, 20 bp, Artificial Sequence
  Description of Artificial Sequence: Synthetic oligonucleotide
  Target: SCN9A; (+) strand; PAM type: NRG; PAM sequence: CAG
aatgacaagtagctattttc

SEQ ID NO: 53580 - DNA, 20 bp, Artificial Sequence
  Description of Artificial Sequence: Synthetic oligonucleotide
  Target: SCN9A; (+) strand; PAM type: NRG; PAM sequence: TAG
caagtagctattttccagcc

SEQ ID NO: 53581 - DNA, 20 bp, Artificial Sequence
  Description of Artificial Sequence: Synthetic oligonucleotide
  Target: SCN9A; (+) strand; PAM type: NRG; PAM sequence: AAG
ccagcctagatatgcccctc

SEQ ID NO: 53582 - DNA, 20 bp, Artificial Sequence
  Description of Artificial Sequence: Synthetic oligonucleotide
  Target: SCN9A; (+) strand; PAM type: NRG; PAM sequence: CAG
ccgctcatttaaatgattgc

SEQ ID NO: 53583 - DNA, 20 bp, Artificial Sequence
  Description of Artificial Sequence: Synthetic oligonucleotide
  Target: SCN9A; (+) strand; PAM type: NRG; PAM sequence: CAG
tcatttaaatgattgccagt

SEQ ID NO: 53584 - DNA, 20 bp, Artificial Sequence
  Description of Artificial Sequence: Synthetic oligonucleotide
  Target: SCN9A; (+) strand; PAM type: NRG; PAM sequence: TAG
tttaaatgattgccagtcag

SEQ ID NO: 53585 - DNA, 20 bp, Artificial Sequence
  Description of Artificial Sequence: Synthetic oligonucleotide
  Target: SCN9A; (+) strand; PAM type: NRG; PAM sequence: CAG
aatgattgccagtcagtagc

SEQ ID NO: 53586 - DNA, 20 bp, Artificial Sequence
  Description of Artificial Sequence: Synthetic oligonucleotide
  Target: SCN9A; (+) strand; PAM type: NRG; PAM sequence: TAG
tgccagtcagtagccagtgc

SEQ ID NO: 53587 - DNA, 20 bp, Artificial Sequence
  Description of Artificial Sequence: Synthetic oligonucleotide
  Target: SCN9A; (+) strand; PAM type: NRG; PAM sequence: AAG
tagccagtgctagtaataaa

SEQ ID NO: 53588 - DNA, 20 bp, Artificial Sequence
  Description of Artificial Sequence: Synthetic oligonucleotide
  Target: SCN9A; (+) strand; PAM type: NRG; PAM sequence: TGG
aaaaagtaccatttactccc

SEQ ID NO: 53589 - DNA, 20 bp, Artificial Sequence
  Description of Artificial Sequence: Synthetic oligonucleotide
  Target: SCN9A; (+) strand; PAM type: NRG; PAM sequence: GGG
aaaagtaccatttactccct

SEQ ID NO: 53590 - DNA, 20 bp, Artificial Sequence
  Description of Artificial Sequence: Synthetic oligonucleotide
  Target: SCN9A; (+) strand; PAM type: NRG; PAM sequence: CAG
ccatttactccctgggaact

SEQ ID NO: 53591 - DNA, 20 bp, Artificial Sequence
  Description of Artificial Sequence: Synthetic oligonucleotide
  Target: SCN9A; (+) strand; PAM type: NRG; PAM sequence: TAG
tactccctgggaactcagaa

SEQ ID NO: 53592 - DNA, 20 bp, Artificial Sequence
  Description of Artificial Sequence: Synthetic oligonucleotide
  Target: SCN9A; (+) strand; PAM type: NRG; PAM sequence: GAG
ctccctgggaactcagaata

SEQ ID NO: 53593 - DNA, 20 bp, Artificial Sequence
  Description of Artificial Sequence: Synthetic oligonucleotide
  Target: SCN9A; (+) strand; PAM type: NRG; PAM sequence: AAG
tagagtaacatctaatcaac

SEQ ID NO: 53594 - DNA, 20 bp, Artificial Sequence
  Description of Artificial Sequence: Synthetic oligonucleotide
  Target: SCN9A; (+) strand; PAM type: NRG; PAM sequence: AGG
agagtaacatctaatcaaca

SEQ ID NO: 53595 - DNA, 20 bp, Artificial Sequence
  Description of Artificial Sequence: Synthetic oligonucleotide
  Target: SCN9A; (+) strand; PAM type: NRG; PAM sequence: GGG
gagtaacatctaatcaacaa

SEQ ID NO: 53596 - DNA, 20 bp, Artificial Sequence
  Description of Artificial Sequence: Synthetic oligonucleotide
  Target: SCN9A; (+) strand; PAM type: NRG; PAM sequence: TGG
ttttatctgtactatcacaa

SEQ ID NO: 53597 - DNA, 20 bp, Artificial Sequence
  Description of Artificial Sequence: Synthetic oligonucleotide
  Target: SCN9A; (+) strand; PAM type: NRG; PAM sequence: AAG
gtactatcacaatggtctcc

SEQ ID NO: 53598 - DNA, 20 bp, Artificial Sequence
  Description of Artificial Sequence: Synthetic oligonucleotide
  Target: SCN9A; (+) strand; PAM type: NRG; PAM sequence: TAG
cacaatggtctccaagtctc

SEQ ID NO: 53599 - DNA, 20 bp, Artificial Sequence
  Description of Artificial Sequence: Synthetic oligonucleotide
  Target: SCN9A; (+) strand; PAM type: NRG; PAM sequence: AGG
acaatggtctccaagtctct

SEQ ID NO: 53600 - DNA, 20 bp, Artificial Sequence
  Description of Artificial Sequence: Synthetic oligonucleotide
  Target: SCN9A; (+) strand; PAM type: NRG; PAM sequence: CAG
ctctcattttgtcttatcca

SEQ ID NO: 53601 - DNA, 20 bp, Artificial Sequence
  Description of Artificial Sequence: Synthetic oligonucleotide
  Target: SCN9A; (+) strand; PAM type: NRG; PAM sequence: TAG
tgtcttatccacagaatata

SEQ ID NO: 53602 - DNA, 20 bp, Artificial Sequence
  Description of Artificial Sequence: Synthetic oligonucleotide
  Target: SCN9A; (+) strand; PAM type: NRG; PAM sequence: CAG
cacagaatatatagtactgt

SEQ ID NO: 53603 - DNA, 20 bp, Artificial Sequence
  Description of Artificial Sequence: Synthetic oligonucleotide
  Target: SCN9A; (+) strand; PAM type: NRG; PAM sequence: GAG
cagaatatatagtactgtca

SEQ ID NO: 53604 - DNA, 20 bp, Artificial Sequence
  Description of Artificial Sequence: Synthetic oligonucleotide
  Target: SCN9A; (+) strand; PAM type: NRG; PAM sequence: TGG
aatatatagtactgtcagag

SEQ ID NO: 53605 - DNA, 20 bp, Artificial Sequence
  Description of Artificial Sequence: Synthetic oligonucleotide
  Target: SCN9A; (+) strand; PAM type: NRG; PAM sequence: CAG
ctcttctgttaaaaaatcat

SEQ ID NO: 53606 - DNA, 20 bp, Artificial Sequence
  Description of Artificial Sequence: Synthetic oligonucleotide
  Target: SCN9A; (+) strand; PAM type: NRG; PAM sequence: TGG
ttctgttaaaaaatcatcag

SEQ ID NO: 53607 - DNA, 20 bp, Artificial Sequence
  Description of Artificial Sequence: Synthetic oligonucleotide
  Target: SCN9A; (+) strand; PAM type: NRG; PAM sequence: TAG
aatcatcagtggcttctcaa

SEQ ID NO: 53608 - DNA, 20 bp, Artificial Sequence
  Description of Artificial Sequence: Synthetic oligonucleotide
  Target: SCN9A; (+) strand; PAM type: NRG; PAM sequence: TGG
agtggcttctcaatagctta

SEQ ID NO: 53609 - DNA, 20 bp, Artificial Sequence
  Description of Artificial Sequence: Synthetic oligonucleotide
  Target: SCN9A; (+) strand; PAM type: NRG; PAM sequence: GGG
gtggcttctcaatagcttat

SEQ ID NO: 53610 - DNA, 20 bp, Artificial Sequence
  Description of Artificial Sequence: Synthetic oligonucleotide
  Target: SCN9A; (+) strand; PAM type: NRG; PAM sequence: AAG
agcttatgggattaacccac

SEQ ID NO: 53611 - DNA, 20 bp, Artificial Sequence
  Description of Artificial Sequence: Synthetic oligonucleotide
  Target: SCN9A; (+) strand; PAM type: NRG; PAM sequence: AGG
gcttatgggattaacccaca

SEQ ID NO: 53612 - DNA, 20 bp, Artificial Sequence
  Description of Artificial Sequence: Synthetic oligonucleotide
  Target: SCN9A; (+) strand; PAM type: NRG; PAM sequence: GGG
cttatgggattaacccacaa

SEQ ID NO: 53613 - DNA, 20 bp, Artificial Sequence
  Description of Artificial Sequence: Synthetic oligonucleotide
  Target: SCN9A; (+) strand; PAM type: NRG; PAM sequence: AAG
aacccacaagggcctgtcct

SEQ ID NO: 53614 - DNA, 20 bp, Artificial Sequence
  Description of Artificial Sequence: Synthetic oligonucleotide
  Target: SCN9A; (+) strand; PAM type: NRG; PAM sequence: TGG
ccacaagggcctgtcctaag

SEQ ID NO: 53615 - DNA, 20 bp, Artificial Sequence
  Description of Artificial Sequence: Synthetic oligonucleotide
  Target: SCN9A; (+) strand; PAM type: NRG; PAM sequence: CAG
gggcctgtcctaagtggtcc

SEQ ID NO: 53616 - DNA, 20 bp, Artificial Sequence
  Description of Artificial Sequence: Synthetic oligonucleotide
  Target: SCN9A; (+) strand; PAM type: NRG; PAM sequence: TAG
ctcattcccacccacctatc

SEQ ID NO: 53617 - DNA, 20 bp, Artificial Sequence
  Description of Artificial Sequence: Synthetic oligonucleotide
  Target: SCN9A; (+) strand; PAM type: NRG; PAM sequence: AGG
tcattcccacccacctatct

SEQ ID NO: 53618 - DNA, 20 bp, Artificial Sequence
  Description of Artificial Sequence: Synthetic oligonucleotide
  Target: SCN9A; (+) strand; PAM type: NRG; PAM sequence: AAG
cacccacctatctaggactc

SEQ ID NO: 53619 - DNA, 20 bp, Artificial Sequence
  Description of Artificial Sequence: Synthetic oligonucleotide
  Target: SCN9A; (+) strand; PAM type: NRG; PAM sequence: TAG
ctatctaggactcaagatcc

SEQ ID NO: 53620 - DNA, 20 bp, Artificial Sequence
  Description of Artificial Sequence: Synthetic oligonucleotide
  Target: SCN9A; (+) strand; PAM type: NRG; PAM sequence: TAG
ctaggactcaagatcctaga

SEQ ID NO: 53621 - DNA, 20 bp, Artificial Sequence
  Description of Artificial Sequence: Synthetic oligonucleotide
  Target: SCN9A; (+) strand; PAM type: NRG; PAM sequence: AGG
taggactcaagatcctagat

SEQ ID NO: 53622 - DNA, 20 bp, Artificial Sequence
  Description of Artificial Sequence: Synthetic oligonucleotide
  Target: SCN9A; (+) strand; PAM type: NRG; PAM sequence: TGG
gactcaagatcctagatagg

SEQ ID NO: 53623 - DNA, 20 bp, Artificial Sequence
  Description of Artificial Sequence: Synthetic oligonucleotide
  Target: SCN9A; (+) strand; PAM type: NRG; PAM sequence: TAG
gataggtggctatgctccaa

SEQ ID NO: 53624 - DNA, 20 bp, Artificial Sequence
  Description of Artificial Sequence: Synthetic oligonucleotide
  Target: SCN9A; (+) strand; PAM type: NRG; PAM sequence: AGG
ataggtggctatgctccaat

SEQ ID NO: 53625 - DNA, 20 bp, Artificial Sequence
  Description of Artificial Sequence: Synthetic oligonucleotide
  Target: SCN9A; (+) strand; PAM type: NRG; PAM sequence: GGG
taggtggctatgctccaata

SEQ ID NO: 53626 - DNA, 20 bp, Artificial Sequence
  Description of Artificial Sequence: Synthetic oligonucleotide
  Target: SCN9A; (+) strand; PAM type: NRG; PAM sequence: CAG
gggcattttaattcttccct

SEQ ID NO: 53627 - DNA, 20 bp, Artificial Sequence
  Description of Artificial Sequence: Synthetic oligonucleotide
  Target: SCN9A; (+) strand; PAM type: NRG; PAM sequence: AGG
ggcattttaattcttccctc

SEQ ID NO: 53628 - DNA, 20 bp, Artificial Sequence
  Description of Artificial Sequence: Synthetic oligonucleotide
  Target: SCN9A; (+) strand; PAM type: NRG; PAM sequence: GAG
cattttaattcttccctcag

SEQ ID NO: 53629 - DNA, 20 bp, Artificial Sequence
  Description of Artificial Sequence: Synthetic oligonucleotide
  Target: SCN9A; (+) strand; PAM type: NRG; PAM sequence: CAG
ttaattcttccctcaggagc

SEQ ID NO: 53630 - DNA, 20 bp, Artificial Sequence
  Description of Artificial Sequence: Synthetic oligonucleotide
  Target: SCN9A; (+) strand; PAM type: NRG; PAM sequence: AAG
cttccctcaggagccagtcc

SEQ ID NO: 53631 - DNA, 20 bp, Artificial Sequence
  Description of Artificial Sequence: Synthetic oligonucleotide
  Target: SCN9A; (+) strand; PAM type: NRG; PAM sequence: GAG
tccctcaggagccagtccaa

SEQ ID NO: 53632 - DNA, 20 bp, Artificial Sequence
  Description of Artificial Sequence: Synthetic oligonucleotide
  Target: SCN9A; (+) strand; PAM type: NRG; PAM sequence: AAG
ctacttttcttaaacctcca

SEQ ID NO: 53633 - DNA, 20 bp, Artificial Sequence
  Description of Artificial Sequence: Synthetic oligonucleotide
  Target: SCN9A; (+) strand; PAM type: NRG; PAM sequence: TAG
cttttcttaaacctccaaag

SEQ ID NO: 53634 - DNA, 20 bp, Artificial Sequence
  Description of Artificial Sequence: Synthetic oligonucleotide
  Target: SCN9A; (+) strand; PAM type: NRG; PAM sequence: TGG
ttcttaaacctccaaagtag

SEQ ID NO: 53635 - DNA, 20 bp, Artificial Sequence
  Description of Artificial Sequence: Synthetic oligonucleotide
  Target: SCN9A; (+) strand; PAM type: NRG; PAM sequence: CGG
taaacctccaaagtagtggc

SEQ ID NO: 53636 - DNA, 20 bp, Artificial Sequence
  Description of Artificial Sequence: Synthetic oligonucleotide
  Target: SCN9A; (+) strand; PAM type: NRG; PAM sequence: GGG
aaacctccaaagtagtggcc

SEQ ID NO: 53637 - DNA, 20 bp, Artificial Sequence
  Description of Artificial Sequence: Synthetic oligonucleotide
  Target: SCN9A; (+) strand; PAM type: NRG; PAM sequence: CAG
tccaaagtagtggccgggtg

SEQ ID NO: 53638 - DNA, 20 bp, Artificial Sequence
  Description of Artificial Sequence: Synthetic oligonucleotide
  Target: SCN9A; (+) strand; PAM type: NRG; PAM sequence: TGG
aaagtagtggccgggtgcag

SEQ ID NO: 53639 - DNA, 20 bp, Artificial Sequence
  Description of Artificial Sequence: Synthetic oligonucleotide
  Target: SCN9A; (+) strand; PAM type: NRG; PAM sequence: TGG
cgtctgtaatcccaacactt

SEQ ID NO: 53640 - DNA, 20 bp, Artificial Sequence
  Description of Artificial Sequence: Synthetic oligonucleotide
  Target: SCN9A; (+) strand; PAM type: NRG; PAM sequence: GGG
gtctgtaatcccaacacttt

SEQ ID NO: 53641 - DNA, 20 bp, Artificial Sequence
  Description of Artificial Sequence: Synthetic oligonucleotide
  Target: SCN9A; (+) strand; PAM type: NRG; PAM sequence: GAG
ctgtaatcccaacactttgg

SEQ ID NO: 53642 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccaacactttggg

SEQ ID NO: 53643 - DNA, 20 bp, Artificial Sequence
  Description of Artificial Sequence: Synthetic oligonucleotide
  Target: SCN9A; (+) strand; PAM type: NRG; PAM sequence: CAG
aatcccaacactttgggagg

SEQ ID NO: 53644 - DNA, 20 bp, Artificial Sequence
  Description of Artificial Sequence: Synthetic oligonucleotide
  Target: SCN9A; (+) strand; PAM type: NRG; PAM sequence: GAG
tcccaacactttgggaggca

SEQ ID NO: 53645 - DNA, 20 bp, Artificial Sequence
  Description of Artificial Sequence: Synthetic oligonucleotide
  Target: SCN9A; (+) strand; PAM type: NRG; PAM sequence: AGG
cccaacactttgggaggcag

SEQ ID NO: 53646 - DNA, 20 bp, Artificial Sequence
  Description of Artificial Sequence: Synthetic oligonucleotide
  Target: SCN9A; (+) strand; PAM type: NRG; PAM sequence: TGG
aacactttgggaggcagagg

SEQ ID NO: 53647 - DNA, 20 bp, Artificial Sequence
  Description of Artificial Sequence: Synthetic oligonucleotide
  Target: SCN9A; (+) strand; PAM type: NRG; PAM sequence: GGG
acactttgggaggcagaggt

SEQ ID NO: 53648 - DNA, 20 bp, Artificial Sequence
  Description of Artificial Sequence: Synthetic oligonucleotide
  Target: SCN9A; (+) strand; PAM type: NRG; PAM sequence: CAG
ctttgggaggcagaggtggg

SEQ ID NO: 53649 - DNA, 20 bp, Artificial Sequence
  Description of Artificial Sequence: Synthetic oligonucleotide
  Target: SCN9A; (+) strand; PAM type: NRG; PAM sequence: GAG
cagaggtgggcagatcactt

SEQ ID NO: 53650 - DNA, 20 bp, Artificial Sequence
  Description of Artificial Sequence: Synthetic oligonucleotide
  Target: SCN9A; (+) strand; PAM type: NRG; PAM sequence: AGG
agaggtgggcagatcacttg

SEQ ID NO: 53651 - DNA, 20 bp, Artificial Sequence
  Description of Artificial Sequence: Synthetic oligonucleotide
  Target: SCN9A; (+) strand; PAM type: NRG; PAM sequence: CGG
gtgggcagatcacttgaggt

SEQ ID NO: 53652 - DNA, 20 bp, Artificial Sequence
  Description of Artificial Sequence: Synthetic oligonucleotide
  Target: SCN9A; (+) strand; PAM type: NRG; PAM sequence: AAG
ggcagatcacttgaggtcgg

SEQ ID NO: 53653 - DNA, 20 bp, Artificial Sequence
  Description of Artificial Sequence: Synthetic oligonucleotide
  Target: SCN9A; (+) strand; PAM type: NRG; PAM sequence: AAG
tcacttgaggtcggaagttc

SEQ ID NO: 53654 - DNA, 20 bp, Artificial Sequence
  Description of Artificial Sequence: Synthetic oligonucleotide
  Target: SCN9A; (+) strand; PAM type: NRG; PAM sequence: CAG
tgaggtcggaagttcaagac

SEQ ID NO: 53655 - DNA, 20 bp, Artificial Sequence
  Description of Artificial Sequence: Synthetic oligonucleotide
  Target: SCN9A; (+) strand; PAM type: NRG; PAM sequence: TGG
caagaccagcctgaccaaca

SEQ ID NO: 53656 - DNA, 20 bp, Artificial Sequence
  Description of Artificial Sequence: Synthetic oligonucleotide
  Target: SCN9A; (+) strand; PAM type: NRG; PAM sequence: GAG
agaccagcctgaccaacatg

SEQ ID NO: 53657 - DNA, 20 bp, Artificial Sequence
  Description of Artificial Sequence: Synthetic oligonucleotide
  Target: SCN9A; (+) strand; PAM type: NRG; PAM sequence: TAG
tactaaaaaaaatacaaaat

SEQ ID NO: 53658 - DNA, 20 bp, Artificial Sequence
  Description of Artificial Sequence: Synthetic oligonucleotide
  Target: SCN9A; (+) strand; PAM type: NRG; PAM sequence: CGG
aaaaaaaatacaaaattagc

SEQ ID NO: 53659 - DNA, 20 bp, Artificial Sequence
  Description of Artificial Sequence: Synthetic oligonucleotide
  Target: SCN9A; (+) strand; PAM type: NRG; PAM sequence: GGG
aaaaaaatacaaaattagcc

SEQ ID NO: 53660 - DNA, 20 bp, Artificial Sequence
  Description of Artificial Sequence: Synthetic oligonucleotide
  Target: SCN9A; (+) strand; PAM type: NRG; PAM sequence: TGG
aatacaaaattagccgggcg

SEQ ID NO: 53661 - DNA, 20 bp, Artificial Sequence
  Description of Artificial Sequence: Synthetic oligonucleotide
  Target: SCN9A; (+) strand; PAM type: NRG; PAM sequence: TGG
acaaaattagccgggcgtgg

SEQ ID NO: 53662 - DNA, 20 bp, Artificial Sequence
  Description of Artificial Sequence: Synthetic oligonucleotide
  Target: SCN9A; (+) strand; PAM type: NRG; PAM sequence: CGG
gtggcgcgtgcttataatcc

SEQ ID NO: 53663 - DNA, 20 bp, Artificial Sequence
  Description of Artificial Sequence: Synthetic oligonucleotide
  Target: SCN9A; (+) strand; PAM type: NRG; PAM sequence: CGG
tgcttataatcccggctcct

SEQ ID NO: 53664 - DNA, 20 bp, Artificial Sequence
  Description of Artificial Sequence: Synthetic oligonucleotide
  Target: SCN9A; (+) strand; PAM type: NRG; PAM sequence: AAG
ttataatcccggctcctcgg

SEQ ID NO: 53665 - DNA, 20 bp, Artificial Sequence
  Description of Artificial Sequence: Synthetic oligonucleotide
  Target: SCN9A; (+) strand; PAM type: NRG; PAM sequence: AGG
tataatcccggctcctcgga

SEQ ID NO: 53666 - DNA, 20 bp, Artificial Sequence
  Description of Artificial Sequence: Synthetic oligonucleotide
  Target: SCN9A; (+) strand; PAM type: NRG; PAM sequence: GAG
tcccggctcctcggaaggct

SEQ ID NO: 53667 - DNA, 20 bp, Artificial Sequence
  Description of Artificial Sequence: Synthetic oligonucleotide
  Target: SCN9A; (+) strand; PAM type: NRG; PAM sequence: AGG
cccggctcctcggaaggctg

SEQ ID NO: 53668 - DNA, 20 bp, Artificial Sequence
  Description of Artificial Sequence: Synthetic oligonucleotide
  Target: SCN9A; (+) strand; PAM type: NRG; PAM sequence: CAG
ggctcctcggaaggctgagg

SEQ ID NO: 53669 - DNA, 20 bp, Artificial Sequence
  Description of Artificial Sequence: Synthetic oligonucleotide
  Target: SCN9A; (+) strand; PAM type: NRG; PAM sequence: AGG
gctcctcggaaggctgaggc

SEQ ID NO: 53670 - DNA, 20 bp, Artificial Sequence
  Description of Artificial Sequence: Synthetic oligonucleotide
  Target: SCN9A; (+) strand; PAM type: NRG; PAM sequence: GAG
tcctcggaaggctgaggcag

SEQ ID NO: 53671 - DNA, 20 bp, Artificial Sequence
  Description of Artificial Sequence: Synthetic oligonucleotide
  Target: SCN9A; (+) strand; PAM type: NRG; PAM sequence: CAG
gcaggagaatcgcttgaacc

SEQ ID NO: 53672 - DNA, 20 bp, Artificial Sequence
  Description of Artificial Sequence: Synthetic oligonucleotide
  Target: SCN9A; (+) strand; PAM type: NRG; PAM sequence: AGG
caggagaatcgcttgaaccc

SEQ ID NO: 53673 - DNA, 20 bp, Artificial Sequence
  Description of Artificial Sequence: Synthetic oligonucleotide
  Target: SCN9A; (+) strand; PAM type: NRG; PAM sequence: GAG
ggagaatcgcttgaacccag

SEQ ID NO: 53674 - DNA, 20 bp, Artificial Sequence
  Description of Artificial Sequence: Synthetic oligonucleotide
  Target: SCN9A; (+) strand; PAM type: NRG; PAM sequence: CGG
gaatcgcttgaacccaggag

SEQ ID NO: 53675 - DNA, 20 bp, Artificial Sequence
  Description of Artificial Sequence: Synthetic oligonucleotide
  Target: SCN9A; (+) strand; PAM type: NRG; PAM sequence: GAG
atcgcttgaacccaggagcg

SEQ ID NO: 53676 - DNA, 20 bp, Artificial Sequence
  Description of Artificial Sequence: Synthetic oligonucleotide
  Target: SCN9A; (+) strand; PAM type: NRG; PAM sequence: CGG
gaacccaggagcggagattg

SEQ ID NO: 53677 - DNA, 20 bp, Artificial Sequence
  Description of Artificial Sequence: Synthetic oligonucleotide
  Target: SCN9A; (+) strand; PAM type: NRG; PAM sequence: GAG
ccaggagcggagattgcggt

SEQ ID NO: 53678 - DNA, 20 bp, Artificial Sequence
  Description of Artificial Sequence: Synthetic oligonucleotide
  Target: SCN9A; (+) strand; PAM type: NRG; PAM sequence: GAG
agcggagattgcggtgagcc

SEQ ID NO: 53679 - DNA, 20 bp, Artificial Sequence
  Description of Artificial Sequence: Synthetic oligonucleotide
  Target: SCN9A; (+) strand; PAM type: NRG; PAM sequence: CAG
gagatcacgccattgcactt

SEQ ID NO: 53680 - DNA, 20 bp, Artificial Sequence
  Description of Artificial Sequence: Synthetic oligonucleotide
  Target: SCN9A; (+) strand; PAM type: NRG; PAM sequence: AGG
agatcacgccattgcacttc

SEQ ID NO: 53681 - DNA, 20 bp, Artificial Sequence
  Description of Artificial Sequence: Synthetic oligonucleotide
  Target: SCN9A; (+) strand; PAM type: NRG; PAM sequence: TGG
cacgccattgcacttcagga

SEQ ID NO: 53682 - DNA, 20 bp, Artificial Sequence
  Description of Artificial Sequence: Synthetic oligonucleotide
  Target: SCN9A; (+) strand; PAM type: NRG; PAM sequence: GGG
acgccattgcacttcaggat

SEQ ID NO: 53683 - DNA, 20 bp, Artificial Sequence
  Description of Artificial Sequence: Synthetic oligonucleotide
  Target: SCN9A; (+) strand; PAM type: NRG; PAM sequence: AAG
tgcacttcaggatgggcaac

SEQ ID NO: 53684 - DNA, 20 bp, Artificial Sequence
  Description of Artificial Sequence: Synthetic oligonucleotide
  Target: SCN9A; (+) strand; PAM type: NRG; PAM sequence: GAG
cacttcaggatgggcaacaa

SEQ ID NO: 53685 - DNA, 20 bp, Artificial Sequence
  Description of Artificial Sequence: Synthetic oligonucleotide
  Target: SCN9A; (+) strand; PAM type: NRG; PAM sequence: AAG
tgacataatcaccctccccc

SEQ ID NO: 53686 - DNA, 20 bp, Artificial Sequence
  Description of Artificial Sequence: Synthetic oligonucleotide
  Target: SCN9A; (+) strand; PAM type: NRG; PAM sequence: TAG
catctttctactcccatatt

SEQ ID NO: 53687 - DNA, 20 bp, Artificial Sequence
  Description of Artificial Sequence: Synthetic oligonucleotide
  Target: SCN9A; (+) strand; PAM type: NRG; PAM sequence: TGG
tactcccatatttagcccaa

SEQ ID NO: 53688 - DNA, 20 bp, Artificial Sequence
  Description of Artificial Sequence: Synthetic oligonucleotide
  Target: SCN9A; (+) strand; PAM type: NRG; PAM sequence: GGG
actcccatatttagcccaat

SEQ ID NO: 53689 - DNA, 20 bp, Artificial Sequence
  Description of Artificial Sequence: Synthetic oligonucleotide
  Target: SCN9A; (+) strand; PAM type: NRG; PAM sequence: GGG
ctcccatatttagcccaatg

SEQ ID NO: 53690 - DNA, 20 bp, Artificial Sequence
  Description of Artificial Sequence: Synthetic oligonucleotide
  Target: SCN9A; (+) strand; PAM type: NRG; PAM sequence: TAG
atttagcccaatggggtaca

SEQ ID NO: 53691 - DNA, 20 bp, Artificial Sequence
  Description of Artificial Sequence: Synthetic oligonucleotide
  Target: SCN9A; (+) strand; PAM type: NRG; PAM sequence: AAG
tagcccaatggggtacatag

SEQ ID NO: 53692 - DNA, 20 bp, Artificial Sequence
  Description of Artificial Sequence: Synthetic oligonucleotide
  Target: SCN9A; (+) strand; PAM type: NRG; PAM sequence: AGG
agcccaatggggtacataga

SEQ ID NO: 53693 - DNA, 20 bp, Artificial Sequence
  Description of Artificial Sequence: Synthetic oligonucleotide
  Target: SCN9A; (+) strand; PAM type: NRG; PAM sequence: CAG
gtaatcaataaatacttatt

SEQ ID NO: 53694 - DNA, 20 bp, Artificial Sequence
  Description of Artificial Sequence: Synthetic oligonucleotide
  Target: SCN9A; (+) strand; PAM type: NRG; PAM sequence: AAG
tctctattccttactttaaa

SEQ ID NO: 53695 - DNA, 20 bp, Artificial Sequence
  Description of Artificial Sequence: Synthetic oligonucleotide
  Target: SCN9A; (+) strand; PAM type: NRG; PAM sequence: AAG
ctattccttactttaaaaag

SEQ ID NO: 53696 - DNA, 20 bp, Artificial Sequence
  Description of Artificial Sequence: Synthetic oligonucleotide
  Target: SCN9A; (+) strand; PAM type: NRG; PAM sequence: AGG
tattccttactttaaaaaga

SEQ ID NO: 53697 - DNA, 20 bp, Artificial Sequence
  Description of Artificial Sequence: Synthetic oligonucleotide
  Target: SCN9A; (+) strand; PAM type: NRG; PAM sequence: CAG
ttactttaaaaagaaggaaa

SEQ ID NO: 53698 - DNA, 20 bp, Artificial Sequence
  Description of Artificial Sequence: Synthetic oligonucleotide
  Target: SCN9A; (+) strand; PAM type: NRG; PAM sequence: AAG
taaaaagaaggaaacagaaa

SEQ ID NO: 53699 - DNA, 20 bp, Artificial Sequence
  Description of Artificial Sequence: Synthetic oligonucleotide
  Target: SCN9A; (+) strand; PAM type: NRG; PAM sequence: GAG
aagaaggaaacagaaaaagt

SEQ ID NO: 53700 - DNA, 20 bp, Artificial Sequence
  Description of Artificial Sequence: Synthetic oligonucleotide
  Target: SCN9A; (+) strand; PAM type: NRG; PAM sequence: AAG
aggaaacagaaaaagtgaga

SEQ ID NO: 53701 - DNA, 20 bp, Artificial Sequence
  Description of Artificial Sequence: Synthetic oligonucleotide
  Target: SCN9A; (+) strand; PAM type: NRG; PAM sequence: GAG
gaaacagaaaaagtgagaaa

SEQ ID NO: 53702 - DNA, 20 bp, Artificial Sequence
  Description of Artificial Sequence: Synthetic oligonucleotide
  Target: SCN9A; (+) strand; PAM type: NRG; PAM sequence: AAG
tgagaaagagttcaaaatgt

SEQ ID NO: 53703 - DNA, 20 bp, Artificial Sequence
  Description of Artificial Sequence: Synthetic oligonucleotide
  Target: SCN9A; (+) strand; PAM type: NRG; PAM sequence: AGG
gagaaagagttcaaaatgta

SEQ ID NO: 53704 - DNA, 20 bp, Artificial Sequence
  Description of Artificial Sequence: Synthetic oligonucleotide
  Target: SCN9A; (+) strand; PAM type: NRG; PAM sequence: AAG
aaaatgtaaggaaccaatga

SEQ ID NO: 53705 - DNA, 20 bp, Artificial Sequence
  Description of Artificial Sequence: Synthetic oligonucleotide
  Target: SCN9A; (+) strand; PAM type: NRG; PAM sequence: AAG
taaggaaccaatgaaagaaa

SEQ ID NO: 53706 - DNA, 20 bp, Artificial Sequence
  Description of Artificial Sequence: Synthetic oligonucleotide
  Target: SCN9A; (+) strand; PAM type: NRG; PAM sequence: AAG
ccaatgaaagaaaaagaaaa

SEQ ID NO: 53707 - DNA, 20 bp, Artificial Sequence
  Description of Artificial Sequence: Synthetic oligonucleotide
  Target: SCN9A; (+) strand; PAM type: NRG; PAM sequence: AAG
agaaaaagaaaaaagtcaca

SEQ ID NO: 53708 - DNA, 20 bp, Artificial Sequence
  Description of Artificial Sequence: Synthetic oligonucleotide
  Target: SCN9A; (+) strand; PAM type: NRG; PAM sequence: GAG
aagtcacaaagttatgtaat

SEQ ID NO: 53709 - DNA, 20 bp, Artificial Sequence
  Description of Artificial Sequence: Synthetic oligonucleotide
  Target: SCN9A; (+) strand; PAM type: NRG; PAM sequence: TAG
atttgttatcattttctaaa

SEQ ID NO: 53710 - DNA, 20 bp, Artificial Sequence
  Description of Artificial Sequence: Synthetic oligonucleotide
  Target: SCN9A; (+) strand; PAM type: NRG; PAM sequence: TAG
ttccacttcattttgcaatt

SEQ ID NO: 53711 - DNA, 20 bp, Artificial Sequence
  Description of Artificial Sequence: Synthetic oligonucleotide
  Target: SCN9A; (+) strand; PAM type: NRG; PAM sequence: AGG
tccacttcattttgcaattt

SEQ ID NO: 53712 - DNA, 20 bp, Artificial Sequence
  Description of Artificial Sequence: Synthetic oligonucleotide
  Target: SCN9A; (+) strand; PAM type: NRG; PAM sequence: GAG
cacttcattttgcaatttag

SEQ ID NO: 53713 - DNA, 20 bp, Artificial Sequence
  Description of Artificial Sequence: Synthetic oligonucleotide
  Target: SCN9A; (+) strand; PAM type: NRG; PAM sequence: TGG
gcaatttaggagtatttcaa

SEQ ID NO: 53714 - DNA, 20 bp, Artificial Sequence
  Description of Artificial Sequence: Synthetic oligonucleotide
  Target: SCN9A; (+) strand; PAM type: NRG; PAM sequence: CAG
tttaggagtatttcaatggt

SEQ ID NO: 53715 - DNA, 20 bp, Artificial Sequence
  Description of Artificial Sequence: Synthetic oligonucleotide
  Target: SCN9A; (+) strand; PAM type: NRG; PAM sequence: GAG
taggagtatttcaatggtca

SEQ ID NO: 53716 - DNA, 20 bp, Artificial Sequence
  Description of Artificial Sequence: Synthetic oligonucleotide
  Target: SCN9A; (+) strand; PAM type: NRG; PAM sequence: AAG
tcaatggtcagagaaaatga

SEQ ID NO: 53717 - DNA, 20 bp, Artificial Sequence
  Description of Artificial Sequence: Synthetic oligonucleotide
  Target: SCN9A; (+) strand; PAM type: NRG; PAM sequence: TAG
gtactgttaattctgaaaat

SEQ ID NO: 53718 - DNA, 20 bp, Artificial Sequence
  Description of Artificial Sequence: Synthetic oligonucleotide
  Target: SCN9A; (+) strand; PAM type: NRG; PAM sequence: TAG
ctctctacaaacttttaaat

SEQ ID NO: 53719 - DNA, 20 bp, Artificial Sequence
  Description of Artificial Sequence: Synthetic oligonucleotide
  Target: SCN9A; (+) strand; PAM type: NRG; PAM sequence: AGG
tctctacaaacttttaaatt

SEQ ID NO: 53720 - DNA, 20 bp, Artificial Sequence
  Description of Artificial Sequence: Synthetic oligonucleotide
  Target: SCN9A; (+) strand; PAM type: NRG; PAM sequence: AAG
acaatattcctaaaaaccct

SEQ ID NO: 53721 - DNA, 20 bp, Artificial Sequence
  Description of Artificial Sequence: Synthetic oligonucleotide
  Target: SCN9A; (+) strand; PAM type: NRG; PAM sequence: TAG
atattcctaaaaaccctaag

SEQ ID NO: 53722 - DNA, 20 bp, Artificial Sequence
  Description of Artificial Sequence: Synthetic oligonucleotide
  Target: SCN9A; (+) strand; PAM type: NRG; PAM sequence: AAG
aaaaaccctaagtagactat

SEQ ID NO: 53723 - DNA, 20 bp, Artificial Sequence
  Description of Artificial Sequence: Synthetic oligonucleotide
  Target: SCN9A; (+) strand; PAM type: NRG; PAM sequence: AGG
aaaaccctaagtagactata

SEQ ID NO: 53724 - DNA, 20 bp, Artificial Sequence
  Description of Artificial Sequence: Synthetic oligonucleotide
  Target: SCN9A; (+) strand; PAM type: NRG; PAM sequence: GGG
aaaccctaagtagactataa

SEQ ID NO: 53725 - DNA, 20 bp, Artificial Sequence
  Description of Artificial Sequence: Synthetic oligonucleotide
  Target: SCN9A; (+) strand; PAM type: NRG; PAM sequence: AAG
ctataagggcaatgcattat

SEQ ID NO: 53726 - DNA, 20 bp, Artificial Sequence
  Description of Artificial Sequence: Synthetic oligonucleotide
  Target: SCN9A; (+) strand; PAM type: NRG; PAM sequence: AGG
tataagggcaatgcattata

SEQ ID NO: 53727 - DNA, 20 bp, Artificial Sequence
  Description of Artificial Sequence: Synthetic oligonucleotide
  Target: SCN9A; (+) strand; PAM type: NRG; PAM sequence: TAG
agggcaatgcattataaggc

SEQ ID NO: 53728 - DNA, 20 bp, Artificial Sequence
  Description of Artificial Sequence: Synthetic oligonucleotide
  Target: SCN9A; (+) strand; PAM type: NRG; PAM sequence: GAG
ggcaatgcattataaggcta

SEQ ID NO: 53729 - DNA, 20 bp, Artificial Sequence
  Description of Artificial Sequence: Synthetic oligonucleotide
  Target: SCN9A; (+) strand; PAM type: NRG; PAM sequence: CAG
ccgtgtatataacaatacct

SEQ ID NO: 53730 - DNA, 20 bp, Artificial Sequence
  Description of Artificial Sequence: Synthetic oligonucleotide
  Target: SCN9A; (+) strand; PAM type: NRG; PAM sequence: CGG
tatataacaatacctcagac

SEQ ID NO: 53731 - DNA, 20 bp, Artificial Sequence
  Description of Artificial Sequence: Synthetic oligonucleotide
  Target: SCN9A; (+) strand; PAM type: NRG; PAM sequence: GGG
atataacaatacctcagacc

SEQ ID NO: 53732 - DNA, 20 bp, Artificial Sequence
  Description of Artificial Sequence: Synthetic oligonucleotide
  Target: SCN9A; (+) strand; PAM type: NRG; PAM sequence: TGG
acaatacctcagaccgggca

SEQ ID NO: 53733 - DNA, 20 bp, Artificial Sequence
  Description of Artificial Sequence: Synthetic oligonucleotide
  Target: SCN9A; (+) strand; PAM type: NRG; PAM sequence: TGG
atacctcagaccgggcatgg

SEQ ID NO: 53734 - DNA, 20 bp, Artificial Sequence
  Description of Artificial Sequence: Synthetic oligonucleotide
  Target: SCN9A; (+) strand; PAM type: NRG; PAM sequence: CAG
gtggctcacgcctgtaatcc

SEQ ID NO: 53735 - DNA, 20 bp, Artificial Sequence
  Description of Artificial Sequence: Synthetic oligonucleotide
  Target: SCN9A; (+) strand; PAM type: NRG; PAM sequence: TGG
cgcctgtaatcccagcactt

SEQ ID NO: 53736 - DNA, 20 bp, Artificial Sequence
  Description of Artificial Sequence: Synthetic oligonucleotide
  Target: SCN9A; (+) strand; PAM type: NRG; PAM sequence: AAG
ctgtaatcccagcactttgg

SEQ ID NO: 53737 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccagcactttgga

SEQ ID NO: 53738 - DNA, 20 bp, Artificial Sequence
  Description of Artificial Sequence: Synthetic oligonucleotide
  Target: SCN9A; (+) strand; PAM type: NRG; PAM sequence: GAG
tcccagcactttggaaggcc

SEQ ID NO: 53739 - DNA, 20 bp, Artificial Sequence
  Description of Artificial Sequence: Synthetic oligonucleotide
  Target: SCN9A; (+) strand; PAM type: NRG; PAM sequence: AGG
cccagcactttggaaggccg

SEQ ID NO: 53740 - DNA, 20 bp, Artificial Sequence
  Description of Artificial Sequence: Synthetic oligonucleotide
  Target: SCN9A; (+) strand; PAM type: NRG; PAM sequence: CAG
agcactttggaaggccgagg

SEQ ID NO: 53741 - DNA, 20 bp, Artificial Sequence
  Description of Artificial Sequence: Synthetic oligonucleotide
  Target: SCN9A; (+) strand; PAM type: NRG; PAM sequence: AGG
gcactttggaaggccgaggc

SEQ ID NO: 53742 - DNA, 20 bp, Artificial Sequence
  Description of Artificial Sequence: Synthetic oligonucleotide
  Target: SCN9A; (+) strand; PAM type: NRG; PAM sequence: TGG
ctttggaaggccgaggcagg

SEQ ID NO: 53743 - DNA, 20 bp, Artificial Sequence
  Description of Artificial Sequence: Synthetic oligonucleotide
  Target: SCN9A; (+) strand; PAM type: NRG; PAM sequence: AAG
cgaggcaggtggatcacctg

SEQ ID NO: 53744 - DNA, 20 bp, Artificial Sequence
  Description of Artificial Sequence: Synthetic oligonucleotide
  Target: SCN9A; (+) strand; PAM type: NRG; PAM sequence: CGG
gcaggtggatcacctgaagt

SEQ ID NO: 53745 - DNA, 20 bp, Artificial Sequence
  Description of Artificial Sequence: Synthetic oligonucleotide
  Target: SCN9A; (+) strand; PAM type: NRG; PAM sequence: GGG
caggtggatcacctgaagtc

SEQ ID NO: 53746 - DNA, 20 bp, Artificial Sequence
  Description of Artificial Sequence: Synthetic oligonucleotide
  Target: SCN9A; (+) strand; PAM type: NRG; PAM sequence: GAG
ggtggatcacctgaagtcgg

SEQ ID NO: 53747 - DNA, 20 bp, Artificial Sequence
  Description of Artificial Sequence: Synthetic oligonucleotide
  Target: SCN9A; (+) strand; PAM type: NRG; PAM sequence: GAG
tcacctgaagtcgggagttc

SEQ ID NO: 53748 - DNA, 20 bp, Artificial Sequence
  Description of Artificial Sequence: Synthetic oligonucleotide
  Target: SCN9A; (+) strand; PAM type: NRG; PAM sequence: CAG
tgaagtcgggagttcgagac

SEQ ID NO: 53749 - DNA, 20 bp, Artificial Sequence
  Description of Artificial Sequence: Synthetic oligonucleotide
  Target: SCN9A; (+) strand; PAM type: NRG; PAM sequence: TGG
cgagaccagtctgaccaaca

SEQ ID NO: 53750 - DNA, 20 bp, Artificial Sequence
  Description of Artificial Sequence: Synthetic oligonucleotide
  Target: SCN9A; (+) strand; PAM type: NRG; PAM sequence: GAG
agaccagtctgaccaacatg

SEQ ID NO: 53751 - DNA, 20 bp, Artificial Sequence
  Description of Artificial Sequence: Synthetic oligonucleotide
  Target: SCN9A; (+) strand; PAM type: NRG; PAM sequence: TAG
ctctactaaaaatacaaaat

SEQ ID NO: 53752 - DNA, 20 bp, Artificial Sequence
  Description of Artificial Sequence: Synthetic oligonucleotide
  Target: SCN9A; (+) strand; PAM type: NRG; PAM sequence: CAG
actaaaaatacaaaattagc

SEQ ID NO: 53753 - DNA, 20 bp, Artificial Sequence
  Description of Artificial Sequence: Synthetic oligonucleotide
  Target: SCN9A; (+) strand; PAM type: NRG; PAM sequence: AGG
ctaaaaatacaaaattagcc

SEQ ID NO: 53754 - DNA, 20 bp, Artificial Sequence
  Description of Artificial Sequence: Synthetic oligonucleotide
  Target: SCN9A; (+) strand; PAM type: NRG; PAM sequence: TGG
aatacaaaattagccaggcg

SEQ ID NO: 53755 - DNA, 20 bp, Artificial Sequence
  Description of Artificial Sequence: Synthetic oligonucleotide
  Target: SCN9A; (+) strand; PAM type: NRG; PAM sequence: TGG
acaaaattagccaggcgtgg

SEQ ID NO: 53756 - DNA, 20 bp, Artificial Sequence
  Description of Artificial Sequence: Synthetic oligonucleotide
  Target: SCN9A; (+) strand; PAM type: NRG; PAM sequence: GGG
caaaattagccaggcgtggt

SEQ ID NO: 53757 - DNA, 20 bp, Artificial Sequence
  Description of Artificial Sequence: Synthetic oligonucleotide
  Target: SCN9A; (+) strand; PAM type: NRG; PAM sequence: GGG
aaaattagccaggcgtggtg

SEQ ID NO: 53758 - DNA, 20 bp, Artificial Sequence
  Description of Artificial Sequence: Synthetic oligonucleotide
  Target: SCN9A; (+) strand; PAM type: NRG; PAM sequence: CAG
gtggggcatgcctgtaatcc

SEQ ID NO: 53759 - DNA, 20 bp, Artificial Sequence
  Description of Artificial Sequence: Synthetic oligonucleotide
  Target: SCN9A; (+) strand; PAM type: NRG; PAM sequence: CAG
tgcctgtaatcccagctact

SEQ ID NO: 53760 - DNA, 20 bp, Artificial Sequence
  Description of Artificial Sequence: Synthetic oligonucleotide
  Target: SCN9A; (+) strand; PAM type: NRG; PAM sequence: AGG
gcctgtaatcccagctactc

SEQ ID NO: 53761 - DNA, 20 bp, Artificial Sequence
  Description of Artificial Sequence: Synthetic oligonucleotide
  Target: SCN9A; (+) strand; PAM type: NRG; PAM sequence: GAG
ctgtaatcccagctactcag

SEQ ID NO: 53762 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccagctactcagg

SEQ ID NO: 53763 - DNA, 20 bp, Artificial Sequence
  Description of Artificial Sequence: Synthetic oligonucleotide
  Target: SCN9A; (+) strand; PAM type: NRG; PAM sequence: GAG
tcccagctactcaggaggct

SEQ ID NO: 53764 - DNA, 20 bp, Artificial Sequence
  Description of Artificial Sequence: Synthetic oligonucleotide
  Target: SCN9A; (+) strand; PAM type: NRG; PAM sequence: AGG
cccagctactcaggaggctg

SEQ ID NO: 53765 - DNA, 20 bp, Artificial Sequence
  Description of Artificial Sequence: Synthetic oligonucleotide
  Target: SCN9A; (+) strand; PAM type: NRG; PAM sequence: CAG
agctactcaggaggctgagg

SEQ ID NO: 53766 - DNA, 20 bp, Artificial Sequence
  Description of Artificial Sequence: Synthetic oligonucleotide
  Target: SCN9A; (+) strand; PAM type: NRG; PAM sequence: AAG
tactcaggaggctgaggcag

SEQ ID NO: 53767 - DNA, 20 bp, Artificial Sequence
  Description of Artificial Sequence: Synthetic oligonucleotide
  Target: SCN9A; (+) strand; PAM type: NRG; PAM sequence: TGG
gcagaagaattgcttgaacc

SEQ ID NO: 53768 - DNA, 20 bp, Artificial Sequence
  Description of Artificial Sequence: Synthetic oligonucleotide
  Target: SCN9A; (+) strand; PAM type: NRG; PAM sequence: GGG
cagaagaattgcttgaacct

SEQ ID NO: 53769 - DNA, 20 bp, Artificial Sequence
  Description of Artificial Sequence: Synthetic oligonucleotide
  Target: SCN9A; (+) strand; PAM type: NRG; PAM sequence: GAG
gaagaattgcttgaacctgg

SEQ ID NO: 53770 - DNA, 20 bp, Artificial Sequence
  Description of Artificial Sequence: Synthetic oligonucleotide
  Target: SCN9A; (+) strand; PAM type: NRG; PAM sequence: AGG
aagaattgcttgaacctggg

SEQ ID NO: 53771 - DNA, 20 bp, Artificial Sequence
  Description of Artificial Sequence: Synthetic oligonucleotide
  Target: SCN9A; (+) strand; PAM type: NRG; PAM sequence: CGG
aattgcttgaacctgggagg

SEQ ID NO: 53772 - DNA, 20 bp, Artificial Sequence
  Description of Artificial Sequence: Synthetic oligonucleotide
  Target: SCN9A; (+) strand; PAM type: NRG; PAM sequence: GAG
ttgcttgaacctgggaggcg

SEQ ID NO: 53773 - DNA, 20 bp, Artificial Sequence
  Description of Artificial Sequence: Synthetic oligonucleotide
  Target: SCN9A; (+) strand; PAM type: NRG; PAM sequence: AGG
tgcttgaacctgggaggcgg

SEQ ID NO: 53774 - DNA, 20 bp, Artificial Sequence
  Description of Artificial Sequence: Synthetic oligonucleotide
  Target: SCN9A; (+) strand; PAM type: NRG; PAM sequence: TGG
aacctgggaggcggaggttg

SEQ ID NO: 53775 - DNA, 20 bp, Artificial Sequence
  Description of Artificial Sequence: Synthetic oligonucleotide
  Target: SCN9A; (+) strand; PAM type: NRG; PAM sequence: GAG
tgggaggcggaggttgtggc

SEQ ID NO: 53776 - DNA, 20 bp, Artificial Sequence
  Description of Artificial Sequence: Synthetic oligonucleotide
  Target: SCN9A; (+) strand; PAM type: NRG; PAM sequence: AAG
ggcggaggttgtggcgagcc

SEQ ID NO: 53777 - DNA, 20 bp, Artificial Sequence
  Description of Artificial Sequence: Synthetic oligonucleotide
  Target: SCN9A; (+) strand; PAM type: NRG; PAM sequence: CAG
aagattgcgccattgcactc

SEQ ID NO: 53778 - DNA, 20 bp, Artificial Sequence
  Description of Artificial Sequence: Synthetic oligonucleotide
  Target: SCN9A; (+) strand; PAM type: NRG; PAM sequence: TGG
tgcgccattgcactccagcc

SEQ ID NO: 53779 - DNA, 20 bp, Artificial Sequence
  Description of Artificial Sequence: Synthetic oligonucleotide
  Target: SCN9A; (+) strand; PAM type: NRG; PAM sequence: GGG
gcgccattgcactccagcct

SEQ ID NO: 53780 - DNA, 20 bp, Artificial Sequence
  Description of Artificial Sequence: Synthetic oligonucleotide
  Target: SCN9A; (+) strand; PAM type: NRG; PAM sequence: AAG
tgcactccagcctgggcaac

SEQ ID NO: 53781 - DNA, 20 bp, Artificial Sequence
  Description of Artificial Sequence: Synthetic oligonucleotide
  Target: SCN9A; (+) strand; PAM type: NRG; PAM sequence: GAG
cactccagcctgggcaacaa

SEQ ID NO: 53782 - DNA, 20 bp, Artificial Sequence
  Description of Artificial Sequence: Synthetic oligonucleotide
  Target: SCN9A; (+) strand; PAM type: NRG; PAM sequence: TGG
taaaataaaattaacatgct

SEQ ID NO: 53783 - DNA, 20 bp, Artificial Sequence
  Description of Artificial Sequence: Synthetic oligonucleotide
  Target: SCN9A; (+) strand; PAM type: NRG; PAM sequence: TGG
tttgaaaacttttctactcc

SEQ ID NO: 53784 - DNA, 20 bp, Artificial Sequence
  Description of Artificial Sequence: Synthetic oligonucleotide
  Target: SCN9A; (+) strand; PAM type: NRG; PAM sequence: TGG
acttttctactcctggttcg

SEQ ID NO: 53785 - DNA, 20 bp, Artificial Sequence
  Description of Artificial Sequence: Synthetic oligonucleotide
  Target: SCN9A; (+) strand; PAM type: NRG; PAM sequence: AAG
aacttcctctgccataatta

SEQ ID NO: 53786 - DNA, 20 bp, Artificial Sequence
  Description of Artificial Sequence: Synthetic oligonucleotide
  Target: SCN9A; (+) strand; PAM type: NRG; PAM sequence: TGG
tgccataattaaagtatctc

SEQ ID NO: 53787 - DNA, 20 bp, Artificial Sequence
  Description of Artificial Sequence: Synthetic oligonucleotide
  Target: SCN9A; (+) strand; PAM type: NRG; PAM sequence: GGG
gccataattaaagtatctct

SEQ ID NO: 53788 - DNA, 20 bp, Artificial Sequence
  Description of Artificial Sequence: Synthetic oligonucleotide
  Target: SCN9A; (+) strand; PAM type: NRG; PAM sequence: TGG
atgattctattattcctgca

SEQ ID NO: 53789 - DNA, 20 bp, Artificial Sequence
  Description of Artificial Sequence: Synthetic oligonucleotide
  Target: SCN9A; (+) strand; PAM type: NRG; PAM sequence: CAG
ttcctgcatggataatttac

SEQ ID NO: 53790 - DNA, 20 bp, Artificial Sequence
  Description of Artificial Sequence: Synthetic oligonucleotide
  Target: SCN9A; (+) strand; PAM type: NRG; PAM sequence: AAG
ggataatttaccagtaattc

SEQ ID NO: 53791 - DNA, 20 bp, Artificial Sequence
  Description of Artificial Sequence: Synthetic oligonucleotide
  Target: SCN9A; (+) strand; PAM type: NRG; PAM sequence: AAG
gtaattcaagctttttatgt

SEQ ID NO: 53792 - DNA, 20 bp, Artificial Sequence
  Description of Artificial Sequence: Synthetic oligonucleotide
  Target: SCN9A; (+) strand; PAM type: NRG; PAM sequence: AGG
taattcaagctttttatgta

SEQ ID NO: 53793 - DNA, 20 bp, Artificial Sequence
  Description of Artificial Sequence: Synthetic oligonucleotide
  Target: SCN9A; (+) strand; PAM type: NRG; PAM sequence: GAG
attcaagctttttatgtaag

SEQ ID NO: 53794 - DNA, 20 bp, Artificial Sequence
  Description of Artificial Sequence: Synthetic oligonucleotide
  Target: SCN9A; (+) strand; PAM type: NRG; PAM sequence: GAG
tcaagctttttatgtaagga

SEQ ID NO: 53795 - DNA, 20 bp, Artificial Sequence
  Description of Artificial Sequence: Synthetic oligonucleotide
  Target: SCN9A; (+) strand; PAM type: NRG; PAM sequence: GAG
aagctttttatgtaaggaga

SEQ ID NO: 53796 - DNA, 20 bp, Artificial Sequence
  Description of Artificial Sequence: Synthetic oligonucleotide
  Target: SCN9A; (+) strand; PAM type: NRG; PAM sequence: CAG
tatgtaaggagagagattat

SEQ ID NO: 53797 - DNA, 20 bp, Artificial Sequence
  Description of Artificial Sequence: Synthetic oligonucleotide
  Target: SCN9A; (+) strand; PAM type: NRG; PAM sequence: TGG
agagattatcagaaaaacta

SEQ ID NO: 53798 - DNA, 20 bp, Artificial Sequence
  Description of Artificial Sequence: Synthetic oligonucleotide
  Target: SCN9A; (+) strand; PAM type: NRG; PAM sequence: GGG
gagattatcagaaaaactat

SEQ ID NO: 53799 - DNA, 20 bp, Artificial Sequence
  Description of Artificial Sequence: Synthetic oligonucleotide
  Target: SCN9A; (+) strand; PAM type: NRG; PAM sequence: GGG
agattatcagaaaaactatg

SEQ ID NO: 53800 - DNA, 20 bp, Artificial Sequence
  Description of Artificial Sequence: Synthetic oligonucleotide
  Target: SCN9A; (+) strand; PAM type: NRG; PAM sequence: CAG
aaactatggggatgcccctc

SEQ ID NO: 53801 - DNA, 20 bp, Artificial Sequence
  Description of Artificial Sequence: Synthetic oligonucleotide
  Target: SCN9A; (+) strand; PAM type: NRG; PAM sequence: AGG
aactatggggatgcccctcc

SEQ ID NO: 53802 - DNA, 20 bp, Artificial Sequence
  Description of Artificial Sequence: Synthetic oligonucleotide
  Target: SCN9A; (+) strand; PAM type: NRG; PAM sequence: TGG
atttcattttcattcttgtc

SEQ ID NO: 53803 - DNA, 20 bp, Artificial Sequence
  Description of Artificial Sequence: Synthetic oligonucleotide
  Target: SCN9A; (+) strand; PAM type: NRG; PAM sequence: GGG
tttcattttcattcttgtct

SEQ ID NO: 53804 - DNA, 20 bp, Artificial Sequence
  Description of Artificial Sequence: Synthetic oligonucleotide
  Target: SCN9A; (+) strand; PAM type: NRG; PAM sequence: CAG
tctgggcattctgcctttaa

SEQ ID NO: 53805 - DNA, 20 bp, Artificial Sequence
  Description of Artificial Sequence: Synthetic oligonucleotide
  Target: SCN9A; (+) strand; PAM type: NRG; PAM sequence: TGG
tgtgtaatgtccccaccact

SEQ ID NO: 53806 - DNA, 20 bp, Artificial Sequence
  Description of Artificial Sequence: Synthetic oligonucleotide
  Target: SCN9A; (+) strand; PAM type: NRG; PAM sequence: TAG
accacttggtttcatgaaac

SEQ ID NO: 53807 - DNA, 20 bp, Artificial Sequence
  Description of Artificial Sequence: Synthetic oligonucleotide
  Target: SCN9A; (+) strand; PAM type: NRG; PAM sequence: AGG
ccacttggtttcatgaaact

SEQ ID NO: 53808 - DNA, 20 bp, Artificial Sequence
  Description of Artificial Sequence: Synthetic oligonucleotide
  Target: SCN9A; (+) strand; PAM type: NRG; PAM sequence: CAG
aggtatccctatatgtgcct

SEQ ID NO: 53809 - DNA, 20 bp, Artificial Sequence
  Description of Artificial Sequence: Synthetic oligonucleotide
  Target: SCN9A; (+) strand; PAM type: NRG; PAM sequence: TAG
cacaaaacacaacaaaatta

SEQ ID NO: 53810 - DNA, 20 bp, Artificial Sequence
  Description of Artificial Sequence: Synthetic oligonucleotide
  Target: SCN9A; (+) strand; PAM type: NRG; PAM sequence: TGG
cacaacaaaattatagttgc

SEQ ID NO: 53811 - DNA, 20 bp, Artificial Sequence
  Description of Artificial Sequence: Synthetic oligonucleotide
  Target: SCN9A; (+) strand; PAM type: NRG; PAM sequence: TAG
cccttcatctctgctgattt

SEQ ID NO: 53812 - DNA, 20 bp, Artificial Sequence
  Description of Artificial Sequence: Synthetic oligonucleotide
  Target: SCN9A; (+) strand; PAM type: NRG; PAM sequence: AGG
ccttcatctctgctgatttt

SEQ ID NO: 53813 - DNA, 20 bp, Artificial Sequence
  Description of Artificial Sequence: Synthetic oligonucleotide
  Target: SCN9A; (+) strand; PAM type: NRG; PAM sequence: CAG
ctctgctgattttaggaatt

SEQ ID NO: 53814 - DNA, 20 bp, Artificial Sequence
  Description of Artificial Sequence: Synthetic oligonucleotide
  Target: SCN9A; (+) strand; PAM type: NRG; PAM sequence: AAG
ttttaggaattcagaaattt

SEQ ID NO: 53815 - DNA, 20 bp, Artificial Sequence
  Description of Artificial Sequence: Synthetic oligonucleotide
  Target: SCN9A; (+) strand; PAM type: NRG; PAM sequence: GAG
attcagaaatttaagaatat

SEQ ID NO: 53816 - DNA, 20 bp, Artificial Sequence
  Description of Artificial Sequence: Synthetic oligonucleotide
  Target: SCN9A; (+) strand; PAM type: NRG; PAM sequence: AAG
cagaaatttaagaatatgag

SEQ ID NO: 53817 - DNA, 20 bp, Artificial Sequence
  Description of Artificial Sequence: Synthetic oligonucleotide
  Target: SCN9A; (+) strand; PAM type: NRG; PAM sequence: TGG
gaatatgagaagttttgatt

SEQ ID NO: 53818 - DNA, 20 bp, Artificial Sequence
  Description of Artificial Sequence: Synthetic oligonucleotide
  Target: SCN9A; (+) strand; PAM type: NRG; PAM sequence: GGG
aatatgagaagttttgattt

SEQ ID NO: 53819 - DNA, 20 bp, Artificial Sequence
  Description of Artificial Sequence: Synthetic oligonucleotide
  Target: SCN9A; (+) strand; PAM type: NRG; PAM sequence: GGG
atatgagaagttttgatttg

SEQ ID NO: 53820 - DNA, 20 bp, Artificial Sequence
  Description of Artificial Sequence: Synthetic oligonucleotide
  Target: SCN9A; (+) strand; PAM type: NRG; PAM sequence: AAG
tgagaagttttgatttgggg

SEQ ID NO: 53821 - DNA, 20 bp, Artificial Sequence
  Description of Artificial Sequence: Synthetic oligonucleotide
  Target: SCN9A; (+) strand; PAM type: NRG; PAM sequence: GAG
agaagttttgatttggggaa

SEQ ID NO: 53822 - DNA, 20 bp, Artificial Sequence
  Description of Artificial Sequence: Synthetic oligonucleotide
  Target: SCN9A; (+) strand; PAM type: NRG; PAM sequence: AGG
gaagttttgatttggggaag

SEQ ID NO: 53823 - DNA, 20 bp, Artificial Sequence
  Description of Artificial Sequence: Synthetic oligonucleotide
  Target: SCN9A; (+) strand; PAM type: NRG; PAM sequence: TAG
ttgatttggggaagaggaat

SEQ ID NO: 53824 - DNA, 20 bp, Artificial Sequence
  Description of Artificial Sequence: Synthetic oligonucleotide
  Target: SCN9A; (+) strand; PAM type: NRG; PAM sequence: TAG
ggaagaggaattagtatgca

SEQ ID NO: 53825 - DNA, 20 bp, Artificial Sequence
  Description of Artificial Sequence: Synthetic oligonucleotide
  Target: SCN9A; (+) strand; PAM type: NRG; PAM sequence: AGG
gaagaggaattagtatgcat

SEQ ID NO: 53826 - DNA, 20 bp, Artificial Sequence
  Description of Artificial Sequence: Synthetic oligonucleotide
  Target: SCN9A; (+) strand; PAM type: NRG; PAM sequence: GGG
aagaggaattagtatgcata

SEQ ID NO: 53827 - DNA, 20 bp, Artificial Sequence
  Description of Artificial Sequence: Synthetic oligonucleotide
  Target: SCN9A; (+) strand; PAM type: NRG; PAM sequence: GGG
agaggaattagtatgcatag

SEQ ID NO: 53828 - DNA, 20 bp, Artificial Sequence
  Description of Artificial Sequence: Synthetic oligonucleotide
  Target: SCN9A; (+) strand; PAM type: NRG; PAM sequence: TAG
gtatgcataggggtatactt

SEQ ID NO: 53829 - DNA, 20 bp, Artificial Sequence
  Description of Artificial Sequence: Synthetic oligonucleotide
  Target: SCN9A; (+) strand; PAM type: NRG; PAM sequence: TAG
aactatgcccactattatcc

SEQ ID NO: 53830 - DNA, 20 bp, Artificial Sequence
  Description of Artificial Sequence: Synthetic oligonucleotide
  Target: SCN9A; (+) strand; PAM type: NRG; PAM sequence: GAG
tatcctagacacattgaatt

SEQ ID NO: 53831 - DNA, 20 bp, Artificial Sequence
  Description of Artificial Sequence: Synthetic oligonucleotide
  Target: SCN9A; (+) strand; PAM type: NRG; PAM sequence: TAG
gacacattgaattgagctct

SEQ ID NO: 53832 - DNA, 20 bp, Artificial Sequence
  Description of Artificial Sequence: Synthetic oligonucleotide
  Target: SCN9A; (+) strand; PAM type: NRG; PAM sequence: AAG
ttagaattttgtctgtaaat

SEQ ID NO: 53833 - DNA, 20 bp, Artificial Sequence
  Description of Artificial Sequence: Synthetic oligonucleotide
  Target: SCN9A; (+) strand; PAM type: NRG; PAM sequence: TAG
ttttgtctgtaaataagaat

SEQ ID NO: 53834 - DNA, 20 bp, Artificial Sequence
  Description of Artificial Sequence: Synthetic oligonucleotide
  Target: SCN9A; (+) strand; PAM type: NRG; PAM sequence: GAG
gaattagaactatattttat

SEQ ID NO: 53835 - DNA, 20 bp, Artificial Sequence
  Description of Artificial Sequence: Synthetic oligonucleotide
  Target: SCN9A; (+) strand; PAM type: NRG; PAM sequence: AGG
aattagaactatattttatg

SEQ ID NO: 53836 - DNA, 20 bp, Artificial Sequence
  Description of Artificial Sequence: Synthetic oligonucleotide
  Target: SCN9A; (+) strand; PAM type: NRG; PAM sequence: TAG
ttatgaggtcacttttaact

SEQ ID NO: 53837 - DNA, 20 bp, Artificial Sequence
  Description of Artificial Sequence: Synthetic oligonucleotide
  Target: SCN9A; (+) strand; PAM type: NRG; PAM sequence: TGG
ctgtcaatcatcttgcccac

SEQ ID NO: 53838 - DNA, 20 bp, Artificial Sequence
  Description of Artificial Sequence: Synthetic oligonucleotide
  Target: SCN9A; (+) strand; PAM type: NRG; PAM sequence: CAG
tcttgcccactggtgatcac

SEQ ID NO: 53839 - DNA, 20 bp, Artificial Sequence
  Description of Artificial Sequence: Synthetic oligonucleotide
  Target: SCN9A; (+) strand; PAM type: NRG; PAM sequence: AGG
cttgcccactggtgatcacc

SEQ ID NO: 53840 - DNA, 20 bp, Artificial Sequence
  Description of Artificial Sequence: Synthetic oligonucleotide
  Target: SCN9A; (+) strand; PAM type: NRG; PAM sequence: GGG
ttgcccactggtgatcacca

SEQ ID NO: 53841 - DNA, 20 bp, Artificial Sequence
  Description of Artificial Sequence: Synthetic oligonucleotide
  Target: SCN9A; (+) strand; PAM type: NRG; PAM sequence: AAG
cactggtgatcaccagggaa

SEQ ID NO: 53842 - DNA, 20 bp, Artificial Sequence
  Description of Artificial Sequence: Synthetic oligonucleotide
  Target: SCN9A; (+) strand; PAM type: NRG; PAM sequence: AGG
actggtgatcaccagggaaa

SEQ ID NO: 53843 - DNA, 20 bp, Artificial Sequence
  Description of Artificial Sequence: Synthetic oligonucleotide
  Target: SCN9A; (+) strand; PAM type: NRG; PAM sequence: AAG
gatcaccagggaaaaggcaa

SEQ ID NO: 53844 - DNA, 20 bp, Artificial Sequence
  Description of Artificial Sequence: Synthetic oligonucleotide
  Target: SCN9A; (+) strand; PAM type: NRG; PAM sequence: AGG
atcaccagggaaaaggcaaa

SEQ ID NO: 53845 - DNA, 20 bp, Artificial Sequence
  Description of Artificial Sequence: Synthetic oligonucleotide
  Target: SCN9A; (+) strand; PAM type: NRG; PAM sequence: AAG
aaaaggcaaaaggttattca

SEQ ID NO: 53846 - DNA, 20 bp, Artificial Sequence
  Description of Artificial Sequence: Synthetic oligonucleotide
  Target: SCN9A; (+) strand; PAM type: NRG; PAM sequence: AAG
aaggttattcaaagctcaaa

SEQ ID NO: 53847 - DNA, 20 bp, Artificial Sequence
  Description of Artificial Sequence: Synthetic oligonucleotide
  Target: SCN9A; (+) strand; PAM type: NRG; PAM sequence: AAG
aagctcaaaaagaacatttt

SEQ ID NO: 53848 - DNA, 20 bp, Artificial Sequence
  Description of Artificial Sequence: Synthetic oligonucleotide
  Target: SCN9A; (+) strand; PAM type: NRG; PAM sequence: CAG
tttaagtatatgtattacat

SEQ ID NO: 53849 - DNA, 20 bp, Artificial Sequence
  Description of Artificial Sequence: Synthetic oligonucleotide
  Target: SCN9A; (+) strand; PAM type: NRG; PAM sequence: CGG
aagtatatgtattacatcag

SEQ ID NO: 53850 - DNA, 20 bp, Artificial Sequence
  Description of Artificial Sequence: Synthetic oligonucleotide
  Target: SCN9A; (+) strand; PAM type: NRG; PAM sequence: TAG
tatgtattacatcagcggct

SEQ ID NO: 53851 - DNA, 20 bp, Artificial Sequence
  Description of Artificial Sequence: Synthetic oligonucleotide
  Target: SCN9A; (+) strand; PAM type: NRG; PAM sequence: AAG
tgcatgtgtattaaaatgtg

SEQ ID NO: 53852 - DNA, 20 bp, Artificial Sequence
  Description of Artificial Sequence: Synthetic oligonucleotide
  Target: SCN9A; (+) strand; PAM type: NRG; PAM sequence: AGG
gcatgtgtattaaaatgtga

SEQ ID NO: 53853 - DNA, 20 bp, Artificial Sequence
  Description of Artificial Sequence: Synthetic oligonucleotide
  Target: SCN9A; (+) strand; PAM type: NRG; PAM sequence: GGG
catgtgtattaaaatgtgaa

SEQ ID NO: 53854 - DNA, 20 bp, Artificial Sequence
  Description of Artificial Sequence: Synthetic oligonucleotide
  Target: SCN9A; (+) strand; PAM type: NRG; PAM sequence: CAG
gtgtattaaaatgtgaaggg

SEQ ID NO: 53855 - DNA, 20 bp, Artificial Sequence
  Description of Artificial Sequence: Synthetic oligonucleotide
  Target: SCN9A; (+) strand; PAM type: NRG; PAM sequence: AAG
ggcagtatattattaatcaa

SEQ ID NO: 53856 - DNA, 20 bp, Artificial Sequence
  Description of Artificial Sequence: Synthetic oligonucleotide
  Target: SCN9A; (+) strand; PAM type: NRG; PAM sequence: TGG
gtatattattaatcaaaaga

SEQ ID NO: 53857 - DNA, 20 bp, Artificial Sequence
  Description of Artificial Sequence: Synthetic oligonucleotide
  Target: SCN9A; (+) strand; PAM type: NRG; PAM sequence: AAG
atcaaaagatggttataact

SEQ ID NO: 53858 - DNA, 20 bp, Artificial Sequence
  Description of Artificial Sequence: Synthetic oligonucleotide
  Target: SCN9A; (+) strand; PAM type: NRG; PAM sequence: GAG
caaaagatggttataactaa

SEQ ID NO: 53859 - DNA, 20 bp, Artificial Sequence
  Description of Artificial Sequence: Synthetic oligonucleotide
  Target: SCN9A; (+) strand; PAM type: NRG; PAM sequence: AAG
agatggttataactaagagt

SEQ ID NO: 53860 - DNA, 20 bp, Artificial Sequence
  Description of Artificial Sequence: Synthetic oligonucleotide
  Target: SCN9A; (+) strand; PAM type: NRG; PAM sequence: CAG
ttataactaagagtaagaaa

SEQ ID NO: 53861 - DNA, 20 bp, Artificial Sequence
  Description of Artificial Sequence: Synthetic oligonucleotide
  Target: SCN9A; (+) strand; PAM type: NRG; PAM sequence: AGG
tataactaagagtaagaaac

SEQ ID NO: 53862 - DNA, 20 bp, Artificial Sequence
  Description of Artificial Sequence: Synthetic oligonucleotide
  Target: SCN9A; (+) strand; PAM type: NRG; PAM sequence: AAG
ttatttcaactacaaatata

SEQ ID NO: 53863 - DNA, 20 bp, Artificial Sequence
  Description of Artificial Sequence: Synthetic oligonucleotide
  Target: SCN9A; (+) strand; PAM type: NRG; PAM sequence: CGG
taaagcgaatgctattttga

SEQ ID NO: 53864 - DNA, 20 bp, Artificial Sequence
  Description of Artificial Sequence: Synthetic oligonucleotide
  Target: SCN9A; (+) strand; PAM type: NRG; PAM sequence: AAG
aaacattattttaacaaaaa

SEQ ID NO: 53865 - DNA, 20 bp, Artificial Sequence
  Description of Artificial Sequence: Synthetic oligonucleotide
  Target: SCN9A; (+) strand; PAM type: NRG; PAM sequence: CAG
tttaacaaaaaaagcttttt

SEQ ID NO: 53866 - DNA, 20 bp, Artificial Sequence
  Description of Artificial Sequence: Synthetic oligonucleotide
  Target: SCN9A; (+) strand; PAM type: NRG; PAM sequence: GAG
taacaaaaaaagctttttca

SEQ ID NO: 53867 - DNA, 20 bp, Artificial Sequence
  Description of Artificial Sequence: Synthetic oligonucleotide
  Target: SCN9A; (+) strand; PAM type: NRG; PAM sequence: AAG
aaaagctttttcagagtgct

SEQ ID NO: 53868 - DNA, 20 bp, Artificial Sequence
  Description of Artificial Sequence: Synthetic oligonucleotide
  Target: SCN9A; (+) strand; PAM type: NRG; PAM sequence: GAG
aagctttttcagagtgctaa

SEQ ID NO: 53869 - DNA, 20 bp, Artificial Sequence
  Description of Artificial Sequence: Synthetic oligonucleotide
  Target: SCN9A; (+) strand; PAM type: NRG; PAM sequence: AAG
tttgcctgctctctatatat

SEQ ID NO: 53870 - DNA, 20 bp, Artificial Sequence
  Description of Artificial Sequence: Synthetic oligonucleotide
  Target: SCN9A; (+) strand; PAM type: NRG; PAM sequence: CAG
ctgctctctatatataagca

SEQ ID NO: 53871 - DNA, 20 bp, Artificial Sequence
  Description of Artificial Sequence: Synthetic oligonucleotide
  Target: SCN9A; (+) strand; PAM type: NRG; PAM sequence: CAG
tataagcacagacgcacaca

SEQ ID NO: 53872 - DNA, 20 bp, Artificial Sequence
  Description of Artificial Sequence: Synthetic oligonucleotide
  Target: SCN9A; (+) strand; PAM type: NRG; PAM sequence: AAG
gacatacacacatatttcct

SEQ ID NO: 53873 - DNA, 20 bp, Artificial Sequence
  Description of Artificial Sequence: Synthetic oligonucleotide
  Target: SCN9A; (+) strand; PAM type: NRG; PAM sequence: TAG
atacacacatatttcctaag

SEQ ID NO: 53874 - DNA, 20 bp, Artificial Sequence
  Description of Artificial Sequence: Synthetic oligonucleotide
  Target: SCN9A; (+) strand; PAM type: NRG; PAM sequence: AAG
tatttcctaagtagacactt

SEQ ID NO: 53875 - DNA, 20 bp, Artificial Sequence
  Description of Artificial Sequence: Synthetic oligonucleotide
  Target: SCN9A; (+) strand; PAM type: NRG; PAM sequence: AAG
cacttaagacattcatatct

SEQ ID NO: 53876 - DNA, 20 bp, Artificial Sequence
  Description of Artificial Sequence: Synthetic oligonucleotide
  Target: SCN9A; (+) strand; PAM type: NRG; PAM sequence: TGG
agttttaaaaaaatctgatt

SEQ ID NO: 53877 - DNA, 20 bp, Artificial Sequence
  Description of Artificial Sequence: Synthetic oligonucleotide
  Target: SCN9A; (+) strand; PAM type: NRG; PAM sequence: AAG
aaatctgatttggcgacaca

SEQ ID NO: 53878 - DNA, 20 bp, Artificial Sequence
  Description of Artificial Sequence: Synthetic oligonucleotide
  Target: SCN9A; (+) strand; PAM type: NRG; PAM sequence: AGG
aatctgatttggcgacacaa

SEQ ID NO: 53879 - DNA, 20 bp, Artificial Sequence
  Description of Artificial Sequence: Synthetic oligonucleotide
  Target: SCN9A; (+) strand; PAM type: NRG; PAM sequence: AAG
ttggcgacacaaaggcttcc

SEQ ID NO: 53880 - DNA, 20 bp, Artificial Sequence
  Description of Artificial Sequence: Synthetic oligonucleotide
  Target: SCN9A; (+) strand; PAM type: NRG; PAM sequence: AGG
tggcgacacaaaggcttcca

SEQ ID NO: 53881 - DNA, 20 bp, Artificial Sequence
  Description of Artificial Sequence: Synthetic oligonucleotide
  Target: SCN9A; (+) strand; PAM type: NRG; PAM sequence: GGG
ggcgacacaaaggcttccaa

SEQ ID NO: 53882 - DNA, 20 bp, Artificial Sequence
  Description of Artificial Sequence: Synthetic oligonucleotide
  Target: SCN9A; (+) strand; PAM type: NRG; PAM sequence: AAG
gacacaaaggcttccaaggg

SEQ ID NO: 53883 - DNA, 20 bp, Artificial Sequence
  Description of Artificial Sequence: Synthetic oligonucleotide
  Target: SCN9A; (+) strand; PAM type: NRG; PAM sequence: AAG
gaatttaacaaaatatcttg

SEQ ID NO: 53884 - DNA, 20 bp, Artificial Sequence
  Description of Artificial Sequence: Synthetic oligonucleotide
  Target: SCN9A; (+) strand; PAM type: NRG; PAM sequence: AAG
caaaatatcttgaagtcttg

SEQ ID NO: 53885 - DNA, 20 bp, Artificial Sequence
  Description of Artificial Sequence: Synthetic oligonucleotide
  Target: SCN9A; (+) strand; PAM type: NRG; PAM sequence: AAG
ttgaagtcttgaagcatgaa

SEQ ID NO: 53886 - DNA, 20 bp, Artificial Sequence
  Description of Artificial Sequence: Synthetic oligonucleotide
  Target: SCN9A; (+) strand; PAM type: NRG; PAM sequence: AAG
tgaagcatgaaaagcctaaa

SEQ ID NO: 53887 - DNA, 20 bp, Artificial Sequence
  Description of Artificial Sequence: Synthetic oligonucleotide
  Target: SCN9A; (+) strand; PAM type: NRG; PAM sequence: AAG
agcatgaaaagcctaaaaag

SEQ ID NO: 53888 - DNA, 20 bp, Artificial Sequence
  Description of Artificial Sequence: Synthetic oligonucleotide
  Target: SCN9A; (+) strand; PAM type: NRG; PAM sequence: CAG
caaaacaaaaacccacacat

SEQ ID NO: 53889 - DNA, 20 bp, Artificial Sequence
  Description of Artificial Sequence: Synthetic oligonucleotide
  Target: SCN9A; (+) strand; PAM type: NRG; PAM sequence: AGG
aaaacaaaaacccacacatc

SEQ ID NO: 53890 - DNA, 20 bp, Artificial Sequence
  Description of Artificial Sequence: Synthetic oligonucleotide
  Target: SCN9A; (+) strand; PAM type: NRG; PAM sequence: GGG
aaacaaaaacccacacatca

SEQ ID NO: 53891 - DNA, 20 bp, Artificial Sequence
  Description of Artificial Sequence: Synthetic oligonucleotide
  Target: SCN9A; (+) strand; PAM type: NRG; PAM sequence: TGG
caaaaacccacacatcaggg

SEQ ID NO: 53892 - DNA, 20 bp, Artificial Sequence
  Description of Artificial Sequence: Synthetic oligonucleotide
  Target: SCN9A; (+) strand; PAM type: NRG; PAM sequence: GAG
acacatcagggtggtgaaat

SEQ ID NO: 53893 - DNA, 20 bp, Artificial Sequence
  Description of Artificial Sequence: Synthetic oligonucleotide
  Target: SCN9A; (+) strand; PAM type: NRG; PAM sequence: AAG
atcagggtggtgaaatgaga

SEQ ID NO: 53894 - DNA, 20 bp, Artificial Sequence
  Description of Artificial Sequence: Synthetic oligonucleotide
  Target: SCN9A; (+) strand; PAM type: NRG; PAM sequence: CAG
gggtggtgaaatgagaaagt

SEQ ID NO: 53895 - DNA, 20 bp, Artificial Sequence
  Description of Artificial Sequence: Synthetic oligonucleotide
  Target: SCN9A; (+) strand; PAM type: NRG; PAM sequence: AAG
tcagaaacattttccttata

SEQ ID NO: 53896 - DNA, 20 bp, Artificial Sequence
  Description of Artificial Sequence: Synthetic oligonucleotide
  Target: SCN9A; (+) strand; PAM type: NRG; PAM sequence: TGG
tcaaccacacaattacttta

SEQ ID NO: 53897 - DNA, 20 bp, Artificial Sequence
  Description of Artificial Sequence: Synthetic oligonucleotide
  Target: SCN9A; (+) strand; PAM type: NRG; PAM sequence: GAG
aaaaattgcttcctgcaact

SEQ ID NO: 53898 - DNA, 20 bp, Artificial Sequence
  Description of Artificial Sequence: Synthetic oligonucleotide
  Target: SCN9A; (+) strand; PAM type: NRG; PAM sequence: GAG
ttgcttcctgcaactgagct

SEQ ID NO: 53899 - DNA, 20 bp, Artificial Sequence
  Description of Artificial Sequence: Synthetic oligonucleotide
  Target: SCN9A; (+) strand; PAM type: NRG; PAM sequence: AGG
tgcttcctgcaactgagctg

SEQ ID NO: 53900 - DNA, 20 bp, Artificial Sequence
  Description of Artificial Sequence: Synthetic oligonucleotide
  Target: SCN9A; (+) strand; PAM type: NRG; PAM sequence: TAG
tgcaactgagctgaggaatt

SEQ ID NO: 53901 - DNA, 20 bp, Artificial Sequence
  Description of Artificial Sequence: Synthetic oligonucleotide
  Target: SCN9A; (+) strand; PAM type: NRG; PAM sequence: AGG
gcaactgagctgaggaattt

SEQ ID NO: 53902 - DNA, 20 bp, Artificial Sequence
  Description of Artificial Sequence: Synthetic oligonucleotide
  Target: SCN9A; (+) strand; PAM type: NRG; PAM sequence: GGG
caactgagctgaggaattta

SEQ ID NO: 53903 - DNA, 20 bp, Artificial Sequence
  Description of Artificial Sequence: Synthetic oligonucleotide
  Target: SCN9A; (+) strand; PAM type: NRG; PAM sequence: AAG
tttagggatgatatgtgtca

SEQ ID NO: 53904 - DNA, 20 bp, Artificial Sequence
  Description of Artificial Sequence: Synthetic oligonucleotide
  Target: SCN9A; (+) strand; PAM type: NRG; PAM sequence: AGG
ttagggatgatatgtgtcaa

SEQ ID NO: 53905 - DNA, 20 bp, Artificial Sequence
  Description of Artificial Sequence: Synthetic oligonucleotide
  Target: SCN9A; (+) strand; PAM type: NRG; PAM sequence: AAG
tgaaaacatgtttctttttc

SEQ ID NO: 53906 - DNA, 20 bp, Artificial Sequence
  Description of Artificial Sequence: Synthetic oligonucleotide
  Target: SCN9A; (+) strand; PAM type: NRG; PAM sequence: AAG
catgtttctttttcaagcaa

SEQ ID NO: 53907 - DNA, 20 bp, Artificial Sequence
  Description of Artificial Sequence: Synthetic oligonucleotide
  Target: SCN9A; (+) strand; PAM type: NRG; PAM sequence: TGG
tctttttcaagcaaaagatg

SEQ ID NO: 53908 - DNA, 20 bp, Artificial Sequence
  Description of Artificial Sequence: Synthetic oligonucleotide
  Target: SCN9A; (+) strand; PAM type: NRG; PAM sequence: GGG
ctttttcaagcaaaagatgt

SEQ ID NO: 53909 - DNA, 20 bp, Artificial Sequence
  Description of Artificial Sequence: Synthetic oligonucleotide
  Target: SCN9A; (+) strand; PAM type: NRG; PAM sequence: TGG
agcaaaagatgtgggtcatg

SEQ ID NO: 53910 - DNA, 20 bp, Artificial Sequence
  Description of Artificial Sequence: Synthetic oligonucleotide
  Target: SCN9A; (+) strand; PAM type: NRG; PAM sequence: AAG
aaagatgtgggtcatgtggt

SEQ ID NO: 53911 - DNA, 20 bp, Artificial Sequence
  Description of Artificial Sequence: Synthetic oligonucleotide
  Target: SCN9A; (+) strand; PAM type: NRG; PAM sequence: AGG
aagatgtgggtcatgtggta

SEQ ID NO: 53912 - DNA, 20 bp, Artificial Sequence
  Description of Artificial Sequence: Synthetic oligonucleotide
  Target: SCN9A; (+) strand; PAM type: NRG; PAM sequence: TGG
gttctattgcaatatcttca

SEQ ID NO: 53913 - DNA, 20 bp, Artificial Sequence
  Description of Artificial Sequence: Synthetic oligonucleotide
  Target: SCN9A; (+) strand; PAM type: NRG; PAM sequence: AAG
cttcatggctctcttgccaa

SEQ ID NO: 53914 - DNA, 20 bp, Artificial Sequence
  Description of Artificial Sequence: Synthetic oligonucleotide
  Target: SCN9A; (+) strand; PAM type: NRG; PAM sequence: TGG
tatttaatcactttatctaa

SEQ ID NO: 53915 - DNA, 20 bp, Artificial Sequence
  Description of Artificial Sequence: Synthetic oligonucleotide
  Target: SCN9A; (+) strand; PAM type: NRG; PAM sequence: AAG
tctaatggatgtgatttcta

SEQ ID NO: 53916 - DNA, 20 bp, Artificial Sequence
  Description of Artificial Sequence: Synthetic oligonucleotide
  Target: SCN9A; (+) strand; PAM type: NRG; PAM sequence: CAG
ggatgtgatttctaaagtca

SEQ ID NO: 53917 - DNA, 20 bp, Artificial Sequence
  Description of Artificial Sequence: Synthetic oligonucleotide
  Target: SCN9A; (+) strand; PAM type: NRG; PAM sequence: TAG
gtgatttctaaagtcacagt

SEQ ID NO: 53918 - DNA, 20 bp, Artificial Sequence
  Description of Artificial Sequence: Synthetic oligonucleotide
  Target: SCN9A; (+) strand; PAM type: NRG; PAM sequence: TAG
ctaaagtcacagttagccat

SEQ ID NO: 53919 - DNA, 20 bp, Artificial Sequence
  Description of Artificial Sequence: Synthetic oligonucleotide
  Target: SCN9A; (+) strand; PAM type: NRG; PAM sequence: AGG
taaagtcacagttagccatt

SEQ ID NO: 53920 - DNA, 20 bp, Artificial Sequence
  Description of Artificial Sequence: Synthetic oligonucleotide
  Target: SCN9A; (+) strand; PAM type: NRG; PAM sequence: AAG
gtcacagttagccattagga

SEQ ID NO: 53921 - DNA, 20 bp, Artificial Sequence
  Description of Artificial Sequence: Synthetic oligonucleotide
  Target: SCN9A; (+) strand; PAM type: NRG; PAM sequence: TGG
cattaggaaagctcttgctc

SEQ ID NO: 53922 - DNA, 20 bp, Artificial Sequence
  Description of Artificial Sequence: Synthetic oligonucleotide
  Target: SCN9A; (+) strand; PAM type: NRG; PAM sequence: CAG
ggaaagctcttgctctggtt

SEQ ID NO: 53923 - DNA, 20 bp, Artificial Sequence
  Description of Artificial Sequence: Synthetic oligonucleotide
  Target: SCN9A; (+) strand; PAM type: NRG; PAM sequence: GAG
gctcttgctctggttcagct

SEQ ID NO: 53924 - DNA, 20 bp, Artificial Sequence
  Description of Artificial Sequence: Synthetic oligonucleotide
  Target: SCN9A; (+) strand; PAM type: NRG; PAM sequence: TGG
gattacatttcctgactttg

SEQ ID NO: 53925 - DNA, 20 bp, Artificial Sequence
  Description of Artificial Sequence: Synthetic oligonucleotide
  Target: SCN9A; (+) strand; PAM type: NRG; PAM sequence: CAG
atttcctgactttgtggttt

SEQ ID NO: 53926 - DNA, 20 bp, Artificial Sequence
  Description of Artificial Sequence: Synthetic oligonucleotide
  Target: SCN9A; (+) strand; PAM type: NRG; PAM sequence: GAG
ttcctgactttgtggtttca

SEQ ID NO: 53927 - DNA, 20 bp, Artificial Sequence
  Description of Artificial Sequence: Synthetic oligonucleotide
  Target: SCN9A; (+) strand; PAM type: NRG; PAM sequence: AAG
ctgactttgtggtttcagag

SEQ ID NO: 53928 - DNA, 20 bp, Artificial Sequence
  Description of Artificial Sequence: Synthetic oligonucleotide
  Target: SCN9A; (+) strand; PAM type: NRG; PAM sequence: CAG
actttgtggtttcagagaag

SEQ ID NO: 53929 - DNA, 20 bp, Artificial Sequence
  Description of Artificial Sequence: Synthetic oligonucleotide
  Target: SCN9A; (+) strand; PAM type: NRG; PAM sequence: GAG
tttgtggtttcagagaagca

SEQ ID NO: 53930 - DNA, 20 bp, Artificial Sequence
  Description of Artificial Sequence: Synthetic oligonucleotide
  Target: SCN9A; (+) strand; PAM type: NRG; PAM sequence: TGG
tggtttcagagaagcagagc

SEQ ID NO: 53931 - DNA, 20 bp, Artificial Sequence
  Description of Artificial Sequence: Synthetic oligonucleotide
  Target: SCN9A; (+) strand; PAM type: NRG; PAM sequence: TGG
tttcagagaagcagagctgg

SEQ ID NO: 53932 - DNA, 20 bp, Artificial Sequence
  Description of Artificial Sequence: Synthetic oligonucleotide
  Target: SCN9A; (+) strand; PAM type: NRG; PAM sequence: GAG
tcagagaagcagagctggtg

SEQ ID NO: 53933 - DNA, 20 bp, Artificial Sequence
  Description of Artificial Sequence: Synthetic oligonucleotide
  Target: SCN9A; (+) strand; PAM type: NRG; PAM sequence: TGG
agagctggtggagaattccc

SEQ ID NO: 53934 - DNA, 20 bp, Artificial Sequence
  Description of Artificial Sequence: Synthetic oligonucleotide
  Target: SCN9A; (+) strand; PAM type: NRG; PAM sequence: TGG
ctggtggagaattccctggc

SEQ ID NO: 53935 - DNA, 20 bp, Artificial Sequence
  Description of Artificial Sequence: Synthetic oligonucleotide
  Target: SCN9A; (+) strand; PAM type: NRG; PAM sequence: CAG
aattccctggctggattcat

SEQ ID NO: 53936 - DNA, 20 bp, Artificial Sequence
  Description of Artificial Sequence: Synthetic oligonucleotide
  Target: SCN9A; (+) strand; PAM type: NRG; PAM sequence: TGG
ggattcatcagtctttgcta

SEQ ID NO: 53937 - DNA, 20 bp, Artificial Sequence
  Description of Artificial Sequence: Synthetic oligonucleotide
  Target: SCN9A; (+) strand; PAM type: NRG; PAM sequence: AAG
catcagtctttgctatggac

SEQ ID NO: 53938 - DNA, 20 bp, Artificial Sequence
  Description of Artificial Sequence: Synthetic oligonucleotide
  Target: SCN9A; (+) strand; PAM type: NRG; PAM sequence: GAG
tcagtctttgctatggacaa

SEQ ID NO: 53939 - DNA, 20 bp, Artificial Sequence
  Description of Artificial Sequence: Synthetic oligonucleotide
  Target: SCN9A; (+) strand; PAM type: NRG; PAM sequence: CAG
ttgctatggacaagagaata

SEQ ID NO: 53940 - DNA, 20 bp, Artificial Sequence
  Description of Artificial Sequence: Synthetic oligonucleotide
  Target: SCN9A; (+) strand; PAM type: NRG; PAM sequence: AAG
tatggacaagagaatacagt

SEQ ID NO: 53941 - DNA, 20 bp, Artificial Sequence
  Description of Artificial Sequence: Synthetic oligonucleotide
  Target: SCN9A; (+) strand; PAM type: NRG; PAM sequence: AAG
agaatacagtaagaccatcc

SEQ ID NO: 53942 - DNA, 20 bp, Artificial Sequence
  Description of Artificial Sequence: Synthetic oligonucleotide
  Target: SCN9A; (+) strand; PAM type: NRG; PAM sequence: TAG
agtaagaccatccaagtcat

SEQ ID NO: 53943 - DNA, 20 bp, Artificial Sequence
  Description of Artificial Sequence: Synthetic oligonucleotide
  Target: SCN9A; (+) strand; PAM type: NRG; PAM sequence: TGG
accatccaagtcattagtct

SEQ ID NO: 53944 - DNA, 20 bp, Artificial Sequence
  Description of Artificial Sequence: Synthetic oligonucleotide
  Target: SCN9A; (+) strand; PAM type: NRG; PAM sequence: GGG
ccatccaagtcattagtctt

SEQ ID NO: 53945 - DNA, 20 bp, Artificial Sequence
  Description of Artificial Sequence: Synthetic oligonucleotide
  Target: SCN9A; (+) strand; PAM type: NRG; PAM sequence: GGG
catccaagtcattagtcttg

SEQ ID NO: 53946 - DNA, 20 bp, Artificial Sequence
  Description of Artificial Sequence: Synthetic oligonucleotide
  Target: SCN9A; (+) strand; PAM type: NRG; PAM sequence: GGG
atccaagtcattagtcttgg

SEQ ID NO: 53947 - DNA, 20 bp, Artificial Sequence
  Description of Artificial Sequence: Synthetic oligonucleotide
  Target: SCN9A; (+) strand; PAM type: NRG; PAM sequence: TGG
aagtcattagtcttgggggt

SEQ ID NO: 53948 - DNA, 20 bp, Artificial Sequence
  Description of Artificial Sequence: Synthetic oligonucleotide
  Target: SCN9A; (+) strand; PAM type: NRG; PAM sequence: GGG
agtcattagtcttgggggtt

SEQ ID NO: 53949 - DNA, 20 bp, Artificial Sequence
  Description of Artificial Sequence: Synthetic oligonucleotide
  Target: SCN9A; (+) strand; PAM type: NRG; PAM sequence: TAG
cattagtcttgggggttggg

SEQ ID NO: 53950 - DNA, 20 bp, Artificial Sequence
  Description of Artificial Sequence: Synthetic oligonucleotide
  Target: SCN9A; (+) strand; PAM type: NRG; PAM sequence: AAG
tgggtagattcactacatcc

SEQ ID NO: 53951 - DNA, 20 bp, Artificial Sequence
  Description of Artificial Sequence: Synthetic oligonucleotide
  Target: SCN9A; (+) strand; PAM type: NRG; PAM sequence: TAG
attcactacatccaagtctt

SEQ ID NO: 53952 - DNA, 20 bp, Artificial Sequence
  Description of Artificial Sequence: Synthetic oligonucleotide
  Target: SCN9A; (+) strand; PAM type: NRG; PAM sequence: GAG
tcactacatccaagtcttta

SEQ ID NO: 53953 - DNA, 20 bp, Artificial Sequence
  Description of Artificial Sequence: Synthetic oligonucleotide
  Target: SCN9A; (+) strand; PAM type: NRG; PAM sequence: AAG
acatccaagtctttagagcc

SEQ ID NO: 53954 - DNA, 20 bp, Artificial Sequence
  Description of Artificial Sequence: Synthetic oligonucleotide
  Target: SCN9A; (+) strand; PAM type: NRG; PAM sequence: TGG
tttagagccaagtgcccata

SEQ ID NO: 53955 - DNA, 20 bp, Artificial Sequence
  Description of Artificial Sequence: Synthetic oligonucleotide
  Target: SCN9A; (+) strand; PAM type: NRG; PAM sequence: TAG
atggctaactttaattacta

SEQ ID NO: 53956 - DNA, 20 bp, Artificial Sequence
  Description of Artificial Sequence: Synthetic oligonucleotide
  Target: SCN9A; (+) strand; PAM type: NRG; PAM sequence: CAG
taactttaattactatagaa

SEQ ID NO: 53957 - DNA, 20 bp, Artificial Sequence
  Description of Artificial Sequence: Synthetic oligonucleotide
  Target: SCN9A; (+) strand; PAM type: NRG; PAM sequence: TAG
aaattcttacccttcttgat

SEQ ID NO: 53958 - DNA, 20 bp, Artificial Sequence
  Description of Artificial Sequence: Synthetic oligonucleotide
  Target: SCN9A; (+) strand; PAM type: NRG; PAM sequence: TGG
cttacccttcttgattagat

SEQ ID NO: 53959 - DNA, 20 bp, Artificial Sequence
  Description of Artificial Sequence: Synthetic oligonucleotide
  Target: SCN9A; (+) strand; PAM type: NRG; PAM sequence: TGG
attggaaacaaatctcatta

SEQ ID NO: 53960 - DNA, 20 bp, Artificial Sequence
  Description of Artificial Sequence: Synthetic oligonucleotide
  Target: SCN9A; (+) strand; PAM type: NRG; PAM sequence: GAG
tggaaacaaatctcattatg

SEQ ID NO: 53961 - DNA, 20 bp, Artificial Sequence
  Description of Artificial Sequence: Synthetic oligonucleotide
  Target: SCN9A; (+) strand; PAM type: NRG; PAM sequence: AAG
agttttaaataattaccatg

SEQ ID NO: 53962 - DNA, 20 bp, Artificial Sequence
  Description of Artificial Sequence: Synthetic oligonucleotide
  Target: SCN9A; (+) strand; PAM type: NRG; PAM sequence: AAG
tcatcaacctgataccatct

SEQ ID NO: 53963 - DNA, 20 bp, Artificial Sequence
  Description of Artificial Sequence: Synthetic oligonucleotide
  Target: SCN9A; (+) strand; PAM type: NRG; PAM sequence: AAG
acttgaaaaaatttaaattc

SEQ ID NO: 53964 - DNA, 20 bp, Artificial Sequence
  Description of Artificial Sequence: Synthetic oligonucleotide
  Target: SCN9A; (+) strand; PAM type: NRG; PAM sequence: TAG
aaaaaatttaaattcaagta

SEQ ID NO: 53965 - DNA, 20 bp, Artificial Sequence
  Description of Artificial Sequence: Synthetic oligonucleotide
  Target: SCN9A; (+) strand; PAM type: NRG; PAM sequence: AAG
tgtgatatgtttactgttgt

SEQ ID NO: 53966 - DNA, 20 bp, Artificial Sequence
  Description of Artificial Sequence: Synthetic oligonucleotide
  Target: SCN9A; (+) strand; PAM type: NRG; PAM sequence: CAG
atgtttactgttgtaagata

SEQ ID NO: 53967 - DNA, 20 bp, Artificial Sequence
  Description of Artificial Sequence: Synthetic oligonucleotide
  Target: SCN9A; (+) strand; PAM type: NRG; PAM sequence: AAG
taagatacagtaaaaaatgt

SEQ ID NO: 53968 - DNA, 20 bp, Artificial Sequence
  Description of Artificial Sequence: Synthetic oligonucleotide
  Target: SCN9A; (+) strand; PAM type: NRG; PAM sequence: GAG
atacagtaaaaaatgtaagt

SEQ ID NO: 53969 - DNA, 20 bp, Artificial Sequence
  Description of Artificial Sequence: Synthetic oligonucleotide
  Target: SCN9A; (+) strand; PAM type: NRG; PAM sequence: TAG
agtaaaaaatgtaagtgagc

SEQ ID NO: 53970 - DNA, 20 bp, Artificial Sequence
  Description of Artificial Sequence: Synthetic oligonucleotide
  Target: SCN9A; (+) strand; PAM type: NRG; PAM sequence: TAG
gagctagaatatatcacaaa

SEQ ID NO: 53971 - DNA, 20 bp, Artificial Sequence
  Description of Artificial Sequence: Synthetic oligonucleotide
  Target: SCN9A; (+) strand; PAM type: NRG; PAM sequence: TGG
tccctattgtcttcattcta

SEQ ID NO: 53972 - DNA, 20 bp, Artificial Sequence
  Description of Artificial Sequence: Synthetic oligonucleotide
  Target: SCN9A; (+) strand; PAM type: NRG; PAM sequence: AAG
ttcattctatggcgtttctt

SEQ ID NO: 53973 - DNA, 20 bp, Artificial Sequence
  Description of Artificial Sequence: Synthetic oligonucleotide
  Target: SCN9A; (+) strand; PAM type: NRG; PAM sequence: TAG
aaacacgtacaatgttaaaa

SEQ ID NO: 53974 - DNA, 20 bp, Artificial Sequence
  Description of Artificial Sequence: Synthetic oligonucleotide
  Target: SCN9A; (+) strand; PAM type: NRG; PAM sequence: AAG
cttgacatctcaaaaaaaat

SEQ ID NO: 53975 - DNA, 20 bp, Artificial Sequence
  Description of Artificial Sequence: Synthetic oligonucleotide
  Target: SCN9A; (+) strand; PAM type: NRG; PAM sequence: TGG
taagccctaaacccgtaaaa

SEQ ID NO: 53976 - DNA, 20 bp, Artificial Sequence
  Description of Artificial Sequence: Synthetic oligonucleotide
  Target: SCN9A; (+) strand; PAM type: NRG; PAM sequence: GGG
aagccctaaacccgtaaaat

SEQ ID NO: 53977 - DNA, 20 bp, Artificial Sequence
  Description of Artificial Sequence: Synthetic oligonucleotide
  Target: SCN9A; (+) strand; PAM type: NRG; PAM sequence: GGG
agccctaaacccgtaaaatg

SEQ ID NO: 53978 - DNA, 20 bp, Artificial Sequence
  Description of Artificial Sequence: Synthetic oligonucleotide
  Target: SCN9A; (+) strand; PAM type: NRG; PAM sequence: GAG
ccctaaacccgtaaaatggg

SEQ ID NO: 53979 - DNA, 20 bp, Artificial Sequence
  Description of Artificial Sequence: Synthetic oligonucleotide
  Target: SCN9A; (+) strand; PAM type: NRG; PAM sequence: AAG
aatggggagaaaaaactata

SEQ ID NO: 53980 - DNA, 20 bp, Artificial Sequence
  Description of Artificial Sequence: Synthetic oligonucleotide
  Target: SCN9A; (+) strand; PAM type: NRG; PAM sequence: TGG
gggagaaaaaactataaagt

SEQ ID NO: 53981 - DNA, 20 bp, Artificial Sequence
  Description of Artificial Sequence: Synthetic oligonucleotide
  Target: SCN9A; (+) strand; PAM type: NRG; PAM sequence: TGG
aaactataaagttggtatat

SEQ ID NO: 53982 - DNA, 20 bp, Artificial Sequence
  Description of Artificial Sequence: Synthetic oligonucleotide
  Target: SCN9A; (+) strand; PAM type: NRG; PAM sequence: AAG
tataaagttggtatattggt

SEQ ID NO: 53983 - DNA, 20 bp, Artificial Sequence
  Description of Artificial Sequence: Synthetic oligonucleotide
  Target: SCN9A; (+) strand; PAM type: NRG; PAM sequence: CAG
gcctattataatgtgaatga

SEQ ID NO: 53984 - DNA, 20 bp, Artificial Sequence
  Description of Artificial Sequence: Synthetic oligonucleotide
  Target: SCN9A; (+) strand; PAM type: NRG; PAM sequence: AAG
attataatgtgaatgacagt

SEQ ID NO: 53985 - DNA, 20 bp, Artificial Sequence
  Description of Artificial Sequence: Synthetic oligonucleotide
  Target: SCN9A; (+) strand; PAM type: NRG; PAM sequence: CGG
gaatgacagtaagatttaca

SEQ ID NO: 53986 - DNA, 20 bp, Artificial Sequence
  Description of Artificial Sequence: Synthetic oligonucleotide
  Target: SCN9A; (+) strand; PAM type: NRG; PAM sequence: CAG
ttacacggccctacttttaa

SEQ ID NO: 53987 - DNA, 20 bp, Artificial Sequence
  Description of Artificial Sequence: Synthetic oligonucleotide
  Target: SCN9A; (+) strand; PAM type: NRG; PAM sequence: CAG
ccctacttttaacagcctga

SEQ ID NO: 53988 - DNA, 20 bp, Artificial Sequence
  Description of Artificial Sequence: Synthetic oligonucleotide
  Target: SCN9A; (+) strand; PAM type: NRG; PAM sequence: CAG
acagcctgacagaaaattta

SEQ ID NO: 53989 - DNA, 20 bp, Artificial Sequence
  Description of Artificial Sequence: Synthetic oligonucleotide
  Target: SCN9A; (+) strand; PAM type: NRG; PAM sequence: TAG
gcctgacagaaaatttacag

SEQ ID NO: 53990 - DNA, 20 bp, Artificial Sequence
  Description of Artificial Sequence: Synthetic oligonucleotide
  Target: SCN9A; (+) strand; PAM type: NRG; PAM sequence: TGG
agataaatctatactactca

SEQ ID NO: 53991 - DNA, 20 bp, Artificial Sequence
  Description of Artificial Sequence: Synthetic oligonucleotide
  Target: SCN9A; (+) strand; PAM type: NRG; PAM sequence: TGG
tcatggatttatctgactta

SEQ ID NO: 53992 - DNA, 20 bp, Artificial Sequence
  Description of Artificial Sequence: Synthetic oligonucleotide
  Target: SCN9A; (+) strand; PAM type: NRG; PAM sequence: AAG
ttatggatgattccccttta

SEQ ID NO: 53993 - DNA, 20 bp, Artificial Sequence
  Description of Artificial Sequence: Synthetic oligonucleotide
  Target: SCN9A; (+) strand; PAM type: NRG; PAM sequence: AAG
aaagactgttctattcaata

SEQ ID NO: 53994 - DNA, 20 bp, Artificial Sequence
  Description of Artificial Sequence: Synthetic oligonucleotide
  Target: SCN9A; (+) strand; PAM type: NRG; PAM sequence: AAG
tgtatgcattcctttgctac

SEQ ID NO: 53995 - DNA, 20 bp, Artificial Sequence
  Description of Artificial Sequence: Synthetic oligonucleotide
  Target: SCN9A; (+) strand; PAM type: NRG; PAM sequence: CAG
gcattcctttgctacaagac

SEQ ID NO: 53996 - DNA, 20 bp, Artificial Sequence
  Description of Artificial Sequence: Synthetic oligonucleotide
  Target: SCN9A; (+) strand; PAM type: NRG; PAM sequence: AAG
ttgctacaagaccagaaata

SEQ ID NO: 53997 - DNA, 20 bp, Artificial Sequence
  Description of Artificial Sequence: Synthetic oligonucleotide
  Target: SCN9A; (+) strand; PAM type: NRG; PAM sequence: AAG
tacaatgtgatctaaataac

SEQ ID NO: 53998 - DNA, 20 bp, Artificial Sequence
  Description of Artificial Sequence: Synthetic oligonucleotide
  Target: SCN9A; (+) strand; PAM type: NRG; PAM sequence: AAG
gatctaaataacaagttaaa

SEQ ID NO: 53999 - DNA, 20 bp, Artificial Sequence
  Description of Artificial Sequence: Synthetic oligonucleotide
  Target: SCN9A; (+) strand; PAM type: NRG; PAM sequence: TGG
gttaaaaagataaaacacca

SEQ ID NO: 54000 - DNA, 20 bp, Artificial Sequence
  Description of Artificial Sequence: Synthetic oligonucleotide
  Target: SCN9A; (+) strand; PAM type: NRG; PAM sequence: TGG
acaccatggtaaattaatga

SEQ ID NO: 54001 - DNA, 20 bp, Artificial Sequence
  Description of Artificial Sequence: Synthetic oligonucleotide
  Target: SCN9A; (+) strand; PAM type: NRG; PAM sequence: AAG
atgatggtgataaatgtaat

SEQ ID NO: 54002 - DNA, 20 bp, Artificial Sequence
  Description of Artificial Sequence: Synthetic oligonucleotide
  Target: SCN9A; (+) strand; PAM type: NRG; PAM sequence: AAG
atgtaataagcctacaataa

SEQ ID NO: 54003 - DNA, 20 bp, Artificial Sequence
  Description of Artificial Sequence: Synthetic oligonucleotide
  Target: SCN9A; (+) strand; PAM type: NRG; PAM sequence: CAG
taataagcctacaataaaag

SEQ ID NO: 54004 - DNA, 20 bp, Artificial Sequence
  Description of Artificial Sequence: Synthetic oligonucleotide
  Target: SCN9A; (+) strand; PAM type: NRG; PAM sequence: CAG
cctacaataaaagcagactg

SEQ ID NO: 54005 - DNA, 20 bp, Artificial Sequence
  Description of Artificial Sequence: Synthetic oligonucleotide
  Target: SCN9A; (+) strand; PAM type: NRG; PAM sequence: AAG
caataaaagcagactgcagt

SEQ ID NO: 54006 - DNA, 20 bp, Artificial Sequence
  Description of Artificial Sequence: Synthetic oligonucleotide
  Target: SCN9A; (+) strand; PAM type: NRG; PAM sequence: AAG
actgcagtaagactgaaact

SEQ ID NO: 54007 - DNA, 20 bp, Artificial Sequence
  Description of Artificial Sequence: Synthetic oligonucleotide
  Target: SCN9A; (+) strand; PAM type: NRG; PAM sequence: AAG
ctgaaactaagaaaccaaat

SEQ ID NO: 54008 - DNA, 20 bp, Artificial Sequence
  Description of Artificial Sequence: Synthetic oligonucleotide
  Target: SCN9A; (+) strand; PAM type: NRG; PAM sequence: AGG
tgaaactaagaaaccaaata

SEQ ID NO: 54009 - DNA, 20 bp, Artificial Sequence
  Description of Artificial Sequence: Synthetic oligonucleotide
  Target: SCN9A; (+) strand; PAM type: NRG; PAM sequence: TAG
taagaaaccaaataaggcat

SEQ ID NO: 54010 - DNA, 20 bp, Artificial Sequence
  Description of Artificial Sequence: Synthetic oligonucleotide
  Target: SCN9A; (+) strand; PAM type: NRG; PAM sequence: AAG
aaaccaaataaggcattagc

SEQ ID NO: 54011 - DNA, 20 bp, Artificial Sequence
  Description of Artificial Sequence: Synthetic oligonucleotide
  Target: SCN9A; (+) strand; PAM type: NRG; PAM sequence: AGG
aaccaaataaggcattagca

SEQ ID NO: 54012 - DNA, 20 bp, Artificial Sequence
  Description of Artificial Sequence: Synthetic oligonucleotide
  Target: SCN9A; (+) strand; PAM type: NRG; PAM sequence: AAG
ggaccttacattctgtactg

SEQ ID NO: 54013 - DNA, 20 bp, Artificial Sequence
  Description of Artificial Sequence: Synthetic oligonucleotide
  Target: SCN9A; (+) strand; PAM type: NRG; PAM sequence: TAG
ttacattctgtactgaagta

SEQ ID NO: 54014 - DNA, 20 bp, Artificial Sequence
  Description of Artificial Sequence: Synthetic oligonucleotide
  Target: SCN9A; (+) strand; PAM type: NRG; PAM sequence: TAG
tgaagtatagaaatattatt

SEQ ID NO: 54015 - DNA, 20 bp, Artificial Sequence
  Description of Artificial Sequence: Synthetic oligonucleotide
  Target: SCN9A; (+) strand; PAM type: NRG; PAM sequence: AGG
gaagtatagaaatattattt

SEQ ID NO: 54016 - DNA, 20 bp, Artificial Sequence
  Description of Artificial Sequence: Synthetic oligonucleotide
  Target: SCN9A; (+) strand; PAM type: NRG; PAM sequence: AAG
tatagaaatattatttagga

SEQ ID NO: 54017 - DNA, 20 bp, Artificial Sequence
  Description of Artificial Sequence: Synthetic oligonucleotide
  Target: SCN9A; (+) strand; PAM type: NRG; PAM sequence: AAG
gaaatattatttaggaaagc

SEQ ID NO: 54018 - DNA, 20 bp, Artificial Sequence
  Description of Artificial Sequence: Synthetic oligonucleotide
  Target: SCN9A; (+) strand; PAM type: NRG; PAM sequence: AAG
aaaacatcaatcattaatta

SEQ ID NO: 54019 - DNA, 20 bp, Artificial Sequence
  Description of Artificial Sequence: Synthetic oligonucleotide
  Target: SCN9A; (+) strand; PAM type: NRG; PAM sequence: TAG
tttcgtatatgcaccttcat

SEQ ID NO: 54020 - DNA, 20 bp, Artificial Sequence
  Description of Artificial Sequence: Synthetic oligonucleotide
  Target: SCN9A; (+) strand; PAM type: NRG; PAM sequence: TGG
attaaaaatgttttctccaa

SEQ ID NO: 54021 - DNA, 20 bp, Artificial Sequence
  Description of Artificial Sequence: Synthetic oligonucleotide
  Target: SCN9A; (+) strand; PAM type: NRG; PAM sequence: GGG
ttaaaaatgttttctccaat

SEQ ID NO: 54022 - DNA, 20 bp, Artificial Sequence
  Description of Artificial Sequence: Synthetic oligonucleotide
  Target: SCN9A; (+) strand; PAM type: NRG; PAM sequence: TAG
ccaatgggttaattttttct

SEQ ID NO: 54023 - DNA, 20 bp, Artificial Sequence
  Description of Artificial Sequence: Synthetic oligonucleotide
  Target: SCN9A; (+) strand; PAM type: NRG; PAM sequence: CAG
ggttaattttttcttagttg

SEQ ID NO: 54024 - DNA, 20 bp, Artificial Sequence
  Description of Artificial Sequence: Synthetic oligonucleotide
  Target: SCN9A; (+) strand; PAM type: NRG; PAM sequence: TGG
tcttagttgcagtaacattg

SEQ ID NO: 54025 - DNA, 20 bp, Artificial Sequence
  Description of Artificial Sequence: Synthetic oligonucleotide
  Target: SCN9A; (+) strand; PAM type: NRG; PAM sequence: GGG
cttagttgcagtaacattgt

SEQ ID NO: 54026 - DNA, 20 bp, Artificial Sequence
  Description of Artificial Sequence: Synthetic oligonucleotide
  Target: SCN9A; (+) strand; PAM type: NRG; PAM sequence: AAG
tattcttctatatactgatc

SEQ ID NO: 54027 - DNA, 20 bp, Artificial Sequence
  Description of Artificial Sequence: Synthetic oligonucleotide
  Target: SCN9A; (+) strand; PAM type: NRG; PAM sequence: CAG
caagatacttttcctacaca

SEQ ID NO: 54028 - DNA, 20 bp, Artificial Sequence
  Description of Artificial Sequence: Synthetic oligonucleotide
  Target: SCN9A; (+) strand; PAM type: NRG; PAM sequence: AAG
acttttcctacacacagcat

SEQ ID NO: 54029 - DNA, 20 bp, Artificial Sequence
  Description of Artificial Sequence: Synthetic oligonucleotide
  Target: SCN9A; (+) strand; PAM type: NRG; PAM sequence: AAG
tttcctacacacagcataag

SEQ ID NO: 54030 - DNA, 20 bp, Artificial Sequence
  Description of Artificial Sequence: Synthetic oligonucleotide
  Target: SCN9A; (+) strand; PAM type: NRG; PAM sequence: GAG
acacagcataagaagatatt

SEQ ID NO: 54031 - DNA, 20 bp, Artificial Sequence
  Description of Artificial Sequence: Synthetic oligonucleotide
  Target: SCN9A; (+) strand; PAM type: NRG; PAM sequence: AAG
tccacgttaatcaaactgaa

SEQ ID NO: 54032 - DNA, 20 bp, Artificial Sequence
  Description of Artificial Sequence: Synthetic oligonucleotide
  Target: SCN9A; (+) strand; PAM type: NRG; PAM sequence: AAG
cgttaatcaaactgaaaagt

SEQ ID NO: 54033 - DNA, 20 bp, Artificial Sequence
  Description of Artificial Sequence: Synthetic oligonucleotide
  Target: SCN9A; (+) strand; PAM type: NRG; PAM sequence: AAG
atcaaactgaaaagtaagac

SEQ ID NO: 54034 - DNA, 20 bp, Artificial Sequence
  Description of Artificial Sequence: Synthetic oligonucleotide
  Target: SCN9A; (+) strand; PAM type: NRG; PAM sequence: AGG
tcaaactgaaaagtaagaca

SEQ ID NO: 54035 - DNA, 20 bp, Artificial Sequence
  Description of Artificial Sequence: Synthetic oligonucleotide
  Target: SCN9A; (+) strand; PAM type: NRG; PAM sequence: CAG
taagacaaggaattccaaat

SEQ ID NO: 54036 - DNA, 20 bp, Artificial Sequence
  Description of Artificial Sequence: Synthetic oligonucleotide
  Target: SCN9A; (+) strand; PAM type: NRG; PAM sequence: GAG
agacaaggaattccaaatca

SEQ ID NO: 54037 - DNA, 20 bp, Artificial Sequence
  Description of Artificial Sequence: Synthetic oligonucleotide
  Target: SCN9A; (+) strand; PAM type: NRG; PAM sequence: TAG
ttccaaatcagagcctattt

SEQ ID NO: 54038 - DNA, 20 bp, Artificial Sequence
  Description of Artificial Sequence: Synthetic oligonucleotide
  Target: SCN9A; (+) strand; PAM type: NRG; PAM sequence: GAG
agagcctattttagaactat

SEQ ID NO: 54039 - DNA, 20 bp, Artificial Sequence
  Description of Artificial Sequence: Synthetic oligonucleotide
  Target: SCN9A; (+) strand; PAM type: NRG; PAM sequence: CGG
tatgagcattcaactgaaaa

SEQ ID NO: 54040 - DNA, 20 bp, Artificial Sequence
  Description of Artificial Sequence: Synthetic oligonucleotide
  Target: SCN9A; (+) strand; PAM type: NRG; PAM sequence: GGG
atgagcattcaactgaaaac

SEQ ID NO: 54041 - DNA, 20 bp, Artificial Sequence
  Description of Artificial Sequence: Synthetic oligonucleotide
  Target: SCN9A; (+) strand; PAM type: NRG; PAM sequence: CAG
ttcaactgaaaacgggtctc

SEQ ID NO: 54042 - DNA, 20 bp, Artificial Sequence
  Description of Artificial Sequence: Synthetic oligonucleotide
  Target: SCN9A; (+) strand; PAM type: NRG; PAM sequence: TGG
tgccaccaacaattgataat

SEQ ID NO: 54043 - DNA, 20 bp, Artificial Sequence
  Description of Artificial Sequence: Synthetic oligonucleotide
  Target: SCN9A; (+) strand; PAM type: NRG; PAM sequence: AAG
aattggtatcatttttgtgc

SEQ ID NO: 54044 - DNA, 20 bp, Artificial Sequence
  Description of Artificial Sequence: Synthetic oligonucleotide
  Target: SCN9A; (+) strand; PAM type: NRG; PAM sequence: GAG
ggtatcatttttgtgcaagt

SEQ ID NO: 54045 - DNA, 20 bp, Artificial Sequence
  Description of Artificial Sequence: Synthetic oligonucleotide
  Target: SCN9A; (+) strand; PAM type: NRG; PAM sequence: TAG
gcaagtgagatgtgccttgt

SEQ ID NO: 54046 - DNA, 20 bp, Artificial Sequence
  Description of Artificial Sequence: Synthetic oligonucleotide
  Target: SCN9A; (+) strand; PAM type: NRG; PAM sequence: GAG
ttgttagtgctttttaactt

SEQ ID NO: 54047 - DNA, 20 bp, Artificial Sequence
  Description of Artificial Sequence: Synthetic oligonucleotide
  Target: SCN9A; (+) strand; PAM type: NRG; PAM sequence: AAG
ctttttaacttgagtgtttg

SEQ ID NO: 54048 - DNA, 20 bp, Artificial Sequence
  Description of Artificial Sequence: Synthetic oligonucleotide
  Target: SCN9A; (+) strand; PAM type: NRG; PAM sequence: AAG
taaactgttttctctaaacc

SEQ ID NO: 54049 - DNA, 20 bp, Artificial Sequence
  Description of Artificial Sequence: Synthetic oligonucleotide
  Target: SCN9A; (+) strand; PAM type: NRG; PAM sequence: AAG
ttctctaaaccaagatttaa

SEQ ID NO: 54050 - DNA, 20 bp, Artificial Sequence
  Description of Artificial Sequence: Synthetic oligonucleotide
  Target: SCN9A; (+) strand; PAM type: NRG; PAM sequence: CAG
aaaccaagatttaaaagttc

SEQ ID NO: 54051 - DNA, 20 bp, Artificial Sequence
  Description of Artificial Sequence: Synthetic oligonucleotide
  Target: SCN9A; (+) strand; PAM type: NRG; PAM sequence: AGG
aaccaagatttaaaagttcc

SEQ ID NO: 54052 - DNA, 20 bp, Artificial Sequence
  Description of Artificial Sequence: Synthetic oligonucleotide
  Target: SCN9A; (+) strand; PAM type: NRG; PAM sequence: AAG
tcacaaatttcttttgaaaa

SEQ ID NO: 54053 - DNA, 20 bp, Artificial Sequence
  Description of Artificial Sequence: Synthetic oligonucleotide
  Target: SCN9A; (+) strand; PAM type: NRG; PAM sequence: TGG
gaaaaaagatctgtgctttc

SEQ ID NO: 54054 - DNA, 20 bp, Artificial Sequence
  Description of Artificial Sequence: Synthetic oligonucleotide
  Target: SCN9A; (+) strand; PAM type: NRG; PAM sequence: GGG
aaaaaagatctgtgctttct

SEQ ID NO: 54055 - DNA, 20 bp, Artificial Sequence
  Description of Artificial Sequence: Synthetic oligonucleotide
  Target: SCN9A; (+) strand; PAM type: NRG; PAM sequence: TGG
agatctgtgctttctgggcg

SEQ ID NO: 54056 - DNA, 20 bp, Artificial Sequence
  Description of Artificial Sequence: Synthetic oligonucleotide
  Target: SCN9A; (+) strand; PAM type: NRG; PAM sequence: TGG
tctgtgctttctgggcgtgg

SEQ ID NO: 54057 - DNA, 20 bp, Artificial Sequence
  Description of Artificial Sequence: Synthetic oligonucleotide
  Target: SCN9A; (+) strand; PAM type: NRG; PAM sequence: CAG
gtggctaatgtctgtaatcc

SEQ ID NO: 54058 - DNA, 20 bp, Artificial Sequence
  Description of Artificial Sequence: Synthetic oligonucleotide
  Target: SCN9A; (+) strand; PAM type: NRG; PAM sequence: TGG
tgtctgtaatcccagcactt

SEQ ID NO: 54059 - DNA, 20 bp, Artificial Sequence
  Description of Artificial Sequence: Synthetic oligonucleotide
  Target: SCN9A; (+) strand; PAM type: NRG; PAM sequence: GGG
gtctgtaatcccagcacttt

SEQ ID NO: 54060 - DNA, 20 bp, Artificial Sequence
  Description of Artificial Sequence: Synthetic oligonucleotide
  Target: SCN9A; (+) strand; PAM type: NRG; PAM sequence: GAG
ctgtaatcccagcactttgg

SEQ ID NO: 54061 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccagcactttggg

SEQ ID NO: 54062 - DNA, 20 bp, Artificial Sequence
  Description of Artificial Sequence: Synthetic oligonucleotide
  Target: SCN9A; (+) strand; PAM type: NRG; PAM sequence: AAG
cccagcactttgggaggccg

SEQ ID NO: 54063 - DNA, 20 bp, Artificial Sequence
  Description of Artificial Sequence: Synthetic oligonucleotide
  Target: SCN9A; (+) strand; PAM type: NRG; PAM sequence: TGG
agcactttgggaggccgaag

SEQ ID NO: 54064 - DNA, 20 bp, Artificial Sequence
  Description of Artificial Sequence: Synthetic oligonucleotide
  Target: SCN9A; (+) strand; PAM type: NRG; PAM sequence: GGG
gcactttgggaggccgaagt

SEQ ID NO: 54065 - DNA, 20 bp, Artificial Sequence
  Description of Artificial Sequence: Synthetic oligonucleotide
  Target: SCN9A; (+) strand; PAM type: NRG; PAM sequence: CAG
ctttgggaggccgaagtggg

SEQ ID NO: 54066 - DNA, 20 bp, Artificial Sequence
  Description of Artificial Sequence: Synthetic oligonucleotide
  Target: SCN9A; (+) strand; PAM type: NRG; PAM sequence: GAG
ccgaagtgggcagatcactt

SEQ ID NO: 54067 - DNA, 20 bp, Artificial Sequence
  Description of Artificial Sequence: Synthetic oligonucleotide
  Target: SCN9A; (+) strand; PAM type: NRG; PAM sequence: AGG
cgaagtgggcagatcacttg

SEQ ID NO: 54068 - DNA, 20 bp, Artificial Sequence
  Description of Artificial Sequence: Synthetic oligonucleotide
  Target: SCN9A; (+) strand; PAM type: NRG; PAM sequence: CAG
gtgggcagatcacttgaggt

SEQ ID NO: 54069 - DNA, 20 bp, Artificial Sequence
  Description of Artificial Sequence: Synthetic oligonucleotide
  Target: SCN9A; (+) strand; PAM type: NRG; PAM sequence: AGG
tgggcagatcacttgaggtc

SEQ ID NO: 54070 - DNA, 20 bp, Artificial Sequence
  Description of Artificial Sequence: Synthetic oligonucleotide
  Target: SCN9A; (+) strand; PAM type: NRG; PAM sequence: GAG
ggcagatcacttgaggtcag

SEQ ID NO: 54071 - DNA, 20 bp, Artificial Sequence
  Description of Artificial Sequence: Synthetic oligonucleotide
  Target: SCN9A; (+) strand; PAM type: NRG; PAM sequence: AAG
tcacttgaggtcaggagttc

SEQ ID NO: 54072 - DNA, 20 bp, Artificial Sequence
  Description of Artificial Sequence: Synthetic oligonucleotide
  Target: SCN9A; (+) strand; PAM type: NRG; PAM sequence: CAG
tgaggtcaggagttcaagtc

SEQ ID NO: 54073 - DNA, 20 bp, Artificial Sequence
  Description of Artificial Sequence: Synthetic oligonucleotide
  Target: SCN9A; (+) strand; PAM type: NRG; PAM sequence: TAG
tcccttcaaaaatacaaaaa

SEQ ID NO: 54074 - DNA, 20 bp, Artificial Sequence
  Description of Artificial Sequence: Synthetic oligonucleotide
  Target: SCN9A; (+) strand; PAM type: NRG; PAM sequence: GAG
ttcaaaaatacaaaaatagt

SEQ ID NO: 54075 - DNA, 20 bp, Artificial Sequence
  Description of Artificial Sequence: Synthetic oligonucleotide
  Target: SCN9A; (+) strand; PAM type: NRG; PAM sequence: AAG
ctgtttccaaaaaaaaaaaa

SEQ ID NO: 54076 - DNA, 20 bp, Artificial Sequence
  Description of Artificial Sequence: Synthetic oligonucleotide
  Target: SCN9A; (+) strand; PAM type: NRG; PAM sequence: GAG
gtttccaaaaaaaaaaaaaa

SEQ ID NO: 54077 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaaaaaaagagaaaa

SEQ ID NO: 54078 - DNA, 20 bp, Artificial Sequence
  Description of Artificial Sequence: Synthetic oligonucleotide
  Target: SCN9A; (+) strand; PAM type: NRG; PAM sequence: GAG
aaaaaaaaaaagagaaaaaa

SEQ ID NO: 54079 - DNA, 20 bp, Artificial Sequence
  Description of Artificial Sequence: Synthetic oligonucleotide
  Target: SCN9A; (+) strand; PAM type: NRG; PAM sequence: TAG
aaaaaatgccttaaaacatt

SEQ ID NO: 54080 - DNA, 20 bp, Artificial Sequence
  Description of Artificial Sequence: Synthetic oligonucleotide
  Target: SCN9A; (+) strand; PAM type: NRG; PAM sequence: AAG
acatttagttgcctaacacc

SEQ ID NO: 54081 - DNA, 20 bp, Artificial Sequence
  Description of Artificial Sequence: Synthetic oligonucleotide
  Target: SCN9A; (+) strand; PAM type: NRG; PAM sequence: AAG
ttagttgcctaacaccaagc

SEQ ID NO: 54082 - DNA, 20 bp, Artificial Sequence
  Description of Artificial Sequence: Synthetic oligonucleotide
  Target: SCN9A; (+) strand; PAM type: NRG; PAM sequence: AAG
gtaatattcattcaatgaac

SEQ ID NO: 54083 - DNA, 20 bp, Artificial Sequence
  Description of Artificial Sequence: Synthetic oligonucleotide
  Target: SCN9A; (+) strand; PAM type: NRG; PAM sequence: GAG
aatattcattcaatgaacaa

SEQ ID NO: 54084 - DNA, 20 bp, Artificial Sequence
  Description of Artificial Sequence: Synthetic oligonucleotide
  Target: SCN9A; (+) strand; PAM type: NRG; PAM sequence: TAG
aagagaccctttgtctgcaa

SEQ ID NO: 54085 - DNA, 20 bp, Artificial Sequence
  Description of Artificial Sequence: Synthetic oligonucleotide
  Target: SCN9A; (+) strand; PAM type: NRG; PAM sequence: AGG
agagaccctttgtctgcaat

SEQ ID NO: 54086 - DNA, 20 bp, Artificial Sequence
  Description of Artificial Sequence: Synthetic oligonucleotide
  Target: SCN9A; (+) strand; PAM type: NRG; PAM sequence: CAG
taaaaaaaaattataatcta

SEQ ID NO: 54087 - DNA, 20 bp, Artificial Sequence
  Description of Artificial Sequence: Synthetic oligonucleotide
  Target: SCN9A; (+) strand; PAM type: NRG; PAM sequence: CAG
ctacagctccccactatgta

SEQ ID NO: 54088 - DNA, 20 bp, Artificial Sequence
  Description of Artificial Sequence: Synthetic oligonucleotide
  Target: SCN9A; (+) strand; PAM type: NRG; PAM sequence: TGG
agaataacctgtcatgtctt

SEQ ID NO: 54089 - DNA, 20 bp, Artificial Sequence
  Description of Artificial Sequence: Synthetic oligonucleotide
  Target: SCN9A; (+) strand; PAM type: NRG; PAM sequence: TAG
gtcatgtctttggtctgtca

SEQ ID NO: 54090 - DNA, 20 bp, Artificial Sequence
  Description of Artificial Sequence: Synthetic oligonucleotide
  Target: SCN9A; (+) strand; PAM type: NRG; PAM sequence: AAG
atgtctttggtctgtcatag

SEQ ID NO: 54091 - DNA, 20 bp, Artificial Sequence
  Description of Artificial Sequence: Synthetic oligonucleotide
  Target: SCN9A; (+) strand; PAM type: NRG; PAM sequence: AGG
tgtctttggtctgtcataga

SEQ ID NO: 54092 - DNA, 20 bp, Artificial Sequence
  Description of Artificial Sequence: Synthetic oligonucleotide
  Target: SCN9A; (+) strand; PAM type: NRG; PAM sequence: CAG
ttttactaacctgatgctga

SEQ ID NO: 54093 - DNA, 20 bp, Artificial Sequence
  Description of Artificial Sequence: Synthetic oligonucleotide
  Target: SCN9A; (+) strand; PAM type: NRG; PAM sequence: CAG
ctcttctgtttccctatttg

SEQ ID NO: 54094 - DNA, 20 bp, Artificial Sequence
  Description of Artificial Sequence: Synthetic oligonucleotide
  Target: SCN9A; (+) strand; PAM type: NRG; PAM sequence: CAG
cctatttgcagtctacattc

SEQ ID NO: 54095 - DNA, 20 bp, Artificial Sequence
  Description of Artificial Sequence: Synthetic oligonucleotide
  Target: SCN9A; (+) strand; PAM type: NRG; PAM sequence: AAG
ttctacgtttaatttcccca

SEQ ID NO: 54096 - DNA, 20 bp, Artificial Sequence
  Description of Artificial Sequence: Synthetic oligonucleotide
  Target: SCN9A; (+) strand; PAM type: NRG; PAM sequence: AGG
tctacgtttaatttccccaa

SEQ ID NO: 54097 - DNA, 20 bp, Artificial Sequence
  Description of Artificial Sequence: Synthetic oligonucleotide
  Target: SCN9A; (+) strand; PAM type: NRG; PAM sequence: CAG
cgtttaatttccccaaaggt

SEQ ID NO: 54098 - DNA, 20 bp, Artificial Sequence
  Description of Artificial Sequence: Synthetic oligonucleotide
  Target: SCN9A; (+) strand; PAM type: NRG; PAM sequence: TAG
taatttccccaaaggtcagc

SEQ ID NO: 54099 - DNA, 20 bp, Artificial Sequence
  Description of Artificial Sequence: Synthetic oligonucleotide
  Target: SCN9A; (+) strand; PAM type: NRG; PAM sequence: CAG
taatgttccctttatctgaa

SEQ ID NO: 54100 - DNA, 20 bp, Artificial Sequence
  Description of Artificial Sequence: Synthetic oligonucleotide
  Target: SCN9A; (+) strand; PAM type: NRG; PAM sequence: TGG
attacttgctttgtaatatt

SEQ ID NO: 54101 - DNA, 20 bp, Artificial Sequence
  Description of Artificial Sequence: Synthetic oligonucleotide
  Target: SCN9A; (+) strand; PAM type: NRG; PAM sequence: AAG
ctcaatacctcttgtatgaa

SEQ ID NO: 54102 - DNA, 20 bp, Artificial Sequence
  Description of Artificial Sequence: Synthetic oligonucleotide
  Target: SCN9A; (+) strand; PAM type: NRG; PAM sequence: CAG
atataaattcaacccttcat

SEQ ID NO: 54103 - DNA, 20 bp, Artificial Sequence
  Description of Artificial Sequence: Synthetic oligonucleotide
  Target: SCN9A; (+) strand; PAM type: NRG; PAM sequence: CAG
ttctctttctcccatatctc

SEQ ID NO: 54104 - DNA, 20 bp, Artificial Sequence
  Description of Artificial Sequence: Synthetic oligonucleotide
  Target: SCN9A; (+) strand; PAM type: NRG; PAM sequence: GAG
ccatatctccagtctgcttt

SEQ ID NO: 54105 - DNA, 20 bp, Artificial Sequence
  Description of Artificial Sequence: Synthetic oligonucleotide
  Target: SCN9A; (+) strand; PAM type: NRG; PAM sequence: CAG
tccagtctgctttgagctgc

SEQ ID NO: 54106 - DNA, 20 bp, Artificial Sequence
  Description of Artificial Sequence: Synthetic oligonucleotide
  Target: SCN9A; (+) strand; PAM type: NRG; PAM sequence: CAG
agtctgctttgagctgccag

SEQ ID NO: 54107 - DNA, 20 bp, Artificial Sequence
  Description of Artificial Sequence: Synthetic oligonucleotide
  Target: SCN9A; (+) strand; PAM type: NRG; PAM sequence: CGG
tgccagcagtcccctaaatg

SEQ ID NO: 54108 - DNA, 20 bp, Artificial Sequence
  Description of Artificial Sequence: Synthetic oligonucleotide
  Target: SCN9A; (+) strand; PAM type: NRG; PAM sequence: CAG
ggatttttatcctacttcta

SEQ ID NO: 54109 - DNA, 20 bp, Artificial Sequence
  Description of Artificial Sequence: Synthetic oligonucleotide
  Target: SCN9A; (+) strand; PAM type: NRG; PAM sequence: TAG
tcacgcctgtctccttcaac

SEQ ID NO: 54110 - DNA, 20 bp, Artificial Sequence
  Description of Artificial Sequence: Synthetic oligonucleotide
  Target: SCN9A; (+) strand; PAM type: NRG; PAM sequence: TAG
caactagattccaaacttca

SEQ ID NO: 54111 - DNA, 20 bp, Artificial Sequence
  Description of Artificial Sequence: Synthetic oligonucleotide
  Target: SCN9A; (+) strand; PAM type: NRG; PAM sequence: CAG
tagattccaaacttcataga

SEQ ID NO: 54112 - DNA, 20 bp, Artificial Sequence
  Description of Artificial Sequence: Synthetic oligonucleotide
  Target: SCN9A; (+) strand; PAM type: NRG; PAM sequence: AGG
agattccaaacttcatagac

SEQ ID NO: 54113 - DNA, 20 bp, Artificial Sequence
  Description of Artificial Sequence: Synthetic oligonucleotide
  Target: SCN9A; (+) strand; PAM type: NRG; PAM sequence: TAG
catagacaggaaatttgtct

SEQ ID NO: 54114 - DNA, 20 bp, Artificial Sequence
  Description of Artificial Sequence: Synthetic oligonucleotide
  Target: SCN9A; (+) strand; PAM type: NRG; PAM sequence: AGG
atagacaggaaatttgtctt

SEQ ID NO: 54115 - DNA, 20 bp, Artificial Sequence
  Description of Artificial Sequence: Synthetic oligonucleotide
  Target: SCN9A; (+) strand; PAM type: NRG; PAM sequence: AAG
cttaggcatgtattatcacc

SEQ ID NO: 54116 - DNA, 20 bp, Artificial Sequence
  Description of Artificial Sequence: Synthetic oligonucleotide
  Target: SCN9A; (+) strand; PAM type: NRG; PAM sequence: AGG
ttaggcatgtattatcacca

SEQ ID NO: 54117 - DNA, 20 bp, Artificial Sequence
  Description of Artificial Sequence: Synthetic oligonucleotide
  Target: SCN9A; (+) strand; PAM type: NRG; PAM sequence: TGG
ccaaggtataacatgatatc

SEQ ID NO: 54118 - DNA, 20 bp, Artificial Sequence
  Description of Artificial Sequence: Synthetic oligonucleotide
  Target: SCN9A; (+) strand; PAM type: NRG; PAM sequence: AAG
tgttaaatgcttgatgaatg

SEQ ID NO: 54119 - DNA, 20 bp, Artificial Sequence
  Description of Artificial Sequence: Synthetic oligonucleotide
  Target: SCN9A; (+) strand; PAM type: NRG; PAM sequence: TGG
aaatgcttgatgaatgaaga

SEQ ID NO: 54120 - DNA, 20 bp, Artificial Sequence
  Description of Artificial Sequence: Synthetic oligonucleotide
  Target: SCN9A; (+) strand; PAM type: NRG; PAM sequence: AAG
tgaaatacttctcctaaccc

SEQ ID NO: 54121 - DNA, 20 bp, Artificial Sequence
  Description of Artificial Sequence: Synthetic oligonucleotide
  Target: SCN9A; (+) strand; PAM type: NRG; PAM sequence: AAG
tctcctaacccaagcacttg

SEQ ID NO: 54122 - DNA, 20 bp, Artificial Sequence
  Description of Artificial Sequence: Synthetic oligonucleotide
  Target: SCN9A; (+) strand; PAM type: NRG; PAM sequence: AAG
cctaacccaagcacttgaag

SEQ ID NO: 54123 - DNA, 20 bp, Artificial Sequence
  Description of Artificial Sequence: Synthetic oligonucleotide
  Target: SCN9A; (+) strand; PAM type: NRG; PAM sequence: TAG
taattatattgcctttaaca

SEQ ID NO: 54124 - DNA, 20 bp, Artificial Sequence
  Description of Artificial Sequence: Synthetic oligonucleotide
  Target: SCN9A; (+) strand; PAM type: NRG; PAM sequence: AAG
catagatgtcacactaattt

SEQ ID NO: 54125 - DNA, 20 bp, Artificial Sequence
  Description of Artificial Sequence: Synthetic oligonucleotide
  Target: SCN9A; (+) strand; PAM type: NRG; PAM sequence: AAG
attatttaacaaaattttct

SEQ ID NO: 54126 - DNA, 20 bp, Artificial Sequence
  Description of Artificial Sequence: Synthetic oligonucleotide
  Target: SCN9A; (+) strand; PAM type: NRG; PAM sequence: CAG
caaaattttctaagattttt

SEQ ID NO: 54127 - DNA, 20 bp, Artificial Sequence
  Description of Artificial Sequence: Synthetic oligonucleotide
  Target: SCN9A; (+) strand; PAM type: NRG; PAM sequence: AAG
ctaagatttttcagtgttcc

SEQ ID NO: 54128 - DNA, 20 bp, Artificial Sequence
  Description of Artificial Sequence: Synthetic oligonucleotide
  Target: SCN9A; (+) strand; PAM type: NRG; PAM sequence: GAG
aagatttttcagtgttccaa

SEQ ID NO: 54129 - DNA, 20 bp, Artificial Sequence
  Description of Artificial Sequence: Synthetic oligonucleotide
  Target: SCN9A; (+) strand; PAM type: NRG; PAM sequence: CAG
aactatcattgattttacat

SEQ ID NO: 54130 - DNA, 20 bp, Artificial Sequence
  Description of Artificial Sequence: Synthetic oligonucleotide
  Target: SCN9A; (+) strand; PAM type: NRG; PAM sequence: TGG
gaaacgctatctttaattta

SEQ ID NO: 54131 - DNA, 20 bp, Artificial Sequence
  Description of Artificial Sequence: Synthetic oligonucleotide
  Target: SCN9A; (+) strand; PAM type: NRG; PAM sequence: AAG
aattaaaacattgaaaaaca

SEQ ID NO: 54132 - DNA, 20 bp, Artificial Sequence
  Description of Artificial Sequence: Synthetic oligonucleotide
  Target: SCN9A; (+) strand; PAM type: NRG; PAM sequence: TGG
aagcaatttccatcctttta

SEQ ID NO: 54133 - DNA, 20 bp, Artificial Sequence
  Description of Artificial Sequence: Synthetic oligonucleotide
  Target: SCN9A; (+) strand; PAM type: NRG; PAM sequence: GAG
gcaatttccatccttttatg

SEQ ID NO: 54134 - DNA, 20 bp, Artificial Sequence
  Description of Artificial Sequence: Synthetic oligonucleotide
  Target: SCN9A; (+) strand; PAM type: NRG; PAM sequence: AGG
caatttccatccttttatgg

SEQ ID NO: 54135 - DNA, 20 bp, Artificial Sequence
  Description of Artificial Sequence: Synthetic oligonucleotide
  Target: SCN9A; (+) strand; PAM type: NRG; PAM sequence: AAG
ctgatatgtgcaaaaaatat

SEQ ID NO: 54136 - DNA, 20 bp, Artificial Sequence
  Description of Artificial Sequence: Synthetic oligonucleotide
  Target: SCN9A; (+) strand; PAM type: NRG; PAM sequence: AGG
tgatatgtgcaaaaaatata

SEQ ID NO: 54137 - DNA, 20 bp, Artificial Sequence
  Description of Artificial Sequence: Synthetic oligonucleotide
  Target: SCN9A; (+) strand; PAM type: NRG; PAM sequence: TAG
tacaacctgtttccccattt

SEQ ID NO: 54138 - DNA, 20 bp, Artificial Sequence
  Description of Artificial Sequence: Synthetic oligonucleotide
  Target: SCN9A; (+) strand; PAM type: NRG; PAM sequence: TAG
taaaaacaacactatctgct

SEQ ID NO: 54139 - DNA, 20 bp, Artificial Sequence
  Description of Artificial Sequence: Synthetic oligonucleotide
  Target: SCN9A; (+) strand; PAM type: NRG; PAM sequence: AGG
aaaaacaacactatctgctt

SEQ ID NO: 54140 - DNA, 20 bp, Artificial Sequence
  Description of Artificial Sequence: Synthetic oligonucleotide
  Target: SCN9A; (+) strand; PAM type: NRG; PAM sequence: AAG
tatctgcttaggtttaatta

SEQ ID NO: 54141 - DNA, 20 bp, Artificial Sequence
  Description of Artificial Sequence: Synthetic oligonucleotide
  Target: SCN9A; (+) strand; PAM type: NRG; PAM sequence: TAG
ctgcttaggtttaattaaag

SEQ ID NO: 54142 - DNA, 20 bp, Artificial Sequence
  Description of Artificial Sequence: Synthetic oligonucleotide
  Target: SCN9A; (+) strand; PAM type: NRG; PAM sequence: CAG
aaagtagctttttttttccc

SEQ ID NO: 54143 - DNA, 20 bp, Artificial Sequence
  Description of Artificial Sequence: Synthetic oligonucleotide
  Target: SCN9A; (+) strand; PAM type: NRG; PAM sequence: CAG
tttttttccccagccataaa

SEQ ID NO: 54144 - DNA, 20 bp, Artificial Sequence
  Description of Artificial Sequence: Synthetic oligonucleotide
  Target: SCN9A; (+) strand; PAM type: NRG; PAM sequence: AGG
ttttttccccagccataaac

SEQ ID NO: 54145 - DNA, 20 bp, Artificial Sequence
  Description of Artificial Sequence: Synthetic oligonucleotide
  Target: SCN9A; (+) strand; PAM type: NRG; PAM sequence: AAG
tttccccagccataaacagg

SEQ ID NO: 54146 - DNA, 20 bp, Artificial Sequence
  Description of Artificial Sequence: Synthetic oligonucleotide
  Target: SCN9A; (+) strand; PAM type: NRG; PAM sequence: AGG
ttccccagccataaacagga

SEQ ID NO: 54147 - DNA, 20 bp, Artificial Sequence
  Description of Artificial Sequence: Synthetic oligonucleotide
  Target: SCN9A; (+) strand; PAM type: NRG; PAM sequence: AAG
gccataaacaggaaggttaa

SEQ ID NO: 54148 - DNA, 20 bp, Artificial Sequence
  Description of Artificial Sequence: Synthetic oligonucleotide
  Target: SCN9A; (+) strand; PAM type: NRG; PAM sequence: TGG
aaacaggaaggttaaaagtt

SEQ ID NO: 54149 - DNA, 20 bp, Artificial Sequence
  Description of Artificial Sequence: Synthetic oligonucleotide
  Target: SCN9A; (+) strand; PAM type: NRG; PAM sequence: CAG
aggaaggttaaaagtttggt

SEQ ID NO: 54150 - DNA, 20 bp, Artificial Sequence
  Description of Artificial Sequence: Synthetic oligonucleotide
  Target: SCN9A; (+) strand; PAM type: NRG; PAM sequence: TGG
aggttaaaagtttggtcaga

SEQ ID NO: 54151 - DNA, 20 bp, Artificial Sequence
  Description of Artificial Sequence: Synthetic oligonucleotide
  Target: SCN9A; (+) strand; PAM type: NRG; PAM sequence: AAG
agtttggtcagatggatgaa

SEQ ID NO: 54152 - DNA, 20 bp, Artificial Sequence
  Description of Artificial Sequence: Synthetic oligonucleotide
  Target: SCN9A; (+) strand; PAM type: NRG; PAM sequence: AGG
gtttggtcagatggatgaaa

SEQ ID NO: 54153 - DNA, 20 bp, Artificial Sequence
  Description of Artificial Sequence: Synthetic oligonucleotide
  Target: SCN9A; (+) strand; PAM type: NRG; PAM sequence: GGG
tttggtcagatggatgaaaa

SEQ ID NO: 54154 - DNA, 20 bp, Artificial Sequence
  Description of Artificial Sequence: Synthetic oligonucleotide
  Target: SCN9A; (+) strand; PAM type: NRG; PAM sequence: GGG
ttggtcagatggatgaaaag

SEQ ID NO: 54155 - DNA, 20 bp, Artificial Sequence
  Description of Artificial Sequence: Synthetic oligonucleotide
  Target: SCN9A; (+) strand; PAM type: NRG; PAM sequence: GGG
tggtcagatggatgaaaagg

SEQ ID NO: 54156 - DNA, 20 bp, Artificial Sequence
  Description of Artificial Sequence: Synthetic oligonucleotide
  Target: SCN9A; (+) strand; PAM type: NRG; PAM sequence: TGG
ggatgaaaagggggacaata

SEQ ID NO: 54157 - DNA, 20 bp, Artificial Sequence
  Description of Artificial Sequence: Synthetic oligonucleotide
  Target: SCN9A; (+) strand; PAM type: NRG; PAM sequence: TGG
tgaaaagggggacaatatgg

SEQ ID NO: 54158 - DNA, 20 bp, Artificial Sequence
  Description of Artificial Sequence: Synthetic oligonucleotide
  Target: SCN9A; (+) strand; PAM type: NRG; PAM sequence: AAG
aatatggtggacaccaacta

SEQ ID NO: 54159 - DNA, 20 bp, Artificial Sequence
  Description of Artificial Sequence: Synthetic oligonucleotide
  Target: SCN9A; (+) strand; PAM type: NRG; PAM sequence: TGG
aagtttaaaattctctaatt

SEQ ID NO: 54160 - DNA, 20 bp, Artificial Sequence
  Description of Artificial Sequence: Synthetic oligonucleotide
  Target: SCN9A; (+) strand; PAM type: NRG; PAM sequence: GGG
agtttaaaattctctaattt

SEQ ID NO: 54161 - DNA, 20 bp, Artificial Sequence
  Description of Artificial Sequence: Synthetic oligonucleotide
  Target: SCN9A; (+) strand; PAM type: NRG; PAM sequence: AAG
ttgggattacacaaatccca

SEQ ID NO: 54162 - DNA, 20 bp, Artificial Sequence
  Description of Artificial Sequence: Synthetic oligonucleotide
  Target: SCN9A; (+) strand; PAM type: NRG; PAM sequence: AAG
acacaaatcccaaagttttt

SEQ ID NO: 54163 - DNA, 20 bp, Artificial Sequence
  Description of Artificial Sequence: Synthetic oligonucleotide
  Target: SCN9A; (+) strand; PAM type: NRG; PAM sequence: CAG
tcccaaagtttttaagttca

SEQ ID NO: 54164 - DNA, 20 bp, Artificial Sequence
  Description of Artificial Sequence: Synthetic oligonucleotide
  Target: SCN9A; (+) strand; PAM type: NRG; PAM sequence: CAG
caaagtttttaagttcacag

SEQ ID NO: 54165 - DNA, 20 bp, Artificial Sequence
  Description of Artificial Sequence: Synthetic oligonucleotide
  Target: SCN9A; (+) strand; PAM type: NRG; PAM sequence: TAG
agcagaacttaaaaatacat

SEQ ID NO: 54166 - DNA, 20 bp, Artificial Sequence
  Description of Artificial Sequence: Synthetic oligonucleotide
  Target: SCN9A; (+) strand; PAM type: NRG; PAM sequence: AGG
gcagaacttaaaaatacatt

SEQ ID NO: 54167 - DNA, 20 bp, Artificial Sequence
  Description of Artificial Sequence: Synthetic oligonucleotide
  Target: SCN9A; (+) strand; PAM type: NRG; PAM sequence: CAG
gcacattttgacatgttcac

SEQ ID NO: 54168 - DNA, 20 bp, Artificial Sequence
  Description of Artificial Sequence: Synthetic oligonucleotide
  Target: SCN9A; (+) strand; PAM type: NRG; PAM sequence: AAG
tgacatgttcaccagtactt

SEQ ID NO: 54169 - DNA, 20 bp, Artificial Sequence
  Description of Artificial Sequence: Synthetic oligonucleotide
  Target: SCN9A; (+) strand; PAM type: NRG; PAM sequence: TAG
acttaagcaccttaaaattg

SEQ ID NO: 54170 - DNA, 20 bp, Artificial Sequence
  Description of Artificial Sequence: Synthetic oligonucleotide
  Target: SCN9A; (+) strand; PAM type: NRG; PAM sequence: AAG
tttatttgaaacatatattt

SEQ ID NO: 54171 - DNA, 20 bp, Artificial Sequence
  Description of Artificial Sequence: Synthetic oligonucleotide
  Target: SCN9A; (+) strand; PAM type: NRG; PAM sequence: AGG
ttatttgaaacatatattta

SEQ ID NO: 54172 - DNA, 20 bp, Artificial Sequence
  Description of Artificial Sequence: Synthetic oligonucleotide
  Target: SCN9A; (+) strand; PAM type: NRG; PAM sequence: AAG
aaatctttgaacatccaaca

SEQ ID NO: 54173 - DNA, 20 bp, Artificial Sequence
  Description of Artificial Sequence: Synthetic oligonucleotide
  Target: SCN9A; (+) strand; PAM type: NRG; PAM sequence: AAG
gaacatccaacaaagcgatc

SEQ ID NO: 54174 - DNA, 20 bp, Artificial Sequence
  Description of Artificial Sequence: Synthetic oligonucleotide
  Target: SCN9A; (+) strand; PAM type: NRG; PAM sequence: TAG
gatcaagtatttaattgttt

SEQ ID NO: 54175 - DNA, 20 bp, Artificial Sequence
  Description of Artificial Sequence: Synthetic oligonucleotide
  Target: SCN9A; (+) strand; PAM type: NRG; PAM sequence: TAG
atttaattgttttagaaacc

SEQ ID NO: 54176 - DNA, 20 bp, Artificial Sequence
  Description of Artificial Sequence: Synthetic oligonucleotide
  Target: SCN9A; (+) strand; PAM type: NRG; PAM sequence: AGG
tttaattgttttagaaacct

SEQ ID NO: 54177 - DNA, 20 bp, Artificial Sequence
  Description of Artificial Sequence: Synthetic oligonucleotide
  Target: SCN9A; (+) strand; PAM type: NRG; PAM sequence: CAG
ttgttttagaaacctaggca

SEQ ID NO: 54178 - DNA, 20 bp, Artificial Sequence
  Description of Artificial Sequence: Synthetic oligonucleotide
  Target: SCN9A; (+) strand; PAM type: NRG; PAM sequence: TAG
cctaggcacagatacaatcc

SEQ ID NO: 54179 - DNA, 20 bp, Artificial Sequence
  Description of Artificial Sequence: Synthetic oligonucleotide
  Target: SCN9A; (+) strand; PAM type: NRG; PAM sequence: TGG
ggcacagatacaatcctaga

SEQ ID NO: 54180 - DNA, 20 bp, Artificial Sequence
  Description of Artificial Sequence: Synthetic oligonucleotide
  Target: SCN9A; (+) strand; PAM type: NRG; PAM sequence: TAG
cttaatttttgccattaaaa

SEQ ID NO: 54181 - DNA, 20 bp, Artificial Sequence
  Description of Artificial Sequence: Synthetic oligonucleotide
  Target: SCN9A; (+) strand; PAM type: NRG; PAM sequence: CAG
tgccattaaaatagtttatg

SEQ ID NO: 54182 - DNA, 20 bp, Artificial Sequence
  Description of Artificial Sequence: Synthetic oligonucleotide
  Target: SCN9A; (+) strand; PAM type: NRG; PAM sequence: AAG
aaaatagtttatgcagtttg

SEQ ID NO: 54183 - DNA, 20 bp, Artificial Sequence
  Description of Artificial Sequence: Synthetic oligonucleotide
  Target: SCN9A; (+) strand; PAM type: NRG; PAM sequence: CAG
tgaagcttgtacgcaaataa

SEQ ID NO: 54184 - DNA, 20 bp, Artificial Sequence
  Description of Artificial Sequence: Synthetic oligonucleotide
  Target: SCN9A; (+) strand; PAM type: NRG; PAM sequence: AGG
gaagcttgtacgcaaataac

SEQ ID NO: 54185 - DNA, 20 bp, Artificial Sequence
  Description of Artificial Sequence: Synthetic oligonucleotide
  Target: SCN9A; (+) strand; PAM type: NRG; PAM sequence: GGG
aagcttgtacgcaaataaca

SEQ ID NO: 54186 - DNA, 20 bp, Artificial Sequence
  Description of Artificial Sequence: Synthetic oligonucleotide
  Target: SCN9A; (+) strand; PAM type: NRG; PAM sequence: GAG
gcttgtacgcaaataacagg

SEQ ID NO: 54187 - DNA, 20 bp, Artificial Sequence
  Description of Artificial Sequence: Synthetic oligonucleotide
  Target: SCN9A; (+) strand; PAM type: NRG; PAM sequence: AAG
tgtacgcaaataacagggag

SEQ ID NO: 54188 - DNA, 20 bp, Artificial Sequence
  Description of Artificial Sequence: Synthetic oligonucleotide
  Target: SCN9A; (+) strand; PAM type: NRG; PAM sequence: AAG
cagggagaagctatactgaa

SEQ ID NO: 54189 - DNA, 20 bp, Artificial Sequence
  Description of Artificial Sequence: Synthetic oligonucleotide
  Target: SCN9A; (+) strand; PAM type: NRG; PAM sequence: AAG
atttcatttccattaaatcc

SEQ ID NO: 54190 - DNA, 20 bp, Artificial Sequence
  Description of Artificial Sequence: Synthetic oligonucleotide
  Target: SCN9A; (+) strand; PAM type: NRG; PAM sequence: CAG
atccaagacacatttatttg

SEQ ID NO: 54191 - DNA, 20 bp, Artificial Sequence
  Description of Artificial Sequence: Synthetic oligonucleotide
  Target: SCN9A; (+) strand; PAM type: NRG; PAM sequence: AAG
aagacacatttatttgcaga

SEQ ID NO: 54192 - DNA, 20 bp, Artificial Sequence
  Description of Artificial Sequence: Synthetic oligonucleotide
  Target: SCN9A; (+) strand; PAM type: NRG; PAM sequence: TGG
agttgcacatgtgactaatt

SEQ ID NO: 54193 - DNA, 20 bp, Artificial Sequence
  Description of Artificial Sequence: Synthetic oligonucleotide
  Target: SCN9A; (+) strand; PAM type: NRG; PAM sequence: GGG
gttgcacatgtgactaattt

SEQ ID NO: 54194 - DNA, 20 bp, Artificial Sequence
  Description of Artificial Sequence: Synthetic oligonucleotide
  Target: SCN9A; (+) strand; PAM type: NRG; PAM sequence: GGG
ttgcacatgtgactaatttg

SEQ ID NO: 54195 - DNA, 20 bp, Artificial Sequence
  Description of Artificial Sequence: Synthetic oligonucleotide
  Target: SCN9A; (+) strand; PAM type: NRG; PAM sequence: TGG
ctaatttggggttattaata

SEQ ID NO: 54196 - DNA, 20 bp, Artificial Sequence
  Description of Artificial Sequence: Synthetic oligonucleotide
  Target: SCN9A; (+) strand; PAM type: NRG; PAM sequence: TAG
aatatggttgaatataaata

SEQ ID NO: 54197 - DNA, 20 bp, Artificial Sequence
  Description of Artificial Sequence: Synthetic oligonucleotide
  Target: SCN9A; (+) strand; PAM type: NRG; PAM sequence: TGG
taaatatagcaaattttcat

SEQ ID NO: 54198 - DNA, 20 bp, Artificial Sequence
  Description of Artificial Sequence: Synthetic oligonucleotide
  Target: SCN9A; (+) strand; PAM type: NRG; PAM sequence: GGG
aaatatagcaaattttcatt

SEQ ID NO: 54199 - DNA, 20 bp, Artificial Sequence
  Description of Artificial Sequence: Synthetic oligonucleotide
  Target: SCN9A; (+) strand; PAM type: NRG; PAM sequence: GAG
atatagcaaattttcattgg

SEQ ID NO: 54200 - DNA, 20 bp, Artificial Sequence
  Description of Artificial Sequence: Synthetic oligonucleotide
  Target: SCN9A; (+) strand; PAM type: NRG; PAM sequence: TAG
attttcattgggagaaaatt

SEQ ID NO: 54201 - DNA, 20 bp, Artificial Sequence
  Description of Artificial Sequence: Synthetic oligonucleotide
  Target: SCN9A; (+) strand; PAM type: NRG; PAM sequence: AAG
agaaaatttagaaaactgaa

SEQ ID NO: 54202 - DNA, 20 bp, Artificial Sequence
  Description of Artificial Sequence: Synthetic oligonucleotide
  Target: SCN9A; (+) strand; PAM type: NRG; PAM sequence: TAG
atttagaaaactgaaaagca

SEQ ID NO: 54203 - DNA, 20 bp, Artificial Sequence
  Description of Artificial Sequence: Synthetic oligonucleotide
  Target: SCN9A; (+) strand; PAM type: NRG; PAM sequence: AAG
aaatgaaattaacctattcc

SEQ ID NO: 54204 - DNA, 20 bp, Artificial Sequence
  Description of Artificial Sequence: Synthetic oligonucleotide
  Target: SCN9A; (+) strand; PAM type: NRG; PAM sequence: AAG
attactgattttttttttta

SEQ ID NO: 54205 - DNA, 20 bp, Artificial Sequence
  Description of Artificial Sequence: Synthetic oligonucleotide
  Target: SCN9A; (+) strand; PAM type: NRG; PAM sequence: GAG
tactgatttttttttttaaa

SEQ ID NO: 54206 - DNA, 20 bp, Artificial Sequence
  Description of Artificial Sequence: Synthetic oligonucleotide
  Target: SCN9A; (+) strand; PAM type: NRG; PAM sequence: CAG
caatgtctcctactgttacc

SEQ ID NO: 54207 - DNA, 20 bp, Artificial Sequence
  Description of Artificial Sequence: Synthetic oligonucleotide
  Target: SCN9A; (+) strand; PAM type: NRG; PAM sequence: AGG
aatgtctcctactgttaccc

SEQ ID NO: 54208 - DNA, 20 bp, Artificial Sequence
  Description of Artificial Sequence: Synthetic oligonucleotide
  Target: SCN9A; (+) strand; PAM type: NRG; PAM sequence: TGG
tcctactgttacccaggctg

SEQ ID NO: 54209 - DNA, 20 bp, Artificial Sequence
  Description of Artificial Sequence: Synthetic oligonucleotide
  Target: SCN9A; (+) strand; PAM type: NRG; PAM sequence: TAG
cccaggctgtggtgcaatca

SEQ ID NO: 54210 - DNA, 20 bp, Artificial Sequence
  Description of Artificial Sequence: Synthetic oligonucleotide
  Target: SCN9A; (+) strand; PAM type: NRG; PAM sequence: TGG
actgcaacctccaaacctca

SEQ ID NO: 54211 - DNA, 20 bp, Artificial Sequence
  Description of Artificial Sequence: Synthetic oligonucleotide
  Target: SCN9A; (+) strand; PAM type: NRG; PAM sequence: GGG
ctgcaacctccaaacctcat

SEQ ID NO: 54212 - DNA, 20 bp, Artificial Sequence
  Description of Artificial Sequence: Synthetic oligonucleotide
  Target: SCN9A; (+) strand; PAM type: NRG; PAM sequence: AAG
cctccaaacctcatgggctc

SEQ ID NO: 54213 - DNA, 20 bp, Artificial Sequence
  Description of Artificial Sequence: Synthetic oligonucleotide
  Target: SCN9A; (+) strand; PAM type: NRG; PAM sequence: CAG
ctcaagtgttcttcccacct

SEQ ID NO: 54214 - DNA, 20 bp, Artificial Sequence
  Description of Artificial Sequence: Synthetic oligonucleotide
  Target: SCN9A; (+) strand; PAM type: NRG; PAM sequence: AAG
tcttcccacctcagcctccc

SEQ ID NO: 54215 - DNA, 20 bp, Artificial Sequence
  Description of Artificial Sequence: Synthetic oligonucleotide
  Target: SCN9A; (+) strand; PAM type: NRG; PAM sequence: TAG
tcccacctcagcctcccaag

SEQ ID NO: 54216 - DNA, 20 bp, Artificial Sequence
  Description of Artificial Sequence: Synthetic oligonucleotide
  Target: SCN9A; (+) strand; PAM type: NRG; PAM sequence: TAG
acctcagcctcccaagtagc

SEQ ID NO: 54217 - DNA, 20 bp, Artificial Sequence
  Description of Artificial Sequence: Synthetic oligonucleotide
  Target: SCN9A; (+) strand; PAM type: NRG; PAM sequence: AGG
cctcagcctcccaagtagct

SEQ ID NO: 54218 - DNA, 20 bp, Artificial Sequence
  Description of Artificial Sequence: Synthetic oligonucleotide
  Target: SCN9A; (+) strand; PAM type: NRG; PAM sequence: CAG
ctcccaagtagctaggacta

SEQ ID NO: 54219 - DNA, 20 bp, Artificial Sequence
  Description of Artificial Sequence: Synthetic oligonucleotide
  Target: SCN9A; (+) strand; PAM type: NRG; PAM sequence: AGG
tcccaagtagctaggactac

SEQ ID NO: 54220 - DNA, 20 bp, Artificial Sequence
  Description of Artificial Sequence: Synthetic oligonucleotide
  Target: SCN9A; (+) strand; PAM type: NRG; PAM sequence: TGG
caggtgtgcaccactatgtc

SEQ ID NO: 54221 - DNA, 20 bp, Artificial Sequence
  Description of Artificial Sequence: Synthetic oligonucleotide
  Target: SCN9A; (+) strand; PAM type: NRG; PAM sequence: TGG
tggctaatttttttttttaa

SEQ ID NO: 54222 - DNA, 20 bp, Artificial Sequence
  Description of Artificial Sequence: Synthetic oligonucleotide
  Target: SCN9A; (+) strand; PAM type: NRG; PAM sequence: GAG
gctaatttttttttttaatg

SEQ ID NO: 54223 - DNA, 20 bp, Artificial Sequence
  Description of Artificial Sequence: Synthetic oligonucleotide
  Target: SCN9A; (+) strand; PAM type: NRG; PAM sequence: CAG
tggagtctctctctgtcacc

SEQ ID NO: 54224 - DNA, 20 bp, Artificial Sequence
  Description of Artificial Sequence: Synthetic oligonucleotide
  Target: SCN9A; (+) strand; PAM type: NRG; PAM sequence: AGG
ggagtctctctctgtcaccc

SEQ ID NO: 54225 - DNA, 20 bp, Artificial Sequence
  Description of Artificial Sequence: Synthetic oligonucleotide
  Target: SCN9A; (+) strand; PAM type: NRG; PAM sequence: TGG
tctctctctgtcacccaggc

SEQ ID NO: 54226 - DNA, 20 bp, Artificial Sequence
  Description of Artificial Sequence: Synthetic oligonucleotide
  Target: SCN9A; (+) strand; PAM type: NRG; PAM sequence: GAG
tctctctgtcacccaggctg

SEQ ID NO: 54227 - DNA, 20 bp, Artificial Sequence
  Description of Artificial Sequence: Synthetic oligonucleotide
  Target: SCN9A; (+) strand; PAM type: NRG; PAM sequence: CAG
ctgtcacccaggctggagtg

SEQ ID NO: 54228 - DNA, 20 bp, Artificial Sequence
  Description of Artificial Sequence: Synthetic oligonucleotide
  Target: SCN9A; (+) strand; PAM type: NRG; PAM sequence: CGG
ggagtgcagtgatatgatct

SEQ ID NO: 54229 - DNA, 20 bp, Artificial Sequence
  Description of Artificial Sequence: Synthetic oligonucleotide
  Target: SCN9A; (+) strand; PAM type: NRG; PAM sequence: TGG
tcactgcaacctctgcctct

SEQ ID NO: 54230 - DNA, 20 bp, Artificial Sequence
  Description of Artificial Sequence: Synthetic oligonucleotide
  Target: SCN9A; (+) strand; PAM type: NRG; PAM sequence: CAG
ctgcaacctctgcctcttgg

SEQ ID NO: 54231 - DNA, 20 bp, Artificial Sequence
  Description of Artificial Sequence: Synthetic oligonucleotide
  Target: SCN9A; (+) strand; PAM type: NRG; PAM sequence: TGG
cctctgcctcttggcagcac

SEQ ID NO: 54232 - DNA, 20 bp, Artificial Sequence
  Description of Artificial Sequence: Synthetic oligonucleotide
  Target: SCN9A; (+) strand; PAM type: NRG; PAM sequence: GGG
ctctgcctcttggcagcact

SEQ ID NO: 54233 - DNA, 20 bp, Artificial Sequence
  Description of Artificial Sequence: Synthetic oligonucleotide
  Target: SCN9A; (+) strand; PAM type: NRG; PAM sequence: CAG
tcttggcagcactgggataa

SEQ ID NO: 54234 - DNA, 20 bp, Artificial Sequence
  Description of Artificial Sequence: Synthetic oligonucleotide
  Target: SCN9A; (+) strand; PAM type: NRG; PAM sequence: AGG
cttggcagcactgggataac

SEQ ID NO: 54235 - DNA, 20 bp, Artificial Sequence
  Description of Artificial Sequence: Synthetic oligonucleotide
  Target: SCN9A; (+) strand; PAM type: NRG; PAM sequence: GAG
agcactgggataacaggcat

SEQ ID NO: 54236 - DNA, 20 bp, Artificial Sequence
  Description of Artificial Sequence: Synthetic oligonucleotide
  Target: SCN9A; (+) strand; PAM type: NRG; PAM sequence: CAG
acatactgacaaaatgtttc

SEQ ID NO: 54237 - DNA, 20 bp, Artificial Sequence
  Description of Artificial Sequence: Synthetic oligonucleotide
  Target: SCN9A; (+) strand; PAM type: NRG; PAM sequence: AAG
actgacaaaatgtttccaga

SEQ ID NO: 54238 - DNA, 20 bp, Artificial Sequence
  Description of Artificial Sequence: Synthetic oligonucleotide
  Target: SCN9A; (+) strand; PAM type: NRG; PAM sequence: AGG
ctgacaaaatgtttccagaa

SEQ ID NO: 54239 - DNA, 20 bp, Artificial Sequence
  Description of Artificial Sequence: Synthetic oligonucleotide
  Target: SCN9A; (+) strand; PAM type: NRG; PAM sequence: TAG
ataaaaatgtatatcatttt

SEQ ID NO: 54240 - DNA, 20 bp, Artificial Sequence
  Description of Artificial Sequence: Synthetic oligonucleotide
  Target: SCN9A; (+) strand; PAM type: NRG; PAM sequence: AAG
tatcatttttagcaacatgt

SEQ ID NO: 54241 - DNA, 20 bp, Artificial Sequence
  Description of Artificial Sequence: Synthetic oligonucleotide
  Target: SCN9A; (+) strand; PAM type: NRG; PAM sequence: AAG
atatattttcccacaatgtt

SEQ ID NO: 54242 - DNA, 20 bp, Artificial Sequence
  Description of Artificial Sequence: Synthetic oligonucleotide
  Target: SCN9A; (+) strand; PAM type: NRG; PAM sequence: TAG
ttttcccacaatgttaagta

SEQ ID NO: 54243 - DNA, 20 bp, Artificial Sequence
  Description of Artificial Sequence: Synthetic oligonucleotide
  Target: SCN9A; (+) strand; PAM type: NRG; PAM sequence: TAG
tgaatttcgtgaaacatttc

SEQ ID NO: 54244 - DNA, 20 bp, Artificial Sequence
  Description of Artificial Sequence: Synthetic oligonucleotide
  Target: SCN9A; (+) strand; PAM type: NRG; PAM sequence: TGG
aaacatttctagttcttctt

SEQ ID NO: 54245 - DNA, 20 bp, Artificial Sequence
  Description of Artificial Sequence: Synthetic oligonucleotide
  Target: SCN9A; (+) strand; PAM type: NRG; PAM sequence: CAG
atttctagttcttctttggt

SEQ ID NO: 54246 - DNA, 20 bp, Artificial Sequence
  Description of Artificial Sequence: Synthetic oligonucleotide
  Target: SCN9A; (+) strand; PAM type: NRG; PAM sequence: TAG
tcttctttggtcagtgtctt

SEQ ID NO: 54247 - DNA, 20 bp, Artificial Sequence
  Description of Artificial Sequence: Synthetic oligonucleotide
  Target: SCN9A; (+) strand; PAM type: NRG; PAM sequence: AAG
tcattattttcttgtttgcc

SEQ ID NO: 54248 - DNA, 20 bp, Artificial Sequence
  Description of Artificial Sequence: Synthetic oligonucleotide
  Target: SCN9A; (+) strand; PAM type: NRG; PAM sequence: AGG
cattattttcttgtttgcca

SEQ ID NO: 54249 - DNA, 20 bp, Artificial Sequence
  Description of Artificial Sequence: Synthetic oligonucleotide
  Target: SCN9A; (+) strand; PAM type: NRG; PAM sequence: GGG
attattttcttgtttgccaa

SEQ ID NO: 54250 - DNA, 20 bp, Artificial Sequence
  Description of Artificial Sequence: Synthetic oligonucleotide
  Target: SCN9A; (+) strand; PAM type: NRG; PAM sequence: TGG
caagggattgtgtgtgtgtg

SEQ ID NO: 54251 - DNA, 20 bp, Artificial Sequence
  Description of Artificial Sequence: Synthetic oligonucleotide
  Target: SCN9A; (+) strand; PAM type: NRG; PAM sequence: GGG
aagggattgtgtgtgtgtgt

SEQ ID NO: 54252 - DNA, 20 bp, Artificial Sequence
  Description of Artificial Sequence: Synthetic oligonucleotide
  Target: SCN9A; (+) strand; PAM type: NRG; PAM sequence: AAG
tgggtgtgtgtgcacacgct

SEQ ID NO: 54253 - DNA, 20 bp, Artificial Sequence
  Description of Artificial Sequence: Synthetic oligonucleotide
  Target: SCN9A; (+) strand; PAM type: NRG; PAM sequence: AGG
gggtgtgtgtgcacacgcta

SEQ ID NO: 54254 - DNA, 20 bp, Artificial Sequence
  Description of Artificial Sequence: Synthetic oligonucleotide
  Target: SCN9A; (+) strand; PAM type: NRG; PAM sequence: CAG
ttcttttttttttcttttgc

SEQ ID NO: 54255 - DNA, 20 bp, Artificial Sequence
  Description of Artificial Sequence: Synthetic oligonucleotide
  Target: SCN9A; (+) strand; PAM type: NRG; PAM sequence: TGG
aactttgtctttactaaaac

SEQ ID NO: 54256 - DNA, 20 bp, Artificial Sequence
  Description of Artificial Sequence: Synthetic oligonucleotide
  Target: SCN9A; (+) strand; PAM type: NRG; PAM sequence: TAG
aactggttttcaaaaatgaa

SEQ ID NO: 54257 - DNA, 20 bp, Artificial Sequence
  Description of Artificial Sequence: Synthetic oligonucleotide
  Target: SCN9A; (+) strand; PAM type: NRG; PAM sequence: AAG
aaatatataattactcttta

SEQ ID NO: 54258 - DNA, 20 bp, Artificial Sequence
  Description of Artificial Sequence: Synthetic oligonucleotide
  Target: SCN9A; (+) strand; PAM type: NRG; PAM sequence: AGG
aatatataattactctttaa

SEQ ID NO: 54259 - DNA, 20 bp, Artificial Sequence
  Description of Artificial Sequence: Synthetic oligonucleotide
  Target: SCN9A; (+) strand; PAM type: NRG; PAM sequence: CAG
tactctttaaaggaattatg

SEQ ID NO: 54260 - DNA, 20 bp, Artificial Sequence
  Description of Artificial Sequence: Synthetic oligonucleotide
  Target: SCN9A; (+) strand; PAM type: NRG; PAM sequence: TGG
gcatatatatgttttcccat

SEQ ID NO: 54261 - DNA, 20 bp, Artificial Sequence
  Description of Artificial Sequence: Synthetic oligonucleotide
  Target: SCN9A; (+) strand; PAM type: NRG; PAM sequence: GGG
catatatatgttttcccatt

SEQ ID NO: 54262 - DNA, 20 bp, Artificial Sequence
  Description of Artificial Sequence: Synthetic oligonucleotide
  Target: SCN9A; (+) strand; PAM type: NRG; PAM sequence: GAG
tatatatgttttcccattgg

SEQ ID NO: 54263 - DNA, 20 bp, Artificial Sequence
  Description of Artificial Sequence: Synthetic oligonucleotide
  Target: SCN9A; (+) strand; PAM type: NRG; PAM sequence: AGG
atatatgttttcccattggg

SEQ ID NO: 54264 - DNA, 20 bp, Artificial Sequence
  Description of Artificial Sequence: Synthetic oligonucleotide
  Target: SCN9A; (+) strand; PAM type: NRG; PAM sequence: GGG
tatatgttttcccattggga

SEQ ID NO: 54265 - DNA, 20 bp, Artificial Sequence
  Description of Artificial Sequence: Synthetic oligonucleotide
  Target: SCN9A; (+) strand; PAM type: NRG; PAM sequence: CAG
atgttttcccattgggaggg

SEQ ID NO: 54266 - DNA, 20 bp, Artificial Sequence
  Description of Artificial Sequence: Synthetic oligonucleotide
  Target: SCN9A; (+) strand; PAM type: NRG; PAM sequence: TGG
ttattttcatgacatatttc

SEQ ID NO: 54267 - DNA, 20 bp, Artificial Sequence
  Description of Artificial Sequence: Synthetic oligonucleotide
  Target: SCN9A; (+) strand; PAM type: NRG; PAM sequence: GGG
tattttcatgacatatttct

SEQ ID NO: 54268 - DNA, 20 bp, Artificial Sequence
  Description of Artificial Sequence: Synthetic oligonucleotide
  Target: SCN9A; (+) strand; PAM type: NRG; PAM sequence: TAG
tgacatatttctgggaaaca

SEQ ID NO: 54269 - DNA, 20 bp, Artificial Sequence
  Description of Artificial Sequence: Synthetic oligonucleotide
  Target: SCN9A; (+) strand; PAM type: NRG; PAM sequence: AGG
gacatatttctgggaaacat

SEQ ID NO: 54270 - DNA, 20 bp, Artificial Sequence
  Description of Artificial Sequence: Synthetic oligonucleotide
  Target: SCN9A; (+) strand; PAM type: NRG; PAM sequence: TAG
atttctgggaaacataggcc

SEQ ID NO: 54271 - DNA, 20 bp, Artificial Sequence
  Description of Artificial Sequence: Synthetic oligonucleotide
  Target: SCN9A; (+) strand; PAM type: NRG; PAM sequence: GAG
ggaaacataggcctagaaat

SEQ ID NO: 54272 - DNA, 20 bp, Artificial Sequence
  Description of Artificial Sequence: Synthetic oligonucleotide
  Target: SCN9A; (+) strand; PAM type: NRG; PAM sequence: CAG
agatttttttttttttttga

SEQ ID NO: 54273 - DNA, 20 bp, Artificial Sequence
  Description of Artificial Sequence: Synthetic oligonucleotide
  Target: SCN9A; (+) strand; PAM type: NRG; PAM sequence: CAG
ttttttttttgacagattct

SEQ ID NO: 54274 - DNA, 20 bp, Artificial Sequence
  Description of Artificial Sequence: Synthetic oligonucleotide
  Target: SCN9A; (+) strand; PAM type: NRG; PAM sequence: TGG
tttttgacagattctcagtc

SEQ ID NO: 54275 - DNA, 20 bp, Artificial Sequence
  Description of Artificial Sequence: Synthetic oligonucleotide
  Target: SCN9A; (+) strand; PAM type: NRG; PAM sequence: GAG
tttgacagattctcagtctg

SEQ ID NO: 54276 - DNA, 20 bp, Artificial Sequence
  Description of Artificial Sequence: Synthetic oligonucleotide
  Target: SCN9A; (+) strand; PAM type: NRG; PAM sequence: CAG
cagattctcagtctggagtg

SEQ ID NO: 54277 - DNA, 20 bp, Artificial Sequence
  Description of Artificial Sequence: Synthetic oligonucleotide
  Target: SCN9A; (+) strand; PAM type: NRG; PAM sequence: TGG
attctcagtctggagtgcag

SEQ ID NO: 54278 - DNA, 20 bp, Artificial Sequence
  Description of Artificial Sequence: Synthetic oligonucleotide
  Target: SCN9A; (+) strand; PAM type: NRG; PAM sequence: CAG
ggagtgcagtggcatgatct

SEQ ID NO: 54279 - DNA, 20 bp, Artificial Sequence
  Description of Artificial Sequence: Synthetic oligonucleotide
  Target: SCN9A; (+) strand; PAM type: NRG; PAM sequence: TGG
tcactataacctctgcctcc

SEQ ID NO: 54280 - DNA, 20 bp, Artificial Sequence
  Description of Artificial Sequence: Synthetic oligonucleotide
  Target: SCN9A; (+) strand; PAM type: NRG; PAM sequence: AAG
aacctctgcctcctggattc

SEQ ID NO: 54281 - DNA, 20 bp, Artificial Sequence
  Description of Artificial Sequence: Synthetic oligonucleotide
  Target: SCN9A; (+) strand; PAM type: NRG; PAM sequence: CAG
ttcaagtgattctcctgcct

SEQ ID NO: 54282 - DNA, 20 bp, Artificial Sequence
  Description of Artificial Sequence: Synthetic oligonucleotide
  Target: SCN9A; (+) strand; PAM type: NRG; PAM sequence: GAG
ttctcctgcctcagcctcct

SEQ ID NO: 54283 - DNA, 20 bp, Artificial Sequence
  Description of Artificial Sequence: Synthetic oligonucleotide
  Target: SCN9A; (+) strand; PAM type: NRG; PAM sequence: TAG
tcctgcctcagcctcctgag

SEQ ID NO: 54284 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctcctgagtagc

SEQ ID NO: 54285 - DNA, 20 bp, Artificial Sequence
  Description of Artificial Sequence: Synthetic oligonucleotide
  Target: SCN9A; (+) strand; PAM type: NRG; PAM sequence: GGG
cctcagcctcctgagtagct

SEQ ID NO: 54286 - DNA, 20 bp, Artificial Sequence
  Description of Artificial Sequence: Synthetic oligonucleotide
  Target: SCN9A; (+) strand; PAM type: NRG; PAM sequence: TAG
ctcctgagtagctgggacta

SEQ ID NO: 54287 - DNA, 20 bp, Artificial Sequence
  Description of Artificial Sequence: Synthetic oligonucleotide
  Target: SCN9A; (+) strand; PAM type: NRG; PAM sequence: AGG
tcctgagtagctgggactat

SEQ ID NO: 54288 - DNA, 20 bp, Artificial Sequence
  Description of Artificial Sequence: Synthetic oligonucleotide
  Target: SCN9A; (+) strand; PAM type: NRG; PAM sequence: CAG
taggtgcctgccaccacgcc

SEQ ID NO: 54289 - DNA, 20 bp, Artificial Sequence
  Description of Artificial Sequence: Synthetic oligonucleotide
  Target: SCN9A; (+) strand; PAM type: NRG; PAM sequence: TAG
ccagctaatttttgtatttt

SEQ ID NO: 54290 - DNA, 20 bp, Artificial Sequence
  Description of Artificial Sequence: Synthetic oligonucleotide
  Target: SCN9A; (+) strand; PAM type: NRG; PAM sequence: TAG
gctaatttttgtatttttag

SEQ ID NO: 54291 - DNA, 20 bp, Artificial Sequence
  Description of Artificial Sequence: Synthetic oligonucleotide
  Target: SCN9A; (+) strand; PAM type: NRG; PAM sequence: CAG
ttttgtatttttagtagcga

SEQ ID NO: 54292 - DNA, 20 bp, Artificial Sequence
  Description of Artificial Sequence: Synthetic oligonucleotide
  Target: SCN9A; (+) strand; PAM type: NRG; PAM sequence: AGG
tttgtatttttagtagcgac

SEQ ID NO: 54293 - DNA, 20 bp, Artificial Sequence
  Description of Artificial Sequence: Synthetic oligonucleotide
  Target: SCN9A; (+) strand; PAM type: NRG; PAM sequence: GGG
ttgtatttttagtagcgaca

SEQ ID NO: 54294 - DNA, 20 bp, Artificial Sequence
  Description of Artificial Sequence: Synthetic oligonucleotide
  Target: SCN9A; (+) strand; PAM type: NRG; PAM sequence: TGG
gcgacagggtttcaccatgt

SEQ ID NO: 54295 - DNA, 20 bp, Artificial Sequence
  Description of Artificial Sequence: Synthetic oligonucleotide
  Target: SCN9A; (+) strand; PAM type: NRG; PAM sequence: CAG
cagggtttcaccatgttggc

SEQ ID NO: 54296 - DNA, 20 bp, Artificial Sequence
  Description of Artificial Sequence: Synthetic oligonucleotide
  Target: SCN9A; (+) strand; PAM type: NRG; PAM sequence: AGG
agggtttcaccatgttggcc

SEQ ID NO: 54297 - DNA, 20 bp, Artificial Sequence
  Description of Artificial Sequence: Synthetic oligonucleotide
  Target: SCN9A; (+) strand; PAM type: NRG; PAM sequence: TGG
tttcaccatgttggccagga

SEQ ID NO: 54298 - DNA, 20 bp, Artificial Sequence
  Description of Artificial Sequence: Synthetic oligonucleotide
  Target: SCN9A; (+) strand; PAM type: NRG; PAM sequence: TGG
accttgtgatctgcccgcct

SEQ ID NO: 54299 - DNA, 20 bp, Artificial Sequence
  Description of Artificial Sequence: Synthetic oligonucleotide
  Target: SCN9A; (+) strand; PAM type: NRG; PAM sequence: TGG
gccttggcctcccaaaatgc

SEQ ID NO: 54300 - DNA, 20 bp, Artificial Sequence
  Description of Artificial Sequence: Synthetic oligonucleotide
  Target: SCN9A; (+) strand; PAM type: NRG; PAM sequence: GGG
ccttggcctcccaaaatgct

SEQ ID NO: 54301 - DNA, 20 bp, Artificial Sequence
  Description of Artificial Sequence: Synthetic oligonucleotide
  Target: SCN9A; (+) strand; PAM type: NRG; PAM sequence: CAG
ctcccaaaatgctgggatta

SEQ ID NO: 54302 - DNA, 20 bp, Artificial Sequence
  Description of Artificial Sequence: Synthetic oligonucleotide
  Target: SCN9A; (+) strand; PAM type: NRG; PAM sequence: AGG
tcccaaaatgctgggattac

SEQ ID NO: 54303 - DNA, 20 bp, Artificial Sequence
  Description of Artificial Sequence: Synthetic oligonucleotide
  Target: SCN9A; (+) strand; PAM type: NRG; PAM sequence: GAG
aatgctgggattacaggcgt

SEQ ID NO: 54304 - DNA, 20 bp, Artificial Sequence
  Description of Artificial Sequence: Synthetic oligonucleotide
  Target: SCN9A; (+) strand; PAM type: NRG; PAM sequence: TGG
caggcgtgagccactgcgcc

SEQ ID NO: 54305 - DNA, 20 bp, Artificial Sequence
  Description of Artificial Sequence: Synthetic oligonucleotide
  Target: SCN9A; (+) strand; PAM type: NRG; PAM sequence: GAG
ccactgcgcctggccaaaat

SEQ ID NO: 54306 - DNA, 20 bp, Artificial Sequence
  Description of Artificial Sequence: Synthetic oligonucleotide
  Target: SCN9A; (+) strand; PAM type: NRG; PAM sequence: AGG
cactgcgcctggccaaaatg

SEQ ID NO: 54307 - DNA, 20 bp, Artificial Sequence
  Description of Artificial Sequence: Synthetic oligonucleotide
  Target: SCN9A; (+) strand; PAM type: NRG; PAM sequence: CAG
ccaaaatgaggtttttcaca

SEQ ID NO: 54308 - DNA, 20 bp, Artificial Sequence
  Description of Artificial Sequence: Synthetic oligonucleotide
  Target: SCN9A; (+) strand; PAM type: NRG; PAM sequence: TGG
gaggtttttcacacagtccc

SEQ ID NO: 54309 - DNA, 20 bp, Artificial Sequence
  Description of Artificial Sequence: Synthetic oligonucleotide
  Target: SCN9A; (+) strand; PAM type: NRG; PAM sequence: GAG
ggtttttcacacagtccctg

SEQ ID NO: 54310 - DNA, 20 bp, Artificial Sequence
  Description of Artificial Sequence: Synthetic oligonucleotide
  Target: SCN9A; (+) strand; PAM type: NRG; PAM sequence: GAG
cagtccctggagtcttgtct

SEQ ID NO: 54311 - DNA, 20 bp, Artificial Sequence
  Description of Artificial Sequence: Synthetic oligonucleotide
  Target: SCN9A; (+) strand; PAM type: NRG; PAM sequence: AGG
agtccctggagtcttgtctg

SEQ ID NO: 54312 - DNA, 20 bp, Artificial Sequence
  Description of Artificial Sequence: Synthetic oligonucleotide
  Target: SCN9A; (+) strand; PAM type: NRG; PAM sequence: TGG
cctggagtcttgtctgaggc

SEQ ID NO: 54313 - DNA, 20 bp, Artificial Sequence
  Description of Artificial Sequence: Synthetic oligonucleotide
  Target: SCN9A; (+) strand; PAM type: NRG; PAM sequence: GGG
ctggagtcttgtctgaggct

SEQ ID NO: 54314 - DNA, 20 bp, Artificial Sequence
  Description of Artificial Sequence: Synthetic oligonucleotide
  Target: SCN9A; (+) strand; PAM type: NRG; PAM sequence: GAG
agtcttgtctgaggctgggt

SEQ ID NO: 54315 - DNA, 20 bp, Artificial Sequence
  Description of Artificial Sequence: Synthetic oligonucleotide
  Target: SCN9A; (+) strand; PAM type: NRG; PAM sequence: AGG
gtcttgtctgaggctgggtg

SEQ ID NO: 54316 - DNA, 20 bp, Artificial Sequence
  Description of Artificial Sequence: Synthetic oligonucleotide
  Target: SCN9A; (+) strand; PAM type: NRG; PAM sequence: CAG
tcaaactgaactatcctgct

SEQ ID NO: 54317 - DNA, 20 bp, Artificial Sequence
  Description of Artificial Sequence: Synthetic oligonucleotide
  Target: SCN9A; (+) strand; PAM type: NRG; PAM sequence: CAG
ctctgcctcttttcttttct

SEQ ID NO: 54318 - DNA, 20 bp, Artificial Sequence
  Description of Artificial Sequence: Synthetic oligonucleotide
  Target: SCN9A; (+) strand; PAM type: NRG; PAM sequence: TGG
tcttttcttttctcagtgtt

SEQ ID NO: 54319 - DNA, 20 bp, Artificial Sequence
  Description of Artificial Sequence: Synthetic oligonucleotide
  Target: SCN9A; (+) strand; PAM type: NRG; PAM sequence: GGG
cttttcttttctcagtgttt

SEQ ID NO: 54320 - DNA, 20 bp, Artificial Sequence
  Description of Artificial Sequence: Synthetic oligonucleotide
  Target: SCN9A; (+) strand; PAM type: NRG; PAM sequence: CAG
gtttgggtcatccacctcct

SEQ ID NO: 54321 - DNA, 20 bp, Artificial Sequence
  Description of Artificial Sequence: Synthetic oligonucleotide
  Target: SCN9A; (+) strand; PAM type: NRG; PAM sequence: GAG
ttgggtcatccacctcctca

SEQ ID NO: 54322 - DNA, 20 bp, Artificial Sequence
  Description of Artificial Sequence: Synthetic oligonucleotide
  Target: SCN9A; (+) strand; PAM type: NRG; PAM sequence: TAG
ctgtacaacatttttttatt

SEQ ID NO: 54323 - DNA, 20 bp, Artificial Sequence
  Description of Artificial Sequence: Synthetic oligonucleotide
  Target: SCN9A; (+) strand; PAM type: NRG; PAM sequence: AAG
atttagatttttgtataacg

SEQ ID NO: 54324 - DNA, 20 bp, Artificial Sequence
  Description of Artificial Sequence: Synthetic oligonucleotide
  Target: SCN9A; (+) strand; PAM type: NRG; PAM sequence: CAG
ataacgaagtttctttaatg

SEQ ID NO: 54325 - DNA, 20 bp, Artificial Sequence
  Description of Artificial Sequence: Synthetic oligonucleotide
  Target: SCN9A; (+) strand; PAM type: NRG; PAM sequence: TGG
ctacatttttacacacataa

SEQ ID NO: 54326 - DNA, 20 bp, Artificial Sequence
  Description of Artificial Sequence: Synthetic oligonucleotide
  Target: SCN9A; (+) strand; PAM type: NRG; PAM sequence: AAG
attcattcattcattcattc

SEQ ID NO: 54327 - DNA, 20 bp, Artificial Sequence
  Description of Artificial Sequence: Synthetic oligonucleotide
  Target: SCN9A; (+) strand; PAM type: NRG; PAM sequence: CAG
tcattcattcaagttcattc

SEQ ID NO: 54328 - DNA, 20 bp, Artificial Sequence
  Description of Artificial Sequence: Synthetic oligonucleotide
  Target: SCN9A; (+) strand; PAM type: NRG; PAM sequence: TAG
agttcattccagacatattt

SEQ ID NO: 54329 - DNA, 20 bp, Artificial Sequence
  Description of Artificial Sequence: Synthetic oligonucleotide
  Target: SCN9A; (+) strand; PAM type: NRG; PAM sequence: GAG
ttcattccagacatatttta

SEQ ID NO: 54330 - DNA, 20 bp, Artificial Sequence
  Description of Artificial Sequence: Synthetic oligonucleotide
  Target: SCN9A; (+) strand; PAM type: NRG; PAM sequence: AGG
tcattccagacatattttag

SEQ ID NO: 54331 - DNA, 20 bp, Artificial Sequence
  Description of Artificial Sequence: Synthetic oligonucleotide
  Target: SCN9A; (+) strand; PAM type: NRG; PAM sequence: AAG
tattatttgattatcatcct

SEQ ID NO: 54332 - DNA, 20 bp, Artificial Sequence
  Description of Artificial Sequence: Synthetic oligonucleotide
  Target: SCN9A; (+) strand; PAM type: NRG; PAM sequence: CAG
ttgattatcatcctaagcat

SEQ ID NO: 54333 - DNA, 20 bp, Artificial Sequence
  Description of Artificial Sequence: Synthetic oligonucleotide
  Target: SCN9A; (+) strand; PAM type: NRG; PAM sequence: GAG
gattatcatcctaagcatca

SEQ ID NO: 54334 - DNA, 20 bp, Artificial Sequence
  Description of Artificial Sequence: Synthetic oligonucleotide
  Target: SCN9A; (+) strand; PAM type: NRG; PAM sequence: CAG
tatcatcctaagcatcagag

SEQ ID NO: 54335 - DNA, 20 bp, Artificial Sequence
  Description of Artificial Sequence: Synthetic oligonucleotide
  Target: SCN9A; (+) strand; PAM type: NRG; PAM sequence: TAG
atcctaagcatcagagcagt

SEQ ID NO: 54336 - DNA, 20 bp, Artificial Sequence
  Description of Artificial Sequence: Synthetic oligonucleotide
  Target: SCN9A; (+) strand; PAM type: NRG; PAM sequence: AAG
tcagagcagttagtaactcc

SEQ ID NO: 54337 - DNA, 20 bp, Artificial Sequence
  Description of Artificial Sequence: Synthetic oligonucleotide
  Target: SCN9A; (+) strand; PAM type: NRG; PAM sequence: CAG
gcagttagtaactccaagaa

SEQ ID NO: 54338 - DNA, 20 bp, Artificial Sequence
  Description of Artificial Sequence: Synthetic oligonucleotide
  Target: SCN9A; (+) strand; PAM type: NRG; PAM sequence: AAG
tccaagaacagaacattttt

SEQ ID NO: 54339 - DNA, 20 bp, Artificial Sequence
  Description of Artificial Sequence: Synthetic oligonucleotide
  Target: SCN9A; (+) strand; PAM type: NRG; PAM sequence: AAG
cagaacatttttaagttgaa

SEQ ID NO: 54340 - DNA, 20 bp, Artificial Sequence
  Description of Artificial Sequence: Synthetic oligonucleotide
  Target: SCN9A; (+) strand; PAM type: NRG; PAM sequence: TAG
acatttttaagttgaaaagt

SEQ ID NO: 54341 - DNA, 20 bp, Artificial Sequence
  Description of Artificial Sequence: Synthetic oligonucleotide
  Target: SCN9A; (+) strand; PAM type: NRG; PAM sequence: AGG
catttttaagttgaaaagtt

SEQ ID NO: 54342 - DNA, 20 bp, Artificial Sequence
  Description of Artificial Sequence: Synthetic oligonucleotide
  Target: SCN9A; (+) strand; PAM type: NRG; PAM sequence: CAG
gaaaagttaggtccaaattg

SEQ ID NO: 54343 - DNA, 20 bp, Artificial Sequence
  Description of Artificial Sequence: Synthetic oligonucleotide
  Target: SCN9A; (+) strand; PAM type: NRG; PAM sequence: AGG
aaaagttaggtccaaattgc

SEQ ID NO: 54344 - DNA, 20 bp, Artificial Sequence
  Description of Artificial Sequence: Synthetic oligonucleotide
  Target: SCN9A; (+) strand; PAM type: NRG; PAM sequence: TAG
tcccattttttccccataaa

SEQ ID NO: 54345 - DNA, 20 bp, Artificial Sequence
  Description of Artificial Sequence: Synthetic oligonucleotide
  Target: SCN9A; (+) strand; PAM type: NRG; PAM sequence: AAG
cattcttatatttatttttg

SEQ ID NO: 54346 - DNA, 20 bp, Artificial Sequence
  Description of Artificial Sequence: Synthetic oligonucleotide
  Target: SCN9A; (+) strand; PAM type: NRG; PAM sequence: TAG
ttatttttgaagaataaatt

SEQ ID NO: 54347 - DNA, 20 bp, Artificial Sequence
  Description of Artificial Sequence: Synthetic oligonucleotide
  Target: SCN9A; (+) strand; PAM type: NRG; PAM sequence: AAG
aatttagccacaaaactcaa

SEQ ID NO: 54348 - DNA, 20 bp, Artificial Sequence
  Description of Artificial Sequence: Synthetic oligonucleotide
  Target: SCN9A; (+) strand; PAM type: NRG; PAM sequence: CAG
tctcactcttcaatgtttcc

SEQ ID NO: 54349 - DNA, 20 bp, Artificial Sequence
  Description of Artificial Sequence: Synthetic oligonucleotide
  Target: SCN9A; (+) strand; PAM type: NRG; PAM sequence: TGG
ccatccaaattcctcccctg

SEQ ID NO: 54350 - DNA, 20 bp, Artificial Sequence
  Description of Artificial Sequence: Synthetic oligonucleotide
  Target: SCN9A; (+) strand; PAM type: NRG; PAM sequence: CAG
tcctcccctgtggacaacca

SEQ ID NO: 54351 - DNA, 20 bp, Artificial Sequence
  Description of Artificial Sequence: Synthetic oligonucleotide
  Target: SCN9A; (+) strand; PAM type: NRG; PAM sequence: TGG
cccttgtgtatccatccatg

SEQ ID NO: 54352 - DNA, 20 bp, Artificial Sequence
  Description of Artificial Sequence: Synthetic oligonucleotide
  Target: SCN9A; (+) strand; PAM type: NRG; PAM sequence: CAG
atccatccatgtggttttat

SEQ ID NO: 54353 - DNA, 20 bp, Artificial Sequence
  Description of Artificial Sequence: Synthetic oligonucleotide
  Target: SCN9A; (+) strand; PAM type: NRG; PAM sequence: CAG
ttccttcgtcacttaaaaat

SEQ ID NO: 54354 - DNA, 20 bp, Artificial Sequence
  Description of Artificial Sequence: Synthetic oligonucleotide
  Target: SCN9A; (+) strand; PAM type: NRG; PAM sequence: TGG
cgtcacttaaaaatcagact

SEQ ID NO: 54355 - DNA, 20 bp, Artificial Sequence
  Description of Artificial Sequence: Synthetic oligonucleotide
  Target: SCN9A; (+) strand; PAM type: NRG; PAM sequence: CAG
acttggaaatctttctgtat

SEQ ID NO: 54356 - DNA, 20 bp, Artificial Sequence
  Description of Artificial Sequence: Synthetic oligonucleotide
  Target: SCN9A; (+) strand; PAM type: NRG; PAM sequence: AAG
tttctgtatcagcatgtata

SEQ ID NO: 54357 - DNA, 20 bp, Artificial Sequence
  Description of Artificial Sequence: Synthetic oligonucleotide
  Target: SCN9A; (+) strand; PAM type: NRG; PAM sequence: TAG
tataaagctacttcttttta

SEQ ID NO: 54358 - DNA, 20 bp, Artificial Sequence
  Description of Artificial Sequence: Synthetic oligonucleotide
  Target: SCN9A; (+) strand; PAM type: NRG; PAM sequence: CAG
aaagctacttctttttatag

SEQ ID NO: 54359 - DNA, 20 bp, Artificial Sequence
  Description of Artificial Sequence: Synthetic oligonucleotide
  Target: SCN9A; (+) strand; PAM type: NRG; PAM sequence: AAG
ctttttatagcagcttcata

SEQ ID NO: 54360 - DNA, 20 bp, Artificial Sequence
  Description of Artificial Sequence: Synthetic oligonucleotide
  Target: SCN9A; (+) strand; PAM type: NRG; PAM sequence: CAG
cttcataaagtcctattgta

SEQ ID NO: 54361 - DNA, 20 bp, Artificial Sequence
  Description of Artificial Sequence: Synthetic oligonucleotide
  Target: SCN9A; (+) strand; PAM type: NRG; PAM sequence: TAG
acagctgtacccaaattatt

SEQ ID NO: 54362 - DNA, 20 bp, Artificial Sequence
  Description of Artificial Sequence: Synthetic oligonucleotide
  Target: SCN9A; (+) strand; PAM type: NRG; PAM sequence: TAG
atttagtcattcccacactg

SEQ ID NO: 54363 - DNA, 20 bp, Artificial Sequence
  Description of Artificial Sequence: Synthetic oligonucleotide
  Target: SCN9A; (+) strand; PAM type: NRG; PAM sequence: TAG
ttcccacactgtagaacatt

SEQ ID NO: 54364 - DNA, 20 bp, Artificial Sequence
  Description of Artificial Sequence: Synthetic oligonucleotide
  Target: SCN9A; (+) strand; PAM type: NRG; PAM sequence: AGG
tcccacactgtagaacattt

SEQ ID NO: 54365 - DNA, 20 bp, Artificial Sequence
  Description of Artificial Sequence: Synthetic oligonucleotide
  Target: SCN9A; (+) strand; PAM type: NRG; PAM sequence: AAG
aacatttaggttgtttccca

SEQ ID NO: 54366 - DNA, 20 bp, Artificial Sequence
  Description of Artificial Sequence: Synthetic oligonucleotide
  Target: SCN9A; (+) strand; PAM type: NRG; PAM sequence: TAG
tacaataattatcttctcat

SEQ ID NO: 54367 - DNA, 20 bp, Artificial Sequence
  Description of Artificial Sequence: Synthetic oligonucleotide
  Target: SCN9A; (+) strand; PAM type: NRG; PAM sequence: TGG
ttttttaacctactcttttg

SEQ ID NO: 54368 - DNA, 20 bp, Artificial Sequence
  Description of Artificial Sequence: Synthetic oligonucleotide
  Target: SCN9A; (+) strand; PAM type: NRG; PAM sequence: GGG
tttttaacctactcttttgt

SEQ ID NO: 54369 - DNA, 20 bp, Artificial Sequence
  Description of Artificial Sequence: Synthetic oligonucleotide
  Target: SCN9A; (+) strand; PAM type: NRG; PAM sequence: AAG
ctttttgtaacttttatttt

SEQ ID NO: 54370 - DNA, 20 bp, Artificial Sequence
  Description of Artificial Sequence: Synthetic oligonucleotide
  Target: SCN9A; (+) strand; PAM type: NRG; PAM sequence: CAG
tgtaacttttattttaagtt

SEQ ID NO: 54371 - DNA, 20 bp, Artificial Sequence
  Description of Artificial Sequence: Synthetic oligonucleotide
  Target: SCN9A; (+) strand; PAM type: NRG; PAM sequence: AGG
gtaacttttattttaagttc

SEQ ID NO: 54372 - DNA, 20 bp, Artificial Sequence
  Description of Artificial Sequence: Synthetic oligonucleotide
  Target: SCN9A; (+) strand; PAM type: NRG; PAM sequence: GGG
taacttttattttaagttca

SEQ ID NO: 54373 - DNA, 20 bp, Artificial Sequence
  Description of Artificial Sequence: Synthetic oligonucleotide
  Target: SCN9A; (+) strand; PAM type: NRG; PAM sequence: GGG
aacttttattttaagttcag

SEQ ID NO: 54374 - DNA, 20 bp, Artificial Sequence
  Description of Artificial Sequence: Synthetic oligonucleotide
  Target: SCN9A; (+) strand; PAM type: NRG; PAM sequence: CAG
taagttcaggggtacatgca

SEQ ID NO: 54375 - DNA, 20 bp, Artificial Sequence
  Description of Artificial Sequence: Synthetic oligonucleotide
  Target: SCN9A; (+) strand; PAM type: NRG; PAM sequence: AGG
aagttcaggggtacatgcac

SEQ ID NO: 54376 - DNA, 20 bp, Artificial Sequence
  Description of Artificial Sequence: Synthetic oligonucleotide
  Target: SCN9A; (+) strand; PAM type: NRG; PAM sequence: CAG
acatgcacaggtttgttaca

SEQ ID NO: 54377 - DNA, 20 bp, Artificial Sequence
  Description of Artificial Sequence: Synthetic oligonucleotide
  Target: SCN9A; (+) strand; PAM type: NRG; PAM sequence: AGG
catgcacaggtttgttacac

SEQ ID NO: 54378 - DNA, 20 bp, Artificial Sequence
  Description of Artificial Sequence: Synthetic oligonucleotide
  Target: SCN9A; (+) strand; PAM type: NRG; PAM sequence: GGG
atgcacaggtttgttacaca

SEQ ID NO: 54379 - DNA, 20 bp, Artificial Sequence
  Description of Artificial Sequence: Synthetic oligonucleotide
  Target: SCN9A; (+) strand; PAM type: NRG; PAM sequence: CAG
acacagggaaacttgtgtta

SEQ ID NO: 54380 - DNA, 20 bp, Artificial Sequence
  Description of Artificial Sequence: Synthetic oligonucleotide
  Target: SCN9A; (+) strand; PAM type: NRG; PAM sequence: AGG
cacagggaaacttgtgttac

SEQ ID NO: 54381 - DNA, 20 bp, Artificial Sequence
  Description of Artificial Sequence: Synthetic oligonucleotide
  Target: SCN9A; (+) strand; PAM type: NRG; PAM sequence: GGG
acagggaaacttgtgttaca

SEQ ID NO: 54382 - DNA, 20 bp, Artificial Sequence
  Description of Artificial Sequence: Synthetic oligonucleotide
  Target: SCN9A; (+) strand; PAM type: NRG; PAM sequence: AAG
ctacatcttatttcatcacc

SEQ ID NO: 54383 - DNA, 20 bp, Artificial Sequence
  Description of Artificial Sequence: Synthetic oligonucleotide
  Target: SCN9A; (+) strand; PAM type: NRG; PAM sequence: AGG
tacatcttatttcatcacca

SEQ ID NO: 54384 - DNA, 20 bp, Artificial Sequence
  Description of Artificial Sequence: Synthetic oligonucleotide
  Target: SCN9A; (+) strand; PAM type: NRG; PAM sequence: AAG
tatttcatcaccaaggtctt

SEQ ID NO: 54385 - DNA, 20 bp, Artificial Sequence
  Description of Artificial Sequence: Synthetic oligonucleotide
  Target: SCN9A; (+) strand; PAM type: NRG; PAM sequence: AAG
catcaccaaggtcttaagcc

SEQ ID NO: 54386 - DNA, 20 bp, Artificial Sequence
  Description of Artificial Sequence: Synthetic oligonucleotide
  Target: SCN9A; (+) strand; PAM type: NRG; PAM sequence: TAG
gtcttaagccaagtacttat

SEQ ID NO: 54387 - DNA, 20 bp, Artificial Sequence
  Description of Artificial Sequence: Synthetic oligonucleotide
  Target: SCN9A; (+) strand; PAM type: NRG; PAM sequence: TGG
tgccaccctccaccctccaa

SEQ ID NO: 54388 - DNA, 20 bp, Artificial Sequence
  Description of Artificial Sequence: Synthetic oligonucleotide
  Target: SCN9A; (+) strand; PAM type: NRG; PAM sequence: GGG
gccaccctccaccctccaat

SEQ ID NO: 54389 - DNA, 20 bp, Artificial Sequence
  Description of Artificial Sequence: Synthetic oligonucleotide
  Target: SCN9A; (+) strand; PAM type: NRG; PAM sequence: CAG
ctccaccctccaatgggccc

SEQ ID NO: 54390 - DNA, 20 bp, Artificial Sequence
  Description of Artificial Sequence: Synthetic oligonucleotide
  Target: SCN9A; (+) strand; PAM type: NRG; PAM sequence: TAG
gtccatgtgttctcatcatt

SEQ ID NO: 54391 - DNA, 20 bp, Artificial Sequence
  Description of Artificial Sequence: Synthetic oligonucleotide
  Target: SCN9A; (+) strand; PAM type: NRG; PAM sequence: AAG
atcatttagctctcacttat

SEQ ID NO: 54392 - DNA, 20 bp, Artificial Sequence
  Description of Artificial Sequence: Synthetic oligonucleotide
  Target: SCN9A; (+) strand; PAM type: NRG; PAM sequence: GAG
tttagctctcacttataagt

SEQ ID NO: 54393 - DNA, 20 bp, Artificial Sequence
  Description of Artificial Sequence: Synthetic oligonucleotide
  Target: SCN9A; (+) strand; PAM type: NRG; PAM sequence: AGG
ttagctctcacttataagtg

SEQ ID NO: 54394 - DNA, 20 bp, Artificial Sequence
  Description of Artificial Sequence: Synthetic oligonucleotide
  Target: SCN9A; (+) strand; PAM type: NRG; PAM sequence: TAG
agtgaggacattctcttgaa

SEQ ID NO: 54395 - DNA, 20 bp, Artificial Sequence
  Description of Artificial Sequence: Synthetic oligonucleotide
  Target: SCN9A; (+) strand; PAM type: NRG; PAM sequence: CAG
cattctcttgaatagtttca

SEQ ID NO: 54396 - DNA, 20 bp, Artificial Sequence
  Description of Artificial Sequence: Synthetic oligonucleotide
  Target: SCN9A; (+) strand; PAM type: NRG; PAM sequence: CGG
tcttgaatagtttcacagta

SEQ ID NO: 54397 - DNA, 20 bp, Artificial Sequence
  Description of Artificial Sequence: Synthetic oligonucleotide
  Target: SCN9A; (+) strand; PAM type: NRG; PAM sequence: AAG
cagtacggtattttatttgt

SEQ ID NO: 54398 - DNA, 20 bp, Artificial Sequence
  Description of Artificial Sequence: Synthetic oligonucleotide
  Target: SCN9A; (+) strand; PAM type: NRG; PAM sequence: CAG
tatttgtaagacaaatgctt

SEQ ID NO: 54399 - DNA, 20 bp, Artificial Sequence
  Description of Artificial Sequence: Synthetic oligonucleotide
  Target: SCN9A; (+) strand; PAM type: NRG; PAM sequence: GAG
tttgtaagacaaatgcttca

SEQ ID NO: 54400 - DNA, 20 bp, Artificial Sequence
  Description of Artificial Sequence: Synthetic oligonucleotide
  Target: SCN9A; (+) strand; PAM type: NRG; PAM sequence: GAG
tgcttcagagtgaaattgct

SEQ ID NO: 54401 - DNA, 20 bp, Artificial Sequence
  Description of Artificial Sequence: Synthetic oligonucleotide
  Target: SCN9A; (+) strand; PAM type: NRG; PAM sequence: TAG
ccgaattctcttttgttacc

SEQ ID NO: 54402 - DNA, 20 bp, Artificial Sequence
  Description of Artificial Sequence: Synthetic oligonucleotide
  Target: SCN9A; (+) strand; PAM type: NRG; PAM sequence: CAG
gttacctagtgtaacgccta

SEQ ID NO: 54403 - DNA, 20 bp, Artificial Sequence
  Description of Artificial Sequence: Synthetic oligonucleotide
  Target: SCN9A; (+) strand; PAM type: NRG; PAM sequence: AGG
ttacctagtgtaacgcctac

SEQ ID NO: 54404 - DNA, 20 bp, Artificial Sequence
  Description of Artificial Sequence: Synthetic oligonucleotide
  Target: SCN9A; (+) strand; PAM type: NRG; PAM sequence: GGG
tacctagtgtaacgcctaca

SEQ ID NO: 54405 - DNA, 20 bp, Artificial Sequence
  Description of Artificial Sequence: Synthetic oligonucleotide
  Target: SCN9A; (+) strand; PAM type: NRG; PAM sequence: TAG
gtgtaacgcctacagggcca

SEQ ID NO: 54406 - DNA, 20 bp, Artificial Sequence
  Description of Artificial Sequence: Synthetic oligonucleotide
  Target: SCN9A; (+) strand; PAM type: NRG; PAM sequence: AAG
ccctaactctgctgatcttt

SEQ ID NO: 54407 - DNA, 20 bp, Artificial Sequence
  Description of Artificial Sequence: Synthetic oligonucleotide
  Target: SCN9A; (+) strand; PAM type: NRG; PAM sequence: CAG
ctctgctgatctttaagaaa

SEQ ID NO: 54408 - DNA, 20 bp, Artificial Sequence
  Description of Artificial Sequence: Synthetic oligonucleotide
  Target: SCN9A; (+) strand; PAM type: NRG; PAM sequence: AGG
tctgctgatctttaagaaac

SEQ ID NO: 54409 - DNA, 20 bp, Artificial Sequence
  Description of Artificial Sequence: Synthetic oligonucleotide
  Target: SCN9A; (+) strand; PAM type: NRG; PAM sequence: CAG
taaaatgttccatttgtaac

SEQ ID NO: 54410 - DNA, 20 bp, Artificial Sequence
  Description of Artificial Sequence: Synthetic oligonucleotide
  Target: SCN9A; (+) strand; PAM type: NRG; PAM sequence: GAG
aaatgttccatttgtaacca

SEQ ID NO: 54411 - DNA, 20 bp, Artificial Sequence
  Description of Artificial Sequence: Synthetic oligonucleotide
  Target: SCN9A; (+) strand; PAM type: NRG; PAM sequence: CAG
tgttccatttgtaaccagag

SEQ ID NO: 54412 - DNA, 20 bp, Artificial Sequence
  Description of Artificial Sequence: Synthetic oligonucleotide
  Target: SCN9A; (+) strand; PAM type: NRG; PAM sequence: GAG
catttgtaaccagagcagct

SEQ ID NO: 54413 - DNA, 20 bp, Artificial Sequence
  Description of Artificial Sequence: Synthetic oligonucleotide
  Target: SCN9A; (+) strand; PAM type: NRG; PAM sequence: TAG
ccagagcagctgagattgct

SEQ ID NO: 54414 - DNA, 20 bp, Artificial Sequence
  Description of Artificial Sequence: Synthetic oligonucleotide
  Target: SCN9A; (+) strand; PAM type: NRG; PAM sequence: AAG
agctgagattgcttagaacc

SEQ ID NO: 54415 - DNA, 20 bp, Artificial Sequence
  Description of Artificial Sequence: Synthetic oligonucleotide
  Target: SCN9A; (+) strand; PAM type: NRG; PAM sequence: TAG
gagattgcttagaaccaaga

SEQ ID NO: 54416 - DNA, 20 bp, Artificial Sequence
  Description of Artificial Sequence: Synthetic oligonucleotide
  Target: SCN9A; (+) strand; PAM type: NRG; PAM sequence: AAG
agaaccaagatagttgacta

SEQ ID NO: 54417 - DNA, 20 bp, Artificial Sequence
  Description of Artificial Sequence: Synthetic oligonucleotide
  Target: SCN9A; (+) strand; PAM type: NRG; PAM sequence: AGG
gaaccaagatagttgactaa

SEQ ID NO: 54418 - DNA, 20 bp, Artificial Sequence
  Description of Artificial Sequence: Synthetic oligonucleotide
  Target: SCN9A; (+) strand; PAM type: NRG; PAM sequence: AAG
atagttgactaaaggacttc

SEQ ID NO: 54419 - DNA, 20 bp, Artificial Sequence
  Description of Artificial Sequence: Synthetic oligonucleotide
  Target: SCN9A; (+) strand; PAM type: NRG; PAM sequence: AAG
gttgactaaaggacttcaag

SEQ ID NO: 54420 - DNA, 20 bp, Artificial Sequence
  Description of Artificial Sequence: Synthetic oligonucleotide
  Target: SCN9A; (+) strand; PAM type: NRG; PAM sequence: CAG
aaaggacttcaagaagacct

SEQ ID NO: 54421 - DNA, 20 bp, Artificial Sequence
  Description of Artificial Sequence: Synthetic oligonucleotide
  Target: SCN9A; (+) strand; PAM type: NRG; PAM sequence: AGG
aaggacttcaagaagacctc

SEQ ID NO: 54422 - DNA, 20 bp, Artificial Sequence
  Description of Artificial Sequence: Synthetic oligonucleotide
  Target: SCN9A; (+) strand; PAM type: NRG; PAM sequence: CAG
atgctaaatgacacccccac

SEQ ID NO: 54423 - DNA, 20 bp, Artificial Sequence
  Description of Artificial Sequence: Synthetic oligonucleotide
  Target: SCN9A; (+) strand; PAM type: NRG; PAM sequence: CAG
cacccccaccagtgccatga

SEQ ID NO: 54424 - DNA, 20 bp, Artificial Sequence
  Description of Artificial Sequence: Synthetic oligonucleotide
  Target: SCN9A; (+) strand; PAM type: NRG; PAM sequence: CAG
ataatccccatgacaatgac

SEQ ID NO: 54425 - DNA, 20 bp, Artificial Sequence
  Description of Artificial Sequence: Synthetic oligonucleotide
  Target: SCN9A; (+) strand; PAM type: NRG; PAM sequence: AAG
atccccatgacaatgaccag

SEQ ID NO: 54426 - DNA, 20 bp, Artificial Sequence
  Description of Artificial Sequence: Synthetic oligonucleotide
  Target: SCN9A; (+) strand; PAM type: NRG; PAM sequence: AAG
cccatgacaatgaccagaag

SEQ ID NO: 54427 - DNA, 20 bp, Artificial Sequence
  Description of Artificial Sequence: Synthetic oligonucleotide
  Target: SCN9A; (+) strand; PAM type: NRG; PAM sequence: AAG
atgaccagaagaagccataa

SEQ ID NO: 54428 - DNA, 20 bp, Artificial Sequence
  Description of Artificial Sequence: Synthetic oligonucleotide
  Target: SCN9A; (+) strand; PAM type: NRG; PAM sequence: AGG
tgaccagaagaagccataaa

SEQ ID NO: 54429 - DNA, 20 bp, Artificial Sequence
  Description of Artificial Sequence: Synthetic oligonucleotide
  Target: SCN9A; (+) strand; PAM type: NRG; PAM sequence: AAG
agaagccataaaaggacaaa

SEQ ID NO: 54430 - DNA, 20 bp, Artificial Sequence
  Description of Artificial Sequence: Synthetic oligonucleotide
  Target: SCN9A; (+) strand; PAM type: NRG; PAM sequence: AGG
gaagccataaaaggacaaaa

SEQ ID NO: 54431 - DNA, 20 bp, Artificial Sequence
  Description of Artificial Sequence: Synthetic oligonucleotide
  Target: SCN9A; (+) strand; PAM type: NRG; PAM sequence: AAG
gccataaaaggacaaaaagg

SEQ ID NO: 54432 - DNA, 20 bp, Artificial Sequence
  Description of Artificial Sequence: Synthetic oligonucleotide
  Target: SCN9A; (+) strand; PAM type: NRG; PAM sequence: AGG
ccataaaaggacaaaaagga

SEQ ID NO: 54433 - DNA, 20 bp, Artificial Sequence
  Description of Artificial Sequence: Synthetic oligonucleotide
  Target: SCN9A; (+) strand; PAM type: NRG; PAM sequence: CGG
taaaaggacaaaaaggaagg

SEQ ID NO: 54434 - DNA, 20 bp, Artificial Sequence
  Description of Artificial Sequence: Synthetic oligonucleotide
  Target: SCN9A; (+) strand; PAM type: NRG; PAM sequence: TGG
caaaaaggaaggcggcactc

SEQ ID NO: 54435 - DNA, 20 bp, Artificial Sequence
  Description of Artificial Sequence: Synthetic oligonucleotide
  Target: SCN9A; (+) strand; PAM type: NRG; PAM sequence: AAG
gaaggcggcactctggttcc

SEQ ID NO: 54436 - DNA, 20 bp, Artificial Sequence
  Description of Artificial Sequence: Synthetic oligonucleotide
  Target: SCN9A; (+) strand; PAM type: NRG; PAM sequence: AAG
ggcggcactctggttccaag

SEQ ID NO: 54437 - DNA, 20 bp, Artificial Sequence
  Description of Artificial Sequence: Synthetic oligonucleotide
  Target: SCN9A; (+) strand; PAM type: NRG; PAM sequence: TGG
agaagttcaccacctatttc

SEQ ID NO: 54438 - DNA, 20 bp, Artificial Sequence
  Description of Artificial Sequence: Synthetic oligonucleotide
  Target: SCN9A; (+) strand; PAM type: NRG; PAM sequence: AAG
ttcaccacctatttctggaa

SEQ ID NO: 54439 - DNA, 20 bp, Artificial Sequence
  Description of Artificial Sequence: Synthetic oligonucleotide
  Target: SCN9A; (+) strand; PAM type: NRG; PAM sequence: TAG
ttaatgaccaacttcttcat

SEQ ID NO: 54440 - DNA, 20 bp, Artificial Sequence
  Description of Artificial Sequence: Synthetic oligonucleotide
  Target: SCN9A; (+) strand; PAM type: NRG; PAM sequence: TAG
tcaatttcctcactcctcac

SEQ ID NO: 54441 - DNA, 20 bp, Artificial Sequence
  Description of Artificial Sequence: Synthetic oligonucleotide
  Target: SCN9A; (+) strand; PAM type: NRG; PAM sequence: AAG
ttcctcactcctcactagtc

SEQ ID NO: 54442 - DNA, 20 bp, Artificial Sequence
  Description of Artificial Sequence: Synthetic oligonucleotide
  Target: SCN9A; (+) strand; PAM type: NRG; PAM sequence: AAG
ctcactcctcactagtcaag

SEQ ID NO: 54443 - DNA, 20 bp, Artificial Sequence
  Description of Artificial Sequence: Synthetic oligonucleotide
  Target: SCN9A; (+) strand; PAM type: NRG; PAM sequence: TAG
ctcctcactagtcaagaagt

SEQ ID NO: 54444 - DNA, 20 bp, Artificial Sequence
  Description of Artificial Sequence: Synthetic oligonucleotide
  Target: SCN9A; (+) strand; PAM type: NRG; PAM sequence: TGG
acttgcacttctccattctt

SEQ ID NO: 54445 - DNA, 20 bp, Artificial Sequence
  Description of Artificial Sequence: Synthetic oligonucleotide
  Target: SCN9A; (+) strand; PAM type: NRG; PAM sequence: AAG
cattctttggccatcgaata

SEQ ID NO: 54446 - DNA, 20 bp, Artificial Sequence
  Description of Artificial Sequence: Synthetic oligonucleotide
  Target: SCN9A; (+) strand; PAM type: NRG; PAM sequence: TGG
cactttcccatttcttgtat

SEQ ID NO: 54447 - DNA, 20 bp, Artificial Sequence
  Description of Artificial Sequence: Synthetic oligonucleotide
  Target: SCN9A; (+) strand; PAM type: NRG; PAM sequence: GGG
actttcccatttcttgtatt

SEQ ID NO: 54448 - DNA, 20 bp, Artificial Sequence
  Description of Artificial Sequence: Synthetic oligonucleotide
  Target: SCN9A; (+) strand; PAM type: NRG; PAM sequence: CAG
attgggtctccaataccaaa

SEQ ID NO: 54449 - DNA, 20 bp, Artificial Sequence
  Description of Artificial Sequence: Synthetic oligonucleotide
  Target: SCN9A; (+) strand; PAM type: NRG; PAM sequence: AGG
ttgggtctccaataccaaac

SEQ ID NO: 54450 - DNA, 20 bp, Artificial Sequence
  Description of Artificial Sequence: Synthetic oligonucleotide
  Target: SCN9A; (+) strand; PAM type: NRG; PAM sequence: GGG
tgggtctccaataccaaaca

SEQ ID NO: 54451 - DNA, 20 bp, Artificial Sequence
  Description of Artificial Sequence: Synthetic oligonucleotide
  Target: SCN9A; (+) strand; PAM type: NRG; PAM sequence: AAG
tctccaataccaaacaggga

SEQ ID NO: 54452 - DNA, 20 bp, Artificial Sequence
  Description of Artificial Sequence: Synthetic oligonucleotide
  Target: SCN9A; (+) strand; PAM type: NRG; PAM sequence: AAG
tgccaccttttgaaactacc

SEQ ID NO: 54453 - DNA, 20 bp, Artificial Sequence
  Description of Artificial Sequence: Synthetic oligonucleotide
  Target: SCN9A; (+) strand; PAM type: NRG; PAM sequence: AGG
gccaccttttgaaactacca

SEQ ID NO: 54454 - DNA, 20 bp, Artificial Sequence
  Description of Artificial Sequence: Synthetic oligonucleotide
  Target: SCN9A; (+) strand; PAM type: NRG; PAM sequence: GAG
caccttttgaaactaccaag

SEQ ID NO: 54455 - DNA, 20 bp, Artificial Sequence
  Description of Artificial Sequence: Synthetic oligonucleotide
  Target: SCN9A; (+) strand; PAM type: NRG; PAM sequence: AGG
accttttgaaactaccaagg

SEQ ID NO: 54456 - DNA, 20 bp, Artificial Sequence
  Description of Artificial Sequence: Synthetic oligonucleotide
  Target: SCN9A; (+) strand; PAM type: NRG; PAM sequence: TGG
gaaactaccaaggaggttat

SEQ ID NO: 54457 - DNA, 20 bp, Artificial Sequence
  Description of Artificial Sequence: Synthetic oligonucleotide
  Target: SCN9A; (+) strand; PAM type: NRG; PAM sequence: TGG
caaggaggttattggtatat

SEQ ID NO: 54458 - DNA, 20 bp, Artificial Sequence
  Description of Artificial Sequence: Synthetic oligonucleotide
  Target: SCN9A; (+) strand; PAM type: NRG; PAM sequence: AAG
atattggtaactccttcata

SEQ ID NO: 54459 - DNA, 20 bp, Artificial Sequence
  Description of Artificial Sequence: Synthetic oligonucleotide
  Target: SCN9A; (+) strand; PAM type: NRG; PAM sequence: AGG
tattggtaactccttcataa

SEQ ID NO: 54460 - DNA, 20 bp, Artificial Sequence
  Description of Artificial Sequence: Synthetic oligonucleotide
  Target: SCN9A; (+) strand; PAM type: NRG; PAM sequence: CAG
gctctccccaaacaatgtgt

SEQ ID NO: 54461 - DNA, 20 bp, Artificial Sequence
  Description of Artificial Sequence: Synthetic oligonucleotide
  Target: SCN9A; (+) strand; PAM type: NRG; PAM sequence: AGG
ctctccccaaacaatgtgtc

SEQ ID NO: 54462 - DNA, 20 bp, Artificial Sequence
  Description of Artificial Sequence: Synthetic oligonucleotide
  Target: SCN9A; (+) strand; PAM type: NRG; PAM sequence: GGG
tctccccaaacaatgtgtca

SEQ ID NO: 54463 - DNA, 20 bp, Artificial Sequence
  Description of Artificial Sequence: Synthetic oligonucleotide
  Target: SCN9A; (+) strand; PAM type: NRG; PAM sequence: AAG
gtttgcacataccttcaata

SEQ ID NO: 54464 - DNA, 20 bp, Artificial Sequence
  Description of Artificial Sequence: Synthetic oligonucleotide
  Target: SCN9A; (+) strand; PAM type: NRG; PAM sequence: GAG
aaattttttttcatctttgt

SEQ ID NO: 54465 - DNA, 20 bp, Artificial Sequence
  Description of Artificial Sequence: Synthetic oligonucleotide
  Target: SCN9A; (+) strand; PAM type: NRG; PAM sequence: AAG
ttcatctttgtgagcctaat

SEQ ID NO: 54466 - DNA, 20 bp, Artificial Sequence
  Description of Artificial Sequence: Synthetic oligonucleotide
  Target: SCN9A; (+) strand; PAM type: NRG; PAM sequence: TGG
atctttgtgagcctaataag

SEQ ID NO: 54467 - DNA, 20 bp, Artificial Sequence
  Description of Artificial Sequence: Synthetic oligonucleotide
  Target: SCN9A; (+) strand; PAM type: NRG; PAM sequence: GGG
tctttgtgagcctaataagt

SEQ ID NO: 54468 - DNA, 20 bp, Artificial Sequence
  Description of Artificial Sequence: Synthetic oligonucleotide
  Target: SCN9A; (+) strand; PAM type: NRG; PAM sequence: GGG
ctttgtgagcctaataagtg

SEQ ID NO: 54469 - DNA, 20 bp, Artificial Sequence
  Description of Artificial Sequence: Synthetic oligonucleotide
  Target: SCN9A; (+) strand; PAM type: NRG; PAM sequence: GAG
tttatttatttatttatttt

SEQ ID NO: 54470 - DNA, 20 bp, Artificial Sequence
  Description of Artificial Sequence: Synthetic oligonucleotide
  Target: SCN9A; (+) strand; PAM type: NRG; PAM sequence: TGG
tttatttatttattttgaga

SEQ ID NO: 54471 - DNA, 20 bp, Artificial Sequence
  Description of Artificial Sequence: Synthetic oligonucleotide
  Target: SCN9A; (+) strand; PAM type: NRG; PAM sequence: GAG
tatttatttattttgagatg

SEQ ID NO: 54472 - DNA, 20 bp, Artificial Sequence
  Description of Artificial Sequence: Synthetic oligonucleotide
  Target: SCN9A; (+) strand; PAM type: NRG; PAM sequence: CAG
ggagtcgctctctcattgcc

SEQ ID NO: 54473 - DNA, 20 bp, Artificial Sequence
  Description of Artificial Sequence: Synthetic oligonucleotide
  Target: SCN9A; (+) strand; PAM type: NRG; PAM sequence: AGG
gagtcgctctctcattgccc

SEQ ID NO: 54474 - DNA, 20 bp, Artificial Sequence
  Description of Artificial Sequence: Synthetic oligonucleotide
  Target: SCN9A; (+) strand; PAM type: NRG; PAM sequence: TGG
cgctctctcattgcccaggc

SEQ ID NO: 54475 - DNA, 20 bp, Artificial Sequence
  Description of Artificial Sequence: Synthetic oligonucleotide
  Target: SCN9A; (+) strand; PAM type: NRG; PAM sequence: GAG
ctctctcattgcccaggctg

SEQ ID NO: 54476 - DNA, 20 bp, Artificial Sequence
  Description of Artificial Sequence: Synthetic oligonucleotide
  Target: SCN9A; (+) strand; PAM type: NRG; PAM sequence: TGG
ttgcccaggctggagtgcct

SEQ ID NO: 54477 - DNA, 20 bp, Artificial Sequence
  Description of Artificial Sequence: Synthetic oligonucleotide
  Target: SCN9A; (+) strand; PAM type: NRG; PAM sequence: CAG
ggagtgccttggtgcgatct

SEQ ID NO: 54478 - DNA, 20 bp, Artificial Sequence
  Description of Artificial Sequence: Synthetic oligonucleotide
  Target: SCN9A; (+) strand; PAM type: NRG; PAM sequence: TGG
tcactgcaacatctgcctcc

SEQ ID NO: 54479 - DNA, 20 bp, Artificial Sequence
  Description of Artificial Sequence: Synthetic oligonucleotide
  Target: SCN9A; (+) strand; PAM type: NRG; PAM sequence: GGG
cactgcaacatctgcctcct

SEQ ID NO: 54480 - DNA, 20 bp, Artificial Sequence
  Description of Artificial Sequence: Synthetic oligonucleotide
  Target: SCN9A; (+) strand; PAM type: NRG; PAM sequence: AAG
aacatctgcctcctgggttc

SEQ ID NO: 54481 - DNA, 20 bp, Artificial Sequence
  Description of Artificial Sequence: Synthetic oligonucleotide
  Target: SCN9A; (+) strand; PAM type: NRG; PAM sequence: CAG
atctgcctcctgggttcaag

SEQ ID NO: 54482 - DNA, 20 bp, Artificial Sequence
  Description of Artificial Sequence: Synthetic oligonucleotide
  Target: SCN9A; (+) strand; PAM type: NRG; PAM sequence: CAG
ttcaagcagttctcctgcct

SEQ ID NO: 54483 - DNA, 20 bp, Artificial Sequence
  Description of Artificial Sequence: Synthetic oligonucleotide
  Target: SCN9A; (+) strand; PAM type: NRG; PAM sequence: GAG
ttctcctgcctcagcctcct

SEQ ID NO: 54484 - DNA, 20 bp, Artificial Sequence
  Description of Artificial Sequence: Synthetic oligonucleotide
  Target: SCN9A; (+) strand; PAM type: NRG; PAM sequence: TAG
tcctgcctcagcctcctgag

SEQ ID NO: 54485 - DNA, 20 bp, Artificial Sequence
  Description of Artificial Sequence: Synthetic oligonucleotide
  Target: SCN9A; (+) strand; PAM type: NRG; PAM sequence: CGG
cctcagcctcctgagtagct

SEQ ID NO: 54486 - DNA, 20 bp, Artificial Sequence
  Description of Artificial Sequence: Synthetic oligonucleotide
  Target: SCN9A; (+) strand; PAM type: NRG; PAM sequence: TAG
gcctcctgagtagctcggat

SEQ ID NO: 54487 - DNA, 20 bp, Artificial Sequence
  Description of Artificial Sequence: Synthetic oligonucleotide
  Target: SCN9A; (+) strand; PAM type: NRG; PAM sequence: GAG
ctcctgagtagctcggatta

SEQ ID NO: 54488 - DNA, 20 bp, Artificial Sequence
  Description of Artificial Sequence: Synthetic oligonucleotide
  Target: SCN9A; (+) strand; PAM type: NRG; PAM sequence: AGG
tcctgagtagctcggattag

SEQ ID NO: 54489 - DNA, 20 bp, Artificial Sequence
  Description of Artificial Sequence: Synthetic oligonucleotide
  Target: SCN9A; (+) strand; PAM type: NRG; PAM sequence: CGG
gaggtacccaccaccacacc

SEQ ID NO: 54490 - DNA, 20 bp, Artificial Sequence
  Description of Artificial Sequence: Synthetic oligonucleotide
  Target: SCN9A; (+) strand; PAM type: NRG; PAM sequence: TAG
ccggctaatttttgtacctt

SEQ ID NO: 54491 - DNA, 20 bp, Artificial Sequence
  Description of Artificial Sequence: Synthetic oligonucleotide
  Target: SCN9A; (+) strand; PAM type: NRG; PAM sequence: TAG
gctaatttttgtacctttag

SEQ ID NO: 54492 - DNA, 20 bp, Artificial Sequence
  Description of Artificial Sequence: Synthetic oligonucleotide
  Target: SCN9A; (+) strand; PAM type: NRG; PAM sequence: GAG
taatttttgtacctttagta

SEQ ID NO: 54493 - DNA, 20 bp, Artificial Sequence
  Description of Artificial Sequence: Synthetic oligonucleotide
  Target: SCN9A; (+) strand; PAM type: NRG; PAM sequence: CAG
ttttgtacctttagtagaga

SEQ ID NO: 54494 - DNA, 20 bp, Artificial Sequence
  Description of Artificial Sequence: Synthetic oligonucleotide
  Target: SCN9A; (+) strand; PAM type: NRG; PAM sequence: AGG
tttgtacctttagtagagac

SEQ ID NO: 54495 - DNA, 20 bp, Artificial Sequence
  Description of Artificial Sequence: Synthetic oligonucleotide
  Target: SCN9A; (+) strand; PAM type: NRG; PAM sequence: TGG
gagacaggttttcaccatgt

SEQ ID NO: 54496 - DNA, 20 bp, Artificial Sequence
  Description of Artificial Sequence: Synthetic oligonucleotide
  Target: SCN9A; (+) strand; PAM type: NRG; PAM sequence: CAG
caggttttcaccatgttggc

SEQ ID NO: 54497 - DNA, 20 bp, Artificial Sequence
  Description of Artificial Sequence: Synthetic oligonucleotide
  Target: SCN9A; (+) strand; PAM type: NRG; PAM sequence: AGG
aggttttcaccatgttggcc

SEQ ID NO: 54498 - DNA, 20 bp, Artificial Sequence
  Description of Artificial Sequence: Synthetic oligonucleotide
  Target: SCN9A; (+) strand; PAM type: NRG; PAM sequence: TGG
tttcaccatgttggccaggc

SEQ ID NO: 54499 - DNA, 20 bp, Artificial Sequence
  Description of Artificial Sequence: Synthetic oligonucleotide
  Target: SCN9A; (+) strand; PAM type: NRG; PAM sequence: CAG
ctcatgtgatccacccatct

SEQ ID NO: 54500 - DNA, 20 bp, Artificial Sequence
  Description of Artificial Sequence: Synthetic oligonucleotide
  Target: SCN9A; (+) strand; PAM type: NRG; PAM sequence: AAG
ccacccatctcagcttccca

SEQ ID NO: 54501 - DNA, 20 bp, Artificial Sequence
  Description of Artificial Sequence: Synthetic oligonucleotide
  Target: SCN9A; (+) strand; PAM type: NRG; PAM sequence: TGG
atctcagcttcccaaagtgc

SEQ ID NO: 54502 - DNA, 20 bp, Artificial Sequence
  Description of Artificial Sequence: Synthetic oligonucleotide
  Target: SCN9A; (+) strand; PAM type: NRG; PAM sequence: GGG
tctcagcttcccaaagtgct

SEQ ID NO: 54503 - DNA, 20 bp, Artificial Sequence
  Description of Artificial Sequence: Synthetic oligonucleotide
  Target: SCN9A; (+) strand; PAM type: NRG; PAM sequence: GAG
agtgctgggatcacaaacat

SEQ ID NO: 54504 - DNA, 20 bp, Artificial Sequence
  Description of Artificial Sequence: Synthetic oligonucleotide
  Target: SCN9A; (+) strand; PAM type: NRG; PAM sequence: CGG
caaacatgagccaccacacc

SEQ ID NO: 54505 - DNA, 20 bp, Artificial Sequence
  Description of Artificial Sequence: Synthetic oligonucleotide
  Target: SCN9A; (+) strand; PAM type: NRG; PAM sequence: TAG
cttcttaattcttatcattt

SEQ ID NO: 54506 - DNA, 20 bp, Artificial Sequence
  Description of Artificial Sequence: Synthetic oligonucleotide
  Target: SCN9A; (+) strand; PAM type: NRG; PAM sequence: GAG
tagtttgcattttcttttgt

SEQ ID NO: 54507 - DNA, 20 bp, Artificial Sequence
  Description of Artificial Sequence: Synthetic oligonucleotide
  Target: SCN9A; (+) strand; PAM type: NRG; PAM sequence: GAG
ttgcattttcttttgtgagt

SEQ ID NO: 54508 - DNA, 20 bp, Artificial Sequence
  Description of Artificial Sequence: Synthetic oligonucleotide
  Target: SCN9A; (+) strand; PAM type: NRG; PAM sequence: AGG
tgcattttcttttgtgagtg

SEQ ID NO: 54509 - DNA, 20 bp, Artificial Sequence
  Description of Artificial Sequence: Synthetic oligonucleotide
  Target: SCN9A; (+) strand; PAM type: NRG; PAM sequence: CAG
ttttcttttgtgagtgaggt

SEQ ID NO: 54510 - DNA, 20 bp, Artificial Sequence
  Description of Artificial Sequence: Synthetic oligonucleotide
  Target: SCN9A; (+) strand; PAM type: NRG; PAM sequence: AGG
tttcttttgtgagtgaggtc

SEQ ID NO: 54511 - DNA, 20 bp, Artificial Sequence
  Description of Artificial Sequence: Synthetic oligonucleotide
  Target: SCN9A; (+) strand; PAM type: NRG; PAM sequence: GGG
ttcttttgtgagtgaggtca

SEQ ID NO: 54512 - DNA, 20 bp, Artificial Sequence
  Description of Artificial Sequence: Synthetic oligonucleotide
  Target: SCN9A; (+) strand; PAM type: NRG; PAM sequence: CAG
cagggatcttttcatatcct

SEQ ID NO: 54513 - DNA, 20 bp, Artificial Sequence
  Description of Artificial Sequence: Synthetic oligonucleotide
  Target: SCN9A; (+) strand; PAM type: NRG; PAM sequence: TAG
ttctgtgctctgtctgtatg

SEQ ID NO: 54514 - DNA, 20 bp, Artificial Sequence
  Description of Artificial Sequence: Synthetic oligonucleotide
  Target: SCN9A; (+) strand; PAM type: NRG; PAM sequence: TAG
agtcttgtccacttttttaa

SEQ ID NO: 54515 - DNA, 20 bp, Artificial Sequence
  Description of Artificial Sequence: Synthetic oligonucleotide
  Target: SCN9A; (+) strand; PAM type: NRG; PAM sequence: CAG
ccacttttttaatagactat

SEQ ID NO: 54516 - DNA, 20 bp, Artificial Sequence
  Description of Artificial Sequence: Synthetic oligonucleotide
  Target: SCN9A; (+) strand; PAM type: NRG; PAM sequence: TAG
ctatcagtgttttattaatt

SEQ ID NO: 54517 - DNA, 20 bp, Artificial Sequence
  Description of Artificial Sequence: Synthetic oligonucleotide
  Target: SCN9A; (+) strand; PAM type: NRG; PAM sequence: AGG
tatcagtgttttattaattt

SEQ ID NO: 54518 - DNA, 20 bp, Artificial Sequence
  Description of Artificial Sequence: Synthetic oligonucleotide
  Target: SCN9A; (+) strand; PAM type: NRG; PAM sequence: TAG
tcttaacaaaataataaaat

SEQ ID NO: 54519 - DNA, 20 bp, Artificial Sequence
  Description of Artificial Sequence: Synthetic oligonucleotide
  Target: SCN9A; (+) strand; PAM type: NRG; PAM sequence: TGG
taaaattagctttttttctg

SEQ ID NO: 54520 - DNA, 20 bp, Artificial Sequence
  Description of Artificial Sequence: Synthetic oligonucleotide
  Target: SCN9A; (+) strand; PAM type: NRG; PAM sequence: AAG
tacaatacaaatatttttgt

SEQ ID NO: 54521 - DNA, 20 bp, Artificial Sequence
  Description of Artificial Sequence: Synthetic oligonucleotide
  Target: SCN9A; (+) strand; PAM type: NRG; PAM sequence: TGG
tttgctgtttttgtttcttt

SEQ ID NO: 54522 - DNA, 20 bp, Artificial Sequence
  Description of Artificial Sequence: Synthetic oligonucleotide
  Target: SCN9A; (+) strand; PAM type: NRG; PAM sequence: TGG
tttttgtttcttttggttta

SEQ ID NO: 54523 - DNA, 20 bp, Artificial Sequence
  Description of Artificial Sequence: Synthetic oligonucleotide
  Target: SCN9A; (+) strand; PAM type: NRG; PAM sequence: TAG
ttgtttcttttggtttatgg

SEQ ID NO: 54524 - DNA, 20 bp, Artificial Sequence
  Description of Artificial Sequence: Synthetic oligonucleotide
  Target: SCN9A; (+) strand; PAM type: NRG; PAM sequence: AAG
tatggtagtttatcttttaa

SEQ ID NO: 54525 - DNA, 20 bp, Artificial Sequence
  Description of Artificial Sequence: Synthetic oligonucleotide
  Target: SCN9A; (+) strand; PAM type: NRG; PAM sequence: CAG
gaattcaccaatcctttctc

SEQ ID NO: 54526 - DNA, 20 bp, Artificial Sequence
  Description of Artificial Sequence: Synthetic oligonucleotide
  Target: SCN9A; (+) strand; PAM type: NRG; PAM sequence: TGG
ttcaccaatcctttctccag

SEQ ID NO: 54527 - DNA, 20 bp, Artificial Sequence
  Description of Artificial Sequence: Synthetic oligonucleotide
  Target: SCN9A; (+) strand; PAM type: NRG; PAM sequence: TAG
tcctgtgttttatattatct

SEQ ID NO: 54528 - DNA, 20 bp, Artificial Sequence
  Description of Artificial Sequence: Synthetic oligonucleotide
  Target: SCN9A; (+) strand; PAM type: NRG; PAM sequence: AAG
tagaaaataatttctacttc

SEQ ID NO: 54529 - DNA, 20 bp, Artificial Sequence
  Description of Artificial Sequence: Synthetic oligonucleotide
  Target: SCN9A; (+) strand; PAM type: NRG; PAM sequence: AAG
ttctacttcaagtacttcat

SEQ ID NO: 54530 - DNA, 20 bp, Artificial Sequence
  Description of Artificial Sequence: Synthetic oligonucleotide
  Target: SCN9A; (+) strand; PAM type: NRG; PAM sequence: TGG
tacttcataagtgtgatgac

SEQ ID NO: 54531 - DNA, 20 bp, Artificial Sequence
  Description of Artificial Sequence: Synthetic oligonucleotide
  Target: SCN9A; (+) strand; PAM type: NRG; PAM sequence: GGG
acttcataagtgtgatgact

SEQ ID NO: 54532 - DNA, 20 bp, Artificial Sequence
  Description of Artificial Sequence: Synthetic oligonucleotide
  Target: SCN9A; (+) strand; PAM type: NRG; PAM sequence: GAG
gggttttcacatgcatatgt

SEQ ID NO: 54533 - DNA, 20 bp, Artificial Sequence
  Description of Artificial Sequence: Synthetic oligonucleotide
  Target: SCN9A; (+) strand; PAM type: NRG; PAM sequence: CAG
cattgatatattatccatct

SEQ ID NO: 54534 - DNA, 20 bp, Artificial Sequence
  Description of Artificial Sequence: Synthetic oligonucleotide
  Target: SCN9A; (+) strand; PAM type: NRG; PAM sequence: AGG
attgatatattatccatctc

SEQ ID NO: 54535 - DNA, 20 bp, Artificial Sequence
  Description of Artificial Sequence: Synthetic oligonucleotide
  Target: SCN9A; (+) strand; PAM type: NRG; PAM sequence: AAG
tattatccatctcaggtgaa

SEQ ID NO: 54536 - DNA, 20 bp, Artificial Sequence
  Description of Artificial Sequence: Synthetic oligonucleotide
  Target: SCN9A; (+) strand; PAM type: NRG; PAM sequence: AAG
catctcaggtgaaaagaaaa

SEQ ID NO: 54537 - DNA, 20 bp, Artificial Sequence
  Description of Artificial Sequence: Synthetic oligonucleotide
  Target: SCN9A; (+) strand; PAM type: NRG; PAM sequence: TAG
aaccttcacatgttttcttc

SEQ ID NO: 54538 - DNA, 20 bp, Artificial Sequence
  Description of Artificial Sequence: Synthetic oligonucleotide
  Target: SCN9A; (+) strand; PAM type: NRG; PAM sequence: CAG
cttcacatgttttcttctag

SEQ ID NO: 54539 - DNA, 20 bp, Artificial Sequence
  Description of Artificial Sequence: Synthetic oligonucleotide
  Target: SCN9A; (+) strand; PAM type: NRG; PAM sequence: TGG
gttttcttctagcagttttg

SEQ ID NO: 54540 - DNA, 20 bp, Artificial Sequence
  Description of Artificial Sequence: Synthetic oligonucleotide
  Target: SCN9A; (+) strand; PAM type: NRG; PAM sequence: TGG
gattccactaaaatgtatct

SEQ ID NO: 54541 - DNA, 20 bp, Artificial Sequence
  Description of Artificial Sequence: Synthetic oligonucleotide
  Target: SCN9A; (+) strand; PAM type: NRG; PAM sequence: GGG
attccactaaaatgtatctt

SEQ ID NO: 54542 - DNA, 20 bp, Artificial Sequence
  Description of Artificial Sequence: Synthetic oligonucleotide
  Target: SCN9A; (+) strand; PAM type: NRG; PAM sequence: TAG
cactaaaatgtatcttgggt

SEQ ID NO: 54543 - DNA, 20 bp, Artificial Sequence
  Description of Artificial Sequence: Synthetic oligonucleotide
  Target: SCN9A; (+) strand; PAM type: NRG; PAM sequence: AGG
actaaaatgtatcttgggtt

SEQ ID NO: 54544 - DNA, 20 bp, Artificial Sequence
  Description of Artificial Sequence: Synthetic oligonucleotide
  Target: SCN9A; (+) strand; PAM type: NRG; PAM sequence: TGG
aaaatgtatcttgggttagg

SEQ ID NO: 54545 - DNA, 20 bp, Artificial Sequence
  Description of Artificial Sequence: Synthetic oligonucleotide
  Target: SCN9A; (+) strand; PAM type: NRG; PAM sequence: AAG
gtatcttgggttaggtggca

SEQ ID NO: 54546 - DNA, 20 bp, Artificial Sequence
  Description of Artificial Sequence: Synthetic oligonucleotide
  Target: SCN9A; (+) strand; PAM type: NRG; PAM sequence: CAG
tcttgggttaggtggcaaag

SEQ ID NO: 54547 - DNA, 20 bp, Artificial Sequence
  Description of Artificial Sequence: Synthetic oligonucleotide
  Target: SCN9A; (+) strand; PAM type: NRG; PAM sequence: CAG
tttttatccacatgactacc

SEQ ID NO: 54548 - DNA, 20 bp, Artificial Sequence
  Description of Artificial Sequence: Synthetic oligonucleotide
  Target: SCN9A; (+) strand; PAM type: NRG; PAM sequence: AGG
ttttatccacatgactaccc

SEQ ID NO: 54549 - DNA, 20 bp, Artificial Sequence
  Description of Artificial Sequence: Synthetic oligonucleotide
  Target: SCN9A; (+) strand; PAM type: NRG; PAM sequence: AAG
atatttctttcaacctattt

SEQ ID NO: 54550 - DNA, 20 bp, Artificial Sequence
  Description of Artificial Sequence: Synthetic oligonucleotide
  Target: SCN9A; (+) strand; PAM type: NRG; PAM sequence: TGG
tatgtaactatgtctatttc

SEQ ID NO: 54551 - DNA, 20 bp, Artificial Sequence
  Description of Artificial Sequence: Synthetic oligonucleotide
  Target: SCN9A; (+) strand; PAM type: NRG; PAM sequence: TAG
cttccaatgaactatctatg

SEQ ID NO: 54552 - DNA, 20 bp, Artificial Sequence
  Description of Artificial Sequence: Synthetic oligonucleotide
  Target: SCN9A; (+) strand; PAM type: NRG; PAM sequence: AGG
ttccaatgaactatctatgt

SEQ ID NO: 54553 - DNA, 20 bp, Artificial Sequence
  Description of Artificial Sequence: Synthetic oligonucleotide
  Target: SCN9A; (+) strand; PAM type: NRG; PAM sequence: TAG
cataaaataacattatgtat

SEQ ID NO: 54554 - DNA, 20 bp, Artificial Sequence
  Description of Artificial Sequence: Synthetic oligonucleotide
  Target: SCN9A; (+) strand; PAM type: NRG; PAM sequence: AGG
ataaaataacattatgtatt

SEQ ID NO: 54555 - DNA, 20 bp, Artificial Sequence
  Description of Artificial Sequence: Synthetic oligonucleotide
  Target: SCN9A; (+) strand; PAM type: NRG; PAM sequence: GGG
taaaataacattatgtatta

SEQ ID NO: 54556 - DNA, 20 bp, Artificial Sequence
  Description of Artificial Sequence: Synthetic oligonucleotide
  Target: SCN9A; (+) strand; PAM type: NRG; PAM sequence: TGG
ataacattatgtattagggt

SEQ ID NO: 54557 - DNA, 20 bp, Artificial Sequence
  Description of Artificial Sequence: Synthetic oligonucleotide
  Target: SCN9A; (+) strand; PAM type: NRG; PAM sequence: TAG
tgtattagggttggtgctat

SEQ ID NO: 54558 - DNA, 20 bp, Artificial Sequence
  Description of Artificial Sequence: Synthetic oligonucleotide
  Target: SCN9A; (+) strand; PAM type: NRG; PAM sequence: TAG
tgtgtgtacaatttcccaac

SEQ ID NO: 54559 - DNA, 20 bp, Artificial Sequence
  Description of Artificial Sequence: Synthetic oligonucleotide
  Target: SCN9A; (+) strand; PAM type: NRG; PAM sequence: CAG
tacaatttcccaactagatc

SEQ ID NO: 54560 - DNA, 20 bp, Artificial Sequence
  Description of Artificial Sequence: Synthetic oligonucleotide
  Target: SCN9A; (+) strand; PAM type: NRG; PAM sequence: TGG
ccagattatctaattccaaa

SEQ ID NO: 54561 - DNA, 20 bp, Artificial Sequence
  Description of Artificial Sequence: Synthetic oligonucleotide
  Target: SCN9A; (+) strand; PAM type: NRG; PAM sequence: GGG
cagattatctaattccaaat

SEQ ID NO: 54562 - DNA, 20 bp, Artificial Sequence
  Description of Artificial Sequence: Synthetic oligonucleotide
  Target: SCN9A; (+) strand; PAM type: NRG; PAM sequence: TGG
atttctatttttattttcat

SEQ ID NO: 54563 - DNA, 20 bp, Artificial Sequence
  Description of Artificial Sequence: Synthetic oligonucleotide
  Target: SCN9A; (+) strand; PAM type: NRG; PAM sequence: GGG
tttctatttttattttcatt

SEQ ID NO: 54564 - DNA, 20 bp, Artificial Sequence
  Description of Artificial Sequence: Synthetic oligonucleotide
  Target: SCN9A; (+) strand; PAM type: NRG; PAM sequence: AAG
gcaatgtctttataaattaa

SEQ ID NO: 54565 - DNA, 20 bp, Artificial Sequence
  Description of Artificial Sequence: Synthetic oligonucleotide
  Target: SCN9A; (+) strand; PAM type: NRG; PAM sequence: AGG
caatgtctttataaattaaa

SEQ ID NO: 54566 - DNA, 20 bp, Artificial Sequence
  Description of Artificial Sequence: Synthetic oligonucleotide
  Target: SCN9A; (+) strand; PAM type: NRG; PAM sequence: AAG
tttataaattaaaaggttaa

SEQ ID NO: 54567 - DNA, 20 bp, Artificial Sequence
  Description of Artificial Sequence: Synthetic oligonucleotide
  Target: SCN9A; (+) strand; PAM type: NRG; PAM sequence: AGG
ttataaattaaaaggttaaa

SEQ ID NO: 54568 - DNA, 20 bp, Artificial Sequence
  Description of Artificial Sequence: Synthetic oligonucleotide
  Target: SCN9A; (+) strand; PAM type: NRG; PAM sequence: TGG
aggttaaaaggaactgccaa

SEQ ID NO: 54569 - DNA, 20 bp, Artificial Sequence
  Description of Artificial Sequence: Synthetic oligonucleotide
  Target: SCN9A; (+) strand; PAM type: NRG; PAM sequence: AAG
taaaaggaactgccaatggt

SEQ ID NO: 54570 - DNA, 20 bp, Artificial Sequence
  Description of Artificial Sequence: Synthetic oligonucleotide
  Target: SCN9A; (+) strand; PAM type: NRG; PAM sequence: TAG
tttttttaatacctcttctt

SEQ ID NO: 54571 - DNA, 20 bp, Artificial Sequence
  Description of Artificial Sequence: Synthetic oligonucleotide
  Target: SCN9A; (+) strand; PAM type: NRG; PAM sequence: AAG
ttctttagattataaaaaca

SEQ ID NO: 54572 - DNA, 20 bp, Artificial Sequence
  Description of Artificial Sequence: Synthetic oligonucleotide
  Target: SCN9A; (+) strand; PAM type: NRG; PAM sequence: AAG
ttataaaaacaaagtatgcc

SEQ ID NO: 54573 - DNA, 20 bp, Artificial Sequence
  Description of Artificial Sequence: Synthetic oligonucleotide
  Target: SCN9A; (+) strand; PAM type: NRG; PAM sequence: AAG
tatgccaagtataatatcac

SEQ ID NO: 54574 - DNA, 20 bp, Artificial Sequence
  Description of Artificial Sequence: Synthetic oligonucleotide
  Target: SCN9A; (+) strand; PAM type: NRG; PAM sequence: CAG
gtataatatcacaagaaaaa

SEQ ID NO: 54575 - DNA, 20 bp, Artificial Sequence
  Description of Artificial Sequence: Synthetic oligonucleotide
  Target: SCN9A; (+) strand; PAM type: NRG; PAM sequence: AGG
tataatatcacaagaaaaac

SEQ ID NO: 54576 - DNA, 20 bp, Artificial Sequence
  Description of Artificial Sequence: Synthetic oligonucleotide
  Target: SCN9A; (+) strand; PAM type: NRG; PAM sequence: CAG
aatatcacaagaaaaacagg

SEQ ID NO: 54577 - DNA, 20 bp, Artificial Sequence
  Description of Artificial Sequence: Synthetic oligonucleotide
  Target: SCN9A; (+) strand; PAM type: NRG; PAM sequence: AGG
atatcacaagaaaaacaggc

SEQ ID NO: 54578 - DNA, 20 bp, Artificial Sequence
  Description of Artificial Sequence: Synthetic oligonucleotide
  Target: SCN9A; (+) strand; PAM type: NRG; PAM sequence: TGG
cacaagaaaaacaggcaggc

SEQ ID NO: 54579 - DNA, 20 bp, Artificial Sequence
  Description of Artificial Sequence: Synthetic oligonucleotide
  Target: SCN9A; (+) strand; PAM type: NRG; PAM sequence: TAG
ggcaggctggctactcattt

SEQ ID NO: 54580 - DNA, 20 bp, Artificial Sequence
  Description of Artificial Sequence: Synthetic oligonucleotide
  Target: SCN9A; (+) strand; PAM type: NRG; PAM sequence: AAG
attttagaacctctaatgtt

SEQ ID NO: 54581 - DNA, 20 bp, Artificial Sequence
  Description of Artificial Sequence: Synthetic oligonucleotide
  Target: SCN9A; (+) strand; PAM type: NRG; PAM sequence: AAG
cttaccattgcatccttcat

SEQ ID NO: 54582 - DNA, 20 bp, Artificial Sequence
  Description of Artificial Sequence: Synthetic oligonucleotide
  Target: SCN9A; (+) strand; PAM type: NRG; PAM sequence: TAG
ttaaaataattattatttct

SEQ ID NO: 54583 - DNA, 20 bp, Artificial Sequence
  Description of Artificial Sequence: Synthetic oligonucleotide
  Target: SCN9A; (+) strand; PAM type: NRG; PAM sequence: TGG
tttcttagaaatgcttaatt

SEQ ID NO: 54584 - DNA, 20 bp, Artificial Sequence
  Description of Artificial Sequence: Synthetic oligonucleotide
  Target: SCN9A; (+) strand; PAM type: NRG; PAM sequence: TAG
cttagaaatgcttaatttgg

SEQ ID NO: 54585 - DNA, 20 bp, Artificial Sequence
  Description of Artificial Sequence: Synthetic oligonucleotide
  Target: SCN9A; (+) strand; PAM type: NRG; PAM sequence: TGG
gaaatgcttaatttggtaga

SEQ ID NO: 54586 - DNA, 20 bp, Artificial Sequence
  Description of Artificial Sequence: Synthetic oligonucleotide
  Target: SCN9A; (+) strand; PAM type: NRG; PAM sequence: CAG
taatttggtagatggcaaat

SEQ ID NO: 54587 - DNA, 20 bp, Artificial Sequence
  Description of Artificial Sequence: Synthetic oligonucleotide
  Target: SCN9A; (+) strand; PAM type: NRG; PAM sequence: AAG
atcagtttaataacttcaac

SEQ ID NO: 54588 - DNA, 20 bp, Artificial Sequence
  Description of Artificial Sequence: Synthetic oligonucleotide
  Target: SCN9A; (+) strand; PAM type: NRG; PAM sequence: GAG
cagtttaataacttcaacaa

SEQ ID NO: 54589 - DNA, 20 bp, Artificial Sequence
  Description of Artificial Sequence: Synthetic oligonucleotide
  Target: SCN9A; (+) strand; PAM type: NRG; PAM sequence: TAG
tttaataacttcaacaagag

SEQ ID NO: 54590 - DNA, 20 bp, Artificial Sequence
  Description of Artificial Sequence: Synthetic oligonucleotide
  Target: SCN9A; (+) strand; PAM type: NRG; PAM sequence: TGG
cctaaaatcattcaatttta

SEQ ID NO: 54591 - DNA, 20 bp, Artificial Sequence
  Description of Artificial Sequence: Synthetic oligonucleotide
  Target: SCN9A; (+) strand; PAM type: NRG; PAM sequence: TAG
ttcaattttatggcatttta

SEQ ID NO: 54592 - DNA, 20 bp, Artificial Sequence
  Description of Artificial Sequence: Synthetic oligonucleotide
  Target: SCN9A; (+) strand; PAM type: NRG; PAM sequence: TAG
aattttatggcattttatag

SEQ ID NO: 54593 - DNA, 20 bp, Artificial Sequence
  Description of Artificial Sequence: Synthetic oligonucleotide
  Target: SCN9A; (+) strand; PAM type: NRG; PAM sequence: TGG
ttttatagtagttgaacaac

SEQ ID NO: 54594 - DNA, 20 bp, Artificial Sequence
  Description of Artificial Sequence: Synthetic oligonucleotide
  Target: SCN9A; (+) strand; PAM type: NRG; PAM sequence: AAG
actggtatgcaaaacaaatt

SEQ ID NO: 54595 - DNA, 20 bp, Artificial Sequence
  Description of Artificial Sequence: Synthetic oligonucleotide
  Target: SCN9A; (+) strand; PAM type: NRG; PAM sequence: CAG
atatgcgataattttatatt

SEQ ID NO: 54596 - DNA, 20 bp, Artificial Sequence
  Description of Artificial Sequence: Synthetic oligonucleotide
  Target: SCN9A; (+) strand; PAM type: NRG; PAM sequence: TAG
ttttatattcagacaactga

SEQ ID NO: 54597 - DNA, 20 bp, Artificial Sequence
  Description of Artificial Sequence: Synthetic oligonucleotide
  Target: SCN9A; (+) strand; PAM type: NRG; PAM sequence: AGG
tttatattcagacaactgat

SEQ ID NO: 54598 - DNA, 20 bp, Artificial Sequence
  Description of Artificial Sequence: Synthetic oligonucleotide
  Target: SCN9A; (+) strand; PAM type: NRG; PAM sequence: GGG
ttatattcagacaactgata

SEQ ID NO: 54599 - DNA, 20 bp, Artificial Sequence
  Description of Artificial Sequence: Synthetic oligonucleotide
  Target: SCN9A; (+) strand; PAM type: NRG; PAM sequence: TGG
attattaaaatattgtgatt

SEQ ID NO: 54600 - DNA, 20 bp, Artificial Sequence
  Description of Artificial Sequence: Synthetic oligonucleotide
  Target: SCN9A; (+) strand; PAM type: NRG; PAM sequence: GGG
ttattaaaatattgtgattt

SEQ ID NO: 54601 - DNA, 20 bp, Artificial Sequence
  Description of Artificial Sequence: Synthetic oligonucleotide
  Target: SCN9A; (+) strand; PAM type: NRG; PAM sequence: AAG
atatttattattttattatt

SEQ ID NO: 54602 - DNA, 20 bp, Artificial Sequence
  Description of Artificial Sequence: Synthetic oligonucleotide
  Target: SCN9A; (+) strand; PAM type: NRG; PAM sequence: TAG
ttattattttattattaaga

SEQ ID NO: 54603 - DNA, 20 bp, Artificial Sequence
  Description of Artificial Sequence: Synthetic oligonucleotide
  Target: SCN9A; (+) strand; PAM type: NRG; PAM sequence: AAG
ttattttattattaagatag

SEQ ID NO: 54604 - DNA, 20 bp, Artificial Sequence
  Description of Artificial Sequence: Synthetic oligonucleotide
  Target: SCN9A; (+) strand; PAM type: NRG; PAM sequence: TAG
tttattattaagatagaagt

SEQ ID NO: 54605 - DNA, 20 bp, Artificial Sequence
  Description of Artificial Sequence: Synthetic oligonucleotide
  Target: SCN9A; (+) strand; PAM type: NRG; PAM sequence: TAG
atagaagttagtcttatgta

SEQ ID NO: 54606 - DNA, 20 bp, Artificial Sequence
  Description of Artificial Sequence: Synthetic oligonucleotide
  Target: SCN9A; (+) strand; PAM type: NRG; PAM sequence: TAG
atgtatagccttttaaaata

SEQ ID NO: 54607 - DNA, 20 bp, Artificial Sequence
  Description of Artificial Sequence: Synthetic oligonucleotide
  Target: SCN9A; (+) strand; PAM type: NRG; PAM sequence: AAG
tttaaaatatagtattcctc

SEQ ID NO: 54608 - DNA, 20 bp, Artificial Sequence
  Description of Artificial Sequence: Synthetic oligonucleotide
  Target: SCN9A; (+) strand; PAM type: NRG; PAM sequence: AAG
atagtattcctcaagtttat

SEQ ID NO: 54609 - DNA, 20 bp, Artificial Sequence
  Description of Artificial Sequence: Synthetic oligonucleotide
  Target: SCN9A; (+) strand; PAM type: NRG; PAM sequence: AAG
ctcaagtttataagaaatga

SEQ ID NO: 54610 - DNA, 20 bp, Artificial Sequence
  Description of Artificial Sequence: Synthetic oligonucleotide
  Target: SCN9A; (+) strand; PAM type: NRG; PAM sequence: CGG
tataagaaatgaaagtttgc

SEQ ID NO: 54611 - DNA, 20 bp, Artificial Sequence
  Description of Artificial Sequence: Synthetic oligonucleotide
  Target: SCN9A; (+) strand; PAM type: NRG; PAM sequence: GGG
ataagaaatgaaagtttgcc

SEQ ID NO: 54612 - DNA, 20 bp, Artificial Sequence
  Description of Artificial Sequence: Synthetic oligonucleotide
  Target: SCN9A; (+) strand; PAM type: NRG; PAM sequence: TGG
aaatgaaagtttgccgggcg

SEQ ID NO: 54613 - DNA, 20 bp, Artificial Sequence
  Description of Artificial Sequence: Synthetic oligonucleotide
  Target: SCN9A; (+) strand; PAM type: NRG; PAM sequence: TGG
tgaaagtttgccgggcgtgg

SEQ ID NO: 54614 - DNA, 20 bp, Artificial Sequence
  Description of Artificial Sequence: Synthetic oligonucleotide
  Target: SCN9A; (+) strand; PAM type: NRG; PAM sequence: CAG
gtggctcacgcctataatcc

SEQ ID NO: 54615 - DNA, 20 bp, Artificial Sequence
  Description of Artificial Sequence: Synthetic oligonucleotide
  Target: SCN9A; (+) strand; PAM type: NRG; PAM sequence: TGG
cgcctataatcccagcactt

SEQ ID NO: 54616 - DNA, 20 bp, Artificial Sequence
  Description of Artificial Sequence: Synthetic oligonucleotide
  Target: SCN9A; (+) strand; PAM type: NRG; PAM sequence: GGG
gcctataatcccagcacttt

SEQ ID NO: 54617 - DNA, 20 bp, Artificial Sequence
  Description of Artificial Sequence: Synthetic oligonucleotide
  Target: SCN9A; (+) strand; PAM type: NRG; PAM sequence: AAG
tataatcccagcactttggg

SEQ ID NO: 54618 - DNA, 20 bp, Artificial Sequence
  Description of Artificial Sequence: Synthetic oligonucleotide
  Target: SCN9A; (+) strand; PAM type: NRG; PAM sequence: GAG
tcccagcactttgggaagcc

SEQ ID NO: 54619 - DNA, 20 bp, Artificial Sequence
  Description of Artificial Sequence: Synthetic oligonucleotide
  Target: SCN9A; (+) strand; PAM type: NRG; PAM sequence: AGG
cccagcactttgggaagccg

SEQ ID NO: 54620 - DNA, 20 bp, Artificial Sequence
  Description of Artificial Sequence: Synthetic oligonucleotide
  Target: SCN9A; (+) strand; PAM type: NRG; PAM sequence: CAG
agcactttgggaagccgagg

SEQ ID NO: 54621 - DNA, 20 bp, Artificial Sequence
  Description of Artificial Sequence: Synthetic oligonucleotide
  Target: SCN9A; (+) strand; PAM type: NRG; PAM sequence: AGG
gcactttgggaagccgaggc

SEQ ID NO: 54622 - DNA, 20 bp, Artificial Sequence
  Description of Artificial Sequence: Synthetic oligonucleotide
  Target: SCN9A; (+) strand; PAM type: NRG; PAM sequence: CGG
ctttgggaagccgaggcagg

SEQ ID NO: 54623 - DNA, 20 bp, Artificial Sequence
  Description of Artificial Sequence: Synthetic oligonucleotide
  Target: SCN9A; (+) strand; PAM type: NRG; PAM sequence: GAG
ccgaggcaggcggatcacct

SEQ ID NO: 54624 - DNA, 20 bp, Artificial Sequence
  Description of Artificial Sequence: Synthetic oligonucleotide
  Target: SCN9A; (+) strand; PAM type: NRG; PAM sequence: AGG
cgaggcaggcggatcacctg

SEQ ID NO: 54625 - DNA, 20 bp, Artificial Sequence
  Description of Artificial Sequence: Synthetic oligonucleotide
  Target: SCN9A; (+) strand; PAM type: NRG; PAM sequence: CAG
gcaggcggatcacctgaggt

SEQ ID NO: 54626 - DNA, 20 bp, Artificial Sequence
  Description of Artificial Sequence: Synthetic oligonucleotide
  Target: SCN9A; (+) strand; PAM type: NRG; PAM sequence: AGG
caggcggatcacctgaggtc

SEQ ID NO: 54627 - DNA, 20 bp, Artificial Sequence
  Description of Artificial Sequence: Synthetic oligonucleotide
  Target: SCN9A; (+) strand; PAM type: NRG; PAM sequence: AAG
tcacctgaggtcaggaattc

SEQ ID NO: 54628 - DNA, 20 bp, Artificial Sequence
  Description of Artificial Sequence: Synthetic oligonucleotide
  Target: SCN9A; (+) strand; PAM type: NRG; PAM sequence: CAG
tgaggtcaggaattcaagac

SEQ ID NO: 54629 - DNA, 20 bp, Artificial Sequence
  Description of Artificial Sequence: Synthetic oligonucleotide
  Target: SCN9A; (+) strand; PAM type: NRG; PAM sequence: TGG
caagaccagcctgaccaaca

SEQ ID NO: 54630 - DNA, 20 bp, Artificial Sequence
  Description of Artificial Sequence: Synthetic oligonucleotide
  Target: SCN9A; (+) strand; PAM type: NRG; PAM sequence: GAG
agaccagcctgaccaacatg

SEQ ID NO: 54631 - DNA, 20 bp, Artificial Sequence
  Description of Artificial Sequence: Synthetic oligonucleotide
  Target: SCN9A; (+) strand; PAM type: NRG; PAM sequence: TAG
ctctactaaaaatacaaaat

SEQ ID NO: 54632 - DNA, 20 bp, Artificial Sequence
  Description of Artificial Sequence: Synthetic oligonucleotide
  Target: SCN9A; (+) strand; PAM type: NRG; PAM sequence: TGG
actaaaaatacaaaattagc

SEQ ID NO: 54633 - DNA, 20 bp, Artificial Sequence
  Description of Artificial Sequence: Synthetic oligonucleotide
  Target: SCN9A; (+) strand; PAM type: NRG; PAM sequence: TGG
aatacaaaattagctggtca

SEQ ID NO: 54634 - DNA, 20 bp, Artificial Sequence
  Description of Artificial Sequence: Synthetic oligonucleotide
  Target: SCN9A; (+) strand; PAM type: NRG; PAM sequence: TGG
acaaaattagctggtcatgg

SEQ ID NO: 54635 - DNA, 20 bp, Artificial Sequence
  Description of Artificial Sequence: Synthetic oligonucleotide
  Target: SCN9A; (+) strand; PAM type: NRG; PAM sequence: CAG
gtggcgcatgcctgtaatcc

SEQ ID NO: 54636 - DNA, 20 bp, Artificial Sequence
  Description of Artificial Sequence: Synthetic oligonucleotide
  Target: SCN9A; (+) strand; PAM type: NRG; PAM sequence: CAG
tgcctgtaatcccagctact

SEQ ID NO: 54637 - DNA, 20 bp, Artificial Sequence
  Description of Artificial Sequence: Synthetic oligonucleotide
  Target: SCN9A; (+) strand; PAM type: NRG; PAM sequence: AGG
gcctgtaatcccagctactc

SEQ ID NO: 54638 - DNA, 20 bp, Artificial Sequence
  Description of Artificial Sequence: Synthetic oligonucleotide
  Target: SCN9A; (+) strand; PAM type: NRG; PAM sequence: GAG
ctgtaatcccagctactcag

SEQ ID NO: 54639 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccagctactcagg

SEQ ID NO: 54640 - DNA, 20 bp, Artificial Sequence
  Description of Artificial Sequence: Synthetic oligonucleotide
  Target: SCN9A; (+) strand; PAM type: NRG; PAM sequence: GAG
tcccagctactcaggaggct

SEQ ID NO: 54641 - DNA, 20 bp, Artificial Sequence
  Description of Artificial Sequence: Synthetic oligonucleotide
  Target: SCN9A; (+) strand; PAM type: NRG; PAM sequence: AGG
cccagctactcaggaggctg

SEQ ID NO: 54642 - DNA, 20 bp, Artificial Sequence
  Description of Artificial Sequence: Synthetic oligonucleotide
  Target: SCN9A; (+) strand; PAM type: NRG; PAM sequence: CAG
agctactcaggaggctgagg

SEQ ID NO: 54643 - DNA, 20 bp, Artificial Sequence
  Description of Artificial Sequence: Synthetic oligonucleotide
  Target: SCN9A; (+) strand; PAM type: NRG; PAM sequence: AGG
gctactcaggaggctgaggc

SEQ ID NO: 54644 - DNA, 20 bp, Artificial Sequence
  Description of Artificial Sequence: Synthetic oligonucleotide
  Target: SCN9A; (+) strand; PAM type: NRG; PAM sequence: GAG
tactcaggaggctgaggcag

SEQ ID NO: 54645 - DNA, 20 bp, Artificial Sequence
  Description of Artificial Sequence: Synthetic oligonucleotide
  Target: SCN9A; (+) strand; PAM type: NRG; PAM sequence: CGG
gcaggagaactgcttgaacc

SEQ ID NO: 54646 - DNA, 20 bp, Artificial Sequence
  Description of Artificial Sequence: Synthetic oligonucleotide
  Target: SCN9A; (+) strand; PAM type: NRG; PAM sequence: GGG
caggagaactgcttgaaccc

SEQ ID NO: 54647 - DNA, 20 bp, Artificial Sequence
  Description of Artificial Sequence: Synthetic oligonucleotide
  Target: SCN9A; (+) strand; PAM type: NRG; PAM sequence: GAG
ggagaactgcttgaacccgg

SEQ ID NO: 54648 - DNA, 20 bp, Artificial Sequence
  Description of Artificial Sequence: Synthetic oligonucleotide
  Target: SCN9A; (+) strand; PAM type: NRG; PAM sequence: AGG
gagaactgcttgaacccggg

SEQ ID NO: 54649 - DNA, 20 bp, Artificial Sequence
  Description of Artificial Sequence: Synthetic oligonucleotide
  Target: SCN9A; (+) strand; PAM type: NRG; PAM sequence: TGG
aactgcttgaacccgggagg

SEQ ID NO: 54650 - DNA, 20 bp, Artificial Sequence
  Description of Artificial Sequence: Synthetic oligonucleotide
  Target: SCN9A; (+) strand; PAM type: NRG; PAM sequence: TAG
tgaacccgggaggtggattg

SEQ ID NO: 54651 - DNA, 20 bp, Artificial Sequence
  Description of Artificial Sequence: Synthetic oligonucleotide
  Target: SCN9A; (+) strand; PAM type: NRG; PAM sequence: GAG
cccgggaggtggattgtagt

SEQ ID NO: 54652 - DNA, 20 bp, Artificial Sequence
  Description of Artificial Sequence: Synthetic oligonucleotide
  Target: SCN9A; (+) strand; PAM type: NRG; PAM sequence: GAG
gaggtggattgtagtgagct

SEQ ID NO: 54653 - DNA, 20 bp, Artificial Sequence
  Description of Artificial Sequence: Synthetic oligonucleotide
  Target: SCN9A; (+) strand; PAM type: NRG; PAM sequence: CGG
ggattgtagtgagctgagat

SEQ ID NO: 54654 - DNA, 20 bp, Artificial Sequence
  Description of Artificial Sequence: Synthetic oligonucleotide
  Target: SCN9A; (+) strand; PAM type: NRG; PAM sequence: GGG
gattgtagtgagctgagatc

SEQ ID NO: 54655 - DNA, 20 bp, Artificial Sequence
  Description of Artificial Sequence: Synthetic oligonucleotide
  Target: SCN9A; (+) strand; PAM type: NRG; PAM sequence: CAG
gagatcgggccattgcactc

SEQ ID NO: 54656 - DNA, 20 bp, Artificial Sequence
  Description of Artificial Sequence: Synthetic oligonucleotide
  Target: SCN9A; (+) strand; PAM type: NRG; PAM sequence: TGG
cgggccattgcactccagcc

SEQ ID NO: 54657 - DNA, 20 bp, Artificial Sequence
  Description of Artificial Sequence: Synthetic oligonucleotide
  Target: SCN9A; (+) strand; PAM type: NRG; PAM sequence: GGG
gggccattgcactccagcct

SEQ ID NO: 54658 - DNA, 20 bp, Artificial Sequence
  Description of Artificial Sequence: Synthetic oligonucleotide
  Target: SCN9A; (+) strand; PAM type: NRG; PAM sequence: AAG
tgcactccagcctgggcaac

SEQ ID NO: 54659 - DNA, 20 bp, Artificial Sequence
  Description of Artificial Sequence: Synthetic oligonucleotide
  Target: SCN9A; (+) strand; PAM type: NRG; PAM sequence: GAG
cactccagcctgggcaacaa

SEQ ID NO: 54660 - DNA, 20 bp, Artificial Sequence
  Description of Artificial Sequence: Synthetic oligonucleotide
  Target: SCN9A; (+) strand; PAM type: NRG; PAM sequence: AAG
tgtctcaaaaaaaaaaaaaa

SEQ ID NO: 54661 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaagaaaaaaaaaaa

SEQ ID NO: 54662 - DNA, 20 bp, Artificial Sequence
  Description of Artificial Sequence: Synthetic oligonucleotide
  Target: SCN9A; (+) strand; PAM type: NRG; PAM sequence: AAG
aaaaaaaaaaaaagaaatta

SEQ ID NO: 54663 - DNA, 20 bp, Artificial Sequence
  Description of Artificial Sequence: Synthetic oligonucleotide
  Target: SCN9A; (+) strand; PAM type: NRG; PAM sequence: AAG
aaattaaagtttataatctt

SEQ ID NO: 54664 - DNA, 20 bp, Artificial Sequence
  Description of Artificial Sequence: Synthetic oligonucleotide
  Target: SCN9A; (+) strand; PAM type: NRG; PAM sequence: AAG
ttaaagtttataatcttaag

SEQ ID NO: 54665 - DNA, 20 bp, Artificial Sequence
  Description of Artificial Sequence: Synthetic oligonucleotide
  Target: SCN9A; (+) strand; PAM type: NRG; PAM sequence: TGG
tcttaagaagtgtattaccc

SEQ ID NO: 54666 - DNA, 20 bp, Artificial Sequence
  Description of Artificial Sequence: Synthetic oligonucleotide
  Target: SCN9A; (+) strand; PAM type: NRG; PAM sequence: GGG
cttaagaagtgtattaccct

SEQ ID NO: 54667 - DNA, 20 bp, Artificial Sequence
  Description of Artificial Sequence: Synthetic oligonucleotide
  Target: SCN9A; (+) strand; PAM type: NRG; PAM sequence: AAG
gtattaccctgggaaaactt

SEQ ID NO: 54668 - DNA, 20 bp, Artificial Sequence
  Description of Artificial Sequence: Synthetic oligonucleotide
  Target: SCN9A; (+) strand; PAM type: NRG; PAM sequence: TAG
accctgggaaaacttaagat

SEQ ID NO: 54669 - DNA, 20 bp, Artificial Sequence
  Description of Artificial Sequence: Synthetic oligonucleotide
  Target: SCN9A; (+) strand; PAM type: NRG; PAM sequence: TGG
agattagtgtcaacatttgc

SEQ ID NO: 54670 - DNA, 20 bp, Artificial Sequence
  Description of Artificial Sequence: Synthetic oligonucleotide
  Target: SCN9A; (+) strand; PAM type: NRG; PAM sequence: AAG
gttttaataaaaaattcata

SEQ ID NO: 54671 - DNA, 20 bp, Artificial Sequence
  Description of Artificial Sequence: Synthetic oligonucleotide
  Target: SCN9A; (+) strand; PAM type: NRG; PAM sequence: CAG
ttcataaagtcttatctgta

SEQ ID NO: 54672 - DNA, 20 bp, Artificial Sequence
  Description of Artificial Sequence: Synthetic oligonucleotide
  Target: SCN9A; (+) strand; PAM type: NRG; PAM sequence: AAG
ttatctgtacagcatgtata

SEQ ID NO: 54673 - DNA, 20 bp, Artificial Sequence
  Description of Artificial Sequence: Synthetic oligonucleotide
  Target: SCN9A; (+) strand; PAM type: NRG; PAM sequence: AGG
tatctgtacagcatgtataa

SEQ ID NO: 54674 - DNA, 20 bp, Artificial Sequence
  Description of Artificial Sequence: Synthetic oligonucleotide
  Target: SCN9A; (+) strand; PAM type: NRG; PAM sequence: AAG
ctgtacagcatgtataaagg

SEQ ID NO: 54675 - DNA, 20 bp, Artificial Sequence
  Description of Artificial Sequence: Synthetic oligonucleotide
  Target: SCN9A; (+) strand; PAM type: NRG; PAM sequence: CAG
acagcatgtataaaggaaga

SEQ ID NO: 54676 - DNA, 20 bp, Artificial Sequence
  Description of Artificial Sequence: Synthetic oligonucleotide
  Target: SCN9A; (+) strand; PAM type: NRG; PAM sequence: TAG
ggaagacagaaaatacttct

SEQ ID NO: 54677 - DNA, 20 bp, Artificial Sequence
  Description of Artificial Sequence: Synthetic oligonucleotide
  Target: SCN9A; (+) strand; PAM type: NRG; PAM sequence: TAG
gttaaatcccatctctctgt

SEQ ID NO: 54678 - DNA, 20 bp, Artificial Sequence
  Description of Artificial Sequence: Synthetic oligonucleotide
  Target: SCN9A; (+) strand; PAM type: NRG; PAM sequence: AAG
atcccatctctctgttagtt

SEQ ID NO: 54679 - DNA, 20 bp, Artificial Sequence
  Description of Artificial Sequence: Synthetic oligonucleotide
  Target: SCN9A; (+) strand; PAM type: NRG; PAM sequence: GAG
ctgttagttaagactttatt

SEQ ID NO: 54680 - DNA, 20 bp, Artificial Sequence
  Description of Artificial Sequence: Synthetic oligonucleotide
  Target: SCN9A; (+) strand; PAM type: NRG; PAM sequence: GAG
gttagttaagactttattga

SEQ ID NO: 54681 - DNA, 20 bp, Artificial Sequence
  Description of Artificial Sequence: Synthetic oligonucleotide
  Target: SCN9A; (+) strand; PAM type: NRG; PAM sequence: CAG
ttgagagcacaaaattatca

SEQ ID NO: 54682 - DNA, 20 bp, Artificial Sequence
  Description of Artificial Sequence: Synthetic oligonucleotide
  Target: SCN9A; (+) strand; PAM type: NRG; PAM sequence: TGG
acaaaattatcacagactta

SEQ ID NO: 54683 - DNA, 20 bp, Artificial Sequence
  Description of Artificial Sequence: Synthetic oligonucleotide
  Target: SCN9A; (+) strand; PAM type: NRG; PAM sequence: CAG
ttatcacagacttatggctg

SEQ ID NO: 54684 - DNA, 20 bp, Artificial Sequence
  Description of Artificial Sequence: Synthetic oligonucleotide
  Target: SCN9A; (+) strand; PAM type: NRG; PAM sequence: CAG
acagacttatggctgcagaa

SEQ ID NO: 54685 - DNA, 20 bp, Artificial Sequence
  Description of Artificial Sequence: Synthetic oligonucleotide
  Target: SCN9A; (+) strand; PAM type: NRG; PAM sequence: AGG
cagacttatggctgcagaac

SEQ ID NO: 54686 - DNA, 20 bp, Artificial Sequence
  Description of Artificial Sequence: Synthetic oligonucleotide
  Target: SCN9A; (+) strand; PAM type: NRG; PAM sequence: TAG
tatacccttatttaaataat

SEQ ID NO: 54687 - DNA, 20 bp, Artificial Sequence
  Description of Artificial Sequence: Synthetic oligonucleotide
  Target: SCN9A; (+) strand; PAM type: NRG; PAM sequence: GAG
tacccttatttaaataatta

SEQ ID NO: 54688 - DNA, 20 bp, Artificial Sequence
  Description of Artificial Sequence: Synthetic oligonucleotide
  Target: SCN9A; (+) strand; PAM type: NRG; PAM sequence: GAG
cccttatttaaataattaga

SEQ ID NO: 54689 - DNA, 20 bp, Artificial Sequence
  Description of Artificial Sequence: Synthetic oligonucleotide
  Target: SCN9A; (+) strand; PAM type: NRG; PAM sequence: TAG
ctcaaaacatcaacatgatt

SEQ ID NO: 54690 - DNA, 20 bp, Artificial Sequence
  Description of Artificial Sequence: Synthetic oligonucleotide
  Target: SCN9A; (+) strand; PAM type: NRG; PAM sequence: AGG
tcaaaacatcaacatgattt

SEQ ID NO: 54691 - DNA, 20 bp, Artificial Sequence
  Description of Artificial Sequence: Synthetic oligonucleotide
  Target: SCN9A; (+) strand; PAM type: NRG; PAM sequence: GAG
aaaacatcaacatgatttag

SEQ ID NO: 54692 - DNA, 20 bp, Artificial Sequence
  Description of Artificial Sequence: Synthetic oligonucleotide
  Target: SCN9A; (+) strand; PAM type: NRG; PAM sequence: AAG
catcaacatgatttaggaga

SEQ ID NO: 54693 - DNA, 20 bp, Artificial Sequence
  Description of Artificial Sequence: Synthetic oligonucleotide
  Target: SCN9A; (+) strand; PAM type: NRG; PAM sequence: TAG
atgatttaggagaaagtgca

SEQ ID NO: 54694 - DNA, 20 bp, Artificial Sequence
  Description of Artificial Sequence: Synthetic oligonucleotide
  Target: SCN9A; (+) strand; PAM type: NRG; PAM sequence: TGG
aaagtgcatagtaataactt

SEQ ID NO: 54695 - DNA, 20 bp, Artificial Sequence
  Description of Artificial Sequence: Synthetic oligonucleotide
  Target: SCN9A; (+) strand; PAM type: NRG; PAM sequence: CAG
catagtaataactttggcac

SEQ ID NO: 54696 - DNA, 20 bp, Artificial Sequence
  Description of Artificial Sequence: Synthetic oligonucleotide
  Target: SCN9A; (+) strand; PAM type: NRG; PAM sequence: AGG
atagtaataactttggcacc

SEQ ID NO: 54697 - DNA, 20 bp, Artificial Sequence
  Description of Artificial Sequence: Synthetic oligonucleotide
  Target: SCN9A; (+) strand; PAM type: NRG; PAM sequence: CAG
gtaataactttggcaccagg

SEQ ID NO: 54698 - DNA, 20 bp, Artificial Sequence
  Description of Artificial Sequence: Synthetic oligonucleotide
  Target: SCN9A; (+) strand; PAM type: NRG; PAM sequence: TAG
actttggcaccaggcagact

SEQ ID NO: 54699 - DNA, 20 bp, Artificial Sequence
  Description of Artificial Sequence: Synthetic oligonucleotide
  Target: SCN9A; (+) strand; PAM type: NRG; PAM sequence: AGG
ctttggcaccaggcagactt

SEQ ID NO: 54700 - DNA, 20 bp, Artificial Sequence
  Description of Artificial Sequence: Synthetic oligonucleotide
  Target: SCN9A; (+) strand; PAM type: NRG; PAM sequence: TAG
tcctgtttattccatataat

SEQ ID NO: 54701 - DNA, 20 bp, Artificial Sequence
  Description of Artificial Sequence: Synthetic oligonucleotide
  Target: SCN9A; (+) strand; PAM type: NRG; PAM sequence: CAG
attccatataattagctctg

SEQ ID NO: 54702 - DNA, 20 bp, Artificial Sequence
  Description of Artificial Sequence: Synthetic oligonucleotide
  Target: SCN9A; (+) strand; PAM type: NRG; PAM sequence: AAG
tgcaaattccccataaatga

SEQ ID NO: 54703 - DNA, 20 bp, Artificial Sequence
  Description of Artificial Sequence: Synthetic oligonucleotide
  Target: SCN9A; (+) strand; PAM type: NRG; PAM sequence: GAG
caaattccccataaatgaaa

SEQ ID NO: 54704 - DNA, 20 bp, Artificial Sequence
  Description of Artificial Sequence: Synthetic oligonucleotide
  Target: SCN9A; (+) strand; PAM type: NRG; PAM sequence: GAG
aattccccataaatgaaaga

SEQ ID NO: 54705 - DNA, 20 bp, Artificial Sequence
  Description of Artificial Sequence: Synthetic oligonucleotide
  Target: SCN9A; (+) strand; PAM type: NRG; PAM sequence: AAG
agaaatatatctgtcttata

SEQ ID NO: 54706 - DNA, 20 bp, Artificial Sequence
  Description of Artificial Sequence: Synthetic oligonucleotide
  Target: SCN9A; (+) strand; PAM type: NRG; PAM sequence: TAG
tgtcttataaagttatcatg

SEQ ID NO: 54707 - DNA, 20 bp, Artificial Sequence
  Description of Artificial Sequence: Synthetic oligonucleotide
  Target: SCN9A; (+) strand; PAM type: NRG; PAM sequence: TAG
tataaagttatcatgtagaa

SEQ ID NO: 54708 - DNA, 20 bp, Artificial Sequence
  Description of Artificial Sequence: Synthetic oligonucleotide
  Target: SCN9A; (+) strand; PAM type: NRG; PAM sequence: TGG
gttatcatgtagaatagaaa

SEQ ID NO: 54709 - DNA, 20 bp, Artificial Sequence
  Description of Artificial Sequence: Synthetic oligonucleotide
  Target: SCN9A; (+) strand; PAM type: NRG; PAM sequence: TGG
atgtagaatagaaatggttt

SEQ ID NO: 54710 - DNA, 20 bp, Artificial Sequence
  Description of Artificial Sequence: Synthetic oligonucleotide
  Target: SCN9A; (+) strand; PAM type: NRG; PAM sequence: AAG
gaatagaaatggttttggta

SEQ ID NO: 54711 - DNA, 20 bp, Artificial Sequence
  Description of Artificial Sequence: Synthetic oligonucleotide
  Target: SCN9A; (+) strand; PAM type: NRG; PAM sequence: CAG
ttttggtaaagtgcctacca

SEQ ID NO: 54712 - DNA, 20 bp, Artificial Sequence
  Description of Artificial Sequence: Synthetic oligonucleotide
  Target: SCN9A; (+) strand; PAM type: NRG; PAM sequence: TAG
aaagtgcctaccacagtgcc

SEQ ID NO: 54713 - DNA, 20 bp, Artificial Sequence
  Description of Artificial Sequence: Synthetic oligonucleotide
  Target: SCN9A; (+) strand; PAM type: NRG; PAM sequence: AGG
aagtgcctaccacagtgcct

SEQ ID NO: 54714 - DNA, 20 bp, Artificial Sequence
  Description of Artificial Sequence: Synthetic oligonucleotide
  Target: SCN9A; (+) strand; PAM type: NRG; PAM sequence: CAG
tgcctaggctaaataaataa

SEQ ID NO: 54715 - DNA, 20 bp, Artificial Sequence
  Description of Artificial Sequence: Synthetic oligonucleotide
  Target: SCN9A; (+) strand; PAM type: NRG; PAM sequence: AAG
taggctaaataaataacagc

SEQ ID NO: 54716 - DNA, 20 bp, Artificial Sequence
  Description of Artificial Sequence: Synthetic oligonucleotide
  Target: SCN9A; (+) strand; PAM type: NRG; PAM sequence: CAG
tattatccttcttccctata

SEQ ID NO: 54717 - DNA, 20 bp, Artificial Sequence
  Description of Artificial Sequence: Synthetic oligonucleotide
  Target: SCN9A; (+) strand; PAM type: NRG; PAM sequence: AAG
gactgaaatttttaaataat

SEQ ID NO: 54718 - DNA, 20 bp, Artificial Sequence
  Description of Artificial Sequence: Synthetic oligonucleotide
  Target: SCN9A; (+) strand; PAM type: NRG; PAM sequence: GAG
atttttaaataataagccat

SEQ ID NO: 54719 - DNA, 20 bp, Artificial Sequence
  Description of Artificial Sequence: Synthetic oligonucleotide
  Target: SCN9A; (+) strand; PAM type: NRG; PAM sequence: TGG
ttaaataataagccatgagt

SEQ ID NO: 54720 - DNA, 20 bp, Artificial Sequence
  Description of Artificial Sequence: Synthetic oligonucleotide
  Target: SCN9A; (+) strand; PAM type: NRG; PAM sequence: TGG
aaccttacgaaaatcttatg

SEQ ID NO: 54721 - DNA, 20 bp, Artificial Sequence
  Description of Artificial Sequence: Synthetic oligonucleotide
  Target: SCN9A; (+) strand; PAM type: NRG; PAM sequence: GAG
ccttacgaaaatcttatgtg

SEQ ID NO: 54722 - DNA, 20 bp, Artificial Sequence
  Description of Artificial Sequence: Synthetic oligonucleotide
  Target: SCN9A; (+) strand; PAM type: NRG; PAM sequence: TGG
tatcttgccaaacatgttta

SEQ ID NO: 54723 - DNA, 20 bp, Artificial Sequence
  Description of Artificial Sequence: Synthetic oligonucleotide
  Target: SCN9A; (+) strand; PAM type: NRG; PAM sequence: TAG
tatggctttaatttaaaata

SEQ ID NO: 54724 - DNA, 20 bp, Artificial Sequence
  Description of Artificial Sequence: Synthetic oligonucleotide
  Target: SCN9A; (+) strand; PAM type: NRG; PAM sequence: CAG
taatttaaaatatagatctg

SEQ ID NO: 54725 - DNA, 20 bp, Artificial Sequence
  Description of Artificial Sequence: Synthetic oligonucleotide
  Target: SCN9A; (+) strand; PAM type: NRG; PAM sequence: TAG
aatatagatctgcagtaaaa

SEQ ID NO: 54726 - DNA, 20 bp, Artificial Sequence
  Description of Artificial Sequence: Synthetic oligonucleotide
  Target: SCN9A; (+) strand; PAM type: NRG; PAM sequence: AAG
tagatctgcagtaaaatagt

SEQ ID NO: 54727 - DNA, 20 bp, Artificial Sequence
  Description of Artificial Sequence: Synthetic oligonucleotide
  Target: SCN9A; (+) strand; PAM type: NRG; PAM sequence: CAG
tctgcagtaaaatagtaaga

SEQ ID NO: 54728 - DNA, 20 bp, Artificial Sequence
  Description of Artificial Sequence: Synthetic oligonucleotide
  Target: SCN9A; (+) strand; PAM type: NRG; PAM sequence: CAG
aatagtaagacagcataacc

SEQ ID NO: 54729 - DNA, 20 bp, Artificial Sequence
  Description of Artificial Sequence: Synthetic oligonucleotide
  Target: SCN9A; (+) strand; PAM type: NRG; PAM sequence: TGG
taacccagttgttaaattca

SEQ ID NO: 54730 - DNA, 20 bp, Artificial Sequence
  Description of Artificial Sequence: Synthetic oligonucleotide
  Target: SCN9A; (+) strand; PAM type: NRG; PAM sequence: CAG
agttgttaaattcatggctc

SEQ ID NO: 54731 - DNA, 20 bp, Artificial Sequence
  Description of Artificial Sequence: Synthetic oligonucleotide
  Target: SCN9A; (+) strand; PAM type: NRG; PAM sequence: GAG
ttgttaaattcatggctcca

SEQ ID NO: 54732 - DNA, 20 bp, Artificial Sequence
  Description of Artificial Sequence: Synthetic oligonucleotide
  Target: SCN9A; (+) strand; PAM type: NRG; PAM sequence: GAG
taaattcatggctccagagt

SEQ ID NO: 54733 - DNA, 20 bp, Artificial Sequence
  Description of Artificial Sequence: Synthetic oligonucleotide
  Target: SCN9A; (+) strand; PAM type: NRG; PAM sequence: GAG
aattcatggctccagagtga

SEQ ID NO: 54734 - DNA, 20 bp, Artificial Sequence
  Description of Artificial Sequence: Synthetic oligonucleotide
  Target: SCN9A; (+) strand; PAM type: NRG; PAM sequence: GAG
ttcatggctccagagtgaga

SEQ ID NO: 54735 - DNA, 20 bp, Artificial Sequence
  Description of Artificial Sequence: Synthetic oligonucleotide
  Target: SCN9A; (+) strand; PAM type: NRG; PAM sequence: AGG
tcatggctccagagtgagag

SEQ ID NO: 54736 - DNA, 20 bp, Artificial Sequence
  Description of Artificial Sequence: Synthetic oligonucleotide
  Target: SCN9A; (+) strand; PAM type: NRG; PAM sequence: TGG
gctccagagtgagagaggca

SEQ ID NO: 54737 - DNA, 20 bp, Artificial Sequence
  Description of Artificial Sequence: Synthetic oligonucleotide
  Target: SCN9A; (+) strand; PAM type: NRG; PAM sequence: GGG
ctccagagtgagagaggcat

SEQ ID NO: 54738 - DNA, 20 bp, Artificial Sequence
  Description of Artificial Sequence: Synthetic oligonucleotide
  Target: SCN9A; (+) strand; PAM type: NRG; PAM sequence: TAG
atcccatctctactgcttac

SEQ ID NO: 54739 - DNA, 20 bp, Artificial Sequence
  Description of Artificial Sequence: Synthetic oligonucleotide
  Target: SCN9A; (+) strand; PAM type: NRG; PAM sequence: TGG
tgcttactagcttatgtcct

SEQ ID NO: 54740 - DNA, 20 bp, Artificial Sequence
  Description of Artificial Sequence: Synthetic oligonucleotide
  Target: SCN9A; (+) strand; PAM type: NRG; PAM sequence: GGG
gcttactagcttatgtcctt

SEQ ID NO: 54741 - DNA, 20 bp, Artificial Sequence
  Description of Artificial Sequence: Synthetic oligonucleotide
  Target: SCN9A; (+) strand; PAM type: NRG; PAM sequence: GGG
cttactagcttatgtccttg

SEQ ID NO: 54742 - DNA, 20 bp, Artificial Sequence
  Description of Artificial Sequence: Synthetic oligonucleotide
  Target: SCN9A; (+) strand; PAM type: NRG; PAM sequence: AAG
gaatttaattaacttctcta

SEQ ID NO: 54743 - DNA, 20 bp, Artificial Sequence
  Description of Artificial Sequence: Synthetic oligonucleotide
  Target: SCN9A; (+) strand; PAM type: NRG; PAM sequence: CAG
taattaacttctctaaagct

SEQ ID NO: 54744 - DNA, 20 bp, Artificial Sequence
  Description of Artificial Sequence: Synthetic oligonucleotide
  Target: SCN9A; (+) strand; PAM type: NRG; PAM sequence: TAG
tctaaagctcagttcttata

SEQ ID NO: 54745 - DNA, 20 bp, Artificial Sequence
  Description of Artificial Sequence: Synthetic oligonucleotide
  Target: SCN9A; (+) strand; PAM type: NRG; PAM sequence: CGG
tcagttcttatatagcaaac

SEQ ID NO: 54746 - DNA, 20 bp, Artificial Sequence
  Description of Artificial Sequence: Synthetic oligonucleotide
  Target: SCN9A; (+) strand; PAM type: NRG; PAM sequence: GAG
agttcttatatagcaaaccg

SEQ ID NO: 54747 - DNA, 20 bp, Artificial Sequence
  Description of Artificial Sequence: Synthetic oligonucleotide
  Target: SCN9A; (+) strand; PAM type: NRG; PAM sequence: AAG
gctgaaaatgataatccttt

SEQ ID NO: 54748 - DNA, 20 bp, Artificial Sequence
  Description of Artificial Sequence: Synthetic oligonucleotide
  Target: SCN9A; (+) strand; PAM type: NRG; PAM sequence: AGG
ctgaaaatgataatccttta

SEQ ID NO: 54749 - DNA, 20 bp, Artificial Sequence
  Description of Artificial Sequence: Synthetic oligonucleotide
  Target: SCN9A; (+) strand; PAM type: NRG; PAM sequence: TAG
ataatcctttaaggttattt

SEQ ID NO: 54750 - DNA, 20 bp, Artificial Sequence
  Description of Artificial Sequence: Synthetic oligonucleotide
  Target: SCN9A; (+) strand; PAM type: NRG; PAM sequence: TGG
atcctttaaggttattttag

SEQ ID NO: 54751 - DNA, 20 bp, Artificial Sequence
  Description of Artificial Sequence: Synthetic oligonucleotide
  Target: SCN9A; (+) strand; PAM type: NRG; PAM sequence: TAG
gttattttagtggaaaaaat

SEQ ID NO: 54752 - DNA, 20 bp, Artificial Sequence
  Description of Artificial Sequence: Synthetic oligonucleotide
  Target: SCN9A; (+) strand; PAM type: NRG; PAM sequence: TAG
gacactgaattttaataact

SEQ ID NO: 54753 - DNA, 20 bp, Artificial Sequence
  Description of Artificial Sequence: Synthetic oligonucleotide
  Target: SCN9A; (+) strand; PAM type: NRG; PAM sequence: CAG
cacatttcctgttacacttt

SEQ ID NO: 54754 - DNA, 20 bp, Artificial Sequence
  Description of Artificial Sequence: Synthetic oligonucleotide
  Target: SCN9A; (+) strand; PAM type: NRG; PAM sequence: TAG
tacattgtaactgttattat

SEQ ID NO: 54755 - DNA, 20 bp, Artificial Sequence
  Description of Artificial Sequence: Synthetic oligonucleotide
  Target: SCN9A; (+) strand; PAM type: NRG; PAM sequence: TAG
actgttattattagtgattt

SEQ ID NO: 54756 - DNA, 20 bp, Artificial Sequence
  Description of Artificial Sequence: Synthetic oligonucleotide
  Target: SCN9A; (+) strand; PAM type: NRG; PAM sequence: AAG
gattttagcaactttcttct

SEQ ID NO: 54757 - DNA, 20 bp, Artificial Sequence
  Description of Artificial Sequence: Synthetic oligonucleotide
  Target: SCN9A; (+) strand; PAM type: NRG; PAM sequence: AAG
aagttgattttgtataccta

SEQ ID NO: 54758 - DNA, 20 bp, Artificial Sequence
  Description of Artificial Sequence: Synthetic oligonucleotide
  Target: SCN9A; (+) strand; PAM type: NRG; PAM sequence: TAG
atacctaaagctaatgttct

SEQ ID NO: 54759 - DNA, 20 bp, Artificial Sequence
  Description of Artificial Sequence: Synthetic oligonucleotide
  Target: SCN9A; (+) strand; PAM type: NRG; PAM sequence: AGG
tacctaaagctaatgttctt

SEQ ID NO: 54760 - DNA, 20 bp, Artificial Sequence
  Description of Artificial Sequence: Synthetic oligonucleotide
  Target: SCN9A; (+) strand; PAM type: NRG; PAM sequence: GAG
aagctaatgttcttaggaac

SEQ ID NO: 54761 - DNA, 20 bp, Artificial Sequence
  Description of Artificial Sequence: Synthetic oligonucleotide
  Target: SCN9A; (+) strand; PAM type: NRG; PAM sequence: TAG
tatatttgcttactttataa

SEQ ID NO: 54762 - DNA, 20 bp, Artificial Sequence
  Description of Artificial Sequence: Synthetic oligonucleotide
  Target: SCN9A; (+) strand; PAM type: NRG; PAM sequence: AAG
ttgcttactttataatagaa

SEQ ID NO: 54763 - DNA, 20 bp, Artificial Sequence
  Description of Artificial Sequence: Synthetic oligonucleotide
  Target: SCN9A; (+) strand; PAM type: NRG; PAM sequence: TAG
tatacaaaaccttttcttct

SEQ ID NO: 54764 - DNA, 20 bp, Artificial Sequence
  Description of Artificial Sequence: Synthetic oligonucleotide
  Target: SCN9A; (+) strand; PAM type: NRG; PAM sequence: AGG
atacaaaaccttttcttctt

SEQ ID NO: 54765 - DNA, 20 bp, Artificial Sequence
  Description of Artificial Sequence: Synthetic oligonucleotide
  Target: SCN9A; (+) strand; PAM type: NRG; PAM sequence: GGG
tacaaaaccttttcttctta

SEQ ID NO: 54766 - DNA, 20 bp, Artificial Sequence
  Description of Artificial Sequence: Synthetic oligonucleotide
  Target: SCN9A; (+) strand; PAM type: NRG; PAM sequence: GAG
caaaaccttttcttcttagg

SEQ ID NO: 54767 - DNA, 20 bp, Artificial Sequence
  Description of Artificial Sequence: Synthetic oligonucleotide
  Target: SCN9A; (+) strand; PAM type: NRG; PAM sequence: CAG
ttcttagggagctttcaact

SEQ ID NO: 54768 - DNA, 20 bp, Artificial Sequence
  Description of Artificial Sequence: Synthetic oligonucleotide
  Target: SCN9A; (+) strand; PAM type: NRG; PAM sequence: AAG
tttcaactcagaatatttta

SEQ ID NO: 54769 - DNA, 20 bp, Artificial Sequence
  Description of Artificial Sequence: Synthetic oligonucleotide
  Target: SCN9A; (+) strand; PAM type: NRG; PAM sequence: TAG
aagactaaaatgtatgctta

SEQ ID NO: 54770 - DNA, 20 bp, Artificial Sequence
  Description of Artificial Sequence: Synthetic oligonucleotide
  Target: SCN9A; (+) strand; PAM type: NRG; PAM sequence: AAG
tgtatgcttatagcaaaacc

SEQ ID NO: 54771 - DNA, 20 bp, Artificial Sequence
  Description of Artificial Sequence: Synthetic oligonucleotide
  Target: SCN9A; (+) strand; PAM type: NRG; PAM sequence: CAG
actacattgccttctaccaa

SEQ ID NO: 54772 - DNA, 20 bp, Artificial Sequence
  Description of Artificial Sequence: Synthetic oligonucleotide
  Target: SCN9A; (+) strand; PAM type: NRG; PAM sequence: AGG
ctacattgccttctaccaac

SEQ ID NO: 54773 - DNA, 20 bp, Artificial Sequence
  Description of Artificial Sequence: Synthetic oligonucleotide
  Target: SCN9A; (+) strand; PAM type: NRG; PAM sequence: TGG
cattgccttctaccaacagg

SEQ ID NO: 54774 - DNA, 20 bp, Artificial Sequence
  Description of Artificial Sequence: Synthetic oligonucleotide
  Target: SCN9A; (+) strand; PAM type: NRG; PAM sequence: CAG
gtggcaatatatgccacaca

SEQ ID NO: 54775 - DNA, 20 bp, Artificial Sequence
  Description of Artificial Sequence: Synthetic oligonucleotide
  Target: SCN9A; (+) strand; PAM type: NRG; PAM sequence: TAG
tatgccacacacagccattt

SEQ ID NO: 54776 - DNA, 20 bp, Artificial Sequence
  Description of Artificial Sequence: Synthetic oligonucleotide
  Target: SCN9A; (+) strand; PAM type: NRG; PAM sequence: AAG
attttagtcctgccaataca

SEQ ID NO: 54777 - DNA, 20 bp, Artificial Sequence
  Description of Artificial Sequence: Synthetic oligonucleotide
  Target: SCN9A; (+) strand; PAM type: NRG; PAM sequence: TAG
cctgccaatacaaagttcat

SEQ ID NO: 54778 - DNA, 20 bp, Artificial Sequence
  Description of Artificial Sequence: Synthetic oligonucleotide
  Target: SCN9A; (+) strand; PAM type: NRG; PAM sequence: CAG
acaaagttcattagtttatt

SEQ ID NO: 54779 - DNA, 20 bp, Artificial Sequence
  Description of Artificial Sequence: Synthetic oligonucleotide
  Target: SCN9A; (+) strand; PAM type: NRG; PAM sequence: CAG
attagtttattcagtgtcta

SEQ ID NO: 54780 - DNA, 20 bp, Artificial Sequence
  Description of Artificial Sequence: Synthetic oligonucleotide
  Target: SCN9A; (+) strand; PAM type: NRG; PAM sequence: AGG
ttagtttattcagtgtctac

SEQ ID NO: 54781 - DNA, 20 bp, Artificial Sequence
  Description of Artificial Sequence: Synthetic oligonucleotide
  Target: SCN9A; (+) strand; PAM type: NRG; PAM sequence: TGG
tattcagtgtctacaggatg

SEQ ID NO: 54782 - DNA, 20 bp, Artificial Sequence
  Description of Artificial Sequence: Synthetic oligonucleotide
  Target: SCN9A; (+) strand; PAM type: NRG; PAM sequence: GGG
attcagtgtctacaggatgt

SEQ ID NO: 54783 - DNA, 20 bp, Artificial Sequence
  Description of Artificial Sequence: Synthetic oligonucleotide
  Target: SCN9A; (+) strand; PAM type: NRG; PAM sequence: AAG
aggatgtgggccttgctttc

SEQ ID NO: 54784 - DNA, 20 bp, Artificial Sequence
  Description of Artificial Sequence: Synthetic oligonucleotide
  Target: SCN9A; (+) strand; PAM type: NRG; PAM sequence: AGG
ggatgtgggccttgctttca

SEQ ID NO: 54785 - DNA, 20 bp, Artificial Sequence
  Description of Artificial Sequence: Synthetic oligonucleotide
  Target: SCN9A; (+) strand; PAM type: NRG; PAM sequence: CAG
atataaattcttaaatccat

SEQ ID NO: 54786 - DNA, 20 bp, Artificial Sequence
  Description of Artificial Sequence: Synthetic oligonucleotide
  Target: SCN9A; (+) strand; PAM type: NRG; PAM sequence: AGG
tataaattcttaaatccatc

SEQ ID NO: 54787 - DNA, 20 bp, Artificial Sequence
  Description of Artificial Sequence: Synthetic oligonucleotide
  Target: SCN9A; (+) strand; PAM type: NRG; PAM sequence: TGG
tccatcaggtttgataaatg

SEQ ID NO: 54788 - DNA, 20 bp, Artificial Sequence
  Description of Artificial Sequence: Synthetic oligonucleotide
  Target: SCN9A; (+) strand; PAM type: NRG; PAM sequence: GAG
gtggatacactgaacacacc

SEQ ID NO: 54789 - DNA, 20 bp, Artificial Sequence
  Description of Artificial Sequence: Synthetic oligonucleotide
  Target: SCN9A; (+) strand; PAM type: NRG; PAM sequence: AGG
tggatacactgaacacaccg

SEQ ID NO: 54790 - DNA, 20 bp, Artificial Sequence
  Description of Artificial Sequence: Synthetic oligonucleotide
  Target: SCN9A; (+) strand; PAM type: NRG; PAM sequence: AAG
gaacacaccgaggatgttga

SEQ ID NO: 54791 - DNA, 20 bp, Artificial Sequence
  Description of Artificial Sequence: Synthetic oligonucleotide
  Target: SCN9A; (+) strand; PAM type: NRG; PAM sequence: TGG
agatttaataacaaaaacat

SEQ ID NO: 54792 - DNA, 20 bp, Artificial Sequence
  Description of Artificial Sequence: Synthetic oligonucleotide
  Target: SCN9A; (+) strand; PAM type: NRG; PAM sequence: TGG
acaaaaacattggaatatca

SEQ ID NO: 54793 - DNA, 20 bp, Artificial Sequence
  Description of Artificial Sequence: Synthetic oligonucleotide
  Target: SCN9A; (+) strand; PAM type: NRG; PAM sequence: GGG
caaaaacattggaatatcat

SEQ ID NO: 54794 - DNA, 20 bp, Artificial Sequence
  Description of Artificial Sequence: Synthetic oligonucleotide
  Target: SCN9A; (+) strand; PAM type: NRG; PAM sequence: AAG
ttggaatatcatgggaacca

SEQ ID NO: 54795 - DNA, 20 bp, Artificial Sequence
  Description of Artificial Sequence: Synthetic oligonucleotide
  Target: SCN9A; (+) strand; PAM type: NRG; PAM sequence: AAG
aaaaataataaaatgatcga

SEQ ID NO: 54796 - DNA, 20 bp, Artificial Sequence
  Description of Artificial Sequence: Synthetic oligonucleotide
  Target: SCN9A; (+) strand; PAM type: NRG; PAM sequence: AAG
ataataaaatgatcgaaagt

SEQ ID NO: 54797 - DNA, 20 bp, Artificial Sequence
  Description of Artificial Sequence: Synthetic oligonucleotide
  Target: SCN9A; (+) strand; PAM type: NRG; PAM sequence: TGG
aagtaagaaaataataaatg

SEQ ID NO: 54798 - DNA, 20 bp, Artificial Sequence
  Description of Artificial Sequence: Synthetic oligonucleotide
  Target: SCN9A; (+) strand; PAM type: NRG; PAM sequence: AAG
aagaaaataataaatgtggc

SEQ ID NO: 54799 - DNA, 20 bp, Artificial Sequence
  Description of Artificial Sequence: Synthetic oligonucleotide
  Target: SCN9A; (+) strand; PAM type: NRG; PAM sequence: AAG
taaatgtggcaagtgcataa

SEQ ID NO: 54800 - DNA, 20 bp, Artificial Sequence
  Description of Artificial Sequence: Synthetic oligonucleotide
  Target: SCN9A; (+) strand; PAM type: NRG; PAM sequence: CAG
cataaaagtttaatcattga

SEQ ID NO: 54801 - DNA, 20 bp, Artificial Sequence
  Description of Artificial Sequence: Synthetic oligonucleotide
  Target: SCN9A; (+) strand; PAM type: NRG; PAM sequence: TAG
tgacagtaatgatgaccctc

SEQ ID NO: 54802 - DNA, 20 bp, Artificial Sequence
  Description of Artificial Sequence: Synthetic oligonucleotide
  Target: SCN9A; (+) strand; PAM type: NRG; PAM sequence: AGG
gacagtaatgatgaccctct

SEQ ID NO: 54803 - DNA, 20 bp, Artificial Sequence
  Description of Artificial Sequence: Synthetic oligonucleotide
  Target: SCN9A; (+) strand; PAM type: NRG; PAM sequence: GAG
aatgatgaccctctaggact

SEQ ID NO: 54804 - DNA, 20 bp, Artificial Sequence
  Description of Artificial Sequence: Synthetic oligonucleotide
  Target: SCN9A; (+) strand; PAM type: NRG; PAM sequence: CAG
gatgaccctctaggactgag

SEQ ID NO: 54805 - DNA, 20 bp, Artificial Sequence
  Description of Artificial Sequence: Synthetic oligonucleotide
  Target: SCN9A; (+) strand; PAM type: NRG; PAM sequence: AAG
gactgagcagaattatgcaa

SEQ ID NO: 54806 - DNA, 20 bp, Artificial Sequence
  Description of Artificial Sequence: Synthetic oligonucleotide
  Target: SCN9A; (+) strand; PAM type: NRG; PAM sequence: GAG
atgcaaaagtttaaaataat

SEQ ID NO: 54807 - DNA, 20 bp, Artificial Sequence
  Description of Artificial Sequence: Synthetic oligonucleotide
  Target: SCN9A; (+) strand; PAM type: NRG; PAM sequence: TAG
aaagtttaaaataatgagct

SEQ ID NO: 54808 - DNA, 20 bp, Artificial Sequence
  Description of Artificial Sequence: Synthetic oligonucleotide
  Target: SCN9A; (+) strand; PAM type: NRG; PAM sequence: AGG
aagtttaaaataatgagctt

SEQ ID NO: 54809 - DNA, 20 bp, Artificial Sequence
  Description of Artificial Sequence: Synthetic oligonucleotide
  Target: SCN9A; (+) strand; PAM type: NRG; PAM sequence: TAG
aaaataatgagcttaggcaa

SEQ ID NO: 54810 - DNA, 20 bp, Artificial Sequence
  Description of Artificial Sequence: Synthetic oligonucleotide
  Target: SCN9A; (+) strand; PAM type: NRG; PAM sequence: CAG
taatgagcttaggcaatagc

SEQ ID NO: 54811 - DNA, 20 bp, Artificial Sequence
  Description of Artificial Sequence: Synthetic oligonucleotide
  Target: SCN9A; (+) strand; PAM type: NRG; PAM sequence: AAG
gagcttaggcaatagccagc

SEQ ID NO: 54812 - DNA, 20 bp, Artificial Sequence
  Description of Artificial Sequence: Synthetic oligonucleotide
  Target: SCN9A; (+) strand; PAM type: NRG; PAM sequence: AAG
ggcaatagccagcaagatac

SEQ ID NO: 54813 - DNA, 20 bp, Artificial Sequence
  Description of Artificial Sequence: Synthetic oligonucleotide
  Target: SCN9A; (+) strand; PAM type: NRG; PAM sequence: AGG
gcaatagccagcaagataca

SEQ ID NO: 54814 - DNA, 20 bp, Artificial Sequence
  Description of Artificial Sequence: Synthetic oligonucleotide
  Target: SCN9A; (+) strand; PAM type: NRG; PAM sequence: TAG
ttaaaaaaatgaaaatgctc

SEQ ID NO: 54815 - DNA, 20 bp, Artificial Sequence
  Description of Artificial Sequence: Synthetic oligonucleotide
  Target: SCN9A; (+) strand; PAM type: NRG; PAM sequence: GAG
aaatgaaaatgctctagcat

SEQ ID NO: 54816 - DNA, 20 bp, Artificial Sequence
  Description of Artificial Sequence: Synthetic oligonucleotide
  Target: SCN9A; (+) strand; PAM type: NRG; PAM sequence: CAG
gaaaatgctctagcatgagt

SEQ ID NO: 54817 - DNA, 20 bp, Artificial Sequence
  Description of Artificial Sequence: Synthetic oligonucleotide
  Target: SCN9A; (+) strand; PAM type: NRG; PAM sequence: GAG
aaatgctctagcatgagtca

SEQ ID NO: 54818 - DNA, 20 bp, Artificial Sequence
  Description of Artificial Sequence: Synthetic oligonucleotide
  Target: SCN9A; (+) strand; PAM type: NRG; PAM sequence: AGG
aatgctctagcatgagtcag

SEQ ID NO: 54819 - DNA, 20 bp, Artificial Sequence
  Description of Artificial Sequence: Synthetic oligonucleotide
  Target: SCN9A; (+) strand; PAM type: NRG; PAM sequence: TAG
tgagtcagaggatttttcat

SEQ ID NO: 54820 - DNA, 20 bp, Artificial Sequence
  Description of Artificial Sequence: Synthetic oligonucleotide
  Target: SCN9A; (+) strand; PAM type: NRG; PAM sequence: CAG
gtcagaggatttttcattag

SEQ ID NO: 54821 - DNA, 20 bp, Artificial Sequence
  Description of Artificial Sequence: Synthetic oligonucleotide
  Target: SCN9A; (+) strand; PAM type: NRG; PAM sequence: CGG
agaggatttttcattagcag

SEQ ID NO: 54822 - DNA, 20 bp, Artificial Sequence
  Description of Artificial Sequence: Synthetic oligonucleotide
  Target: SCN9A; (+) strand; PAM type: NRG; PAM sequence: CAG
ttcattagcagcggatgctc

SEQ ID NO: 54823 - DNA, 20 bp, Artificial Sequence
  Description of Artificial Sequence: Synthetic oligonucleotide
  Target: SCN9A; (+) strand; PAM type: NRG; PAM sequence: AAG
tgctccagaacttaatgcta

SEQ ID NO: 54824 - DNA, 20 bp, Artificial Sequence
  Description of Artificial Sequence: Synthetic oligonucleotide
  Target: SCN9A; (+) strand; PAM type: NRG; PAM sequence: GAG
ccagaacttaatgctaaagt

SEQ ID NO: 54825 - DNA, 20 bp, Artificial Sequence
  Description of Artificial Sequence: Synthetic oligonucleotide
  Target: SCN9A; (+) strand; PAM type: NRG; PAM sequence: AAG
acttaatgctaaagtgagaa

SEQ ID NO: 54826 - DNA, 20 bp, Artificial Sequence
  Description of Artificial Sequence: Synthetic oligonucleotide
  Target: SCN9A; (+) strand; PAM type: NRG; PAM sequence: TAG
atgctaaagtgagaaaagac

SEQ ID NO: 54827 - DNA, 20 bp, Artificial Sequence
  Description of Artificial Sequence: Synthetic oligonucleotide
  Target: SCN9A; (+) strand; PAM type: NRG; PAM sequence: AGG
tgctaaagtgagaaaagact

SEQ ID NO: 54828 - DNA, 20 bp, Artificial Sequence
  Description of Artificial Sequence: Synthetic oligonucleotide
  Target: SCN9A; (+) strand; PAM type: NRG; PAM sequence: AAG
aaaagactaggtattcattc

SEQ ID NO: 54829 - DNA, 20 bp, Artificial Sequence
  Description of Artificial Sequence: Synthetic oligonucleotide
  Target: SCN9A; (+) strand; PAM type: NRG; PAM sequence: AAG
agactaggtattcattcaag

SEQ ID NO: 54830 - DNA, 20 bp, Artificial Sequence
  Description of Artificial Sequence: Synthetic oligonucleotide
  Target: SCN9A; (+) strand; PAM type: NRG; PAM sequence: AGG
gactaggtattcattcaaga

SEQ ID NO: 54831 - DNA, 20 bp, Artificial Sequence
  Description of Artificial Sequence: Synthetic oligonucleotide
  Target: SCN9A; (+) strand; PAM type: NRG; PAM sequence: AAG
cattcaagaaggcaaaatcc

SEQ ID NO: 54832 - DNA, 20 bp, Artificial Sequence
  Description of Artificial Sequence: Synthetic oligonucleotide
  Target: SCN9A; (+) strand; PAM type: NRG; PAM sequence: CAG
aagaaggcaaaatccaagca

SEQ ID NO: 54833 - DNA, 20 bp, Artificial Sequence
  Description of Artificial Sequence: Synthetic oligonucleotide
  Target: SCN9A; (+) strand; PAM type: NRG; PAM sequence: CAG
gcaaaatccaagcacagtaa

SEQ ID NO: 54834 - DNA, 20 bp, Artificial Sequence
  Description of Artificial Sequence: Synthetic oligonucleotide
  Target: SCN9A; (+) strand; PAM type: NRG; PAM sequence: TGG
tgctgatgaaatattcctga

SEQ ID NO: 54835 - DNA, 20 bp, Artificial Sequence
  Description of Artificial Sequence: Synthetic oligonucleotide
  Target: SCN9A; (+) strand; PAM type: NRG; PAM sequence: GGG
gctgatgaaatattcctgat

SEQ ID NO: 54836 - DNA, 20 bp, Artificial Sequence
  Description of Artificial Sequence: Synthetic oligonucleotide
  Target: SCN9A; (+) strand; PAM type: NRG; PAM sequence: GGG
ctgatgaaatattcctgatg

SEQ ID NO: 54837 - DNA, 20 bp, Artificial Sequence
  Description of Artificial Sequence: Synthetic oligonucleotide
  Target: SCN9A; (+) strand; PAM type: NRG; PAM sequence: CAG
atgaaatattcctgatgggg

SEQ ID NO: 54838 - DNA, 20 bp, Artificial Sequence
  Description of Artificial Sequence: Synthetic oligonucleotide
  Target: SCN9A; (+) strand; PAM type: NRG; PAM sequence: AGG
tgaaatattcctgatggggc

SEQ ID NO: 54839 - DNA, 20 bp, Artificial Sequence
  Description of Artificial Sequence: Synthetic oligonucleotide
  Target: SCN9A; (+) strand; PAM type: NRG; PAM sequence: AAG
gatggggcaggaattgttaa

SEQ ID NO: 54840 - DNA, 20 bp, Artificial Sequence
  Description of Artificial Sequence: Synthetic oligonucleotide
  Target: SCN9A; (+) strand; PAM type: NRG; PAM sequence: AAG
ctttaattcaatatcaaaat

SEQ ID NO: 54841 - DNA, 20 bp, Artificial Sequence
  Description of Artificial Sequence: Synthetic oligonucleotide
  Target: SCN9A; (+) strand; PAM type: NRG; PAM sequence: GAG
aattcaatatcaaaataagt

SEQ ID NO: 54842 - DNA, 20 bp, Artificial Sequence
  Description of Artificial Sequence: Synthetic oligonucleotide
  Target: SCN9A; (+) strand; PAM type: NRG; PAM sequence: AAG
aatatcaaaataagtgagtt

SEQ ID NO: 54843 - DNA, 20 bp, Artificial Sequence
  Description of Artificial Sequence: Synthetic oligonucleotide
  Target: SCN9A; (+) strand; PAM type: NRG; PAM sequence: AAG
atcaaaataagtgagttaag

SEQ ID NO: 54844 - DNA, 20 bp, Artificial Sequence
  Description of Artificial Sequence: Synthetic oligonucleotide
  Target: SCN9A; (+) strand; PAM type: NRG; PAM sequence: AAG
gttaagaagcatgcatgcca

SEQ ID NO: 54845 - DNA, 20 bp, Artificial Sequence
  Description of Artificial Sequence: Synthetic oligonucleotide
  Target: SCN9A; (+) strand; PAM type: NRG; PAM sequence: TGG
atgcatgccaaagtattctt

SEQ ID NO: 54846 - DNA, 20 bp, Artificial Sequence
  Description of Artificial Sequence: Synthetic oligonucleotide
  Target: SCN9A; (+) strand; PAM type: NRG; PAM sequence: TGG
agtattctttggaacatttg

SEQ ID NO: 54847 - DNA, 20 bp, Artificial Sequence
  Description of Artificial Sequence: Synthetic oligonucleotide
  Target: SCN9A; (+) strand; PAM type: NRG; PAM sequence: TAG
tttgtggacattgtcaaaac

SEQ ID NO: 54848 - DNA, 20 bp, Artificial Sequence
  Description of Artificial Sequence: Synthetic oligonucleotide
  Target: SCN9A; (+) strand; PAM type: NRG; PAM sequence: AAG
aactagtgacatctactcat

SEQ ID NO: 54849 - DNA, 20 bp, Artificial Sequence
  Description of Artificial Sequence: Synthetic oligonucleotide
  Target: SCN9A; (+) strand; PAM type: NRG; PAM sequence: AAG
tactcataagatttttgatg

SEQ ID NO: 54850 - DNA, 20 bp, Artificial Sequence
  Description of Artificial Sequence: Synthetic oligonucleotide
  Target: SCN9A; (+) strand; PAM type: NRG; PAM sequence: GAG
ttttgatgaagacattgttt

SEQ ID NO: 54851 - DNA, 20 bp, Artificial Sequence
  Description of Artificial Sequence: Synthetic oligonucleotide
  Target: SCN9A; (+) strand; PAM type: NRG; PAM sequence: TAG
cattgtttgagaatctatat

SEQ ID NO: 54852 - DNA, 20 bp, Artificial Sequence
  Description of Artificial Sequence: Synthetic oligonucleotide
  Target: SCN9A; (+) strand; PAM type: NRG; PAM sequence: AAG
tttgagaatctatattagca

SEQ ID NO: 54853 - DNA, 20 bp, Artificial Sequence
  Description of Artificial Sequence: Synthetic oligonucleotide
  Target: SCN9A; (+) strand; PAM type: NRG; PAM sequence: AGG
ttgagaatctatattagcaa

SEQ ID NO: 54854 - DNA, 20 bp, Artificial Sequence
  Description of Artificial Sequence: Synthetic oligonucleotide
  Target: SCN9A; (+) strand; PAM type: NRG; PAM sequence: AAG
agaatctatattagcaaagg

SEQ ID NO: 54855 - DNA, 20 bp, Artificial Sequence
  Description of Artificial Sequence: Synthetic oligonucleotide
  Target: SCN9A; (+) strand; PAM type: NRG; PAM sequence: AGG
gaatctatattagcaaagga

SEQ ID NO: 54856 - DNA, 20 bp, Artificial Sequence
  Description of Artificial Sequence: Synthetic oligonucleotide
  Target: SCN9A; (+) strand; PAM type: NRG; PAM sequence: GGG
aatctatattagcaaaggaa

SEQ ID NO: 54857 - DNA, 20 bp, Artificial Sequence
  Description of Artificial Sequence: Synthetic oligonucleotide
  Target: SCN9A; (+) strand; PAM type: NRG; PAM sequence: GGG
atctatattagcaaaggaag

SEQ ID NO: 54858 - DNA, 20 bp, Artificial Sequence
  Description of Artificial Sequence: Synthetic oligonucleotide
  Target: SCN9A; (+) strand; PAM type: NRG; PAM sequence: GGG
tctatattagcaaaggaagg

SEQ ID NO: 54859 - DNA, 20 bp, Artificial Sequence
  Description of Artificial Sequence: Synthetic oligonucleotide
  Target: SCN9A; (+) strand; PAM type: NRG; PAM sequence: TGG
agcaaaggaagggggtaatc

SEQ ID NO: 54860 - DNA, 20 bp, Artificial Sequence
  Description of Artificial Sequence: Synthetic oligonucleotide
  Target: SCN9A; (+) strand; PAM type: NRG; PAM sequence: GAG
ggaagggggtaatctggttt

SEQ ID NO: 54861 - DNA, 20 bp, Artificial Sequence
  Description of Artificial Sequence: Synthetic oligonucleotide
  Target: SCN9A; (+) strand; PAM type: NRG; PAM sequence: AGG
gaagggggtaatctggtttg

SEQ ID NO: 54862 - DNA, 20 bp, Artificial Sequence
  Description of Artificial Sequence: Synthetic oligonucleotide
  Target: SCN9A; (+) strand; PAM type: NRG; PAM sequence: GAG
agggggtaatctggtttgag

SEQ ID NO: 54863 - DNA, 20 bp, Artificial Sequence
  Description of Artificial Sequence: Synthetic oligonucleotide
  Target: SCN9A; (+) strand; PAM type: NRG; PAM sequence: AAG
aatctggtttgaggagtcta

SEQ ID NO: 54864 - DNA, 20 bp, Artificial Sequence
  Description of Artificial Sequence: Synthetic oligonucleotide
  Target: SCN9A; (+) strand; PAM type: NRG; PAM sequence: AGG
atctggtttgaggagtctaa

SEQ ID NO: 54865 - DNA, 20 bp, Artificial Sequence
  Description of Artificial Sequence: Synthetic oligonucleotide
  Target: SCN9A; (+) strand; PAM type: NRG; PAM sequence: CAG
gtttgaggagtctaaaggaa

SEQ ID NO: 54866 - DNA, 20 bp, Artificial Sequence
  Description of Artificial Sequence: Synthetic oligonucleotide
  Target: SCN9A; (+) strand; PAM type: NRG; PAM sequence: TAG
gtctaaaggaacagtttatt

SEQ ID NO: 54867 - DNA, 20 bp, Artificial Sequence
  Description of Artificial Sequence: Synthetic oligonucleotide
  Target: SCN9A; (+) strand; PAM type: NRG; PAM sequence: TGG
taaaggaacagtttatttag

SEQ ID NO: 54868 - DNA, 20 bp, Artificial Sequence
  Description of Artificial Sequence: Synthetic oligonucleotide
  Target: SCN9A; (+) strand; PAM type: NRG; PAM sequence: TGG
ttatttagtggaaattcatc

SEQ ID NO: 54869 - DNA, 20 bp, Artificial Sequence
  Description of Artificial Sequence: Synthetic oligonucleotide
  Target: SCN9A; (+) strand; PAM type: NRG; PAM sequence: GAG
atttagtggaaattcatctg

SEQ ID NO: 54870 - DNA, 20 bp, Artificial Sequence
  Description of Artificial Sequence: Synthetic oligonucleotide
  Target: SCN9A; (+) strand; PAM type: NRG; PAM sequence: TGG
agtggaaattcatctggaga

SEQ ID NO: 54871 - DNA, 20 bp, Artificial Sequence
  Description of Artificial Sequence: Synthetic oligonucleotide
  Target: SCN9A; (+) strand; PAM type: NRG; PAM sequence: AAG
aaattcatctggagatggta

SEQ ID NO: 54872 - DNA, 20 bp, Artificial Sequence
  Description of Artificial Sequence: Synthetic oligonucleotide
  Target: SCN9A; (+) strand; PAM type: NRG; PAM sequence: TGG
ctggagatggtaaagtacta

SEQ ID NO: 54873 - DNA, 20 bp, Artificial Sequence
  Description of Artificial Sequence: Synthetic oligonucleotide
  Target: SCN9A; (+) strand; PAM type: NRG; PAM sequence: GAG
tactatggtataaataacat

SEQ ID NO: 54874 - DNA, 20 bp, Artificial Sequence
  Description of Artificial Sequence: Synthetic oligonucleotide
  Target: SCN9A; (+) strand; PAM type: NRG; PAM sequence: TAG
tttgcaaactaacatgttca

SEQ ID NO: 54875 - DNA, 20 bp, Artificial Sequence
  Description of Artificial Sequence: Synthetic oligonucleotide
  Target: SCN9A; (+) strand; PAM type: NRG; PAM sequence: TGG
cttatttctctgctctctct

SEQ ID NO: 54876 - DNA, 20 bp, Artificial Sequence
  Description of Artificial Sequence: Synthetic oligonucleotide
  Target: SCN9A; (+) strand; PAM type: NRG; PAM sequence: AAG
tctgctctctcttggaacta

SEQ ID NO: 54877 - DNA, 20 bp, Artificial Sequence
  Description of Artificial Sequence: Synthetic oligonucleotide
  Target: SCN9A; (+) strand; PAM type: NRG; PAM sequence: AGG
ctgctctctcttggaactaa

SEQ ID NO: 54878 - DNA, 20 bp, Artificial Sequence
  Description of Artificial Sequence: Synthetic oligonucleotide
  Target: SCN9A; (+) strand; PAM type: NRG; PAM sequence: TGG
ggaactaaaggctgtgatta

SEQ ID NO: 54879 - DNA, 20 bp, Artificial Sequence
  Description of Artificial Sequence: Synthetic oligonucleotide
  Target: SCN9A; (+) strand; PAM type: NRG; PAM sequence: AAG
ctaaaggctgtgattatggc

SEQ ID NO: 54880 - DNA, 20 bp, Artificial Sequence
  Description of Artificial Sequence: Synthetic oligonucleotide
  Target: SCN9A; (+) strand; PAM type: NRG; PAM sequence: AGG
taaaggctgtgattatggca

SEQ ID NO: 54881 - DNA, 20 bp, Artificial Sequence
  Description of Artificial Sequence: Synthetic oligonucleotide
  Target: SCN9A; (+) strand; PAM type: NRG; PAM sequence: TAG
tgtgattatggcaaggtatc

SEQ ID NO: 54882 - DNA, 20 bp, Artificial Sequence
  Description of Artificial Sequence: Synthetic oligonucleotide
  Target: SCN9A; (+) strand; PAM type: NRG; PAM sequence: AGG
gtgattatggcaaggtatct

SEQ ID NO: 54883 - DNA, 20 bp, Artificial Sequence
  Description of Artificial Sequence: Synthetic oligonucleotide
  Target: SCN9A; (+) strand; PAM type: NRG; PAM sequence: TGG
taggaaccctcaccataatc

SEQ ID NO: 54884 - DNA, 20 bp, Artificial Sequence
  Description of Artificial Sequence: Synthetic oligonucleotide
  Target: SCN9A; (+) strand; PAM type: NRG; PAM sequence: GGG
aggaaccctcaccataatct

SEQ ID NO: 54885 - DNA, 20 bp, Artificial Sequence
  Description of Artificial Sequence: Synthetic oligonucleotide
  Target: SCN9A; (+) strand; PAM type: NRG; PAM sequence: AAG
tgttgttaaaaatatattca

SEQ ID NO: 54886 - DNA, 20 bp, Artificial Sequence
  Description of Artificial Sequence: Synthetic oligonucleotide
  Target: SCN9A; (+) strand; PAM type: NRG; PAM sequence: AAG
taaaaatatattcaaagata

SEQ ID NO: 54887 - DNA, 20 bp, Artificial Sequence
  Description of Artificial Sequence: Synthetic oligonucleotide
  Target: SCN9A; (+) strand; PAM type: NRG; PAM sequence: AGG
aaaaatatattcaaagataa

SEQ ID NO: 54888 - DNA, 20 bp, Artificial Sequence
  Description of Artificial Sequence: Synthetic oligonucleotide
  Target: SCN9A; (+) strand; PAM type: NRG; PAM sequence: GGG
aaaatatattcaaagataaa

SEQ ID NO: 54889 - DNA, 20 bp, Artificial Sequence
  Description of Artificial Sequence: Synthetic oligonucleotide
  Target: SCN9A; (+) strand; PAM type: NRG; PAM sequence: TGG
atattcaaagataaagggta

SEQ ID NO: 54890 - DNA, 20 bp, Artificial Sequence
  Description of Artificial Sequence: Synthetic oligonucleotide
  Target: SCN9A; (+) strand; PAM type: NRG; PAM sequence: AAG
aagggtatggctattttttt

SEQ ID NO: 54891 - DNA, 20 bp, Artificial Sequence
  Description of Artificial Sequence: Synthetic oligonucleotide
  Target: SCN9A; (+) strand; PAM type: NRG; PAM sequence: AGG
agggtatggctattttttta

SEQ ID NO: 54892 - DNA, 20 bp, Artificial Sequence
  Description of Artificial Sequence: Synthetic oligonucleotide
  Target: SCN9A; (+) strand; PAM type: NRG; PAM sequence: GGG
gggtatggctatttttttaa

SEQ ID NO: 54893 - DNA, 20 bp, Artificial Sequence
  Description of Artificial Sequence: Synthetic oligonucleotide
  Target: SCN9A; (+) strand; PAM type: NRG; PAM sequence: TAG
agggtgaattaaatgtgtga

SEQ ID NO: 54894 - DNA, 20 bp, Artificial Sequence
  Description of Artificial Sequence: Synthetic oligonucleotide
  Target: SCN9A; (+) strand; PAM type: NRG; PAM sequence: TGG
tttcttactttctgccattt

SEQ ID NO: 54895 - DNA, 20 bp, Artificial Sequence
  Description of Artificial Sequence: Synthetic oligonucleotide
  Target: SCN9A; (+) strand; PAM type: NRG; PAM sequence: GGG
ttcttactttctgccatttt

SEQ ID NO: 54896 - DNA, 20 bp, Artificial Sequence
  Description of Artificial Sequence: Synthetic oligonucleotide
  Target: SCN9A; (+) strand; PAM type: NRG; PAM sequence: GGG
tcttactttctgccattttg

SEQ ID NO: 54897 - DNA, 20 bp, Artificial Sequence
  Description of Artificial Sequence: Synthetic oligonucleotide
  Target: SCN9A; (+) strand; PAM type: NRG; PAM sequence: CAG
tactttctgccattttgggg

SEQ ID NO: 54898 - DNA, 20 bp, Artificial Sequence
  Description of Artificial Sequence: Synthetic oligonucleotide
  Target: SCN9A; (+) strand; PAM type: NRG; PAM sequence: CAG
ccattttggggcagaatttt

SEQ ID NO: 54899 - DNA, 20 bp, Artificial Sequence
  Description of Artificial Sequence: Synthetic oligonucleotide
  Target: SCN9A; (+) strand; PAM type: NRG; PAM sequence: CAG
gcagaattttcagaacctca

SEQ ID NO: 54900 - DNA, 20 bp, Artificial Sequence
  Description of Artificial Sequence: Synthetic oligonucleotide
  Target: SCN9A; (+) strand; PAM type: NRG; PAM sequence: TAG
cagaacctcacagatataaa

SEQ ID NO: 54901 - DNA, 20 bp, Artificial Sequence
  Description of Artificial Sequence: Synthetic oligonucleotide
  Target: SCN9A; (+) strand; PAM type: NRG; PAM sequence: AGG
agaacctcacagatataaat

SEQ ID NO: 54902 - DNA, 20 bp, Artificial Sequence
  Description of Artificial Sequence: Synthetic oligonucleotide
  Target: SCN9A; (+) strand; PAM type: NRG; PAM sequence: TGG
ctcacagatataaataggat

SEQ ID NO: 54903 - DNA, 20 bp, Artificial Sequence
  Description of Artificial Sequence: Synthetic oligonucleotide
  Target: SCN9A; (+) strand; PAM type: NRG; PAM sequence: GAG
cacagatataaataggattg

SEQ ID NO: 54904 - DNA, 20 bp, Artificial Sequence
  Description of Artificial Sequence: Synthetic oligonucleotide
  Target: SCN9A; (+) strand; PAM type: NRG; PAM sequence: AAG
taaataggattggagtcatg

SEQ ID NO: 54905 - DNA, 20 bp, Artificial Sequence
  Description of Artificial Sequence: Synthetic oligonucleotide
  Target: SCN9A; (+) strand; PAM type: NRG; PAM sequence: TAG
tcatgaagaatattccaaat

SEQ ID NO: 54906 - DNA, 20 bp, Artificial Sequence
  Description of Artificial Sequence: Synthetic oligonucleotide
  Target: SCN9A; (+) strand; PAM type: NRG; PAM sequence: CAG
tccaaattagataacaatca

SEQ ID NO: 54907 - DNA, 20 bp, Artificial Sequence
  Description of Artificial Sequence: Synthetic oligonucleotide
  Target: SCN9A; (+) strand; PAM type: NRG; PAM sequence: AGG
ccaaattagataacaatcac

SEQ ID NO: 54908 - DNA, 20 bp, Artificial Sequence
  Description of Artificial Sequence: Synthetic oligonucleotide
  Target: SCN9A; (+) strand; PAM type: NRG; PAM sequence: TAG
atcacaggatcacaaatgaa

SEQ ID NO: 54909 - DNA, 20 bp, Artificial Sequence
  Description of Artificial Sequence: Synthetic oligonucleotide
  Target: SCN9A; (+) strand; PAM type: NRG; PAM sequence: AGG
tcacaggatcacaaatgaat

SEQ ID NO: 54910 - DNA, 20 bp, Artificial Sequence
  Description of Artificial Sequence: Synthetic oligonucleotide
  Target: SCN9A; (+) strand; PAM type: NRG; PAM sequence: AAG
caggatcacaaatgaatagg

SEQ ID NO: 54911 - DNA, 20 bp, Artificial Sequence
  Description of Artificial Sequence: Synthetic oligonucleotide
  Target: SCN9A; (+) strand; PAM type: NRG; PAM sequence: CAG
ccttcctcaaatttatattc

SEQ ID NO: 54912 - DNA, 20 bp, Artificial Sequence
  Description of Artificial Sequence: Synthetic oligonucleotide
  Target: SCN9A; (+) strand; PAM type: NRG; PAM sequence: AAG
tcctcaaatttatattccag

SEQ ID NO: 54913 - DNA, 20 bp, Artificial Sequence
  Description of Artificial Sequence: Synthetic oligonucleotide
  Target: SCN9A; (+) strand; PAM type: NRG; PAM sequence: AGG
cctcaaatttatattccaga

SEQ ID NO: 54914 - DNA, 20 bp, Artificial Sequence
  Description of Artificial Sequence: Synthetic oligonucleotide
  Target: SCN9A; (+) strand; PAM type: NRG; PAM sequence: AAG
caaatttatattccagaagg

SEQ ID NO: 54915 - DNA, 20 bp, Artificial Sequence
  Description of Artificial Sequence: Synthetic oligonucleotide
  Target: SCN9A; (+) strand; PAM type: NRG; PAM sequence: CAG
cctaaacatttgctttatct

SEQ ID NO: 54916 - DNA, 20 bp, Artificial Sequence
  Description of Artificial Sequence: Synthetic oligonucleotide
  Target: SCN9A; (+) strand; PAM type: NRG; PAM sequence: AAG
tttgctttatctcagaatcc

SEQ ID NO: 54917 - DNA, 20 bp, Artificial Sequence
  Description of Artificial Sequence: Synthetic oligonucleotide
  Target: SCN9A; (+) strand; PAM type: NRG; PAM sequence: CAG
tcctgatcaaatttatattc

SEQ ID NO: 54918 - DNA, 20 bp, Artificial Sequence
  Description of Artificial Sequence: Synthetic oligonucleotide
  Target: SCN9A; (+) strand; PAM type: NRG; PAM sequence: AAG
tgatcaaatttatattccag

SEQ ID NO: 54919 - DNA, 20 bp, Artificial Sequence
  Description of Artificial Sequence: Synthetic oligonucleotide
  Target: SCN9A; (+) strand; PAM type: NRG; PAM sequence: AGG
gatcaaatttatattccaga

SEQ ID NO: 54920 - DNA, 20 bp, Artificial Sequence
  Description of Artificial Sequence: Synthetic oligonucleotide
  Target: SCN9A; (+) strand; PAM type: NRG; PAM sequence: TAG
attattatttttaaatttat

SEQ ID NO: 54921 - DNA, 20 bp, Artificial Sequence
  Description of Artificial Sequence: Synthetic oligonucleotide
  Target: SCN9A; (+) strand; PAM type: NRG; PAM sequence: AGG
ttattatttttaaatttatt

SEQ ID NO: 54922 - DNA, 20 bp, Artificial Sequence
  Description of Artificial Sequence: Synthetic oligonucleotide
  Target: SCN9A; (+) strand; PAM type: NRG; PAM sequence: CAG
attaggaatataactttgac

SEQ ID NO: 54923 - DNA, 20 bp, Artificial Sequence
  Description of Artificial Sequence: Synthetic oligonucleotide
  Target: SCN9A; (+) strand; PAM type: NRG; PAM sequence: AGG
ttaggaatataactttgacc

SEQ ID NO: 54924 - DNA, 20 bp, Artificial Sequence
  Description of Artificial Sequence: Synthetic oligonucleotide
  Target: SCN9A; (+) strand; PAM type: NRG; PAM sequence: GAG
aggaatataactttgaccag

SEQ ID NO: 54925 - DNA, 20 bp, Artificial Sequence
  Description of Artificial Sequence: Synthetic oligonucleotide
  Target: SCN9A; (+) strand; PAM type: NRG; PAM sequence: AGG
ggaatataactttgaccagg

SEQ ID NO: 54926 - DNA, 20 bp, Artificial Sequence
  Description of Artificial Sequence: Synthetic oligonucleotide
  Target: SCN9A; (+) strand; PAM type: NRG; PAM sequence: TGG
ataactttgaccaggaggct

SEQ ID NO: 54927 - DNA, 20 bp, Artificial Sequence
  Description of Artificial Sequence: Synthetic oligonucleotide
  Target: SCN9A; (+) strand; PAM type: NRG; PAM sequence: GAG
gaccaggaggcttggattct

SEQ ID NO: 54928 - DNA, 20 bp, Artificial Sequence
  Description of Artificial Sequence: Synthetic oligonucleotide
  Target: SCN9A; (+) strand; PAM type: NRG; PAM sequence: AAG
gaggcttggattctgagata

SEQ ID NO: 54929 - DNA, 20 bp, Artificial Sequence
  Description of Artificial Sequence: Synthetic oligonucleotide
  Target: SCN9A; (+) strand; PAM type: NRG; PAM sequence: AAG
cttggattctgagataaagc

SEQ ID NO: 54930 - DNA, 20 bp, Artificial Sequence
  Description of Artificial Sequence: Synthetic oligonucleotide
  Target: SCN9A; (+) strand; PAM type: NRG; PAM sequence: TAG
tctgagataaagcaagtgca

SEQ ID NO: 54931 - DNA, 20 bp, Artificial Sequence
  Description of Artificial Sequence: Synthetic oligonucleotide
  Target: SCN9A; (+) strand; PAM type: NRG; PAM sequence: AGG
ctgagataaagcaagtgcat

SEQ ID NO: 54932 - DNA, 20 bp, Artificial Sequence
  Description of Artificial Sequence: Synthetic oligonucleotide
  Target: SCN9A; (+) strand; PAM type: NRG; PAM sequence: CGG
agcaagtgcataggcaaaaa

SEQ ID NO: 54933 - DNA, 20 bp, Artificial Sequence
  Description of Artificial Sequence: Synthetic oligonucleotide
  Target: SCN9A; (+) strand; PAM type: NRG; PAM sequence: AAG
ttcacaacaattcaatgaca

SEQ ID NO: 54934 - DNA, 20 bp, Artificial Sequence
  Description of Artificial Sequence: Synthetic oligonucleotide
  Target: SCN9A; (+) strand; PAM type: NRG; PAM sequence: AGG
tcacaacaattcaatgacaa

SEQ ID NO: 54935 - DNA, 20 bp, Artificial Sequence
  Description of Artificial Sequence: Synthetic oligonucleotide
  Target: SCN9A; (+) strand; PAM type: NRG; PAM sequence: CAG
aggtgcttaacttttattta

SEQ ID NO: 54936 - DNA, 20 bp, Artificial Sequence
  Description of Artificial Sequence: Synthetic oligonucleotide
  Target: SCN9A; (+) strand; PAM type: NRG; PAM sequence: TAG
atgaaaatgcaaaatttact

SEQ ID NO: 54937 - DNA, 20 bp, Artificial Sequence
  Description of Artificial Sequence: Synthetic oligonucleotide
  Target: SCN9A; (+) strand; PAM type: NRG; PAM sequence: TGG
gcaaaatttacttagtgacc

SEQ ID NO: 54938 - DNA, 20 bp, Artificial Sequence
  Description of Artificial Sequence: Synthetic oligonucleotide
  Target: SCN9A; (+) strand; PAM type: NRG; PAM sequence: GAG
aaaatttacttagtgacctg

SEQ ID NO: 54939 - DNA, 20 bp, Artificial Sequence
  Description of Artificial Sequence: Synthetic oligonucleotide
  Target: SCN9A; (+) strand; PAM type: NRG; PAM sequence: TAG
tgacctggagtttccataaa

SEQ ID NO: 54940 - DNA, 20 bp, Artificial Sequence
  Description of Artificial Sequence: Synthetic oligonucleotide
  Target: SCN9A; (+) strand; PAM type: NRG; PAM sequence: CAG
ttcatttgcttgtaactccc

SEQ ID NO: 54941 - DNA, 20 bp, Artificial Sequence
  Description of Artificial Sequence: Synthetic oligonucleotide
  Target: SCN9A; (+) strand; PAM type: NRG; PAM sequence: TGG
atttgcttgtaactccccag

SEQ ID NO: 54942 - DNA, 20 bp, Artificial Sequence
  Description of Artificial Sequence: Synthetic oligonucleotide
  Target: SCN9A; (+) strand; PAM type: NRG; PAM sequence: GGG
tttgcttgtaactccccagt

SEQ ID NO: 54943 - DNA, 20 bp, Artificial Sequence
  Description of Artificial Sequence: Synthetic oligonucleotide
  Target: SCN9A; (+) strand; PAM type: NRG; PAM sequence: AAG
ttgtaactccccagtgggaa

SEQ ID NO: 54944 - DNA, 20 bp, Artificial Sequence
  Description of Artificial Sequence: Synthetic oligonucleotide
  Target: SCN9A; (+) strand; PAM type: NRG; PAM sequence: AGG
tgtaactccccagtgggaaa

SEQ ID NO: 54945 - DNA, 20 bp, Artificial Sequence
  Description of Artificial Sequence: Synthetic oligonucleotide
  Target: SCN9A; (+) strand; PAM type: NRG; PAM sequence: TAG
cagtgggaaaaggtattgcc

SEQ ID NO: 54946 - DNA, 20 bp, Artificial Sequence
  Description of Artificial Sequence: Synthetic oligonucleotide
  Target: SCN9A; (+) strand; PAM type: NRG; PAM sequence: AGG
agtgggaaaaggtattgcct

SEQ ID NO: 54947 - DNA, 20 bp, Artificial Sequence
  Description of Artificial Sequence: Synthetic oligonucleotide
  Target: SCN9A; (+) strand; PAM type: NRG; PAM sequence: GGG
gtgggaaaaggtattgccta

SEQ ID NO: 54948 - DNA, 20 bp, Artificial Sequence
  Description of Artificial Sequence: Synthetic oligonucleotide
  Target: SCN9A; (+) strand; PAM type: NRG; PAM sequence: GGG
tgggaaaaggtattgcctag

SEQ ID NO: 54949 - DNA, 20 bp, Artificial Sequence
  Description of Artificial Sequence: Synthetic oligonucleotide
  Target: SCN9A; (+) strand; PAM type: NRG; PAM sequence: AAG
ctaggggacttaacctccac

SEQ ID NO: 54950 - DNA, 20 bp, Artificial Sequence
  Description of Artificial Sequence: Synthetic oligonucleotide
  Target: SCN9A; (+) strand; PAM type: NRG; PAM sequence: AGG
taggggacttaacctccaca

SEQ ID NO: 54951 - DNA, 20 bp, Artificial Sequence
  Description of Artificial Sequence: Synthetic oligonucleotide
  Target: SCN9A; (+) strand; PAM type: NRG; PAM sequence: AAG
cacaaggattgtctaaaaac

SEQ ID NO: 54952 - DNA, 20 bp, Artificial Sequence
  Description of Artificial Sequence: Synthetic oligonucleotide
  Target: SCN9A; (+) strand; PAM type: NRG; PAM sequence: TGG
ctaaaaacaagaaatatctg

SEQ ID NO: 54953 - DNA, 20 bp, Artificial Sequence
  Description of Artificial Sequence: Synthetic oligonucleotide
  Target: SCN9A; (+) strand; PAM type: NRG; PAM sequence: CAG
aaacactaaccttaaaactt

SEQ ID NO: 54954 - DNA, 20 bp, Artificial Sequence
  Description of Artificial Sequence: Synthetic oligonucleotide
  Target: SCN9A; (+) strand; PAM type: NRG; PAM sequence: CGG
aaccttaaaacttcagtttt

SEQ ID NO: 54955 - DNA, 20 bp, Artificial Sequence
  Description of Artificial Sequence: Synthetic oligonucleotide
  Target: SCN9A; (+) strand; PAM type: NRG; PAM sequence: GAG
gaaaacactttaacaaaact

SEQ ID NO: 54956 - DNA, 20 bp, Artificial Sequence
  Description of Artificial Sequence: Synthetic oligonucleotide
  Target: SCN9A; (+) strand; PAM type: NRG; PAM sequence: AAG
aacaaaactgagtgaaaaat

SEQ ID NO: 54957 - DNA, 20 bp, Artificial Sequence
  Description of Artificial Sequence: Synthetic oligonucleotide
  Target: SCN9A; (+) strand; PAM type: NRG; PAM sequence: CAG
gtgactttactaaaaattaa

SEQ ID NO: 54958 - DNA, 20 bp, Artificial Sequence
  Description of Artificial Sequence: Synthetic oligonucleotide
  Target: SCN9A; (+) strand; PAM type: NRG; PAM sequence: GAG
gactttactaaaaattaaca

SEQ ID NO: 54959 - DNA, 20 bp, Artificial Sequence
  Description of Artificial Sequence: Synthetic oligonucleotide
  Target: SCN9A; (+) strand; PAM type: NRG; PAM sequence: GAG
ctttactaaaaattaacaga

SEQ ID NO: 54960 - DNA, 20 bp, Artificial Sequence
  Description of Artificial Sequence: Synthetic oligonucleotide
  Target: SCN9A; (+) strand; PAM type: NRG; PAM sequence: GAG
ttactaaaaattaacagaga

SEQ ID NO: 54961 - DNA, 20 bp, Artificial Sequence
  Description of Artificial Sequence: Synthetic oligonucleotide
  Target: SCN9A; (+) strand; PAM type: NRG; PAM sequence: AGG
tactaaaaattaacagagag

SEQ ID NO: 54962 - DNA, 20 bp, Artificial Sequence
  Description of Artificial Sequence: Synthetic oligonucleotide
  Target: SCN9A; (+) strand; PAM type: NRG; PAM sequence: GAG
ctaaaaattaacagagagag

SEQ ID NO: 54963 - DNA, 20 bp, Artificial Sequence
  Description of Artificial Sequence: Synthetic oligonucleotide
  Target: SCN9A; (+) strand; PAM type: NRG; PAM sequence: AAG
tgctttattaaaataaatct

SEQ ID NO: 54964 - DNA, 20 bp, Artificial Sequence
  Description of Artificial Sequence: Synthetic oligonucleotide
  Target: SCN9A; (+) strand; PAM type: NRG; PAM sequence: TAG
aataaatctaagattctaaa

SEQ ID NO: 54965 - DNA, 20 bp, Artificial Sequence
  Description of Artificial Sequence: Synthetic oligonucleotide
  Target: SCN9A; (+) strand; PAM type: NRG; PAM sequence: TAG
aaatctaagattctaaatag

SEQ ID NO: 54966 - DNA, 20 bp, Artificial Sequence
  Description of Artificial Sequence: Synthetic oligonucleotide
  Target: SCN9A; (+) strand; PAM type: NRG; PAM sequence: GAG
cattgatctacttgaccgtt

SEQ ID NO: 54967 - DNA, 20 bp, Artificial Sequence
  Description of Artificial Sequence: Synthetic oligonucleotide
  Target: SCN9A; (+) strand; PAM type: NRG; PAM sequence: AAG
tacttgaccgttgagaaaac

SEQ ID NO: 54968 - DNA, 20 bp, Artificial Sequence
  Description of Artificial Sequence: Synthetic oligonucleotide
  Target: SCN9A; (+) strand; PAM type: NRG; PAM sequence: TAG
tgaccgttgagaaaacaaga

SEQ ID NO: 54969 - DNA, 20 bp, Artificial Sequence
  Description of Artificial Sequence: Synthetic oligonucleotide
  Target: SCN9A; (+) strand; PAM type: NRG; PAM sequence: AAG
ttaattcaatttgtttactc

SEQ ID NO: 54970 - DNA, 20 bp, Artificial Sequence
  Description of Artificial Sequence: Synthetic oligonucleotide
  Target: SCN9A; (+) strand; PAM type: NRG; PAM sequence: AAG
aatttgtttactcaagtatt

SEQ ID NO: 54971 - DNA, 20 bp, Artificial Sequence
  Description of Artificial Sequence: Synthetic oligonucleotide
  Target: SCN9A; (+) strand; PAM type: NRG; PAM sequence: AAG
ttaagcaccttctctgtgca

SEQ ID NO: 54972 - DNA, 20 bp, Artificial Sequence
  Description of Artificial Sequence: Synthetic oligonucleotide
  Target: SCN9A; (+) strand; PAM type: NRG; PAM sequence: TGG
ctgtgcaaagccttgtaaaa

SEQ ID NO: 54973 - DNA, 20 bp, Artificial Sequence
  Description of Artificial Sequence: Synthetic oligonucleotide
  Target: SCN9A; (+) strand; PAM type: NRG; PAM sequence: TGG
gccttgtaaaatggtctgtg

SEQ ID NO: 54974 - DNA, 20 bp, Artificial Sequence
  Description of Artificial Sequence: Synthetic oligonucleotide
  Target: SCN9A; (+) strand; PAM type: NRG; PAM sequence: CAG
gtctgtgtggattacaacta

SEQ ID NO: 54975 - DNA, 20 bp, Artificial Sequence
  Description of Artificial Sequence: Synthetic oligonucleotide
  Target: SCN9A; (+) strand; PAM type: NRG; PAM sequence: TAG
ttgtttgatttaatcatatc

SEQ ID NO: 54976 - DNA, 20 bp, Artificial Sequence
  Description of Artificial Sequence: Synthetic oligonucleotide
  Target: SCN9A; (+) strand; PAM type: NRG; PAM sequence: AGG
tgtttgatttaatcatatct

SEQ ID NO: 54977 - DNA, 20 bp, Artificial Sequence
  Description of Artificial Sequence: Synthetic oligonucleotide
  Target: SCN9A; (+) strand; PAM type: NRG; PAM sequence: TAG
gatttaatcatatctaggat

SEQ ID NO: 54978 - DNA, 20 bp, Artificial Sequence
  Description of Artificial Sequence: Synthetic oligonucleotide
  Target: SCN9A; (+) strand; PAM type: NRG; PAM sequence: AAG
atatctaggattagaaaatg

SEQ ID NO: 54979 - DNA, 20 bp, Artificial Sequence
  Description of Artificial Sequence: Synthetic oligonucleotide
  Target: SCN9A; (+) strand; PAM type: NRG; PAM sequence: AGG
tatctaggattagaaaatga

SEQ ID NO: 54980 - DNA, 20 bp, Artificial Sequence
  Description of Artificial Sequence: Synthetic oligonucleotide
  Target: SCN9A; (+) strand; PAM type: NRG; PAM sequence: GGG
atctaggattagaaaatgaa

SEQ ID NO: 54981 - DNA, 20 bp, Artificial Sequence
  Description of Artificial Sequence: Synthetic oligonucleotide
  Target: SCN9A; (+) strand; PAM type: NRG; PAM sequence: TAG
gggtccctaaattcattaac

SEQ ID NO: 54982 - DNA, 20 bp, Artificial Sequence
  Description of Artificial Sequence: Synthetic oligonucleotide
  Target: SCN9A; (+) strand; PAM type: NRG; PAM sequence: TAG
ccctaaattcattaactagc

SEQ ID NO: 54983 - DNA, 20 bp, Artificial Sequence
  Description of Artificial Sequence: Synthetic oligonucleotide
  Target: SCN9A; (+) strand; PAM type: NRG; PAM sequence: AGG
cctaaattcattaactagct

SEQ ID NO: 54984 - DNA, 20 bp, Artificial Sequence
  Description of Artificial Sequence: Synthetic oligonucleotide
  Target: SCN9A; (+) strand; PAM type: NRG; PAM sequence: AAG
aattcattaactagctaggc

SEQ ID NO: 54985 - DNA, 20 bp, Artificial Sequence
  Description of Artificial Sequence: Synthetic oligonucleotide
  Target: SCN9A; (+) strand; PAM type: NRG; PAM sequence: AGG
attcattaactagctaggca

SEQ ID NO: 54986 - DNA, 20 bp, Artificial Sequence
  Description of Artificial Sequence: Synthetic oligonucleotide
  Target: SCN9A; (+) strand; PAM type: NRG; PAM sequence: CAG
gcaaggatattctttcccat

SEQ ID NO: 54987 - DNA, 20 bp, Artificial Sequence
  Description of Artificial Sequence: Synthetic oligonucleotide
  Target: SCN9A; (+) strand; PAM type: NRG; PAM sequence: AGG
caaggatattctttcccatc

SEQ ID NO: 54988 - DNA, 20 bp, Artificial Sequence
  Description of Artificial Sequence: Synthetic oligonucleotide
  Target: SCN9A; (+) strand; PAM type: NRG; PAM sequence: TAG
caggaattctcctaaattgc

SEQ ID NO: 54989 - DNA, 20 bp, Artificial Sequence
  Description of Artificial Sequence: Synthetic oligonucleotide
  Target: SCN9A; (+) strand; PAM type: NRG; PAM sequence: AAG
atatttatacaacaactcaa

SEQ ID NO: 54990 - DNA, 20 bp, Artificial Sequence
  Description of Artificial Sequence: Synthetic oligonucleotide
  Target: SCN9A; (+) strand; PAM type: NRG; PAM sequence: TGG
caactcaaaagttttaatac

SEQ ID NO: 54991 - DNA, 20 bp, Artificial Sequence
  Description of Artificial Sequence: Synthetic oligonucleotide
  Target: SCN9A; (+) strand; PAM type: NRG; PAM sequence: AAG
aagttttaatactggtataa

SEQ ID NO: 54992 - DNA, 20 bp, Artificial Sequence
  Description of Artificial Sequence: Synthetic oligonucleotide
  Target: SCN9A; (+) strand; PAM type: NRG; PAM sequence: CAG
tactggtataaaagaaaaaa

SEQ ID NO: 54993 - DNA, 20 bp, Artificial Sequence
  Description of Artificial Sequence: Synthetic oligonucleotide
  Target: SCN9A; (+) strand; PAM type: NRG; PAM sequence: TGG
cagaacaaaacaaaatgaaa

SEQ ID NO: 54994 - DNA, 20 bp, Artificial Sequence
  Description of Artificial Sequence: Synthetic oligonucleotide
  Target: SCN9A; (+) strand; PAM type: NRG; PAM sequence: GGG
agaacaaaacaaaatgaaat

SEQ ID NO: 54995 - DNA, 20 bp, Artificial Sequence
  Description of Artificial Sequence: Synthetic oligonucleotide
  Target: SCN9A; (+) strand; PAM type: NRG; PAM sequence: GAG
aacaaaacaaaatgaaatgg

SEQ ID NO: 54996 - DNA, 20 bp, Artificial Sequence
  Description of Artificial Sequence: Synthetic oligonucleotide
  Target: SCN9A; (+) strand; PAM type: NRG; PAM sequence: TGG
tgaaatgggagttcttgaaa

SEQ ID NO: 54997 - DNA, 20 bp, Artificial Sequence
  Description of Artificial Sequence: Synthetic oligonucleotide
  Target: SCN9A; (+) strand; PAM type: NRG; PAM sequence: AAG
aatgggagttcttgaaatgg

SEQ ID NO: 54998 - DNA, 20 bp, Artificial Sequence
  Description of Artificial Sequence: Synthetic oligonucleotide
  Target: SCN9A; (+) strand; PAM type: NRG; PAM sequence: AGG
atgggagttcttgaaatgga

SEQ ID NO: 54999 - DNA, 20 bp, Artificial Sequence
  Description of Artificial Sequence: Synthetic oligonucleotide
  Target: SCN9A; (+) strand; PAM type: NRG; PAM sequence: CAG
tgaaatggaaggcacatgtt

SEQ ID NO: 55000 - DNA, 20 bp, Artificial Sequence
  Description of Artificial Sequence: Synthetic oligonucleotide
  Target: SCN9A; (+) strand; PAM type: NRG; PAM sequence: GAG
aaatggaaggcacatgttca

SEQ ID NO: 55001 - DNA, 20 bp, Artificial Sequence
  Description of Artificial Sequence: Synthetic oligonucleotide
  Target: SCN9A; (+) strand; PAM type: NRG; PAM sequence: AAG
ggaaggcacatgttcagagt

SEQ ID NO: 55002 - DNA, 20 bp, Artificial Sequence
  Description of Artificial Sequence: Synthetic oligonucleotide
  Target: SCN9A; (+) strand; PAM type: NRG; PAM sequence: AGG
gaaggcacatgttcagagta

SEQ ID NO: 55003 - DNA, 20 bp, Artificial Sequence
  Description of Artificial Sequence: Synthetic oligonucleotide
  Target: SCN9A; (+) strand; PAM type: NRG; PAM sequence: CAG
tgttcagagtaaggcacatt

SEQ ID NO: 55004 - DNA, 20 bp, Artificial Sequence
  Description of Artificial Sequence: Synthetic oligonucleotide
  Target: SCN9A; (+) strand; PAM type: NRG; PAM sequence: CAG
ggcacattcagactaaaaac

SEQ ID NO: 55005 - DNA, 20 bp, Artificial Sequence
  Description of Artificial Sequence: Synthetic oligonucleotide
  Target: SCN9A; (+) strand; PAM type: NRG; PAM sequence: TGG
cagactaaaaaccagatctc

SEQ ID NO: 55006 - DNA, 20 bp, Artificial Sequence
  Description of Artificial Sequence: Synthetic oligonucleotide
  Target: SCN9A; (+) strand; PAM type: NRG; PAM sequence: GGG
agactaaaaaccagatctct

SEQ ID NO: 55007 - DNA, 20 bp, Artificial Sequence
  Description of Artificial Sequence: Synthetic oligonucleotide
  Target: SCN9A; (+) strand; PAM type: NRG; PAM sequence: GGG
gactaaaaaccagatctctg

SEQ ID NO: 55008 - DNA, 20 bp, Artificial Sequence
  Description of Artificial Sequence: Synthetic oligonucleotide
  Target: SCN9A; (+) strand; PAM type: NRG; PAM sequence: TGG
aaccagatctctggggacaa

SEQ ID NO: 55009 - DNA, 20 bp, Artificial Sequence
  Description of Artificial Sequence: Synthetic oligonucleotide
  Target: SCN9A; (+) strand; PAM type: NRG; PAM sequence: GGG
accagatctctggggacaat

SEQ ID NO: 55010 - DNA, 20 bp, Artificial Sequence
  Description of Artificial Sequence: Synthetic oligonucleotide
  Target: SCN9A; (+) strand; PAM type: NRG; PAM sequence: TGG
atctctggggacaatgggta

SEQ ID NO: 55011 - DNA, 20 bp, Artificial Sequence
  Description of Artificial Sequence: Synthetic oligonucleotide
  Target: SCN9A; (+) strand; PAM type: NRG; PAM sequence: GGG
tctctggggacaatgggtat

SEQ ID NO: 55012 - DNA, 20 bp, Artificial Sequence
  Description of Artificial Sequence: Synthetic oligonucleotide
  Target: SCN9A; (+) strand; PAM type: NRG; PAM sequence: AAG
tggggacaatgggtatggga

SEQ ID NO: 55013 - DNA, 20 bp, Artificial Sequence
  Description of Artificial Sequence: Synthetic oligonucleotide
  Target: SCN9A; (+) strand; PAM type: NRG; PAM sequence: TGG
gacaatgggtatgggaaagc

SEQ ID NO: 55014 - DNA, 20 bp, Artificial Sequence
  Description of Artificial Sequence: Synthetic oligonucleotide
  Target: SCN9A; (+) strand; PAM type: NRG; PAM sequence: TAG
gggaaagctggaaactctct

SEQ ID NO: 55015 - DNA, 20 bp, Artificial Sequence
  Description of Artificial Sequence: Synthetic oligonucleotide
  Target: SCN9A; (+) strand; PAM type: NRG; PAM sequence: GAG
gaaagctggaaactctctta

SEQ ID NO: 55016 - DNA, 20 bp, Artificial Sequence
  Description of Artificial Sequence: Synthetic oligonucleotide
  Target: SCN9A; (+) strand; PAM type: NRG; PAM sequence: TAG
cttagagtctacgaattata

SEQ ID NO: 55017 - DNA, 20 bp, Artificial Sequence
  Description of Artificial Sequence: Synthetic oligonucleotide
  Target: SCN9A; (+) strand; PAM type: NRG; PAM sequence: AGG
ttagagtctacgaattatat

SEQ ID NO: 55018 - DNA, 20 bp, Artificial Sequence
  Description of Artificial Sequence: Synthetic oligonucleotide
  Target: SCN9A; (+) strand; PAM type: NRG; PAM sequence: CAG
aaaaaatcaccaatgaatca

SEQ ID NO: 55019 - DNA, 20 bp, Artificial Sequence
  Description of Artificial Sequence: Synthetic oligonucleotide
  Target: SCN9A; (+) strand; PAM type: NRG; PAM sequence: CAG
tgaatcacagacctaaacgt

SEQ ID NO: 55020 - DNA, 20 bp, Artificial Sequence
  Description of Artificial Sequence: Synthetic oligonucleotide
  Target: SCN9A; (+) strand; PAM type: NRG; PAM sequence: GAG
aatcacagacctaaacgtca

SEQ ID NO: 55021 - DNA, 20 bp, Artificial Sequence
  Description of Artificial Sequence: Synthetic oligonucleotide
  Target: SCN9A; (+) strand; PAM type: NRG; PAM sequence: TAG
acagacctaaacgtcagagt

SEQ ID NO: 55022 - DNA, 20 bp, Artificial Sequence
  Description of Artificial Sequence: Synthetic oligonucleotide
  Target: SCN9A; (+) strand; PAM type: NRG; PAM sequence: AAG
agttagaactgtaaatttct

SEQ ID NO: 55023 - DNA, 20 bp, Artificial Sequence
  Description of Artificial Sequence: Synthetic oligonucleotide
  Target: SCN9A; (+) strand; PAM type: NRG; PAM sequence: TAG
aaatttctaagaaaatatca

SEQ ID NO: 55024 - DNA, 20 bp, Artificial Sequence
  Description of Artificial Sequence: Synthetic oligonucleotide
  Target: SCN9A; (+) strand; PAM type: NRG; PAM sequence: AGG
aatttctaagaaaatatcat

SEQ ID NO: 55025 - DNA, 20 bp, Artificial Sequence
  Description of Artificial Sequence: Synthetic oligonucleotide
  Target: SCN9A; (+) strand; PAM type: NRG; PAM sequence: GGG
atttctaagaaaatatcata

SEQ ID NO: 55026 - DNA, 20 bp, Artificial Sequence
  Description of Artificial Sequence: Synthetic oligonucleotide
  Target: SCN9A; (+) strand; PAM type: NRG; PAM sequence: GAG
tatcatagggaaaaatcttc

SEQ ID NO: 55027 - DNA, 20 bp, Artificial Sequence
  Description of Artificial Sequence: Synthetic oligonucleotide
  Target: SCN9A; (+) strand; PAM type: NRG; PAM sequence: TAG
gggaaaaatcttcgagacat

SEQ ID NO: 55028 - DNA, 20 bp, Artificial Sequence
  Description of Artificial Sequence: Synthetic oligonucleotide
  Target: SCN9A; (+) strand; PAM type: NRG; PAM sequence: TGG
aatcttcgagacattagatt

SEQ ID NO: 55029 - DNA, 20 bp, Artificial Sequence
  Description of Artificial Sequence: Synthetic oligonucleotide
  Target: SCN9A; (+) strand; PAM type: NRG; PAM sequence: TGG
gagacattagatttggcaca

SEQ ID NO: 55030 - DNA, 20 bp, Artificial Sequence
  Description of Artificial Sequence: Synthetic oligonucleotide
  Target: SCN9A; (+) strand; PAM type: NRG; PAM sequence: TGG
ttagatttggcacatggaca

SEQ ID NO: 55031 - DNA, 20 bp, Artificial Sequence
  Description of Artificial Sequence: Synthetic oligonucleotide
  Target: SCN9A; (+) strand; PAM type: NRG; PAM sequence: AAG
gcacatggacatggaaccaa

SEQ ID NO: 55032 - DNA, 20 bp, Artificial Sequence
  Description of Artificial Sequence: Synthetic oligonucleotide
  Target: SCN9A; (+) strand; PAM type: NRG; PAM sequence: CGG
tggacatggaaccaaaagca

SEQ ID NO: 55033 - DNA, 20 bp, Artificial Sequence
  Description of Artificial Sequence: Synthetic oligonucleotide
  Target: SCN9A; (+) strand; PAM type: NRG; PAM sequence: AAG
accaaaagcacggtcaacaa

SEQ ID NO: 55034 - DNA, 20 bp, Artificial Sequence
  Description of Artificial Sequence: Synthetic oligonucleotide
  Target: SCN9A; (+) strand; PAM type: NRG; PAM sequence: AAG
cacggtcaacaaaagaaaaa

SEQ ID NO: 55035 - DNA, 20 bp, Artificial Sequence
  Description of Artificial Sequence: Synthetic oligonucleotide
  Target: SCN9A; (+) strand; PAM type: NRG; PAM sequence: GAG
cggtcaacaaaagaaaaaaa

SEQ ID NO: 55036 - DNA, 20 bp, Artificial Sequence
  Description of Artificial Sequence: Synthetic oligonucleotide
  Target: SCN9A; (+) strand; PAM type: NRG; PAM sequence: TGG
aaagaaaaaaagagctgaat

SEQ ID NO: 55037 - DNA, 20 bp, Artificial Sequence
  Description of Artificial Sequence: Synthetic oligonucleotide
  Target: SCN9A; (+) strand; PAM type: NRG; PAM sequence: AAG
attgaaactgttgtgcatca

SEQ ID NO: 55038 - DNA, 20 bp, Artificial Sequence
  Description of Artificial Sequence: Synthetic oligonucleotide
  Target: SCN9A; (+) strand; PAM type: NRG; PAM sequence: TAG
tgtgcatcaaagaacactac

SEQ ID NO: 55039 - DNA, 20 bp, Artificial Sequence
  Description of Artificial Sequence: Synthetic oligonucleotide
  Target: SCN9A; (+) strand; PAM type: NRG; PAM sequence: AAG
catcaaagaacactactaga

SEQ ID NO: 55040 - DNA, 20 bp, Artificial Sequence
  Description of Artificial Sequence: Synthetic oligonucleotide
  Target: SCN9A; (+) strand; PAM type: NRG; PAM sequence: AAG
gaacactactagaaagtgaa

SEQ ID NO: 55041 - DNA, 20 bp, Artificial Sequence
  Description of Artificial Sequence: Synthetic oligonucleotide
  Target: SCN9A; (+) strand; PAM type: NRG; PAM sequence: AGG
aacactactagaaagtgaaa

SEQ ID NO: 55042 - DNA, 20 bp, Artificial Sequence
  Description of Artificial Sequence: Synthetic oligonucleotide
  Target: SCN9A; (+) strand; PAM type: NRG; PAM sequence: TGG
tgaaaaggcaatccatatga

SEQ ID NO: 55043 - DNA, 20 bp, Artificial Sequence
  Description of Artificial Sequence: Synthetic oligonucleotide
  Target: SCN9A; (+) strand; PAM type: NRG; PAM sequence: GGG
gaaaaggcaatccatatgat

SEQ ID NO: 55044 - DNA, 20 bp, Artificial Sequence
  Description of Artificial Sequence: Synthetic oligonucleotide
  Target: SCN9A; (+) strand; PAM type: NRG; PAM sequence: GAG
aaaggcaatccatatgatgg

SEQ ID NO: 55045 - DNA, 20 bp, Artificial Sequence
  Description of Artificial Sequence: Synthetic oligonucleotide
  Target: SCN9A; (+) strand; PAM type: NRG; PAM sequence: AAG
ttgcaaatcatatatctgat

SEQ ID NO: 55046 - DNA, 20 bp, Artificial Sequence
  Description of Artificial Sequence: Synthetic oligonucleotide
  Target: SCN9A; (+) strand; PAM type: NRG; PAM sequence: AGG
tgcaaatcatatatctgata

SEQ ID NO: 55047 - DNA, 20 bp, Artificial Sequence
  Description of Artificial Sequence: Synthetic oligonucleotide
  Target: SCN9A; (+) strand; PAM type: NRG; PAM sequence: GGG
gcaaatcatatatctgataa

SEQ ID NO: 55048 - DNA, 20 bp, Artificial Sequence
  Description of Artificial Sequence: Synthetic oligonucleotide
  Target: SCN9A; (+) strand; PAM type: NRG; PAM sequence: TGG
atctgataagggattaacat

SEQ ID NO: 55049 - DNA, 20 bp, Artificial Sequence
  Description of Artificial Sequence: Synthetic oligonucleotide
  Target: SCN9A; (+) strand; PAM type: NRG; PAM sequence: AAG
ctcctcaacaaaaaataaac

SEQ ID NO: 55050 - DNA, 20 bp, Artificial Sequence
  Description of Artificial Sequence: Synthetic oligonucleotide
  Target: SCN9A; (+) strand; PAM type: NRG; PAM sequence: CAG
ctcaacaaaaaataaacaag

SEQ ID NO: 55051 - DNA, 20 bp, Artificial Sequence
  Description of Artificial Sequence: Synthetic oligonucleotide
  Target: SCN9A; (+) strand; PAM type: NRG; PAM sequence: AAG
aagcagattaaaaatgaaca

SEQ ID NO: 55052 - DNA, 20 bp, Artificial Sequence
  Description of Artificial Sequence: Synthetic oligonucleotide
  Target: SCN9A; (+) strand; PAM type: NRG; PAM sequence: AGG
agcagattaaaaatgaacaa

SEQ ID NO: 55053 - DNA, 20 bp, Artificial Sequence
  Description of Artificial Sequence: Synthetic oligonucleotide
  Target: SCN9A; (+) strand; PAM type: NRG; PAM sequence: AAG
aaatgaacaaaggatttgaa

SEQ ID NO: 55054 - DNA, 20 bp, Artificial Sequence
  Description of Artificial Sequence: Synthetic oligonucleotide
  Target: SCN9A; (+) strand; PAM type: NRG; PAM sequence: AAG
tttgaaaagacatttttcca

SEQ ID NO: 55055 - DNA, 20 bp, Artificial Sequence
  Description of Artificial Sequence: Synthetic oligonucleotide
  Target: SCN9A; (+) strand; PAM type: NRG; PAM sequence: AAG
aaaagacatttttccaaaga

SEQ ID NO: 55056 - DNA, 20 bp, Artificial Sequence
  Description of Artificial Sequence: Synthetic oligonucleotide
  Target: SCN9A; (+) strand; PAM type: NRG; PAM sequence: CAG
tttttccaaagaaagtcaat

SEQ ID NO: 55057 - DNA, 20 bp, Artificial Sequence
  Description of Artificial Sequence: Synthetic oligonucleotide
  Target: SCN9A; (+) strand; PAM type: NRG; PAM sequence: TGG
aaagaaagtcaatcagtaca

SEQ ID NO: 55058 - DNA, 20 bp, Artificial Sequence
  Description of Artificial Sequence: Synthetic oligonucleotide
  Target: SCN9A; (+) strand; PAM type: NRG; PAM sequence: GGG
aagaaagtcaatcagtacat

SEQ ID NO: 55059 - DNA, 20 bp, Artificial Sequence
  Description of Artificial Sequence: Synthetic oligonucleotide
  Target: SCN9A; (+) strand; PAM type: NRG; PAM sequence: AAG
aaagtcaatcagtacatggg

SEQ ID NO: 55060 - DNA, 20 bp, Artificial Sequence
  Description of Artificial Sequence: Synthetic oligonucleotide
  Target: SCN9A; (+) strand; PAM type: NRG; PAM sequence: TGG
gctcaacatcaccgatcatt

SEQ ID NO: 55061 - DNA, 20 bp, Artificial Sequence
  Description of Artificial Sequence: Synthetic oligonucleotide
  Target: SCN9A; (+) strand; PAM type: NRG; PAM sequence: GGG
ctcaacatcaccgatcattt

SEQ ID NO: 55062 - DNA, 20 bp, Artificial Sequence
  Description of Artificial Sequence: Synthetic oligonucleotide
  Target: SCN9A; (+) strand; PAM type: NRG; PAM sequence: TGG
ataaaatatcacttcacact

SEQ ID NO: 55063 - DNA, 20 bp, Artificial Sequence
  Description of Artificial Sequence: Synthetic oligonucleotide
  Target: SCN9A; (+) strand; PAM type: NRG; PAM sequence: CGG
aatatcacttcacacttggt

SEQ ID NO: 55064 - DNA, 20 bp, Artificial Sequence
  Description of Artificial Sequence: Synthetic oligonucleotide
  Target: SCN9A; (+) strand; PAM type: NRG; PAM sequence: TGG
tcacttcacacttggtcgga

SEQ ID NO: 55065 - DNA, 20 bp, Artificial Sequence
  Description of Artificial Sequence: Synthetic oligonucleotide
  Target: SCN9A; (+) strand; PAM type: NRG; PAM sequence: AAG
gttattgtttaaaaaaaaaa

SEQ ID NO: 55066 - DNA, 20 bp, Artificial Sequence
  Description of Artificial Sequence: Synthetic oligonucleotide
  Target: SCN9A; (+) strand; PAM type: NRG; PAM sequence: AGG
ttattgtttaaaaaaaaaaa

SEQ ID NO: 55067 - DNA, 20 bp, Artificial Sequence
  Description of Artificial Sequence: Synthetic oligonucleotide
  Target: SCN9A; (+) strand; PAM type: NRG; PAM sequence: AAG
gtttaaaaaaaaaaaaggaa

SEQ ID NO: 55068 - DNA, 20 bp, Artificial Sequence
  Description of Artificial Sequence: Synthetic oligonucleotide
  Target: SCN9A; (+) strand; PAM type: NRG; PAM sequence: AAG
aaaggaaaagaaacattgac

SEQ ID NO: 55069 - DNA, 20 bp, Artificial Sequence
  Description of Artificial Sequence: Synthetic oligonucleotide
  Target: SCN9A; (+) strand; PAM type: NRG; PAM sequence: AGG
aaggaaaagaaacattgaca

SEQ ID NO: 55070 - DNA, 20 bp, Artificial Sequence
  Description of Artificial Sequence: Synthetic oligonucleotide
  Target: SCN9A; (+) strand; PAM type: NRG; PAM sequence: GGG
aggaaaagaaacattgacaa

SEQ ID NO: 55071 - DNA, 20 bp, Artificial Sequence
  Description of Artificial Sequence: Synthetic oligonucleotide
  Target: SCN9A; (+) strand; PAM type: NRG; PAM sequence: TGG
aagaaacattgacaagggtg

SEQ ID NO: 55072 - DNA, 20 bp, Artificial Sequence
  Description of Artificial Sequence: Synthetic oligonucleotide
  Target: SCN9A; (+) strand; PAM type: NRG; PAM sequence: GAG
gaaacattgacaagggtgtg

SEQ ID NO: 55073 - DNA, 20 bp, Artificial Sequence
  Description of Artificial Sequence: Synthetic oligonucleotide
  Target: SCN9A; (+) strand; PAM type: NRG; PAM sequence: TAG
taacccttgtgcattgctga

SEQ ID NO: 55074 - DNA, 20 bp, Artificial Sequence
  Description of Artificial Sequence: Synthetic oligonucleotide
  Target: SCN9A; (+) strand; PAM type: NRG; PAM sequence: AGG
aacccttgtgcattgctgat

SEQ ID NO: 55075 - DNA, 20 bp, Artificial Sequence
  Description of Artificial Sequence: Synthetic oligonucleotide
  Target: SCN9A; (+) strand; PAM type: NRG; PAM sequence: TAG
ttgctgataggaatataaaa

SEQ ID NO: 55076 - DNA, 20 bp, Artificial Sequence
  Description of Artificial Sequence: Synthetic oligonucleotide
  Target: SCN9A; (+) strand; PAM type: NRG; PAM sequence: CAG
gataggaatataaaatagtg

SEQ ID NO: 55077 - DNA, 20 bp, Artificial Sequence
  Description of Artificial Sequence: Synthetic oligonucleotide
  Target: SCN9A; (+) strand; PAM type: NRG; PAM sequence: TGG
ataaaatagtgcagctgctg

SEQ ID NO: 55078 - DNA, 20 bp, Artificial Sequence
  Description of Artificial Sequence: Synthetic oligonucleotide
  Target: SCN9A; (+) strand; PAM type: NRG; PAM sequence: TGG
agctgctgtggaaaacactg

SEQ ID NO: 55079 - DNA, 20 bp, Artificial Sequence
  Description of Artificial Sequence: Synthetic oligonucleotide
  Target: SCN9A; (+) strand; PAM type: NRG; PAM sequence: TGG
tgctgtggaaaacactgtgg

SEQ ID NO: 55080 - DNA, 20 bp, Artificial Sequence
  Description of Artificial Sequence: Synthetic oligonucleotide
  Target: SCN9A; (+) strand; PAM type: NRG; PAM sequence: CAG
tggttcctcaaaaaattaaa

SEQ ID NO: 55081 - DNA, 20 bp, Artificial Sequence
  Description of Artificial Sequence: Synthetic oligonucleotide
  Target: SCN9A; (+) strand; PAM type: NRG; PAM sequence: CAG
aacagaaatatcacatgatc

SEQ ID NO: 55082 - DNA, 20 bp, Artificial Sequence
  Description of Artificial Sequence: Synthetic oligonucleotide
  Target: SCN9A; (+) strand; PAM type: NRG; PAM sequence: TAG
atgatccagcaattctactt

SEQ ID NO: 55083 - DNA, 20 bp, Artificial Sequence
  Description of Artificial Sequence: Synthetic oligonucleotide
  Target: SCN9A; (+) strand; PAM type: NRG; PAM sequence: AGG
tgatccagcaattctacttt

SEQ ID NO: 55084 - DNA, 20 bp, Artificial Sequence
  Description of Artificial Sequence: Synthetic oligonucleotide
  Target: SCN9A; (+) strand; PAM type: NRG; PAM sequence: GGG
gatccagcaattctacttta

SEQ ID NO: 55085 - DNA, 20 bp, Artificial Sequence
  Description of Artificial Sequence: Synthetic oligonucleotide
  Target: SCN9A; (+) strand; PAM type: NRG; PAM sequence: TAG
tatacatcctaaacaattaa

SEQ ID NO: 55086 - DNA, 20 bp, Artificial Sequence
  Description of Artificial Sequence: Synthetic oligonucleotide
  Target: SCN9A; (+) strand; PAM type: NRG; PAM sequence: AAG
acatcctaaacaattaatag

SEQ ID NO: 55087 - DNA, 20 bp, Artificial Sequence
  Description of Artificial Sequence: Synthetic oligonucleotide
  Target: SCN9A; (+) strand; PAM type: NRG; PAM sequence: AGG
catcctaaacaattaataga

SEQ ID NO: 55088 - DNA, 20 bp, Artificial Sequence
  Description of Artificial Sequence: Synthetic oligonucleotide
  Target: SCN9A; (+) strand; PAM type: NRG; PAM sequence: GGG
atcctaaacaattaatagaa

SEQ ID NO: 55089 - DNA, 20 bp, Artificial Sequence
  Description of Artificial Sequence: Synthetic oligonucleotide
  Target: SCN9A; (+) strand; PAM type: NRG; PAM sequence: TAG
attaatagaagggacgcatg

SEQ ID NO: 55090 - DNA, 20 bp, Artificial Sequence
  Description of Artificial Sequence: Synthetic oligonucleotide
  Target: SCN9A; (+) strand; PAM type: NRG; PAM sequence: TAG
tatctgtacaccaatgttca

SEQ ID NO: 55091 - DNA, 20 bp, Artificial Sequence
  Description of Artificial Sequence: Synthetic oligonucleotide
  Target: SCN9A; (+) strand; PAM type: NRG; PAM sequence: CAG
ctgtacaccaatgttcatag

SEQ ID NO: 55092 - DNA, 20 bp, Artificial Sequence
  Description of Artificial Sequence: Synthetic oligonucleotide
  Target: SCN9A; (+) strand; PAM type: NRG; PAM sequence: CAG
gttcatagcagcactaatca

SEQ ID NO: 55093 - DNA, 20 bp, Artificial Sequence
  Description of Artificial Sequence: Synthetic oligonucleotide
  Target: SCN9A; (+) strand; PAM type: NRG; PAM sequence: TAG
catagcagcactaatcacag

SEQ ID NO: 55094 - DNA, 20 bp, Artificial Sequence
  Description of Artificial Sequence: Synthetic oligonucleotide
  Target: SCN9A; (+) strand; PAM type: NRG; PAM sequence: AAG
cactaatcacagtagccaaa

SEQ ID NO: 55095 - DNA, 20 bp, Artificial Sequence
  Description of Artificial Sequence: Synthetic oligonucleotide
  Target: SCN9A; (+) strand; PAM type: NRG; PAM sequence: CAG
acaacccaaatgtctatcaa

SEQ ID NO: 55096 - DNA, 20 bp, Artificial Sequence
  Description of Artificial Sequence: Synthetic oligonucleotide
  Target: SCN9A; (+) strand; PAM type: NRG; PAM sequence: CAG
aatgtctatcaacagatgaa

SEQ ID NO: 55097 - DNA, 20 bp, Artificial Sequence
  Description of Artificial Sequence: Synthetic oligonucleotide
  Target: SCN9A; (+) strand; PAM type: NRG; PAM sequence: CAG
atgcacaataaaatactaca

SEQ ID NO: 55098 - DNA, 20 bp, Artificial Sequence
  Description of Artificial Sequence: Synthetic oligonucleotide
  Target: SCN9A; (+) strand; PAM type: NRG; PAM sequence: CGG
ttctgatatatgctacgacc

SEQ ID NO: 55099 - DNA, 20 bp, Artificial Sequence
  Description of Artificial Sequence: Synthetic oligonucleotide
  Target: SCN9A; (+) strand; PAM type: NRG; PAM sequence: AAG
caccttgaaaacattatgct

SEQ ID NO: 55100 - DNA, 20 bp, Artificial Sequence
  Description of Artificial Sequence: Synthetic oligonucleotide
  Target: SCN9A; (+) strand; PAM type: NRG; PAM sequence: AAG
aacattatgctaagtgaaat

SEQ ID NO: 55101 - DNA, 20 bp, Artificial Sequence
  Description of Artificial Sequence: Synthetic oligonucleotide
  Target: SCN9A; (+) strand; PAM type: NRG; PAM sequence: CAG
ttatgctaagtgaaataagc

SEQ ID NO: 55102 - DNA, 20 bp, Artificial Sequence
  Description of Artificial Sequence: Synthetic oligonucleotide
  Target: SCN9A; (+) strand; PAM type: NRG; PAM sequence: AAG
tgaaataagccagacatgaa

SEQ ID NO: 55103 - DNA, 20 bp, Artificial Sequence
  Description of Artificial Sequence: Synthetic oligonucleotide
  Target: SCN9A; (+) strand; PAM type: NRG; PAM sequence: TAG
acatgaaaagacaaatgcta

SEQ ID NO: 55104 - DNA, 20 bp, Artificial Sequence
  Description of Artificial Sequence: Synthetic oligonucleotide
  Target: SCN9A; (+) strand; PAM type: NRG; PAM sequence: AGG
catgaaaagacaaatgctat

SEQ ID NO: 55105 - DNA, 20 bp, Artificial Sequence
  Description of Artificial Sequence: Synthetic oligonucleotide
  Target: SCN9A; (+) strand; PAM type: NRG; PAM sequence: GGG
atgaaaagacaaatgctata

SEQ ID NO: 55106 - DNA, 20 bp, Artificial Sequence
  Description of Artificial Sequence: Synthetic oligonucleotide
  Target: SCN9A; (+) strand; PAM type: NRG; PAM sequence: GAG
ctatagggttccacttacat

SEQ ID NO: 55107 - DNA, 20 bp, Artificial Sequence
  Description of Artificial Sequence: Synthetic oligonucleotide
  Target: SCN9A; (+) strand; PAM type: NRG; PAM sequence: AGG
tatagggttccacttacatg

SEQ ID NO: 55108 - DNA, 20 bp, Artificial Sequence
  Description of Artificial Sequence: Synthetic oligonucleotide
  Target: SCN9A; (+) strand; PAM type: NRG; PAM sequence: TAG
ttccacttacatgaggtacc

SEQ ID NO: 55109 - DNA, 20 bp, Artificial Sequence
  Description of Artificial Sequence: Synthetic oligonucleotide
  Target: SCN9A; (+) strand; PAM type: NRG; PAM sequence: TAG
cttacatgaggtacctagaa

SEQ ID NO: 55110 - DNA, 20 bp, Artificial Sequence
  Description of Artificial Sequence: Synthetic oligonucleotide
  Target: SCN9A; (+) strand; PAM type: NRG; PAM sequence: TAG
acctagaatagtcacattca

SEQ ID NO: 55111 - DNA, 20 bp, Artificial Sequence
  Description of Artificial Sequence: Synthetic oligonucleotide
  Target: SCN9A; (+) strand; PAM type: NRG; PAM sequence: GAG
ctagaatagtcacattcata

SEQ ID NO: 55112 - DNA, 20 bp, Artificial Sequence
  Description of Artificial Sequence: Synthetic oligonucleotide
  Target: SCN9A; (+) strand; PAM type: NRG; PAM sequence: AAG
aatagtcacattcatagaga

SEQ ID NO: 55113 - DNA, 20 bp, Artificial Sequence
  Description of Artificial Sequence: Synthetic oligonucleotide
  Target: SCN9A; (+) strand; PAM type: NRG; PAM sequence: TAG
agtcacattcatagagaaag

SEQ ID NO: 55114 - DNA, 20 bp, Artificial Sequence
  Description of Artificial Sequence: Synthetic oligonucleotide
  Target: SCN9A; (+) strand; PAM type: NRG; PAM sequence: TAG
cattcatagagaaagtagaa

SEQ ID NO: 55115 - DNA, 20 bp, Artificial Sequence
  Description of Artificial Sequence: Synthetic oligonucleotide
  Target: SCN9A; (+) strand; PAM type: NRG; PAM sequence: TGG
tcatagagaaagtagaatag

SEQ ID NO: 55116 - DNA, 20 bp, Artificial Sequence
  Description of Artificial Sequence: Synthetic oligonucleotide
  Target: SCN9A; (+) strand; PAM type: NRG; PAM sequence: TGG
gaaagtagaatagtggttac

SEQ ID NO: 55117 - DNA, 20 bp, Artificial Sequence
  Description of Artificial Sequence: Synthetic oligonucleotide
  Target: SCN9A; (+) strand; PAM type: NRG; PAM sequence: GGG
aaagtagaatagtggttact

SEQ ID NO: 55118 - DNA, 20 bp, Artificial Sequence
  Description of Artificial Sequence: Synthetic oligonucleotide
  Target: SCN9A; (+) strand; PAM type: NRG; PAM sequence: TAG
gaatagtggttactgggtga

SEQ ID NO: 55119 - DNA, 20 bp, Artificial Sequence
  Description of Artificial Sequence: Synthetic oligonucleotide
  Target: SCN9A; (+) strand; PAM type: NRG; PAM sequence: AGG
aatagtggttactgggtgat

SEQ ID NO: 55120 - DNA, 20 bp, Artificial Sequence
  Description of Artificial Sequence: Synthetic oligonucleotide
  Target: SCN9A; (+) strand; PAM type: NRG; PAM sequence: GGG
atagtggttactgggtgata

SEQ ID NO: 55121 - DNA, 20 bp, Artificial Sequence
  Description of Artificial Sequence: Synthetic oligonucleotide
  Target: SCN9A; (+) strand; PAM type: NRG; PAM sequence: GGG
tagtggttactgggtgatag

SEQ ID NO: 55122 - DNA, 20 bp, Artificial Sequence
  Description of Artificial Sequence: Synthetic oligonucleotide
  Target: SCN9A; (+) strand; PAM type: NRG; PAM sequence: AAG
tggttactgggtgatagggg

SEQ ID NO: 55123 - DNA, 20 bp, Artificial Sequence
  Description of Artificial Sequence: Synthetic oligonucleotide
  Target: SCN9A; (+) strand; PAM type: NRG; PAM sequence: GAG
gttactgggtgataggggaa

SEQ ID NO: 55124 - DNA, 20 bp, Artificial Sequence
  Description of Artificial Sequence: Synthetic oligonucleotide
  Target: SCN9A; (+) strand; PAM type: NRG; PAM sequence: GAG
tactgggtgataggggaaga

SEQ ID NO: 55125 - DNA, 20 bp, Artificial Sequence
  Description of Artificial Sequence: Synthetic oligonucleotide
  Target: SCN9A; (+) strand; PAM type: NRG; PAM sequence: AGG
actgggtgataggggaagag

SEQ ID NO: 55126 - DNA, 20 bp, Artificial Sequence
  Description of Artificial Sequence: Synthetic oligonucleotide
  Target: SCN9A; (+) strand; PAM type: NRG; PAM sequence: GAG
tgggtgataggggaagagag

SEQ ID NO: 55127 - DNA, 20 bp, Artificial Sequence
  Description of Artificial Sequence: Synthetic oligonucleotide
  Target: SCN9A; (+) strand; PAM type: NRG; PAM sequence: TGG
gataggggaagagaggagtg

SEQ ID NO: 55128 - DNA, 20 bp, Artificial Sequence
  Description of Artificial Sequence: Synthetic oligonucleotide
  Target: SCN9A; (+) strand; PAM type: NRG; PAM sequence: GAG
taggggaagagaggagtgtg

SEQ ID NO: 55129 - DNA, 20 bp, Artificial Sequence
  Description of Artificial Sequence: Synthetic oligonucleotide
  Target: SCN9A; (+) strand; PAM type: NRG; PAM sequence: TAG
agtgtggagtcattgtttaa

SEQ ID NO: 55130 - DNA, 20 bp, Artificial Sequence
  Description of Artificial Sequence: Synthetic oligonucleotide
  Target: SCN9A; (+) strand; PAM type: NRG; PAM sequence: GAG
gtcattgtttaatagttacc

SEQ ID NO: 55131 - DNA, 20 bp, Artificial Sequence
  Description of Artificial Sequence: Synthetic oligonucleotide
  Target: SCN9A; (+) strand; PAM type: NRG; PAM sequence: TGG
atagttaccgagtttttgtt

SEQ ID NO: 55132 - DNA, 20 bp, Artificial Sequence
  Description of Artificial Sequence: Synthetic oligonucleotide
  Target: SCN9A; (+) strand; PAM type: NRG; PAM sequence: AAG
ggaatgatgaaaatgttctg

SEQ ID NO: 55133 - DNA, 20 bp, Artificial Sequence
  Description of Artificial Sequence: Synthetic oligonucleotide
  Target: SCN9A; (+) strand; PAM type: NRG; PAM sequence: TGG
tgatgaaaatgttctgaaga

SEQ ID NO: 55134 - DNA, 20 bp, Artificial Sequence
  Description of Artificial Sequence: Synthetic oligonucleotide
  Target: SCN9A; (+) strand; PAM type: NRG; PAM sequence: TGG
gaaaatgttctgaagatgga

SEQ ID NO: 55135 - DNA, 20 bp, Artificial Sequence
  Description of Artificial Sequence: Synthetic oligonucleotide
  Target: SCN9A; (+) strand; PAM type: NRG; PAM sequence: TGG
aatgttctgaagatggatgg

SEQ ID NO: 55136 - DNA, 20 bp, Artificial Sequence
  Description of Artificial Sequence: Synthetic oligonucleotide
  Target: SCN9A; (+) strand; PAM type: NRG; PAM sequence: TGG
tctaaactgtacatttgaaa

SEQ ID NO: 55137 - DNA, 20 bp, Artificial Sequence
  Description of Artificial Sequence: Synthetic oligonucleotide
  Target: SCN9A; (+) strand; PAM type: NRG; PAM sequence: TGG
tacatttgaaatggttaaaa

SEQ ID NO: 55138 - DNA, 20 bp, Artificial Sequence
  Description of Artificial Sequence: Synthetic oligonucleotide
  Target: SCN9A; (+) strand; PAM type: NRG; PAM sequence: TAG
atataaatttttaaattcac

SEQ ID NO: 55139 - DNA, 20 bp, Artificial Sequence
  Description of Artificial Sequence: Synthetic oligonucleotide
  Target: SCN9A; (+) strand; PAM type: NRG; PAM sequence: GAG
taaattcactagcgtgtttt

SEQ ID NO: 55140 - DNA, 20 bp, Artificial Sequence
  Description of Artificial Sequence: Synthetic oligonucleotide
  Target: SCN9A; (+) strand; PAM type: NRG; PAM sequence: AAG
tagcgtgttttgagatccgt

SEQ ID NO: 55141 - DNA, 20 bp, Artificial Sequence
  Description of Artificial Sequence: Synthetic oligonucleotide
  Target: SCN9A; (+) strand; PAM type: NRG; PAM sequence: AGG
agcgtgttttgagatccgta

SEQ ID NO: 55142 - DNA, 20 bp, Artificial Sequence
  Description of Artificial Sequence: Synthetic oligonucleotide
  Target: SCN9A; (+) strand; PAM type: NRG; PAM sequence: CAG
gtgttttgagatccgtaagg

SEQ ID NO: 55143 - DNA, 20 bp, Artificial Sequence
  Description of Artificial Sequence: Synthetic oligonucleotide
  Target: SCN9A; (+) strand; PAM type: NRG; PAM sequence: AAG
tttgagatccgtaaggcaga

SEQ ID NO: 55144 - DNA, 20 bp, Artificial Sequence
  Description of Artificial Sequence: Synthetic oligonucleotide
  Target: SCN9A; (+) strand; PAM type: NRG; PAM sequence: GAG
tgagatccgtaaggcagaaa

SEQ ID NO: 55145 - DNA, 20 bp, Artificial Sequence
  Description of Artificial Sequence: Synthetic oligonucleotide
  Target: SCN9A; (+) strand; PAM type: NRG; PAM sequence: CAG
atccgtaaggcagaaagagt

SEQ ID NO: 55146 - DNA, 20 bp, Artificial Sequence
  Description of Artificial Sequence: Synthetic oligonucleotide
  Target: SCN9A; (+) strand; PAM type: NRG; PAM sequence: AAG
gtaaggcagaaagagtcagt

SEQ ID NO: 55147 - DNA, 20 bp, Artificial Sequence
  Description of Artificial Sequence: Synthetic oligonucleotide
  Target: SCN9A; (+) strand; PAM type: NRG; PAM sequence: GAG
aaggcagaaagagtcagtaa

SEQ ID NO: 55148 - DNA, 20 bp, Artificial Sequence
  Description of Artificial Sequence: Synthetic oligonucleotide
  Target: SCN9A; (+) strand; PAM type: NRG; PAM sequence: CAG
tcagtaagagaacaaaatca

SEQ ID NO: 55149 - DNA, 20 bp, Artificial Sequence
  Description of Artificial Sequence: Synthetic oligonucleotide
  Target: SCN9A; (+) strand; PAM type: NRG; PAM sequence: CAG
gtaagagaacaaaatcacag

SEQ ID NO: 55150 - DNA, 20 bp, Artificial Sequence
  Description of Artificial Sequence: Synthetic oligonucleotide
  Target: SCN9A; (+) strand; PAM type: NRG; PAM sequence: TAG
gagaacaaaatcacagcagt

SEQ ID NO: 55151 - DNA, 20 bp, Artificial Sequence
  Description of Artificial Sequence: Synthetic oligonucleotide
  Target: SCN9A; (+) strand; PAM type: NRG; PAM sequence: CGG
aaatcacagcagttagcaac

SEQ ID NO: 55152 - DNA, 20 bp, Artificial Sequence
  Description of Artificial Sequence: Synthetic oligonucleotide
  Target: SCN9A; (+) strand; PAM type: NRG; PAM sequence: CGG
cggtcaaccctgacaacatg

SEQ ID NO: 55153 - DNA, 20 bp, Artificial Sequence
  Description of Artificial Sequence: Synthetic oligonucleotide
  Target: SCN9A; (+) strand; PAM type: NRG; PAM sequence: TGG
gacaacatgcggtgtctcct

SEQ ID NO: 55154 - DNA, 20 bp, Artificial Sequence
  Description of Artificial Sequence: Synthetic oligonucleotide
  Target: SCN9A; (+) strand; PAM type: NRG; PAM sequence: TAG
ctccttggtatctgttttgc

SEQ ID NO: 55155 - DNA, 20 bp, Artificial Sequence
  Description of Artificial Sequence: Synthetic oligonucleotide
  Target: SCN9A; (+) strand; PAM type: NRG; PAM sequence: AGG
tccttggtatctgttttgct

SEQ ID NO: 55156 - DNA, 20 bp, Artificial Sequence
  Description of Artificial Sequence: Synthetic oligonucleotide
  Target: SCN9A; (+) strand; PAM type: NRG; PAM sequence: CAG
ttggtatctgttttgctagg

SEQ ID NO: 55157 - DNA, 20 bp, Artificial Sequence
  Description of Artificial Sequence: Synthetic oligonucleotide
  Target: SCN9A; (+) strand; PAM type: NRG; PAM sequence: TAG
gtatctgttttgctaggcag

SEQ ID NO: 55158 - DNA, 20 bp, Artificial Sequence
  Description of Artificial Sequence: Synthetic oligonucleotide
  Target: SCN9A; (+) strand; PAM type: NRG; PAM sequence: CAG
agtagtcatttatatctatg

SEQ ID NO: 55159 - DNA, 20 bp, Artificial Sequence
  Description of Artificial Sequence: Synthetic oligonucleotide
  Target: SCN9A; (+) strand; PAM type: NRG; PAM sequence: GAG
atgcagtaccactatttcat

SEQ ID NO: 55160 - DNA, 20 bp, Artificial Sequence
  Description of Artificial Sequence: Synthetic oligonucleotide
  Target: SCN9A; (+) strand; PAM type: NRG; PAM sequence: AAG
attactgtactcccaccatt

SEQ ID NO: 55161 - DNA, 20 bp, Artificial Sequence
  Description of Artificial Sequence: Synthetic oligonucleotide
  Target: SCN9A; (+) strand; PAM type: NRG; PAM sequence: AAG
ttccaaaatgcaaacattta

SEQ ID NO: 55162 - DNA, 20 bp, Artificial Sequence
  Description of Artificial Sequence: Synthetic oligonucleotide
  Target: SCN9A; (+) strand; PAM type: NRG; PAM sequence: TAG
aattgtaatctttgtcttat

SEQ ID NO: 55163 - DNA, 20 bp, Artificial Sequence
  Description of Artificial Sequence: Synthetic oligonucleotide
  Target: SCN9A; (+) strand; PAM type: NRG; PAM sequence: TAG
gccctgccccctgccccaaa

SEQ ID NO: 55164 - DNA, 20 bp, Artificial Sequence
  Description of Artificial Sequence: Synthetic oligonucleotide
  Target: SCN9A; (+) strand; PAM type: NRG; PAM sequence: AAG
tgccccctgccccaaatagt

SEQ ID NO: 55165 - DNA, 20 bp, Artificial Sequence
  Description of Artificial Sequence: Synthetic oligonucleotide
  Target: SCN9A; (+) strand; PAM type: NRG; PAM sequence: GAG
ccccctgccccaaatagtaa

SEQ ID NO: 55166 - DNA, 20 bp, Artificial Sequence
  Description of Artificial Sequence: Synthetic oligonucleotide
  Target: SCN9A; (+) strand; PAM type: NRG; PAM sequence: AGG
cccctgccccaaatagtaag

SEQ ID NO: 55167 - DNA, 20 bp, Artificial Sequence
  Description of Artificial Sequence: Synthetic oligonucleotide
  Target: SCN9A; (+) strand; PAM type: NRG; PAM sequence: AAG
cccaaatagtaagaggttcc

SEQ ID NO: 55168 - DNA, 20 bp, Artificial Sequence
  Description of Artificial Sequence: Synthetic oligonucleotide
  Target: SCN9A; (+) strand; PAM type: NRG; PAM sequence: CAG
tccaagaatccaatccatta

SEQ ID NO: 55169 - DNA, 20 bp, Artificial Sequence
  Description of Artificial Sequence: Synthetic oligonucleotide
  Target: SCN9A; (+) strand; PAM type: NRG; PAM sequence: CAG
agaatccaatccattacaga

SEQ ID NO: 55170 - DNA, 20 bp, Artificial Sequence
  Description of Artificial Sequence: Synthetic oligonucleotide
  Target: SCN9A; (+) strand; PAM type: NRG; PAM sequence: AGG
gaatccaatccattacagac

SEQ ID NO: 55171 - DNA, 20 bp, Artificial Sequence
  Description of Artificial Sequence: Synthetic oligonucleotide
  Target: SCN9A; (+) strand; PAM type: NRG; PAM sequence: AAG
tccaatccattacagacagg

SEQ ID NO: 55172 - DNA, 20 bp, Artificial Sequence
  Description of Artificial Sequence: Synthetic oligonucleotide
  Target: SCN9A; (+) strand; PAM type: NRG; PAM sequence: GAG
caatccattacagacaggaa

SEQ ID NO: 55173 - DNA, 20 bp, Artificial Sequence
  Description of Artificial Sequence: Synthetic oligonucleotide
  Target: SCN9A; (+) strand; PAM type: NRG; PAM sequence: TAG
ttacagacaggaagagaata

SEQ ID NO: 55174 - DNA, 20 bp, Artificial Sequence
  Description of Artificial Sequence: Synthetic oligonucleotide
  Target: SCN9A; (+) strand; PAM type: NRG; PAM sequence: AGG
tacagacaggaagagaatat

SEQ ID NO: 55175 - DNA, 20 bp, Artificial Sequence
  Description of Artificial Sequence: Synthetic oligonucleotide
  Target: SCN9A; (+) strand; PAM type: NRG; PAM sequence: TAG
tacatttacatatacataaa

SEQ ID NO: 55176 - DNA, 20 bp, Artificial Sequence
  Description of Artificial Sequence: Synthetic oligonucleotide
  Target: SCN9A; (+) strand; PAM type: NRG; PAM sequence: CAG
catatacataaatagtaaat

SEQ ID NO: 55177 - DNA, 20 bp, Artificial Sequence
  Description of Artificial Sequence: Synthetic oligonucleotide
  Target: SCN9A; (+) strand; PAM type: NRG; PAM sequence: AAG
ttacatctaaatcacaaaaa

SEQ ID NO: 55178 - DNA, 20 bp, Artificial Sequence
  Description of Artificial Sequence: Synthetic oligonucleotide
  Target: SCN9A; (+) strand; PAM type: NRG; PAM sequence: TAG
acaaaaacattatttttgta

SEQ ID NO: 55179 - DNA, 20 bp, Artificial Sequence
  Description of Artificial Sequence: Synthetic oligonucleotide
  Target: SCN9A; (+) strand; PAM type: NRG; PAM sequence: TAG
cattatttttgtatagaaat

SEQ ID NO: 55180 - DNA, 20 bp, Artificial Sequence
  Description of Artificial Sequence: Synthetic oligonucleotide
  Target: SCN9A; (+) strand; PAM type: NRG; PAM sequence: TGG
acttctcaaacatttttttc

SEQ ID NO: 55181 - DNA, 20 bp, Artificial Sequence
  Description of Artificial Sequence: Synthetic oligonucleotide
  Target: SCN9A; (+) strand; PAM type: NRG; PAM sequence: CAG
ggttttatgttacccatgtc

SEQ ID NO: 55182 - DNA, 20 bp, Artificial Sequence
  Description of Artificial Sequence: Synthetic oligonucleotide
  Target: SCN9A; (+) strand; PAM type: NRG; PAM sequence: AAG
ttatgttacccatgtccaga

SEQ ID NO: 55183 - DNA, 20 bp, Artificial Sequence
  Description of Artificial Sequence: Synthetic oligonucleotide
  Target: SCN9A; (+) strand; PAM type: NRG; PAM sequence: GAG
atgttacccatgtccagaaa

SEQ ID NO: 55184 - DNA, 20 bp, Artificial Sequence
  Description of Artificial Sequence: Synthetic oligonucleotide
  Target: SCN9A; (+) strand; PAM type: NRG; PAM sequence: CAG
cccatgtccagaaagagatc

SEQ ID NO: 55185 - DNA, 20 bp, Artificial Sequence
  Description of Artificial Sequence: Synthetic oligonucleotide
  Target: SCN9A; (+) strand; PAM type: NRG; PAM sequence: AAG
agaaagagatccagttaaaa

SEQ ID NO: 55186 - DNA, 20 bp, Artificial Sequence
  Description of Artificial Sequence: Synthetic oligonucleotide
  Target: SCN9A; (+) strand; PAM type: NRG; PAM sequence: GAG
aaagagatccagttaaaaaa

SEQ ID NO: 55187 - DNA, 20 bp, Artificial Sequence
  Description of Artificial Sequence: Synthetic oligonucleotide
  Target: SCN9A; (+) strand; PAM type: NRG; PAM sequence: AAG
agcacactcatccctttcca

SEQ ID NO: 55188 - DNA, 20 bp, Artificial Sequence
  Description of Artificial Sequence: Synthetic oligonucleotide
  Target: SCN9A; (+) strand; PAM type: NRG; PAM sequence: TGG
ttccaaagttgtacccatgc

SEQ ID NO: 55189 - DNA, 20 bp, Artificial Sequence
  Description of Artificial Sequence: Synthetic oligonucleotide
  Target: SCN9A; (+) strand; PAM type: NRG; PAM sequence: TAG
tgtacccatgctggtaattt

SEQ ID NO: 55190 - DNA, 20 bp, Artificial Sequence
  Description of Artificial Sequence: Synthetic oligonucleotide
  Target: SCN9A; (+) strand; PAM type: NRG; PAM sequence: TGG
catgctggtaattttagcat

SEQ ID NO: 55191 - DNA, 20 bp, Artificial Sequence
  Description of Artificial Sequence: Synthetic oligonucleotide
  Target: SCN9A; (+) strand; PAM type: NRG; PAM sequence: CAG
tttagcattggtttatcacg

SEQ ID NO: 55192 - DNA, 20 bp, Artificial Sequence
  Description of Artificial Sequence: Synthetic oligonucleotide
  Target: SCN9A; (+) strand; PAM type: NRG; PAM sequence: CAG
ttatcacgcagccctcgacg

SEQ ID NO: 55193 - DNA, 20 bp, Artificial Sequence
  Description of Artificial Sequence: Synthetic oligonucleotide
  Target: SCN9A; (+) strand; PAM type: NRG; PAM sequence: AGG
tatcacgcagccctcgacgc

SEQ ID NO: 55194 - DNA, 20 bp, Artificial Sequence
  Description of Artificial Sequence: Synthetic oligonucleotide
  Target: SCN9A; (+) strand; PAM type: NRG; PAM sequence: TAG
acgcagccctcgacgcaggt

SEQ ID NO: 55195 - DNA, 20 bp, Artificial Sequence
  Description of Artificial Sequence: Synthetic oligonucleotide
  Target: SCN9A; (+) strand; PAM type: NRG; PAM sequence: AAG
ttagtaatccctacaaaatc

SEQ ID NO: 55196 - DNA, 20 bp, Artificial Sequence
  Description of Artificial Sequence: Synthetic oligonucleotide
  Target: SCN9A; (+) strand; PAM type: NRG; PAM sequence: TGG
tgtctgtatttcaaccatgc

SEQ ID NO: 55197 - DNA, 20 bp, Artificial Sequence
  Description of Artificial Sequence: Synthetic oligonucleotide
  Target: SCN9A; (+) strand; PAM type: NRG; PAM sequence: TAG
taaatacatcaaatatgcct

SEQ ID NO: 55198 - DNA, 20 bp, Artificial Sequence
  Description of Artificial Sequence: Synthetic oligonucleotide
  Target: SCN9A; (+) strand; PAM type: NRG; PAM sequence: AGG
aaatacatcaaatatgcctt

SEQ ID NO: 55199 - DNA, 20 bp, Artificial Sequence
  Description of Artificial Sequence: Synthetic oligonucleotide
  Target: SCN9A; (+) strand; PAM type: NRG; PAM sequence: GGG
aatacatcaaatatgcctta

SEQ ID NO: 55200 - DNA, 20 bp, Artificial Sequence
  Description of Artificial Sequence: Synthetic oligonucleotide
  Target: SCN9A; (+) strand; PAM type: NRG; PAM sequence: TAG
caattgctgttttttgtgac

SEQ ID NO: 55201 - DNA, 20 bp, Artificial Sequence
  Description of Artificial Sequence: Synthetic oligonucleotide
  Target: SCN9A; (+) strand; PAM type: NRG; PAM sequence: CAG
ttgtgactagaatgattctt

SEQ ID NO: 55202 - DNA, 20 bp, Artificial Sequence
  Description of Artificial Sequence: Synthetic oligonucleotide
  Target: SCN9A; (+) strand; PAM type: NRG; PAM sequence: TAG
agaatgattcttcagttgtt

SEQ ID NO: 55203 - DNA, 20 bp, Artificial Sequence
  Description of Artificial Sequence: Synthetic oligonucleotide
  Target: SCN9A; (+) strand; PAM type: NRG; PAM sequence: TAG
tgattcttcagttgtttagc

SEQ ID NO: 55204 - DNA, 20 bp, Artificial Sequence
  Description of Artificial Sequence: Synthetic oligonucleotide
  Target: SCN9A; (+) strand; PAM type: NRG; PAM sequence: TAG
agttgtttagctagctccct

SEQ ID NO: 55205 - DNA, 20 bp, Artificial Sequence
  Description of Artificial Sequence: Synthetic oligonucleotide
  Target: SCN9A; (+) strand; PAM type: NRG; PAM sequence: CAG
ataccctgtataaaattttt

SEQ ID NO: 55206 - DNA, 20 bp, Artificial Sequence
  Description of Artificial Sequence: Synthetic oligonucleotide
  Target: SCN9A; (+) strand; PAM type: NRG; PAM sequence: CAG
tcctgttttattgtttttca

SEQ ID NO: 55207 - DNA, 20 bp, Artificial Sequence
  Description of Artificial Sequence: Synthetic oligonucleotide
  Target: SCN9A; (+) strand; PAM type: NRG; PAM sequence: TGG
gtttttcacagcatatctta

SEQ ID NO: 55208 - DNA, 20 bp, Artificial Sequence
  Description of Artificial Sequence: Synthetic oligonucleotide
  Target: SCN9A; (+) strand; PAM type: NRG; PAM sequence: TGG
catatcttatggtacaatga

SEQ ID NO: 55209 - DNA, 20 bp, Artificial Sequence
  Description of Artificial Sequence: Synthetic oligonucleotide
  Target: SCN9A; (+) strand; PAM type: NRG; PAM sequence: TAG
tcttatggtacaatgatgga

SEQ ID NO: 55210 - DNA, 20 bp, Artificial Sequence
  Description of Artificial Sequence: Synthetic oligonucleotide
  Target: SCN9A; (+) strand; PAM type: NRG; PAM sequence: TGG
tatggtacaatgatggatag

SEQ ID NO: 55211 - DNA, 20 bp, Artificial Sequence
  Description of Artificial Sequence: Synthetic oligonucleotide
  Target: SCN9A; (+) strand; PAM type: NRG; PAM sequence: CGG
tcttcattatctcttaaaat

SEQ ID NO: 55212 - DNA, 20 bp, Artificial Sequence
  Description of Artificial Sequence: Synthetic oligonucleotide
  Target: SCN9A; (+) strand; PAM type: NRG; PAM sequence: AAG
gtctacaataaaactttatg

SEQ ID NO: 55213 - DNA, 20 bp, Artificial Sequence
  Description of Artificial Sequence: Synthetic oligonucleotide
  Target: SCN9A; (+) strand; PAM type: NRG; PAM sequence: AAG
tacaataaaactttatgaag

SEQ ID NO: 55214 - DNA, 20 bp, Artificial Sequence
  Description of Artificial Sequence: Synthetic oligonucleotide
  Target: SCN9A; (+) strand; PAM type: NRG; PAM sequence: AGG
acaataaaactttatgaaga

SEQ ID NO: 55215 - DNA, 20 bp, Artificial Sequence
  Description of Artificial Sequence: Synthetic oligonucleotide
  Target: SCN9A; (+) strand; PAM type: NRG; PAM sequence: AAG
ataaaactttatgaagaagg

SEQ ID NO: 55216 - DNA, 20 bp, Artificial Sequence
  Description of Artificial Sequence: Synthetic oligonucleotide
  Target: SCN9A; (+) strand; PAM type: NRG; PAM sequence: GAG
aaaactttatgaagaaggaa

SEQ ID NO: 55217 - DNA, 20 bp, Artificial Sequence
  Description of Artificial Sequence: Synthetic oligonucleotide
  Target: SCN9A; (+) strand; PAM type: NRG; PAM sequence: GAG
aactttatgaagaaggaaga

SEQ ID NO: 55218 - DNA, 20 bp, Artificial Sequence
  Description of Artificial Sequence: Synthetic oligonucleotide
  Target: SCN9A; (+) strand; PAM type: NRG; PAM sequence: AGG
actttatgaagaaggaagag

SEQ ID NO: 55219 - DNA, 20 bp, Artificial Sequence
  Description of Artificial Sequence: Synthetic oligonucleotide
  Target: SCN9A; (+) strand; PAM type: NRG; PAM sequence: GGG
ctttatgaagaaggaagaga

SEQ ID NO: 55220 - DNA, 20 bp, Artificial Sequence
  Description of Artificial Sequence: Synthetic oligonucleotide
  Target: SCN9A; (+) strand; PAM type: NRG; PAM sequence: AAG
aagaaggaagagagggaaaa

SEQ ID NO: 55221 - DNA, 20 bp, Artificial Sequence
  Description of Artificial Sequence: Synthetic oligonucleotide
  Target: SCN9A; (+) strand; PAM type: NRG; PAM sequence: AAG
aggaagagagggaaaaaaga

SEQ ID NO: 55222 - DNA, 20 bp, Artificial Sequence
  Description of Artificial Sequence: Synthetic oligonucleotide
  Target: SCN9A; (+) strand; PAM type: NRG; PAM sequence: GAG
gaagagagggaaaaaagaaa

SEQ ID NO: 55223 - DNA, 20 bp, Artificial Sequence
  Description of Artificial Sequence: Synthetic oligonucleotide
  Target: SCN9A; (+) strand; PAM type: NRG; PAM sequence: AGG
aagagagggaaaaaagaaag

SEQ ID NO: 55224 - DNA, 20 bp, Artificial Sequence
  Description of Artificial Sequence: Synthetic oligonucleotide
  Target: SCN9A; (+) strand; PAM type: NRG; PAM sequence: GGG
agagagggaaaaaagaaaga

SEQ ID NO: 55225 - DNA, 20 bp, Artificial Sequence
  Description of Artificial Sequence: Synthetic oligonucleotide
  Target: SCN9A; (+) strand; PAM type: NRG; PAM sequence: AAG
gagggaaaaaagaaagaggg

SEQ ID NO: 55226 - DNA, 20 bp, Artificial Sequence
  Description of Artificial Sequence: Synthetic oligonucleotide
  Target: SCN9A; (+) strand; PAM type: NRG; PAM sequence: AGG
agggaaaaaagaaagaggga

SEQ ID NO: 55227 - DNA, 20 bp, Artificial Sequence
  Description of Artificial Sequence: Synthetic oligonucleotide
  Target: SCN9A; (+) strand; PAM type: NRG; PAM sequence: AAG
aaaaaagaaagagggaagga

SEQ ID NO: 55228 - DNA, 20 bp, Artificial Sequence
  Description of Artificial Sequence: Synthetic oligonucleotide
  Target: SCN9A; (+) strand; PAM type: NRG; PAM sequence: AAG
aaagaaagagggaaggaaag

SEQ ID NO: 55229 - DNA, 20 bp, Artificial Sequence
  Description of Artificial Sequence: Synthetic oligonucleotide
  Target: SCN9A; (+) strand; PAM type: NRG; PAM sequence: AGG
aagaaagagggaaggaaaga

SEQ ID NO: 55230 - DNA, 20 bp, Artificial Sequence
  Description of Artificial Sequence: Synthetic oligonucleotide
  Target: SCN9A; (+) strand; PAM type: NRG; PAM sequence: CAG
aaggaattgcttttaaattc

SEQ ID NO: 55231 - DNA, 20 bp, Artificial Sequence
  Description of Artificial Sequence: Synthetic oligonucleotide
  Target: SCN9A; (+) strand; PAM type: NRG; PAM sequence: AGG
aggaattgcttttaaattcc

SEQ ID NO: 55232 - DNA, 20 bp, Artificial Sequence
  Description of Artificial Sequence: Synthetic oligonucleotide
  Target: SCN9A; (+) strand; PAM type: NRG; PAM sequence: AAG
aattgcttttaaattccagg

SEQ ID NO: 55233 - DNA, 20 bp, Artificial Sequence
  Description of Artificial Sequence: Synthetic oligonucleotide
  Target: SCN9A; (+) strand; PAM type: NRG; PAM sequence: GAG
ttgcttttaaattccaggaa

SEQ ID NO: 55234 - DNA, 20 bp, Artificial Sequence
  Description of Artificial Sequence: Synthetic oligonucleotide
  Target: SCN9A; (+) strand; PAM type: NRG; PAM sequence: GAG
ccaggaagagtataaatgct

SEQ ID NO: 55235 - DNA, 20 bp, Artificial Sequence
  Description of Artificial Sequence: Synthetic oligonucleotide
  Target: SCN9A; (+) strand; PAM type: NRG; PAM sequence: GAG
aggaagagtataaatgctga

SEQ ID NO: 55236 - DNA, 20 bp, Artificial Sequence
  Description of Artificial Sequence: Synthetic oligonucleotide
  Target: SCN9A; (+) strand; PAM type: NRG; PAM sequence: AGG
ggaagagtataaatgctgag

SEQ ID NO: 55237 - DNA, 20 bp, Artificial Sequence
  Description of Artificial Sequence: Synthetic oligonucleotide
  Target: SCN9A; (+) strand; PAM type: NRG; PAM sequence: GAG
aagagtataaatgctgagag

SEQ ID NO: 55238 - DNA, 20 bp, Artificial Sequence
  Description of Artificial Sequence: Synthetic oligonucleotide
  Target: SCN9A; (+) strand; PAM type: NRG; PAM sequence: GAG
gtataaatgctgagaggagt

SEQ ID NO: 55239 - DNA, 20 bp, Artificial Sequence
  Description of Artificial Sequence: Synthetic oligonucleotide
  Target: SCN9A; (+) strand; PAM type: NRG; PAM sequence: AGG
tataaatgctgagaggagtg

SEQ ID NO: 55240 - DNA, 20 bp, Artificial Sequence
  Description of Artificial Sequence: Synthetic oligonucleotide
  Target: SCN9A; (+) strand; PAM type: NRG; PAM sequence: GAG
gctgagaggagtgaggttgt

SEQ ID NO: 55241 - DNA, 20 bp, Artificial Sequence
  Description of Artificial Sequence: Synthetic oligonucleotide
  Target: SCN9A; (+) strand; PAM type: NRG; PAM sequence: TGG
ggagtgaggttgtgagttct

SEQ ID NO: 55242 - DNA, 20 bp, Artificial Sequence
  Description of Artificial Sequence: Synthetic oligonucleotide
  Target: SCN9A; (+) strand; PAM type: NRG; PAM sequence: TGG
aggttgtgagttcttggaac

SEQ ID NO: 55243 - DNA, 20 bp, Artificial Sequence
  Description of Artificial Sequence: Synthetic oligonucleotide
  Target: SCN9A; (+) strand; PAM type: NRG; PAM sequence: TGG
gtgagttcttggaactggcc

SEQ ID NO: 55244 - DNA, 20 bp, Artificial Sequence
  Description of Artificial Sequence: Synthetic oligonucleotide
  Target: SCN9A; (+) strand; PAM type: NRG; PAM sequence: GAG
gagttcttggaactggcctg

SEQ ID NO: 55245 - DNA, 20 bp, Artificial Sequence
  Description of Artificial Sequence: Synthetic oligonucleotide
  Target: SCN9A; (+) strand; PAM type: NRG; PAM sequence: AGG
agttcttggaactggcctgg

SEQ ID NO: 55246 - DNA, 20 bp, Artificial Sequence
  Description of Artificial Sequence: Synthetic oligonucleotide
  Target: SCN9A; (+) strand; PAM type: NRG; PAM sequence: GGG
gttcttggaactggcctgga

SEQ ID NO: 55247 - DNA, 20 bp, Artificial Sequence
  Description of Artificial Sequence: Synthetic oligonucleotide
  Target: SCN9A; (+) strand; PAM type: NRG; PAM sequence: CAG
ggaactggcctggagggact

SEQ ID NO: 55248 - DNA, 20 bp, Artificial Sequence
  Description of Artificial Sequence: Synthetic oligonucleotide
  Target: SCN9A; (+) strand; PAM type: NRG; PAM sequence: CAG
actggcctggagggactcag

SEQ ID NO: 55249 - DNA, 20 bp, Artificial Sequence
  Description of Artificial Sequence: Synthetic oligonucleotide
  Target: SCN9A; (+) strand; PAM type: NRG; PAM sequence: TGG
cagccgcttaccactgccct

SEQ ID NO: 55250 - DNA, 20 bp, Artificial Sequence
  Description of Artificial Sequence: Synthetic oligonucleotide
  Target: SCN9A; (+) strand; PAM type: NRG; PAM sequence: GGG
agccgcttaccactgccctt

SEQ ID NO: 55251 - DNA, 20 bp, Artificial Sequence
  Description of Artificial Sequence: Synthetic oligonucleotide
  Target: SCN9A; (+) strand; PAM type: NRG; PAM sequence: CAG
actgcccttgggatctctgc

SEQ ID NO: 55252 - DNA, 20 bp, Artificial Sequence
  Description of Artificial Sequence: Synthetic oligonucleotide
  Target: SCN9A; (+) strand; PAM type: NRG; PAM sequence: AGG
ctgcccttgggatctctgcc

SEQ ID NO: 55253 - DNA, 20 bp, Artificial Sequence
  Description of Artificial Sequence: Synthetic oligonucleotide
  Target: SCN9A; (+) strand; PAM type: NRG; PAM sequence: TGG
tccctccctacaaacctcaa

SEQ ID NO: 55254 - DNA, 20 bp, Artificial Sequence
  Description of Artificial Sequence: Synthetic oligonucleotide
  Target: SCN9A; (+) strand; PAM type: NRG; PAM sequence: TGG
caatggcaccaataccaact

SEQ ID NO: 55255 - DNA, 20 bp, Artificial Sequence
  Description of Artificial Sequence: Synthetic oligonucleotide
  Target: SCN9A; (+) strand; PAM type: NRG; PAM sequence: TGG
aactcctgacctacacattt

SEQ ID NO: 55256 - DNA, 20 bp, Artificial Sequence
  Description of Artificial Sequence: Synthetic oligonucleotide
  Target: SCN9A; (+) strand; PAM type: NRG; PAM sequence: GAG
ctcctgacctacacattttg

SEQ ID NO: 55257 - DNA, 20 bp, Artificial Sequence
  Description of Artificial Sequence: Synthetic oligonucleotide
  Target: SCN9A; (+) strand; PAM type: NRG; PAM sequence: AGG
tcctgacctacacattttgg

SEQ ID NO: 55258 - DNA, 20 bp, Artificial Sequence
  Description of Artificial Sequence: Synthetic oligonucleotide
  Target: SCN9A; (+) strand; PAM type: NRG; PAM sequence: TAG
tacacattttggaggccaac

SEQ ID NO: 55259 - DNA, 20 bp, Artificial Sequence
  Description of Artificial Sequence: Synthetic oligonucleotide
  Target: SCN9A; (+) strand; PAM type: NRG; PAM sequence: CGG
attttggaggccaactagac

SEQ ID NO: 55260 - DNA, 20 bp, Artificial Sequence
  Description of Artificial Sequence: Synthetic oligonucleotide
  Target: SCN9A; (+) strand; PAM type: NRG; PAM sequence: TAG
cggatctaatgattaatccc

SEQ ID NO: 55261 - DNA, 20 bp, Artificial Sequence
  Description of Artificial Sequence: Synthetic oligonucleotide
  Target: SCN9A; (+) strand; PAM type: NRG; PAM sequence: AGG
ggatctaatgattaatccct

SEQ ID NO: 55262 - DNA, 20 bp, Artificial Sequence
  Description of Artificial Sequence: Synthetic oligonucleotide
  Target: SCN9A; (+) strand; PAM type: NRG; PAM sequence: AAG
taatgattaatccctaggct

SEQ ID NO: 55263 - DNA, 20 bp, Artificial Sequence
  Description of Artificial Sequence: Synthetic oligonucleotide
  Target: SCN9A; (+) strand; PAM type: NRG; PAM sequence: CAG
atccctaggctaagataaat

SEQ ID NO: 55264 - DNA, 20 bp, Artificial Sequence
  Description of Artificial Sequence: Synthetic oligonucleotide
  Target: SCN9A; (+) strand; PAM type: NRG; PAM sequence: TGG
ctaggctaagataaatcagt

SEQ ID NO: 55265 - DNA, 20 bp, Artificial Sequence
  Description of Artificial Sequence: Synthetic oligonucleotide
  Target: SCN9A; (+) strand; PAM type: NRG; PAM sequence: CAG
gataaatcagttggaaattt

SEQ ID NO: 55266 - DNA, 20 bp, Artificial Sequence
  Description of Artificial Sequence: Synthetic oligonucleotide
  Target: SCN9A; (+) strand; PAM type: NRG; PAM sequence: CAG
ctttgttttttcttatctgc

SEQ ID NO: 55267 - DNA, 20 bp, Artificial Sequence
  Description of Artificial Sequence: Synthetic oligonucleotide
  Target: SCN9A; (+) strand; PAM type: NRG; PAM sequence: AAG
tatctgccagtctacctgtt

SEQ ID NO: 55268 - DNA, 20 bp, Artificial Sequence
  Description of Artificial Sequence: Synthetic oligonucleotide
  Target: SCN9A; (+) strand; PAM type: NRG; PAM sequence: AAG
agcatatctgtcactgtcaa

SEQ ID NO: 55269 - DNA, 20 bp, Artificial Sequence
  Description of Artificial Sequence: Synthetic oligonucleotide
  Target: SCN9A; (+) strand; PAM type: NRG; PAM sequence: TAG
gtccctttacttatttcact

SEQ ID NO: 55270 - DNA, 20 bp, Artificial Sequence
  Description of Artificial Sequence: Synthetic oligonucleotide
  Target: SCN9A; (+) strand; PAM type: NRG; PAM sequence: TAG
ttcacttagcatgtctcttc

SEQ ID NO: 55271 - DNA, 20 bp, Artificial Sequence
  Description of Artificial Sequence: Synthetic oligonucleotide
  Target: SCN9A; (+) strand; PAM type: NRG; PAM sequence: AGG
tcacttagcatgtctcttct

SEQ ID NO: 55272 - DNA, 20 bp, Artificial Sequence
  Description of Artificial Sequence: Synthetic oligonucleotide
  Target: SCN9A; (+) strand; PAM type: NRG; PAM sequence: TAG
tccatgcatgctgtcacaaa

SEQ ID NO: 55273 - DNA, 20 bp, Artificial Sequence
  Description of Artificial Sequence: Synthetic oligonucleotide
  Target: SCN9A; (+) strand; PAM type: NRG; PAM sequence: AAG
tgcatgctgtcacaaatagt

SEQ ID NO: 55274 - DNA, 20 bp, Artificial Sequence
  Description of Artificial Sequence: Synthetic oligonucleotide
  Target: SCN9A; (+) strand; PAM type: NRG; PAM sequence: AAG
taagatttccttcttttttt

SEQ ID NO: 55275 - DNA, 20 bp, Artificial Sequence
  Description of Artificial Sequence: Synthetic oligonucleotide
  Target: SCN9A; (+) strand; PAM type: NRG; PAM sequence: AGG
aagatttccttcttttttta

SEQ ID NO: 55276 - DNA, 20 bp, Artificial Sequence
  Description of Artificial Sequence: Synthetic oligonucleotide
  Target: SCN9A; (+) strand; PAM type: NRG; PAM sequence: TAG
tttccttctttttttaaggc

SEQ ID NO: 55277 - DNA, 20 bp, Artificial Sequence
  Description of Artificial Sequence: Synthetic oligonucleotide
  Target: SCN9A; (+) strand; PAM type: NRG; PAM sequence: CAG
ataatattctattttatata

SEQ ID NO: 55278 - DNA, 20 bp, Artificial Sequence
  Description of Artificial Sequence: Synthetic oligonucleotide
  Target: SCN9A; (+) strand; PAM type: NRG; PAM sequence: TGG
tttatctgttgatgatcatt

SEQ ID NO: 55279 - DNA, 20 bp, Artificial Sequence
  Description of Artificial Sequence: Synthetic oligonucleotide
  Target: SCN9A; (+) strand; PAM type: NRG; PAM sequence: GGG
ttatctgttgatgatcattt

SEQ ID NO: 55280 - DNA, 20 bp, Artificial Sequence
  Description of Artificial Sequence: Synthetic oligonucleotide
  Target: SCN9A; (+) strand; PAM type: NRG; PAM sequence: CAG
tgctattgtgaataatgctg

SEQ ID NO: 55281 - DNA, 20 bp, Artificial Sequence
  Description of Artificial Sequence: Synthetic oligonucleotide
  Target: SCN9A; (+) strand; PAM type: NRG; PAM sequence: CAG
gaataatgctgcagtaaaca

SEQ ID NO: 55282 - DNA, 20 bp, Artificial Sequence
  Description of Artificial Sequence: Synthetic oligonucleotide
  Target: SCN9A; (+) strand; PAM type: NRG; PAM sequence: AAG
taatgctgcagtaaacacag

SEQ ID NO: 55283 - DNA, 20 bp, Artificial Sequence
  Description of Artificial Sequence: Synthetic oligonucleotide
  Target: SCN9A; (+) strand; PAM type: NRG; PAM sequence: GAG
agaagtgcatatatctcttt

SEQ ID NO: 55284 - DNA, 20 bp, Artificial Sequence
  Description of Artificial Sequence: Synthetic oligonucleotide
  Target: SCN9A; (+) strand; PAM type: NRG; PAM sequence: TGG
gagattctgatttcaattgc

SEQ ID NO: 55285 - DNA, 20 bp, Artificial Sequence
  Description of Artificial Sequence: Synthetic oligonucleotide
  Target: SCN9A; (+) strand; PAM type: NRG; PAM sequence: TGG
atttcaattgctggatcata

SEQ ID NO: 55286 - DNA, 20 bp, Artificial Sequence
  Description of Artificial Sequence: Synthetic oligonucleotide
  Target: SCN9A; (+) strand; PAM type: NRG; PAM sequence: TAG
tcaattgctggatcatatgg

SEQ ID NO: 55287 - DNA, 20 bp, Artificial Sequence
  Description of Artificial Sequence: Synthetic oligonucleotide
  Target: SCN9A; (+) strand; PAM type: NRG; PAM sequence: GAG
agttctatttttaatttttt

SEQ ID NO: 55288 - DNA, 20 bp, Artificial Sequence
  Description of Artificial Sequence: Synthetic oligonucleotide
  Target: SCN9A; (+) strand; PAM type: NRG; PAM sequence: AGG
gttctatttttaattttttg

SEQ ID NO: 55289 - DNA, 20 bp, Artificial Sequence
  Description of Artificial Sequence: Synthetic oligonucleotide
  Target: SCN9A; (+) strand; PAM type: NRG; PAM sequence: TAG
aacttccatattattttcca

SEQ ID NO: 55290 - DNA, 20 bp, Artificial Sequence
  Description of Artificial Sequence: Synthetic oligonucleotide
  Target: SCN9A; (+) strand; PAM type: NRG; PAM sequence: CAG
ttccatattattttccatag

SEQ ID NO: 55291 - DNA, 20 bp, Artificial Sequence
  Description of Artificial Sequence: Synthetic oligonucleotide
  Target: SCN9A; (+) strand; PAM type: NRG; PAM sequence: CAG
ctattatacattcccaccaa

SEQ ID NO: 55292 - DNA, 20 bp, Artificial Sequence
  Description of Artificial Sequence: Synthetic oligonucleotide
  Target: SCN9A; (+) strand; PAM type: NRG; PAM sequence: TGG
ttatacattcccaccaacag

SEQ ID NO: 55293 - DNA, 20 bp, Artificial Sequence
  Description of Artificial Sequence: Synthetic oligonucleotide
  Target: SCN9A; (+) strand; PAM type: NRG; PAM sequence: CAG
cacctttcacttttttataa

SEQ ID NO: 55294 - DNA, 20 bp, Artificial Sequence
  Description of Artificial Sequence: Synthetic oligonucleotide
  Target: SCN9A; (+) strand; PAM type: NRG; PAM sequence: CAG
ttttataacagccatcttaa

SEQ ID NO: 55295 - DNA, 20 bp, Artificial Sequence
  Description of Artificial Sequence: Synthetic oligonucleotide
  Target: SCN9A; (+) strand; PAM type: NRG; PAM sequence: AGG
tttataacagccatcttaac

SEQ ID NO: 55296 - DNA, 20 bp, Artificial Sequence
  Description of Artificial Sequence: Synthetic oligonucleotide
  Target: SCN9A; (+) strand; PAM type: NRG; PAM sequence: GAG
acagccatcttaacaggtgt

SEQ ID NO: 55297 - DNA, 20 bp, Artificial Sequence
  Description of Artificial Sequence: Synthetic oligonucleotide
  Target: SCN9A; (+) strand; PAM type: NRG; PAM sequence: CAG
gtgagatgattatctcattg

SEQ ID NO: 55298 - DNA, 20 bp, Artificial Sequence
  Description of Artificial Sequence: Synthetic oligonucleotide
  Target: SCN9A; (+) strand; PAM type: NRG; PAM sequence: TAG
ctgataaaaccttaaccact

SEQ ID NO: 55299 - DNA, 20 bp, Artificial Sequence
  Description of Artificial Sequence: Synthetic oligonucleotide
  Target: SCN9A; (+) strand; PAM type: NRG; PAM sequence: TAG
aaaaccttaaccacttagtc

SEQ ID NO: 55300 - DNA, 20 bp, Artificial Sequence
  Description of Artificial Sequence: Synthetic oligonucleotide
  Target: SCN9A; (+) strand; PAM type: NRG; PAM sequence: GAG
aaccttaaccacttagtcta

SEQ ID NO: 55301 - DNA, 20 bp, Artificial Sequence
  Description of Artificial Sequence: Synthetic oligonucleotide
  Target: SCN9A; (+) strand; PAM type: NRG; PAM sequence: AGG
accttaaccacttagtctag

SEQ ID NO: 55302 - DNA, 20 bp, Artificial Sequence
  Description of Artificial Sequence: Synthetic oligonucleotide
  Target: SCN9A; (+) strand; PAM type: NRG; PAM sequence: AAG
aaccacttagtctagaggat

SEQ ID NO: 55303 - DNA, 20 bp, Artificial Sequence
  Description of Artificial Sequence: Synthetic oligonucleotide
  Target: SCN9A; (+) strand; PAM type: NRG; PAM sequence: TAG
caatccacaaatcactaaaa

SEQ ID NO: 55304 - DNA, 20 bp, Artificial Sequence
  Description of Artificial Sequence: Synthetic oligonucleotide
  Target: SCN9A; (+) strand; PAM type: NRG; PAM sequence: GAG
acaaatcactaaaatagatt

SEQ ID NO: 55305 - DNA, 20 bp, Artificial Sequence
  Description of Artificial Sequence: Synthetic oligonucleotide
  Target: SCN9A; (+) strand; PAM type: NRG; PAM sequence: TAG
aaatagattgagacgtatca

SEQ ID NO: 55306 - DNA, 20 bp, Artificial Sequence
  Description of Artificial Sequence: Synthetic oligonucleotide
  Target: SCN9A; (+) strand; PAM type: NRG; PAM sequence: AAG
tgagacgtatcatagaactc

SEQ ID NO: 55307 - DNA, 20 bp, Artificial Sequence
  Description of Artificial Sequence: Synthetic oligonucleotide
  Target: SCN9A; (+) strand; PAM type: NRG; PAM sequence: AGG
gagacgtatcatagaactca

SEQ ID NO: 55308 - DNA, 20 bp, Artificial Sequence
  Description of Artificial Sequence: Synthetic oligonucleotide
  Target: SCN9A; (+) strand; PAM type: NRG; PAM sequence: GGG
agacgtatcatagaactcaa

SEQ ID NO: 55309 - DNA, 20 bp, Artificial Sequence
  Description of Artificial Sequence: Synthetic oligonucleotide
  Target: SCN9A; (+) strand; PAM type: NRG; PAM sequence: TGG
ctcaagggccaaatttccca

SEQ ID NO: 55310 - DNA, 20 bp, Artificial Sequence
  Description of Artificial Sequence: Synthetic oligonucleotide
  Target: SCN9A; (+) strand; PAM type: NRG; PAM sequence: AAG
cccatggtttttatatccca

SEQ ID NO: 55311 - DNA, 20 bp, Artificial Sequence
  Description of Artificial Sequence: Synthetic oligonucleotide
  Target: SCN9A; (+) strand; PAM type: NRG; PAM sequence: CAG
ggtttttatatcccaaagta

SEQ ID NO: 55312 - DNA, 20 bp, Artificial Sequence
  Description of Artificial Sequence: Synthetic oligonucleotide
  Target: SCN9A; (+) strand; PAM type: NRG; PAM sequence: AAG
tatcccaaagtacagtatct

SEQ ID NO: 55313 - DNA, 20 bp, Artificial Sequence
  Description of Artificial Sequence: Synthetic oligonucleotide
  Target: SCN9A; (+) strand; PAM type: NRG; PAM sequence: TGG
cccaaagtacagtatctaag

SEQ ID NO: 55314 - DNA, 20 bp, Artificial Sequence
  Description of Artificial Sequence: Synthetic oligonucleotide
  Target: SCN9A; (+) strand; PAM type: NRG; PAM sequence: TAG
tacagtatctaagtggataa

SEQ ID NO: 55315 - DNA, 20 bp, Artificial Sequence
  Description of Artificial Sequence: Synthetic oligonucleotide
  Target: SCN9A; (+) strand; PAM type: NRG; PAM sequence: TAG
aaacataatgtaaaataaat

SEQ ID NO: 55316 - DNA, 20 bp, Artificial Sequence
  Description of Artificial Sequence: Synthetic oligonucleotide
  Target: SCN9A; (+) strand; PAM type: NRG; PAM sequence: AAG
aactgttttaaaacccttaa

SEQ ID NO: 55317 - DNA, 20 bp, Artificial Sequence
  Description of Artificial Sequence: Synthetic oligonucleotide
  Target: SCN9A; (+) strand; PAM type: NRG; PAM sequence: TAG
acttcttgcattactgatgt

SEQ ID NO: 55318 - DNA, 20 bp, Artificial Sequence
  Description of Artificial Sequence: Synthetic oligonucleotide
  Target: SCN9A; (+) strand; PAM type: NRG; PAM sequence: TAG
gttagacaatttaactgact

SEQ ID NO: 55319 - DNA, 20 bp, Artificial Sequence
  Description of Artificial Sequence: Synthetic oligonucleotide
  Target: SCN9A; (+) strand; PAM type: NRG; PAM sequence: GAG
tttaactgacttagataatt

SEQ ID NO: 55320 - DNA, 20 bp, Artificial Sequence
  Description of Artificial Sequence: Synthetic oligonucleotide
  Target: SCN9A; (+) strand; PAM type: NRG; PAM sequence: AAG
aattgagtcttcatgacaat

SEQ ID NO: 55321 - DNA, 20 bp, Artificial Sequence
  Description of Artificial Sequence: Synthetic oligonucleotide
  Target: SCN9A; (+) strand; PAM type: NRG; PAM sequence: TAG
tgacaataagtactgtgatt

SEQ ID NO: 55322 - DNA, 20 bp, Artificial Sequence
  Description of Artificial Sequence: Synthetic oligonucleotide
  Target: SCN9A; (+) strand; PAM type: NRG; PAM sequence: AGG
gacaataagtactgtgattt

SEQ ID NO: 55323 - DNA, 20 bp, Artificial Sequence
  Description of Artificial Sequence: Synthetic oligonucleotide
  Target: SCN9A; (+) strand; PAM type: NRG; PAM sequence: TAG
atatttgtactcctccaata

SEQ ID NO: 55324 - DNA, 20 bp, Artificial Sequence
  Description of Artificial Sequence: Synthetic oligonucleotide
  Target: SCN9A; (+) strand; PAM type: NRG; PAM sequence: AAG
tatctaaatttttattttcc

SEQ ID NO: 55325 - DNA, 20 bp, Artificial Sequence
  Description of Artificial Sequence: Synthetic oligonucleotide
  Target: SCN9A; (+) strand; PAM type: NRG; PAM sequence: AAG
accatcatcttatcctgcac

SEQ ID NO: 55326 - DNA, 20 bp, Artificial Sequence
  Description of Artificial Sequence: Synthetic oligonucleotide
  Target: SCN9A; (+) strand; PAM type: NRG; PAM sequence: TAG
tttcatacttctccatctgc

SEQ ID NO: 55327 - DNA, 20 bp, Artificial Sequence
  Description of Artificial Sequence: Synthetic oligonucleotide
  Target: SCN9A; (+) strand; PAM type: NRG; PAM sequence: CAG
acttctccatctgctagctc

SEQ ID NO: 55328 - DNA, 20 bp, Artificial Sequence
  Description of Artificial Sequence: Synthetic oligonucleotide
  Target: SCN9A; (+) strand; PAM type: NRG; PAM sequence: AGG
cttctccatctgctagctcc

SEQ ID NO: 55329 - DNA, 20 bp, Artificial Sequence
  Description of Artificial Sequence: Synthetic oligonucleotide
  Target: SCN9A; (+) strand; PAM type: NRG; PAM sequence: CAG
tccctgtttcttctccattt

SEQ ID NO: 55330 - DNA, 20 bp, Artificial Sequence
  Description of Artificial Sequence: Synthetic oligonucleotide
  Target: SCN9A; (+) strand; PAM type: NRG; PAM sequence: TAG
tttcagaataaacttcatcc

SEQ ID NO: 55331 - DNA, 20 bp, Artificial Sequence
  Description of Artificial Sequence: Synthetic oligonucleotide
  Target: SCN9A; (+) strand; PAM type: NRG; PAM sequence: GAG
tttttttaattttttttctt

SEQ ID NO: 55332 - DNA, 20 bp, Artificial Sequence
  Description of Artificial Sequence: Synthetic oligonucleotide
  Target: SCN9A; (+) strand; PAM type: NRG; PAM sequence: GAG
taattttttttcttgagact

SEQ ID NO: 55333 - DNA, 20 bp, Artificial Sequence
  Description of Artificial Sequence: Synthetic oligonucleotide
  Target: SCN9A; (+) strand; PAM type: NRG; PAM sequence: CAG
ctgagtctcgctctgttgcc

SEQ ID NO: 55334 - DNA, 20 bp, Artificial Sequence
  Description of Artificial Sequence: Synthetic oligonucleotide
  Target: SCN9A; (+) strand; PAM type: NRG; PAM sequence: AGG
tgagtctcgctctgttgccc

SEQ ID NO: 55335 - DNA, 20 bp, Artificial Sequence
  Description of Artificial Sequence: Synthetic oligonucleotide
  Target: SCN9A; (+) strand; PAM type: NRG; PAM sequence: CAG
gtctcgctctgttgcccagg

SEQ ID NO: 55336 - DNA, 20 bp, Artificial Sequence
  Description of Artificial Sequence: Synthetic oligonucleotide
  Target: SCN9A; (+) strand; PAM type: NRG; PAM sequence: AGG
tctcgctctgttgcccaggc

SEQ ID NO: 55337 - DNA, 20 bp, Artificial Sequence
  Description of Artificial Sequence: Synthetic oligonucleotide
  Target: SCN9A; (+) strand; PAM type: NRG; PAM sequence: GAG
tcgctctgttgcccaggcag

SEQ ID NO: 55338 - DNA, 20 bp, Artificial Sequence
  Description of Artificial Sequence: Synthetic oligonucleotide
  Target: SCN9A; (+) strand; PAM type: NRG; PAM sequence: CAG
ctgttgcccaggcaggagtg

SEQ ID NO: 55339 - DNA, 20 bp, Artificial Sequence
  Description of Artificial Sequence: Synthetic oligonucleotide
  Target: SCN9A; (+) strand; PAM type: NRG; PAM sequence: TGG
ttgcccaggcaggagtgcag

SEQ ID NO: 55340 - DNA, 20 bp, Artificial Sequence
  Description of Artificial Sequence: Synthetic oligonucleotide
  Target: SCN9A; (+) strand; PAM type: NRG; PAM sequence: CAG
ggagtgcagtggctcgatct

SEQ ID NO: 55341 - DNA, 20 bp, Artificial Sequence
  Description of Artificial Sequence: Synthetic oligonucleotide
  Target: SCN9A; (+) strand; PAM type: NRG; PAM sequence: CAG
tcactgcaacctccatctcc

SEQ ID NO: 55342 - DNA, 20 bp, Artificial Sequence
  Description of Artificial Sequence: Synthetic oligonucleotide
  Target: SCN9A; (+) strand; PAM type: NRG; PAM sequence: AGG
cactgcaacctccatctccc

SEQ ID NO: 55343 - DNA, 20 bp, Artificial Sequence
  Description of Artificial Sequence: Synthetic oligonucleotide
  Target: SCN9A; (+) strand; PAM type: NRG; PAM sequence: CAG
caacctccatctcccaggtt

SEQ ID NO: 55344 - DNA, 20 bp, Artificial Sequence
  Description of Artificial Sequence: Synthetic oligonucleotide
  Target: SCN9A; (+) strand; PAM type: NRG; PAM sequence: AGG
aacctccatctcccaggttc

SEQ ID NO: 55345 - DNA, 20 bp, Artificial Sequence
  Description of Artificial Sequence: Synthetic oligonucleotide
  Target: SCN9A; (+) strand; PAM type: NRG; PAM sequence: CAG
ttcaggcaattctcctgcct

SEQ ID NO: 55346 - DNA, 20 bp, Artificial Sequence
  Description of Artificial Sequence: Synthetic oligonucleotide
  Target: SCN9A; (+) strand; PAM type: NRG; PAM sequence: GAG
ttctcctgcctcagcctccc

SEQ ID NO: 55347 - DNA, 20 bp, Artificial Sequence
  Description of Artificial Sequence: Synthetic oligonucleotide
  Target: SCN9A; (+) strand; PAM type: NRG; PAM sequence: AAG
tcctgcctcagcctcccgag

SEQ ID NO: 55348 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctcccgagaagc

SEQ ID NO: 55349 - DNA, 20 bp, Artificial Sequence
  Description of Artificial Sequence: Synthetic oligonucleotide
  Target: SCN9A; (+) strand; PAM type: NRG; PAM sequence: GGG
cctcagcctcccgagaagct

SEQ ID NO: 55350 - DNA, 20 bp, Artificial Sequence
  Description of Artificial Sequence: Synthetic oligonucleotide
  Target: SCN9A; (+) strand; PAM type: NRG; PAM sequence: CAG
ctcccgagaagctgggacta

SEQ ID NO: 55351 - DNA, 20 bp, Artificial Sequence
  Description of Artificial Sequence: Synthetic oligonucleotide
  Target: SCN9A; (+) strand; PAM type: NRG; PAM sequence: AGG
tcccgagaagctgggactac

SEQ ID NO: 55352 - DNA, 20 bp, Artificial Sequence
  Description of Artificial Sequence: Synthetic oligonucleotide
  Target: SCN9A; (+) strand; PAM type: NRG; PAM sequence: TGG
gaagctgggactacaggtgc

SEQ ID NO: 55353 - DNA, 20 bp, Artificial Sequence
  Description of Artificial Sequence: Synthetic oligonucleotide
  Target: SCN9A; (+) strand; PAM type: NRG; PAM sequence: TGG
caggtgctggccaccatgcc

SEQ ID NO: 55354 - DNA, 20 bp, Artificial Sequence
  Description of Artificial Sequence: Synthetic oligonucleotide
  Target: SCN9A; (+) strand; PAM type: NRG; PAM sequence: TAG
tgctggccaccatgcctgga

SEQ ID NO: 55355 - DNA, 20 bp, Artificial Sequence
  Description of Artificial Sequence: Synthetic oligonucleotide
  Target: SCN9A; (+) strand; PAM type: NRG; PAM sequence: TAG
gatagtttttgtattttttt

SEQ ID NO: 55356 - DNA, 20 bp, Artificial Sequence
  Description of Artificial Sequence: Synthetic oligonucleotide
  Target: SCN9A; (+) strand; PAM type: NRG; PAM sequence: TAG
agtttttgtattttttttag

SEQ ID NO: 55357 - DNA, 20 bp, Artificial Sequence
  Description of Artificial Sequence: Synthetic oligonucleotide
  Target: SCN9A; (+) strand; PAM type: NRG; PAM sequence: GAG
tttttgtattttttttagta

SEQ ID NO: 55358 - DNA, 20 bp, Artificial Sequence
  Description of Artificial Sequence: Synthetic oligonucleotide
  Target: SCN9A; (+) strand; PAM type: NRG; PAM sequence: TGG
tgtattttttttagtagaga

SEQ ID NO: 55359 - DNA, 20 bp, Artificial Sequence
  Description of Artificial Sequence: Synthetic oligonucleotide
  Target: SCN9A; (+) strand; PAM type: NRG; PAM sequence: GGG
gtattttttttagtagagat

SEQ ID NO: 55360 - DNA, 20 bp, Artificial Sequence
  Description of Artificial Sequence: Synthetic oligonucleotide
  Target: SCN9A; (+) strand; PAM type: NRG; PAM sequence: GGG
tattttttttagtagagatg

SEQ ID NO: 55361 - DNA, 20 bp, Artificial Sequence
  Description of Artificial Sequence: Synthetic oligonucleotide
  Target: SCN9A; (+) strand; PAM type: NRG; PAM sequence: CAG
tggggtttcactatgttgac

SEQ ID NO: 55362 - DNA, 20 bp, Artificial Sequence
  Description of Artificial Sequence: Synthetic oligonucleotide
  Target: SCN9A; (+) strand; PAM type: NRG; PAM sequence: AGG
ggggtttcactatgttgacc

SEQ ID NO: 55363 - DNA, 20 bp, Artificial Sequence
  Description of Artificial Sequence: Synthetic oligonucleotide
  Target: SCN9A; (+) strand; PAM type: NRG; PAM sequence: TGG
tttcactatgttgaccaggc

SEQ ID NO: 55364 - DNA, 20 bp, Artificial Sequence
  Description of Artificial Sequence: Synthetic oligonucleotide
  Target: SCN9A; (+) strand; PAM type: NRG; PAM sequence: AAG
ggtctccaactcctgacctc

SEQ ID NO: 55365 - DNA, 20 bp, Artificial Sequence
  Description of Artificial Sequence: Synthetic oligonucleotide
  Target: SCN9A; (+) strand; PAM type: NRG; PAM sequence: CAG
aactcctgacctcaagtgat

SEQ ID NO: 55366 - DNA, 20 bp, Artificial Sequence
  Description of Artificial Sequence: Synthetic oligonucleotide
  Target: SCN9A; (+) strand; PAM type: NRG; PAM sequence: CAG
ctcaagtgatcagcctgcct

SEQ ID NO: 55367 - DNA, 20 bp, Artificial Sequence
  Description of Artificial Sequence: Synthetic oligonucleotide
  Target: SCN9A; (+) strand; PAM type: NRG; PAM sequence: AAG
cagcctgcctcagccttcca

SEQ ID NO: 55368 - DNA, 20 bp, Artificial Sequence
  Description of Artificial Sequence: Synthetic oligonucleotide
  Target: SCN9A; (+) strand; PAM type: NRG; PAM sequence: TGG
gcctcagccttccaaagtgc

SEQ ID NO: 55369 - DNA, 20 bp, Artificial Sequence
  Description of Artificial Sequence: Synthetic oligonucleotide
  Target: SCN9A; (+) strand; PAM type: NRG; PAM sequence: CGG
ccttccaaagtgctggatta

SEQ ID NO: 55370 - DNA, 20 bp, Artificial Sequence
  Description of Artificial Sequence: Synthetic oligonucleotide
  Target: SCN9A; (+) strand; PAM type: NRG; PAM sequence: GGG
cttccaaagtgctggattac

SEQ ID NO: 55371 - DNA, 20 bp, Artificial Sequence
  Description of Artificial Sequence: Synthetic oligonucleotide
  Target: SCN9A; (+) strand; PAM type: NRG; PAM sequence: AAG
aagtgctggattacgggcgt

SEQ ID NO: 55372 - DNA, 20 bp, Artificial Sequence
  Description of Artificial Sequence: Synthetic oligonucleotide
  Target: SCN9A; (+) strand; PAM type: NRG; PAM sequence: TGG
cgggcgtaagccaccgcgcc

SEQ ID NO: 55373 - DNA, 20 bp, Artificial Sequence
  Description of Artificial Sequence: Synthetic oligonucleotide
  Target: SCN9A; (+) strand; PAM type: NRG; PAM sequence: TAG
ccaccgcgcctggcccaccc

SEQ ID NO: 55374 - DNA, 20 bp, Artificial Sequence
  Description of Artificial Sequence: Synthetic oligonucleotide
  Target: SCN9A; (+) strand; PAM type: NRG; PAM sequence: TGG
ttttcaaatcttttctacct

SEQ ID NO: 55375 - DNA, 20 bp, Artificial Sequence
  Description of Artificial Sequence: Synthetic oligonucleotide
  Target: SCN9A; (+) strand; PAM type: NRG; PAM sequence: GGG
tttcaaatcttttctacctt

SEQ ID NO: 55376 - DNA, 20 bp, Artificial Sequence
  Description of Artificial Sequence: Synthetic oligonucleotide
  Target: SCN9A; (+) strand; PAM type: NRG; PAM sequence: GGG
ttcaaatcttttctaccttg

SEQ ID NO: 55377 - DNA, 20 bp, Artificial Sequence
  Description of Artificial Sequence: Synthetic oligonucleotide
  Target: SCN9A; (+) strand; PAM type: NRG; PAM sequence: AAG
aaatcttttctaccttgggg

SEQ ID NO: 55378 - DNA, 20 bp, Artificial Sequence
  Description of Artificial Sequence: Synthetic oligonucleotide
  Target: SCN9A; (+) strand; PAM type: NRG; PAM sequence: AGG
aatcttttctaccttgggga

SEQ ID NO: 55379 - DNA, 20 bp, Artificial Sequence
  Description of Artificial Sequence: Synthetic oligonucleotide
  Target: SCN9A; (+) strand; PAM type: NRG; PAM sequence: CAG
ggaaggcctttttcccattt

SEQ ID NO: 55380 - DNA, 20 bp, Artificial Sequence
  Description of Artificial Sequence: Synthetic oligonucleotide
  Target: SCN9A; (+) strand; PAM type: NRG; PAM sequence: TAG
aaaacaaaatatgcgaatca

SEQ ID NO: 55381 - DNA, 20 bp, Artificial Sequence
  Description of Artificial Sequence: Synthetic oligonucleotide
  Target: SCN9A; (+) strand; PAM type: NRG; PAM sequence: AAG
aaaatatgcgaatcatagca

SEQ ID NO: 55382 - DNA, 20 bp, Artificial Sequence
  Description of Artificial Sequence: Synthetic oligonucleotide
  Target: SCN9A; (+) strand; PAM type: NRG; PAM sequence: AAG
atgcgaatcatagcaaagtc

SEQ ID NO: 55383 - DNA, 20 bp, Artificial Sequence
  Description of Artificial Sequence: Synthetic oligonucleotide
  Target: SCN9A; (+) strand; PAM type: NRG; PAM sequence: CAG
atcatagcaaagtcaagtca

SEQ ID NO: 55384 - DNA, 20 bp, Artificial Sequence
  Description of Artificial Sequence: Synthetic oligonucleotide
  Target: SCN9A; (+) strand; PAM type: NRG; PAM sequence: TAG
atagcaaagtcaagtcacag

SEQ ID NO: 55385 - DNA, 20 bp, Artificial Sequence
  Description of Artificial Sequence: Synthetic oligonucleotide
  Target: SCN9A; (+) strand; PAM type: NRG; PAM sequence: TAG
cagtagtgcaataatactcc

SEQ ID NO: 55386 - DNA, 20 bp, Artificial Sequence
  Description of Artificial Sequence: Synthetic oligonucleotide
  Target: SCN9A; (+) strand; PAM type: NRG; PAM sequence: CAG
gtgcaataatactcctagac

SEQ ID NO: 55387 - DNA, 20 bp, Artificial Sequence
  Description of Artificial Sequence: Synthetic oligonucleotide
  Target: SCN9A; (+) strand; PAM type: NRG; PAM sequence: AGG
tgcaataatactcctagacc

SEQ ID NO: 55388 - DNA, 20 bp, Artificial Sequence
  Description of Artificial Sequence: Synthetic oligonucleotide
  Target: SCN9A; (+) strand; PAM type: NRG; PAM sequence: AAG
ataatactcctagaccagga

SEQ ID NO: 55389 - DNA, 20 bp, Artificial Sequence
  Description of Artificial Sequence: Synthetic oligonucleotide
  Target: SCN9A; (+) strand; PAM type: NRG; PAM sequence: AAG
actcctagaccaggaaagtg

SEQ ID NO: 55390 - DNA, 20 bp, Artificial Sequence
  Description of Artificial Sequence: Synthetic oligonucleotide
  Target: SCN9A; (+) strand; PAM type: NRG; PAM sequence: TAG
tcaaaaacactttaaatgca

SEQ ID NO: 55391 - DNA, 20 bp, Artificial Sequence
  Description of Artificial Sequence: Synthetic oligonucleotide
  Target: SCN9A; (+) strand; PAM type: NRG; PAM sequence: AGG
caaaaacactttaaatgcat

SEQ ID NO: 55392 - DNA, 20 bp, Artificial Sequence
  Description of Artificial Sequence: Synthetic oligonucleotide
  Target: SCN9A; (+) strand; PAM type: NRG; PAM sequence: CAG
acttaacacaatatacccct

SEQ ID NO: 55393 - DNA, 20 bp, Artificial Sequence
  Description of Artificial Sequence: Synthetic oligonucleotide
  Target: SCN9A; (+) strand; PAM type: NRG; PAM sequence: AGG
cttaacacaatatacccctc

SEQ ID NO: 55394 - DNA, 20 bp, Artificial Sequence
  Description of Artificial Sequence: Synthetic oligonucleotide
  Target: SCN9A; (+) strand; PAM type: NRG; PAM sequence: TGG
acaatatacccctcaggaat

SEQ ID NO: 55395 - DNA, 20 bp, Artificial Sequence
  Description of Artificial Sequence: Synthetic oligonucleotide
  Target: SCN9A; (+) strand; PAM type: NRG; PAM sequence: AAG
cccctcaggaattggtgtcc

SEQ ID NO: 55396 - DNA, 20 bp, Artificial Sequence
  Description of Artificial Sequence: Synthetic oligonucleotide
  Target: SCN9A; (+) strand; PAM type: NRG; PAM sequence: AAG
ctcaggaattggtgtccaag

SEQ ID NO: 55397 - DNA, 20 bp, Artificial Sequence
  Description of Artificial Sequence: Synthetic oligonucleotide
  Target: SCN9A; (+) strand; PAM type: NRG; PAM sequence: CAG
gtccaagaagaaaattgaaa

SEQ ID NO: 55398 - DNA, 20 bp, Artificial Sequence
  Description of Artificial Sequence: Synthetic oligonucleotide
  Target: SCN9A; (+) strand; PAM type: NRG; PAM sequence: TAG
ctttttttgttgttttctat

SEQ ID NO: 55399 - DNA, 20 bp, Artificial Sequence
  Description of Artificial Sequence: Synthetic oligonucleotide
  Target: SCN9A; (+) strand; PAM type: NRG; PAM sequence: TAG
ttagctgtaattacatgatt

SEQ ID NO: 55400 - DNA, 20 bp, Artificial Sequence
  Description of Artificial Sequence: Synthetic oligonucleotide
  Target: SCN9A; (+) strand; PAM type: NRG; PAM sequence: TAG
ttgcaaatgtaattttattt

SEQ ID NO: 55401 - DNA, 20 bp, Artificial Sequence
  Description of Artificial Sequence: Synthetic oligonucleotide
  Target: SCN9A; (+) strand; PAM type: NRG; PAM sequence: AAG
aattttattttagctccatt

SEQ ID NO: 55402 - DNA, 20 bp, Artificial Sequence
  Description of Artificial Sequence: Synthetic oligonucleotide
  Target: SCN9A; (+) strand; PAM type: NRG; PAM sequence: AGG
attttattttagctccatta

SEQ ID NO: 55403 - DNA, 20 bp, Artificial Sequence
  Description of Artificial Sequence: Synthetic oligonucleotide
  Target: SCN9A; (+) strand; PAM type: NRG; PAM sequence: GGG
ttttattttagctccattaa

SEQ ID NO: 55404 - DNA, 20 bp, Artificial Sequence
  Description of Artificial Sequence: Synthetic oligonucleotide
  Target: SCN9A; (+) strand; PAM type: NRG; PAM sequence: TAG
taagggttaaacatatttga

SEQ ID NO: 55405 - DNA, 20 bp, Artificial Sequence
  Description of Artificial Sequence: Synthetic oligonucleotide
  Target: SCN9A; (+) strand; PAM type: NRG; PAM sequence: TGG
aacatatttgatagaatgct

SEQ ID NO: 55406 - DNA, 20 bp, Artificial Sequence
  Description of Artificial Sequence: Synthetic oligonucleotide
  Target: SCN9A; (+) strand; PAM type: NRG; PAM sequence: TAG
atatttgatagaatgcttgg

SEQ ID NO: 55407 - DNA, 20 bp, Artificial Sequence
  Description of Artificial Sequence: Synthetic oligonucleotide
  Target: SCN9A; (+) strand; PAM type: NRG; PAM sequence: CAG
atgcttggtagcgtaaccac

SEQ ID NO: 55408 - DNA, 20 bp, Artificial Sequence
  Description of Artificial Sequence: Synthetic oligonucleotide
  Target: SCN9A; (+) strand; PAM type: NRG; PAM sequence: AGG
tgcttggtagcgtaaccacc

SEQ ID NO: 55409 - DNA, 20 bp, Artificial Sequence
  Description of Artificial Sequence: Synthetic oligonucleotide
  Target: SCN9A; (+) strand; PAM type: NRG; PAM sequence: TGG
aaccaccaggtatatctgtg

SEQ ID NO: 55410 - DNA, 20 bp, Artificial Sequence
  Description of Artificial Sequence: Synthetic oligonucleotide
  Target: SCN9A; (+) strand; PAM type: NRG; PAM sequence: GGG
accaccaggtatatctgtgt

SEQ ID NO: 55411 - DNA, 20 bp, Artificial Sequence
  Description of Artificial Sequence: Synthetic oligonucleotide
  Target: SCN9A; (+) strand; PAM type: NRG; PAM sequence: GGG
ccaccaggtatatctgtgtg

SEQ ID NO: 55412 - DNA, 20 bp, Artificial Sequence
  Description of Artificial Sequence: Synthetic oligonucleotide
  Target: SCN9A; (+) strand; PAM type: NRG; PAM sequence: TGG
ggtatgtgcaaacgtattct

SEQ ID NO: 55413 - DNA, 20 bp, Artificial Sequence
  Description of Artificial Sequence: Synthetic oligonucleotide
  Target: SCN9A; (+) strand; PAM type: NRG; PAM sequence: AAG
aacgtattcttggaatatat

SEQ ID NO: 55414 - DNA, 20 bp, Artificial Sequence
  Description of Artificial Sequence: Synthetic oligonucleotide
  Target: SCN9A; (+) strand; PAM type: NRG; PAM sequence: AAG
ataagatttctttcctataa

SEQ ID NO: 55415 - DNA, 20 bp, Artificial Sequence
  Description of Artificial Sequence: Synthetic oligonucleotide
  Target: SCN9A; (+) strand; PAM type: NRG; PAM sequence: AAG
aagaaatgtgtatgttattc

SEQ ID NO: 55416 - DNA, 20 bp, Artificial Sequence
  Description of Artificial Sequence: Synthetic oligonucleotide
  Target: SCN9A; (+) strand; PAM type: NRG; PAM sequence: TAG
atgtgtatgttattcaagtt

SEQ ID NO: 55417 - DNA, 20 bp, Artificial Sequence
  Description of Artificial Sequence: Synthetic oligonucleotide
  Target: SCN9A; (+) strand; PAM type: NRG; PAM sequence: GAG
tcaagtttagtaaccattgt

SEQ ID NO: 55418 - DNA, 20 bp, Artificial Sequence
  Description of Artificial Sequence: Synthetic oligonucleotide
  Target: SCN9A; (+) strand; PAM type: NRG; PAM sequence: TGG
tagtaaccattgtgagtctt

SEQ ID NO: 55419 - DNA, 20 bp, Artificial Sequence
  Description of Artificial Sequence: Synthetic oligonucleotide
  Target: SCN9A; (+) strand; PAM type: NRG; PAM sequence: AAG
aaccattgtgagtctttgga

SEQ ID NO: 55420 - DNA, 20 bp, Artificial Sequence
  Description of Artificial Sequence: Synthetic oligonucleotide
  Target: SCN9A; (+) strand; PAM type: NRG; PAM sequence: AGG
accattgtgagtctttggaa

SEQ ID NO: 55421 - DNA, 20 bp, Artificial Sequence
  Description of Artificial Sequence: Synthetic oligonucleotide
  Target: SCN9A; (+) strand; PAM type: NRG; PAM sequence: TAG
ttgtgagtctttggaaaggt

SEQ ID NO: 55422 - DNA, 20 bp, Artificial Sequence
  Description of Artificial Sequence: Synthetic oligonucleotide
  Target: SCN9A; (+) strand; PAM type: NRG; PAM sequence: AGG
tgtgagtctttggaaaggtt

SEQ ID NO: 55423 - DNA, 20 bp, Artificial Sequence
  Description of Artificial Sequence: Synthetic oligonucleotide
  Target: SCN9A; (+) strand; PAM type: NRG; PAM sequence: GAG
ggaaaggttaggtaatttct

SEQ ID NO: 55424 - DNA, 20 bp, Artificial Sequence
  Description of Artificial Sequence: Synthetic oligonucleotide
  Target: SCN9A; (+) strand; PAM type: NRG; PAM sequence: TAG
gttaggtaatttctgagcct

SEQ ID NO: 55425 - DNA, 20 bp, Artificial Sequence
  Description of Artificial Sequence: Synthetic oligonucleotide
  Target: SCN9A; (+) strand; PAM type: NRG; PAM sequence: TGG
cttagtgttctcacctcaaa

SEQ ID NO: 55426 - DNA, 20 bp, Artificial Sequence
  Description of Artificial Sequence: Synthetic oligonucleotide
  Target: SCN9A; (+) strand; PAM type: NRG; PAM sequence: TGG
agtgttctcacctcaaatgg

SEQ ID NO: 55427 - DNA, 20 bp, Artificial Sequence
  Description of Artificial Sequence: Synthetic oligonucleotide
  Target: SCN9A; (+) strand; PAM type: NRG; PAM sequence: GAG
tcacctcaaatggtggtcat

SEQ ID NO: 55428 - DNA, 20 bp, Artificial Sequence
  Description of Artificial Sequence: Synthetic oligonucleotide
  Target: SCN9A; (+) strand; PAM type: NRG; PAM sequence: AGG
cacctcaaatggtggtcatg

SEQ ID NO: 55429 - DNA, 20 bp, Artificial Sequence
  Description of Artificial Sequence: Synthetic oligonucleotide
  Target: SCN9A; (+) strand; PAM type: NRG; PAM sequence: CGG
ggtggtcatgaggatttaaa

SEQ ID NO: 55430 - DNA, 20 bp, Artificial Sequence
  Description of Artificial Sequence: Synthetic oligonucleotide
  Target: SCN9A; (+) strand; PAM type: NRG; PAM sequence: GAG
tggtcatgaggatttaaacg

SEQ ID NO: 55431 - DNA, 20 bp, Artificial Sequence
  Description of Artificial Sequence: Synthetic oligonucleotide
  Target: SCN9A; (+) strand; PAM type: NRG; PAM sequence: CAG
aaatcccttaacaaactgct

SEQ ID NO: 55432 - DNA, 20 bp, Artificial Sequence
  Description of Artificial Sequence: Synthetic oligonucleotide
  Target: SCN9A; (+) strand; PAM type: NRG; PAM sequence: TAG
cccttaacaaactgctcagt

SEQ ID NO: 55433 - DNA, 20 bp, Artificial Sequence
  Description of Artificial Sequence: Synthetic oligonucleotide
  Target: SCN9A; (+) strand; PAM type: NRG; PAM sequence: AAG
caaactgctcagttagcatt

SEQ ID NO: 55434 - DNA, 20 bp, Artificial Sequence
  Description of Artificial Sequence: Synthetic oligonucleotide
  Target: SCN9A; (+) strand; PAM type: NRG; PAM sequence: AGG
aaactgctcagttagcatta

SEQ ID NO: 55435 - DNA, 20 bp, Artificial Sequence
  Description of Artificial Sequence: Synthetic oligonucleotide
  Target: SCN9A; (+) strand; PAM type: NRG; PAM sequence: GAG
actgctcagttagcattaag

SEQ ID NO: 55436 - DNA, 20 bp, Artificial Sequence
  Description of Artificial Sequence: Synthetic oligonucleotide
  Target: SCN9A; (+) strand; PAM type: NRG; PAM sequence: AAG
ttaaggagacgtccatacat

SEQ ID NO: 55437 - DNA, 20 bp, Artificial Sequence
  Description of Artificial Sequence: Synthetic oligonucleotide
  Target: SCN9A; (+) strand; PAM type: NRG; PAM sequence: CAG
gactgttacattaatattat

SEQ ID NO: 55438 - DNA, 20 bp, Artificial Sequence
  Description of Artificial Sequence: Synthetic oligonucleotide
  Target: SCN9A; (+) strand; PAM type: NRG; PAM sequence: TAG
attaatattatcagtaatgt

SEQ ID NO: 55439 - DNA, 20 bp, Artificial Sequence
  Description of Artificial Sequence: Synthetic oligonucleotide
  Target: SCN9A; (+) strand; PAM type: NRG; PAM sequence: AAG
atattatcagtaatgttagc

SEQ ID NO: 55440 - DNA, 20 bp, Artificial Sequence
  Description of Artificial Sequence: Synthetic oligonucleotide
  Target: SCN9A; (+) strand; PAM type: NRG; PAM sequence: CAG
gtatgtatttttccttgtaa

SEQ ID NO: 55441 - DNA, 20 bp, Artificial Sequence
  Description of Artificial Sequence: Synthetic oligonucleotide
  Target: SCN9A; (+) strand; PAM type: NRG; PAM sequence: TGG
ccttgtaacagcataattgc

SEQ ID NO: 55442 - DNA, 20 bp, Artificial Sequence
  Description of Artificial Sequence: Synthetic oligonucleotide
  Target: SCN9A; (+) strand; PAM type: NRG; PAM sequence: CAG
gcataattgctggccttgca

SEQ ID NO: 55443 - DNA, 20 bp, Artificial Sequence
  Description of Artificial Sequence: Synthetic oligonucleotide
  Target: SCN9A; (+) strand; PAM type: NRG; PAM sequence: TGG
taattgctggccttgcacag

SEQ ID NO: 55444 - DNA, 20 bp, Artificial Sequence
  Description of Artificial Sequence: Synthetic oligonucleotide
  Target: SCN9A; (+) strand; PAM type: NRG; PAM sequence: TAG
cacctgtaatcccaacactt

SEQ ID NO: 55445 - DNA, 20 bp, Artificial Sequence
  Description of Artificial Sequence: Synthetic oligonucleotide
  Target: SCN9A; (+) strand; PAM type: NRG; PAM sequence: AAG
ctgtaatcccaacactttag

SEQ ID NO: 55446 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccaacactttaga

SEQ ID NO: 55447 - DNA, 20 bp, Artificial Sequence
  Description of Artificial Sequence: Synthetic oligonucleotide
  Target: SCN9A; (+) strand; PAM type: NRG; PAM sequence: GAG
tcccaacactttagaaggcc

SEQ ID NO: 55448 - DNA, 20 bp, Artificial Sequence
  Description of Artificial Sequence: Synthetic oligonucleotide
  Target: SCN9A; (+) strand; PAM type: NRG; PAM sequence: AGG
cccaacactttagaaggccg

SEQ ID NO: 55449 - DNA, 20 bp, Artificial Sequence
  Description of Artificial Sequence: Synthetic oligonucleotide
  Target: SCN9A; (+) strand; PAM type: NRG; PAM sequence: TGG
aacactttagaaggccgagg

SEQ ID NO: 55450 - DNA, 20 bp, Artificial Sequence
  Description of Artificial Sequence: Synthetic oligonucleotide
  Target: SCN9A; (+) strand; PAM type: NRG; PAM sequence: GGG
acactttagaaggccgaggt

SEQ ID NO: 55451 - DNA, 20 bp, Artificial Sequence
  Description of Artificial Sequence: Synthetic oligonucleotide
  Target: SCN9A; (+) strand; PAM type: NRG; PAM sequence: CAG
ctttagaaggccgaggtggg

SEQ ID NO: 55452 - DNA, 20 bp, Artificial Sequence
  Description of Artificial Sequence: Synthetic oligonucleotide
  Target: SCN9A; (+) strand; PAM type: NRG; PAM sequence: GAG
ccgaggtgggcagatcacct

SEQ ID NO: 55453 - DNA, 20 bp, Artificial Sequence
  Description of Artificial Sequence: Synthetic oligonucleotide
  Target: SCN9A; (+) strand; PAM type: NRG; PAM sequence: AGG
cgaggtgggcagatcacctg

SEQ ID NO: 55454 - DNA, 20 bp, Artificial Sequence
  Description of Artificial Sequence: Synthetic oligonucleotide
  Target: SCN9A; (+) strand; PAM type: NRG; PAM sequence: CAG
gtgggcagatcacctgaggt

SEQ ID NO: 55455 - DNA, 20 bp, Artificial Sequence
  Description of Artificial Sequence: Synthetic oligonucleotide
  Target: SCN9A; (+) strand; PAM type: NRG; PAM sequence: AGG
tgggcagatcacctgaggtc

SEQ ID NO: 55456 - DNA, 20 bp, Artificial Sequence
  Description of Artificial Sequence: Synthetic oligonucleotide
  Target: SCN9A; (+) strand; PAM type: NRG; PAM sequence: GAG
tcacctgaggtcaggaattc

SEQ ID NO: 55457 - DNA, 20 bp, Artificial Sequence
  Description of Artificial Sequence: Synthetic oligonucleotide
  Target: SCN9A; (+) strand; PAM type: NRG; PAM sequence: TAG
tgaggtcaggaattcgagac

SEQ ID NO: 55458 - DNA, 20 bp, Artificial Sequence
  Description of Artificial Sequence: Synthetic oligonucleotide
  Target: SCN9A; (+) strand; PAM type: NRG; PAM sequence: TGG
tcaggaattcgagactagtc

SEQ ID NO: 55459 - DNA, 20 bp, Artificial Sequence
  Description of Artificial Sequence: Synthetic oligonucleotide
  Target: SCN9A; (+) strand; PAM type: NRG; PAM sequence: TGG
cgagactagtctggccaaca

SEQ ID NO: 55460 - DNA, 20 bp, Artificial Sequence
  Description of Artificial Sequence: Synthetic oligonucleotide
  Target: SCN9A; (+) strand; PAM type: NRG; PAM sequence: TAG
ctctactaaaactgcaaaat

SEQ ID NO: 55461 - DNA, 20 bp, Artificial Sequence
  Description of Artificial Sequence: Synthetic oligonucleotide
  Target: SCN9A; (+) strand; PAM type: NRG; PAM sequence: CGG
actaaaactgcaaaattagc

SEQ ID NO: 55462 - DNA, 20 bp, Artificial Sequence
  Description of Artificial Sequence: Synthetic oligonucleotide
  Target: SCN9A; (+) strand; PAM type: NRG; PAM sequence: GGG
ctaaaactgcaaaattagcc

SEQ ID NO: 55463 - DNA, 20 bp, Artificial Sequence
  Description of Artificial Sequence: Synthetic oligonucleotide
  Target: SCN9A; (+) strand; PAM type: NRG; PAM sequence: TGG
actgcaaaattagccgggca

SEQ ID NO: 55464 - DNA, 20 bp, Artificial Sequence
  Description of Artificial Sequence: Synthetic oligonucleotide
  Target: SCN9A; (+) strand; PAM type: NRG; PAM sequence: TGG
gcaaaattagccgggcatgg

SEQ ID NO: 55465 - DNA, 20 bp, Artificial Sequence
  Description of Artificial Sequence: Synthetic oligonucleotide
  Target: SCN9A; (+) strand; PAM type: NRG; PAM sequence: CAG
gtggtacatgcctgtaatcc

SEQ ID NO: 55466 - DNA, 20 bp, Artificial Sequence
  Description of Artificial Sequence: Synthetic oligonucleotide
  Target: SCN9A; (+) strand; PAM type: NRG; PAM sequence: TGG
tgcctgtaatcccagctact

SEQ ID NO: 55467 - DNA, 20 bp, Artificial Sequence
  Description of Artificial Sequence: Synthetic oligonucleotide
  Target: SCN9A; (+) strand; PAM type: NRG; PAM sequence: GGG
gcctgtaatcccagctactt

SEQ ID NO: 55468 - DNA, 20 bp, Artificial Sequence
  Description of Artificial Sequence: Synthetic oligonucleotide
  Target: SCN9A; (+) strand; PAM type: NRG; PAM sequence: GAG
ctgtaatcccagctacttgg

SEQ ID NO: 55469 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccagctacttggg

SEQ ID NO: 55470 - DNA, 20 bp, Artificial Sequence
  Description of Artificial Sequence: Synthetic oligonucleotide
  Target: SCN9A; (+) strand; PAM type: NRG; PAM sequence: GAG
tcccagctacttgggaggct

SEQ ID NO: 55471 - DNA, 20 bp, Artificial Sequence
  Description of Artificial Sequence: Synthetic oligonucleotide
  Target: SCN9A; (+) strand; PAM type: NRG; PAM sequence: AGG
cccagctacttgggaggctg

SEQ ID NO: 55472 - DNA, 20 bp, Artificial Sequence
  Description of Artificial Sequence: Synthetic oligonucleotide
  Target: SCN9A; (+) strand; PAM type: NRG; PAM sequence: CAG
agctacttgggaggctgagg

SEQ ID NO: 55473 - DNA, 20 bp, Artificial Sequence
  Description of Artificial Sequence: Synthetic oligonucleotide
  Target: SCN9A; (+) strand; PAM type: NRG; PAM sequence: AGG
gctacttgggaggctgaggc

SEQ ID NO: 55474 - DNA, 20 bp, Artificial Sequence
  Description of Artificial Sequence: Synthetic oligonucleotide
  Target: SCN9A; (+) strand; PAM type: NRG; PAM sequence: GAG
tacttgggaggctgaggcag

SEQ ID NO: 55475 - DNA, 20 bp, Artificial Sequence
  Description of Artificial Sequence: Synthetic oligonucleotide
  Target: SCN9A; (+) strand; PAM type: NRG; PAM sequence: TGG
gcaggagaatcacttgaatc

SEQ ID NO: 55476 - DNA, 20 bp, Artificial Sequence
  Description of Artificial Sequence: Synthetic oligonucleotide
  Target: SCN9A; (+) strand; PAM type: NRG; PAM sequence: GGG
caggagaatcacttgaatct

SEQ ID NO: 55477 - DNA, 20 bp, Artificial Sequence
  Description of Artificial Sequence: Synthetic oligonucleotide
  Target: SCN9A; (+) strand; PAM type: NRG; PAM sequence: GAG
ggagaatcacttgaatctgg

SEQ ID NO: 55478 - DNA, 20 bp, Artificial Sequence
  Description of Artificial Sequence: Synthetic oligonucleotide
  Target: SCN9A; (+) strand; PAM type: NRG; PAM sequence: AGG
gagaatcacttgaatctggg

SEQ ID NO: 55479 - DNA, 20 bp, Artificial Sequence
  Description of Artificial Sequence: Synthetic oligonucleotide
  Target: SCN9A; (+) strand; PAM type: NRG; PAM sequence: CAG
aatcacttgaatctgggagg

SEQ ID NO: 55480 - DNA, 20 bp, Artificial Sequence
  Description of Artificial Sequence: Synthetic oligonucleotide
  Target: SCN9A; (+) strand; PAM type: NRG; PAM sequence: GAG
tcacttgaatctgggaggca

SEQ ID NO: 55481 - DNA, 20 bp, Artificial Sequence
  Description of Artificial Sequence: Synthetic oligonucleotide
  Target: SCN9A; (+) strand; PAM type: NRG; PAM sequence: AGG
cacttgaatctgggaggcag

SEQ ID NO: 55482 - DNA, 20 bp, Artificial Sequence
  Description of Artificial Sequence: Synthetic oligonucleotide
  Target: SCN9A; (+) strand; PAM type: NRG; PAM sequence: CAG
aatctgggaggcagaggttg

SEQ ID NO: 55483 - DNA, 20 bp, Artificial Sequence
  Description of Artificial Sequence: Synthetic oligonucleotide
  Target: SCN9A; (+) strand; PAM type: NRG; PAM sequence: GAG
tgggaggcagaggttgcagc

SEQ ID NO: 55484 - DNA, 20 bp, Artificial Sequence
  Description of Artificial Sequence: Synthetic oligonucleotide
  Target: SCN9A; (+) strand; PAM type: NRG; PAM sequence: CAG
aacatcgtaccactgcactc

SEQ ID NO: 55485 - DNA, 20 bp, Artificial Sequence
  Description of Artificial Sequence: Synthetic oligonucleotide
  Target: SCN9A; (+) strand; PAM type: NRG; PAM sequence: TGG
cgtaccactgcactccagcc

SEQ ID NO: 55486 - DNA, 20 bp, Artificial Sequence
  Description of Artificial Sequence: Synthetic oligonucleotide
  Target: SCN9A; (+) strand; PAM type: NRG; PAM sequence: GGG
gtaccactgcactccagcct

SEQ ID NO: 55487 - DNA, 20 bp, Artificial Sequence
  Description of Artificial Sequence: Synthetic oligonucleotide
  Target: SCN9A; (+) strand; PAM type: NRG; PAM sequence: CAG
ctgcactccagcctgggcaa

SEQ ID NO: 55488 - DNA, 20 bp, Artificial Sequence
  Description of Artificial Sequence: Synthetic oligonucleotide
  Target: SCN9A; (+) strand; PAM type: NRG; PAM sequence: GAG
gcactccagcctgggcaaca

SEQ ID NO: 55489 - DNA, 20 bp, Artificial Sequence
  Description of Artificial Sequence: Synthetic oligonucleotide
  Target: SCN9A; (+) strand; PAM type: NRG; PAM sequence: CGG
cctgggcaacagagtgaaac

SEQ ID NO: 55490 - DNA, 20 bp, Artificial Sequence
  Description of Artificial Sequence: Synthetic oligonucleotide
  Target: SCN9A; (+) strand; PAM type: NRG; PAM sequence: AAG
taattaaaaaaaaaaaaaaa

SEQ ID NO: 55491 - DNA, 20 bp, Artificial Sequence
  Description of Artificial Sequence: Synthetic oligonucleotide
  Target: SCN9A; (+) strand; PAM type: NRG; PAM sequence: GAG
attaaaaaaaaaaaaaaaaa

SEQ ID NO: 55492 - DNA, 20 bp, Artificial Sequence
  Description of Artificial Sequence: Synthetic oligonucleotide
  Target: SCN9A; (+) strand; PAM type: NRG; PAM sequence: AGG
ttaaaaaaaaaaaaaaaaag

SEQ ID NO: 55493 - DNA, 20 bp, Artificial Sequence
  Description of Artificial Sequence: Synthetic oligonucleotide
  Target: SCN9A; (+) strand; PAM type: NRG; PAM sequence: TGG
aaaaaaaaaaaaaaagaggc

SEQ ID NO: 55494 - DNA, 20 bp, Artificial Sequence
  Description of Artificial Sequence: Synthetic oligonucleotide
  Target: SCN9A; (+) strand; PAM type: NRG; PAM sequence: GGG
aaaaaaaaaaaaaagaggct

SEQ ID NO: 55495 - DNA, 20 bp, Artificial Sequence
  Description of Artificial Sequence: Synthetic oligonucleotide
  Target: SCN9A; (+) strand; PAM type: NRG; PAM sequence: TGG
aaaaaaaaagaggctgggca

SEQ ID NO: 55496 - DNA, 20 bp, Artificial Sequence
  Description of Artificial Sequence: Synthetic oligonucleotide
  Target: SCN9A; (+) strand; PAM type: NRG; PAM sequence: TGG
aaaaaagaggctgggcatgg

SEQ ID NO: 55497 - DNA, 20 bp, Artificial Sequence
  Description of Artificial Sequence: Synthetic oligonucleotide
  Target: SCN9A; (+) strand; PAM type: NRG; PAM sequence: CAG
gtggctcacgcctataatcc

SEQ ID NO: 55498 - DNA, 20 bp, Artificial Sequence
  Description of Artificial Sequence: Synthetic oligonucleotide
  Target: SCN9A; (+) strand; PAM type: NRG; PAM sequence: TGG
cgcctataatcccagcactt

SEQ ID NO: 55499 - DNA, 20 bp, Artificial Sequence
  Description of Artificial Sequence: Synthetic oligonucleotide
  Target: SCN9A; (+) strand; PAM type: NRG; PAM sequence: GGG
gcctataatcccagcacttt

SEQ ID NO: 55500 - DNA, 20 bp, Artificial Sequence
  Description of Artificial Sequence: Synthetic oligonucleotide
  Target: SCN9A; (+) strand; PAM type: NRG; PAM sequence: GGG
cctataatcccagcactttg

SEQ ID NO: 55501 - DNA, 20 bp, Artificial Sequence
  Description of Artificial Sequence: Synthetic oligonucleotide
  Target: SCN9A; (+) strand; PAM type: NRG; PAM sequence: GGG
ctataatcccagcactttgg

SEQ ID NO: 55502 - DNA, 20 bp, Artificial Sequence
  Description of Artificial Sequence: Synthetic oligonucleotide
  Target: SCN9A; (+) strand; PAM type: NRG; PAM sequence: GGG
tataatcccagcactttggg

SEQ ID NO: 55503 - DNA, 20 bp, Artificial Sequence
  Description of Artificial Sequence: Synthetic oligonucleotide
  Target: SCN9A; (+) strand; PAM type: NRG; PAM sequence: TAG
tcccagcactttggggggcc

SEQ ID NO: 55504 - DNA, 20 bp, Artificial Sequence
  Description of Artificial Sequence: Synthetic oligonucleotide
  Target: SCN9A; (+) strand; PAM type: NRG; PAM sequence: AGG
cccagcactttggggggcct

SEQ ID NO: 55505 - DNA, 20 bp, Artificial Sequence
  Description of Artificial Sequence: Synthetic oligonucleotide
  Target: SCN9A; (+) strand; PAM type: NRG; PAM sequence: CGG
agcactttggggggcctagg

SEQ ID NO: 55506 - DNA, 20 bp, Artificial Sequence
  Description of Artificial Sequence: Synthetic oligonucleotide
  Target: SCN9A; (+) strand; PAM type: NRG; PAM sequence: GGG
gcactttggggggcctaggc

SEQ ID NO: 55507 - DNA, 20 bp, Artificial Sequence
  Description of Artificial Sequence: Synthetic oligonucleotide
  Target: SCN9A; (+) strand; PAM type: NRG; PAM sequence: CAG
ctttggggggcctaggcggg

SEQ ID NO: 55508 - DNA, 20 bp, Artificial Sequence
  Description of Artificial Sequence: Synthetic oligonucleotide
  Target: SCN9A; (+) strand; PAM type: NRG; PAM sequence: CAG
gcgggcagatcacctgaact

SEQ ID NO: 55509 - DNA, 20 bp, Artificial Sequence
  Description of Artificial Sequence: Synthetic oligonucleotide
  Target: SCN9A; (+) strand; PAM type: NRG; PAM sequence: AGG
cgggcagatcacctgaactc

SEQ ID NO: 55510 - DNA, 20 bp, Artificial Sequence
  Description of Artificial Sequence: Synthetic oligonucleotide
  Target: SCN9A; (+) strand; PAM type: NRG; PAM sequence: GAG
ggcagatcacctgaactcag

SEQ ID NO: 55511 - DNA, 20 bp, Artificial Sequence
  Description of Artificial Sequence: Synthetic oligonucleotide
  Target: SCN9A; (+) strand; PAM type: NRG; PAM sequence: AAG
tcacctgaactcaggagttc

SEQ ID NO: 55512 - DNA, 20 bp, Artificial Sequence
  Description of Artificial Sequence: Synthetic oligonucleotide
  Target: SCN9A; (+) strand; PAM type: NRG; PAM sequence: CAG
tgaactcaggagttcaagac

SEQ ID NO: 55513 - DNA, 20 bp, Artificial Sequence
  Description of Artificial Sequence: Synthetic oligonucleotide
  Target: SCN9A; (+) strand; PAM type: NRG; PAM sequence: TGG
caagaccagcctgcccaacc

SEQ ID NO: 55514 - DNA, 20 bp, Artificial Sequence
  Description of Artificial Sequence: Synthetic oligonucleotide
  Target: SCN9A; (+) strand; PAM type: NRG; PAM sequence: TAG
ctctactaaaaatacaaaat

SEQ ID NO: 55515 - DNA, 20 bp, Artificial Sequence
  Description of Artificial Sequence: Synthetic oligonucleotide
  Target: SCN9A; (+) strand; PAM type: NRG; PAM sequence: CAG
actaaaaatacaaaattagc

SEQ ID NO: 55516 - DNA, 20 bp, Artificial Sequence
  Description of Artificial Sequence: Synthetic oligonucleotide
  Target: SCN9A; (+) strand; PAM type: NRG; PAM sequence: AGG
ctaaaaatacaaaattagcc

SEQ ID NO: 55517 - DNA, 20 bp, Artificial Sequence
  Description of Artificial Sequence: Synthetic oligonucleotide
  Target: SCN9A; (+) strand; PAM type: NRG; PAM sequence: GAG
aaatacaaaattagccaggc

SEQ ID NO: 55518 - DNA, 20 bp, Artificial Sequence
  Description of Artificial Sequence: Synthetic oligonucleotide
  Target: SCN9A; (+) strand; PAM type: NRG; PAM sequence: AGG
aatacaaaattagccaggcg

SEQ ID NO: 55519 - DNA, 20 bp, Artificial Sequence
  Description of Artificial Sequence: Synthetic oligonucleotide
  Target: SCN9A; (+) strand; PAM type: NRG; PAM sequence: TGG
acaaaattagccaggcgagg

SEQ ID NO: 55520 - DNA, 20 bp, Artificial Sequence
  Description of Artificial Sequence: Synthetic oligonucleotide
  Target: SCN9A; (+) strand; PAM type: NRG; PAM sequence: CGG
gtggctcatgcctgtaatcc

SEQ ID NO: 55521 - DNA, 20 bp, Artificial Sequence
  Description of Artificial Sequence: Synthetic oligonucleotide
  Target: SCN9A; (+) strand; PAM type: NRG; PAM sequence: CGG
tgcctgtaatcccggctact

SEQ ID NO: 55522 - DNA, 20 bp, Artificial Sequence
  Description of Artificial Sequence: Synthetic oligonucleotide
  Target: SCN9A; (+) strand; PAM type: NRG; PAM sequence: GGG
gcctgtaatcccggctactc

SEQ ID NO: 55523 - DNA, 20 bp, Artificial Sequence
  Description of Artificial Sequence: Synthetic oligonucleotide
  Target: SCN9A; (+) strand; PAM type: NRG; PAM sequence: GAG
ctgtaatcccggctactcgg

SEQ ID NO: 55524 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccggctactcggg

SEQ ID NO: 55525 - DNA, 20 bp, Artificial Sequence
  Description of Artificial Sequence: Synthetic oligonucleotide
  Target: SCN9A; (+) strand; PAM type: NRG; PAM sequence: GAG
tcccggctactcgggaggct

SEQ ID NO: 55526 - DNA, 20 bp, Artificial Sequence
  Description of Artificial Sequence: Synthetic oligonucleotide
  Target: SCN9A; (+) strand; PAM type: NRG; PAM sequence: AGG
cccggctactcgggaggctg

SEQ ID NO: 55527 - DNA, 20 bp, Artificial Sequence
  Description of Artificial Sequence: Synthetic oligonucleotide
  Target: SCN9A; (+) strand; PAM type: NRG; PAM sequence: CAG
ggctactcgggaggctgagg

SEQ ID NO: 55528 - DNA, 20 bp, Artificial Sequence
  Description of Artificial Sequence: Synthetic oligonucleotide
  Target: SCN9A; (+) strand; PAM type: NRG; PAM sequence: AGG
gctactcgggaggctgaggc

SEQ ID NO: 55529 - DNA, 20 bp, Artificial Sequence
  Description of Artificial Sequence: Synthetic oligonucleotide
  Target: SCN9A; (+) strand; PAM type: NRG; PAM sequence: GAG
tactcgggaggctgaggcag

SEQ ID NO: 55530 - DNA, 20 bp, Artificial Sequence
  Description of Artificial Sequence: Synthetic oligonucleotide
  Target: SCN9A; (+) strand; PAM type: NRG; PAM sequence: TGG
gcaggagaattgcttgaacc

SEQ ID NO: 55531 - DNA, 20 bp, Artificial Sequence
  Description of Artificial Sequence: Synthetic oligonucleotide
  Target: SCN9A; (+) strand; PAM type: NRG; PAM sequence: GGG
caggagaattgcttgaacct

SEQ ID NO: 55532 - DNA, 20 bp, Artificial Sequence
  Description of Artificial Sequence: Synthetic oligonucleotide
  Target: SCN9A; (+) strand; PAM type: NRG; PAM sequence: GAG
ggagaattgcttgaacctgg

SEQ ID NO: 55533 - DNA, 20 bp, Artificial Sequence
  Description of Artificial Sequence: Synthetic oligonucleotide
  Target: SCN9A; (+) strand; PAM type: NRG; PAM sequence: AGG
gagaattgcttgaacctggg

SEQ ID NO: 55534 - DNA, 20 bp, Artificial Sequence
  Description of Artificial Sequence: Synthetic oligonucleotide
  Target: SCN9A; (+) strand; PAM type: NRG; PAM sequence: CGG
aattgcttgaacctgggagg

SEQ ID NO: 55535 - DNA, 20 bp, Artificial Sequence
  Description of Artificial Sequence: Synthetic oligonucleotide
  Target: SCN9A; (+) strand; PAM type: NRG; PAM sequence: AAG
tgcttgaacctgggaggcgg

SEQ ID NO: 55536 - DNA, 20 bp, Artificial Sequence
  Description of Artificial Sequence: Synthetic oligonucleotide
  Target: SCN9A; (+) strand; PAM type: NRG; PAM sequence: CAG
aacctgggaggcggaagttg

SEQ ID NO: 55537 - DNA, 20 bp, Artificial Sequence
  Description of Artificial Sequence: Synthetic oligonucleotide
  Target: SCN9A; (+) strand; PAM type: NRG; PAM sequence: GAG
tgggaggcggaagttgcagt

SEQ ID NO: 55538 - DNA, 20 bp, Artificial Sequence
  Description of Artificial Sequence: Synthetic oligonucleotide
  Target: SCN9A; (+) strand; PAM type: NRG; PAM sequence: AAG
ggcggaagttgcagtgagcc

SEQ ID NO: 55539 - DNA, 20 bp, Artificial Sequence
  Description of Artificial Sequence: Synthetic oligonucleotide
  Target: SCN9A; (+) strand; PAM type: NRG; PAM sequence: CAG
aagatcgtaccattgcactc

SEQ ID NO: 55540 - DNA, 20 bp, Artificial Sequence
  Description of Artificial Sequence: Synthetic oligonucleotide
  Target: SCN9A; (+) strand; PAM type: NRG; PAM sequence: TGG
cgtaccattgcactccagcc

SEQ ID NO: 55541 - DNA, 20 bp, Artificial Sequence
  Description of Artificial Sequence: Synthetic oligonucleotide
  Target: SCN9A; (+) strand; PAM type: NRG; PAM sequence: GGG
gtaccattgcactccagcct

SEQ ID NO: 55542 - DNA, 20 bp, Artificial Sequence
  Description of Artificial Sequence: Synthetic oligonucleotide
  Target: SCN9A; (+) strand; PAM type: NRG; PAM sequence: AAG
tgcactccagcctgggcaac

SEQ ID NO: 55543 - DNA, 20 bp, Artificial Sequence
  Description of Artificial Sequence: Synthetic oligonucleotide
  Target: SCN9A; (+) strand; PAM type: NRG; PAM sequence: GAG
cactccagcctgggcaacaa

SEQ ID NO: 55544 - DNA, 20 bp, Artificial Sequence
  Description of Artificial Sequence: Synthetic oligonucleotide
  Target: SCN9A; (+) strand; PAM type: NRG; PAM sequence: CGG
tgggcaacaagagtgaaact

SEQ ID NO: 55545 - DNA, 20 bp, Artificial Sequence
  Description of Artificial Sequence: Synthetic oligonucleotide
  Target: SCN9A; (+) strand; PAM type: NRG; PAM sequence: AAG
tcggtctcaaaaaaaaaaaa

SEQ ID NO: 55546 - DNA, 20 bp, Artificial Sequence
  Description of Artificial Sequence: Synthetic oligonucleotide
  Target: SCN9A; (+) strand; PAM type: NRG; PAM sequence: AAG
cattttgattataatattct

SEQ ID NO: 55547 - DNA, 20 bp, Artificial Sequence
  Description of Artificial Sequence: Synthetic oligonucleotide
  Target: SCN9A; (+) strand; PAM type: NRG; PAM sequence: TAG
attctaagttattaaatgcc

SEQ ID NO: 55548 - DNA, 20 bp, Artificial Sequence
  Description of Artificial Sequence: Synthetic oligonucleotide
  Target: SCN9A; (+) strand; PAM type: NRG; PAM sequence: AAG
catatctacttatcatgtgt

SEQ ID NO: 55549 - DNA, 20 bp, Artificial Sequence
  Description of Artificial Sequence: Synthetic oligonucleotide
  Target: SCN9A; (+) strand; PAM type: NRG; PAM sequence: AAG
ttatcatgtgtaagacacta

SEQ ID NO: 55550 - DNA, 20 bp, Artificial Sequence
  Description of Artificial Sequence: Synthetic oligonucleotide
  Target: SCN9A; (+) strand; PAM type: NRG; PAM sequence: TGG
tcatgtgtaagacactaaag

SEQ ID NO: 55551 - DNA, 20 bp, Artificial Sequence
  Description of Artificial Sequence: Synthetic oligonucleotide
  Target: SCN9A; (+) strand; PAM type: NRG; PAM sequence: TGG
agacactaaagtggctgttt

SEQ ID NO: 55552 - DNA, 20 bp, Artificial Sequence
  Description of Artificial Sequence: Synthetic oligonucleotide
  Target: SCN9A; (+) strand; PAM type: NRG; PAM sequence: TAG
tctatatataacatataata

SEQ ID NO: 55553 - DNA, 20 bp, Artificial Sequence
  Description of Artificial Sequence: Synthetic oligonucleotide
  Target: SCN9A; (+) strand; PAM type: NRG; PAM sequence: TAG
ataacatataatatagtcct

SEQ ID NO: 55554 - DNA, 20 bp, Artificial Sequence
  Description of Artificial Sequence: Synthetic oligonucleotide
  Target: SCN9A; (+) strand; PAM type: NRG; PAM sequence: AAG
acatataatatagtccttag

SEQ ID NO: 55555 - DNA, 20 bp, Artificial Sequence
  Description of Artificial Sequence: Synthetic oligonucleotide
  Target: SCN9A; (+) strand; PAM type: NRG; PAM sequence: CAG
aagtaaatactactaattta

SEQ ID NO: 55556 - DNA, 20 bp, Artificial Sequence
  Description of Artificial Sequence: Synthetic oligonucleotide
  Target: SCN9A; (+) strand; PAM type: NRG; PAM sequence: AGG
agtaaatactactaatttac

SEQ ID NO: 55557 - DNA, 20 bp, Artificial Sequence
  Description of Artificial Sequence: Synthetic oligonucleotide
  Target: SCN9A; (+) strand; PAM type: NRG; PAM sequence: AAG
aatactactaatttacagga

SEQ ID NO: 55558 - DNA, 20 bp, Artificial Sequence
  Description of Artificial Sequence: Synthetic oligonucleotide
  Target: SCN9A; (+) strand; PAM type: NRG; PAM sequence: AAG
tttacaggaaagcaatattt

SEQ ID NO: 55559 - DNA, 20 bp, Artificial Sequence
  Description of Artificial Sequence: Synthetic oligonucleotide
  Target: SCN9A; (+) strand; PAM type: NRG; PAM sequence: AAG
taagaaattaatatttgact

SEQ ID NO: 55560 - DNA, 20 bp, Artificial Sequence
  Description of Artificial Sequence: Synthetic oligonucleotide
  Target: SCN9A; (+) strand; PAM type: NRG; PAM sequence: GAG
tttgactaagaccacatact

SEQ ID NO: 55561 - DNA, 20 bp, Artificial Sequence
  Description of Artificial Sequence: Synthetic oligonucleotide
  Target: SCN9A; (+) strand; PAM type: NRG; PAM sequence: AAG
ctaagaccacatactgagta

SEQ ID NO: 55562 - DNA, 20 bp, Artificial Sequence
  Description of Artificial Sequence: Synthetic oligonucleotide
  Target: SCN9A; (+) strand; PAM type: NRG; PAM sequence: AGG
taagaccacatactgagtaa

SEQ ID NO: 55563 - DNA, 20 bp, Artificial Sequence
  Description of Artificial Sequence: Synthetic oligonucleotide
  Target: SCN9A; (+) strand; PAM type: NRG; PAM sequence: TGG
tactgagtaaaggaaatatt

SEQ ID NO: 55564 - DNA, 20 bp, Artificial Sequence
  Description of Artificial Sequence: Synthetic oligonucleotide
  Target: SCN9A; (+) strand; PAM type: NRG; PAM sequence: GGG
actgagtaaaggaaatattt

SEQ ID NO: 55565 - DNA, 20 bp, Artificial Sequence
  Description of Artificial Sequence: Synthetic oligonucleotide
  Target: SCN9A; (+) strand; PAM type: NRG; PAM sequence: CAG
cactttataaaaatatttta

SEQ ID NO: 55566 - DNA, 20 bp, Artificial Sequence
  Description of Artificial Sequence: Synthetic oligonucleotide
  Target: SCN9A; (+) strand; PAM type: NRG; PAM sequence: TAG
atattttacagtctgaaata

SEQ ID NO: 55567 - DNA, 20 bp, Artificial Sequence
  Description of Artificial Sequence: Synthetic oligonucleotide
  Target: SCN9A; (+) strand; PAM type: NRG; PAM sequence: TAG
ttttacagtctgaaatatag

SEQ ID NO: 55568 - DNA, 20 bp, Artificial Sequence
  Description of Artificial Sequence: Synthetic oligonucleotide
  Target: SCN9A; (+) strand; PAM type: NRG; PAM sequence: GAG
ttacagtctgaaatatagta

SEQ ID NO: 55569 - DNA, 20 bp, Artificial Sequence
  Description of Artificial Sequence: Synthetic oligonucleotide
  Target: SCN9A; (+) strand; PAM type: NRG; PAM sequence: AAG
agatgtaatataaattttga

SEQ ID NO: 55570 - DNA, 20 bp, Artificial Sequence
  Description of Artificial Sequence: Synthetic oligonucleotide
  Target: SCN9A; (+) strand; PAM type: NRG; PAM sequence: AGG
gatgtaatataaattttgaa

SEQ ID NO: 55571 - DNA, 20 bp, Artificial Sequence
  Description of Artificial Sequence: Synthetic oligonucleotide
  Target: SCN9A; (+) strand; PAM type: NRG; PAM sequence: TAG
ttgaaaggcacttctctgcc

SEQ ID NO: 55572 - DNA, 20 bp, Artificial Sequence
  Description of Artificial Sequence: Synthetic oligonucleotide
  Target: SCN9A; (+) strand; PAM type: NRG; PAM sequence: AAG
tctctgcctagctgttctac

SEQ ID NO: 55573 - DNA, 20 bp, Artificial Sequence
  Description of Artificial Sequence: Synthetic oligonucleotide
  Target: SCN9A; (+) strand; PAM type: NRG; PAM sequence: AAG
ctacaagtgttcattcctaa

SEQ ID NO: 55574 - DNA, 20 bp, Artificial Sequence
  Description of Artificial Sequence: Synthetic oligonucleotide
  Target: SCN9A; (+) strand; PAM type: NRG; PAM sequence: CAG
gttcattcctaaaagtctgt

SEQ ID NO: 55575 - DNA, 20 bp, Artificial Sequence
  Description of Artificial Sequence: Synthetic oligonucleotide
  Target: SCN9A; (+) strand; PAM type: NRG; PAM sequence: TGG
aagtctgtcagctgatctca

SEQ ID NO: 55576 - DNA, 20 bp, Artificial Sequence
  Description of Artificial Sequence: Synthetic oligonucleotide
  Target: SCN9A; (+) strand; PAM type: NRG; PAM sequence: GGG
agtctgtcagctgatctcat

SEQ ID NO: 55577 - DNA, 20 bp, Artificial Sequence
  Description of Artificial Sequence: Synthetic oligonucleotide
  Target: SCN9A; (+) strand; PAM type: NRG; PAM sequence: AAG
agctgatctcatgggattat

SEQ ID NO: 55578 - DNA, 20 bp, Artificial Sequence
  Description of Artificial Sequence: Synthetic oligonucleotide
  Target: SCN9A; (+) strand; PAM type: NRG; PAM sequence: CAG
gattataagaaccttattcc

SEQ ID NO: 55579 - DNA, 20 bp, Artificial Sequence
  Description of Artificial Sequence: Synthetic oligonucleotide
  Target: SCN9A; (+) strand; PAM type: NRG; PAM sequence: GAG
cttattcccagttgatccct

SEQ ID NO: 55580 - DNA, 20 bp, Artificial Sequence
  Description of Artificial Sequence: Synthetic oligonucleotide
  Target: SCN9A; (+) strand; PAM type: NRG; PAM sequence: TAG
attcccagttgatccctgag

SEQ ID NO: 55581 - DNA, 20 bp, Artificial Sequence
  Description of Artificial Sequence: Synthetic oligonucleotide
  Target: SCN9A; (+) strand; PAM type: NRG; PAM sequence: AGG
ttcccagttgatccctgagt

SEQ ID NO: 55582 - DNA, 20 bp, Artificial Sequence
  Description of Artificial Sequence: Synthetic oligonucleotide
  Target: SCN9A; (+) strand; PAM type: NRG; PAM sequence: GAG
tttcctacctgaattaccat

SEQ ID NO: 55583 - DNA, 20 bp, Artificial Sequence
  Description of Artificial Sequence: Synthetic oligonucleotide
  Target: SCN9A; (+) strand; PAM type: NRG; PAM sequence: AAG
tacctgaattaccatgagcc

SEQ ID NO: 55584 - DNA, 20 bp, Artificial Sequence
  Description of Artificial Sequence: Synthetic oligonucleotide
  Target: SCN9A; (+) strand; PAM type: NRG; PAM sequence: TGG
ccatgagccaagtttgtaaa

SEQ ID NO: 55585 - DNA, 20 bp, Artificial Sequence
  Description of Artificial Sequence: Synthetic oligonucleotide
  Target: SCN9A; (+) strand; PAM type: NRG; PAM sequence: GGG
catgagccaagtttgtaaat

SEQ ID NO: 55586 - DNA, 20 bp, Artificial Sequence
  Description of Artificial Sequence: Synthetic oligonucleotide
  Target: SCN9A; (+) strand; PAM type: NRG; PAM sequence: GGG
atgagccaagtttgtaaatg

SEQ ID NO: 55587 - DNA, 20 bp, Artificial Sequence
  Description of Artificial Sequence: Synthetic oligonucleotide
  Target: SCN9A; (+) strand; PAM type: NRG; PAM sequence: AAG
aagtttgtaaatggggtaac

SEQ ID NO: 55588 - DNA, 20 bp, Artificial Sequence
  Description of Artificial Sequence: Synthetic oligonucleotide
  Target: SCN9A; (+) strand; PAM type: NRG; PAM sequence: AAG
acaagaatacatattttgtt

SEQ ID NO: 55589 - DNA, 20 bp, Artificial Sequence
  Description of Artificial Sequence: Synthetic oligonucleotide
  Target: SCN9A; (+) strand; PAM type: NRG; PAM sequence: GAG
aagaatacatattttgttaa

SEQ ID NO: 55590 - DNA, 20 bp, Artificial Sequence
  Description of Artificial Sequence: Synthetic oligonucleotide
  Target: SCN9A; (+) strand; PAM type: NRG; PAM sequence: AGG
agaatacatattttgttaag

SEQ ID NO: 55591 - DNA, 20 bp, Artificial Sequence
  Description of Artificial Sequence: Synthetic oligonucleotide
  Target: SCN9A; (+) strand; PAM type: NRG; PAM sequence: GGG
gaatacatattttgttaaga

SEQ ID NO: 55592 - DNA, 20 bp, Artificial Sequence
  Description of Artificial Sequence: Synthetic oligonucleotide
  Target: SCN9A; (+) strand; PAM type: NRG; PAM sequence: AAG
ataatattttgttccatgca

SEQ ID NO: 55593 - DNA, 20 bp, Artificial Sequence
  Description of Artificial Sequence: Synthetic oligonucleotide
  Target: SCN9A; (+) strand; PAM type: NRG; PAM sequence: AAG
ccatgcaaagatcatttaca

SEQ ID NO: 55594 - DNA, 20 bp, Artificial Sequence
  Description of Artificial Sequence: Synthetic oligonucleotide
  Target: SCN9A; (+) strand; PAM type: NRG; PAM sequence: TGG
caaagatcatttacaaagat

SEQ ID NO: 55595 - DNA, 20 bp, Artificial Sequence
  Description of Artificial Sequence: Synthetic oligonucleotide
  Target: SCN9A; (+) strand; PAM type: NRG; PAM sequence: TAG
ttggtcccataatatttacc

SEQ ID NO: 55596 - DNA, 20 bp, Artificial Sequence
  Description of Artificial Sequence: Synthetic oligonucleotide
  Target: SCN9A; (+) strand; PAM type: NRG; PAM sequence: AAG
gtcccataatatttacctag

SEQ ID NO: 55597 - DNA, 20 bp, Artificial Sequence
  Description of Artificial Sequence: Synthetic oligonucleotide
  Target: SCN9A; (+) strand; PAM type: NRG; PAM sequence: AGG
tcccataatatttacctaga

SEQ ID NO: 55598 - DNA, 20 bp, Artificial Sequence
  Description of Artificial Sequence: Synthetic oligonucleotide
  Target: SCN9A; (+) strand; PAM type: NRG; PAM sequence: CAG
tttacctagaaggaatcact

SEQ ID NO: 55599 - DNA, 20 bp, Artificial Sequence
  Description of Artificial Sequence: Synthetic oligonucleotide
  Target: SCN9A; (+) strand; PAM type: NRG; PAM sequence: AAG
tagaaggaatcactcagata

SEQ ID NO: 55600 - DNA, 20 bp, Artificial Sequence
  Description of Artificial Sequence: Synthetic oligonucleotide
  Target: SCN9A; (+) strand; PAM type: NRG; PAM sequence: AGG
agaaggaatcactcagataa

SEQ ID NO: 55601 - DNA, 20 bp, Artificial Sequence
  Description of Artificial Sequence: Synthetic oligonucleotide
  Target: SCN9A; (+) strand; PAM type: NRG; PAM sequence: AAG
aaaggcatcacttaccaata

SEQ ID NO: 55602 - DNA, 20 bp, Artificial Sequence
  Description of Artificial Sequence: Synthetic oligonucleotide
  Target: SCN9A; (+) strand; PAM type: NRG; PAM sequence: GAG
caataaattatctttactct

SEQ ID NO: 55603 - DNA, 20 bp, Artificial Sequence
  Description of Artificial Sequence: Synthetic oligonucleotide
  Target: SCN9A; (+) strand; PAM type: NRG; PAM sequence: AAG
atctttactctgagccctaa

SEQ ID NO: 55604 - DNA, 20 bp, Artificial Sequence
  Description of Artificial Sequence: Synthetic oligonucleotide
  Target: SCN9A; (+) strand; PAM type: NRG; PAM sequence: TAG
ctaaaagatacactgtctat

SEQ ID NO: 55605 - DNA, 20 bp, Artificial Sequence
  Description of Artificial Sequence: Synthetic oligonucleotide
  Target: SCN9A; (+) strand; PAM type: NRG; PAM sequence: AAG
acactgtctattagacttga

SEQ ID NO: 55606 - DNA, 20 bp, Artificial Sequence
  Description of Artificial Sequence: Synthetic oligonucleotide
  Target: SCN9A; (+) strand; PAM type: NRG; PAM sequence: TAG
gtctattagacttgaaagaa

SEQ ID NO: 55607 - DNA, 20 bp, Artificial Sequence
  Description of Artificial Sequence: Synthetic oligonucleotide
  Target: SCN9A; (+) strand; PAM type: NRG; PAM sequence: TAG
gacttgaaagaatagtcatt

SEQ ID NO: 55608 - DNA, 20 bp, Artificial Sequence
  Description of Artificial Sequence: Synthetic oligonucleotide
  Target: SCN9A; (+) strand; PAM type: NRG; PAM sequence: TAG
ttgaaagaatagtcatttag

SEQ ID NO: 55609 - DNA, 20 bp, Artificial Sequence
  Description of Artificial Sequence: Synthetic oligonucleotide
  Target: SCN9A; (+) strand; PAM type: NRG; PAM sequence: GAG
gaaagaatagtcatttagta

SEQ ID NO: 55610 - DNA, 20 bp, Artificial Sequence
  Description of Artificial Sequence: Synthetic oligonucleotide
  Target: SCN9A; (+) strand; PAM type: NRG; PAM sequence: TAG
tataaattttaatttttttg

SEQ ID NO: 55611 - DNA, 20 bp, Artificial Sequence
  Description of Artificial Sequence: Synthetic oligonucleotide
  Target: SCN9A; (+) strand; PAM type: NRG; PAM sequence: CAG
ttttaatttttttgtagaaa

SEQ ID NO: 55612 - DNA, 20 bp, Artificial Sequence
  Description of Artificial Sequence: Synthetic oligonucleotide
  Target: SCN9A; (+) strand; PAM type: NRG; PAM sequence: CAG
cagattttccttttattgcc

SEQ ID NO: 55613 - DNA, 20 bp, Artificial Sequence
  Description of Artificial Sequence: Synthetic oligonucleotide
  Target: SCN9A; (+) strand; PAM type: NRG; PAM sequence: AGG
agattttccttttattgccc

SEQ ID NO: 55614 - DNA, 20 bp, Artificial Sequence
  Description of Artificial Sequence: Synthetic oligonucleotide
  Target: SCN9A; (+) strand; PAM type: NRG; PAM sequence: TAG
ttttattgcccaggctgatc

SEQ ID NO: 55615 - DNA, 20 bp, Artificial Sequence
  Description of Artificial Sequence: Synthetic oligonucleotide
  Target: SCN9A; (+) strand; PAM type: NRG; PAM sequence: TGG
ccaggctgatctagaactcc

SEQ ID NO: 55616 - DNA, 20 bp, Artificial Sequence
  Description of Artificial Sequence: Synthetic oligonucleotide
  Target: SCN9A; (+) strand; PAM type: NRG; PAM sequence: AAG
tgatctagaactcctggatc

SEQ ID NO: 55617 - DNA, 20 bp, Artificial Sequence
  Description of Artificial Sequence: Synthetic oligonucleotide
  Target: SCN9A; (+) strand; PAM type: NRG; PAM sequence: CAG
tcctggatcaagcaatcctc

SEQ ID NO: 55618 - DNA, 20 bp, Artificial Sequence
  Description of Artificial Sequence: Synthetic oligonucleotide
  Target: SCN9A; (+) strand; PAM type: NRG; PAM sequence: CGG
atcaagcaatcctccagcct

SEQ ID NO: 55619 - DNA, 20 bp, Artificial Sequence
  Description of Artificial Sequence: Synthetic oligonucleotide
  Target: SCN9A; (+) strand; PAM type: NRG; PAM sequence: AAG
cctccagcctcggcctccca

SEQ ID NO: 55620 - DNA, 20 bp, Artificial Sequence
  Description of Artificial Sequence: Synthetic oligonucleotide
  Target: SCN9A; (+) strand; PAM type: NRG; PAM sequence: TGG
gcctcggcctcccaaagtga

SEQ ID NO: 55621 - DNA, 20 bp, Artificial Sequence
  Description of Artificial Sequence: Synthetic oligonucleotide
  Target: SCN9A; (+) strand; PAM type: NRG; PAM sequence: GGG
cctcggcctcccaaagtgat

SEQ ID NO: 55622 - DNA, 20 bp, Artificial Sequence
  Description of Artificial Sequence: Synthetic oligonucleotide
  Target: SCN9A; (+) strand; PAM type: NRG; PAM sequence: CAG
ctcccaaagtgatgggattg

SEQ ID NO: 55623 - DNA, 20 bp, Artificial Sequence
  Description of Artificial Sequence: Synthetic oligonucleotide
  Target: SCN9A; (+) strand; PAM type: NRG; PAM sequence: AGG
tcccaaagtgatgggattgc

SEQ ID NO: 55624 - DNA, 20 bp, Artificial Sequence
  Description of Artificial Sequence: Synthetic oligonucleotide
  Target: SCN9A; (+) strand; PAM type: NRG; PAM sequence: GGG
cccaaagtgatgggattgca

SEQ ID NO: 55625 - DNA, 20 bp, Artificial Sequence
  Description of Artificial Sequence: Synthetic oligonucleotide
  Target: SCN9A; (+) strand; PAM type: NRG; PAM sequence: GGG
ccaaagtgatgggattgcag

SEQ ID NO: 55626 - DNA, 20 bp, Artificial Sequence
  Description of Artificial Sequence: Synthetic oligonucleotide
  Target: SCN9A; (+) strand; PAM type: NRG; PAM sequence: CAG
gatgggattgcaggggtgac

SEQ ID NO: 55627 - DNA, 20 bp, Artificial Sequence
  Description of Artificial Sequence: Synthetic oligonucleotide
  Target: SCN9A; (+) strand; PAM type: NRG; PAM sequence: TGG
ccctgttttactcatctgca

SEQ ID NO: 55628 - DNA, 20 bp, Artificial Sequence
  Description of Artificial Sequence: Synthetic oligonucleotide
  Target: SCN9A; (+) strand; PAM type: NRG; PAM sequence: AAG
acttcttttttcaaattcta

SEQ ID NO: 55629 - DNA, 20 bp, Artificial Sequence
  Description of Artificial Sequence: Synthetic oligonucleotide
  Target: SCN9A; (+) strand; PAM type: NRG; PAM sequence: TAG
ttttttcaaattctaaagta

SEQ ID NO: 55630 - DNA, 20 bp, Artificial Sequence
  Description of Artificial Sequence: Synthetic oligonucleotide
  Target: SCN9A; (+) strand; PAM type: NRG; PAM sequence: AAG
attctaaagtatagactctc

SEQ ID NO: 55631 - DNA, 20 bp, Artificial Sequence
  Description of Artificial Sequence: Synthetic oligonucleotide
  Target: SCN9A; (+) strand; PAM type: NRG; PAM sequence: AAG
ctaaagtatagactctcaag

SEQ ID NO: 55632 - DNA, 20 bp, Artificial Sequence
  Description of Artificial Sequence: Synthetic oligonucleotide
  Target: SCN9A; (+) strand; PAM type: NRG; PAM sequence: TGG
tatttttaaaataattacat

SEQ ID NO: 55633 - DNA, 20 bp, Artificial Sequence
  Description of Artificial Sequence: Synthetic oligonucleotide
  Target: SCN9A; (+) strand; PAM type: NRG; PAM sequence: TAG
acattggatttaaaaacata

SEQ ID NO: 55634 - DNA, 20 bp, Artificial Sequence
  Description of Artificial Sequence: Synthetic oligonucleotide
  Target: SCN9A; (+) strand; PAM type: NRG; PAM sequence: TAG
ggatttaaaaacatatagtg

SEQ ID NO: 55635 - DNA, 20 bp, Artificial Sequence
  Description of Artificial Sequence: Synthetic oligonucleotide
  Target: SCN9A; (+) strand; PAM type: NRG; PAM sequence: AGG
gatttaaaaacatatagtgt

SEQ ID NO: 55636 - DNA, 20 bp, Artificial Sequence
  Description of Artificial Sequence: Synthetic oligonucleotide
  Target: SCN9A; (+) strand; PAM type: NRG; PAM sequence: GAG
tttaaaaacatatagtgtag

SEQ ID NO: 55637 - DNA, 20 bp, Artificial Sequence
  Description of Artificial Sequence: Synthetic oligonucleotide
  Target: SCN9A; (+) strand; PAM type: NRG; PAM sequence: TAG
acatatagtgtaggagcaac

SEQ ID NO: 55638 - DNA, 20 bp, Artificial Sequence
  Description of Artificial Sequence: Synthetic oligonucleotide
  Target: SCN9A; (+) strand; PAM type: NRG; PAM sequence: AAG
agtgtaggagcaactagtaa

SEQ ID NO: 55639 - DNA, 20 bp, Artificial Sequence
  Description of Artificial Sequence: Synthetic oligonucleotide
  Target: SCN9A; (+) strand; PAM type: NRG; PAM sequence: CAG
gagcaactagtaaaagttga

SEQ ID NO: 55640 - DNA, 20 bp, Artificial Sequence
  Description of Artificial Sequence: Synthetic oligonucleotide
  Target: SCN9A; (+) strand; PAM type: NRG; PAM sequence: CAG
aagttgacagataccacatc

SEQ ID NO: 55641 - DNA, 20 bp, Artificial Sequence
  Description of Artificial Sequence: Synthetic oligonucleotide
  Target: SCN9A; (+) strand; PAM type: NRG; PAM sequence: CAG
acatccagtgaaattacccc

SEQ ID NO: 55642 - DNA, 20 bp, Artificial Sequence
  Description of Artificial Sequence: Synthetic oligonucleotide
  Target: SCN9A; (+) strand; PAM type: NRG; PAM sequence: TAG
ataatcatcatcatcatcat

SEQ ID NO: 55643 - DNA, 20 bp, Artificial Sequence
  Description of Artificial Sequence: Synthetic oligonucleotide
  Target: SCN9A; (+) strand; PAM type: NRG; PAM sequence: TGG
tcatcatcatcattagataa

SEQ ID NO: 55644 - DNA, 20 bp, Artificial Sequence
  Description of Artificial Sequence: Synthetic oligonucleotide
  Target: SCN9A; (+) strand; PAM type: NRG; PAM sequence: GGG
catcatcatcattagataat

SEQ ID NO: 55645 - DNA, 20 bp, Artificial Sequence
  Description of Artificial Sequence: Synthetic oligonucleotide
  Target: SCN9A; (+) strand; PAM type: NRG; PAM sequence: GAG
tcatcattagataatgggct

SEQ ID NO: 55646 - DNA, 20 bp, Artificial Sequence
  Description of Artificial Sequence: Synthetic oligonucleotide
  Target: SCN9A; (+) strand; PAM type: NRG; PAM sequence: CGG
attagataatgggctgagcg

SEQ ID NO: 55647 - DNA, 20 bp, Artificial Sequence
  Description of Artificial Sequence: Synthetic oligonucleotide
  Target: SCN9A; (+) strand; PAM type: NRG; PAM sequence: TGG
agataatgggctgagcgcgg

SEQ ID NO: 55648 - DNA, 20 bp, Artificial Sequence
  Description of Artificial Sequence: Synthetic oligonucleotide
  Target: SCN9A; (+) strand; PAM type: NRG; PAM sequence: CAG
gtggctcatgcttgtaatcc

SEQ ID NO: 55649 - DNA, 20 bp, Artificial Sequence
  Description of Artificial Sequence: Synthetic oligonucleotide
  Target: SCN9A; (+) strand; PAM type: NRG; PAM sequence: TGG
tgcttgtaatcccagcactt

SEQ ID NO: 55650 - DNA, 20 bp, Artificial Sequence
  Description of Artificial Sequence: Synthetic oligonucleotide
  Target: SCN9A; (+) strand; PAM type: NRG; PAM sequence: GGG
gcttgtaatcccagcacttt

SEQ ID NO: 55651 - DNA, 20 bp, Artificial Sequence
  Description of Artificial Sequence: Synthetic oligonucleotide
  Target: SCN9A; (+) strand; PAM type: NRG; PAM sequence: GAG
ttgtaatcccagcactttgg

SEQ ID NO: 55652 - DNA, 20 bp, Artificial Sequence
  Description of Artificial Sequence: Synthetic oligonucleotide
  Target: SCN9A; (+) strand; PAM type: NRG; PAM sequence: AGG
tgtaatcccagcactttggg

SEQ ID NO: 55653 - DNA, 20 bp, Artificial Sequence
  Description of Artificial Sequence: Synthetic oligonucleotide
  Target: SCN9A; (+) strand; PAM type: NRG; PAM sequence: GAG
tcccagcactttgggaggtc

SEQ ID NO: 55654 - DNA, 20 bp, Artificial Sequence
  Description of Artificial Sequence: Synthetic oligonucleotide
  Target: SCN9A; (+) strand; PAM type: NRG; PAM sequence: AGG
cccagcactttgggaggtcg

SEQ ID NO: 55655 - DNA, 20 bp, Artificial Sequence
  Description of Artificial Sequence: Synthetic oligonucleotide
  Target: SCN9A; (+) strand; PAM type: NRG; PAM sequence: CGG
agcactttgggaggtcgagg

SEQ ID NO: 55656 - DNA, 20 bp, Artificial Sequence
  Description of Artificial Sequence: Synthetic oligonucleotide
  Target: SCN9A; (+) strand; PAM type: NRG; PAM sequence: GGG
gcactttgggaggtcgaggc

SEQ ID NO: 55657 - DNA, 20 bp, Artificial Sequence
  Description of Artificial Sequence: Synthetic oligonucleotide
  Target: SCN9A; (+) strand; PAM type: NRG; PAM sequence: CGG
ctttgggaggtcgaggcggg

SEQ ID NO: 55658 - DNA, 20 bp, Artificial Sequence
  Description of Artificial Sequence: Synthetic oligonucleotide
  Target: SCN9A; (+) strand; PAM type: NRG; PAM sequence: TAG
ggtcgaggcgggcggatcac

SEQ ID NO: 55659 - DNA, 20 bp, Artificial Sequence
  Description of Artificial Sequence: Synthetic oligonucleotide
  Target: SCN9A; (+) strand; PAM type: NRG; PAM sequence: AGG
gtcgaggcgggcggatcact

SEQ ID NO: 55660 - DNA, 20 bp, Artificial Sequence
  Description of Artificial Sequence: Synthetic oligonucleotide
  Target: SCN9A; (+) strand; PAM type: NRG; PAM sequence: CAG
aggcgggcggatcactaggt

SEQ ID NO: 55661 - DNA, 20 bp, Artificial Sequence
  Description of Artificial Sequence: Synthetic oligonucleotide
  Target: SCN9A; (+) strand; PAM type: NRG; PAM sequence: AGG
ggcgggcggatcactaggtc

SEQ ID NO: 55662 - DNA, 20 bp, Artificial Sequence
  Description of Artificial Sequence: Synthetic oligonucleotide
  Target: SCN9A; (+) strand; PAM type: NRG; PAM sequence: GAG
cgggcggatcactaggtcag

SEQ ID NO: 55663 - DNA, 20 bp, Artificial Sequence
  Description of Artificial Sequence: Synthetic oligonucleotide
  Target: SCN9A; (+) strand; PAM type: NRG; PAM sequence: GAG
gatcactaggtcaggagatt

SEQ ID NO: 55664 - DNA, 20 bp, Artificial Sequence
  Description of Artificial Sequence: Synthetic oligonucleotide
  Target: SCN9A; (+) strand; PAM type: NRG; PAM sequence: TGG
tcaggagattgagaccatcc

SEQ ID NO: 55665 - DNA, 20 bp, Artificial Sequence
  Description of Artificial Sequence: Synthetic oligonucleotide
  Target: SCN9A; (+) strand; PAM type: NRG; PAM sequence: TGG
tgagaccatcctggctaaca

SEQ ID NO: 55666 - DNA, 20 bp, Artificial Sequence
  Description of Artificial Sequence: Synthetic oligonucleotide
  Target: SCN9A; (+) strand; PAM type: NRG; PAM sequence: TAG
tactaaaaatacaaaaacat

SEQ ID NO: 55667 - DNA, 20 bp, Artificial Sequence
  Description of Artificial Sequence: Synthetic oligonucleotide
  Target: SCN9A; (+) strand; PAM type: NRG; PAM sequence: CGG
aaaaatacaaaaacattagc

SEQ ID NO: 55668 - DNA, 20 bp, Artificial Sequence
  Description of Artificial Sequence: Synthetic oligonucleotide
  Target: SCN9A; (+) strand; PAM type: NRG; PAM sequence: GGG
aaaatacaaaaacattagcc

SEQ ID NO: 55669 - DNA, 20 bp, Artificial Sequence
  Description of Artificial Sequence: Synthetic oligonucleotide
  Target: SCN9A; (+) strand; PAM type: NRG; PAM sequence: CGG
acaaaaacattagccgggca

SEQ ID NO: 55670 - DNA, 20 bp, Artificial Sequence
  Description of Artificial Sequence: Synthetic oligonucleotide
  Target: SCN9A; (+) strand; PAM type: NRG; PAM sequence: TGG
aaaacattagccgggcacgg

SEQ ID NO: 55671 - DNA, 20 bp, Artificial Sequence
  Description of Artificial Sequence: Synthetic oligonucleotide
  Target: SCN9A; (+) strand; PAM type: NRG; PAM sequence: TAG
acattagccgggcacggtgg

SEQ ID NO: 55672 - DNA, 20 bp, Artificial Sequence
  Description of Artificial Sequence: Synthetic oligonucleotide
  Target: SCN9A; (+) strand; PAM type: NRG; PAM sequence: AGG
cattagccgggcacggtggt

SEQ ID NO: 55673 - DNA, 20 bp, Artificial Sequence
  Description of Artificial Sequence: Synthetic oligonucleotide
  Target: SCN9A; (+) strand; PAM type: NRG; PAM sequence: TAG
ggcacggtggtaggcgcctg

SEQ ID NO: 55674 - DNA, 20 bp, Artificial Sequence
  Description of Artificial Sequence: Synthetic oligonucleotide
  Target: SCN9A; (+) strand; PAM type: NRG; PAM sequence: CAG
gtggtaggcgcctgtagtcc

SEQ ID NO: 55675 - DNA, 20 bp, Artificial Sequence
  Description of Artificial Sequence: Synthetic oligonucleotide
  Target: SCN9A; (+) strand; PAM type: NRG; PAM sequence: CGG
cgcctgtagtcccagctact

SEQ ID NO: 55676 - DNA, 20 bp, Artificial Sequence
  Description of Artificial Sequence: Synthetic oligonucleotide
  Target: SCN9A; (+) strand; PAM type: NRG; PAM sequence: GAG
cctgtagtcccagctactcg

SEQ ID NO: 55677 - DNA, 20 bp, Artificial Sequence
  Description of Artificial Sequence: Synthetic oligonucleotide
  Target: SCN9A; (+) strand; PAM type: NRG; PAM sequence: AGG
ctgtagtcccagctactcgg

SEQ ID NO: 55678 - DNA, 20 bp, Artificial Sequence
  Description of Artificial Sequence: Synthetic oligonucleotide
  Target: SCN9A; (+) strand; PAM type: NRG; PAM sequence: GAG
gtcccagctactcggaggct

SEQ ID NO: 55679 - DNA, 20 bp, Artificial Sequence
  Description of Artificial Sequence: Synthetic oligonucleotide
  Target: SCN9A; (+) strand; PAM type: NRG; PAM sequence: AGG
tcccagctactcggaggctg

SEQ ID NO: 55680 - DNA, 20 bp, Artificial Sequence
  Description of Artificial Sequence: Synthetic oligonucleotide
  Target: SCN9A; (+) strand; PAM type: NRG; PAM sequence: CAG
cagctactcggaggctgagg

SEQ ID NO: 55681 - DNA, 20 bp, Artificial Sequence
  Description of Artificial Sequence: Synthetic oligonucleotide
  Target: SCN9A; (+) strand; PAM type: NRG; PAM sequence: AGG
agctactcggaggctgaggc

SEQ ID NO: 55682 - DNA, 20 bp, Artificial Sequence
  Description of Artificial Sequence: Synthetic oligonucleotide
  Target: SCN9A; (+) strand; PAM type: NRG; PAM sequence: GAG
ctactcggaggctgaggcag

SEQ ID NO: 55683 - DNA, 20 bp, Artificial Sequence
  Description of Artificial Sequence: Synthetic oligonucleotide
  Target: SCN9A; (+) strand; PAM type: NRG; PAM sequence: TGG
cggaggctgaggcaggagaa

SEQ ID NO: 55684 - DNA, 20 bp, Artificial Sequence
  Description of Artificial Sequence: Synthetic oligonucleotide
  Target: SCN9A; (+) strand; PAM type: NRG; PAM sequence: CAG
gcaggagaatggtgtgaacc

SEQ ID NO: 55685 - DNA, 20 bp, Artificial Sequence
  Description of Artificial Sequence: Synthetic oligonucleotide
  Target: SCN9A; (+) strand; PAM type: NRG; PAM sequence: AGG
caggagaatggtgtgaaccc

SEQ ID NO: 55686 - DNA, 20 bp, Artificial Sequence
  Description of Artificial Sequence: Synthetic oligonucleotide
  Target: SCN9A; (+) strand; PAM type: NRG; PAM sequence: CGG
aatggtgtgaacccaggacg

SEQ ID NO: 55687 - DNA, 20 bp, Artificial Sequence
  Description of Artificial Sequence: Synthetic oligonucleotide
  Target: SCN9A; (+) strand; PAM type: NRG; PAM sequence: GAG
tggtgtgaacccaggacgcg

SEQ ID NO: 55688 - DNA, 20 bp, Artificial Sequence
  Description of Artificial Sequence: Synthetic oligonucleotide
  Target: SCN9A; (+) strand; PAM type: NRG; PAM sequence: CAG
aacccaggacgcggagcttg

SEQ ID NO: 55689 - DNA, 20 bp, Artificial Sequence
  Description of Artificial Sequence: Synthetic oligonucleotide
  Target: SCN9A; (+) strand; PAM type: NRG; PAM sequence: GAG
caggacgcggagcttgcagt

SEQ ID NO: 55690 - DNA, 20 bp, Artificial Sequence
  Description of Artificial Sequence: Synthetic oligonucleotide
  Target: SCN9A; (+) strand; PAM type: NRG; PAM sequence: AAG
cgcggagcttgcagtgagcc

SEQ ID NO: 55691 - DNA, 20 bp, Artificial Sequence
  Description of Artificial Sequence: Synthetic oligonucleotide
  Target: SCN9A; (+) strand; PAM type: NRG; PAM sequence: CAG
aagatcgcgccactgcactc

SEQ ID NO: 55692 - DNA, 20 bp, Artificial Sequence
  Description of Artificial Sequence: Synthetic oligonucleotide
  Target: SCN9A; (+) strand; PAM type: NRG; PAM sequence: TGG
cgcgccactgcactccagcc

SEQ ID NO: 55693 - DNA, 20 bp, Artificial Sequence
  Description of Artificial Sequence: Synthetic oligonucleotide
  Target: SCN9A; (+) strand; PAM type: NRG; PAM sequence: GGG
gcgccactgcactccagcct

SEQ ID NO: 55694 - DNA, 20 bp, Artificial Sequence
  Description of Artificial Sequence: Synthetic oligonucleotide
  Target: SCN9A; (+) strand; PAM type: NRG; PAM sequence: CAG
ctgcactccagcctgggcga

SEQ ID NO: 55695 - DNA, 20 bp, Artificial Sequence
  Description of Artificial Sequence: Synthetic oligonucleotide
  Target: SCN9A; (+) strand; PAM type: NRG; PAM sequence: GAG
gcactccagcctgggcgaca

SEQ ID NO: 55696 - DNA, 20 bp, Artificial Sequence
  Description of Artificial Sequence: Synthetic oligonucleotide
  Target: SCN9A; (+) strand; PAM type: NRG; PAM sequence: GAG
tccagcctgggcgacagagc

SEQ ID NO: 55697 - DNA, 20 bp, Artificial Sequence
  Description of Artificial Sequence: Synthetic oligonucleotide
  Target: SCN9A; (+) strand; PAM type: NRG; PAM sequence: AAG
aataaaaaataaaaaaaaaa

SEQ ID NO: 55698 - DNA, 20 bp, Artificial Sequence
  Description of Artificial Sequence: Synthetic oligonucleotide
  Target: SCN9A; (+) strand; PAM type: NRG; PAM sequence: CAG
aaaaaagaatctttaaaaat

SEQ ID NO: 55699 - DNA, 20 bp, Artificial Sequence
  Description of Artificial Sequence: Synthetic oligonucleotide
  Target: SCN9A; (+) strand; PAM type: NRG; PAM sequence: CAG
tctttaaaaatcagataata

SEQ ID NO: 55700 - DNA, 20 bp, Artificial Sequence
  Description of Artificial Sequence: Synthetic oligonucleotide
  Target: SCN9A; (+) strand; PAM type: NRG; PAM sequence: AGG
ctttaaaaatcagataatac

SEQ ID NO: 55701 - DNA, 20 bp, Artificial Sequence
  Description of Artificial Sequence: Synthetic oligonucleotide
  Target: SCN9A; (+) strand; PAM type: NRG; PAM sequence: GGG
tttaaaaatcagataataca

SEQ ID NO: 55702 - DNA, 20 bp, Artificial Sequence
  Description of Artificial Sequence: Synthetic oligonucleotide
  Target: SCN9A; (+) strand; PAM type: NRG; PAM sequence: GAG
taaaaatcagataatacagg

SEQ ID NO: 55703 - DNA, 20 bp, Artificial Sequence
  Description of Artificial Sequence: Synthetic oligonucleotide
  Target: SCN9A; (+) strand; PAM type: NRG; PAM sequence: TAG
atcagataatacagggagtc

SEQ ID NO: 55704 - DNA, 20 bp, Artificial Sequence
  Description of Artificial Sequence: Synthetic oligonucleotide
  Target: SCN9A; (+) strand; PAM type: NRG; PAM sequence: AGG
tcagataatacagggagtct

SEQ ID NO: 55705 - DNA, 20 bp, Artificial Sequence
  Description of Artificial Sequence: Synthetic oligonucleotide
  Target: SCN9A; (+) strand; PAM type: NRG; PAM sequence: TAG
agggagtctaggtgtgcata

SEQ ID NO: 55706 - DNA, 20 bp, Artificial Sequence
  Description of Artificial Sequence: Synthetic oligonucleotide
  Target: SCN9A; (+) strand; PAM type: NRG; PAM sequence: TGG
aatttttattaaaaatctta

SEQ ID NO: 55707 - DNA, 20 bp, Artificial Sequence
  Description of Artificial Sequence: Synthetic oligonucleotide
  Target: SCN9A; (+) strand; PAM type: NRG; PAM sequence: GGG
atttttattaaaaatcttat

SEQ ID NO: 55708 - DNA, 20 bp, Artificial Sequence
  Description of Artificial Sequence: Synthetic oligonucleotide
  Target: SCN9A; (+) strand; PAM type: NRG; PAM sequence: TAG
taatcttatttatctttctt

SEQ ID NO: 55709 - DNA, 20 bp, Artificial Sequence
  Description of Artificial Sequence: Synthetic oligonucleotide
  Target: SCN9A; (+) strand; PAM type: NRG; PAM sequence: GAG
atcttatttatctttcttta

SEQ ID NO: 55710 - DNA, 20 bp, Artificial Sequence
  Description of Artificial Sequence: Synthetic oligonucleotide
  Target: SCN9A; (+) strand; PAM type: NRG; PAM sequence: AGG
tcttatttatctttctttag

SEQ ID NO: 55711 - DNA, 20 bp, Artificial Sequence
  Description of Artificial Sequence: Synthetic oligonucleotide
  Target: SCN9A; (+) strand; PAM type: NRG; PAM sequence: TAG
tttccaattatttgtactaa

SEQ ID NO: 55712 - DNA, 20 bp, Artificial Sequence
  Description of Artificial Sequence: Synthetic oligonucleotide
  Target: SCN9A; (+) strand; PAM type: NRG; PAM sequence: AAG
gtactaatagtttgacctaa

SEQ ID NO: 55713 - DNA, 20 bp, Artificial Sequence
  Description of Artificial Sequence: Synthetic oligonucleotide
  Target: SCN9A; (+) strand; PAM type: NRG; PAM sequence: TGG
ctaatagtttgacctaaaag

SEQ ID NO: 55714 - DNA, 20 bp, Artificial Sequence
  Description of Artificial Sequence: Synthetic oligonucleotide
  Target: SCN9A; (+) strand; PAM type: NRG; PAM sequence: GAG
aatagtttgacctaaaagtg

SEQ ID NO: 55715 - DNA, 20 bp, Artificial Sequence
  Description of Artificial Sequence: Synthetic oligonucleotide
  Target: SCN9A; (+) strand; PAM type: NRG; PAM sequence: TGG
tggagtaaaatttgccttac

SEQ ID NO: 55716 - DNA, 20 bp, Artificial Sequence
  Description of Artificial Sequence: Synthetic oligonucleotide
  Target: SCN9A; (+) strand; PAM type: NRG; PAM sequence: TGG
tggcgtacatatcaaacatt

SEQ ID NO: 55717 - DNA, 20 bp, Artificial Sequence
  Description of Artificial Sequence: Synthetic oligonucleotide
  Target: SCN9A; (+) strand; PAM type: NRG; PAM sequence: AAG
cgtacatatcaaacatttgg

SEQ ID NO: 55718 - DNA, 20 bp, Artificial Sequence
  Description of Artificial Sequence: Synthetic oligonucleotide
  Target: SCN9A; (+) strand; PAM type: NRG; PAM sequence: GAG
atatcaaacatttggaagat

SEQ ID NO: 55719 - DNA, 20 bp, Artificial Sequence
  Description of Artificial Sequence: Synthetic oligonucleotide
  Target: SCN9A; (+) strand; PAM type: NRG; PAM sequence: TAG
aacatttggaagatgagatg

SEQ ID NO: 55720 - DNA, 20 bp, Artificial Sequence
  Description of Artificial Sequence: Synthetic oligonucleotide
  Target: SCN9A; (+) strand; PAM type: NRG; PAM sequence: AGG
acatttggaagatgagatgt

SEQ ID NO: 55721 - DNA, 20 bp, Artificial Sequence
  Description of Artificial Sequence: Synthetic oligonucleotide
  Target: SCN9A; (+) strand; PAM type: NRG; PAM sequence: GAG
atttggaagatgagatgtag

SEQ ID NO: 55722 - DNA, 20 bp, Artificial Sequence
  Description of Artificial Sequence: Synthetic oligonucleotide
  Target: SCN9A; (+) strand; PAM type: NRG; PAM sequence: GAG
ttggaagatgagatgtagga

SEQ ID NO: 55723 - DNA, 20 bp, Artificial Sequence
  Description of Artificial Sequence: Synthetic oligonucleotide
  Target: SCN9A; (+) strand; PAM type: NRG; PAM sequence: AAG
gaagatgagatgtaggagag

SEQ ID NO: 55724 - DNA, 20 bp, Artificial Sequence
  Description of Artificial Sequence: Synthetic oligonucleotide
  Target: SCN9A; (+) strand; PAM type: NRG; PAM sequence: AAG
gatgagatgtaggagagaag

SEQ ID NO: 55725 - DNA, 20 bp, Artificial Sequence
  Description of Artificial Sequence: Synthetic oligonucleotide
  Target: SCN9A; (+) strand; PAM type: NRG; PAM sequence: AGG
atgagatgtaggagagaaga

SEQ ID NO: 55726 - DNA, 20 bp, Artificial Sequence
  Description of Artificial Sequence: Synthetic oligonucleotide
  Target: SCN9A; (+) strand; PAM type: NRG; PAM sequence: AAG
agagaagaaggaaaaaaaaa

SEQ ID NO: 55727 - DNA, 20 bp, Artificial Sequence
  Description of Artificial Sequence: Synthetic oligonucleotide
  Target: SCN9A; (+) strand; PAM type: NRG; PAM sequence: AAG
gaaggaaaaaaaaaaagaaa

SEQ ID NO: 55728 - DNA, 20 bp, Artificial Sequence
  Description of Artificial Sequence: Synthetic oligonucleotide
  Target: SCN9A; (+) strand; PAM type: NRG; PAM sequence: AGG
aaggaaaaaaaaaaagaaaa

SEQ ID NO: 55729 - DNA, 20 bp, Artificial Sequence
  Description of Artificial Sequence: Synthetic oligonucleotide
  Target: SCN9A; (+) strand; PAM type: NRG; PAM sequence: GGG
aggaaaaaaaaaaagaaaaa

SEQ ID NO: 55730 - DNA, 20 bp, Artificial Sequence
  Description of Artificial Sequence: Synthetic oligonucleotide
  Target: SCN9A; (+) strand; PAM type: NRG; PAM sequence: CAG
aagaaaaagggcattcattg

SEQ ID NO: 55731 - DNA, 20 bp, Artificial Sequence
  Description of Artificial Sequence: Synthetic oligonucleotide
  Target: SCN9A; (+) strand; PAM type: NRG; PAM sequence: AGG
agaaaaagggcattcattgc

SEQ ID NO: 55732 - DNA, 20 bp, Artificial Sequence
  Description of Artificial Sequence: Synthetic oligonucleotide
  Target: SCN9A; (+) strand; PAM type: NRG; PAM sequence: GGG
gaaaaagggcattcattgca

SEQ ID NO: 55733 - DNA, 20 bp, Artificial Sequence
  Description of Artificial Sequence: Synthetic oligonucleotide
  Target: SCN9A; (+) strand; PAM type: NRG; PAM sequence: CAG
aaagggcattcattgcaggg

SEQ ID NO: 55734 - DNA, 20 bp, Artificial Sequence
  Description of Artificial Sequence: Synthetic oligonucleotide
  Target: SCN9A; (+) strand; PAM type: NRG; PAM sequence: AGG
aagggcattcattgcagggc

SEQ ID NO: 55735 - DNA, 20 bp, Artificial Sequence
  Description of Artificial Sequence: Synthetic oligonucleotide
  Target: SCN9A; (+) strand; PAM type: NRG; PAM sequence: AAG
cacactctttctaaatttcc

SEQ ID NO: 55736 - DNA, 20 bp, Artificial Sequence
  Description of Artificial Sequence: Synthetic oligonucleotide
  Target: SCN9A; (+) strand; PAM type: NRG; PAM sequence: TAG
aatttccaagtgaacaatcc

SEQ ID NO: 55737 - DNA, 20 bp, Artificial Sequence
  Description of Artificial Sequence: Synthetic oligonucleotide
  Target: SCN9A; (+) strand; PAM type: NRG; PAM sequence: AGG
atttccaagtgaacaatcct

SEQ ID NO: 55738 - DNA, 20 bp, Artificial Sequence
  Description of Artificial Sequence: Synthetic oligonucleotide
  Target: SCN9A; (+) strand; PAM type: NRG; PAM sequence: TAG
tgaacaatcctaggtgcaat

SEQ ID NO: 55739 - DNA, 20 bp, Artificial Sequence
  Description of Artificial Sequence: Synthetic oligonucleotide
  Target: SCN9A; (+) strand; PAM type: NRG; PAM sequence: GAG
aacaatcctaggtgcaatta

SEQ ID NO: 55740 - DNA, 20 bp, Artificial Sequence
  Description of Artificial Sequence: Synthetic oligonucleotide
  Target: SCN9A; (+) strand; PAM type: NRG; PAM sequence: CAG
ttgtattttgataaatgatt

SEQ ID NO: 55741 - DNA, 20 bp, Artificial Sequence
  Description of Artificial Sequence: Synthetic oligonucleotide
  Target: SCN9A; (+) strand; PAM type: NRG; PAM sequence: AAG
attttgataaatgattcaga

SEQ ID NO: 55742 - DNA, 20 bp, Artificial Sequence
  Description of Artificial Sequence: Synthetic oligonucleotide
  Target: SCN9A; (+) strand; PAM type: NRG; PAM sequence: AAG
gaaagctttgtaaaaaatcc

SEQ ID NO: 55743 - DNA, 20 bp, Artificial Sequence
  Description of Artificial Sequence: Synthetic oligonucleotide
  Target: SCN9A; (+) strand; PAM type: NRG; PAM sequence: AGG
aaagctttgtaaaaaatcca

SEQ ID NO: 55744 - DNA, 20 bp, Artificial Sequence
  Description of Artificial Sequence: Synthetic oligonucleotide
  Target: SCN9A; (+) strand; PAM type: NRG; PAM sequence: GAG
agctttgtaaaaaatccaag

SEQ ID NO: 55745 - DNA, 20 bp, Artificial Sequence
  Description of Artificial Sequence: Synthetic oligonucleotide
  Target: SCN9A; (+) strand; PAM type: NRG; PAM sequence: AAG
aaatccaaggagacatttta

SEQ ID NO: 55746 - DNA, 20 bp, Artificial Sequence
  Description of Artificial Sequence: Synthetic oligonucleotide
  Target: SCN9A; (+) strand; PAM type: NRG; PAM sequence: CAG
attttaaagaaatttatgat

SEQ ID NO: 55747 - DNA, 20 bp, Artificial Sequence
  Description of Artificial Sequence: Synthetic oligonucleotide
  Target: SCN9A; (+) strand; PAM type: NRG; PAM sequence: TAG
aagaaatttatgatcagtaa

SEQ ID NO: 55748 - DNA, 20 bp, Artificial Sequence
  Description of Artificial Sequence: Synthetic oligonucleotide
  Target: SCN9A; (+) strand; PAM type: NRG; PAM sequence: CAG
aaatttatgatcagtaatag

SEQ ID NO: 55749 - DNA, 20 bp, Artificial Sequence
  Description of Artificial Sequence: Synthetic oligonucleotide
  Target: SCN9A; (+) strand; PAM type: NRG; PAM sequence: AAG
tctctaacacttgacataac

SEQ ID NO: 55750 - DNA, 20 bp, Artificial Sequence
  Description of Artificial Sequence: Synthetic oligonucleotide
  Target: SCN9A; (+) strand; PAM type: NRG; PAM sequence: GAG
tctaacacttgacataacaa

SEQ ID NO: 55751 - DNA, 20 bp, Artificial Sequence
  Description of Artificial Sequence: Synthetic oligonucleotide
  Target: SCN9A; (+) strand; PAM type: NRG; PAM sequence: AGG
ctaacacttgacataacaag

SEQ ID NO: 55752 - DNA, 20 bp, Artificial Sequence
  Description of Artificial Sequence: Synthetic oligonucleotide
  Target: SCN9A; (+) strand; PAM type: NRG; PAM sequence: TAG
agaggaaatcataaaatgaa

SEQ ID NO: 55753 - DNA, 20 bp, Artificial Sequence
  Description of Artificial Sequence: Synthetic oligonucleotide
  Target: SCN9A; (+) strand; PAM type: NRG; PAM sequence: AAG
gaaatcataaaatgaatagc

SEQ ID NO: 55754 - DNA, 20 bp, Artificial Sequence
  Description of Artificial Sequence: Synthetic oligonucleotide
  Target: SCN9A; (+) strand; PAM type: NRG; PAM sequence: AGG
aaatcataaaatgaatagca

SEQ ID NO: 55755 - DNA, 20 bp, Artificial Sequence
  Description of Artificial Sequence: Synthetic oligonucleotide
  Target: SCN9A; (+) strand; PAM type: NRG; PAM sequence: CAG
aatgaatagcaaggaaatta

SEQ ID NO: 55756 - DNA, 20 bp, Artificial Sequence
  Description of Artificial Sequence: Synthetic oligonucleotide
  Target: SCN9A; (+) strand; PAM type: NRG; PAM sequence: AAG
tagcaaggaaattacagtta

SEQ ID NO: 55757 - DNA, 20 bp, Artificial Sequence
  Description of Artificial Sequence: Synthetic oligonucleotide
  Target: SCN9A; (+) strand; PAM type: NRG; PAM sequence: TAG
aattacagttaaagtaacgt

SEQ ID NO: 55758 - DNA, 20 bp, Artificial Sequence
  Description of Artificial Sequence: Synthetic oligonucleotide
  Target: SCN9A; (+) strand; PAM type: NRG; PAM sequence: AGG
attacagttaaagtaacgtt

SEQ ID NO: 55759 - DNA, 20 bp, Artificial Sequence
  Description of Artificial Sequence: Synthetic oligonucleotide
  Target: SCN9A; (+) strand; PAM type: NRG; PAM sequence: CAG
aaagtaacgttaggtttcaa

SEQ ID NO: 55760 - DNA, 20 bp, Artificial Sequence
  Description of Artificial Sequence: Synthetic oligonucleotide
  Target: SCN9A; (+) strand; PAM type: NRG; PAM sequence: TGG
taggtttcaacagtaatata

SEQ ID NO: 55761 - DNA, 20 bp, Artificial Sequence
  Description of Artificial Sequence: Synthetic oligonucleotide
  Target: SCN9A; (+) strand; PAM type: NRG; PAM sequence: TGG
acagtaatatatggcatttt

SEQ ID NO: 55762 - DNA, 20 bp, Artificial Sequence
  Description of Artificial Sequence: Synthetic oligonucleotide
  Target: SCN9A; (+) strand; PAM type: NRG; PAM sequence: AAG
atatcactttaaaaaatcta

SEQ ID NO: 55763 - DNA, 20 bp, Artificial Sequence
  Description of Artificial Sequence: Synthetic oligonucleotide
  Target: SCN9A; (+) strand; PAM type: NRG; PAM sequence: TAG
cactttaaaaaatctaaaga

SEQ ID NO: 55764 - DNA, 20 bp, Artificial Sequence
  Description of Artificial Sequence: Synthetic oligonucleotide
  Target: SCN9A; (+) strand; PAM type: NRG; PAM sequence: AAG
atagttcatctcctgtgtta

SEQ ID NO: 55765 - DNA, 20 bp, Artificial Sequence
  Description of Artificial Sequence: Synthetic oligonucleotide
  Target: SCN9A; (+) strand; PAM type: NRG; PAM sequence: CAG
aacaacatattttttgctta

SEQ ID NO: 55766 - DNA, 20 bp, Artificial Sequence
  Description of Artificial Sequence: Synthetic oligonucleotide
  Target: SCN9A; (+) strand; PAM type: NRG; PAM sequence: AAG
acatattttttgcttacagt

SEQ ID NO: 55767 - DNA, 20 bp, Artificial Sequence
  Description of Artificial Sequence: Synthetic oligonucleotide
  Target: SCN9A; (+) strand; PAM type: NRG; PAM sequence: AAG
cagtaagttgttattttaaa

SEQ ID NO: 55768 - DNA, 20 bp, Artificial Sequence
  Description of Artificial Sequence: Synthetic oligonucleotide
  Target: SCN9A; (+) strand; PAM type: NRG; PAM sequence: GAG
gtaagttgttattttaaaaa

SEQ ID NO: 55769 - DNA, 20 bp, Artificial Sequence
  Description of Artificial Sequence: Synthetic oligonucleotide
  Target: SCN9A; (+) strand; PAM type: NRG; PAM sequence: TGG
tgttattttaaaaagagacg

SEQ ID NO: 55770 - DNA, 20 bp, Artificial Sequence
  Description of Artificial Sequence: Synthetic oligonucleotide
  Target: SCN9A; (+) strand; PAM type: NRG; PAM sequence: AAG
attttaaaaagagacgtgga

SEQ ID NO: 55771 - DNA, 20 bp, Artificial Sequence
  Description of Artificial Sequence: Synthetic oligonucleotide
  Target: SCN9A; (+) strand; PAM type: NRG; PAM sequence: CGG
aaaaagagacgtggaaagaa

SEQ ID NO: 55772 - DNA, 20 bp, Artificial Sequence
  Description of Artificial Sequence: Synthetic oligonucleotide
  Target: SCN9A; (+) strand; PAM type: NRG; PAM sequence: TAG
ggaaagaacggttttctcta

SEQ ID NO: 55773 - DNA, 20 bp, Artificial Sequence
  Description of Artificial Sequence: Synthetic oligonucleotide
  Target: SCN9A; (+) strand; PAM type: NRG; PAM sequence: AAG
gttttctctatagaactaaa

SEQ ID NO: 55774 - DNA, 20 bp, Artificial Sequence
  Description of Artificial Sequence: Synthetic oligonucleotide
  Target: SCN9A; (+) strand; PAM type: NRG; PAM sequence: TAG
tctatagaactaaaaagata

SEQ ID NO: 55775 - DNA, 20 bp, Artificial Sequence
  Description of Artificial Sequence: Synthetic oligonucleotide
  Target: SCN9A; (+) strand; PAM type: NRG; PAM sequence: CAG
taaaaagatatagaataatt

SEQ ID NO: 55776 - DNA, 20 bp, Artificial Sequence
  Description of Artificial Sequence: Synthetic oligonucleotide
  Target: SCN9A; (+) strand; PAM type: NRG; PAM sequence: TGG
tgtcaattcaaacttgtctg

SEQ ID NO: 55777 - DNA, 20 bp, Artificial Sequence
  Description of Artificial Sequence: Synthetic oligonucleotide
  Target: SCN9A; (+) strand; PAM type: NRG; PAM sequence: CAG
caattcaaacttgtctgtgg

SEQ ID NO: 55778 - DNA, 20 bp, Artificial Sequence
  Description of Artificial Sequence: Synthetic oligonucleotide
  Target: SCN9A; (+) strand; PAM type: NRG; PAM sequence: TGG
ctgtggcagattatgcttac

SEQ ID NO: 55779 - DNA, 20 bp, Artificial Sequence
  Description of Artificial Sequence: Synthetic oligonucleotide
  Target: SCN9A; (+) strand; PAM type: NRG; PAM sequence: AAG
tatgcttactggcactgttc

SEQ ID NO: 55780 - DNA, 20 bp, Artificial Sequence
  Description of Artificial Sequence: Synthetic oligonucleotide
  Target: SCN9A; (+) strand; PAM type: NRG; PAM sequence: AGG
atgcttactggcactgttca

SEQ ID NO: 55781 - DNA, 20 bp, Artificial Sequence
  Description of Artificial Sequence: Synthetic oligonucleotide
  Target: SCN9A; (+) strand; PAM type: NRG; PAM sequence: TGG
cttccttccccactttatca

SEQ ID NO: 55782 - DNA, 20 bp, Artificial Sequence
  Description of Artificial Sequence: Synthetic oligonucleotide
  Target: SCN9A; (+) strand; PAM type: NRG; PAM sequence: TGG
ttccccactttatcatggcc

SEQ ID NO: 55783 - DNA, 20 bp, Artificial Sequence
  Description of Artificial Sequence: Synthetic oligonucleotide
  Target: SCN9A; (+) strand; PAM type: NRG; PAM sequence: CAG
tggcatttttcctcaccacc

SEQ ID NO: 55784 - DNA, 20 bp, Artificial Sequence
  Description of Artificial Sequence: Synthetic oligonucleotide
  Target: SCN9A; (+) strand; PAM type: NRG; PAM sequence: AAG
catttttcctcaccacccag

SEQ ID NO: 55785 - DNA, 20 bp, Artificial Sequence
  Description of Artificial Sequence: Synthetic oligonucleotide
  Target: SCN9A; (+) strand; PAM type: NRG; PAM sequence: AGG
atttttcctcaccacccaga

SEQ ID NO: 55786 - DNA, 20 bp, Artificial Sequence
  Description of Artificial Sequence: Synthetic oligonucleotide
  Target: SCN9A; (+) strand; PAM type: NRG; PAM sequence: GGG
tttttcctcaccacccagaa

SEQ ID NO: 55787 - DNA, 20 bp, Artificial Sequence
  Description of Artificial Sequence: Synthetic oligonucleotide
  Target: SCN9A; (+) strand; PAM type: NRG; PAM sequence: TAG
tccaaacttcattccacctt

SEQ ID NO: 55788 - DNA, 20 bp, Artificial Sequence
  Description of Artificial Sequence: Synthetic oligonucleotide
  Target: SCN9A; (+) strand; PAM type: NRG; PAM sequence: AAG
tcattccacctttagctgcc

SEQ ID NO: 55789 - DNA, 20 bp, Artificial Sequence
  Description of Artificial Sequence: Synthetic oligonucleotide
  Target: SCN9A; (+) strand; PAM type: NRG; PAM sequence: GAG
attccacctttagctgccaa

SEQ ID NO: 55790 - DNA, 20 bp, Artificial Sequence
  Description of Artificial Sequence: Synthetic oligonucleotide
  Target: SCN9A; (+) strand; PAM type: NRG; PAM sequence: TGG
ctttagctgccaagagctga

SEQ ID NO: 55791 - DNA, 20 bp, Artificial Sequence
  Description of Artificial Sequence: Synthetic oligonucleotide
  Target: SCN9A; (+) strand; PAM type: NRG; PAM sequence: AAG
atggctttttcttttgccta

SEQ ID NO: 55792 - DNA, 20 bp, Artificial Sequence
  Description of Artificial Sequence: Synthetic oligonucleotide
  Target: SCN9A; (+) strand; PAM type: NRG; PAM sequence: CAG
tgcctaaagccatttccttc

SEQ ID NO: 55793 - DNA, 20 bp, Artificial Sequence
  Description of Artificial Sequence: Synthetic oligonucleotide
  Target: SCN9A; (+) strand; PAM type: NRG; PAM sequence: AAG
taaagccatttccttccagc

SEQ ID NO: 55794 - DNA, 20 bp, Artificial Sequence
  Description of Artificial Sequence: Synthetic oligonucleotide
  Target: SCN9A; (+) strand; PAM type: NRG; PAM sequence: AGG
aaagccatttccttccagca

SEQ ID NO: 55795 - DNA, 20 bp, Artificial Sequence
  Description of Artificial Sequence: Synthetic oligonucleotide
  Target: SCN9A; (+) strand; PAM type: NRG; PAM sequence: CAG
gccatttccttccagcaagg

SEQ ID NO: 55796 - DNA, 20 bp, Artificial Sequence
  Description of Artificial Sequence: Synthetic oligonucleotide
  Target: SCN9A; (+) strand; PAM type: NRG; PAM sequence: GAG
catttccttccagcaaggca

SEQ ID NO: 55797 - DNA, 20 bp, Artificial Sequence
  Description of Artificial Sequence: Synthetic oligonucleotide
  Target: SCN9A; (+) strand; PAM type: NRG; PAM sequence: AGG
atttccttccagcaaggcag

SEQ ID NO: 55798 - DNA, 20 bp, Artificial Sequence
  Description of Artificial Sequence: Synthetic oligonucleotide
  Target: SCN9A; (+) strand; PAM type: NRG; PAM sequence: AAG
ccttccagcaaggcagagga

SEQ ID NO: 55799 - DNA, 20 bp, Artificial Sequence
  Description of Artificial Sequence: Synthetic oligonucleotide
  Target: SCN9A; (+) strand; PAM type: NRG; PAM sequence: AGG
cttccagcaaggcagaggaa

SEQ ID NO: 55800 - DNA, 20 bp, Artificial Sequence
  Description of Artificial Sequence: Synthetic oligonucleotide
  Target: SCN9A; (+) strand; PAM type: NRG; PAM sequence: GGG
ttccagcaaggcagaggaaa

SEQ ID NO: 55801 - DNA, 20 bp, Artificial Sequence
  Description of Artificial Sequence: Synthetic oligonucleotide
  Target: SCN9A; (+) strand; PAM type: NRG; PAM sequence: AAG
agcaaggcagaggaaagggt

SEQ ID NO: 55802 - DNA, 20 bp, Artificial Sequence
  Description of Artificial Sequence: Synthetic oligonucleotide
  Target: SCN9A; (+) strand; PAM type: NRG; PAM sequence: AAG
ggtaagtgataccttcaatg

SEQ ID NO: 55803 - DNA, 20 bp, Artificial Sequence
  Description of Artificial Sequence: Synthetic oligonucleotide
  Target: SCN9A; (+) strand; PAM type: NRG; PAM sequence: TAG
aatgaagaaatttcattttt

SEQ ID NO: 55804 - DNA, 20 bp, Artificial Sequence
  Description of Artificial Sequence: Synthetic oligonucleotide
  Target: SCN9A; (+) strand; PAM type: NRG; PAM sequence: TGG
agaaatttcattttttagaa

SEQ ID NO: 55805 - DNA, 20 bp, Artificial Sequence
  Description of Artificial Sequence: Synthetic oligonucleotide
  Target: SCN9A; (+) strand; PAM type: NRG; PAM sequence: CAG
aatttcattttttagaatgg

SEQ ID NO: 55806 - DNA, 20 bp, Artificial Sequence
  Description of Artificial Sequence: Synthetic oligonucleotide
  Target: SCN9A; (+) strand; PAM type: NRG; PAM sequence: AGG
atttcattttttagaatggc

SEQ ID NO: 55807 - DNA, 20 bp, Artificial Sequence
  Description of Artificial Sequence: Synthetic oligonucleotide
  Target: SCN9A; (+) strand; PAM type: NRG; PAM sequence: AAG
tgttatctcatattccacaa

SEQ ID NO: 55808 - DNA, 20 bp, Artificial Sequence
  Description of Artificial Sequence: Synthetic oligonucleotide
  Target: SCN9A; (+) strand; PAM type: NRG; PAM sequence: TGG
agtattctacccacattctc

SEQ ID NO: 55809 - DNA, 20 bp, Artificial Sequence
  Description of Artificial Sequence: Synthetic oligonucleotide
  Target: SCN9A; (+) strand; PAM type: NRG; PAM sequence: AAG
ttaatatgaccttgcctctc

SEQ ID NO: 55810 - DNA, 20 bp, Artificial Sequence
  Description of Artificial Sequence: Synthetic oligonucleotide
  Target: SCN9A; (+) strand; PAM type: NRG; PAM sequence: TGG
atatgaccttgcctctcaag

SEQ ID NO: 55811 - DNA, 20 bp, Artificial Sequence
  Description of Artificial Sequence: Synthetic oligonucleotide
  Target: SCN9A; (+) strand; PAM type: NRG; PAM sequence: CAG
agtggtaatctaactctaca

SEQ ID NO: 55812 - DNA, 20 bp, Artificial Sequence
  Description of Artificial Sequence: Synthetic oligonucleotide
  Target: SCN9A; (+) strand; PAM type: NRG; PAM sequence: AAG
tctaactctacacagttcta

SEQ ID NO: 55813 - DNA, 20 bp, Artificial Sequence
  Description of Artificial Sequence: Synthetic oligonucleotide
  Target: SCN9A; (+) strand; PAM type: NRG; PAM sequence: AGG
ctaactctacacagttctaa

SEQ ID NO: 55814 - DNA, 20 bp, Artificial Sequence
  Description of Artificial Sequence: Synthetic oligonucleotide
  Target: SCN9A; (+) strand; PAM type: NRG; PAM sequence: AAG
actctacacagttctaaagg

SEQ ID NO: 55815 - DNA, 20 bp, Artificial Sequence
  Description of Artificial Sequence: Synthetic oligonucleotide
  Target: SCN9A; (+) strand; PAM type: NRG; PAM sequence: AAG
gatgtcataatacttctgta

SEQ ID NO: 55816 - DNA, 20 bp, Artificial Sequence
  Description of Artificial Sequence: Synthetic oligonucleotide
  Target: SCN9A; (+) strand; PAM type: NRG; PAM sequence: TAG
tacttctgtaaagaataaat

SEQ ID NO: 55817 - DNA, 20 bp, Artificial Sequence
  Description of Artificial Sequence: Synthetic oligonucleotide
  Target: SCN9A; (+) strand; PAM type: NRG; PAM sequence: AAG
aatttgtgatgtgtaatatg

SEQ ID NO: 55818 - DNA, 20 bp, Artificial Sequence
  Description of Artificial Sequence: Synthetic oligonucleotide
  Target: SCN9A; (+) strand; PAM type: NRG; PAM sequence: AGG
atttgtgatgtgtaatatga

SEQ ID NO: 55819 - DNA, 20 bp, Artificial Sequence
  Description of Artificial Sequence: Synthetic oligonucleotide
  Target: SCN9A; (+) strand; PAM type: NRG; PAM sequence: TAG
tatgaaggaccatcttcaat

SEQ ID NO: 55820 - DNA, 20 bp, Artificial Sequence
  Description of Artificial Sequence: Synthetic oligonucleotide
  Target: SCN9A; (+) strand; PAM type: NRG; PAM sequence: CAG
gaccatcttcaattagtaca

SEQ ID NO: 55821 - DNA, 20 bp, Artificial Sequence
  Description of Artificial Sequence: Synthetic oligonucleotide
  Target: SCN9A; (+) strand; PAM type: NRG; PAM sequence: CAG
catccacaatatgtcctctt

SEQ ID NO: 55822 - DNA, 20 bp, Artificial Sequence
  Description of Artificial Sequence: Synthetic oligonucleotide
  Target: SCN9A; (+) strand; PAM type: NRG; PAM sequence: GAG
tccacaatatgtcctcttca

SEQ ID NO: 55823 - DNA, 20 bp, Artificial Sequence
  Description of Artificial Sequence: Synthetic oligonucleotide
  Target: SCN9A; (+) strand; PAM type: NRG; PAM sequence: TAG
taaaaatccctgctcacaat

SEQ ID NO: 55824 - DNA, 20 bp, Artificial Sequence
  Description of Artificial Sequence: Synthetic oligonucleotide
  Target: SCN9A; (+) strand; PAM type: NRG; PAM sequence: TAG
tcacaattagtgaaataatt

SEQ ID NO: 55825 - DNA, 20 bp, Artificial Sequence
  Description of Artificial Sequence: Synthetic oligonucleotide
  Target: SCN9A; (+) strand; PAM type: NRG; PAM sequence: AAG
gtgaaataatttagtccttc

SEQ ID NO: 55826 - DNA, 20 bp, Artificial Sequence
  Description of Artificial Sequence: Synthetic oligonucleotide
  Target: SCN9A; (+) strand; PAM type: NRG; PAM sequence: TGG
tagtccttcaagatgtaatg

SEQ ID NO: 55827 - DNA, 20 bp, Artificial Sequence
  Description of Artificial Sequence: Synthetic oligonucleotide
  Target: SCN9A; (+) strand; PAM type: NRG; PAM sequence: TGG
aattatttaccaaaaatctg

SEQ ID NO: 55828 - DNA, 20 bp, Artificial Sequence
  Description of Artificial Sequence: Synthetic oligonucleotide
  Target: SCN9A; (+) strand; PAM type: NRG; PAM sequence: TGG
atttaccaaaaatctgtggc

SEQ ID NO: 55829 - DNA, 20 bp, Artificial Sequence
  Description of Artificial Sequence: Synthetic oligonucleotide
  Target: SCN9A; (+) strand; PAM type: NRG; PAM sequence: CAG
tacataaaaaaatcattaat

SEQ ID NO: 55830 - DNA, 20 bp, Artificial Sequence
  Description of Artificial Sequence: Synthetic oligonucleotide
  Target: SCN9A; (+) strand; PAM type: NRG; PAM sequence: AAG
tcagtttgtcacctaattga

SEQ ID NO: 55831 - DNA, 20 bp, Artificial Sequence
  Description of Artificial Sequence: Synthetic oligonucleotide
  Target: SCN9A; (+) strand; PAM type: NRG; PAM sequence: TAG
aattttcaaccaaatgttaa

SEQ ID NO: 55832 - DNA, 20 bp, Artificial Sequence
  Description of Artificial Sequence: Synthetic oligonucleotide
  Target: SCN9A; (+) strand; PAM type: NRG; PAM sequence: TAG
ccaaatgttaatagcaaaac

SEQ ID NO: 55833 - DNA, 20 bp, Artificial Sequence
  Description of Artificial Sequence: Synthetic oligonucleotide
  Target: SCN9A; (+) strand; PAM type: NRG; PAM sequence: AAG
gttgtttgtttaatatcttt

SEQ ID NO: 55834 - DNA, 20 bp, Artificial Sequence
  Description of Artificial Sequence: Synthetic oligonucleotide
  Target: SCN9A; (+) strand; PAM type: NRG; PAM sequence: TAG
ttgtttaatatctttaagca

SEQ ID NO: 55835 - DNA, 20 bp, Artificial Sequence
  Description of Artificial Sequence: Synthetic oligonucleotide
  Target: SCN9A; (+) strand; PAM type: NRG; PAM sequence: AAG
aagcatagtctgcaaaaata

SEQ ID NO: 55836 - DNA, 20 bp, Artificial Sequence
  Description of Artificial Sequence: Synthetic oligonucleotide
  Target: SCN9A; (+) strand; PAM type: NRG; PAM sequence: AGG
agcatagtctgcaaaaataa

SEQ ID NO: 55837 - DNA, 20 bp, Artificial Sequence
  Description of Artificial Sequence: Synthetic oligonucleotide
  Target: SCN9A; (+) strand; PAM type: NRG; PAM sequence: GGG
gcatagtctgcaaaaataaa

SEQ ID NO: 55838 - DNA, 20 bp, Artificial Sequence
  Description of Artificial Sequence: Synthetic oligonucleotide
  Target: SCN9A; (+) strand; PAM type: NRG; PAM sequence: GGG
catagtctgcaaaaataaag

SEQ ID NO: 55839 - DNA, 20 bp, Artificial Sequence
  Description of Artificial Sequence: Synthetic oligonucleotide
  Target: SCN9A; (+) strand; PAM type: NRG; PAM sequence: GGG
atagtctgcaaaaataaagg

SEQ ID NO: 55840 - DNA, 20 bp, Artificial Sequence
  Description of Artificial Sequence: Synthetic oligonucleotide
  Target: SCN9A; (+) strand; PAM type: NRG; PAM sequence: GGG
tagtctgcaaaaataaaggg

SEQ ID NO: 55841 - DNA, 20 bp, Artificial Sequence
  Description of Artificial Sequence: Synthetic oligonucleotide
  Target: SCN9A; (+) strand; PAM type: NRG; PAM sequence: GAG
gtctgcaaaaataaaggggg

SEQ ID NO: 55842 - DNA, 20 bp, Artificial Sequence
  Description of Artificial Sequence: Synthetic oligonucleotide
  Target: SCN9A; (+) strand; PAM type: NRG; PAM sequence: AGG
tctgcaaaaataaagggggg

SEQ ID NO: 55843 - DNA, 20 bp, Artificial Sequence
  Description of Artificial Sequence: Synthetic oligonucleotide
  Target: SCN9A; (+) strand; PAM type: NRG; PAM sequence: AAG
gggaggcaaatcaccataca

SEQ ID NO: 55844 - DNA, 20 bp, Artificial Sequence
  Description of Artificial Sequence: Synthetic oligonucleotide
  Target: SCN9A; (+) strand; PAM type: NRG; PAM sequence: GAG
gtgtgtgtgtgtgtgtgtgt

SEQ ID NO: 55845 - DNA, 20 bp, Artificial Sequence
  Description of Artificial Sequence: Synthetic oligonucleotide
  Target: SCN9A; (+) strand; PAM type: NRG; PAM sequence: GAG
gtgtgtgtgtgtgtgagtgt

SEQ ID NO: 55846 - DNA, 20 bp, Artificial Sequence
  Description of Artificial Sequence: Synthetic oligonucleotide
  Target: SCN9A; (+) strand; PAM type: NRG; PAM sequence: TGG
tgtgagtgtgagtgtgtgtg

SEQ ID NO: 55847 - DNA, 20 bp, Artificial Sequence
  Description of Artificial Sequence: Synthetic oligonucleotide
  Target: SCN9A; (+) strand; PAM type: NRG; PAM sequence: TAG
gtgtgtgtgtggtaaaattc

SEQ ID NO: 55848 - DNA, 20 bp, Artificial Sequence
  Description of Artificial Sequence: Synthetic oligonucleotide
  Target: SCN9A; (+) strand; PAM type: NRG; PAM sequence: GAG
aaaatgacacaatcatttat

SEQ ID NO: 55849 - DNA, 20 bp, Artificial Sequence
  Description of Artificial Sequence: Synthetic oligonucleotide
  Target: SCN9A; (+) strand; PAM type: NRG; PAM sequence: AAG
cacaatcatttatgagcatg

SEQ ID NO: 55850 - DNA, 20 bp, Artificial Sequence
  Description of Artificial Sequence: Synthetic oligonucleotide
  Target: SCN9A; (+) strand; PAM type: NRG; PAM sequence: CAG
atttatgagcatgaagtttg

SEQ ID NO: 55851 - DNA, 20 bp, Artificial Sequence
  Description of Artificial Sequence: Synthetic oligonucleotide
  Target: SCN9A; (+) strand; PAM type: NRG; PAM sequence: CAG
ccttacttccactctaataa

SEQ ID NO: 55852 - DNA, 20 bp, Artificial Sequence
  Description of Artificial Sequence: Synthetic oligonucleotide
  Target: SCN9A; (+) strand; PAM type: NRG; PAM sequence: TGG
ttccactctaataacagtga

SEQ ID NO: 55853 - DNA, 20 bp, Artificial Sequence
  Description of Artificial Sequence: Synthetic oligonucleotide
  Target: SCN9A; (+) strand; PAM type: NRG; PAM sequence: GGG
tccactctaataacagtgat

SEQ ID NO: 55854 - DNA, 20 bp, Artificial Sequence
  Description of Artificial Sequence: Synthetic oligonucleotide
  Target: SCN9A; (+) strand; PAM type: NRG; PAM sequence: TGG
ataacagtgatgggtcttca

SEQ ID NO: 55855 - DNA, 20 bp, Artificial Sequence
  Description of Artificial Sequence: Synthetic oligonucleotide
  Target: SCN9A; (+) strand; PAM type: NRG; PAM sequence: AAG
agtgatgggtcttcatggat

SEQ ID NO: 55856 - DNA, 20 bp, Artificial Sequence
  Description of Artificial Sequence: Synthetic oligonucleotide
  Target: SCN9A; (+) strand; PAM type: NRG; PAM sequence: TAG
ttgcctctctgaaccttcct

SEQ ID NO: 55857 - DNA, 20 bp, Artificial Sequence
  Description of Artificial Sequence: Synthetic oligonucleotide
  Target: SCN9A; (+) strand; PAM type: NRG; PAM sequence: GAG
gcctctctgaaccttcctta

SEQ ID NO: 55858 - DNA, 20 bp, Artificial Sequence
  Description of Artificial Sequence: Synthetic oligonucleotide
  Target: SCN9A; (+) strand; PAM type: NRG; PAM sequence: TGG
tagagaatgcttcaaatatt

SEQ ID NO: 55859 - DNA, 20 bp, Artificial Sequence
  Description of Artificial Sequence: Synthetic oligonucleotide
  Target: SCN9A; (+) strand; PAM type: NRG; PAM sequence: TGG
gataatgtgccctttgtacc

SEQ ID NO: 55860 - DNA, 20 bp, Artificial Sequence
  Description of Artificial Sequence: Synthetic oligonucleotide
  Target: SCN9A; (+) strand; PAM type: NRG; PAM sequence: GGG
ataatgtgccctttgtacct

SEQ ID NO: 55861 - DNA, 20 bp, Artificial Sequence
  Description of Artificial Sequence: Synthetic oligonucleotide
  Target: SCN9A; (+) strand; PAM type: NRG; PAM sequence: GGG
taatgtgccctttgtacctg

SEQ ID NO: 55862 - DNA, 20 bp, Artificial Sequence
  Description of Artificial Sequence: Synthetic oligonucleotide
  Target: SCN9A; (+) strand; PAM type: NRG; PAM sequence: TAG
acctggggcaaacatcaatt

SEQ ID NO: 55863 - DNA, 20 bp, Artificial Sequence
  Description of Artificial Sequence: Synthetic oligonucleotide
  Target: SCN9A; (+) strand; PAM type: NRG; PAM sequence: TGG
aaacatcaatttagaccgtg

SEQ ID NO: 55864 - DNA, 20 bp, Artificial Sequence
  Description of Artificial Sequence: Synthetic oligonucleotide
  Target: SCN9A; (+) strand; PAM type: NRG; PAM sequence: TGG
ccgtgtggaaacctaactta

SEQ ID NO: 55865 - DNA, 20 bp, Artificial Sequence
  Description of Artificial Sequence: Synthetic oligonucleotide
  Target: SCN9A; (+) strand; PAM type: NRG; PAM sequence: GAG
tgactacatttctatcaact

SEQ ID NO: 55866 - DNA, 20 bp, Artificial Sequence
  Description of Artificial Sequence: Synthetic oligonucleotide
  Target: SCN9A; (+) strand; PAM type: NRG; PAM sequence: AAG
tctatcaactgagctcacat

SEQ ID NO: 55867 - DNA, 20 bp, Artificial Sequence
  Description of Artificial Sequence: Synthetic oligonucleotide
  Target: SCN9A; (+) strand; PAM type: NRG; PAM sequence: AAG
agcatctatgtttattttaa

SEQ ID NO: 55868 - DNA, 20 bp, Artificial Sequence
  Description of Artificial Sequence: Synthetic oligonucleotide
  Target: SCN9A; (+) strand; PAM type: NRG; PAM sequence: TAG
aaaagaatattttaaattca

SEQ ID NO: 55869 - DNA, 20 bp, Artificial Sequence
  Description of Artificial Sequence: Synthetic oligonucleotide
  Target: SCN9A; (+) strand; PAM type: NRG; PAM sequence: CAG
gaatattttaaattcatagt

SEQ ID NO: 55870 - DNA, 20 bp, Artificial Sequence
  Description of Artificial Sequence: Synthetic oligonucleotide
  Target: SCN9A; (+) strand; PAM type: NRG; PAM sequence: TGG
catagtcagtgactattgac

SEQ ID NO: 55871 - DNA, 20 bp, Artificial Sequence
  Description of Artificial Sequence: Synthetic oligonucleotide
  Target: SCN9A; (+) strand; PAM type: NRG; PAM sequence: TAG
actggccctcaaatttctgt

SEQ ID NO: 55872 - DNA, 20 bp, Artificial Sequence
  Description of Artificial Sequence: Synthetic oligonucleotide
  Target: SCN9A; (+) strand; PAM type: NRG; PAM sequence: CAG
caaatttctgttagatgata

SEQ ID NO: 55873 - DNA, 20 bp, Artificial Sequence
  Description of Artificial Sequence: Synthetic oligonucleotide
  Target: SCN9A; (+) strand; PAM type: NRG; PAM sequence: AAG
gatacagatttaaacctaac

SEQ ID NO: 55874 - DNA, 20 bp, Artificial Sequence
  Description of Artificial Sequence: Synthetic oligonucleotide
  Target: SCN9A; (+) strand; PAM type: NRG; PAM sequence: AGG
atacagatttaaacctaaca

SEQ ID NO: 55875 - DNA, 20 bp, Artificial Sequence
  Description of Artificial Sequence: Synthetic oligonucleotide
  Target: SCN9A; (+) strand; PAM type: NRG; PAM sequence: TAG
acctaacaaggttatcattt

SEQ ID NO: 55876 - DNA, 20 bp, Artificial Sequence
  Description of Artificial Sequence: Synthetic oligonucleotide
  Target: SCN9A; (+) strand; PAM type: NRG; PAM sequence: TGG
caaggttatcattttagatt

SEQ ID NO: 55877 - DNA, 20 bp, Artificial Sequence
  Description of Artificial Sequence: Synthetic oligonucleotide
  Target: SCN9A; (+) strand; PAM type: NRG; PAM sequence: GAG
aggttatcattttagatttg

SEQ ID NO: 55878 - DNA, 20 bp, Artificial Sequence
  Description of Artificial Sequence: Synthetic oligonucleotide
  Target: SCN9A; (+) strand; PAM type: NRG; PAM sequence: TAG
ggagtcacttataaccatat

SEQ ID NO: 55879 - DNA, 20 bp, Artificial Sequence
  Description of Artificial Sequence: Synthetic oligonucleotide
  Target: SCN9A; (+) strand; PAM type: NRG; PAM sequence: TGG
aatatattttaatacatttg

SEQ ID NO: 55880 - DNA, 20 bp, Artificial Sequence
  Description of Artificial Sequence: Synthetic oligonucleotide
  Target: SCN9A; (+) strand; PAM type: NRG; PAM sequence: AAG
tttgtggtcactgcctttct

SEQ ID NO: 55881 - DNA, 20 bp, Artificial Sequence
  Description of Artificial Sequence: Synthetic oligonucleotide
  Target: SCN9A; (+) strand; PAM type: NRG; PAM sequence: AAG
attacaaattacttaccttt

SEQ ID NO: 55882 - DNA, 20 bp, Artificial Sequence
  Description of Artificial Sequence: Synthetic oligonucleotide
  Target: SCN9A; (+) strand; PAM type: NRG; PAM sequence: AAG
attatcacctacactgataa

SEQ ID NO: 55883 - DNA, 20 bp, Artificial Sequence
  Description of Artificial Sequence: Synthetic oligonucleotide
  Target: SCN9A; (+) strand; PAM type: NRG; PAM sequence: GAG
tatcacctacactgataaaa

SEQ ID NO: 55884 - DNA, 20 bp, Artificial Sequence
  Description of Artificial Sequence: Synthetic oligonucleotide
  Target: SCN9A; (+) strand; PAM type: NRG; PAM sequence: GAG
tcacctacactgataaaaga

SEQ ID NO: 55885 - DNA, 20 bp, Artificial Sequence
  Description of Artificial Sequence: Synthetic oligonucleotide
  Target: SCN9A; (+) strand; PAM type: NRG; PAM sequence: CAG
ataaaagagagaatacatct

SEQ ID NO: 55886 - DNA, 20 bp, Artificial Sequence
  Description of Artificial Sequence: Synthetic oligonucleotide
  Target: SCN9A; (+) strand; PAM type: NRG; PAM sequence: AGG
taaaagagagaatacatctc

SEQ ID NO: 55887 - DNA, 20 bp, Artificial Sequence
  Description of Artificial Sequence: Synthetic oligonucleotide
  Target: SCN9A; (+) strand; PAM type: NRG; PAM sequence: TAG
aatgcttgacaaataaaaaa

SEQ ID NO: 55888 - DNA, 20 bp, Artificial Sequence
  Description of Artificial Sequence: Synthetic oligonucleotide
  Target: SCN9A; (+) strand; PAM type: NRG; PAM sequence: CAG
aatcacaaaattcatgtttc

SEQ ID NO: 55889 - DNA, 20 bp, Artificial Sequence
  Description of Artificial Sequence: Synthetic oligonucleotide
  Target: SCN9A; (+) strand; PAM type: NRG; PAM sequence: AGG
atcacaaaattcatgtttcc

SEQ ID NO: 55890 - DNA, 20 bp, Artificial Sequence
  Description of Artificial Sequence: Synthetic oligonucleotide
  Target: SCN9A; (+) strand; PAM type: NRG; PAM sequence: GGG
tcacaaaattcatgtttcca

SEQ ID NO: 55891 - DNA, 20 bp, Artificial Sequence
  Description of Artificial Sequence: Synthetic oligonucleotide
  Target: SCN9A; (+) strand; PAM type: NRG; PAM sequence: TGG
agggttaatatgctttattc

SEQ ID NO: 55892 - DNA, 20 bp, Artificial Sequence
  Description of Artificial Sequence: Synthetic oligonucleotide
  Target: SCN9A; (+) strand; PAM type: NRG; PAM sequence: AAG
gttaatatgctttattctgg

SEQ ID NO: 55893 - DNA, 20 bp, Artificial Sequence
  Description of Artificial Sequence: Synthetic oligonucleotide
  Target: SCN9A; (+) strand; PAM type: NRG; PAM sequence: CAG
aaccccctactacttgatgc

SEQ ID NO: 55894 - DNA, 20 bp, Artificial Sequence
  Description of Artificial Sequence: Synthetic oligonucleotide
  Target: SCN9A; (+) strand; PAM type: NRG; PAM sequence: AGG
accccctactacttgatgcc

SEQ ID NO: 55895 - DNA, 20 bp, Artificial Sequence
  Description of Artificial Sequence: Synthetic oligonucleotide
  Target: SCN9A; (+) strand; PAM type: NRG; PAM sequence: TGG
cttgatgccaggcactattc

SEQ ID NO: 55896 - DNA, 20 bp, Artificial Sequence
  Description of Artificial Sequence: Synthetic oligonucleotide
  Target: SCN9A; (+) strand; PAM type: NRG; PAM sequence: AAG
gatgccaggcactattctgg

SEQ ID NO: 55897 - DNA, 20 bp, Artificial Sequence
  Description of Artificial Sequence: Synthetic oligonucleotide
  Target: SCN9A; (+) strand; PAM type: NRG; PAM sequence: AAG
caggcactattctggaagct

SEQ ID NO: 55898 - DNA, 20 bp, Artificial Sequence
  Description of Artificial Sequence: Synthetic oligonucleotide
  Target: SCN9A; (+) strand; PAM type: NRG; PAM sequence: AAG
tggaagctaagtcaacaatg

SEQ ID NO: 55899 - DNA, 20 bp, Artificial Sequence
  Description of Artificial Sequence: Synthetic oligonucleotide
  Target: SCN9A; (+) strand; PAM type: NRG; PAM sequence: TAG
ctaagtcaacaatgaagaca

SEQ ID NO: 55900 - DNA, 20 bp, Artificial Sequence
  Description of Artificial Sequence: Synthetic oligonucleotide
  Target: SCN9A; (+) strand; PAM type: NRG; PAM sequence: TGG
tcaacaatgaagacatagtc

SEQ ID NO: 55901 - DNA, 20 bp, Artificial Sequence
  Description of Artificial Sequence: Synthetic oligonucleotide
  Target: SCN9A; (+) strand; PAM type: NRG; PAM sequence: GGG
caacaatgaagacatagtct

SEQ ID NO: 55902 - DNA, 20 bp, Artificial Sequence
  Description of Artificial Sequence: Synthetic oligonucleotide
  Target: SCN9A; (+) strand; PAM type: NRG; PAM sequence: TGG
agacatagtctgggttccct

SEQ ID NO: 55903 - DNA, 20 bp, Artificial Sequence
  Description of Artificial Sequence: Synthetic oligonucleotide
  Target: SCN9A; (+) strand; PAM type: NRG; PAM sequence: GAG
acatagtctgggttcccttg

SEQ ID NO: 55904 - DNA, 20 bp, Artificial Sequence
  Description of Artificial Sequence: Synthetic oligonucleotide
  Target: SCN9A; (+) strand; PAM type: NRG; PAM sequence: TGG
ctgggttcccttggagtatt

SEQ ID NO: 55905 - DNA, 20 bp, Artificial Sequence
  Description of Artificial Sequence: Synthetic oligonucleotide
  Target: SCN9A; (+) strand; PAM type: NRG; PAM sequence: AAG
aaatacctgcatgctgtaac

SEQ ID NO: 55906 - DNA, 20 bp, Artificial Sequence
  Description of Artificial Sequence: Synthetic oligonucleotide
  Target: SCN9A; (+) strand; PAM type: NRG; PAM sequence: CAG
tacctgcatgctgtaacaag

SEQ ID NO: 55907 - DNA, 20 bp, Artificial Sequence
  Description of Artificial Sequence: Synthetic oligonucleotide
  Target: SCN9A; (+) strand; PAM type: NRG; PAM sequence: AAG
tgctgtaacaagcagtatga

SEQ ID NO: 55908 - DNA, 20 bp, Artificial Sequence
  Description of Artificial Sequence: Synthetic oligonucleotide
  Target: SCN9A; (+) strand; PAM type: NRG; PAM sequence: AAG
acaagcagtatgaaagaaac

SEQ ID NO: 55909 - DNA, 20 bp, Artificial Sequence
  Description of Artificial Sequence: Synthetic oligonucleotide
  Target: SCN9A; (+) strand; PAM type: NRG; PAM sequence: AGG
caagcagtatgaaagaaaca

SEQ ID NO: 55910 - DNA, 20 bp, Artificial Sequence
  Description of Artificial Sequence: Synthetic oligonucleotide
  Target: SCN9A; (+) strand; PAM type: NRG; PAM sequence: AAG
agaaacaaggttccaacatc

SEQ ID NO: 55911 - DNA, 20 bp, Artificial Sequence
  Description of Artificial Sequence: Synthetic oligonucleotide
  Target: SCN9A; (+) strand; PAM type: NRG; PAM sequence: CGG
ttccaacatcaagaccaaca

SEQ ID NO: 55912 - DNA, 20 bp, Artificial Sequence
  Description of Artificial Sequence: Synthetic oligonucleotide
  Target: SCN9A; (+) strand; PAM type: NRG; PAM sequence: GGG
tccaacatcaagaccaacac

SEQ ID NO: 55913 - DNA, 20 bp, Artificial Sequence
  Description of Artificial Sequence: Synthetic oligonucleotide
  Target: SCN9A; (+) strand; PAM type: NRG; PAM sequence: AAG
cgggacaacctacttttaac

SEQ ID NO: 55914 - DNA, 20 bp, Artificial Sequence
  Description of Artificial Sequence: Synthetic oligonucleotide
  Target: SCN9A; (+) strand; PAM type: NRG; PAM sequence: GAG
ttccaaaacaaaaaaacctc

SEQ ID NO: 55915 - DNA, 20 bp, Artificial Sequence
  Description of Artificial Sequence: Synthetic oligonucleotide
  Target: SCN9A; (+) strand; PAM type: NRG; PAM sequence: GAG
aaacaaaaaaacctcgagtt

SEQ ID NO: 55916 - DNA, 20 bp, Artificial Sequence
  Description of Artificial Sequence: Synthetic oligonucleotide
  Target: SCN9A; (+) strand; PAM type: NRG; PAM sequence: AAG
aaacctcgagttgagattta

SEQ ID NO: 55917 - DNA, 20 bp, Artificial Sequence
  Description of Artificial Sequence: Synthetic oligonucleotide
  Target: SCN9A; (+) strand; PAM type: NRG; PAM sequence: AAG
cgagttgagatttaaagttt

SEQ ID NO: 55918 - DNA, 20 bp, Artificial Sequence
  Description of Artificial Sequence: Synthetic oligonucleotide
  Target: SCN9A; (+) strand; PAM type: NRG; PAM sequence: AAG
gttgagatttaaagtttaag

SEQ ID NO: 55919 - DNA, 20 bp, Artificial Sequence
  Description of Artificial Sequence: Synthetic oligonucleotide
  Target: SCN9A; (+) strand; PAM type: NRG; PAM sequence: AGG
ttgagatttaaagtttaaga

SEQ ID NO: 55920 - DNA, 20 bp, Artificial Sequence
  Description of Artificial Sequence: Synthetic oligonucleotide
  Target: SCN9A; (+) strand; PAM type: NRG; PAM sequence: GAG
gagatttaaagtttaagaag

SEQ ID NO: 55921 - DNA, 20 bp, Artificial Sequence
  Description of Artificial Sequence: Synthetic oligonucleotide
  Target: SCN9A; (+) strand; PAM type: NRG; PAM sequence: AAG
tttaaagtttaagaaggagt

SEQ ID NO: 55922 - DNA, 20 bp, Artificial Sequence
  Description of Artificial Sequence: Synthetic oligonucleotide
  Target: SCN9A; (+) strand; PAM type: NRG; PAM sequence: TAG
taagaaggagtaagcacgca

SEQ ID NO: 55923 - DNA, 20 bp, Artificial Sequence
  Description of Artificial Sequence: Synthetic oligonucleotide
  Target: SCN9A; (+) strand; PAM type: NRG; PAM sequence: GAG
agaaggagtaagcacgcata

SEQ ID NO: 55924 - DNA, 20 bp, Artificial Sequence
  Description of Artificial Sequence: Synthetic oligonucleotide
  Target: SCN9A; (+) strand; PAM type: NRG; PAM sequence: CAG
gagtaagcacgcatagagtt

SEQ ID NO: 55925 - DNA, 20 bp, Artificial Sequence
  Description of Artificial Sequence: Synthetic oligonucleotide
  Target: SCN9A; (+) strand; PAM type: NRG; PAM sequence: AGG
agtaagcacgcatagagttc

SEQ ID NO: 55926 - DNA, 20 bp, Artificial Sequence
  Description of Artificial Sequence: Synthetic oligonucleotide
  Target: SCN9A; (+) strand; PAM type: NRG; PAM sequence: TGG
cacgcatagagttcaggcat

SEQ ID NO: 55927 - DNA, 20 bp, Artificial Sequence
  Description of Artificial Sequence: Synthetic oligonucleotide
  Target: SCN9A; (+) strand; PAM type: NRG; PAM sequence: GGG
acgcatagagttcaggcatt

SEQ ID NO: 55928 - DNA, 20 bp, Artificial Sequence
  Description of Artificial Sequence: Synthetic oligonucleotide
  Target: SCN9A; (+) strand; PAM type: NRG; PAM sequence: CAG
tagagttcaggcattgggaa

SEQ ID NO: 55929 - DNA, 20 bp, Artificial Sequence
  Description of Artificial Sequence: Synthetic oligonucleotide
  Target: SCN9A; (+) strand; PAM type: NRG; PAM sequence: AAG
cattgggaacagcatttgaa

SEQ ID NO: 55930 - DNA, 20 bp, Artificial Sequence
  Description of Artificial Sequence: Synthetic oligonucleotide
  Target: SCN9A; (+) strand; PAM type: NRG; PAM sequence: AGG
attgggaacagcatttgaaa

SEQ ID NO: 55931 - DNA, 20 bp, Artificial Sequence
  Description of Artificial Sequence: Synthetic oligonucleotide
  Target: SCN9A; (+) strand; PAM type: NRG; PAM sequence: AAG
cagcatttgaaaaggcctta

SEQ ID NO: 55932 - DNA, 20 bp, Artificial Sequence
  Description of Artificial Sequence: Synthetic oligonucleotide
  Target: SCN9A; (+) strand; PAM type: NRG; PAM sequence: GAG
gcatttgaaaaggccttaaa

SEQ ID NO: 55933 - DNA, 20 bp, Artificial Sequence
  Description of Artificial Sequence: Synthetic oligonucleotide
  Target: SCN9A; (+) strand; PAM type: NRG; PAM sequence: TAG
tgctattgtttcatgtgttt

SEQ ID NO: 55934 - DNA, 20 bp, Artificial Sequence
  Description of Artificial Sequence: Synthetic oligonucleotide
  Target: SCN9A; (+) strand; PAM type: NRG; PAM sequence: TGG
catgtgttttagccacgacc

SEQ ID NO: 55935 - DNA, 20 bp, Artificial Sequence
  Description of Artificial Sequence: Synthetic oligonucleotide
  Target: SCN9A; (+) strand; PAM type: NRG; PAM sequence: GGG
atgtgttttagccacgacct

SEQ ID NO: 55936 - DNA, 20 bp, Artificial Sequence
  Description of Artificial Sequence: Synthetic oligonucleotide
  Target: SCN9A; (+) strand; PAM type: NRG; PAM sequence: CAG
tgttttagccacgacctggg

SEQ ID NO: 55937 - DNA, 20 bp, Artificial Sequence
  Description of Artificial Sequence: Synthetic oligonucleotide
  Target: SCN9A; (+) strand; PAM type: NRG; PAM sequence: AGG
gttttagccacgacctgggc

SEQ ID NO: 55938 - DNA, 20 bp, Artificial Sequence
  Description of Artificial Sequence: Synthetic oligonucleotide
  Target: SCN9A; (+) strand; PAM type: NRG; PAM sequence: GAG
tttagccacgacctgggcag

SEQ ID NO: 55939 - DNA, 20 bp, Artificial Sequence
  Description of Artificial Sequence: Synthetic oligonucleotide
  Target: SCN9A; (+) strand; PAM type: NRG; PAM sequence: GAG
ctgggcaggagcaccttaat

SEQ ID NO: 55940 - DNA, 20 bp, Artificial Sequence
  Description of Artificial Sequence: Synthetic oligonucleotide
  Target: SCN9A; (+) strand; PAM type: NRG; PAM sequence: AAG
ggcaggagcaccttaatgag

SEQ ID NO: 55941 - DNA, 20 bp, Artificial Sequence
  Description of Artificial Sequence: Synthetic oligonucleotide
  Target: SCN9A; (+) strand; PAM type: NRG; PAM sequence: GAG
caggagcaccttaatgagaa

SEQ ID NO: 55942 - DNA, 20 bp, Artificial Sequence
  Description of Artificial Sequence: Synthetic oligonucleotide
  Target: SCN9A; (+) strand; PAM type: NRG; PAM sequence: TAG
gcaccttaatgagaagagaa

SEQ ID NO: 55943 - DNA, 20 bp, Artificial Sequence
  Description of Artificial Sequence: Synthetic oligonucleotide
  Target: SCN9A; (+) strand; PAM type: NRG; PAM sequence: AGG
caccttaatgagaagagaat

SEQ ID NO: 55944 - DNA, 20 bp, Artificial Sequence
  Description of Artificial Sequence: Synthetic oligonucleotide
  Target: SCN9A; (+) strand; PAM type: NRG; PAM sequence: TGG
aatgagaagagaataggttc

SEQ ID NO: 55945 - DNA, 20 bp, Artificial Sequence
  Description of Artificial Sequence: Synthetic oligonucleotide
  Target: SCN9A; (+) strand; PAM type: NRG; PAM sequence: GAG
agaagagaataggttctggt

SEQ ID NO: 55946 - DNA, 20 bp, Artificial Sequence
  Description of Artificial Sequence: Synthetic oligonucleotide
  Target: SCN9A; (+) strand; PAM type: NRG; PAM sequence: AGG
gaagagaataggttctggtg

SEQ ID NO: 55947 - DNA, 20 bp, Artificial Sequence
  Description of Artificial Sequence: Synthetic oligonucleotide
  Target: SCN9A; (+) strand; PAM type: NRG; PAM sequence: TGG
agaataggttctggtgaggt

SEQ ID NO: 55948 - DNA, 20 bp, Artificial Sequence
  Description of Artificial Sequence: Synthetic oligonucleotide
  Target: SCN9A; (+) strand; PAM type: NRG; PAM sequence: GAG
aataggttctggtgaggttg

SEQ ID NO: 55949 - DNA, 20 bp, Artificial Sequence
  Description of Artificial Sequence: Synthetic oligonucleotide
  Target: SCN9A; (+) strand; PAM type: NRG; PAM sequence: GAG
taggttctggtgaggttgga

SEQ ID NO: 55950 - DNA, 20 bp, Artificial Sequence
  Description of Artificial Sequence: Synthetic oligonucleotide
  Target: SCN9A; (+) strand; PAM type: NRG; PAM sequence: AAG
gttctggtgaggttggagag

SEQ ID NO: 55951 - DNA, 20 bp, Artificial Sequence
  Description of Artificial Sequence: Synthetic oligonucleotide
  Target: SCN9A; (+) strand; PAM type: NRG; PAM sequence: AGG
ttctggtgaggttggagaga

SEQ ID NO: 55952 - DNA, 20 bp, Artificial Sequence
  Description of Artificial Sequence: Synthetic oligonucleotide
  Target: SCN9A; (+) strand; PAM type: NRG; PAM sequence: GGG
tctggtgaggttggagagaa

SEQ ID NO: 55953 - DNA, 20 bp, Artificial Sequence
  Description of Artificial Sequence: Synthetic oligonucleotide
  Target: SCN9A; (+) strand; PAM type: NRG; PAM sequence: CAG
gtgaggttggagagaaggga

SEQ ID NO: 55954 - DNA, 20 bp, Artificial Sequence
  Description of Artificial Sequence: Synthetic oligonucleotide
  Target: SCN9A; (+) strand; PAM type: NRG; PAM sequence: CAG
gttggagagaagggacagaa

SEQ ID NO: 55955 - DNA, 20 bp, Artificial Sequence
  Description of Artificial Sequence: Synthetic oligonucleotide
  Target: SCN9A; (+) strand; PAM type: NRG; PAM sequence: GAG
tggagagaagggacagaaca

SEQ ID NO: 55956 - DNA, 20 bp, Artificial Sequence
  Description of Artificial Sequence: Synthetic oligonucleotide
  Target: SCN9A; (+) strand; PAM type: NRG; PAM sequence: GAG
gagagaagggacagaacaga

SEQ ID NO: 55957 - DNA, 20 bp, Artificial Sequence
  Description of Artificial Sequence: Synthetic oligonucleotide
  Target: SCN9A; (+) strand; PAM type: NRG; PAM sequence: GAG
cagagagtaaaccatatgct

SEQ ID NO: 55958 - DNA, 20 bp, Artificial Sequence
  Description of Artificial Sequence: Synthetic oligonucleotide
  Target: SCN9A; (+) strand; PAM type: NRG; PAM sequence: AGG
agagagtaaaccatatgctg

SEQ ID NO: 55959 - DNA, 20 bp, Artificial Sequence
  Description of Artificial Sequence: Synthetic oligonucleotide
  Target: SCN9A; (+) strand; PAM type: NRG; PAM sequence: AAG
agtaaaccatatgctgagga

SEQ ID NO: 55960 - DNA, 20 bp, Artificial Sequence
  Description of Artificial Sequence: Synthetic oligonucleotide
  Target: SCN9A; (+) strand; PAM type: NRG; PAM sequence: AGG
gtaaaccatatgctgaggaa

SEQ ID NO: 55961 - DNA, 20 bp, Artificial Sequence
  Description of Artificial Sequence: Synthetic oligonucleotide
  Target: SCN9A; (+) strand; PAM type: NRG; PAM sequence: TGG
catttactgttgttgctaat

SEQ ID NO: 55962 - DNA, 20 bp, Artificial Sequence
  Description of Artificial Sequence: Synthetic oligonucleotide
  Target: SCN9A; (+) strand; PAM type: NRG; PAM sequence: CAG
tttttttttttttttaaatg

SEQ ID NO: 55963 - DNA, 20 bp, Artificial Sequence
  Description of Artificial Sequence: Synthetic oligonucleotide
  Target: SCN9A; (+) strand; PAM type: NRG; PAM sequence: GAG
ttttttttaaatgcagttgt

SEQ ID NO: 55964 - DNA, 20 bp, Artificial Sequence
  Description of Artificial Sequence: Synthetic oligonucleotide
  Target: SCN9A; (+) strand; PAM type: NRG; PAM sequence: TAG
agttgtgagccaatgtttgt

SEQ ID NO: 55965 - DNA, 20 bp, Artificial Sequence
  Description of Artificial Sequence: Synthetic oligonucleotide
  Target: SCN9A; (+) strand; PAM type: NRG; PAM sequence: AGG
gttgtgagccaatgtttgtt

SEQ ID NO: 55966 - DNA, 20 bp, Artificial Sequence
  Description of Artificial Sequence: Synthetic oligonucleotide
  Target: SCN9A; (+) strand; PAM type: NRG; PAM sequence: GGG
ttgtgagccaatgtttgtta

SEQ ID NO: 55967 - DNA, 20 bp, Artificial Sequence
  Description of Artificial Sequence: Synthetic oligonucleotide
  Target: SCN9A; (+) strand; PAM type: NRG; PAM sequence: GGG
tgtgagccaatgtttgttag

SEQ ID NO: 55968 - DNA, 20 bp, Artificial Sequence
  Description of Artificial Sequence: Synthetic oligonucleotide
  Target: SCN9A; (+) strand; PAM type: NRG; PAM sequence: GAG
tgagccaatgtttgttaggg

SEQ ID NO: 55969 - DNA, 20 bp, Artificial Sequence
  Description of Artificial Sequence: Synthetic oligonucleotide
  Target: SCN9A; (+) strand; PAM type: NRG; PAM sequence: CAG
ccaatgtttgttaggggaga

SEQ ID NO: 55970 - DNA, 20 bp, Artificial Sequence
  Description of Artificial Sequence: Synthetic oligonucleotide
  Target: SCN9A; (+) strand; PAM type: NRG; PAM sequence: AGG
caatgtttgttaggggagac

SEQ ID NO: 55971 - DNA, 20 bp, Artificial Sequence
  Description of Artificial Sequence: Synthetic oligonucleotide
  Target: SCN9A; (+) strand; PAM type: NRG; PAM sequence: TGG
gtttgttaggggagacagga

SEQ ID NO: 55972 - DNA, 20 bp, Artificial Sequence
  Description of Artificial Sequence: Synthetic oligonucleotide
  Target: SCN9A; (+) strand; PAM type: NRG; PAM sequence: TAG
caggatggtattgctttgta

SEQ ID NO: 55973 - DNA, 20 bp, Artificial Sequence
  Description of Artificial Sequence: Synthetic oligonucleotide
  Target: SCN9A; (+) strand; PAM type: NRG; PAM sequence: GAG
ggatggtattgctttgtata

SEQ ID NO: 55974 - DNA, 20 bp, Artificial Sequence
  Description of Artificial Sequence: Synthetic oligonucleotide
  Target: SCN9A; (+) strand; PAM type: NRG; PAM sequence: CAG
tttgtatagagaatgaattg

SEQ ID NO: 55975 - DNA, 20 bp, Artificial Sequence
  Description of Artificial Sequence: Synthetic oligonucleotide
  Target: SCN9A; (+) strand; PAM type: NRG; PAM sequence: AGG
ttgtatagagaatgaattgc

SEQ ID NO: 55976 - DNA, 20 bp, Artificial Sequence
  Description of Artificial Sequence: Synthetic oligonucleotide
  Target: SCN9A; (+) strand; PAM type: NRG; PAM sequence: GGG
tgtatagagaatgaattgca

SEQ ID NO: 55977 - DNA, 20 bp, Artificial Sequence
  Description of Artificial Sequence: Synthetic oligonucleotide
  Target: SCN9A; (+) strand; PAM type: NRG; PAM sequence: GGG
gtatagagaatgaattgcag

SEQ ID NO: 55978 - DNA, 20 bp, Artificial Sequence
  Description of Artificial Sequence: Synthetic oligonucleotide
  Target: SCN9A; (+) strand; PAM type: NRG; PAM sequence: GAG
atagagaatgaattgcaggg

SEQ ID NO: 55979 - DNA, 20 bp, Artificial Sequence
  Description of Artificial Sequence: Synthetic oligonucleotide
  Target: SCN9A; (+) strand; PAM type: NRG; PAM sequence: CAG
aattgcaggggagaaaatta

SEQ ID NO: 55980 - DNA, 20 bp, Artificial Sequence
  Description of Artificial Sequence: Synthetic oligonucleotide
  Target: SCN9A; (+) strand; PAM type: NRG; PAM sequence: AAG
tgcaggggagaaaattacag

SEQ ID NO: 55981 - DNA, 20 bp, Artificial Sequence
  Description of Artificial Sequence: Synthetic oligonucleotide
  Target: SCN9A; (+) strand; PAM type: NRG; PAM sequence: TGG
aggggagaaaattacagaag

SEQ ID NO: 55982 - DNA, 20 bp, Artificial Sequence
  Description of Artificial Sequence: Synthetic oligonucleotide
  Target: SCN9A; (+) strand; PAM type: NRG; PAM sequence: GAG
gggagaaaattacagaagtg

SEQ ID NO: 55983 - DNA, 20 bp, Artificial Sequence
  Description of Artificial Sequence: Synthetic oligonucleotide
  Target: SCN9A; (+) strand; PAM type: NRG; PAM sequence: GAG
gagaaaattacagaagtgga

SEQ ID NO: 55984 - DNA, 20 bp, Artificial Sequence
  Description of Artificial Sequence: Synthetic oligonucleotide
  Target: SCN9A; (+) strand; PAM type: NRG; PAM sequence: TGG
cagaagtggagagattgata

SEQ ID NO: 55985 - DNA, 20 bp, Artificial Sequence
  Description of Artificial Sequence: Synthetic oligonucleotide
  Target: SCN9A; (+) strand; PAM type: NRG; PAM sequence: GAG
gaagtggagagattgatatg

SEQ ID NO: 55986 - DNA, 20 bp, Artificial Sequence
  Description of Artificial Sequence: Synthetic oligonucleotide
  Target: SCN9A; (+) strand; PAM type: NRG; PAM sequence: AGG
aagtggagagattgatatgg

SEQ ID NO: 55987 - DNA, 20 bp, Artificial Sequence
  Description of Artificial Sequence: Synthetic oligonucleotide
  Target: SCN9A; (+) strand; PAM type: NRG; PAM sequence: TGG
agagattgatatggaggctg

SEQ ID NO: 55988 - DNA, 20 bp, Artificial Sequence
  Description of Artificial Sequence: Synthetic oligonucleotide
  Target: SCN9A; (+) strand; PAM type: NRG; PAM sequence: CAG
gattgatatggaggctgtgg

SEQ ID NO: 55989 - DNA, 20 bp, Artificial Sequence
  Description of Artificial Sequence: Synthetic oligonucleotide
  Target: SCN9A; (+) strand; PAM type: NRG; PAM sequence: AGG
attgatatggaggctgtggc

SEQ ID NO: 55990 - DNA, 20 bp, Artificial Sequence
  Description of Artificial Sequence: Synthetic oligonucleotide
  Target: SCN9A; (+) strand; PAM type: NRG; PAM sequence: AAG
ggaggctgtggcaggattcc

SEQ ID NO: 55991 - DNA, 20 bp, Artificial Sequence
  Description of Artificial Sequence: Synthetic oligonucleotide
  Target: SCN9A; (+) strand; PAM type: NRG; PAM sequence: TGG
gatgatgacctgaactaatt

SEQ ID NO: 55992 - DNA, 20 bp, Artificial Sequence
  Description of Artificial Sequence: Synthetic oligonucleotide
  Target: SCN9A; (+) strand; PAM type: NRG; PAM sequence: TGG
gatgacctgaactaatttgg

SEQ ID NO: 55993 - DNA, 20 bp, Artificial Sequence
  Description of Artificial Sequence: Synthetic oligonucleotide
  Target: SCN9A; (+) strand; PAM type: NRG; PAM sequence: TAG
gaactaatttggtggccgtg

SEQ ID NO: 55994 - DNA, 20 bp, Artificial Sequence
  Description of Artificial Sequence: Synthetic oligonucleotide
  Target: SCN9A; (+) strand; PAM type: NRG; PAM sequence: CAG
atttggtggccgtgtagata

SEQ ID NO: 55995 - DNA, 20 bp, Artificial Sequence
  Description of Artificial Sequence: Synthetic oligonucleotide
  Target: SCN9A; (+) strand; PAM type: NRG; PAM sequence: AAG
gtggccgtgtagatacagaa

SEQ ID NO: 55996 - DNA, 20 bp, Artificial Sequence
  Description of Artificial Sequence: Synthetic oligonucleotide
  Target: SCN9A; (+) strand; PAM type: NRG; PAM sequence: GAG
ggccgtgtagatacagaaaa

SEQ ID NO: 55997 - DNA, 20 bp, Artificial Sequence
  Description of Artificial Sequence: Synthetic oligonucleotide
  Target: SCN9A; (+) strand; PAM type: NRG; PAM sequence: AGG
gccgtgtagatacagaaaag

SEQ ID NO: 55998 - DNA, 20 bp, Artificial Sequence
  Description of Artificial Sequence: Synthetic oligonucleotide
  Target: SCN9A; (+) strand; PAM type: NRG; PAM sequence: GGG
ccgtgtagatacagaaaaga

SEQ ID NO: 55999 - DNA, 20 bp, Artificial Sequence
  Description of Artificial Sequence: Synthetic oligonucleotide
  Target: SCN9A; (+) strand; PAM type: NRG; PAM sequence: GAG
atacagaaaagagggtgaat

SEQ ID NO: 56000 - DNA, 20 bp, Artificial Sequence
  Description of Artificial Sequence: Synthetic oligonucleotide
  Target: SCN9A; (+) strand; PAM type: NRG; PAM sequence: GAG
acagaaaagagggtgaatga

SEQ ID NO: 56001 - DNA, 20 bp, Artificial Sequence
  Description of Artificial Sequence: Synthetic oligonucleotide
  Target: SCN9A; (+) strand; PAM type: NRG; PAM sequence: AGG
cagaaaagagggtgaatgag

SEQ ID NO: 56002 - DNA, 20 bp, Artificial Sequence
  Description of Artificial Sequence: Synthetic oligonucleotide
  Target: SCN9A; (+) strand; PAM type: NRG; PAM sequence: GAG
agggtgaatgagaggcatct

SEQ ID NO: 56003 - DNA, 20 bp, Artificial Sequence
  Description of Artificial Sequence: Synthetic oligonucleotide
  Target: SCN9A; (+) strand; PAM type: NRG; PAM sequence: TAG
atctgagacgtatgatgaaa

SEQ ID NO: 56004 - DNA, 20 bp, Artificial Sequence
  Description of Artificial Sequence: Synthetic oligonucleotide
  Target: SCN9A; (+) strand; PAM type: NRG; PAM sequence: AAG
acgtatgatgaaatagaaat

SEQ ID NO: 56005 - DNA, 20 bp, Artificial Sequence
  Description of Artificial Sequence: Synthetic oligonucleotide
  Target: SCN9A; (+) strand; PAM type: NRG; PAM sequence: TGG
tgatgaaatagaaataagtt

SEQ ID NO: 56006 - DNA, 20 bp, Artificial Sequence
  Description of Artificial Sequence: Synthetic oligonucleotide
  Target: SCN9A; (+) strand; PAM type: NRG; PAM sequence: GGG
gatgaaatagaaataagttt

SEQ ID NO: 56007 - DNA, 20 bp, Artificial Sequence
  Description of Artificial Sequence: Synthetic oligonucleotide
  Target: SCN9A; (+) strand; PAM type: NRG; PAM sequence: GAG
tgaaatagaaataagtttgg

SEQ ID NO: 56008 - DNA, 20 bp, Artificial Sequence
  Description of Artificial Sequence: Synthetic oligonucleotide
  Target: SCN9A; (+) strand; PAM type: NRG; PAM sequence: AAG
tagaaataagtttgggagat

SEQ ID NO: 56009 - DNA, 20 bp, Artificial Sequence
  Description of Artificial Sequence: Synthetic oligonucleotide
  Target: SCN9A; (+) strand; PAM type: NRG; PAM sequence: TAG
agtttgggagataagattga

SEQ ID NO: 56010 - DNA, 20 bp, Artificial Sequence
  Description of Artificial Sequence: Synthetic oligonucleotide
  Target: SCN9A; (+) strand; PAM type: NRG; PAM sequence: CAG
aagattgatagatctactta

SEQ ID NO: 56011 - DNA, 20 bp, Artificial Sequence
  Description of Artificial Sequence: Synthetic oligonucleotide
  Target: SCN9A; (+) strand; PAM type: NRG; PAM sequence: AGG
agattgatagatctacttac

SEQ ID NO: 56012 - DNA, 20 bp, Artificial Sequence
  Description of Artificial Sequence: Synthetic oligonucleotide
  Target: SCN9A; (+) strand; PAM type: NRG; PAM sequence: TGG
tgatagatctacttacaggc

SEQ ID NO: 56013 - DNA, 20 bp, Artificial Sequence
  Description of Artificial Sequence: Synthetic oligonucleotide
  Target: SCN9A; (+) strand; PAM type: NRG; PAM sequence: AAG
agatctacttacaggctgga

SEQ ID NO: 56014 - DNA, 20 bp, Artificial Sequence
  Description of Artificial Sequence: Synthetic oligonucleotide
  Target: SCN9A; (+) strand; PAM type: NRG; PAM sequence: AGG
gatctacttacaggctggaa

SEQ ID NO: 56015 - DNA, 20 bp, Artificial Sequence
  Description of Artificial Sequence: Synthetic oligonucleotide
  Target: SCN9A; (+) strand; PAM type: NRG; PAM sequence: GGG
atctacttacaggctggaaa

SEQ ID NO: 56016 - DNA, 20 bp, Artificial Sequence
  Description of Artificial Sequence: Synthetic oligonucleotide
  Target: SCN9A; (+) strand; PAM type: NRG; PAM sequence: TGG
caggctggaaagggctgaaa

SEQ ID NO: 56017 - DNA, 20 bp, Artificial Sequence
  Description of Artificial Sequence: Synthetic oligonucleotide
  Target: SCN9A; (+) strand; PAM type: NRG; PAM sequence: GAG
ggctggaaagggctgaaatg

SEQ ID NO: 56018 - DNA, 20 bp, Artificial Sequence
  Description of Artificial Sequence: Synthetic oligonucleotide
  Target: SCN9A; (+) strand; PAM type: NRG; PAM sequence: AAG
aagggctgaaatggagtaat

SEQ ID NO: 56019 - DNA, 20 bp, Artificial Sequence
  Description of Artificial Sequence: Synthetic oligonucleotide
  Target: SCN9A; (+) strand; PAM type: NRG; PAM sequence: AGG
agggctgaaatggagtaata

SEQ ID NO: 56020 - DNA, 20 bp, Artificial Sequence
  Description of Artificial Sequence: Synthetic oligonucleotide
  Target: SCN9A; (+) strand; PAM type: NRG; PAM sequence: AAG
gctgaaatggagtaataagg

SEQ ID NO: 56021 - DNA, 20 bp, Artificial Sequence
  Description of Artificial Sequence: Synthetic oligonucleotide
  Target: SCN9A; (+) strand; PAM type: NRG; PAM sequence: GAG
tgaaatggagtaataaggaa

SEQ ID NO: 56022 - DNA, 20 bp, Artificial Sequence
  Description of Artificial Sequence: Synthetic oligonucleotide
  Target: SCN9A; (+) strand; PAM type: NRG; PAM sequence: GAG
aaatggagtaataaggaaga

SEQ ID NO: 56023 - DNA, 20 bp, Artificial Sequence
  Description of Artificial Sequence: Synthetic oligonucleotide
  Target: SCN9A; (+) strand; PAM type: NRG; PAM sequence: AAG
aataaggaagagagcaatca

SEQ ID NO: 56024 - DNA, 20 bp, Artificial Sequence
  Description of Artificial Sequence: Synthetic oligonucleotide
  Target: SCN9A; (+) strand; PAM type: NRG; PAM sequence: AGG
ataaggaagagagcaatcaa

SEQ ID NO: 56025 - DNA, 20 bp, Artificial Sequence
  Description of Artificial Sequence: Synthetic oligonucleotide
  Target: SCN9A; (+) strand; PAM type: NRG; PAM sequence: TGG
tcaaaggtgatttcaatact

SEQ ID NO: 56026 - DNA, 20 bp, Artificial Sequence
  Description of Artificial Sequence: Synthetic oligonucleotide
  Target: SCN9A; (+) strand; PAM type: NRG; PAM sequence: TGG
aggtgatttcaatacttgga

SEQ ID NO: 56027 - DNA, 20 bp, Artificial Sequence
  Description of Artificial Sequence: Synthetic oligonucleotide
  Target: SCN9A; (+) strand; PAM type: NRG; PAM sequence: AAG
atttcaatacttggatggtg

SEQ ID NO: 56028 - DNA, 20 bp, Artificial Sequence
  Description of Artificial Sequence: Synthetic oligonucleotide
  Target: SCN9A; (+) strand; PAM type: NRG; PAM sequence: AGG
tttcaatacttggatggtga

SEQ ID NO: 56029 - DNA, 20 bp, Artificial Sequence
  Description of Artificial Sequence: Synthetic oligonucleotide
  Target: SCN9A; (+) strand; PAM type: NRG; PAM sequence: CAG
ggatggtgaaggcatttatt

SEQ ID NO: 56030 - DNA, 20 bp, Artificial Sequence
  Description of Artificial Sequence: Synthetic oligonucleotide
  Target: SCN9A; (+) strand; PAM type: NRG; PAM sequence: AAG
aggcatttattcagataatg

SEQ ID NO: 56031 - DNA, 20 bp, Artificial Sequence
  Description of Artificial Sequence: Synthetic oligonucleotide
  Target: SCN9A; (+) strand; PAM type: NRG; PAM sequence: TGG
atttattcagataatgaaga

SEQ ID NO: 56032 - DNA, 20 bp, Artificial Sequence
  Description of Artificial Sequence: Synthetic oligonucleotide
  Target: SCN9A; (+) strand; PAM type: NRG; PAM sequence: GGG
tttattcagataatgaagat

SEQ ID NO: 56033 - DNA, 20 bp, Artificial Sequence
  Description of Artificial Sequence: Synthetic oligonucleotide
  Target: SCN9A; (+) strand; PAM type: NRG; PAM sequence: GAG
tattcagataatgaagatgg

SEQ ID NO: 56034 - DNA, 20 bp, Artificial Sequence
  Description of Artificial Sequence: Synthetic oligonucleotide
  Target: SCN9A; (+) strand; PAM type: NRG; PAM sequence: AGG
attcagataatgaagatggg

SEQ ID NO: 56035 - DNA, 20 bp, Artificial Sequence
  Description of Artificial Sequence: Synthetic oligonucleotide
  Target: SCN9A; (+) strand; PAM type: NRG; PAM sequence: AAG
agataatgaagatgggagga

SEQ ID NO: 56036 - DNA, 20 bp, Artificial Sequence
  Description of Artificial Sequence: Synthetic oligonucleotide
  Target: SCN9A; (+) strand; PAM type: NRG; PAM sequence: GAG
aagatgggaggaaagaatct

SEQ ID NO: 56037 - DNA, 20 bp, Artificial Sequence
  Description of Artificial Sequence: Synthetic oligonucleotide
  Target: SCN9A; (+) strand; PAM type: NRG; PAM sequence: CAG
tgggaggaaagaatctgaga

SEQ ID NO: 56038 - DNA, 20 bp, Artificial Sequence
  Description of Artificial Sequence: Synthetic oligonucleotide
  Target: SCN9A; (+) strand; PAM type: NRG; PAM sequence: GAG
ggaggaaagaatctgagaca

SEQ ID NO: 56039 - DNA, 20 bp, Artificial Sequence
  Description of Artificial Sequence: Synthetic oligonucleotide
  Target: SCN9A; (+) strand; PAM type: NRG; PAM sequence: TAG
aagaatctgagacagagttt

SEQ ID NO: 56040 - DNA, 20 bp, Artificial Sequence
  Description of Artificial Sequence: Synthetic oligonucleotide
  Target: SCN9A; (+) strand; PAM type: NRG; PAM sequence: AGG
agaatctgagacagagtttt

SEQ ID NO: 56041 - DNA, 20 bp, Artificial Sequence
  Description of Artificial Sequence: Synthetic oligonucleotide
  Target: SCN9A; (+) strand; PAM type: NRG; PAM sequence: GGG
gaatctgagacagagtttta

SEQ ID NO: 56042 - DNA, 20 bp, Artificial Sequence
  Description of Artificial Sequence: Synthetic oligonucleotide
  Target: SCN9A; (+) strand; PAM type: NRG; PAM sequence: AAG
ctgagacagagttttaggga

SEQ ID NO: 56043 - DNA, 20 bp, Artificial Sequence
  Description of Artificial Sequence: Synthetic oligonucleotide
  Target: SCN9A; (+) strand; PAM type: NRG; PAM sequence: TAG
attattatcattatgacatc

SEQ ID NO: 56044 - DNA, 20 bp, Artificial Sequence
  Description of Artificial Sequence: Synthetic oligonucleotide
  Target: SCN9A; (+) strand; PAM type: NRG; PAM sequence: AAG
catttacatcaataaacttt

SEQ ID NO: 56045 - DNA, 20 bp, Artificial Sequence
  Description of Artificial Sequence: Synthetic oligonucleotide
  Target: SCN9A; (+) strand; PAM type: NRG; PAM sequence: AAG
taaactttaagctcttttac

SEQ ID NO: 56046 - DNA, 20 bp, Artificial Sequence
  Description of Artificial Sequence: Synthetic oligonucleotide
  Target: SCN9A; (+) strand; PAM type: NRG; PAM sequence: TAG
tacaagatcatgacttgtct

SEQ ID NO: 56047 - DNA, 20 bp, Artificial Sequence
  Description of Artificial Sequence: Synthetic oligonucleotide
  Target: SCN9A; (+) strand; PAM type: NRG; PAM sequence: AAG
gatcatgacttgtcttagaa

SEQ ID NO: 56048 - DNA, 20 bp, Artificial Sequence
  Description of Artificial Sequence: Synthetic oligonucleotide
  Target: SCN9A; (+) strand; PAM type: NRG; PAM sequence: TAG
aagtaccatataaatccttc

SEQ ID NO: 56049 - DNA, 20 bp, Artificial Sequence
  Description of Artificial Sequence: Synthetic oligonucleotide
  Target: SCN9A; (+) strand; PAM type: NRG; PAM sequence: TAG
acactcttttgcataactaa

SEQ ID NO: 56050 - DNA, 20 bp, Artificial Sequence
  Description of Artificial Sequence: Synthetic oligonucleotide
  Target: SCN9A; (+) strand; PAM type: NRG; PAM sequence: AGG
cactcttttgcataactaat

SEQ ID NO: 56051 - DNA, 20 bp, Artificial Sequence
  Description of Artificial Sequence: Synthetic oligonucleotide
  Target: SCN9A; (+) strand; PAM type: NRG; PAM sequence: TAG
ttttgcataactaataggaa

SEQ ID NO: 56052 - DNA, 20 bp, Artificial Sequence
  Description of Artificial Sequence: Synthetic oligonucleotide
  Target: SCN9A; (+) strand; PAM type: NRG; PAM sequence: TGG
taactaataggaatagaaat

SEQ ID NO: 56053 - DNA, 20 bp, Artificial Sequence
  Description of Artificial Sequence: Synthetic oligonucleotide
  Target: SCN9A; (+) strand; PAM type: NRG; PAM sequence: TAG
aatagaaattggataaaaaa

SEQ ID NO: 56054 - DNA, 20 bp, Artificial Sequence
  Description of Artificial Sequence: Synthetic oligonucleotide
  Target: SCN9A; (+) strand; PAM type: NRG; PAM sequence: CAG
ttctacttttttccttgcca

SEQ ID NO: 56055 - DNA, 20 bp, Artificial Sequence
  Description of Artificial Sequence: Synthetic oligonucleotide
  Target: SCN9A; (+) strand; PAM type: NRG; PAM sequence: GAG
ctacttttttccttgccaca

SEQ ID NO: 56056 - DNA, 20 bp, Artificial Sequence
  Description of Artificial Sequence: Synthetic oligonucleotide
  Target: SCN9A; (+) strand; PAM type: NRG; PAM sequence: AAG
ttttttccttgccacagaga

SEQ ID NO: 56057 - DNA, 20 bp, Artificial Sequence
  Description of Artificial Sequence: Synthetic oligonucleotide
  Target: SCN9A; (+) strand; PAM type: NRG; PAM sequence: TGG
tttccttgccacagagaaag

SEQ ID NO: 56058 - DNA, 20 bp, Artificial Sequence
  Description of Artificial Sequence: Synthetic oligonucleotide
  Target: SCN9A; (+) strand; PAM type: NRG; PAM sequence: GGG
ttccttgccacagagaaagt

SEQ ID NO: 56059 - DNA, 20 bp, Artificial Sequence
  Description of Artificial Sequence: Synthetic oligonucleotide
  Target: SCN9A; (+) strand; PAM type: NRG; PAM sequence: TAG
ggttgattatattaaataaa

SEQ ID NO: 56060 - DNA, 20 bp, Artificial Sequence
  Description of Artificial Sequence: Synthetic oligonucleotide
  Target: SCN9A; (+) strand; PAM type: NRG; PAM sequence: CAG
tctattttgcttctgaaact

SEQ ID NO: 56061 - DNA, 20 bp, Artificial Sequence
  Description of Artificial Sequence: Synthetic oligonucleotide
  Target: SCN9A; (+) strand; PAM type: NRG; PAM sequence: CAG
tttgcttctgaaactcagca

SEQ ID NO: 56062 - DNA, 20 bp, Artificial Sequence
  Description of Artificial Sequence: Synthetic oligonucleotide
  Target: SCN9A; (+) strand; PAM type: NRG; PAM sequence: CAG
tctgaaactcagcacagcaa

SEQ ID NO: 56063 - DNA, 20 bp, Artificial Sequence
  Description of Artificial Sequence: Synthetic oligonucleotide
  Target: SCN9A; (+) strand; PAM type: NRG; PAM sequence: AGG
ctgaaactcagcacagcaac

SEQ ID NO: 56064 - DNA, 20 bp, Artificial Sequence
  Description of Artificial Sequence: Synthetic oligonucleotide
  Target: SCN9A; (+) strand; PAM type: NRG; PAM sequence: TAG
aaactcagcacagcaacagg

SEQ ID NO: 56065 - DNA, 20 bp, Artificial Sequence
  Description of Artificial Sequence: Synthetic oligonucleotide
  Target: SCN9A; (+) strand; PAM type: NRG; PAM sequence: TAG
agcaacaggtagtaaaaaca

SEQ ID NO: 56066 - DNA, 20 bp, Artificial Sequence
  Description of Artificial Sequence: Synthetic oligonucleotide
  Target: SCN9A; (+) strand; PAM type: NRG; PAM sequence: AAG
aacaggtagtaaaaacatag

SEQ ID NO: 56067 - DNA, 20 bp, Artificial Sequence
  Description of Artificial Sequence: Synthetic oligonucleotide
  Target: SCN9A; (+) strand; PAM type: NRG; PAM sequence: CAG
aaaacatagaagcattacca

SEQ ID NO: 56068 - DNA, 20 bp, Artificial Sequence
  Description of Artificial Sequence: Synthetic oligonucleotide
  Target: SCN9A; (+) strand; PAM type: NRG; PAM sequence: AAG
acatagaagcattaccacag

SEQ ID NO: 56069 - DNA, 20 bp, Artificial Sequence
  Description of Artificial Sequence: Synthetic oligonucleotide
  Target: SCN9A; (+) strand; PAM type: NRG; PAM sequence: AGG
catagaagcattaccacaga

SEQ ID NO: 56070 - DNA, 20 bp, Artificial Sequence
  Description of Artificial Sequence: Synthetic oligonucleotide
  Target: SCN9A; (+) strand; PAM type: NRG; PAM sequence: GGG
atagaagcattaccacagaa

SEQ ID NO: 56071 - DNA, 20 bp, Artificial Sequence
  Description of Artificial Sequence: Synthetic oligonucleotide
  Target: SCN9A; (+) strand; PAM type: NRG; PAM sequence: CAG
agggctcccatgattatatg

SEQ ID NO: 56072 - DNA, 20 bp, Artificial Sequence
  Description of Artificial Sequence: Synthetic oligonucleotide
  Target: SCN9A; (+) strand; PAM type: NRG; PAM sequence: AGG
gggctcccatgattatatgc

SEQ ID NO: 56073 - DNA, 20 bp, Artificial Sequence
  Description of Artificial Sequence: Synthetic oligonucleotide
  Target: SCN9A; (+) strand; PAM type: NRG; PAM sequence: TAG
ccatgattatatgcaggccc

SEQ ID NO: 56074 - DNA, 20 bp, Artificial Sequence
  Description of Artificial Sequence: Synthetic oligonucleotide
  Target: SCN9A; (+) strand; PAM type: NRG; PAM sequence: AGG
catgattatatgcaggccct

SEQ ID NO: 56075 - DNA, 20 bp, Artificial Sequence
  Description of Artificial Sequence: Synthetic oligonucleotide
  Target: SCN9A; (+) strand; PAM type: NRG; PAM sequence: GGG
atgattatatgcaggcccta

SEQ ID NO: 56076 - DNA, 20 bp, Artificial Sequence
  Description of Artificial Sequence: Synthetic oligonucleotide
  Target: SCN9A; (+) strand; PAM type: NRG; PAM sequence: GGG
tgattatatgcaggccctag

SEQ ID NO: 56077 - DNA, 20 bp, Artificial Sequence
  Description of Artificial Sequence: Synthetic oligonucleotide
  Target: SCN9A; (+) strand; PAM type: NRG; PAM sequence: AAG
tatatgcaggccctagggga

SEQ ID NO: 56078 - DNA, 20 bp, Artificial Sequence
  Description of Artificial Sequence: Synthetic oligonucleotide
  Target: SCN9A; (+) strand; PAM type: NRG; PAM sequence: AGG
atatgcaggccctaggggaa

SEQ ID NO: 56079 - DNA, 20 bp, Artificial Sequence
  Description of Artificial Sequence: Synthetic oligonucleotide
  Target: SCN9A; (+) strand; PAM type: NRG; PAM sequence: GAG
atgcaggccctaggggaaag

SEQ ID NO: 56080 - DNA, 20 bp, Artificial Sequence
  Description of Artificial Sequence: Synthetic oligonucleotide
  Target: SCN9A; (+) strand; PAM type: NRG; PAM sequence: AGG
tgcaggccctaggggaaagg

SEQ ID NO: 56081 - DNA, 20 bp, Artificial Sequence
  Description of Artificial Sequence: Synthetic oligonucleotide
  Target: SCN9A; (+) strand; PAM type: NRG; PAM sequence: AAG
ccctaggggaaaggaggccc

SEQ ID NO: 56082 - DNA, 20 bp, Artificial Sequence
  Description of Artificial Sequence: Synthetic oligonucleotide
  Target: SCN9A; (+) strand; PAM type: NRG; PAM sequence: TGG
aaggaggcccaagatgcttt

SEQ ID NO: 56083 - DNA, 20 bp, Artificial Sequence
  Description of Artificial Sequence: Synthetic oligonucleotide
  Target: SCN9A; (+) strand; PAM type: NRG; PAM sequence: CAG
gaggcccaagatgcttttgg

SEQ ID NO: 56084 - DNA, 20 bp, Artificial Sequence
  Description of Artificial Sequence: Synthetic oligonucleotide
  Target: SCN9A; (+) strand; PAM type: NRG; PAM sequence: GAG
ggcccaagatgcttttggca

SEQ ID NO: 56085 - DNA, 20 bp, Artificial Sequence
  Description of Artificial Sequence: Synthetic oligonucleotide
  Target: SCN9A; (+) strand; PAM type: NRG; PAM sequence: GAG
cccaagatgcttttggcaga

SEQ ID NO: 56086 - DNA, 20 bp, Artificial Sequence
  Description of Artificial Sequence: Synthetic oligonucleotide
  Target: SCN9A; (+) strand; PAM type: NRG; PAM sequence: CAG
agatgcttttggcagagagc

SEQ ID NO: 56087 - DNA, 20 bp, Artificial Sequence
  Description of Artificial Sequence: Synthetic oligonucleotide
  Target: SCN9A; (+) strand; PAM type: NRG; PAM sequence: TAG
cctgactcatctttcttctg

SEQ ID NO: 56088 - DNA, 20 bp, Artificial Sequence
  Description of Artificial Sequence: Synthetic oligonucleotide
  Target: SCN9A; (+) strand; PAM type: NRG; PAM sequence: AAG
gactcatctttcttctgtag

SEQ ID NO: 56089 - DNA, 20 bp, Artificial Sequence
  Description of Artificial Sequence: Synthetic oligonucleotide
  Target: SCN9A; (+) strand; PAM type: NRG; PAM sequence: CAG
tctttcttctgtagaagcat

SEQ ID NO: 56090 - DNA, 20 bp, Artificial Sequence
  Description of Artificial Sequence: Synthetic oligonucleotide
  Target: SCN9A; (+) strand; PAM type: NRG; PAM sequence: AGG
ctttcttctgtagaagcatc

SEQ ID NO: 56091 - DNA, 20 bp, Artificial Sequence
  Description of Artificial Sequence: Synthetic oligonucleotide
  Target: SCN9A; (+) strand; PAM type: NRG; PAM sequence: GAG
agaagcatcaggtactctgt

SEQ ID NO: 56092 - DNA, 20 bp, Artificial Sequence
  Description of Artificial Sequence: Synthetic oligonucleotide
  Target: SCN9A; (+) strand; PAM type: NRG; PAM sequence: TAG
catcaggtactctgtgagcc

SEQ ID NO: 56093 - DNA, 20 bp, Artificial Sequence
  Description of Artificial Sequence: Synthetic oligonucleotide
  Target: SCN9A; (+) strand; PAM type: NRG; PAM sequence: TAG
gtgagcctagccctgcacca

SEQ ID NO: 56094 - DNA, 20 bp, Artificial Sequence
  Description of Artificial Sequence: Synthetic oligonucleotide
  Target: SCN9A; (+) strand; PAM type: NRG; PAM sequence: AGG
tgagcctagccctgcaccat

SEQ ID NO: 56095 - DNA, 20 bp, Artificial Sequence
  Description of Artificial Sequence: Synthetic oligonucleotide
  Target: SCN9A; (+) strand; PAM type: NRG; PAM sequence: AAG
agccctgcaccataggaatc

SEQ ID NO: 56096 - DNA, 20 bp, Artificial Sequence
  Description of Artificial Sequence: Synthetic oligonucleotide
  Target: SCN9A; (+) strand; PAM type: NRG; PAM sequence: AGG
gccctgcaccataggaatca

SEQ ID NO: 56097 - DNA, 20 bp, Artificial Sequence
  Description of Artificial Sequence: Synthetic oligonucleotide
  Target: SCN9A; (+) strand; PAM type: NRG; PAM sequence: CAG
atcaaggcatatcatatatc

SEQ ID NO: 56098 - DNA, 20 bp, Artificial Sequence
  Description of Artificial Sequence: Synthetic oligonucleotide
  Target: SCN9A; (+) strand; PAM type: NRG; PAM sequence: GAG
cactgtaaaaacacatcact

SEQ ID NO: 56099 - DNA, 20 bp, Artificial Sequence
  Description of Artificial Sequence: Synthetic oligonucleotide
  Target: SCN9A; (+) strand; PAM type: NRG; PAM sequence: CAG
cactgagtcccacaactgca

SEQ ID NO: 56100 - DNA, 20 bp, Artificial Sequence
  Description of Artificial Sequence: Synthetic oligonucleotide
  Target: SCN9A; (+) strand; PAM type: NRG; PAM sequence: TGG
tgagtcccacaactgcacag

SEQ ID NO: 56101 - DNA, 20 bp, Artificial Sequence
  Description of Artificial Sequence: Synthetic oligonucleotide
  Target: SCN9A; (+) strand; PAM type: NRG; PAM sequence: AAG
aactgcacagtggcttactt

SEQ ID NO: 56102 - DNA, 20 bp, Artificial Sequence
  Description of Artificial Sequence: Synthetic oligonucleotide
  Target: SCN9A; (+) strand; PAM type: NRG; PAM sequence: AGG
actgcacagtggcttactta

SEQ ID NO: 56103 - DNA, 20 bp, Artificial Sequence
  Description of Artificial Sequence: Synthetic oligonucleotide
  Target: SCN9A; (+) strand; PAM type: NRG; PAM sequence: AAG
aattttaaaaaacttgtctt

SEQ ID NO: 56104 - DNA, 20 bp, Artificial Sequence
  Description of Artificial Sequence: Synthetic oligonucleotide
  Target: SCN9A; (+) strand; PAM type: NRG; PAM sequence: CAG
cttgtcttaagccaaactat

SEQ ID NO: 56105 - DNA, 20 bp, Artificial Sequence
  Description of Artificial Sequence: Synthetic oligonucleotide
  Target: SCN9A; (+) strand; PAM type: NRG; PAM sequence: TAG
caaactatcagttgcctaaa

SEQ ID NO: 56106 - DNA, 20 bp, Artificial Sequence
  Description of Artificial Sequence: Synthetic oligonucleotide
  Target: SCN9A; (+) strand; PAM type: NRG; PAM sequence: GAG
aactatcagttgcctaaata

SEQ ID NO: 56107 - DNA, 20 bp, Artificial Sequence
  Description of Artificial Sequence: Synthetic oligonucleotide
  Target: SCN9A; (+) strand; PAM type: NRG; PAM sequence: AGG
actatcagttgcctaaatag

SEQ ID NO: 56108 - DNA, 20 bp, Artificial Sequence
  Description of Artificial Sequence: Synthetic oligonucleotide
  Target: SCN9A; (+) strand; PAM type: NRG; PAM sequence: GGG
ctatcagttgcctaaataga

SEQ ID NO: 56109 - DNA, 20 bp, Artificial Sequence
  Description of Artificial Sequence: Synthetic oligonucleotide
  Target: SCN9A; (+) strand; PAM type: NRG; PAM sequence: TAG
atcaaataccatattctgtc

SEQ ID NO: 56110 - DNA, 20 bp, Artificial Sequence
  Description of Artificial Sequence: Synthetic oligonucleotide
  Target: SCN9A; (+) strand; PAM type: NRG; PAM sequence: GAG
caaataccatattctgtcta

SEQ ID NO: 56111 - DNA, 20 bp, Artificial Sequence
  Description of Artificial Sequence: Synthetic oligonucleotide
  Target: SCN9A; (+) strand; PAM type: NRG; PAM sequence: AAG
tctagagttttgttgttgat

SEQ ID NO: 56112 - DNA, 20 bp, Artificial Sequence
  Description of Artificial Sequence: Synthetic oligonucleotide
  Target: SCN9A; (+) strand; PAM type: NRG; PAM sequence: TAG
gagttttgttgttgataagc

SEQ ID NO: 56113 - DNA, 20 bp, Artificial Sequence
  Description of Artificial Sequence: Synthetic oligonucleotide
  Target: SCN9A; (+) strand; PAM type: NRG; PAM sequence: CAG
aatcatgaaaatttgcgaca

SEQ ID NO: 56114 - DNA, 20 bp, Artificial Sequence
  Description of Artificial Sequence: Synthetic oligonucleotide
  Target: SCN9A; (+) strand; PAM type: NRG; PAM sequence: AGG
atcatgaaaatttgcgacac

SEQ ID NO: 56115 - DNA, 20 bp, Artificial Sequence
  Description of Artificial Sequence: Synthetic oligonucleotide
  Target: SCN9A; (+) strand; PAM type: NRG; PAM sequence: GGG
tcatgaaaatttgcgacaca

SEQ ID NO: 56116 - DNA, 20 bp, Artificial Sequence
  Description of Artificial Sequence: Synthetic oligonucleotide
  Target: SCN9A; (+) strand; PAM type: NRG; PAM sequence: CAG
aaaatttgcgacacagggat

SEQ ID NO: 56117 - DNA, 20 bp, Artificial Sequence
  Description of Artificial Sequence: Synthetic oligonucleotide
  Target: SCN9A; (+) strand; PAM type: NRG; PAM sequence: AAG
ttgcgacacagggatcagat

SEQ ID NO: 56118 - DNA, 20 bp, Artificial Sequence
  Description of Artificial Sequence: Synthetic oligonucleotide
  Target: SCN9A; (+) strand; PAM type: NRG; PAM sequence: TAG
acacagggatcagataagac

SEQ ID NO: 56119 - DNA, 20 bp, Artificial Sequence
  Description of Artificial Sequence: Synthetic oligonucleotide
  Target: SCN9A; (+) strand; PAM type: NRG; PAM sequence: AAG
aaaaatctcaccataattat

SEQ ID NO: 56120 - DNA, 20 bp, Artificial Sequence
  Description of Artificial Sequence: Synthetic oligonucleotide
  Target: SCN9A; (+) strand; PAM type: NRG; PAM sequence: TAG
aaattataaacttttttaaa

SEQ ID NO: 56121 - DNA, 20 bp, Artificial Sequence
  Description of Artificial Sequence: Synthetic oligonucleotide
  Target: SCN9A; (+) strand; PAM type: NRG; PAM sequence: TGG
ttataaacttttttaaatag

SEQ ID NO: 56122 - DNA, 20 bp, Artificial Sequence
  Description of Artificial Sequence: Synthetic oligonucleotide
  Target: SCN9A; (+) strand; PAM type: NRG; PAM sequence: AAG
taaatagtggaaaaaatctg

SEQ ID NO: 56123 - DNA, 20 bp, Artificial Sequence
  Description of Artificial Sequence: Synthetic oligonucleotide
  Target: SCN9A; (+) strand; PAM type: NRG; PAM sequence: CAG
agaatttgcaataaaatgaa

SEQ ID NO: 56124 - DNA, 20 bp, Artificial Sequence
  Description of Artificial Sequence: Synthetic oligonucleotide
  Target: SCN9A; (+) strand; PAM type: NRG; PAM sequence: TGG
aaaatgaacagtttaataat

SEQ ID NO: 56125 - DNA, 20 bp, Artificial Sequence
  Description of Artificial Sequence: Synthetic oligonucleotide
  Target: SCN9A; (+) strand; PAM type: NRG; PAM sequence: TGG
aacagtttaataattggatt

SEQ ID NO: 56126 - DNA, 20 bp, Artificial Sequence
  Description of Artificial Sequence: Synthetic oligonucleotide
  Target: SCN9A; (+) strand; PAM type: NRG; PAM sequence: CAG
taataattggatttggtttg

SEQ ID NO: 56127 - DNA, 20 bp, Artificial Sequence
  Description of Artificial Sequence: Synthetic oligonucleotide
  Target: SCN9A; (+) strand; PAM type: NRG; PAM sequence: TAG
ggtttgcagtttatataaaa

SEQ ID NO: 56128 - DNA, 20 bp, Artificial Sequence
  Description of Artificial Sequence: Synthetic oligonucleotide
  Target: SCN9A; (+) strand; PAM type: NRG; PAM sequence: AGG
gtttgcagtttatataaaat

SEQ ID NO: 56129 - DNA, 20 bp, Artificial Sequence
  Description of Artificial Sequence: Synthetic oligonucleotide
  Target: SCN9A; (+) strand; PAM type: NRG; PAM sequence: AAG
ataggtttatattgatgtta

SEQ ID NO: 56130 - DNA, 20 bp, Artificial Sequence
  Description of Artificial Sequence: Synthetic oligonucleotide
  Target: SCN9A; (+) strand; PAM type: NRG; PAM sequence: AAG
ataaaatatatttaaataac

SEQ ID NO: 56131 - DNA, 20 bp, Artificial Sequence
  Description of Artificial Sequence: Synthetic oligonucleotide
  Target: SCN9A; (+) strand; PAM type: NRG; PAM sequence: AGG
taaaatatatttaaataaca

SEQ ID NO: 56132 - DNA, 20 bp, Artificial Sequence
  Description of Artificial Sequence: Synthetic oligonucleotide
  Target: SCN9A; (+) strand; PAM type: NRG; PAM sequence: AAG
atatatttaaataacaagga

SEQ ID NO: 56133 - DNA, 20 bp, Artificial Sequence
  Description of Artificial Sequence: Synthetic oligonucleotide
  Target: SCN9A; (+) strand; PAM type: NRG; PAM sequence: AAG
atttaaataacaaggaaaga

SEQ ID NO: 56134 - DNA, 20 bp, Artificial Sequence
  Description of Artificial Sequence: Synthetic oligonucleotide
  Target: SCN9A; (+) strand; PAM type: NRG; PAM sequence: GAG
ttaaataacaaggaaagaaa

SEQ ID NO: 56135 - DNA, 20 bp, Artificial Sequence
  Description of Artificial Sequence: Synthetic oligonucleotide
  Target: SCN9A; (+) strand; PAM type: NRG; PAM sequence: AAG
ataacaaggaaagaaagaga

SEQ ID NO: 56136 - DNA, 20 bp, Artificial Sequence
  Description of Artificial Sequence: Synthetic oligonucleotide
  Target: SCN9A; (+) strand; PAM type: NRG; PAM sequence: CAG
gaaaatctttatcttgtcta

SEQ ID NO: 56137 - DNA, 20 bp, Artificial Sequence
  Description of Artificial Sequence: Synthetic oligonucleotide
  Target: SCN9A; (+) strand; PAM type: NRG; PAM sequence: AGG
aaaatctttatcttgtctac

SEQ ID NO: 56138 - DNA, 20 bp, Artificial Sequence
  Description of Artificial Sequence: Synthetic oligonucleotide
  Target: SCN9A; (+) strand; PAM type: NRG; PAM sequence: GGG
aaatctttatcttgtctaca

SEQ ID NO: 56139 - DNA, 20 bp, Artificial Sequence
  Description of Artificial Sequence: Synthetic oligonucleotide
  Target: SCN9A; (+) strand; PAM type: NRG; PAM sequence: AAG
tctttatcttgtctacaggg

SEQ ID NO: 56140 - DNA, 20 bp, Artificial Sequence
  Description of Artificial Sequence: Synthetic oligonucleotide
  Target: SCN9A; (+) strand; PAM type: NRG; PAM sequence: AAG
ttatcttgtctacagggaag

SEQ ID NO: 56141 - DNA, 20 bp, Artificial Sequence
  Description of Artificial Sequence: Synthetic oligonucleotide
  Target: SCN9A; (+) strand; PAM type: NRG; PAM sequence: TAG
tgtctacagggaagaagaaa

SEQ ID NO: 56142 - DNA, 20 bp, Artificial Sequence
  Description of Artificial Sequence: Synthetic oligonucleotide
  Target: SCN9A; (+) strand; PAM type: NRG; PAM sequence: AAG
acagggaagaagaaatagaa

SEQ ID NO: 56143 - DNA, 20 bp, Artificial Sequence
  Description of Artificial Sequence: Synthetic oligonucleotide
  Target: SCN9A; (+) strand; PAM type: NRG; PAM sequence: AAG
ataataaatatgtttctgaa

SEQ ID NO: 56144 - DNA, 20 bp, Artificial Sequence
  Description of Artificial Sequence: Synthetic oligonucleotide
  Target: SCN9A; (+) strand; PAM type: NRG; PAM sequence: CAG
cccaacactgacttcctatt

SEQ ID NO: 56145 - DNA, 20 bp, Artificial Sequence
  Description of Artificial Sequence: Synthetic oligonucleotide
  Target: SCN9A; (+) strand; PAM type: NRG; PAM sequence: AAG
cttcctattcagtaactgac

SEQ ID NO: 56146 - DNA, 20 bp, Artificial Sequence
  Description of Artificial Sequence: Synthetic oligonucleotide
  Target: SCN9A; (+) strand; PAM type: NRG; PAM sequence: AAG
acaagctatcacttccttga

SEQ ID NO: 56147 - DNA, 20 bp, Artificial Sequence
  Description of Artificial Sequence: Synthetic oligonucleotide
  Target: SCN9A; (+) strand; PAM type: NRG; PAM sequence: TGG
cttgaaagcttactttgatt

SEQ ID NO: 56148 - DNA, 20 bp, Artificial Sequence
  Description of Artificial Sequence: Synthetic oligonucleotide
  Target: SCN9A; (+) strand; PAM type: NRG; PAM sequence: TAG
ggcttttatcttactgacac

SEQ ID NO: 56149 - DNA, 20 bp, Artificial Sequence
  Description of Artificial Sequence: Synthetic oligonucleotide
  Target: SCN9A; (+) strand; PAM type: NRG; PAM sequence: AAG
agcttcttaaaaacccccct

SEQ ID NO: 56150 - DNA, 20 bp, Artificial Sequence
  Description of Artificial Sequence: Synthetic oligonucleotide
  Target: SCN9A; (+) strand; PAM type: NRG; PAM sequence: CAG
atgtaaattgctcttaacat

SEQ ID NO: 56151 - DNA, 20 bp, Artificial Sequence
  Description of Artificial Sequence: Synthetic oligonucleotide
  Target: SCN9A; (+) strand; PAM type: NRG; PAM sequence: GAG
gtaaattgctcttaacatca

SEQ ID NO: 56152 - DNA, 20 bp, Artificial Sequence
  Description of Artificial Sequence: Synthetic oligonucleotide
  Target: SCN9A; (+) strand; PAM type: NRG; PAM sequence: TAG
aattgctcttaacatcagag

SEQ ID NO: 56153 - DNA, 20 bp, Artificial Sequence
  Description of Artificial Sequence: Synthetic oligonucleotide
  Target: SCN9A; (+) strand; PAM type: NRG; PAM sequence: GAG
aaaaaaaaaactaaaataat

SEQ ID NO: 56154 - DNA, 20 bp, Artificial Sequence
  Description of Artificial Sequence: Synthetic oligonucleotide
  Target: SCN9A; (+) strand; PAM type: NRG; PAM sequence: TGG
tttactataatcacaaaaac

SEQ ID NO: 56155 - DNA, 20 bp, Artificial Sequence
  Description of Artificial Sequence: Synthetic oligonucleotide
  Target: SCN9A; (+) strand; PAM type: NRG; PAM sequence: TAG
aaaactggcattaatgtttc

SEQ ID NO: 56156 - DNA, 20 bp, Artificial Sequence
  Description of Artificial Sequence: Synthetic oligonucleotide
  Target: SCN9A; (+) strand; PAM type: NRG; PAM sequence: AAG
ctgatttttgtcttgaatat

SEQ ID NO: 56157 - DNA, 20 bp, Artificial Sequence
  Description of Artificial Sequence: Synthetic oligonucleotide
  Target: SCN9A; (+) strand; PAM type: NRG; PAM sequence: AGG
tgatttttgtcttgaatata

SEQ ID NO: 56158 - DNA, 20 bp, Artificial Sequence
  Description of Artificial Sequence: Synthetic oligonucleotide
  Target: SCN9A; (+) strand; PAM type: NRG; PAM sequence: AAG
aaatatccattttttcctaa

SEQ ID NO: 56159 - DNA, 20 bp, Artificial Sequence
  Description of Artificial Sequence: Synthetic oligonucleotide
  Target: SCN9A; (+) strand; PAM type: NRG; PAM sequence: GAG
attttttcctaaaagtaaat

SEQ ID NO: 56160 - DNA, 20 bp, Artificial Sequence
  Description of Artificial Sequence: Synthetic oligonucleotide
  Target: SCN9A; (+) strand; PAM type: NRG; PAM sequence: AAG
taaaagtaaatgagtttccc

SEQ ID NO: 56161 - DNA, 20 bp, Artificial Sequence
  Description of Artificial Sequence: Synthetic oligonucleotide
  Target: SCN9A; (+) strand; PAM type: NRG; PAM sequence: AAG
cccaagttgaattcgataaa

SEQ ID NO: 56162 - DNA, 20 bp, Artificial Sequence
  Description of Artificial Sequence: Synthetic oligonucleotide
  Target: SCN9A; (+) strand; PAM type: NRG; PAM sequence: AAG
tgaattcgataaaaagttaa

SEQ ID NO: 56163 - DNA, 20 bp, Artificial Sequence
  Description of Artificial Sequence: Synthetic oligonucleotide
  Target: SCN9A; (+) strand; PAM type: NRG; PAM sequence: AGG
gaattcgataaaaagttaaa

SEQ ID NO: 56164 - DNA, 20 bp, Artificial Sequence
  Description of Artificial Sequence: Synthetic oligonucleotide
  Target: SCN9A; (+) strand; PAM type: NRG; PAM sequence: AAG
cttttctgaatttcactata

SEQ ID NO: 56165 - DNA, 20 bp, Artificial Sequence
  Description of Artificial Sequence: Synthetic oligonucleotide
  Target: SCN9A; (+) strand; PAM type: NRG; PAM sequence: GAG
ataaataaataatctgcgct

SEQ ID NO: 56166 - DNA, 20 bp, Artificial Sequence
  Description of Artificial Sequence: Synthetic oligonucleotide
  Target: SCN9A; (+) strand; PAM type: NRG; PAM sequence: TAG
aaataatctgcgctgagaaa

SEQ ID NO: 56167 - DNA, 20 bp, Artificial Sequence
  Description of Artificial Sequence: Synthetic oligonucleotide
  Target: SCN9A; (+) strand; PAM type: NRG; PAM sequence: AGG
aataatctgcgctgagaaat

SEQ ID NO: 56168 - DNA, 20 bp, Artificial Sequence
  Description of Artificial Sequence: Synthetic oligonucleotide
  Target: SCN9A; (+) strand; PAM type: NRG; PAM sequence: GGG
ataatctgcgctgagaaata

SEQ ID NO: 56169 - DNA, 20 bp, Artificial Sequence
  Description of Artificial Sequence: Synthetic oligonucleotide
  Target: SCN9A; (+) strand; PAM type: NRG; PAM sequence: GGG
taatctgcgctgagaaatag

SEQ ID NO: 56170 - DNA, 20 bp, Artificial Sequence
  Description of Artificial Sequence: Synthetic oligonucleotide
  Target: SCN9A; (+) strand; PAM type: NRG; PAM sequence: CAG
tctgcgctgagaaatagggg

SEQ ID NO: 56171 - DNA, 20 bp, Artificial Sequence
  Description of Artificial Sequence: Synthetic oligonucleotide
  Target: SCN9A; (+) strand; PAM type: NRG; PAM sequence: GAG
tgcgctgagaaataggggca

SEQ ID NO: 56172 - DNA, 20 bp, Artificial Sequence
  Description of Artificial Sequence: Synthetic oligonucleotide
  Target: SCN9A; (+) strand; PAM type: NRG; PAM sequence: AAG
atttgtgtttgtgtgctctt

SEQ ID NO: 56173 - DNA, 20 bp, Artificial Sequence
  Description of Artificial Sequence: Synthetic oligonucleotide
  Target: SCN9A; (+) strand; PAM type: NRG; PAM sequence: AGG
tttgtgtttgtgtgctctta

SEQ ID NO: 56174 - DNA, 20 bp, Artificial Sequence
  Description of Artificial Sequence: Synthetic oligonucleotide
  Target: SCN9A; (+) strand; PAM type: NRG; PAM sequence: GGG
ttgtgtttgtgtgctcttaa

SEQ ID NO: 56175 - DNA, 20 bp, Artificial Sequence
  Description of Artificial Sequence: Synthetic oligonucleotide
  Target: SCN9A; (+) strand; PAM type: NRG; PAM sequence: GGG
tgtgtttgtgtgctcttaag

SEQ ID NO: 56176 - DNA, 20 bp, Artificial Sequence
  Description of Artificial Sequence: Synthetic oligonucleotide
  Target: SCN9A; (+) strand; PAM type: NRG; PAM sequence: CGG
ttgtgtgctcttaaggggtg

SEQ ID NO: 56177 - DNA, 20 bp, Artificial Sequence
  Description of Artificial Sequence: Synthetic oligonucleotide
  Target: SCN9A; (+) strand; PAM type: NRG; PAM sequence: GGG
tgtgtgctcttaaggggtgc

SEQ ID NO: 56178 - DNA, 20 bp, Artificial Sequence
  Description of Artificial Sequence: Synthetic oligonucleotide
  Target: SCN9A; (+) strand; PAM type: NRG; PAM sequence: GGG
gtgtgctcttaaggggtgcg

SEQ ID NO: 56179 - DNA, 20 bp, Artificial Sequence
  Description of Artificial Sequence: Synthetic oligonucleotide
  Target: SCN9A; (+) strand; PAM type: NRG; PAM sequence: CAG
ggggttcttttctgtcccca

SEQ ID NO: 56180 - DNA, 20 bp, Artificial Sequence
  Description of Artificial Sequence: Synthetic oligonucleotide
  Target: SCN9A; (+) strand; PAM type: NRG; PAM sequence: AGG
gggttcttttctgtccccac

SEQ ID NO: 56181 - DNA, 20 bp, Artificial Sequence
  Description of Artificial Sequence: Synthetic oligonucleotide
  Target: SCN9A; (+) strand; PAM type: NRG; PAM sequence: AAG
ccccacaggttgtatctgct

SEQ ID NO: 56182 - DNA, 20 bp, Artificial Sequence
  Description of Artificial Sequence: Synthetic oligonucleotide
  Target: SCN9A; (+) strand; PAM type: NRG; PAM sequence: TGG
acaggttgtatctgctaagc

SEQ ID NO: 56183 - DNA, 20 bp, Artificial Sequence
  Description of Artificial Sequence: Synthetic oligonucleotide
  Target: SCN9A; (+) strand; PAM type: NRG; PAM sequence: CAG
ctaagctggttctgcacgct

SEQ ID NO: 56184 - DNA, 20 bp, Artificial Sequence
  Description of Artificial Sequence: Synthetic oligonucleotide
  Target: SCN9A; (+) strand; PAM type: NRG; PAM sequence: CAG
gttctgcacgctcagctttg

SEQ ID NO: 56185 - DNA, 20 bp, Artificial Sequence
  Description of Artificial Sequence: Synthetic oligonucleotide
  Target: SCN9A; (+) strand; PAM type: NRG; PAM sequence: TGG
tgcacgctcagctttgcaga

SEQ ID NO: 56186 - DNA, 20 bp, Artificial Sequence
  Description of Artificial Sequence: Synthetic oligonucleotide
  Target: SCN9A; (+) strand; PAM type: NRG; PAM sequence: GGG
gcacgctcagctttgcagat

SEQ ID NO: 56187 - DNA, 20 bp, Artificial Sequence
  Description of Artificial Sequence: Synthetic oligonucleotide
  Target: SCN9A; (+) strand; PAM type: NRG; PAM sequence: CAG
agctttgcagatgggaaata

SEQ ID NO: 56188 - DNA, 20 bp, Artificial Sequence
  Description of Artificial Sequence: Synthetic oligonucleotide
  Target: SCN9A; (+) strand; PAM type: NRG; PAM sequence: GAG
tttttgctcgtaaaaaatgt

SEQ ID NO: 56189 - DNA, 20 bp, Artificial Sequence
  Description of Artificial Sequence: Synthetic oligonucleotide
  Target: SCN9A; (+) strand; PAM type: NRG; PAM sequence: AAG
gtgagctgccccttgaattg

SEQ ID NO: 56190 - DNA, 20 bp, Artificial Sequence
  Description of Artificial Sequence: Synthetic oligonucleotide
  Target: SCN9A; (+) strand; PAM type: NRG; PAM sequence: TAG
agtccatctaacaactctgc

SEQ ID NO: 56191 - DNA, 20 bp, Artificial Sequence
  Description of Artificial Sequence: Synthetic oligonucleotide
  Target: SCN9A; (+) strand; PAM type: NRG; PAM sequence: CAG
aacaactctgctagcgtaaa

SEQ ID NO: 56192 - DNA, 20 bp, Artificial Sequence
  Description of Artificial Sequence: Synthetic oligonucleotide
  Target: SCN9A; (+) strand; PAM type: NRG; PAM sequence: AAG
gctagcgtaaacagaaataa

SEQ ID NO: 56193 - DNA, 20 bp, Artificial Sequence
  Description of Artificial Sequence: Synthetic oligonucleotide
  Target: SCN9A; (+) strand; PAM type: NRG; PAM sequence: CAG
gcgtaaacagaaataaaaga

SEQ ID NO: 56194 - DNA, 20 bp, Artificial Sequence
  Description of Artificial Sequence: Synthetic oligonucleotide
  Target: SCN9A; (+) strand; PAM type: NRG; PAM sequence: CAG
aataaaagacagtaaaccac

SEQ ID NO: 56195 - DNA, 20 bp, Artificial Sequence
  Description of Artificial Sequence: Synthetic oligonucleotide
  Target: SCN9A; (+) strand; PAM type: NRG; PAM sequence: AGG
ataaaagacagtaaaccacc

SEQ ID NO: 56196 - DNA, 20 bp, Artificial Sequence
  Description of Artificial Sequence: Synthetic oligonucleotide
  Target: SCN9A; (+) strand; PAM type: NRG; PAM sequence: CAG
attgctacccttcctttcca

SEQ ID NO: 56197 - DNA, 20 bp, Artificial Sequence
  Description of Artificial Sequence: Synthetic oligonucleotide
  Target: SCN9A; (+) strand; PAM type: NRG; PAM sequence: CAG
acccttcctttccacagttt

SEQ ID NO: 56198 - DNA, 20 bp, Artificial Sequence
  Description of Artificial Sequence: Synthetic oligonucleotide
  Target: SCN9A; (+) strand; PAM type: NRG; PAM sequence: TGG
ctttccacagtttcagaacc

SEQ ID NO: 56199 - DNA, 20 bp, Artificial Sequence
  Description of Artificial Sequence: Synthetic oligonucleotide
  Target: SCN9A; (+) strand; PAM type: NRG; PAM sequence: CAG
tccacagtttcagaacctgg

SEQ ID NO: 56200 - DNA, 20 bp, Artificial Sequence
  Description of Artificial Sequence: Synthetic oligonucleotide
  Target: SCN9A; (+) strand; PAM type: NRG; PAM sequence: CAG
agaacctggcagcaaaccca

SEQ ID NO: 56201 - DNA, 20 bp, Artificial Sequence
  Description of Artificial Sequence: Synthetic oligonucleotide
  Target: SCN9A; (+) strand; PAM type: NRG; PAM sequence: GAG
aacctggcagcaaacccaca

SEQ ID NO: 56202 - DNA, 20 bp, Artificial Sequence
  Description of Artificial Sequence: Synthetic oligonucleotide
  Target: SCN9A; (+) strand; PAM type: NRG; PAM sequence: CAG
cccacagagtcaaaaccgca

SEQ ID NO: 56203 - DNA, 20 bp, Artificial Sequence
  Description of Artificial Sequence: Synthetic oligonucleotide
  Target: SCN9A; (+) strand; PAM type: NRG; PAM sequence: AGG
ccacagagtcaaaaccgcac

SEQ ID NO: 56204 - DNA, 20 bp, Artificial Sequence
  Description of Artificial Sequence: Synthetic oligonucleotide
  Target: SCN9A; (+) strand; PAM type: NRG; PAM sequence: GAG
acagagtcaaaaccgcacag

SEQ ID NO: 56205 - DNA, 20 bp, Artificial Sequence
  Description of Artificial Sequence: Synthetic oligonucleotide
  Target: SCN9A; (+) strand; PAM type: NRG; PAM sequence: CAG
aaaaccgcacaggagctgcc

SEQ ID NO: 56206 - DNA, 20 bp, Artificial Sequence
  Description of Artificial Sequence: Synthetic oligonucleotide
  Target: SCN9A; (+) strand; PAM type: NRG; PAM sequence: CAG
tatcgaaataactacgcttc

SEQ ID NO: 56207 - DNA, 20 bp, Artificial Sequence
  Description of Artificial Sequence: Synthetic oligonucleotide
  Target: SCN9A; (+) strand; PAM type: NRG; PAM sequence: TGG
gcccttcttcctcccattgc

SEQ ID NO: 56208 - DNA, 20 bp, Artificial Sequence
  Description of Artificial Sequence: Synthetic oligonucleotide
  Target: SCN9A; (+) strand; PAM type: NRG; PAM sequence: CGG
ctcccattgctggaaccacc

SEQ ID NO: 56209 - DNA, 20 bp, Artificial Sequence
  Description of Artificial Sequence: Synthetic oligonucleotide
  Target: SCN9A; (+) strand; PAM type: NRG; PAM sequence: AAG
attgctggaaccacccggtc

SEQ ID NO: 56210 - DNA, 20 bp, Artificial Sequence
  Description of Artificial Sequence: Synthetic oligonucleotide
  Target: SCN9A; (+) strand; PAM type: NRG; PAM sequence: CAG
cttctcccctctcttctttc

SEQ ID NO: 56211 - DNA, 20 bp, Artificial Sequence
  Description of Artificial Sequence: Synthetic oligonucleotide
  Target: SCN9A; (+) strand; PAM type: NRG; PAM sequence: AGG
ttctcccctctcttctttcc

SEQ ID NO: 56212 - DNA, 20 bp, Artificial Sequence
  Description of Artificial Sequence: Synthetic oligonucleotide
  Target: SCN9A; (+) strand; PAM type: NRG; PAM sequence: TGG
tcccctctcttctttccagg

SEQ ID NO: 56213 - DNA, 20 bp, Artificial Sequence
  Description of Artificial Sequence: Synthetic oligonucleotide
  Target: SCN9A; (+) strand; PAM type: NRG; PAM sequence: CAG
tctttccaggtggcgtaata

SEQ ID NO: 56214 - DNA, 20 bp, Artificial Sequence
  Description of Artificial Sequence: Synthetic oligonucleotide
  Target: SCN9A; (+) strand; PAM type: NRG; PAM sequence: AGG
ctttccaggtggcgtaatac

SEQ ID NO: 56215 - DNA, 20 bp, Artificial Sequence
  Description of Artificial Sequence: Synthetic oligonucleotide
  Target: SCN9A; (+) strand; PAM type: NRG; PAM sequence: GGG
tttccaggtggcgtaataca

SEQ ID NO: 56216 - DNA, 20 bp, Artificial Sequence
  Description of Artificial Sequence: Synthetic oligonucleotide
  Target: SCN9A; (+) strand; PAM type: NRG; PAM sequence: CAG
ggtggcgtaatacagggttc

SEQ ID NO: 56217 - DNA, 20 bp, Artificial Sequence
  Description of Artificial Sequence: Synthetic oligonucleotide
  Target: SCN9A; (+) strand; PAM type: NRG; PAM sequence: GAG
taatacagggttccagaacc

SEQ ID NO: 56218 - DNA, 20 bp, Artificial Sequence
  Description of Artificial Sequence: Synthetic oligonucleotide
  Target: SCN9A; (+) strand; PAM type: NRG; PAM sequence: TAG
ccagaaccgagatgtgaaaa

SEQ ID NO: 56219 - DNA, 20 bp, Artificial Sequence
  Description of Artificial Sequence: Synthetic oligonucleotide
  Target: SCN9A; (+) strand; PAM type: NRG; PAM sequence: CAG
ccgagatgtgaaaatagaca

SEQ ID NO: 56220 - DNA, 20 bp, Artificial Sequence
  Description of Artificial Sequence: Synthetic oligonucleotide
  Target: SCN9A; (+) strand; PAM type: NRG; PAM sequence: AGG
cgagatgtgaaaatagacac

SEQ ID NO: 56221 - DNA, 20 bp, Artificial Sequence
  Description of Artificial Sequence: Synthetic oligonucleotide
  Target: SCN9A; (+) strand; PAM type: NRG; PAM sequence: TGG
gatgtgaaaatagacacagg

SEQ ID NO: 56222 - DNA, 20 bp, Artificial Sequence
  Description of Artificial Sequence: Synthetic oligonucleotide
  Target: SCN9A; (+) strand; PAM type: NRG; PAM sequence: GGG
atgtgaaaatagacacaggt

SEQ ID NO: 56223 - DNA, 20 bp, Artificial Sequence
  Description of Artificial Sequence: Synthetic oligonucleotide
  Target: SCN9A; (+) strand; PAM type: NRG; PAM sequence: TGG
aaaatagacacaggtgggtg

SEQ ID NO: 56224 - DNA, 20 bp, Artificial Sequence
  Description of Artificial Sequence: Synthetic oligonucleotide
  Target: SCN9A; (+) strand; PAM type: NRG; PAM sequence: CGG
atagacacaggtgggtgtgg

SEQ ID NO: 56225 - DNA, 20 bp, Artificial Sequence
  Description of Artificial Sequence: Synthetic oligonucleotide
  Target: SCN9A; (+) strand; PAM type: NRG; PAM sequence: GAG
cacaggtgggtgtggcggtt

SEQ ID NO: 56226 - DNA, 20 bp, Artificial Sequence
  Description of Artificial Sequence: Synthetic oligonucleotide
  Target: SCN9A; (+) strand; PAM type: NRG; PAM sequence: AGG
acaggtgggtgtggcggttg

SEQ ID NO: 56227 - DNA, 20 bp, Artificial Sequence
  Description of Artificial Sequence: Synthetic oligonucleotide
  Target: SCN9A; (+) strand; PAM type: NRG; PAM sequence: GAG
gtgggtgtggcggttgaggc

SEQ ID NO: 56228 - DNA, 20 bp, Artificial Sequence
  Description of Artificial Sequence: Synthetic oligonucleotide
  Target: SCN9A; (+) strand; PAM type: NRG; PAM sequence: CGG
tgtggcggttgaggcgagca

SEQ ID NO: 56229 - DNA, 20 bp, Artificial Sequence
  Description of Artificial Sequence: Synthetic oligonucleotide
  Target: SCN9A; (+) strand; PAM type: NRG; PAM sequence: GGG
gtggcggttgaggcgagcac

SEQ ID NO: 56230 - DNA, 20 bp, Artificial Sequence
  Description of Artificial Sequence: Synthetic oligonucleotide
  Target: SCN9A; (+) strand; PAM type: NRG; PAM sequence: AAG
gttgaggcgagcacgggcga

SEQ ID NO: 56231 - DNA, 20 bp, Artificial Sequence
  Description of Artificial Sequence: Synthetic oligonucleotide
  Target: SCN9A; (+) strand; PAM type: NRG; PAM sequence: GAG
gcgagcacgggcgaaagacc

SEQ ID NO: 56232 - DNA, 20 bp, Artificial Sequence
  Description of Artificial Sequence: Synthetic oligonucleotide
  Target: SCN9A; (+) strand; PAM type: NRG; PAM sequence: AGG
cgagcacgggcgaaagaccg

SEQ ID NO: 56233 - DNA, 20 bp, Artificial Sequence
  Description of Artificial Sequence: Synthetic oligonucleotide
  Target: SCN9A; (+) strand; PAM type: NRG; PAM sequence: GGG
gagcacgggcgaaagaccga

SEQ ID NO: 56234 - DNA, 20 bp, Artificial Sequence
  Description of Artificial Sequence: Synthetic oligonucleotide
  Target: SCN9A; (+) strand; PAM type: NRG; PAM sequence: CAG
ggcttctcctcccctcccca

SEQ ID NO: 56235 - DNA, 20 bp, Artificial Sequence
  Description of Artificial Sequence: Synthetic oligonucleotide
  Target: SCN9A; (+) strand; PAM type: NRG; PAM sequence: AAG
ttctcctcccctccccacag

SEQ ID NO: 56236 - DNA, 20 bp, Artificial Sequence
  Description of Artificial Sequence: Synthetic oligonucleotide
  Target: SCN9A; (+) strand; PAM type: NRG; PAM sequence: CAG
tcctcccctccccacagaag

SEQ ID NO: 56237 - DNA, 20 bp, Artificial Sequence
  Description of Artificial Sequence: Synthetic oligonucleotide
  Target: SCN9A; (+) strand; PAM type: NRG; PAM sequence: AAG
cctccccacagaagcagcaa

SEQ ID NO: 56238 - DNA, 20 bp, Artificial Sequence
  Description of Artificial Sequence: Synthetic oligonucleotide
  Target: SCN9A; (+) strand; PAM type: NRG; PAM sequence: AAG
ccacagaagcagcaaaagaa

SEQ ID NO: 56239 - DNA, 20 bp, Artificial Sequence
  Description of Artificial Sequence: Synthetic oligonucleotide
  Target: SCN9A; (+) strand; PAM type: NRG; PAM sequence: AGG
cacagaagcagcaaaagaaa

SEQ ID NO: 56240 - DNA, 20 bp, Artificial Sequence
  Description of Artificial Sequence: Synthetic oligonucleotide
  Target: SCN9A; (+) strand; PAM type: NRG; PAM sequence: TAG
aaaggcacttacttgcaacc

SEQ ID NO: 56241 - DNA, 20 bp, Artificial Sequence
  Description of Artificial Sequence: Synthetic oligonucleotide
  Target: SCN9A; (+) strand; PAM type: NRG; PAM sequence: CAG
gcccgccgatcatccccacc

SEQ ID NO: 56242 - DNA, 20 bp, Artificial Sequence
  Description of Artificial Sequence: Synthetic oligonucleotide
  Target: SCN9A; (+) strand; PAM type: NRG; PAM sequence: CAG
atccccacccagtgcacctg

SEQ ID NO: 56243 - DNA, 20 bp, Artificial Sequence
  Description of Artificial Sequence: Synthetic oligonucleotide
  Target: SCN9A; (+) strand; PAM type: NRG; PAM sequence: TGG
cccagtgcacctgcagaatc

SEQ ID NO: 56244 - DNA, 20 bp, Artificial Sequence
  Description of Artificial Sequence: Synthetic oligonucleotide
  Target: SCN9A; (+) strand; PAM type: NRG; PAM sequence: CAG
gcacctgcagaatctggctc

SEQ ID NO: 56245 - DNA, 20 bp, Artificial Sequence
  Description of Artificial Sequence: Synthetic oligonucleotide
  Target: SCN9A; (+) strand; PAM type: NRG; PAM sequence: AGG
cacctgcagaatctggctcc

SEQ ID NO: 56246 - DNA, 20 bp, Artificial Sequence
  Description of Artificial Sequence: Synthetic oligonucleotide
  Target: SCN9A; (+) strand; PAM type: NRG; PAM sequence: GAG
cctgcagaatctggctccag

SEQ ID NO: 56247 - DNA, 20 bp, Artificial Sequence
  Description of Artificial Sequence: Synthetic oligonucleotide
  Target: SCN9A; (+) strand; PAM type: NRG; PAM sequence: GAG
tgcagaatctggctccagga

SEQ ID NO: 56248 - DNA, 20 bp, Artificial Sequence
  Description of Artificial Sequence: Synthetic oligonucleotide
  Target: SCN9A; (+) strand; PAM type: NRG; PAM sequence: AGG
gcagaatctggctccaggag

SEQ ID NO: 56249 - DNA, 20 bp, Artificial Sequence
  Description of Artificial Sequence: Synthetic oligonucleotide
  Target: SCN9A; (+) strand; PAM type: NRG; PAM sequence: GGG
cagaatctggctccaggaga

SEQ ID NO: 56250 - DNA, 20 bp, Artificial Sequence
  Description of Artificial Sequence: Synthetic oligonucleotide
  Target: SCN9A; (+) strand; PAM type: NRG; PAM sequence: CGG
tctggctccaggagagggcg

SEQ ID NO: 56251 - DNA, 20 bp, Artificial Sequence
  Description of Artificial Sequence: Synthetic oligonucleotide
  Target: SCN9A; (+) strand; PAM type: NRG; PAM sequence: GGG
ctggctccaggagagggcgc

SEQ ID NO: 56252 - DNA, 20 bp, Artificial Sequence
  Description of Artificial Sequence: Synthetic oligonucleotide
  Target: SCN9A; (+) strand; PAM type: NRG; PAM sequence: CGG
ggcgcgggcctctccttccc

SEQ ID NO: 56253 - DNA, 20 bp, Artificial Sequence
  Description of Artificial Sequence: Synthetic oligonucleotide
  Target: SCN9A; (+) strand; PAM type: NRG; PAM sequence: CAG
ctccttccccggcgctctct

SEQ ID NO: 56254 - DNA, 20 bp, Artificial Sequence
  Description of Artificial Sequence: Synthetic oligonucleotide
  Target: SCN9A; (+) strand; PAM type: NRG; PAM sequence: AGG
tccttccccggcgctctctc

SEQ ID NO: 56255 - DNA, 20 bp, Artificial Sequence
  Description of Artificial Sequence: Synthetic oligonucleotide
  Target: SCN9A; (+) strand; PAM type: NRG; PAM sequence: GGG
ccttccccggcgctctctca

SEQ ID NO: 56256 - DNA, 20 bp, Artificial Sequence
  Description of Artificial Sequence: Synthetic oligonucleotide
  Target: SCN9A; (+) strand; PAM type: NRG; PAM sequence: TGG
cagggctgcttctttttctc

SEQ ID NO: 56257 - DNA, 20 bp, Artificial Sequence
  Description of Artificial Sequence: Synthetic oligonucleotide
  Target: SCN9A; (+) strand; PAM type: NRG; PAM sequence: GGG
agggctgcttctttttctct

SEQ ID NO: 56258 - DNA, 20 bp, Artificial Sequence
  Description of Artificial Sequence: Synthetic oligonucleotide
  Target: SCN9A; (+) strand; PAM type: NRG; PAM sequence: CAG
ttctctgggctcctgttgct

SEQ ID NO: 56259 - DNA, 20 bp, Artificial Sequence
  Description of Artificial Sequence: Synthetic oligonucleotide
  Target: SCN9A; (+) strand; PAM type: NRG; PAM sequence: AGG
tctctgggctcctgttgctc

SEQ ID NO: 56260 - DNA, 20 bp, Artificial Sequence
  Description of Artificial Sequence: Synthetic oligonucleotide
  Target: SCN9A; (+) strand; PAM type: NRG; PAM sequence: GGG
ctctgggctcctgttgctca

SEQ ID NO: 56261 - DNA, 20 bp, Artificial Sequence
  Description of Artificial Sequence: Synthetic oligonucleotide
  Target: SCN9A; (+) strand; PAM type: NRG; PAM sequence: GGG
tctgggctcctgttgctcag

SEQ ID NO: 56262 - DNA, 20 bp, Artificial Sequence
  Description of Artificial Sequence: Synthetic oligonucleotide
  Target: SCN9A; (+) strand; PAM type: NRG; PAM sequence: TAG
gctcaggggacgcctgccgc

SEQ ID NO: 56263 - DNA, 20 bp, Artificial Sequence
  Description of Artificial Sequence: Synthetic oligonucleotide
  Target: SCN9A; (+) strand; PAM type: NRG; PAM sequence: CAG
caggggacgcctgccgctag

SEQ ID NO: 56264 - DNA, 20 bp, Artificial Sequence
  Description of Artificial Sequence: Synthetic oligonucleotide
  Target: SCN9A; (+) strand; PAM type: NRG; PAM sequence: TGG
cgcctgccgctagcagccac

SEQ ID NO: 56265 - DNA, 20 bp, Artificial Sequence
  Description of Artificial Sequence: Synthetic oligonucleotide
  Target: SCN9A; (+) strand; PAM type: NRG; PAM sequence: CAG
cgctagcagccactggcacc

SEQ ID NO: 56266 - DNA, 20 bp, Artificial Sequence
  Description of Artificial Sequence: Synthetic oligonucleotide
  Target: SCN9A; (+) strand; PAM type: NRG; PAM sequence: AGG
gctagcagccactggcaccc

SEQ ID NO: 56267 - DNA, 20 bp, Artificial Sequence
  Description of Artificial Sequence: Synthetic oligonucleotide
  Target: SCN9A; (+) strand; PAM type: NRG; PAM sequence: TAG
gcagccactggcacccaggc

SEQ ID NO: 56268 - DNA, 20 bp, Artificial Sequence
  Description of Artificial Sequence: Synthetic oligonucleotide
  Target: SCN9A; (+) strand; PAM type: NRG; PAM sequence: CAG
cactggcacccaggctagcc

SEQ ID NO: 56269 - DNA, 20 bp, Artificial Sequence
  Description of Artificial Sequence: Synthetic oligonucleotide
  Target: SCN9A; (+) strand; PAM type: NRG; PAM sequence: CAG
cacccaggctagcccagcct

SEQ ID NO: 56270 - DNA, 20 bp, Artificial Sequence
  Description of Artificial Sequence: Synthetic oligonucleotide
  Target: SCN9A; (+) strand; PAM type: NRG; PAM sequence: GAG
aggctagcccagcctcagcc

SEQ ID NO: 56271 - DNA, 20 bp, Artificial Sequence
  Description of Artificial Sequence: Synthetic oligonucleotide
  Target: SCN9A; (+) strand; PAM type: NRG; PAM sequence: TGG
tagcccagcctcagccgagc

SEQ ID NO: 56272 - DNA, 20 bp, Artificial Sequence
  Description of Artificial Sequence: Synthetic oligonucleotide
  Target: SCN9A; (+) strand; PAM type: NRG; PAM sequence: CGG
cccagcctcagccgagctgg

SEQ ID NO: 56273 - DNA, 20 bp, Artificial Sequence
  Description of Artificial Sequence: Synthetic oligonucleotide
  Target: SCN9A; (+) strand; PAM type: NRG; PAM sequence: TGG
ctcagccgagctggcggaat

SEQ ID NO: 56274 - DNA, 20 bp, Artificial Sequence
  Description of Artificial Sequence: Synthetic oligonucleotide
  Target: SCN9A; (+) strand; PAM type: NRG; PAM sequence: AAG
gccgagctggcggaattgga

SEQ ID NO: 56275 - DNA, 20 bp, Artificial Sequence
  Description of Artificial Sequence: Synthetic oligonucleotide
  Target: SCN9A; (+) strand; PAM type: NRG; PAM sequence: CAG
tggcggaattggaaagccga

SEQ ID NO: 56276 - DNA, 20 bp, Artificial Sequence
  Description of Artificial Sequence: Synthetic oligonucleotide
  Target: SCN9A; (+) strand; PAM type: NRG; PAM sequence: TGG
ggaaagccgacagccgccgc

SEQ ID NO: 56277 - DNA, 20 bp, Artificial Sequence
  Description of Artificial Sequence: Synthetic oligonucleotide
  Target: SCN9A; (+) strand; PAM type: NRG; PAM sequence: GAG
aaagccgacagccgccgctg

SEQ ID NO: 56278 - DNA, 20 bp, Artificial Sequence
  Description of Artificial Sequence: Synthetic oligonucleotide
  Target: SCN9A; (+) strand; PAM type: NRG; PAM sequence: TGG
gacagccgccgctggagcgc

SEQ ID NO: 56279 - DNA, 20 bp, Artificial Sequence
  Description of Artificial Sequence: Synthetic oligonucleotide
  Target: SCN9A; (+) strand; PAM type: NRG; PAM sequence: AAG
gagcgctggcgaccgcctgc

SEQ ID NO: 56280 - DNA, 20 bp, Artificial Sequence
  Description of Artificial Sequence: Synthetic oligonucleotide
  Target: SCN9A; (+) strand; PAM type: NRG; PAM sequence: CAG
cgctggcgaccgcctgcaag

SEQ ID NO: 56281 - DNA, 20 bp, Artificial Sequence
  Description of Artificial Sequence: Synthetic oligonucleotide
  Target: SCN9A; (+) strand; PAM type: NRG; PAM sequence: CAG
gcagactgcgcccctcctgc

SEQ ID NO: 56282 - DNA, 20 bp, Artificial Sequence
  Description of Artificial Sequence: Synthetic oligonucleotide
  Target: SCN9A; (+) strand; PAM type: NRG; PAM sequence: AGG
cagactgcgcccctcctgcc

SEQ ID NO: 56283 - DNA, 20 bp, Artificial Sequence
  Description of Artificial Sequence: Synthetic oligonucleotide
  Target: SCN9A; (+) strand; PAM type: NRG; PAM sequence: GGG
agactgcgcccctcctgcca

SEQ ID NO: 56284 - DNA, 20 bp, Artificial Sequence
  Description of Artificial Sequence: Synthetic oligonucleotide
  Target: SCN9A; (+) strand; PAM type: NRG; PAM sequence: TGG
ctcctgccagggcgcgcccg

SEQ ID NO: 56285 - DNA, 20 bp, Artificial Sequence
  Description of Artificial Sequence: Synthetic oligonucleotide
  Target: SCN9A; (+) strand; PAM type: NRG; PAM sequence: GAG
cctgccagggcgcgcccgtg

SEQ ID NO: 56286 - DNA, 20 bp, Artificial Sequence
  Description of Artificial Sequence: Synthetic oligonucleotide
  Target: SCN9A; (+) strand; PAM type: NRG; PAM sequence: AGG
ctgccagggcgcgcccgtgg

SEQ ID NO: 56287 - DNA, 20 bp, Artificial Sequence
  Description of Artificial Sequence: Synthetic oligonucleotide
  Target: SCN9A; (+) strand; PAM type: NRG; PAM sequence: TAG
ccagggcgcgcccgtggagg

SEQ ID NO: 56288 - DNA, 20 bp, Artificial Sequence
  Description of Artificial Sequence: Synthetic oligonucleotide
  Target: SCN9A; (+) strand; PAM type: NRG; PAM sequence: CAG
gggcgcgcccgtggaggtag

SEQ ID NO: 56289 - DNA, 20 bp, Artificial Sequence
  Description of Artificial Sequence: Synthetic oligonucleotide
  Target: SCN9A; (+) strand; PAM type: NRG; PAM sequence: GAG
ggtagcagccccgcctcccc

SEQ ID NO: 56290 - DNA, 20 bp, Artificial Sequence
  Description of Artificial Sequence: Synthetic oligonucleotide
  Target: SCN9A; (+) strand; PAM type: NRG; PAM sequence: AGG
gtagcagccccgcctccccg

SEQ ID NO: 56291 - DNA, 20 bp, Artificial Sequence
  Description of Artificial Sequence: Synthetic oligonucleotide
  Target: SCN9A; (+) strand; PAM type: NRG; PAM sequence: GGG
tagcagccccgcctccccga

SEQ ID NO: 56292 - DNA, 20 bp, Artificial Sequence
  Description of Artificial Sequence: Synthetic oligonucleotide
  Target: SCN9A; (+) strand; PAM type: NRG; PAM sequence: CAG
cagccccgcctccccgaggg

SEQ ID NO: 56293 - DNA, 20 bp, Artificial Sequence
  Description of Artificial Sequence: Synthetic oligonucleotide
  Target: SCN9A; (+) strand; PAM type: NRG; PAM sequence: CAG
tttgcctcctccactcctcc

SEQ ID NO: 56294 - DNA, 20 bp, Artificial Sequence
  Description of Artificial Sequence: Synthetic oligonucleotide
  Target: SCN9A; (+) strand; PAM type: NRG; PAM sequence: CGG
tccactcctcccagcgcgcc

SEQ ID NO: 56295 - DNA, 20 bp, Artificial Sequence
  Description of Artificial Sequence: Synthetic oligonucleotide
  Target: SCN9A; (+) strand; PAM type: NRG; PAM sequence: GGG
ccactcctcccagcgcgccc

SEQ ID NO: 56296 - DNA, 20 bp, Artificial Sequence
  Description of Artificial Sequence: Synthetic oligonucleotide
  Target: SCN9A; (+) strand; PAM type: NRG; PAM sequence: CGG
cctccctctctccactcctg

SEQ ID NO: 56297 - DNA, 20 bp, Artificial Sequence
  Description of Artificial Sequence: Synthetic oligonucleotide
  Target: SCN9A; (+) strand; PAM type: NRG; PAM sequence: GGG
ctccctctctccactcctgc

SEQ ID NO: 56298 - DNA, 20 bp, Artificial Sequence
  Description of Artificial Sequence: Synthetic oligonucleotide
  Target: SCN9A; (+) strand; PAM type: NRG; PAM sequence: CGG
cctctctccactcctgcggg

SEQ ID NO: 56299 - DNA, 20 bp, Artificial Sequence
  Description of Artificial Sequence: Synthetic oligonucleotide
  Target: SCN9A; (+) strand; PAM type: NRG; PAM sequence: CAG
ctccactcctgcgggcggcg

SEQ ID NO: 56300 - DNA, 20 bp, Artificial Sequence
  Description of Artificial Sequence: Synthetic oligonucleotide
  Target: SCN9A; (+) strand; PAM type: NRG; PAM sequence: AGG
tccactcctgcgggcggcgc

SEQ ID NO: 56301 - DNA, 20 bp, Artificial Sequence
  Description of Artificial Sequence: Synthetic oligonucleotide
  Target: SCN9A; (+) strand; PAM type: NRG; PAM sequence: GGG
ccactcctgcgggcggcgca

SEQ ID NO: 56302 - DNA, 20 bp, Artificial Sequence
  Description of Artificial Sequence: Synthetic oligonucleotide
  Target: SCN9A; (+) strand; PAM type: NRG; PAM sequence: CGG
ctcctgcgggcggcgcaggg

SEQ ID NO: 56303 - DNA, 20 bp, Artificial Sequence
  Description of Artificial Sequence: Synthetic oligonucleotide
  Target: SCN9A; (+) strand; PAM type: NRG; PAM sequence: GGG
tcctgcgggcggcgcagggc

SEQ ID NO: 56304 - DNA, 20 bp, Artificial Sequence
  Description of Artificial Sequence: Synthetic oligonucleotide
  Target: SCN9A; (+) strand; PAM type: NRG; PAM sequence: GGG
cctgcgggcggcgcagggcg

SEQ ID NO: 56305 - DNA, 20 bp, Artificial Sequence
  Description of Artificial Sequence: Synthetic oligonucleotide
  Target: SCN9A; (+) strand; PAM type: NRG; PAM sequence: CAG
ggcggcgcagggcggggacc

SEQ ID NO: 56306 - DNA, 20 bp, Artificial Sequence
  Description of Artificial Sequence: Synthetic oligonucleotide
  Target: SCN9A; (+) strand; PAM type: NRG; PAM sequence: TAG
gcgcagggcggggacccagc

SEQ ID NO: 56307 - DNA, 20 bp, Artificial Sequence
  Description of Artificial Sequence: Synthetic oligonucleotide
  Target: SCN9A; (+) strand; PAM type: NRG; PAM sequence: AGG
cgcagggcggggacccagct

SEQ ID NO: 56308 - DNA, 20 bp, Artificial Sequence
  Description of Artificial Sequence: Synthetic oligonucleotide
  Target: SCN9A; (+) strand; PAM type: NRG; PAM sequence: GGG
gcagggcggggacccagcta

SEQ ID NO: 56309 - DNA, 20 bp, Artificial Sequence
  Description of Artificial Sequence: Synthetic oligonucleotide
  Target: SCN9A; (+) strand; PAM type: NRG; PAM sequence: GGG
cagggcggggacccagctag

SEQ ID NO: 56310 - DNA, 20 bp, Artificial Sequence
  Description of Artificial Sequence: Synthetic oligonucleotide
  Target: SCN9A; (+) strand; PAM type: NRG; PAM sequence: CGG
cggggacccagctaggggcg

SEQ ID NO: 56311 - DNA, 20 bp, Artificial Sequence
  Description of Artificial Sequence: Synthetic oligonucleotide
  Target: SCN9A; (+) strand; PAM type: NRG; PAM sequence: TGG
ggacccagctaggggcgcgg

SEQ ID NO: 56312 - DNA, 20 bp, Artificial Sequence
  Description of Artificial Sequence: Synthetic oligonucleotide
  Target: SCN9A; (+) strand; PAM type: NRG; PAM sequence: TGG
cccagctaggggcgcggtgg

SEQ ID NO: 56313 - DNA, 20 bp, Artificial Sequence
  Description of Artificial Sequence: Synthetic oligonucleotide
  Target: SCN9A; (+) strand; PAM type: NRG; PAM sequence: TAG
gcgcggtggtggcgacgctg

SEQ ID NO: 56314 - DNA, 20 bp, Artificial Sequence
  Description of Artificial Sequence: Synthetic oligonucleotide
  Target: SCN9A; (+) strand; PAM type: NRG; PAM sequence: TAG
gcctctgcaccatgcgctaa

SEQ ID NO: 56315 - DNA, 20 bp, Artificial Sequence
  Description of Artificial Sequence: Synthetic oligonucleotide
  Target: SCN9A; (+) strand; PAM type: NRG; PAM sequence: AAG
tctgcaccatgcgctaatag

SEQ ID NO: 56316 - DNA, 20 bp, Artificial Sequence
  Description of Artificial Sequence: Synthetic oligonucleotide
  Target: SCN9A; (+) strand; PAM type: NRG; PAM sequence: AGG
ctgcaccatgcgctaataga

SEQ ID NO: 56317 - DNA, 20 bp, Artificial Sequence
  Description of Artificial Sequence: Synthetic oligonucleotide
  Target: SCN9A; (+) strand; PAM type: NRG; PAM sequence: CGG
caccatgcgctaatagaagg

SEQ ID NO: 56318 - DNA, 20 bp, Artificial Sequence
  Description of Artificial Sequence: Synthetic oligonucleotide
  Target: SCN9A; (+) strand; PAM type: NRG; PAM sequence: GAG
ccatgcgctaatagaaggcg

SEQ ID NO: 56319 - DNA, 20 bp, Artificial Sequence
  Description of Artificial Sequence: Synthetic oligonucleotide
  Target: SCN9A; (+) strand; PAM type: NRG; PAM sequence: AGG
catgcgctaatagaaggcgg

SEQ ID NO: 56320 - DNA, 20 bp, Artificial Sequence
  Description of Artificial Sequence: Synthetic oligonucleotide
  Target: SCN9A; (+) strand; PAM type: NRG; PAM sequence: GAG
tgcgctaatagaaggcggag

SEQ ID NO: 56321 - DNA, 20 bp, Artificial Sequence
  Description of Artificial Sequence: Synthetic oligonucleotide
  Target: SCN9A; (+) strand; PAM type: NRG; PAM sequence: AGG
gcgctaatagaaggcggagg

SEQ ID NO: 56322 - DNA, 20 bp, Artificial Sequence
  Description of Artificial Sequence: Synthetic oligonucleotide
  Target: SCN9A; (+) strand; PAM type: NRG; PAM sequence: GGG
cgctaatagaaggcggagga

SEQ ID NO: 56323 - DNA, 20 bp, Artificial Sequence
  Description of Artificial Sequence: Synthetic oligonucleotide
  Target: SCN9A; (+) strand; PAM type: NRG; PAM sequence: GGG
gctaatagaaggcggaggag

SEQ ID NO: 56324 - DNA, 20 bp, Artificial Sequence
  Description of Artificial Sequence: Synthetic oligonucleotide
  Target: SCN9A; (+) strand; PAM type: NRG; PAM sequence: GGG
ctaatagaaggcggaggagg

SEQ ID NO: 56325 - DNA, 20 bp, Artificial Sequence
  Description of Artificial Sequence: Synthetic oligonucleotide
  Target: SCN9A; (+) strand; PAM type: NRG; PAM sequence: CGG
gttgcacgacctgccatcca

SEQ ID NO: 56326 - DNA, 20 bp, Artificial Sequence
  Description of Artificial Sequence: Synthetic oligonucleotide
  Target: SCN9A; (+) strand; PAM type: NRG; PAM sequence: TGG
tgccatccacggccacccat

SEQ ID NO: 56327 - DNA, 20 bp, Artificial Sequence
  Description of Artificial Sequence: Synthetic oligonucleotide
  Target: SCN9A; (+) strand; PAM type: NRG; PAM sequence: GGG
gccatccacggccacccatt

SEQ ID NO: 56328 - DNA, 20 bp, Artificial Sequence
  Description of Artificial Sequence: Synthetic oligonucleotide
  Target: SCN9A; (+) strand; PAM type: NRG; PAM sequence: TGG
atccacggccacccattggg

SEQ ID NO: 56329 - DNA, 20 bp, Artificial Sequence
  Description of Artificial Sequence: Synthetic oligonucleotide
  Target: SCN9A; (+) strand; PAM type: NRG; PAM sequence: GGG
tccacggccacccattgggt

SEQ ID NO: 56330 - DNA, 20 bp, Artificial Sequence
  Description of Artificial Sequence: Synthetic oligonucleotide
  Target: SCN9A; (+) strand; PAM type: NRG; PAM sequence: GGG
ccacggccacccattgggtg

SEQ ID NO: 56331 - DNA, 20 bp, Artificial Sequence
  Description of Artificial Sequence: Synthetic oligonucleotide
  Target: SCN9A; (+) strand; PAM type: NRG; PAM sequence: GAG
ggtggggcgtgtgtgtgttt

SEQ ID NO: 56332 - DNA, 20 bp, Artificial Sequence
  Description of Artificial Sequence: Synthetic oligonucleotide
  Target: SCN9A; (+) strand; PAM type: NRG; PAM sequence: CAG
agtgtgtgtgtgtgtgtgtc

SEQ ID NO: 56333 - DNA, 20 bp, Artificial Sequence
  Description of Artificial Sequence: Synthetic oligonucleotide
  Target: SCN9A; (+) strand; PAM type: NRG; PAM sequence: CAG
gtgtgtgtgtgtgtgtccag

SEQ ID NO: 56334 - DNA, 20 bp, Artificial Sequence
  Description of Artificial Sequence: Synthetic oligonucleotide
  Target: SCN9A; (+) strand; PAM type: NRG; PAM sequence: CAG
gtgtgtgtgtgtccagcagc

SEQ ID NO: 56335 - DNA, 20 bp, Artificial Sequence
  Description of Artificial Sequence: Synthetic oligonucleotide
  Target: SCN9A; (+) strand; PAM type: NRG; PAM sequence: AAG
tgtgtgtgtccagcagccag

SEQ ID NO: 56336 - DNA, 20 bp, Artificial Sequence
  Description of Artificial Sequence: Synthetic oligonucleotide
  Target: SCN9A; (+) strand; PAM type: NRG; PAM sequence: GAG
tgtgtgtccagcagccagaa

SEQ ID NO: 56337 - DNA, 20 bp, Artificial Sequence
  Description of Artificial Sequence: Synthetic oligonucleotide
  Target: SCN9A; (+) strand; PAM type: NRG; PAM sequence: CAG
ccctttcctcccttcctgct

SEQ ID NO: 56338 - DNA, 20 bp, Artificial Sequence
  Description of Artificial Sequence: Synthetic oligonucleotide
  Target: SCN9A; (+) strand; PAM type: NRG; PAM sequence: CAG
tttcctcccttcctgctcag

SEQ ID NO: 56339 - DNA, 20 bp, Artificial Sequence
  Description of Artificial Sequence: Synthetic oligonucleotide
  Target: SCN9A; (+) strand; PAM type: NRG; PAM sequence: CGG
cccttcctgctcagcagaat

SEQ ID NO: 56340 - DNA, 20 bp, Artificial Sequence
  Description of Artificial Sequence: Synthetic oligonucleotide
  Target: SCN9A; (+) strand; PAM type: NRG; PAM sequence: GAG
cagaatcggctaatgtttcc

SEQ ID NO: 56341 - DNA, 20 bp, Artificial Sequence
  Description of Artificial Sequence: Synthetic oligonucleotide
  Target: SCN9A; (+) strand; PAM type: NRG; PAM sequence: AAG
aatcggctaatgtttccgag

SEQ ID NO: 56342 - DNA, 20 bp, Artificial Sequence
  Description of Artificial Sequence: Synthetic oligonucleotide
  Target: SCN9A; (+) strand; PAM type: NRG; PAM sequence: TGG
ttccgagaagtcactttgtg

SEQ ID NO: 56343 - DNA, 20 bp, Artificial Sequence
  Description of Artificial Sequence: Synthetic oligonucleotide
  Target: SCN9A; (+) strand; PAM type: NRG; PAM sequence: TGG
agaagtcactttgtgtggct

SEQ ID NO: 56344 - DNA, 20 bp, Artificial Sequence
  Description of Artificial Sequence: Synthetic oligonucleotide
  Target: SCN9A; (+) strand; PAM type: NRG; PAM sequence: TGG
agtcactttgtgtggcttgg

SEQ ID NO: 56345 - DNA, 20 bp, Artificial Sequence
  Description of Artificial Sequence: Synthetic oligonucleotide
  Target: SCN9A; (+) strand; PAM type: NRG; PAM sequence: GGG
gtcactttgtgtggcttggt

SEQ ID NO: 56346 - DNA, 20 bp, Artificial Sequence
  Description of Artificial Sequence: Synthetic oligonucleotide
  Target: SCN9A; (+) strand; PAM type: NRG; PAM sequence: GGG
tcactttgtgtggcttggtg

SEQ ID NO: 56347 - DNA, 20 bp, Artificial Sequence
  Description of Artificial Sequence: Synthetic oligonucleotide
  Target: SCN9A; (+) strand; PAM type: NRG; PAM sequence: GAG
actttgtgtggcttggtggg

SEQ ID NO: 56348 - DNA, 20 bp, Artificial Sequence
  Description of Artificial Sequence: Synthetic oligonucleotide
  Target: SCN9A; (+) strand; PAM type: NRG; PAM sequence: TGG
tgtgtggcttggtggggagc

SEQ ID NO: 56349 - DNA, 20 bp, Artificial Sequence
  Description of Artificial Sequence: Synthetic oligonucleotide
  Target: SCN9A; (+) strand; PAM type: NRG; PAM sequence: GAG
tgtggcttggtggggagctg

SEQ ID NO: 56350 - DNA, 20 bp, Artificial Sequence
  Description of Artificial Sequence: Synthetic oligonucleotide
  Target: SCN9A; (+) strand; PAM type: NRG; PAM sequence: CGG
ggggagctggagaaaaactc

SEQ ID NO: 56351 - DNA, 20 bp, Artificial Sequence
  Description of Artificial Sequence: Synthetic oligonucleotide
  Target: SCN9A; (+) strand; PAM type: NRG; PAM sequence: GAG
ggagctggagaaaaactccg

SEQ ID NO: 56352 - DNA, 20 bp, Artificial Sequence
  Description of Artificial Sequence: Synthetic oligonucleotide
  Target: SCN9A; (+) strand; PAM type: NRG; PAM sequence: CAG
gctggagaaaaactccggag

SEQ ID NO: 56353 - DNA, 20 bp, Artificial Sequence
  Description of Artificial Sequence: Synthetic oligonucleotide
  Target: SCN9A; (+) strand; PAM type: NRG; PAM sequence: GAG
tggagaaaaactccggagca

SEQ ID NO: 56354 - DNA, 20 bp, Artificial Sequence
  Description of Artificial Sequence: Synthetic oligonucleotide
  Target: SCN9A; (+) strand; PAM type: NRG; PAM sequence: AGG
ggagaaaaactccggagcag

SEQ ID NO: 56355 - DNA, 20 bp, Artificial Sequence
  Description of Artificial Sequence: Synthetic oligonucleotide
  Target: SCN9A; (+) strand; PAM type: NRG; PAM sequence: GAG
agaaaaactccggagcagag

SEQ ID NO: 56356 - DNA, 20 bp, Artificial Sequence
  Description of Artificial Sequence: Synthetic oligonucleotide
  Target: SCN9A; (+) strand; PAM type: NRG; PAM sequence: AGG
gaaaaactccggagcagagg

SEQ ID NO: 56357 - DNA, 20 bp, Artificial Sequence
  Description of Artificial Sequence: Synthetic oligonucleotide
  Target: SCN9A; (+) strand; PAM type: NRG; PAM sequence: TGG
aaactccggagcagaggagg

SEQ ID NO: 56358 - DNA, 20 bp, Artificial Sequence
  Description of Artificial Sequence: Synthetic oligonucleotide
  Target: SCN9A; (+) strand; PAM type: NRG; PAM sequence: GGG
aactccggagcagaggaggt

SEQ ID NO: 56359 - DNA, 20 bp, Artificial Sequence
  Description of Artificial Sequence: Synthetic oligonucleotide
  Target: SCN9A; (+) strand; PAM type: NRG; PAM sequence: GGG
actccggagcagaggaggtg

SEQ ID NO: 56360 - DNA, 20 bp, Artificial Sequence
  Description of Artificial Sequence: Synthetic oligonucleotide
  Target: SCN9A; (+) strand; PAM type: NRG; PAM sequence: TGG
gcagaggaggtggggaccaa

SEQ ID NO: 56361 - DNA, 20 bp, Artificial Sequence
  Description of Artificial Sequence: Synthetic oligonucleotide
  Target: SCN9A; (+) strand; PAM type: NRG; PAM sequence: AAG
ggaggtggggaccaatggca

SEQ ID NO: 56362 - DNA, 20 bp, Artificial Sequence
  Description of Artificial Sequence: Synthetic oligonucleotide
  Target: SCN9A; (+) strand; PAM type: NRG; PAM sequence: GAG
gggaccaatggcaaagccct

SEQ ID NO: 56363 - DNA, 20 bp, Artificial Sequence
  Description of Artificial Sequence: Synthetic oligonucleotide
  Target: SCN9A; (+) strand; PAM type: NRG; PAM sequence: TGG
caatggcaaagccctgagtc

SEQ ID NO: 56364 - DNA, 20 bp, Artificial Sequence
  Description of Artificial Sequence: Synthetic oligonucleotide
  Target: SCN9A; (+) strand; PAM type: NRG; PAM sequence: GGG
aatggcaaagccctgagtct

SEQ ID NO: 56365 - DNA, 20 bp, Artificial Sequence
  Description of Artificial Sequence: Synthetic oligonucleotide
  Target: SCN9A; (+) strand; PAM type: NRG; PAM sequence: GGG
atggcaaagccctgagtctg

SEQ ID NO: 56366 - DNA, 20 bp, Artificial Sequence
  Description of Artificial Sequence: Synthetic oligonucleotide
  Target: SCN9A; (+) strand; PAM type: NRG; PAM sequence: CAG
gcaaagccctgagtctgggg

SEQ ID NO: 56367 - DNA, 20 bp, Artificial Sequence
  Description of Artificial Sequence: Synthetic oligonucleotide
  Target: SCN9A; (+) strand; PAM type: NRG; PAM sequence: TGG
aagccctgagtctggggcag

SEQ ID NO: 56368 - DNA, 20 bp, Artificial Sequence
  Description of Artificial Sequence: Synthetic oligonucleotide
  Target: SCN9A; (+) strand; PAM type: NRG; PAM sequence: TGG
cctgagtctggggcagtggc

SEQ ID NO: 56369 - DNA, 20 bp, Artificial Sequence
  Description of Artificial Sequence: Synthetic oligonucleotide
  Target: SCN9A; (+) strand; PAM type: NRG; PAM sequence: GGG
ctgagtctggggcagtggct

SEQ ID NO: 56370 - DNA, 20 bp, Artificial Sequence
  Description of Artificial Sequence: Synthetic oligonucleotide
  Target: SCN9A; (+) strand; PAM type: NRG; PAM sequence: GGG
tgagtctggggcagtggctg

SEQ ID NO: 56371 - DNA, 20 bp, Artificial Sequence
  Description of Artificial Sequence: Synthetic oligonucleotide
  Target: SCN9A; (+) strand; PAM type: NRG; PAM sequence: GAG
agtctggggcagtggctggg

SEQ ID NO: 56372 - DNA, 20 bp, Artificial Sequence
  Description of Artificial Sequence: Synthetic oligonucleotide
  Target: SCN9A; (+) strand; PAM type: NRG; PAM sequence: CAG
tggggcagtggctggggagc

SEQ ID NO: 56373 - DNA, 20 bp, Artificial Sequence
  Description of Artificial Sequence: Synthetic oligonucleotide
  Target: SCN9A; (+) strand; PAM type: NRG; PAM sequence: CAG
ggggagccagacaacaccgc

SEQ ID NO: 56374 - DNA, 20 bp, Artificial Sequence
  Description of Artificial Sequence: Synthetic oligonucleotide
  Target: SCN9A; (+) strand; PAM type: NRG; PAM sequence: AGG
gggagccagacaacaccgcc

SEQ ID NO: 56375 - DNA, 20 bp, Artificial Sequence
  Description of Artificial Sequence: Synthetic oligonucleotide
  Target: SCN9A; (+) strand; PAM type: NRG; PAM sequence: CAG
gccagacaacaccgccaggc

SEQ ID NO: 56376 - DNA, 20 bp, Artificial Sequence
  Description of Artificial Sequence: Synthetic oligonucleotide
  Target: SCN9A; (+) strand; PAM type: NRG; PAM sequence: TGG
ggccagcgcctccccgacct

SEQ ID NO: 56377 - DNA, 20 bp, Artificial Sequence
  Description of Artificial Sequence: Synthetic oligonucleotide
  Target: SCN9A; (+) strand; PAM type: NRG; PAM sequence: GGG
gccagcgcctccccgacctt

SEQ ID NO: 56378 - DNA, 20 bp, Artificial Sequence
  Description of Artificial Sequence: Synthetic oligonucleotide
  Target: SCN9A; (+) strand; PAM type: NRG; PAM sequence: AAG
ctccccgaccttgggctctg

SEQ ID NO: 56379 - DNA, 20 bp, Artificial Sequence
  Description of Artificial Sequence: Synthetic oligonucleotide
  Target: SCN9A; (+) strand; PAM type: NRG; PAM sequence: GAG
ccccgaccttgggctctgaa

SEQ ID NO: 56380 - DNA, 20 bp, Artificial Sequence
  Description of Artificial Sequence: Synthetic oligonucleotide
  Target: SCN9A; (+) strand; PAM type: NRG; PAM sequence: TAG
accttgggctctgaagagtc

SEQ ID NO: 56381 - DNA, 20 bp, Artificial Sequence
  Description of Artificial Sequence: Synthetic oligonucleotide
  Target: SCN9A; (+) strand; PAM type: NRG; PAM sequence: AGG
ccttgggctctgaagagtct

SEQ ID NO: 56382 - DNA, 20 bp, Artificial Sequence
  Description of Artificial Sequence: Synthetic oligonucleotide
  Target: SCN9A; (+) strand; PAM type: NRG; PAM sequence: TGG
gggctctgaagagtctaggc

SEQ ID NO: 56383 - DNA, 20 bp, Artificial Sequence
  Description of Artificial Sequence: Synthetic oligonucleotide
  Target: SCN9A; (+) strand; PAM type: NRG; PAM sequence: GGG
ggctctgaagagtctaggct

SEQ ID NO: 56384 - DNA, 20 bp, Artificial Sequence
  Description of Artificial Sequence: Synthetic oligonucleotide
  Target: SCN9A; (+) strand; PAM type: NRG; PAM sequence: TGG
gaagagtctaggctgggaat

SEQ ID NO: 56385 - DNA, 20 bp, Artificial Sequence
  Description of Artificial Sequence: Synthetic oligonucleotide
  Target: SCN9A; (+) strand; PAM type: NRG; PAM sequence: TAG
ctgggaattggtttcttccg

SEQ ID NO: 56386 - DNA, 20 bp, Artificial Sequence
  Description of Artificial Sequence: Synthetic oligonucleotide
  Target: SCN9A; (+) strand; PAM type: NRG; PAM sequence: AGG
tgggaattggtttcttccgt

SEQ ID NO: 56387 - DNA, 20 bp, Artificial Sequence
  Description of Artificial Sequence: Synthetic oligonucleotide
  Target: SCN9A; (+) strand; PAM type: NRG; PAM sequence: GGG
gggaattggtttcttccgta

SEQ ID NO: 56388 - DNA, 20 bp, Artificial Sequence
  Description of Artificial Sequence: Synthetic oligonucleotide
  Target: SCN9A; (+) strand; PAM type: NRG; PAM sequence: GAG
agggctttgctcacaaccgc

SEQ ID NO: 56389 - DNA, 20 bp, Artificial Sequence
  Description of Artificial Sequence: Synthetic oligonucleotide
  Target: SCN9A; (+) strand; PAM type: NRG; PAM sequence: TGG
gctttgctcacaaccgcgag

SEQ ID NO: 56390 - DNA, 20 bp, Artificial Sequence
  Description of Artificial Sequence: Synthetic oligonucleotide
  Target: SCN9A; (+) strand; PAM type: NRG; PAM sequence: GGG
ctttgctcacaaccgcgagt

SEQ ID NO: 56391 - DNA, 20 bp, Artificial Sequence
  Description of Artificial Sequence: Synthetic oligonucleotide
  Target: SCN9A; (+) strand; PAM type: NRG; PAM sequence: GGG
tttgctcacaaccgcgagtg

SEQ ID NO: 56392 - DNA, 20 bp, Artificial Sequence
  Description of Artificial Sequence: Synthetic oligonucleotide
  Target: SCN9A; (+) strand; PAM type: NRG; PAM sequence: CGG
gctcacaaccgcgagtgggg

SEQ ID NO: 56393 - DNA, 20 bp, Artificial Sequence
  Description of Artificial Sequence: Synthetic oligonucleotide
  Target: SCN9A; (+) strand; PAM type: NRG; PAM sequence: AAG
cgagtggggcggtgacgctc

SEQ ID NO: 56394 - DNA, 20 bp, Artificial Sequence
  Description of Artificial Sequence: Synthetic oligonucleotide
  Target: SCN9A; (+) strand; PAM type: NRG; PAM sequence: CGG
ggggcggtgacgctcaagac

SEQ ID NO: 56395 - DNA, 20 bp, Artificial Sequence
  Description of Artificial Sequence: Synthetic oligonucleotide
  Target: SCN9A; (+) strand; PAM type: NRG; PAM sequence: TAG
tgacgctcaagaccggtatc

SEQ ID NO: 56396 - DNA, 20 bp, Artificial Sequence
  Description of Artificial Sequence: Synthetic oligonucleotide
  Target: SCN9A; (+) strand; PAM type: NRG; PAM sequence: AGG
gacgctcaagaccggtatct

SEQ ID NO: 56397 - DNA, 20 bp, Artificial Sequence
  Description of Artificial Sequence: Synthetic oligonucleotide
  Target: SCN9A; (+) strand; PAM type: NRG; PAM sequence: CAG
atataaaatcaattgaattg

SEQ ID NO: 56398 - DNA, 20 bp, Artificial Sequence
  Description of Artificial Sequence: Synthetic oligonucleotide
  Target: SCN9A; (+) strand; PAM type: NRG; PAM sequence: CAG
aattgaattgcagcgtcttc

SEQ ID NO: 56399 - DNA, 20 bp, Artificial Sequence
  Description of Artificial Sequence: Synthetic oligonucleotide
  Target: SCN9A; (+) strand; PAM type: NRG; PAM sequence: AGG
attgaattgcagcgtcttcc

SEQ ID NO: 56400 - DNA, 20 bp, Artificial Sequence
  Description of Artificial Sequence: Synthetic oligonucleotide
  Target: SCN9A; (+) strand; PAM type: NRG; PAM sequence: AAG
aattgcagcgtcttccaggc

SEQ ID NO: 56401 - DNA, 20 bp, Artificial Sequence
  Description of Artificial Sequence: Synthetic oligonucleotide
  Target: SCN9A; (+) strand; PAM type: NRG; PAM sequence: AAG
aaataatacattttctttcg

SEQ ID NO: 56402 - DNA, 20 bp, Artificial Sequence
  Description of Artificial Sequence: Synthetic oligonucleotide
  Target: SCN9A; (+) strand; PAM type: NRG; PAM sequence: CAG
tacattttctttcgaagatg

SEQ ID NO: 56403 - DNA, 20 bp, Artificial Sequence
  Description of Artificial Sequence: Synthetic oligonucleotide
  Target: SCN9A; (+) strand; PAM type: NRG; PAM sequence: AAG
tttctttcgaagatgcagtg

SEQ ID NO: 56404 - DNA, 20 bp, Artificial Sequence
  Description of Artificial Sequence: Synthetic oligonucleotide
  Target: SCN9A; (+) strand; PAM type: NRG; PAM sequence: CAG
tcgaagatgcagtgaagaat

SEQ ID NO: 56405 - DNA, 20 bp, Artificial Sequence
  Description of Artificial Sequence: Synthetic oligonucleotide
  Target: SCN9A; (+) strand; PAM type: NRG; PAM sequence: GAG
gaagatgcagtgaagaatca

SEQ ID NO: 56406 - DNA, 20 bp, Artificial Sequence
  Description of Artificial Sequence: Synthetic oligonucleotide
  Target: SCN9A; (+) strand; PAM type: NRG; PAM sequence: AGG
aagatgcagtgaagaatcag

SEQ ID NO: 56407 - DNA, 20 bp, Artificial Sequence
  Description of Artificial Sequence: Synthetic oligonucleotide
  Target: SCN9A; (+) strand; PAM type: NRG; PAM sequence: GAG
gatgcagtgaagaatcagag

SEQ ID NO: 56408 - DNA, 20 bp, Artificial Sequence
  Description of Artificial Sequence: Synthetic oligonucleotide
  Target: SCN9A; (+) strand; PAM type: NRG; PAM sequence: AGG
atgcagtgaagaatcagagg

SEQ ID NO: 56409 - DNA, 20 bp, Artificial Sequence
  Description of Artificial Sequence: Synthetic oligonucleotide
  Target: SCN9A; (+) strand; PAM type: NRG; PAM sequence: TAG
tgaagaatcagaggaggtcc

SEQ ID NO: 56410 - DNA, 20 bp, Artificial Sequence
  Description of Artificial Sequence: Synthetic oligonucleotide
  Target: SCN9A; (+) strand; PAM type: NRG; PAM sequence: AGG
gaagaatcagaggaggtcct

SEQ ID NO: 56411 - DNA, 20 bp, Artificial Sequence
  Description of Artificial Sequence: Synthetic oligonucleotide
  Target: SCN9A; (+) strand; PAM type: NRG; PAM sequence: TGG
gaatcagaggaggtcctagg

SEQ ID NO: 56412 - DNA, 20 bp, Artificial Sequence
  Description of Artificial Sequence: Synthetic oligonucleotide
  Target: SCN9A; (+) strand; PAM type: NRG; PAM sequence: GGG
aatcagaggaggtcctaggt

SEQ ID NO: 56413 - DNA, 20 bp, Artificial Sequence
  Description of Artificial Sequence: Synthetic oligonucleotide
  Target: SCN9A; (+) strand; PAM type: NRG; PAM sequence: GGG
atcagaggaggtcctaggtg

SEQ ID NO: 56414 - DNA, 20 bp, Artificial Sequence
  Description of Artificial Sequence: Synthetic oligonucleotide
  Target: SCN9A; (+) strand; PAM type: NRG; PAM sequence: AAG
gaggaggtcctaggtgggga

SEQ ID NO: 56415 - DNA, 20 bp, Artificial Sequence
  Description of Artificial Sequence: Synthetic oligonucleotide
  Target: SCN9A; (+) strand; PAM type: NRG; PAM sequence: TGG
cctaggtggggaaagaaacg

SEQ ID NO: 56416 - DNA, 20 bp, Artificial Sequence
  Description of Artificial Sequence: Synthetic oligonucleotide
  Target: SCN9A; (+) strand; PAM type: NRG; PAM sequence: GGG
ctaggtggggaaagaaacgt

SEQ ID NO: 56417 - DNA, 20 bp, Artificial Sequence
  Description of Artificial Sequence: Synthetic oligonucleotide
  Target: SCN9A; (+) strand; PAM type: NRG; PAM sequence: GGG
taggtggggaaagaaacgtg

SEQ ID NO: 56418 - DNA, 20 bp, Artificial Sequence
  Description of Artificial Sequence: Synthetic oligonucleotide
  Target: SCN9A; (+) strand; PAM type: NRG; PAM sequence: AAG
ggggaaagaaacgtggggaa

SEQ ID NO: 56419 - DNA, 20 bp, Artificial Sequence
  Description of Artificial Sequence: Synthetic oligonucleotide
  Target: SCN9A; (+) strand; PAM type: NRG; PAM sequence: AGG
gggaaagaaacgtggggaaa

SEQ ID NO: 56420 - DNA, 20 bp, Artificial Sequence
  Description of Artificial Sequence: Synthetic oligonucleotide
  Target: SCN9A; (+) strand; PAM type: NRG; PAM sequence: CAG
tggggaaaaggctgcttttc

SEQ ID NO: 56421 - DNA, 20 bp, Artificial Sequence
  Description of Artificial Sequence: Synthetic oligonucleotide
  Target: SCN9A; (+) strand; PAM type: NRG; PAM sequence: TGG
aaaggctgcttttccagacc

SEQ ID NO: 56422 - DNA, 20 bp, Artificial Sequence
  Description of Artificial Sequence: Synthetic oligonucleotide
  Target: SCN9A; (+) strand; PAM type: NRG; PAM sequence: GGG
aaggctgcttttccagacct

SEQ ID NO: 56423 - DNA, 20 bp, Artificial Sequence
  Description of Artificial Sequence: Synthetic oligonucleotide
  Target: SCN9A; (+) strand; PAM type: NRG; PAM sequence: CAG
cgattatctgaatatgccat

SEQ ID NO: 56424 - DNA, 20 bp, Artificial Sequence
  Description of Artificial Sequence: Synthetic oligonucleotide
  Target: SCN9A; (+) strand; PAM type: NRG; PAM sequence: TGG
tgaatatgccatcagtcata

SEQ ID NO: 56425 - DNA, 20 bp, Artificial Sequence
  Description of Artificial Sequence: Synthetic oligonucleotide
  Target: SCN9A; (+) strand; PAM type: NRG; PAM sequence: GGG
gaatatgccatcagtcatat

SEQ ID NO: 56426 - DNA, 20 bp, Artificial Sequence
  Description of Artificial Sequence: Synthetic oligonucleotide
  Target: SCN9A; (+) strand; PAM type: NRG; PAM sequence: CAG
gtcatatgggttctgaattt

SEQ ID NO: 56427 - DNA, 20 bp, Artificial Sequence
  Description of Artificial Sequence: Synthetic oligonucleotide
  Target: SCN9A; (+) strand; PAM type: NRG; PAM sequence: GAG
catatgggttctgaatttca

SEQ ID NO: 56428 - DNA, 20 bp, Artificial Sequence
  Description of Artificial Sequence: Synthetic oligonucleotide
  Target: SCN9A; (+) strand; PAM type: NRG; PAM sequence: TGG
tgggttctgaatttcagagc

SEQ ID NO: 56429 - DNA, 20 bp, Artificial Sequence
  Description of Artificial Sequence: Synthetic oligonucleotide
  Target: SCN9A; (+) strand; PAM type: NRG; PAM sequence: TAG
gttctgaatttcagagctgg

SEQ ID NO: 56430 - DNA, 20 bp, Artificial Sequence
  Description of Artificial Sequence: Synthetic oligonucleotide
  Target: SCN9A; (+) strand; PAM type: NRG; PAM sequence: AGG
ttctgaatttcagagctggt

SEQ ID NO: 56431 - DNA, 20 bp, Artificial Sequence
  Description of Artificial Sequence: Synthetic oligonucleotide
  Target: SCN9A; (+) strand; PAM type: NRG; PAM sequence: GAG
ctgaatttcagagctggtag

SEQ ID NO: 56432 - DNA, 20 bp, Artificial Sequence
  Description of Artificial Sequence: Synthetic oligonucleotide
  Target: SCN9A; (+) strand; PAM type: NRG; PAM sequence: TGG
ttttaaaaattcattttgtg

SEQ ID NO: 56433 - DNA, 20 bp, Artificial Sequence
  Description of Artificial Sequence: Synthetic oligonucleotide
  Target: SCN9A; (+) strand; PAM type: NRG; PAM sequence: GAG
ttaaaaattcattttgtgtg

SEQ ID NO: 56434 - DNA, 20 bp, Artificial Sequence
  Description of Artificial Sequence: Synthetic oligonucleotide
  Target: SCN9A; (+) strand; PAM type: NRG; PAM sequence: CAG
tgtgtgcgtgcgctttccta

SEQ ID NO: 56435 - DNA, 20 bp, Artificial Sequence
  Description of Artificial Sequence: Synthetic oligonucleotide
  Target: SCN9A; (+) strand; PAM type: NRG; PAM sequence: CAG
gtgcgtgcgctttcctacag

SEQ ID NO: 56436 - DNA, 20 bp, Artificial Sequence
  Description of Artificial Sequence: Synthetic oligonucleotide
  Target: SCN9A; (+) strand; PAM type: NRG; PAM sequence: TGG
tgcgctttcctacagcagcc

SEQ ID NO: 56437 - DNA, 20 bp, Artificial Sequence
  Description of Artificial Sequence: Synthetic oligonucleotide
  Target: SCN9A; (+) strand; PAM type: NRG; PAM sequence: GGG
gcgctttcctacagcagcct

SEQ ID NO: 56438 - DNA, 20 bp, Artificial Sequence
  Description of Artificial Sequence: Synthetic oligonucleotide
  Target: SCN9A; (+) strand; PAM type: NRG; PAM sequence: GAG
gctttcctacagcagcctgg

SEQ ID NO: 56439 - DNA, 20 bp, Artificial Sequence
  Description of Artificial Sequence: Synthetic oligonucleotide
  Target: SCN9A; (+) strand; PAM type: NRG; PAM sequence: AGG
ctttcctacagcagcctggg

SEQ ID NO: 56440 - DNA, 20 bp, Artificial Sequence
  Description of Artificial Sequence: Synthetic oligonucleotide
  Target: SCN9A; (+) strand; PAM type: NRG; PAM sequence: AAG
tcctacagcagcctgggagg

SEQ ID NO: 56441 - DNA, 20 bp, Artificial Sequence
  Description of Artificial Sequence: Synthetic oligonucleotide
  Target: SCN9A; (+) strand; PAM type: NRG; PAM sequence: TGG
cagcctgggaggaagaacaa

SEQ ID NO: 56442 - DNA, 20 bp, Artificial Sequence
  Description of Artificial Sequence: Synthetic oligonucleotide
  Target: SCN9A; (+) strand; PAM type: NRG; PAM sequence: CAG
gggaggaagaacaatggaaa

SEQ ID NO: 56443 - DNA, 20 bp, Artificial Sequence
  Description of Artificial Sequence: Synthetic oligonucleotide
  Target: SCN9A; (+) strand; PAM type: NRG; PAM sequence: AGG
ggaggaagaacaatggaaac

SEQ ID NO: 56444 - DNA, 20 bp, Artificial Sequence
  Description of Artificial Sequence: Synthetic oligonucleotide
  Target: SCN9A; (+) strand; PAM type: NRG; PAM sequence: GGG
gaggaagaacaatggaaaca

SEQ ID NO: 56445 - DNA, 20 bp, Artificial Sequence
  Description of Artificial Sequence: Synthetic oligonucleotide
  Target: SCN9A; (+) strand; PAM type: NRG; PAM sequence: AAG
gggttgaattatctttctca

SEQ ID NO: 56446 - DNA, 20 bp, Artificial Sequence
  Description of Artificial Sequence: Synthetic oligonucleotide
  Target: SCN9A; (+) strand; PAM type: NRG; PAM sequence: GAG
gttgaattatctttctcaaa

SEQ ID NO: 56447 - DNA, 20 bp, Artificial Sequence
  Description of Artificial Sequence: Synthetic oligonucleotide
  Target: SCN9A; (+) strand; PAM type: NRG; PAM sequence: CAG
ttatctttctcaaagagaaa

SEQ ID NO: 56448 - DNA, 20 bp, Artificial Sequence
  Description of Artificial Sequence: Synthetic oligonucleotide
  Target: SCN9A; (+) strand; PAM type: NRG; PAM sequence: AGG
tatctttctcaaagagaaac

SEQ ID NO: 56449 - DNA, 20 bp, Artificial Sequence
  Description of Artificial Sequence: Synthetic oligonucleotide
  Target: SCN9A; (+) strand; PAM type: NRG; PAM sequence: AAG
agaaacaggaaatttccacc

SEQ ID NO: 56450 - DNA, 20 bp, Artificial Sequence
  Description of Artificial Sequence: Synthetic oligonucleotide
  Target: SCN9A; (+) strand; PAM type: NRG; PAM sequence: AGG
gaaacaggaaatttccacca

SEQ ID NO: 56451 - DNA, 20 bp, Artificial Sequence
  Description of Artificial Sequence: Synthetic oligonucleotide
  Target: SCN9A; (+) strand; PAM type: NRG; PAM sequence: GGG
aaacaggaaatttccaccaa

SEQ ID NO: 56452 - DNA, 20 bp, Artificial Sequence
  Description of Artificial Sequence: Synthetic oligonucleotide
  Target: SCN9A; (+) strand; PAM type: NRG; PAM sequence: AAG
caggaaatttccaccaaggg

SEQ ID NO: 56453 - DNA, 20 bp, Artificial Sequence
  Description of Artificial Sequence: Synthetic oligonucleotide
  Target: SCN9A; (+) strand; PAM type: NRG; PAM sequence: AAG
tccaccaagggaagaaatca

SEQ ID NO: 56454 - DNA, 20 bp, Artificial Sequence
  Description of Artificial Sequence: Synthetic oligonucleotide
  Target: SCN9A; (+) strand; PAM type: NRG; PAM sequence: AGG
ccaccaagggaagaaatcaa

SEQ ID NO: 56455 - DNA, 20 bp, Artificial Sequence
  Description of Artificial Sequence: Synthetic oligonucleotide
  Target: SCN9A; (+) strand; PAM type: NRG; PAM sequence: TGG
caagggaagaaatcaaagga

SEQ ID NO: 56456 - DNA, 20 bp, Artificial Sequence
  Description of Artificial Sequence: Synthetic oligonucleotide
  Target: SCN9A; (+) strand; PAM type: NRG; PAM sequence: TAG
aagaaatcaaaggatggcca

SEQ ID NO: 56457 - DNA, 20 bp, Artificial Sequence
  Description of Artificial Sequence: Synthetic oligonucleotide
  Target: SCN9A; (+) strand; PAM type: NRG; PAM sequence: AGG
agaaatcaaaggatggccat

SEQ ID NO: 56458 - DNA, 20 bp, Artificial Sequence
  Description of Artificial Sequence: Synthetic oligonucleotide
  Target: SCN9A; (+) strand; PAM type: NRG; PAM sequence: GGG
gaaatcaaaggatggccata

SEQ ID NO: 56459 - DNA, 20 bp, Artificial Sequence
  Description of Artificial Sequence: Synthetic oligonucleotide
  Target: SCN9A; (+) strand; PAM type: NRG; PAM sequence: CAG
atcaaaggatggccataggg

SEQ ID NO: 56460 - DNA, 20 bp, Artificial Sequence
  Description of Artificial Sequence: Synthetic oligonucleotide
  Target: SCN9A; (+) strand; PAM type: NRG; PAM sequence: AGG
tcaaaggatggccatagggc

SEQ ID NO: 56461 - DNA, 20 bp, Artificial Sequence
  Description of Artificial Sequence: Synthetic oligonucleotide
  Target: SCN9A; (+) strand; PAM type: NRG; PAM sequence: GGG
caaaggatggccatagggca

SEQ ID NO: 56462 - DNA, 20 bp, Artificial Sequence
  Description of Artificial Sequence: Synthetic oligonucleotide
  Target: SCN9A; (+) strand; PAM type: NRG; PAM sequence: AAG
tagggcagggtgcctctcaa

SEQ ID NO: 56463 - DNA, 20 bp, Artificial Sequence
  Description of Artificial Sequence: Synthetic oligonucleotide
  Target: SCN9A; (+) strand; PAM type: NRG; PAM sequence: AGG
agggcagggtgcctctcaaa

SEQ ID NO: 56464 - DNA, 20 bp, Artificial Sequence
  Description of Artificial Sequence: Synthetic oligonucleotide
  Target: SCN9A; (+) strand; PAM type: NRG; PAM sequence: GGG
gggcagggtgcctctcaaaa

SEQ ID NO: 56465 - DNA, 20 bp, Artificial Sequence
  Description of Artificial Sequence: Synthetic oligonucleotide
  Target: SCN9A; (+) strand; PAM type: NRG; PAM sequence: CAG
cagggtgcctctcaaaaggg

SEQ ID NO: 56466 - DNA, 20 bp, Artificial Sequence
  Description of Artificial Sequence: Synthetic oligonucleotide
  Target: SCN9A; (+) strand; PAM type: NRG; PAM sequence: CAG
caaaagggcagaccactttg

SEQ ID NO: 56467 - DNA, 20 bp, Artificial Sequence
  Description of Artificial Sequence: Synthetic oligonucleotide
  Target: SCN9A; (+) strand; PAM type: NRG; PAM sequence: AGG
aaaagggcagaccactttgc

SEQ ID NO: 56468 - DNA, 20 bp, Artificial Sequence
  Description of Artificial Sequence: Synthetic oligonucleotide
  Target: SCN9A; (+) strand; PAM type: NRG; PAM sequence: TAG
ccactttgcaggataaacac

SEQ ID NO: 56469 - DNA, 20 bp, Artificial Sequence
  Description of Artificial Sequence: Synthetic oligonucleotide
  Target: SCN9A; (+) strand; PAM type: NRG; PAM sequence: CGG
tgcaggataaacactagtga

SEQ ID NO: 56470 - DNA, 20 bp, Artificial Sequence
  Description of Artificial Sequence: Synthetic oligonucleotide
  Target: SCN9A; (+) strand; PAM type: NRG; PAM sequence: GGG
gcaggataaacactagtgac

SEQ ID NO: 56471 - DNA, 20 bp, Artificial Sequence
  Description of Artificial Sequence: Synthetic oligonucleotide
  Target: SCN9A; (+) strand; PAM type: NRG; PAM sequence: TGG
tgcttccacaccttctatca

SEQ ID NO: 56472 - DNA, 20 bp, Artificial Sequence
  Description of Artificial Sequence: Synthetic oligonucleotide
  Target: SCN9A; (+) strand; PAM type: NRG; PAM sequence: TAG
tctatcatggaaatgatgct

SEQ ID NO: 56473 - DNA, 20 bp, Artificial Sequence
  Description of Artificial Sequence: Synthetic oligonucleotide
  Target: SCN9A; (+) strand; PAM type: NRG; PAM sequence: GAG
tatcatggaaatgatgctta

SEQ ID NO: 56474 - DNA, 20 bp, Artificial Sequence
  Description of Artificial Sequence: Synthetic oligonucleotide
  Target: SCN9A; (+) strand; PAM type: NRG; PAM sequence: CGG
aaatgatgcttagagataac

SEQ ID NO: 56475 - DNA, 20 bp, Artificial Sequence
  Description of Artificial Sequence: Synthetic oligonucleotide
  Target: SCN9A; (+) strand; PAM type: NRG; PAM sequence: AAG
tgatgcttagagataaccgg

SEQ ID NO: 56476 - DNA, 20 bp, Artificial Sequence
  Description of Artificial Sequence: Synthetic oligonucleotide
  Target: SCN9A; (+) strand; PAM type: NRG; PAM sequence: AGG
gatgcttagagataaccgga

SEQ ID NO: 56477 - DNA, 20 bp, Artificial Sequence
  Description of Artificial Sequence: Synthetic oligonucleotide
  Target: SCN9A; (+) strand; PAM type: NRG; PAM sequence: CAG
accggaaggaaatcaaatcc

SEQ ID NO: 56478 - DNA, 20 bp, Artificial Sequence
  Description of Artificial Sequence: Synthetic oligonucleotide
  Target: SCN9A; (+) strand; PAM type: NRG; PAM sequence: AGG
ccggaaggaaatcaaatccc

SEQ ID NO: 56479 - DNA, 20 bp, Artificial Sequence
  Description of Artificial Sequence: Synthetic oligonucleotide
  Target: SCN9A; (+) strand; PAM type: NRG; PAM sequence: GGG
cggaaggaaatcaaatccca

SEQ ID NO: 56480 - DNA, 20 bp, Artificial Sequence
  Description of Artificial Sequence: Synthetic oligonucleotide
  Target: SCN9A; (+) strand; PAM type: NRG; PAM sequence: GAG
ctgctgctttctttgcttct

SEQ ID NO: 56481 - DNA, 20 bp, Artificial Sequence
  Description of Artificial Sequence: Synthetic oligonucleotide
  Target: SCN9A; (+) strand; PAM type: NRG; PAM sequence: TGG
tttgcttctgagatttgtcc

SEQ ID NO: 56482 - DNA, 20 bp, Artificial Sequence
  Description of Artificial Sequence: Synthetic oligonucleotide
  Target: SCN9A; (+) strand; PAM type: NRG; PAM sequence: GGG
ttgcttctgagatttgtcct

SEQ ID NO: 56483 - DNA, 20 bp, Artificial Sequence
  Description of Artificial Sequence: Synthetic oligonucleotide
  Target: SCN9A; (+) strand; PAM type: NRG; PAM sequence: GGG
tgcttctgagatttgtcctg

SEQ ID NO: 56484 - DNA, 20 bp, Artificial Sequence
  Description of Artificial Sequence: Synthetic oligonucleotide
  Target: SCN9A; (+) strand; PAM type: NRG; PAM sequence: TGG
tgagatttgtcctggggctt

SEQ ID NO: 56485 - DNA, 20 bp, Artificial Sequence
  Description of Artificial Sequence: Synthetic oligonucleotide
  Target: SCN9A; (+) strand; PAM type: NRG; PAM sequence: AAG
accttacattcttgacttgt

SEQ ID NO: 56486 - DNA, 20 bp, Artificial Sequence
  Description of Artificial Sequence: Synthetic oligonucleotide
  Target: SCN9A; (+) strand; PAM type: NRG; PAM sequence: AAG
acttgtaagatgtgctattg

SEQ ID NO: 56487 - DNA, 20 bp, Artificial Sequence
  Description of Artificial Sequence: Synthetic oligonucleotide
  Target: SCN9A; (+) strand; PAM type: NRG; PAM sequence: AGG
cttgtaagatgtgctattga

SEQ ID NO: 56488 - DNA, 20 bp, Artificial Sequence
  Description of Artificial Sequence: Synthetic oligonucleotide
  Target: SCN9A; (+) strand; PAM type: NRG; PAM sequence: AAG
gtaagatgtgctattgaagg

SEQ ID NO: 56489 - DNA, 20 bp, Artificial Sequence
  Description of Artificial Sequence: Synthetic oligonucleotide
  Target: SCN9A; (+) strand; PAM type: NRG; PAM sequence: AGG
taagatgtgctattgaagga

SEQ ID NO: 56490 - DNA, 20 bp, Artificial Sequence
  Description of Artificial Sequence: Synthetic oligonucleotide
  Target: SCN9A; (+) strand; PAM type: NRG; PAM sequence: CAG
ctattgaaggaaggaaactt

SEQ ID NO: 56491 - DNA, 20 bp, Artificial Sequence
  Description of Artificial Sequence: Synthetic oligonucleotide
  Target: SCN9A; (+) strand; PAM type: NRG; PAM sequence: GAG
ggaaggaaacttcagtgact

SEQ ID NO: 56492 - DNA, 20 bp, Artificial Sequence
  Description of Artificial Sequence: Synthetic oligonucleotide
  Target: SCN9A; (+) strand; PAM type: NRG; PAM sequence: AAG
gtgactgagactgtgcaatg

SEQ ID NO: 56493 - DNA, 20 bp, Artificial Sequence
  Description of Artificial Sequence: Synthetic oligonucleotide
  Target: SCN9A; (+) strand; PAM type: NRG; PAM sequence: AGG
tgactgagactgtgcaatga

SEQ ID NO: 56494 - DNA, 20 bp, Artificial Sequence
  Description of Artificial Sequence: Synthetic oligonucleotide
  Target: SCN9A; (+) strand; PAM type: NRG; PAM sequence: TAG
actgtgcaatgaaggtgaac

SEQ ID NO: 56495 - DNA, 20 bp, Artificial Sequence
  Description of Artificial Sequence: Synthetic oligonucleotide
  Target: SCN9A; (+) strand; PAM type: NRG; PAM sequence: CAG
agctcacttgtgataattct

SEQ ID NO: 56496 - DNA, 20 bp, Artificial Sequence
  Description of Artificial Sequence: Synthetic oligonucleotide
  Target: SCN9A; (+) strand; PAM type: NRG; PAM sequence: TGG
taattctcagtgccatatcc

SEQ ID NO: 56497 - DNA, 20 bp, Artificial Sequence
  Description of Artificial Sequence: Synthetic oligonucleotide
  Target: SCN9A; (+) strand; PAM type: NRG; PAM sequence: TGG
atcgccttctcttccctgat

SEQ ID NO: 56498 - DNA, 20 bp, Artificial Sequence
  Description of Artificial Sequence: Synthetic oligonucleotide
  Target: SCN9A; (+) strand; PAM type: NRG; PAM sequence: TGG
gccttctcttccctgattgg

SEQ ID NO: 56499 - DNA, 20 bp, Artificial Sequence
  Description of Artificial Sequence: Synthetic oligonucleotide
  Target: SCN9A; (+) strand; PAM type: NRG; PAM sequence: TAG
ttctcttccctgattggtgg

SEQ ID NO: 56500 - DNA, 20 bp, Artificial Sequence
  Description of Artificial Sequence: Synthetic oligonucleotide
  Target: SCN9A; (+) strand; PAM type: NRG; PAM sequence: TAG
tccctgattggtggtagata

SEQ ID NO: 56501 - DNA, 20 bp, Artificial Sequence
  Description of Artificial Sequence: Synthetic oligonucleotide
  Target: SCN9A; (+) strand; PAM type: NRG; PAM sequence: AGG
ccctgattggtggtagatat

SEQ ID NO: 56502 - DNA, 20 bp, Artificial Sequence
  Description of Artificial Sequence: Synthetic oligonucleotide
  Target: SCN9A; (+) strand; PAM type: NRG; PAM sequence: AAG
tgattggtggtagatatagg

SEQ ID NO: 56503 - DNA, 20 bp, Artificial Sequence
  Description of Artificial Sequence: Synthetic oligonucleotide
  Target: SCN9A; (+) strand; PAM type: NRG; PAM sequence: AAG
ttggtggtagatataggaag

SEQ ID NO: 56504 - DNA, 20 bp, Artificial Sequence
  Description of Artificial Sequence: Synthetic oligonucleotide
  Target: SCN9A; (+) strand; PAM type: NRG; PAM sequence: GAG
ggtggtagatataggaagaa

SEQ ID NO: 56505 - DNA, 20 bp, Artificial Sequence
  Description of Artificial Sequence: Synthetic oligonucleotide
  Target: SCN9A; (+) strand; PAM type: NRG; PAM sequence: TAG
gaagaagagttcaactgcaa

SEQ ID NO: 56506 - DNA, 20 bp, Artificial Sequence
  Description of Artificial Sequence: Synthetic oligonucleotide
  Target: SCN9A; (+) strand; PAM type: NRG; PAM sequence: AGG
aagaagagttcaactgcaat

SEQ ID NO: 56507 - DNA, 20 bp, Artificial Sequence
  Description of Artificial Sequence: Synthetic oligonucleotide
  Target: SCN9A; (+) strand; PAM type: NRG; PAM sequence: TGG
ttcaactgcaataggaataa

SEQ ID NO: 56508 - DNA, 20 bp, Artificial Sequence
  Description of Artificial Sequence: Synthetic oligonucleotide
  Target: SCN9A; (+) strand; PAM type: NRG; PAM sequence: TAG
ggaataatggtcttttttat

SEQ ID NO: 56509 - DNA, 20 bp, Artificial Sequence
  Description of Artificial Sequence: Synthetic oligonucleotide
  Target: SCN9A; (+) strand; PAM type: NRG; PAM sequence: AAG
tggtcttttttattagatgc

SEQ ID NO: 56510 - DNA, 20 bp, Artificial Sequence
  Description of Artificial Sequence: Synthetic oligonucleotide
  Target: SCN9A; (+) strand; PAM type: NRG; PAM sequence: TAG
tatttttaaaattttatttt

SEQ ID NO: 56511 - DNA, 20 bp, Artificial Sequence
  Description of Artificial Sequence: Synthetic oligonucleotide
  Target: SCN9A; (+) strand; PAM type: NRG; PAM sequence: GAG
tttttaaaattttattttta

SEQ ID NO: 56512 - DNA, 20 bp, Artificial Sequence
  Description of Artificial Sequence: Synthetic oligonucleotide
  Target: SCN9A; (+) strand; PAM type: NRG; PAM sequence: TAG
ttttatttttagagcaattt

SEQ ID NO: 56513 - DNA, 20 bp, Artificial Sequence
  Description of Artificial Sequence: Synthetic oligonucleotide
  Target: SCN9A; (+) strand; PAM type: NRG; PAM sequence: AGG
tttatttttagagcaatttt

SEQ ID NO: 56514 - DNA, 20 bp, Artificial Sequence
  Description of Artificial Sequence: Synthetic oligonucleotide
  Target: SCN9A; (+) strand; PAM type: NRG; PAM sequence: CAG
ttagagcaattttaggttca

SEQ ID NO: 56515 - DNA, 20 bp, Artificial Sequence
  Description of Artificial Sequence: Synthetic oligonucleotide
  Target: SCN9A; (+) strand; PAM type: NRG; PAM sequence: AAG
ttaggttcacagcaaaactg

SEQ ID NO: 56516 - DNA, 20 bp, Artificial Sequence
  Description of Artificial Sequence: Synthetic oligonucleotide
  Target: SCN9A; (+) strand; PAM type: NRG; PAM sequence: AGG
taggttcacagcaaaactga

SEQ ID NO: 56517 - DNA, 20 bp, Artificial Sequence
  Description of Artificial Sequence: Synthetic oligonucleotide
  Target: SCN9A; (+) strand; PAM type: NRG; PAM sequence: GGG
aggttcacagcaaaactgaa

SEQ ID NO: 56518 - DNA, 20 bp, Artificial Sequence
  Description of Artificial Sequence: Synthetic oligonucleotide
  Target: SCN9A; (+) strand; PAM type: NRG; PAM sequence: GAG
gttcacagcaaaactgaagg

SEQ ID NO: 56519 - DNA, 20 bp, Artificial Sequence
  Description of Artificial Sequence: Synthetic oligonucleotide
  Target: SCN9A; (+) strand; PAM type: NRG; PAM sequence: AGG
ttcacagcaaaactgaaggg

SEQ ID NO: 56520 - DNA, 20 bp, Artificial Sequence
  Description of Artificial Sequence: Synthetic oligonucleotide
  Target: SCN9A; (+) strand; PAM type: NRG; PAM sequence: GGG
tcacagcaaaactgaaggga

SEQ ID NO: 56521 - DNA, 20 bp, Artificial Sequence
  Description of Artificial Sequence: Synthetic oligonucleotide
  Target: SCN9A; (+) strand; PAM type: NRG; PAM sequence: CAG
gcaaaactgaagggagggta

SEQ ID NO: 56522 - DNA, 20 bp, Artificial Sequence
  Description of Artificial Sequence: Synthetic oligonucleotide
  Target: SCN9A; (+) strand; PAM type: NRG; PAM sequence: GAG
aaaactgaagggagggtaca

SEQ ID NO: 56523 - DNA, 20 bp, Artificial Sequence
  Description of Artificial Sequence: Synthetic oligonucleotide
  Target: SCN9A; (+) strand; PAM type: NRG; PAM sequence: AAG
cataaccgctactcccacac

SEQ ID NO: 56524 - DNA, 20 bp, Artificial Sequence
  Description of Artificial Sequence: Synthetic oligonucleotide
  Target: SCN9A; (+) strand; PAM type: NRG; PAM sequence: TAG
ccgctactcccacacaagaa

SEQ ID NO: 56525 - DNA, 20 bp, Artificial Sequence
  Description of Artificial Sequence: Synthetic oligonucleotide
  Target: SCN9A; (+) strand; PAM type: NRG; PAM sequence: CAG
ccattatcaacattccccac

SEQ ID NO: 56526 - DNA, 20 bp, Artificial Sequence
  Description of Artificial Sequence: Synthetic oligonucleotide
  Target: SCN9A; (+) strand; PAM type: NRG; PAM sequence: GAG
aaaattaatgaacttacttt

SEQ ID NO: 56527 - DNA, 20 bp, Artificial Sequence
  Description of Artificial Sequence: Synthetic oligonucleotide
  Target: SCN9A; (+) strand; PAM type: NRG; PAM sequence: AGG
aaattaatgaacttactttg

SEQ ID NO: 56528 - DNA, 20 bp, Artificial Sequence
  Description of Artificial Sequence: Synthetic oligonucleotide
  Target: SCN9A; (+) strand; PAM type: NRG; PAM sequence: AAG
ttgaggtttcattatctccc

SEQ ID NO: 56529 - DNA, 20 bp, Artificial Sequence
  Description of Artificial Sequence: Synthetic oligonucleotide
  Target: SCN9A; (+) strand; PAM type: NRG; PAM sequence: AGG
tgaggtttcattatctccca

SEQ ID NO: 56530 - DNA, 20 bp, Artificial Sequence
  Description of Artificial Sequence: Synthetic oligonucleotide
  Target: SCN9A; (+) strand; PAM type: NRG; PAM sequence: TAG
tcattatctcccaaggtctg

SEQ ID NO: 56531 - DNA, 20 bp, Artificial Sequence
  Description of Artificial Sequence: Synthetic oligonucleotide
  Target: SCN9A; (+) strand; PAM type: NRG; PAM sequence: TAG
caaggtctgtagttcacatt

SEQ ID NO: 56532 - DNA, 20 bp, Artificial Sequence
  Description of Artificial Sequence: Synthetic oligonucleotide
  Target: SCN9A; (+) strand; PAM type: NRG; PAM sequence: AGG
aaggtctgtagttcacattt

SEQ ID NO: 56533 - DNA, 20 bp, Artificial Sequence
  Description of Artificial Sequence: Synthetic oligonucleotide
  Target: SCN9A; (+) strand; PAM type: NRG; PAM sequence: GGG
aggtctgtagttcacattta

SEQ ID NO: 56534 - DNA, 20 bp, Artificial Sequence
  Description of Artificial Sequence: Synthetic oligonucleotide
  Target: SCN9A; (+) strand; PAM type: NRG; PAM sequence: TAG
ctgtagttcacatttagggt

SEQ ID NO: 56535 - DNA, 20 bp, Artificial Sequence
  Description of Artificial Sequence: Synthetic oligonucleotide
  Target: SCN9A; (+) strand; PAM type: NRG; PAM sequence: TGG
tcacatttagggttagctca

SEQ ID NO: 56536 - DNA, 20 bp, Artificial Sequence
  Description of Artificial Sequence: Synthetic oligonucleotide
  Target: SCN9A; (+) strand; PAM type: NRG; PAM sequence: TGG
tcatggtgttgtccattcta

SEQ ID NO: 56537 - DNA, 20 bp, Artificial Sequence
  Description of Artificial Sequence: Synthetic oligonucleotide
  Target: SCN9A; (+) strand; PAM type: NRG; PAM sequence: GGG
catggtgttgtccattctat

SEQ ID NO: 56538 - DNA, 20 bp, Artificial Sequence
  Description of Artificial Sequence: Synthetic oligonucleotide
  Target: SCN9A; (+) strand; PAM type: NRG; PAM sequence: GGG
atggtgttgtccattctatg

SEQ ID NO: 56539 - DNA, 20 bp, Artificial Sequence
  Description of Artificial Sequence: Synthetic oligonucleotide
  Target: SCN9A; (+) strand; PAM type: NRG; PAM sequence: TAG
tgttgtccattctatggggt

SEQ ID NO: 56540 - DNA, 20 bp, Artificial Sequence
  Description of Artificial Sequence: Synthetic oligonucleotide
  Target: SCN9A; (+) strand; PAM type: NRG; PAM sequence: AGG
gttgtccattctatggggtt

SEQ ID NO: 56541 - DNA, 20 bp, Artificial Sequence
  Description of Artificial Sequence: Synthetic oligonucleotide
  Target: SCN9A; (+) strand; PAM type: NRG; PAM sequence: CAG
atgacatgtatccaccatta

SEQ ID NO: 56542 - DNA, 20 bp, Artificial Sequence
  Description of Artificial Sequence: Synthetic oligonucleotide
  Target: SCN9A; (+) strand; PAM type: NRG; PAM sequence: CAG
tccaccattacagtatctta

SEQ ID NO: 56543 - DNA, 20 bp, Artificial Sequence
  Description of Artificial Sequence: Synthetic oligonucleotide
  Target: SCN9A; (+) strand; PAM type: NRG; PAM sequence: GAG
caccattacagtatcttaca

SEQ ID NO: 56544 - DNA, 20 bp, Artificial Sequence
  Description of Artificial Sequence: Synthetic oligonucleotide
  Target: SCN9A; (+) strand; PAM type: NRG; PAM sequence: CAG
agtatcttacagagtaattt

SEQ ID NO: 56545 - DNA, 20 bp, Artificial Sequence
  Description of Artificial Sequence: Synthetic oligonucleotide
  Target: SCN9A; (+) strand; PAM type: NRG; PAM sequence: TGG
tcatctcccatttcaacccc

SEQ ID NO: 56546 - DNA, 20 bp, Artificial Sequence
  Description of Artificial Sequence: Synthetic oligonucleotide
  Target: SCN9A; (+) strand; PAM type: NRG; PAM sequence: AAG
ctcccatttcaacccctggc

SEQ ID NO: 56547 - DNA, 20 bp, Artificial Sequence
  Description of Artificial Sequence: Synthetic oligonucleotide
  Target: SCN9A; (+) strand; PAM type: NRG; PAM sequence: TAG
tgatcattttactgtcttta

SEQ ID NO: 56548 - DNA, 20 bp, Artificial Sequence
  Description of Artificial Sequence: Synthetic oligonucleotide
  Target: SCN9A; (+) strand; PAM type: NRG; PAM sequence: CAG
ctttatagttttgccttctc

SEQ ID NO: 56549 - DNA, 20 bp, Artificial Sequence
  Description of Artificial Sequence: Synthetic oligonucleotide
  Target: SCN9A; (+) strand; PAM type: NRG; PAM sequence: AGG
tttatagttttgccttctcc

SEQ ID NO: 56550 - DNA, 20 bp, Artificial Sequence
  Description of Artificial Sequence: Synthetic oligonucleotide
  Target: SCN9A; (+) strand; PAM type: NRG; PAM sequence: TAG
gccttctccaggatatccta

SEQ ID NO: 56551 - DNA, 20 bp, Artificial Sequence
  Description of Artificial Sequence: Synthetic oligonucleotide
  Target: SCN9A; (+) strand; PAM type: NRG; PAM sequence: CAG
atcctatagttgcaataata

SEQ ID NO: 56552 - DNA, 20 bp, Artificial Sequence
  Description of Artificial Sequence: Synthetic oligonucleotide
  Target: SCN9A; (+) strand; PAM type: NRG; PAM sequence: TAG
agttgcaataatacagaata

SEQ ID NO: 56553 - DNA, 20 bp, Artificial Sequence
  Description of Artificial Sequence: Synthetic oligonucleotide
  Target: SCN9A; (+) strand; PAM type: NRG; PAM sequence: CAG
aatacagaatatagcccttt

SEQ ID NO: 56554 - DNA, 20 bp, Artificial Sequence
  Description of Artificial Sequence: Synthetic oligonucleotide
  Target: SCN9A; (+) strand; PAM type: NRG; PAM sequence: TAG
tcagattgactcctttcact

SEQ ID NO: 56555 - DNA, 20 bp, Artificial Sequence
  Description of Artificial Sequence: Synthetic oligonucleotide
  Target: SCN9A; (+) strand; PAM type: NRG; PAM sequence: TAG
ttcacttagcaatatgcttt

SEQ ID NO: 56556 - DNA, 20 bp, Artificial Sequence
  Description of Artificial Sequence: Synthetic oligonucleotide
  Target: SCN9A; (+) strand; PAM type: NRG; PAM sequence: TGG
atgcttttagttttcctcca

SEQ ID NO: 56557 - DNA, 20 bp, Artificial Sequence
  Description of Artificial Sequence: Synthetic oligonucleotide
  Target: SCN9A; (+) strand; PAM type: NRG; PAM sequence: TAG
ttttcctccatggcttttca

SEQ ID NO: 56558 - DNA, 20 bp, Artificial Sequence
  Description of Artificial Sequence: Synthetic oligonucleotide
  Target: SCN9A; (+) strand; PAM type: NRG; PAM sequence: TAG
catggcttttcatagcttga

SEQ ID NO: 56559 - DNA, 20 bp, Artificial Sequence
  Description of Artificial Sequence: Synthetic oligonucleotide
  Target: SCN9A; (+) strand; PAM type: NRG; PAM sequence: CAG
cttgatagctcatttcttta

SEQ ID NO: 56560 - DNA, 20 bp, Artificial Sequence
  Description of Artificial Sequence: Synthetic oligonucleotide
  Target: SCN9A; (+) strand; PAM type: NRG; PAM sequence: TGG
ctgaataatattccattgac

SEQ ID NO: 56561 - DNA, 20 bp, Artificial Sequence
  Description of Artificial Sequence: Synthetic oligonucleotide
  Target: SCN9A; (+) strand; PAM type: NRG; PAM sequence: TGG
aataatattccattgactgg

SEQ ID NO: 56562 - DNA, 20 bp, Artificial Sequence
  Description of Artificial Sequence: Synthetic oligonucleotide
  Target: SCN9A; (+) strand; PAM type: NRG; PAM sequence: TAG
tccattgactggtggtacca

SEQ ID NO: 56563 - DNA, 20 bp, Artificial Sequence
  Description of Artificial Sequence: Synthetic oligonucleotide
  Target: SCN9A; (+) strand; PAM type: NRG; PAM sequence: AAG
gtttattcattcacctactg

SEQ ID NO: 56564 - DNA, 20 bp, Artificial Sequence
  Description of Artificial Sequence: Synthetic oligonucleotide
  Target: SCN9A; (+) strand; PAM type: NRG; PAM sequence: AGG
tttattcattcacctactga

SEQ ID NO: 56565 - DNA, 20 bp, Artificial Sequence
  Description of Artificial Sequence: Synthetic oligonucleotide
  Target: SCN9A; (+) strand; PAM type: NRG; PAM sequence: AAG
aggacatcttgtttgcttcc

SEQ ID NO: 56566 - DNA, 20 bp, Artificial Sequence
  Description of Artificial Sequence: Synthetic oligonucleotide
  Target: SCN9A; (+) strand; PAM type: NRG; PAM sequence: TAG
tcttgtttgcttccaagttt

SEQ ID NO: 56567 - DNA, 20 bp, Artificial Sequence
  Description of Artificial Sequence: Synthetic oligonucleotide
  Target: SCN9A; (+) strand; PAM type: NRG; PAM sequence: AAG
agttttagcaattatgcgta

SEQ ID NO: 56568 - DNA, 20 bp, Artificial Sequence
  Description of Artificial Sequence: Synthetic oligonucleotide
  Target: SCN9A; (+) strand; PAM type: NRG; PAM sequence: AAG
cctctataaacatctttgtg

SEQ ID NO: 56569 - DNA, 20 bp, Artificial Sequence
  Description of Artificial Sequence: Synthetic oligonucleotide
  Target: SCN9A; (+) strand; PAM type: NRG; PAM sequence: AGG
ctctataaacatctttgtga

SEQ ID NO: 56570 - DNA, 20 bp, Artificial Sequence
  Description of Artificial Sequence: Synthetic oligonucleotide
  Target: SCN9A; (+) strand; PAM type: NRG; PAM sequence: TGG
tctttgtgaaggttactgtg

SEQ ID NO: 56571 - DNA, 20 bp, Artificial Sequence
  Description of Artificial Sequence: Synthetic oligonucleotide
  Target: SCN9A; (+) strand; PAM type: NRG; PAM sequence: AAG
tactgtgtggacatgttttc

SEQ ID NO: 56572 - DNA, 20 bp, Artificial Sequence
  Description of Artificial Sequence: Synthetic oligonucleotide
  Target: SCN9A; (+) strand; PAM type: NRG; PAM sequence: TGG
ggacatgttttcaagtcctt

SEQ ID NO: 56573 - DNA, 20 bp, Artificial Sequence
  Description of Artificial Sequence: Synthetic oligonucleotide
  Target: SCN9A; (+) strand; PAM type: NRG; PAM sequence: GGG
gacatgttttcaagtccttt

SEQ ID NO: 56574 - DNA, 20 bp, Artificial Sequence
  Description of Artificial Sequence: Synthetic oligonucleotide
  Target: SCN9A; (+) strand; PAM type: NRG; PAM sequence: AAG
aagtcctttgggtgaacatc

SEQ ID NO: 56575 - DNA, 20 bp, Artificial Sequence
  Description of Artificial Sequence: Synthetic oligonucleotide
  Target: SCN9A; (+) strand; PAM type: NRG; PAM sequence: AGG
agtcctttgggtgaacatca

SEQ ID NO: 56576 - DNA, 20 bp, Artificial Sequence
  Description of Artificial Sequence: Synthetic oligonucleotide
  Target: SCN9A; (+) strand; PAM type: NRG; PAM sequence: GAG
tcctttgggtgaacatcaag

SEQ ID NO: 56577 - DNA, 20 bp, Artificial Sequence
  Description of Artificial Sequence: Synthetic oligonucleotide
  Target: SCN9A; (+) strand; PAM type: NRG; PAM sequence: TGG
acatcaaggagcacaattgc

SEQ ID NO: 56578 - DNA, 20 bp, Artificial Sequence
  Description of Artificial Sequence: Synthetic oligonucleotide
  Target: SCN9A; (+) strand; PAM type: NRG; PAM sequence: TGG
agcacaattgctggatcata

SEQ ID NO: 56579 - DNA, 20 bp, Artificial Sequence
  Description of Artificial Sequence: Synthetic oligonucleotide
  Target: SCN9A; (+) strand; PAM type: NRG; PAM sequence: GAG
caattgctggatcatatggt

SEQ ID NO: 56580 - DNA, 20 bp, Artificial Sequence
  Description of Artificial Sequence: Synthetic oligonucleotide
  Target: SCN9A; (+) strand; PAM type: NRG; PAM sequence: GAG
attgctggatcatatggtga

SEQ ID NO: 56581 - DNA, 20 bp, Artificial Sequence
  Description of Artificial Sequence: Synthetic oligonucleotide
  Target: SCN9A; (+) strand; PAM type: NRG; PAM sequence: TAG
tcatatggtgagagtatgtt

SEQ ID NO: 56582 - DNA, 20 bp, Artificial Sequence
  Description of Artificial Sequence: Synthetic oligonucleotide
  Target: SCN9A; (+) strand; PAM type: NRG; PAM sequence: AAG
gagagtatgtttagttttta

SEQ ID NO: 56583 - DNA, 20 bp, Artificial Sequence
  Description of Artificial Sequence: Synthetic oligonucleotide
  Target: SCN9A; (+) strand; PAM type: NRG; PAM sequence: AAG
aaactgctacactgtcctca

SEQ ID NO: 56584 - DNA, 20 bp, Artificial Sequence
  Description of Artificial Sequence: Synthetic oligonucleotide
  Target: SCN9A; (+) strand; PAM type: NRG; PAM sequence: TGG
ctgctacactgtcctcaaag

SEQ ID NO: 56585 - DNA, 20 bp, Artificial Sequence
  Description of Artificial Sequence: Synthetic oligonucleotide
  Target: SCN9A; (+) strand; PAM type: NRG; PAM sequence: TGG
tacactgtcctcaaagtggc

SEQ ID NO: 56586 - DNA, 20 bp, Artificial Sequence
  Description of Artificial Sequence: Synthetic oligonucleotide
  Target: SCN9A; (+) strand; PAM type: NRG; PAM sequence: GAG
cactgtcctcaaagtggctg

SEQ ID NO: 56587 - DNA, 20 bp, Artificial Sequence
  Description of Artificial Sequence: Synthetic oligonucleotide
  Target: SCN9A; (+) strand; PAM type: NRG; PAM sequence: CAG
ggagcattttgcattcccac

SEQ ID NO: 56588 - DNA, 20 bp, Artificial Sequence
  Description of Artificial Sequence: Synthetic oligonucleotide
  Target: SCN9A; (+) strand; PAM type: NRG; PAM sequence: GAG
cattcccaccagcaatacat

SEQ ID NO: 56589 - DNA, 20 bp, Artificial Sequence
  Description of Artificial Sequence: Synthetic oligonucleotide
  Target: SCN9A; (+) strand; PAM type: NRG; PAM sequence: GAG
ttcccaccagcaatacatga

SEQ ID NO: 56590 - DNA, 20 bp, Artificial Sequence
  Description of Artificial Sequence: Synthetic oligonucleotide
  Target: SCN9A; (+) strand; PAM type: NRG; PAM sequence: TGG
ttcctgttgcctcacatcct

SEQ ID NO: 56591 - DNA, 20 bp, Artificial Sequence
  Description of Artificial Sequence: Synthetic oligonucleotide
  Target: SCN9A; (+) strand; PAM type: NRG; PAM sequence: CAG
tgttgcctcacatccttggc

SEQ ID NO: 56592 - DNA, 20 bp, Artificial Sequence
  Description of Artificial Sequence: Synthetic oligonucleotide
  Target: SCN9A; (+) strand; PAM type: NRG; PAM sequence: CAG
tggccagaacttgatatcat

SEQ ID NO: 56593 - DNA, 20 bp, Artificial Sequence
  Description of Artificial Sequence: Synthetic oligonucleotide
  Target: SCN9A; (+) strand; PAM type: NRG; PAM sequence: TGG
acttgatatcatcagtgttc

SEQ ID NO: 56594 - DNA, 20 bp, Artificial Sequence
  Description of Artificial Sequence: Synthetic oligonucleotide
  Target: SCN9A; (+) strand; PAM type: NRG; PAM sequence: TGG
atcatcagtgttctggattt

SEQ ID NO: 56595 - DNA, 20 bp, Artificial Sequence
  Description of Artificial Sequence: Synthetic oligonucleotide
  Target: SCN9A; (+) strand; PAM type: NRG; PAM sequence: TGG
tggttattccaatacatatg

SEQ ID NO: 56596 - DNA, 20 bp, Artificial Sequence
  Description of Artificial Sequence: Synthetic oligonucleotide
  Target: SCN9A; (+) strand; PAM type: NRG; PAM sequence: TGG
ttattccaatacatatgtgg

SEQ ID NO: 56597 - DNA, 20 bp, Artificial Sequence
  Description of Artificial Sequence: Synthetic oligonucleotide
  Target: SCN9A; (+) strand; PAM type: NRG; PAM sequence: AAG
atgcccattgttgataccat

SEQ ID NO: 56598 - DNA, 20 bp, Artificial Sequence
  Description of Artificial Sequence: Synthetic oligonucleotide
  Target: SCN9A; (+) strand; PAM type: NRG; PAM sequence: TGG
ttcccctgtgatatatgatg

SEQ ID NO: 56599 - DNA, 20 bp, Artificial Sequence
  Description of Artificial Sequence: Synthetic oligonucleotide
  Target: SCN9A; (+) strand; PAM type: NRG; PAM sequence: TGG
tgcaatatgtgcatcttctt

SEQ ID NO: 56600 - DNA, 20 bp, Artificial Sequence
  Description of Artificial Sequence: Synthetic oligonucleotide
  Target: SCN9A; (+) strand; PAM type: NRG; PAM sequence: AAG
tgcatcttctttggtctgtt

SEQ ID NO: 56601 - DNA, 20 bp, Artificial Sequence
  Description of Artificial Sequence: Synthetic oligonucleotide
  Target: SCN9A; (+) strand; PAM type: NRG; PAM sequence: AGG
gcatcttctttggtctgtta

SEQ ID NO: 56602 - DNA, 20 bp, Artificial Sequence
  Description of Artificial Sequence: Synthetic oligonucleotide
  Target: SCN9A; (+) strand; PAM type: NRG; PAM sequence: TGG
ctttggtctgttaaggtata

SEQ ID NO: 56603 - DNA, 20 bp, Artificial Sequence
  Description of Artificial Sequence: Synthetic oligonucleotide
  Target: SCN9A; (+) strand; PAM type: NRG; PAM sequence: TGG
atatggcccatttttttcat

SEQ ID NO: 56604 - DNA, 20 bp, Artificial Sequence
  Description of Artificial Sequence: Synthetic oligonucleotide
  Target: SCN9A; (+) strand; PAM type: NRG; PAM sequence: GGG
tatggcccatttttttcatt

SEQ ID NO: 56605 - DNA, 20 bp, Artificial Sequence
  Description of Artificial Sequence: Synthetic oligonucleotide
  Target: SCN9A; (+) strand; PAM type: NRG; PAM sequence: GAG
ttatttcttttcttgttgtt

SEQ ID NO: 56606 - DNA, 20 bp, Artificial Sequence
  Description of Artificial Sequence: Synthetic oligonucleotide
  Target: SCN9A; (+) strand; PAM type: NRG; PAM sequence: AAG
ttttcttgttgttgagtttt

SEQ ID NO: 56607 - DNA, 20 bp, Artificial Sequence
  Description of Artificial Sequence: Synthetic oligonucleotide
  Target: SCN9A; (+) strand; PAM type: NRG; PAM sequence: TGG
taagctttatttgtatattt

SEQ ID NO: 56608 - DNA, 20 bp, Artificial Sequence
  Description of Artificial Sequence: Synthetic oligonucleotide
  Target: SCN9A; (+) strand; PAM type: NRG; PAM sequence: CAG
tatttgtatattttggttaa

SEQ ID NO: 56609 - DNA, 20 bp, Artificial Sequence
  Description of Artificial Sequence: Synthetic oligonucleotide
  Target: SCN9A; (+) strand; PAM type: NRG; PAM sequence: CAG
tttggttaacagtcatttgt

SEQ ID NO: 56610 - DNA, 20 bp, Artificial Sequence
  Description of Artificial Sequence: Synthetic oligonucleotide
  Target: SCN9A; (+) strand; PAM type: NRG; PAM sequence: TGG
tgcaaatatttatctaacac

SEQ ID NO: 56611 - DNA, 20 bp, Artificial Sequence
  Description of Artificial Sequence: Synthetic oligonucleotide
  Target: SCN9A; (+) strand; PAM type: NRG; PAM sequence: CAG
tggcttgttgtccgtttttg

SEQ ID NO: 56612 - DNA, 20 bp, Artificial Sequence
  Description of Artificial Sequence: Synthetic oligonucleotide
  Target: SCN9A; (+) strand; PAM type: NRG; PAM sequence: GAG
gcttgttgtccgtttttgca

SEQ ID NO: 56613 - DNA, 20 bp, Artificial Sequence
  Description of Artificial Sequence: Synthetic oligonucleotide
  Target: SCN9A; (+) strand; PAM type: NRG; PAM sequence: CAG
tgttgtccgtttttgcagag

SEQ ID NO: 56614 - DNA, 20 bp, Artificial Sequence
  Description of Artificial Sequence: Synthetic oligonucleotide
  Target: SCN9A; (+) strand; PAM type: NRG; PAM sequence: AAG
tgtccgtttttgcagagcag

SEQ ID NO: 56615 - DNA, 20 bp, Artificial Sequence
  Description of Artificial Sequence: Synthetic oligonucleotide
  Target: SCN9A; (+) strand; PAM type: NRG; PAM sequence: CAG
agaagtttttaattttaatg

SEQ ID NO: 56616 - DNA, 20 bp, Artificial Sequence
  Description of Artificial Sequence: Synthetic oligonucleotide
  Target: SCN9A; (+) strand; PAM type: NRG; PAM sequence: TAG
aattttaatgcagttcacct

SEQ ID NO: 56617 - DNA, 20 bp, Artificial Sequence
  Description of Artificial Sequence: Synthetic oligonucleotide
  Target: SCN9A; (+) strand; PAM type: NRG; PAM sequence: TAG
cttagcaattatgtctctta

SEQ ID NO: 56618 - DNA, 20 bp, Artificial Sequence
  Description of Artificial Sequence: Synthetic oligonucleotide
  Target: SCN9A; (+) strand; PAM type: NRG; PAM sequence: TAG
tatgcctttgctgttatatc

SEQ ID NO: 56619 - DNA, 20 bp, Artificial Sequence
  Description of Artificial Sequence: Synthetic oligonucleotide
  Target: SCN9A; (+) strand; PAM type: NRG; PAM sequence: TAG
atctagaataacacatatgt

SEQ ID NO: 56620 - DNA, 20 bp, Artificial Sequence
  Description of Artificial Sequence: Synthetic oligonucleotide
  Target: SCN9A; (+) strand; PAM type: NRG; PAM sequence: TAG
acatatgttagatacattct

SEQ ID NO: 56621 - DNA, 20 bp, Artificial Sequence
  Description of Artificial Sequence: Synthetic oligonucleotide
  Target: SCN9A; (+) strand; PAM type: NRG; PAM sequence: GAG
atatgttagatacattctta

SEQ ID NO: 56622 - DNA, 20 bp, Artificial Sequence
  Description of Artificial Sequence: Synthetic oligonucleotide
  Target: SCN9A; (+) strand; PAM type: NRG; PAM sequence: TGG
tgttagatacattcttagag

SEQ ID NO: 56623 - DNA, 20 bp, Artificial Sequence
  Description of Artificial Sequence: Synthetic oligonucleotide
  Target: SCN9A; (+) strand; PAM type: NRG; PAM sequence: AAG
catattatatattccacttt

SEQ ID NO: 56624 - DNA, 20 bp, Artificial Sequence
  Description of Artificial Sequence: Synthetic oligonucleotide
  Target: SCN9A; (+) strand; PAM type: NRG; PAM sequence: AAG
cactttaagcatccattaac

SEQ ID NO: 56625 - DNA, 20 bp, Artificial Sequence
  Description of Artificial Sequence: Synthetic oligonucleotide
  Target: SCN9A; (+) strand; PAM type: NRG; PAM sequence: TAG
cttactattctcaatatatc

SEQ ID NO: 56626 - DNA, 20 bp, Artificial Sequence
  Description of Artificial Sequence: Synthetic oligonucleotide
  Target: SCN9A; (+) strand; PAM type: NRG; PAM sequence: AGG
ttactattctcaatatatct

SEQ ID NO: 56627 - DNA, 20 bp, Artificial Sequence
  Description of Artificial Sequence: Synthetic oligonucleotide
  Target: SCN9A; (+) strand; PAM type: NRG; PAM sequence: TAG
caatatatctaggttcttgt

SEQ ID NO: 56628 - DNA, 20 bp, Artificial Sequence
  Description of Artificial Sequence: Synthetic oligonucleotide
  Target: SCN9A; (+) strand; PAM type: NRG; PAM sequence: GAG
atatatctaggttcttgtta

SEQ ID NO: 56629 - DNA, 20 bp, Artificial Sequence
  Description of Artificial Sequence: Synthetic oligonucleotide
  Target: SCN9A; (+) strand; PAM type: NRG; PAM sequence: TGG
gatcttcaaacataaaatcc

SEQ ID NO: 56630 - DNA, 20 bp, Artificial Sequence
  Description of Artificial Sequence: Synthetic oligonucleotide
  Target: SCN9A; (+) strand; PAM type: NRG; PAM sequence: TGG
aaccaaaaataaaatcctct

SEQ ID NO: 56631 - DNA, 20 bp, Artificial Sequence
  Description of Artificial Sequence: Synthetic oligonucleotide
  Target: SCN9A; (+) strand; PAM type: NRG; PAM sequence: GAG
aaaatcctcttggtctgact

SEQ ID NO: 56632 - DNA, 20 bp, Artificial Sequence
  Description of Artificial Sequence: Synthetic oligonucleotide
  Target: SCN9A; (+) strand; PAM type: NRG; PAM sequence: AGG
aaatcctcttggtctgactg

SEQ ID NO: 56633 - DNA, 20 bp, Artificial Sequence
  Description of Artificial Sequence: Synthetic oligonucleotide
  Target: SCN9A; (+) strand; PAM type: NRG; PAM sequence: GGG
aatcctcttggtctgactga

SEQ ID NO: 56634 - DNA, 20 bp, Artificial Sequence
  Description of Artificial Sequence: Synthetic oligonucleotide
  Target: SCN9A; (+) strand; PAM type: NRG; PAM sequence: CAG
tctgactgagggatcccttg

SEQ ID NO: 56635 - DNA, 20 bp, Artificial Sequence
  Description of Artificial Sequence: Synthetic oligonucleotide
  Target: SCN9A; (+) strand; PAM type: NRG; PAM sequence: AGG
ctgactgagggatcccttgc

SEQ ID NO: 56636 - DNA, 20 bp, Artificial Sequence
  Description of Artificial Sequence: Synthetic oligonucleotide
  Target: SCN9A; (+) strand; PAM type: NRG; PAM sequence: GAG
ccttgcaggattttccctgt

SEQ ID NO: 56637 - DNA, 20 bp, Artificial Sequence
  Description of Artificial Sequence: Synthetic oligonucleotide
  Target: SCN9A; (+) strand; PAM type: NRG; PAM sequence: TAG
ggattttccctgtgagctca

SEQ ID NO: 56638 - DNA, 20 bp, Artificial Sequence
  Description of Artificial Sequence: Synthetic oligonucleotide
  Target: SCN9A; (+) strand; PAM type: NRG; PAM sequence: AGG
gattttccctgtgagctcat

SEQ ID NO: 56639 - DNA, 20 bp, Artificial Sequence
  Description of Artificial Sequence: Synthetic oligonucleotide
  Target: SCN9A; (+) strand; PAM type: NRG; PAM sequence: AAG
tccctgtgagctcataggca

SEQ ID NO: 56640 - DNA, 20 bp, Artificial Sequence
  Description of Artificial Sequence: Synthetic oligonucleotide
  Target: SCN9A; (+) strand; PAM type: NRG; PAM sequence: TAG
tgagctcataggcaaagcat

SEQ ID NO: 56641 - DNA, 20 bp, Artificial Sequence
  Description of Artificial Sequence: Synthetic oligonucleotide
  Target: SCN9A; (+) strand; PAM type: NRG; PAM sequence: AGG
gagctcataggcaaagcatt

SEQ ID NO: 56642 - DNA, 20 bp, Artificial Sequence
  Description of Artificial Sequence: Synthetic oligonucleotide
  Target: SCN9A; (+) strand; PAM type: NRG; PAM sequence: TAG
tttcttttatgtgccattcc

SEQ ID NO: 56643 - DNA, 20 bp, Artificial Sequence
  Description of Artificial Sequence: Synthetic oligonucleotide
  Target: SCN9A; (+) strand; PAM type: NRG; PAM sequence: CAG
tatgtgccattcctagtcta

SEQ ID NO: 56644 - DNA, 20 bp, Artificial Sequence
  Description of Artificial Sequence: Synthetic oligonucleotide
  Target: SCN9A; (+) strand; PAM type: NRG; PAM sequence: TAG
attcctagtctacagaacat

SEQ ID NO: 56645 - DNA, 20 bp, Artificial Sequence
  Description of Artificial Sequence: Synthetic oligonucleotide
  Target: SCN9A; (+) strand; PAM type: NRG; PAM sequence: TGG
ttgtgtttttcttgctcttt

SEQ ID NO: 56646 - DNA, 20 bp, Artificial Sequence
  Description of Artificial Sequence: Synthetic oligonucleotide
  Target: SCN9A; (+) strand; PAM type: NRG; PAM sequence: CAG
tgtttttcttgctcttttgg

SEQ ID NO: 56647 - DNA, 20 bp, Artificial Sequence
  Description of Artificial Sequence: Synthetic oligonucleotide
  Target: SCN9A; (+) strand; PAM type: NRG; PAM sequence: TAG
tcttgctcttttggcagccc

SEQ ID NO: 56648 - DNA, 20 bp, Artificial Sequence
  Description of Artificial Sequence: Synthetic oligonucleotide
  Target: SCN9A; (+) strand; PAM type: NRG; PAM sequence: TGG
cagccctagaaattttatct

SEQ ID NO: 56649 - DNA, 20 bp, Artificial Sequence
  Description of Artificial Sequence: Synthetic oligonucleotide
  Target: SCN9A; (+) strand; PAM type: NRG; PAM sequence: CAG
attttatcttggtttaaacc

SEQ ID NO: 56650 - DNA, 20 bp, Artificial Sequence
  Description of Artificial Sequence: Synthetic oligonucleotide
  Target: SCN9A; (+) strand; PAM type: NRG; PAM sequence: AAG
tcttggtttaaacccagaaa

SEQ ID NO: 56651 - DNA, 20 bp, Artificial Sequence
  Description of Artificial Sequence: Synthetic oligonucleotide
  Target: SCN9A; (+) strand; PAM type: NRG; PAM sequence: CAG
ttattaaatactacactgca

SEQ ID NO: 56652 - DNA, 20 bp, Artificial Sequence
  Description of Artificial Sequence: Synthetic oligonucleotide
  Target: SCN9A; (+) strand; PAM type: NRG; PAM sequence: GAG
atactacactgcacagcctt

SEQ ID NO: 56653 - DNA, 20 bp, Artificial Sequence
  Description of Artificial Sequence: Synthetic oligonucleotide
  Target: SCN9A; (+) strand; PAM type: NRG; PAM sequence: GAG
actacactgcacagccttga

SEQ ID NO: 56654 - DNA, 20 bp, Artificial Sequence
  Description of Artificial Sequence: Synthetic oligonucleotide
  Target: SCN9A; (+) strand; PAM type: NRG; PAM sequence: CAG
gttcattaaacactaaatga

SEQ ID NO: 56655 - DNA, 20 bp, Artificial Sequence
  Description of Artificial Sequence: Synthetic oligonucleotide
  Target: SCN9A; (+) strand; PAM type: NRG; PAM sequence: CAG
taaacactaaatgacagcgt

SEQ ID NO: 56656 - DNA, 20 bp, Artificial Sequence
  Description of Artificial Sequence: Synthetic oligonucleotide
  Target: SCN9A; (+) strand; PAM type: NRG; PAM sequence: TAG
ctaaatgacagcgtcagatg

SEQ ID NO: 56657 - DNA, 20 bp, Artificial Sequence
  Description of Artificial Sequence: Synthetic oligonucleotide
  Target: SCN9A; (+) strand; PAM type: NRG; PAM sequence: AAG
acagcgtcagatgtagacat

SEQ ID NO: 56658 - DNA, 20 bp, Artificial Sequence
  Description of Artificial Sequence: Synthetic oligonucleotide
  Target: SCN9A; (+) strand; PAM type: NRG; PAM sequence: TAG
gcgtcagatgtagacataag

SEQ ID NO: 56659 - DNA, 20 bp, Artificial Sequence
  Description of Artificial Sequence: Synthetic oligonucleotide
  Target: SCN9A; (+) strand; PAM type: NRG; PAM sequence: TGG
cagatgtagacataagtaga

SEQ ID NO: 56660 - DNA, 20 bp, Artificial Sequence
  Description of Artificial Sequence: Synthetic oligonucleotide
  Target: SCN9A; (+) strand; PAM type: NRG; PAM sequence: AAG
gatggtacgtttaaaattta

SEQ ID NO: 56661 - DNA, 20 bp, Artificial Sequence
  Description of Artificial Sequence: Synthetic oligonucleotide
  Target: SCN9A; (+) strand; PAM type: NRG; PAM sequence: AGG
atggtacgtttaaaatttaa

SEQ ID NO: 56662 - DNA, 20 bp, Artificial Sequence
  Description of Artificial Sequence: Synthetic oligonucleotide
  Target: SCN9A; (+) strand; PAM type: NRG; PAM sequence: GGG
tggtacgtttaaaatttaaa

SEQ ID NO: 56663 - DNA, 20 bp, Artificial Sequence
  Description of Artificial Sequence: Synthetic oligonucleotide
  Target: SCN9A; (+) strand; PAM type: NRG; PAM sequence: TAG
tacgtttaaaatttaaaggg

SEQ ID NO: 56664 - DNA, 20 bp, Artificial Sequence
  Description of Artificial Sequence: Synthetic oligonucleotide
  Target: SCN9A; (+) strand; PAM type: NRG; PAM sequence: AGG
acgtttaaaatttaaagggt

SEQ ID NO: 56665 - DNA, 20 bp, Artificial Sequence
  Description of Artificial Sequence: Synthetic oligonucleotide
  Target: SCN9A; (+) strand; PAM type: NRG; PAM sequence: AAG
ttaaagggtaggcttgaatt

SEQ ID NO: 56666 - DNA, 20 bp, Artificial Sequence
  Description of Artificial Sequence: Synthetic oligonucleotide
  Target: SCN9A; (+) strand; PAM type: NRG; PAM sequence: AGG
taaagggtaggcttgaatta

SEQ ID NO: 56667 - DNA, 20 bp, Artificial Sequence
  Description of Artificial Sequence: Synthetic oligonucleotide
  Target: SCN9A; (+) strand; PAM type: NRG; PAM sequence: GGG
aaagggtaggcttgaattaa

SEQ ID NO: 56668 - DNA, 20 bp, Artificial Sequence
  Description of Artificial Sequence: Synthetic oligonucleotide
  Target: SCN9A; (+) strand; PAM type: NRG; PAM sequence: CAG
taggcttgaattaagggaac

SEQ ID NO: 56669 - DNA, 20 bp, Artificial Sequence
  Description of Artificial Sequence: Synthetic oligonucleotide
  Target: SCN9A; (+) strand; PAM type: NRG; PAM sequence: AAG
tgaattaagggaaccagaca

SEQ ID NO: 56670 - DNA, 20 bp, Artificial Sequence
  Description of Artificial Sequence: Synthetic oligonucleotide
  Target: SCN9A; (+) strand; PAM type: NRG; PAM sequence: TGG
ggaaccagacaaagcctgtc

SEQ ID NO: 56671 - DNA, 20 bp, Artificial Sequence
  Description of Artificial Sequence: Synthetic oligonucleotide
  Target: SCN9A; (+) strand; PAM type: NRG; PAM sequence: AAG
caaagcctgtctggttgaaa

SEQ ID NO: 56672 - DNA, 20 bp, Artificial Sequence
  Description of Artificial Sequence: Synthetic oligonucleotide
  Target: SCN9A; (+) strand; PAM type: NRG; PAM sequence: AAG
tgaaaaagccaataaccaat

SEQ ID NO: 56673 - DNA, 20 bp, Artificial Sequence
  Description of Artificial Sequence: Synthetic oligonucleotide
  Target: SCN9A; (+) strand; PAM type: NRG; PAM sequence: TAG
acaactgaccttccgtaact

SEQ ID NO: 56674 - DNA, 20 bp, Artificial Sequence
  Description of Artificial Sequence: Synthetic oligonucleotide
  Target: SCN9A; (+) strand; PAM type: NRG; PAM sequence: TAG
ctgaccttccgtaacttaga

SEQ ID NO: 56675 - DNA, 20 bp, Artificial Sequence
  Description of Artificial Sequence: Synthetic oligonucleotide
  Target: SCN9A; (+) strand; PAM type: NRG; PAM sequence: TGG
gtaacttagatagaaaaatg

SEQ ID NO: 56676 - DNA, 20 bp, Artificial Sequence
  Description of Artificial Sequence: Synthetic oligonucleotide
  Target: SCN9A; (+) strand; PAM type: NRG; PAM sequence: GAG
tagaaaaatgtggaaatgtt

SEQ ID NO: 56677 - DNA, 20 bp, Artificial Sequence
  Description of Artificial Sequence: Synthetic oligonucleotide
  Target: SCN9A; (+) strand; PAM type: NRG; PAM sequence: TGG
aatgtggaaatgttgagtca

SEQ ID NO: 56678 - DNA, 20 bp, Artificial Sequence
  Description of Artificial Sequence: Synthetic oligonucleotide
  Target: SCN9A; (+) strand; PAM type: NRG; PAM sequence: CAG
taacatcatacaatccatac

SEQ ID NO: 56679 - DNA, 20 bp, Artificial Sequence
  Description of Artificial Sequence: Synthetic oligonucleotide
  Target: SCN9A; (+) strand; PAM type: NRG; PAM sequence: TAG
tcatacaatccataccagaa

SEQ ID NO: 56680 - DNA, 20 bp, Artificial Sequence
  Description of Artificial Sequence: Synthetic oligonucleotide
  Target: SCN9A; (+) strand; PAM type: NRG; PAM sequence: AGG
catacaatccataccagaat

SEQ ID NO: 56681 - DNA, 20 bp, Artificial Sequence
  Description of Artificial Sequence: Synthetic oligonucleotide
  Target: SCN9A; (+) strand; PAM type: NRG; PAM sequence: AAG
atccataccagaataggaat

SEQ ID NO: 56682 - DNA, 20 bp, Artificial Sequence
  Description of Artificial Sequence: Synthetic oligonucleotide
  Target: SCN9A; (+) strand; PAM type: NRG; PAM sequence: TAG
aataagaattttatttccct

SEQ ID NO: 56683 - DNA, 20 bp, Artificial Sequence
  Description of Artificial Sequence: Synthetic oligonucleotide
  Target: SCN9A; (+) strand; PAM type: NRG; PAM sequence: GAG
agaattttatttcccttagt

SEQ ID NO: 56684 - DNA, 20 bp, Artificial Sequence
  Description of Artificial Sequence: Synthetic oligonucleotide
  Target: SCN9A; (+) strand; PAM type: NRG; PAM sequence: TGG
ttcccttagtgagaaataaa

SEQ ID NO: 56685 - DNA, 20 bp, Artificial Sequence
  Description of Artificial Sequence: Synthetic oligonucleotide
  Target: SCN9A; (+) strand; PAM type: NRG; PAM sequence: TAG
cactgcaattttcaaaactg

SEQ ID NO: 56686 - DNA, 20 bp, Artificial Sequence
  Description of Artificial Sequence: Synthetic oligonucleotide
  Target: SCN9A; (+) strand; PAM type: NRG; PAM sequence: AAG
tgcaattttcaaaactgtag

SEQ ID NO: 56687 - DNA, 20 bp, Artificial Sequence
  Description of Artificial Sequence: Synthetic oligonucleotide
  Target: SCN9A; (+) strand; PAM type: NRG; PAM sequence: TGG
ttcaaaactgtagaagtttc

SEQ ID NO: 56688 - DNA, 20 bp, Artificial Sequence
  Description of Artificial Sequence: Synthetic oligonucleotide
  Target: SCN9A; (+) strand; PAM type: NRG; PAM sequence: AAG
aaaactgtagaagtttctgg

SEQ ID NO: 56689 - DNA, 20 bp, Artificial Sequence
  Description of Artificial Sequence: Synthetic oligonucleotide
  Target: SCN9A; (+) strand; PAM type: NRG; PAM sequence: TAG
gtttctggaagaacaaaaaa

SEQ ID NO: 56690 - DNA, 20 bp, Artificial Sequence
  Description of Artificial Sequence: Synthetic oligonucleotide
  Target: SCN9A; (+) strand; PAM type: NRG; PAM sequence: CAG
ctggaagaacaaaaaataga

SEQ ID NO: 56691 - DNA, 20 bp, Artificial Sequence
  Description of Artificial Sequence: Synthetic oligonucleotide
  Target: SCN9A; (+) strand; PAM type: NRG; PAM sequence: AAG
aaaaaatagacagtaatatt

SEQ ID NO: 56692 - DNA, 20 bp, Artificial Sequence
  Description of Artificial Sequence: Synthetic oligonucleotide
  Target: SCN9A; (+) strand; PAM type: NRG; PAM sequence: AGG
aaaaatagacagtaatatta

SEQ ID NO: 56693 - DNA, 20 bp, Artificial Sequence
  Description of Artificial Sequence: Synthetic oligonucleotide
  Target: SCN9A; (+) strand; PAM type: NRG; PAM sequence: AAG
taaaattaatacaatactga

SEQ ID NO: 56694 - DNA, 20 bp, Artificial Sequence
  Description of Artificial Sequence: Synthetic oligonucleotide
  Target: SCN9A; (+) strand; PAM type: NRG; PAM sequence: GAG
aaattaatacaatactgaaa

SEQ ID NO: 56695 - DNA, 20 bp, Artificial Sequence
  Description of Artificial Sequence: Synthetic oligonucleotide
  Target: SCN9A; (+) strand; PAM type: NRG; PAM sequence: TAG
tttgtttttctctaattaaa

SEQ ID NO: 56696 - DNA, 20 bp, Artificial Sequence
  Description of Artificial Sequence: Synthetic oligonucleotide
  Target: SCN9A; (+) strand; PAM type: NRG; PAM sequence: AGG
ttgtttttctctaattaaat

SEQ ID NO: 56697 - DNA, 20 bp, Artificial Sequence
  Description of Artificial Sequence: Synthetic oligonucleotide
  Target: SCN9A; (+) strand; PAM type: NRG; PAM sequence: TAG
tttctctaattaaataggat

SEQ ID NO: 56698 - DNA, 20 bp, Artificial Sequence
  Description of Artificial Sequence: Synthetic oligonucleotide
  Target: SCN9A; (+) strand; PAM type: NRG; PAM sequence: TGG
atacttttaccttctaatat

SEQ ID NO: 56699 - DNA, 20 bp, Artificial Sequence
  Description of Artificial Sequence: Synthetic oligonucleotide
  Target: SCN9A; (+) strand; PAM type: NRG; PAM sequence: CGG
accttctaatattggctgca

SEQ ID NO: 56700 - DNA, 20 bp, Artificial Sequence
  Description of Artificial Sequence: Synthetic oligonucleotide
  Target: SCN9A; (+) strand; PAM type: NRG; PAM sequence: AAG
ggctgcacggcaatattaca

SEQ ID NO: 56701 - DNA, 20 bp, Artificial Sequence
  Description of Artificial Sequence: Synthetic oligonucleotide
  Target: SCN9A; (+) strand; PAM type: NRG; PAM sequence: AAG
gcacggcaatattacaaagt

SEQ ID NO: 56702 - DNA, 20 bp, Artificial Sequence
  Description of Artificial Sequence: Synthetic oligonucleotide
  Target: SCN9A; (+) strand; PAM type: NRG; PAM sequence: TAG
caattattctgttgtgaaaa

SEQ ID NO: 56703 - DNA, 20 bp, Artificial Sequence
  Description of Artificial Sequence: Synthetic oligonucleotide
  Target: SCN9A; (+) strand; PAM type: NRG; PAM sequence: AAG
ttattctgttgtgaaaatag

SEQ ID NO: 56704 - DNA, 20 bp, Artificial Sequence
  Description of Artificial Sequence: Synthetic oligonucleotide
  Target: SCN9A; (+) strand; PAM type: NRG; PAM sequence: AAG
gttgtgaaaatagaagaata

SEQ ID NO: 56705 - DNA, 20 bp, Artificial Sequence
  Description of Artificial Sequence: Synthetic oligonucleotide
  Target: SCN9A; (+) strand; PAM type: NRG; PAM sequence: AAG
aaatagaagaataaagttac

SEQ ID NO: 56706 - DNA, 20 bp, Artificial Sequence
  Description of Artificial Sequence: Synthetic oligonucleotide
  Target: SCN9A; (+) strand; PAM type: NRG; PAM sequence: TAG
ttacaagttttgtgtataca

SEQ ID NO: 56707 - DNA, 20 bp, Artificial Sequence
  Description of Artificial Sequence: Synthetic oligonucleotide
  Target: SCN9A; (+) strand; PAM type: NRG; PAM sequence: AAG
tttgtgtatacatagctaaa

SEQ ID NO: 56708 - DNA, 20 bp, Artificial Sequence
  Description of Artificial Sequence: Synthetic oligonucleotide
  Target: SCN9A; (+) strand; PAM type: NRG; PAM sequence: TAG
gtgtatacatagctaaaaag

SEQ ID NO: 56709 - DNA, 20 bp, Artificial Sequence
  Description of Artificial Sequence: Synthetic oligonucleotide
  Target: SCN9A; (+) strand; PAM type: NRG; PAM sequence: AGG
tgtatacatagctaaaaagt

SEQ ID NO: 56710 - DNA, 20 bp, Artificial Sequence
  Description of Artificial Sequence: Synthetic oligonucleotide
  Target: SCN9A; (+) strand; PAM type: NRG; PAM sequence: AAG
agctaaaaagtaggattcaa

SEQ ID NO: 56711 - DNA, 20 bp, Artificial Sequence
  Description of Artificial Sequence: Synthetic oligonucleotide
  Target: SCN9A; (+) strand; PAM type: NRG; PAM sequence: TAG
taaaaagtaggattcaaaag

SEQ ID NO: 56712 - DNA, 20 bp, Artificial Sequence
  Description of Artificial Sequence: Synthetic oligonucleotide
  Target: SCN9A; (+) strand; PAM type: NRG; PAM sequence: AAG
aacttcaaattataactaaa

SEQ ID NO: 56713 - DNA, 20 bp, Artificial Sequence
  Description of Artificial Sequence: Synthetic oligonucleotide
  Target: SCN9A; (+) strand; PAM type: NRG; PAM sequence: TAG
aaattataactaaaaagaaa

SEQ ID NO: 56714 - DNA, 20 bp, Artificial Sequence
  Description of Artificial Sequence: Synthetic oligonucleotide
  Target: SCN9A; (+) strand; PAM type: NRG; PAM sequence: AAG
aagaaatagaatatacaatg

SEQ ID NO: 56715 - DNA, 20 bp, Artificial Sequence
  Description of Artificial Sequence: Synthetic oligonucleotide
  Target: SCN9A; (+) strand; PAM type: NRG; PAM sequence: CAG
gaatatacaatgaagattat

SEQ ID NO: 56716 - DNA, 20 bp, Artificial Sequence
  Description of Artificial Sequence: Synthetic oligonucleotide
  Target: SCN9A; (+) strand; PAM type: NRG; PAM sequence: TAG
acaatgaagattatcagaca

SEQ ID NO: 56717 - DNA, 20 bp, Artificial Sequence
  Description of Artificial Sequence: Synthetic oligonucleotide
  Target: SCN9A; (+) strand; PAM type: NRG; PAM sequence: TGG
gaagattatcagacatagat

SEQ ID NO: 56718 - DNA, 20 bp, Artificial Sequence
  Description of Artificial Sequence: Synthetic oligonucleotide
  Target: SCN9A; (+) strand; PAM type: NRG; PAM sequence: GAG
agattatcagacatagattg

SEQ ID NO: 56719 - DNA, 20 bp, Artificial Sequence
  Description of Artificial Sequence: Synthetic oligonucleotide
  Target: SCN9A; (+) strand; PAM type: NRG; PAM sequence: GAG
cagacatagattggagtgat

SEQ ID NO: 56720 - DNA, 20 bp, Artificial Sequence
  Description of Artificial Sequence: Synthetic oligonucleotide
  Target: SCN9A; (+) strand; PAM type: NRG; PAM sequence: TGG
catagattggagtgatgaga

SEQ ID NO: 56721 - DNA, 20 bp, Artificial Sequence
  Description of Artificial Sequence: Synthetic oligonucleotide
  Target: SCN9A; (+) strand; PAM type: NRG; PAM sequence: GGG
atagattggagtgatgagat

SEQ ID NO: 56722 - DNA, 20 bp, Artificial Sequence
  Description of Artificial Sequence: Synthetic oligonucleotide
  Target: SCN9A; (+) strand; PAM type: NRG; PAM sequence: AAG
gatgcttaatgaaacaactg

SEQ ID NO: 56723 - DNA, 20 bp, Artificial Sequence
  Description of Artificial Sequence: Synthetic oligonucleotide
  Target: SCN9A; (+) strand; PAM type: NRG; PAM sequence: AAG
ttaatgaaacaactgaagaa

SEQ ID NO: 56724 - DNA, 20 bp, Artificial Sequence
  Description of Artificial Sequence: Synthetic oligonucleotide
  Target: SCN9A; (+) strand; PAM type: NRG; PAM sequence: GAG
aatgaaacaactgaagaaaa

SEQ ID NO: 56725 - DNA, 20 bp, Artificial Sequence
  Description of Artificial Sequence: Synthetic oligonucleotide
  Target: SCN9A; (+) strand; PAM type: NRG; PAM sequence: AGG
atgaaacaactgaagaaaag

SEQ ID NO: 56726 - DNA, 20 bp, Artificial Sequence
  Description of Artificial Sequence: Synthetic oligonucleotide
  Target: SCN9A; (+) strand; PAM type: NRG; PAM sequence: TGG
aagaggtttcctaaatgtat

SEQ ID NO: 56727 - DNA, 20 bp, Artificial Sequence
  Description of Artificial Sequence: Synthetic oligonucleotide
  Target: SCN9A; (+) strand; PAM type: NRG; PAM sequence: GAG
tcctaaatgtattggcatct

SEQ ID NO: 56728 - DNA, 20 bp, Artificial Sequence
  Description of Artificial Sequence: Synthetic oligonucleotide
  Target: SCN9A; (+) strand; PAM type: NRG; PAM sequence: TGG
tttgctcgtctaatttgacg

SEQ ID NO: 56729 - DNA, 20 bp, Artificial Sequence
  Description of Artificial Sequence: Synthetic oligonucleotide
  Target: SCN9A; (+) strand; PAM type: NRG; PAM sequence: TGG
tcgtctaatttgacgtggtc

SEQ ID NO: 56730 - DNA, 20 bp, Artificial Sequence
  Description of Artificial Sequence: Synthetic oligonucleotide
  Target: SCN9A; (+) strand; PAM type: NRG; PAM sequence: TGG
tgacgtggtctggatttttt

SEQ ID NO: 56731 - DNA, 20 bp, Artificial Sequence
  Description of Artificial Sequence: Synthetic oligonucleotide
  Target: SCN9A; (+) strand; PAM type: NRG; PAM sequence: CAG
gtggtctggatttttttggc

SEQ ID NO: 56732 - DNA, 20 bp, Artificial Sequence
  Description of Artificial Sequence: Synthetic oligonucleotide
  Target: SCN9A; (+) strand; PAM type: NRG; PAM sequence: AAG
ttggccagaaaactgatgtg

SEQ ID NO: 56733 - DNA, 20 bp, Artificial Sequence
  Description of Artificial Sequence: Synthetic oligonucleotide
  Target: SCN9A; (+) strand; PAM type: NRG; PAM sequence: TAG
taaatgttttgtcttgcatg

SEQ ID NO: 56734 - DNA, 20 bp, Artificial Sequence
  Description of Artificial Sequence: Synthetic oligonucleotide
  Target: SCN9A; (+) strand; PAM type: NRG; PAM sequence: TAG
atgttttgtcttgcatgtag

SEQ ID NO: 56735 - DNA, 20 bp, Artificial Sequence
  Description of Artificial Sequence: Synthetic oligonucleotide
  Target: SCN9A; (+) strand; PAM type: NRG; PAM sequence: TAG
tcttgcatgtagtagatgct

SEQ ID NO: 56736 - DNA, 20 bp, Artificial Sequence
  Description of Artificial Sequence: Synthetic oligonucleotide
  Target: SCN9A; (+) strand; PAM type: NRG; PAM sequence: AAG
gcatgtagtagatgcttagt

SEQ ID NO: 56737 - DNA, 20 bp, Artificial Sequence
  Description of Artificial Sequence: Synthetic oligonucleotide
  Target: SCN9A; (+) strand; PAM type: NRG; PAM sequence: AAG
taattgattacttattcctg

SEQ ID NO: 56738 - DNA, 20 bp, Artificial Sequence
  Description of Artificial Sequence: Synthetic oligonucleotide
  Target: SCN9A; (+) strand; PAM type: NRG; PAM sequence: CAG
tattcctgaagaattttccc

SEQ ID NO: 56739 - DNA, 20 bp, Artificial Sequence
  Description of Artificial Sequence: Synthetic oligonucleotide
  Target: SCN9A; (+) strand; PAM type: NRG; PAM sequence: TAG
aagaattttccccagtgtca

SEQ ID NO: 56740 - DNA, 20 bp, Artificial Sequence
  Description of Artificial Sequence: Synthetic oligonucleotide
  Target: SCN9A; (+) strand; PAM type: NRG; PAM sequence: TGG
ccagtgtcatagtccactga

SEQ ID NO: 56741 - DNA, 20 bp, Artificial Sequence
  Description of Artificial Sequence: Synthetic oligonucleotide
  Target: SCN9A; (+) strand; PAM type: NRG; PAM sequence: GGG
cagtgtcatagtccactgat

SEQ ID NO: 56742 - DNA, 20 bp, Artificial Sequence
  Description of Artificial Sequence: Synthetic oligonucleotide
  Target: SCN9A; (+) strand; PAM type: NRG; PAM sequence: TGG
tgggtcccttaccctaacaa

SEQ ID NO: 56743 - DNA, 20 bp, Artificial Sequence
  Description of Artificial Sequence: Synthetic oligonucleotide
  Target: SCN9A; (+) strand; PAM type: NRG; PAM sequence: TGG
tgctgataatgtgctttctg

SEQ ID NO: 56744 - DNA, 20 bp, Artificial Sequence
  Description of Artificial Sequence: Synthetic oligonucleotide
  Target: SCN9A; (+) strand; PAM type: NRG; PAM sequence: GAG
ctgataatgtgctttctgtg

SEQ ID NO: 56745 - DNA, 20 bp, Artificial Sequence
  Description of Artificial Sequence: Synthetic oligonucleotide
  Target: SCN9A; (+) strand; PAM type: NRG; PAM sequence: TAG
ttgttatcgacattcccttg

SEQ ID NO: 56746 - DNA, 20 bp, Artificial Sequence
  Description of Artificial Sequence: Synthetic oligonucleotide
  Target: SCN9A; (+) strand; PAM type: NRG; PAM sequence: AAG
ttatcgacattcccttgtag

SEQ ID NO: 56747 - DNA, 20 bp, Artificial Sequence
  Description of Artificial Sequence: Synthetic oligonucleotide
  Target: SCN9A; (+) strand; PAM type: NRG; PAM sequence: TAG
cccttgtagaagtcttccat

SEQ ID NO: 56748 - DNA, 20 bp, Artificial Sequence
  Description of Artificial Sequence: Synthetic oligonucleotide
  Target: SCN9A; (+) strand; PAM type: NRG; PAM sequence: AAG
gtagaagtcttccattagat

SEQ ID NO: 56749 - DNA, 20 bp, Artificial Sequence
  Description of Artificial Sequence: Synthetic oligonucleotide
  Target: SCN9A; (+) strand; PAM type: NRG; PAM sequence: AGG
tagaagtcttccattagata

SEQ ID NO: 56750 - DNA, 20 bp, Artificial Sequence
  Description of Artificial Sequence: Synthetic oligonucleotide
  Target: SCN9A; (+) strand; PAM type: NRG; PAM sequence: GGG
agaagtcttccattagataa

SEQ ID NO: 56751 - DNA, 20 bp, Artificial Sequence
  Description of Artificial Sequence: Synthetic oligonucleotide
  Target: SCN9A; (+) strand; PAM type: NRG; PAM sequence: GGG
gaagtcttccattagataag

SEQ ID NO: 56752 - DNA, 20 bp, Artificial Sequence
  Description of Artificial Sequence: Synthetic oligonucleotide
  Target: SCN9A; (+) strand; PAM type: NRG; PAM sequence: TAG
ggacaaaatatatgaaacac

SEQ ID NO: 56753 - DNA, 20 bp, Artificial Sequence
  Description of Artificial Sequence: Synthetic oligonucleotide
  Target: SCN9A; (+) strand; PAM type: NRG; PAM sequence: CAG
atatatgaaacactagtttt

SEQ ID NO: 56754 - DNA, 20 bp, Artificial Sequence
  Description of Artificial Sequence: Synthetic oligonucleotide
  Target: SCN9A; (+) strand; PAM type: NRG; PAM sequence: TGG
aaacactagttttcagtcat

SEQ ID NO: 56755 - DNA, 20 bp, Artificial Sequence
  Description of Artificial Sequence: Synthetic oligonucleotide
  Target: SCN9A; (+) strand; PAM type: NRG; PAM sequence: GGG
aacactagttttcagtcatt

SEQ ID NO: 56756 - DNA, 20 bp, Artificial Sequence
  Description of Artificial Sequence: Synthetic oligonucleotide
  Target: SCN9A; (+) strand; PAM type: NRG; PAM sequence: AAG
cattgggcaacattatctat

SEQ ID NO: 56757 - DNA, 20 bp, Artificial Sequence
  Description of Artificial Sequence: Synthetic oligonucleotide
  Target: SCN9A; (+) strand; PAM type: NRG; PAM sequence: CAG
gggcaacattatctataaga

SEQ ID NO: 56758 - DNA, 20 bp, Artificial Sequence
  Description of Artificial Sequence: Synthetic oligonucleotide
  Target: SCN9A; (+) strand; PAM type: NRG; PAM sequence: TAG
atctataagacagtgatccc

SEQ ID NO: 56759 - DNA, 20 bp, Artificial Sequence
  Description of Artificial Sequence: Synthetic oligonucleotide
  Target: SCN9A; (+) strand; PAM type: NRG; PAM sequence: GAG
ctataagacagtgatcccta

SEQ ID NO: 56760 - DNA, 20 bp, Artificial Sequence
  Description of Artificial Sequence: Synthetic oligonucleotide
  Target: SCN9A; (+) strand; PAM type: NRG; PAM sequence: AAG
taagacagtgatccctagag

SEQ ID NO: 56761 - DNA, 20 bp, Artificial Sequence
  Description of Artificial Sequence: Synthetic oligonucleotide
  Target: SCN9A; (+) strand; PAM type: NRG; PAM sequence: GAG
agacagtgatccctagagaa

SEQ ID NO: 56762 - DNA, 20 bp, Artificial Sequence
  Description of Artificial Sequence: Synthetic oligonucleotide
  Target: SCN9A; (+) strand; PAM type: NRG; PAM sequence: AAG
agtgatccctagagaagaga

SEQ ID NO: 56763 - DNA, 20 bp, Artificial Sequence
  Description of Artificial Sequence: Synthetic oligonucleotide
  Target: SCN9A; (+) strand; PAM type: NRG; PAM sequence: AAG
atccctagagaagagaaaga

SEQ ID NO: 56764 - DNA, 20 bp, Artificial Sequence
  Description of Artificial Sequence: Synthetic oligonucleotide
  Target: SCN9A; (+) strand; PAM type: NRG; PAM sequence: GAG
ctagagaagagaaagaaagt

SEQ ID NO: 56765 - DNA, 20 bp, Artificial Sequence
  Description of Artificial Sequence: Synthetic oligonucleotide
  Target: SCN9A; (+) strand; PAM type: NRG; PAM sequence: AGG
tagagaagagaaagaaagtg

SEQ ID NO: 56766 - DNA, 20 bp, Artificial Sequence
  Description of Artificial Sequence: Synthetic oligonucleotide
  Target: SCN9A; (+) strand; PAM type: NRG; PAM sequence: AAG
ttgtctctgcatactacaca

SEQ ID NO: 56767 - DNA, 20 bp, Artificial Sequence
  Description of Artificial Sequence: Synthetic oligonucleotide
  Target: SCN9A; (+) strand; PAM type: NRG; PAM sequence: CAG
tacacaaagtttctaaacca

SEQ ID NO: 56768 - DNA, 20 bp, Artificial Sequence
  Description of Artificial Sequence: Synthetic oligonucleotide
  Target: SCN9A; (+) strand; PAM type: NRG; PAM sequence: CAG
aaagtttctaaaccacagct

SEQ ID NO: 56769 - DNA, 20 bp, Artificial Sequence
  Description of Artificial Sequence: Synthetic oligonucleotide
  Target: SCN9A; (+) strand; PAM type: NRG; PAM sequence: AGG
aagtttctaaaccacagctc

SEQ ID NO: 56770 - DNA, 20 bp, Artificial Sequence
  Description of Artificial Sequence: Synthetic oligonucleotide
  Target: SCN9A; (+) strand; PAM type: NRG; PAM sequence: AAG
tttctaaaccacagctcagg

SEQ ID NO: 56771 - DNA, 20 bp, Artificial Sequence
  Description of Artificial Sequence: Synthetic oligonucleotide
  Target: SCN9A; (+) strand; PAM type: NRG; PAM sequence: TGG
taaaccacagctcaggaaga

SEQ ID NO: 56772 - DNA, 20 bp, Artificial Sequence
  Description of Artificial Sequence: Synthetic oligonucleotide
  Target: SCN9A; (+) strand; PAM type: NRG; PAM sequence: AAG
ctcaggaagatggaaacatg

SEQ ID NO: 56773 - DNA, 20 bp, Artificial Sequence
  Description of Artificial Sequence: Synthetic oligonucleotide
  Target: SCN9A; (+) strand; PAM type: NRG; PAM sequence: GAG
caggaagatggaaacatgaa

SEQ ID NO: 56774 - DNA, 20 bp, Artificial Sequence
  Description of Artificial Sequence: Synthetic oligonucleotide
  Target: SCN9A; (+) strand; PAM type: NRG; PAM sequence: CAG
aagatggaaacatgaagagc

SEQ ID NO: 56775 - DNA, 20 bp, Artificial Sequence
  Description of Artificial Sequence: Synthetic oligonucleotide
  Target: SCN9A; (+) strand; PAM type: NRG; PAM sequence: AAG
aacatgaagagccagaaaat

SEQ ID NO: 56776 - DNA, 20 bp, Artificial Sequence
  Description of Artificial Sequence: Synthetic oligonucleotide
  Target: SCN9A; (+) strand; PAM type: NRG; PAM sequence: GAG
catgaagagccagaaaataa

SEQ ID NO: 56777 - DNA, 20 bp, Artificial Sequence
  Description of Artificial Sequence: Synthetic oligonucleotide
  Target: SCN9A; (+) strand; PAM type: NRG; PAM sequence: TAG
gccagaaaataagagtttga

SEQ ID NO: 56778 - DNA, 20 bp, Artificial Sequence
  Description of Artificial Sequence: Synthetic oligonucleotide
  Target: SCN9A; (+) strand; PAM type: NRG; PAM sequence: AGG
ccagaaaataagagtttgat

SEQ ID NO: 56779 - DNA, 20 bp, Artificial Sequence
  Description of Artificial Sequence: Synthetic oligonucleotide
  Target: SCN9A; (+) strand; PAM type: NRG; PAM sequence: GAG
aaataagagtttgataggct

SEQ ID NO: 56780 - DNA, 20 bp, Artificial Sequence
  Description of Artificial Sequence: Synthetic oligonucleotide
  Target: SCN9A; (+) strand; PAM type: NRG; PAM sequence: AGG
aataagagtttgataggctg

SEQ ID NO: 56781 - DNA, 20 bp, Artificial Sequence
  Description of Artificial Sequence: Synthetic oligonucleotide
  Target: SCN9A; (+) strand; PAM type: NRG; PAM sequence: GGG
ataagagtttgataggctga

SEQ ID NO: 56782 - DNA, 20 bp, Artificial Sequence
  Description of Artificial Sequence: Synthetic oligonucleotide
  Target: SCN9A; (+) strand; PAM type: NRG; PAM sequence: GAG
aagagtttgataggctgagg

SEQ ID NO: 56783 - DNA, 20 bp, Artificial Sequence
  Description of Artificial Sequence: Synthetic oligonucleotide
  Target: SCN9A; (+) strand; PAM type: NRG; PAM sequence: TAG
gtttgataggctgagggagc

SEQ ID NO: 56784 - DNA, 20 bp, Artificial Sequence
  Description of Artificial Sequence: Synthetic oligonucleotide
  Target: SCN9A; (+) strand; PAM type: NRG; PAM sequence: TGG
ggagctagaatttgtttatt

SEQ ID NO: 56785 - DNA, 20 bp, Artificial Sequence
  Description of Artificial Sequence: Synthetic oligonucleotide
  Target: SCN9A; (+) strand; PAM type: NRG; PAM sequence: GGG
gagctagaatttgtttattt

SEQ ID NO: 56786 - DNA, 20 bp, Artificial Sequence
  Description of Artificial Sequence: Synthetic oligonucleotide
  Target: SCN9A; (+) strand; PAM type: NRG; PAM sequence: CAG
tagaatttgtttatttggga

SEQ ID NO: 56787 - DNA, 20 bp, Artificial Sequence
  Description of Artificial Sequence: Synthetic oligonucleotide
  Target: SCN9A; (+) strand; PAM type: NRG; PAM sequence: AGG
agaatttgtttatttgggac

SEQ ID NO: 56788 - DNA, 20 bp, Artificial Sequence
  Description of Artificial Sequence: Synthetic oligonucleotide
  Target: SCN9A; (+) strand; PAM type: NRG; PAM sequence: AAG
ttatttgggacaggacacct

SEQ ID NO: 56789 - DNA, 20 bp, Artificial Sequence
  Description of Artificial Sequence: Synthetic oligonucleotide
  Target: SCN9A; (+) strand; PAM type: NRG; PAM sequence: AAG
tgggacaggacacctaagac

SEQ ID NO: 56790 - DNA, 20 bp, Artificial Sequence
  Description of Artificial Sequence: Synthetic oligonucleotide
  Target: SCN9A; (+) strand; PAM type: NRG; PAM sequence: AGG
gggacaggacacctaagaca

SEQ ID NO: 56791 - DNA, 20 bp, Artificial Sequence
  Description of Artificial Sequence: Synthetic oligonucleotide
  Target: SCN9A; (+) strand; PAM type: NRG; PAM sequence: GGG
ggacaggacacctaagacaa

SEQ ID NO: 56792 - DNA, 20 bp, Artificial Sequence
  Description of Artificial Sequence: Synthetic oligonucleotide
  Target: SCN9A; (+) strand; PAM type: NRG; PAM sequence: GAG
acaggacacctaagacaagg

SEQ ID NO: 56793 - DNA, 20 bp, Artificial Sequence
  Description of Artificial Sequence: Synthetic oligonucleotide
  Target: SCN9A; (+) strand; PAM type: NRG; PAM sequence: CAG
cctaagacaagggagctgaa

SEQ ID NO: 56794 - DNA, 20 bp, Artificial Sequence
  Description of Artificial Sequence: Synthetic oligonucleotide
  Target: SCN9A; (+) strand; PAM type: NRG; PAM sequence: GAG
taagacaagggagctgaaca

SEQ ID NO: 56795 - DNA, 20 bp, Artificial Sequence
  Description of Artificial Sequence: Synthetic oligonucleotide
  Target: SCN9A; (+) strand; PAM type: NRG; PAM sequence: GAG
agacaagggagctgaacaga

SEQ ID NO: 56796 - DNA, 20 bp, Artificial Sequence
  Description of Artificial Sequence: Synthetic oligonucleotide
  Target: SCN9A; (+) strand; PAM type: NRG; PAM sequence: CAG
gagctgaacagagagtatac

SEQ ID NO: 56797 - DNA, 20 bp, Artificial Sequence
  Description of Artificial Sequence: Synthetic oligonucleotide
  Target: SCN9A; (+) strand; PAM type: NRG; PAM sequence: GAG
gctgaacagagagtatacca

SEQ ID NO: 56798 - DNA, 20 bp, Artificial Sequence
  Description of Artificial Sequence: Synthetic oligonucleotide
  Target: SCN9A; (+) strand; PAM type: NRG; PAM sequence: TAG
gagagtataccagagatctg

SEQ ID NO: 56799 - DNA, 20 bp, Artificial Sequence
  Description of Artificial Sequence: Synthetic oligonucleotide
  Target: SCN9A; (+) strand; PAM type: NRG; PAM sequence: AAG
gtataccagagatctgtaga

SEQ ID NO: 56800 - DNA, 20 bp, Artificial Sequence
  Description of Artificial Sequence: Synthetic oligonucleotide
  Target: SCN9A; (+) strand; PAM type: NRG; PAM sequence: GAG
ataccagagatctgtagaaa

SEQ ID NO: 56801 - DNA, 20 bp, Artificial Sequence
  Description of Artificial Sequence: Synthetic oligonucleotide
  Target: SCN9A; (+) strand; PAM type: NRG; PAM sequence: AAG
gatctgtagaaagagacctc

SEQ ID NO: 56802 - DNA, 20 bp, Artificial Sequence
  Description of Artificial Sequence: Synthetic oligonucleotide
  Target: SCN9A; (+) strand; PAM type: NRG; PAM sequence: CAG
gacctcaagtttttgcttga

SEQ ID NO: 56803 - DNA, 20 bp, Artificial Sequence
  Description of Artificial Sequence: Synthetic oligonucleotide
  Target: SCN9A; (+) strand; PAM type: NRG; PAM sequence: AAG
tgtgaaaacaaaaataccct

SEQ ID NO: 56804 - DNA, 20 bp, Artificial Sequence
  Description of Artificial Sequence: Synthetic oligonucleotide
  Target: SCN9A; (+) strand; PAM type: NRG; PAM sequence: CAG
aaaacaaaaataccctaagc

SEQ ID NO: 56805 - DNA, 20 bp, Artificial Sequence
  Description of Artificial Sequence: Synthetic oligonucleotide
  Target: SCN9A; (+) strand; PAM type: NRG; PAM sequence: GAG
aacaaaaataccctaagcca

SEQ ID NO: 56806 - DNA, 20 bp, Artificial Sequence
  Description of Artificial Sequence: Synthetic oligonucleotide
  Target: SCN9A; (+) strand; PAM type: NRG; PAM sequence: AAG
aaaataccctaagccagaga

SEQ ID NO: 56807 - DNA, 20 bp, Artificial Sequence
  Description of Artificial Sequence: Synthetic oligonucleotide
  Target: SCN9A; (+) strand; PAM type: NRG; PAM sequence: CAG
ctaagccagagaaagaacta

SEQ ID NO: 56808 - DNA, 20 bp, Artificial Sequence
  Description of Artificial Sequence: Synthetic oligonucleotide
  Target: SCN9A; (+) strand; PAM type: NRG; PAM sequence: TGG
agtcatgcattgcctaacaa

SEQ ID NO: 56809 - DNA, 20 bp, Artificial Sequence
  Description of Artificial Sequence: Synthetic oligonucleotide
  Target: SCN9A; (+) strand; PAM type: NRG; PAM sequence: GAG
tcatgcattgcctaacaatg

SEQ ID NO: 56810 - DNA, 20 bp, Artificial Sequence
  Description of Artificial Sequence: Synthetic oligonucleotide
  Target: SCN9A; (+) strand; PAM type: NRG; PAM sequence: GAG
taacaatggagatatgtacc

SEQ ID NO: 56811 - DNA, 20 bp, Artificial Sequence
  Description of Artificial Sequence: Synthetic oligonucleotide
  Target: SCN9A; (+) strand; PAM type: NRG; PAM sequence: TAG
tgtaccgagaaatgtgtcac

SEQ ID NO: 56812 - DNA, 20 bp, Artificial Sequence
  Description of Artificial Sequence: Synthetic oligonucleotide
  Target: SCN9A; (+) strand; PAM type: NRG; PAM sequence: AGG
gtaccgagaaatgtgtcact

SEQ ID NO: 56813 - DNA, 20 bp, Artificial Sequence
  Description of Artificial Sequence: Synthetic oligonucleotide
  Target: SCN9A; (+) strand; PAM type: NRG; PAM sequence: TAG
actaggcaattttaacatca

SEQ ID NO: 56814 - DNA, 20 bp, Artificial Sequence
  Description of Artificial Sequence: Synthetic oligonucleotide
  Target: SCN9A; (+) strand; PAM type: NRG; PAM sequence: GAG
taggcaattttaacatcata

SEQ ID NO: 56815 - DNA, 20 bp, Artificial Sequence
  Description of Artificial Sequence: Synthetic oligonucleotide
  Target: SCN9A; (+) strand; PAM type: NRG; PAM sequence: CAG
caattttaacatcatagaga

SEQ ID NO: 56816 - DNA, 20 bp, Artificial Sequence
  Description of Artificial Sequence: Synthetic oligonucleotide
  Target: SCN9A; (+) strand; PAM type: NRG; PAM sequence: TAG
agacagtacttacacaaacc

SEQ ID NO: 56817 - DNA, 20 bp, Artificial Sequence
  Description of Artificial Sequence: Synthetic oligonucleotide
  Target: SCN9A; (+) strand; PAM type: NRG; PAM sequence: TGG
agtacttacacaaacctaga

SEQ ID NO: 56818 - DNA, 20 bp, Artificial Sequence
  Description of Artificial Sequence: Synthetic oligonucleotide
  Target: SCN9A; (+) strand; PAM type: NRG; PAM sequence: TAG
ttacacaaacctagatggta

SEQ ID NO: 56819 - DNA, 20 bp, Artificial Sequence
  Description of Artificial Sequence: Synthetic oligonucleotide
  Target: SCN9A; (+) strand; PAM type: NRG; PAM sequence: TAG
ggtatagtctactacatact

SEQ ID NO: 56820 - DNA, 20 bp, Artificial Sequence
  Description of Artificial Sequence: Synthetic oligonucleotide
  Target: SCN9A; (+) strand; PAM type: NRG; PAM sequence: TGG
tactacatacttagtcttta

SEQ ID NO: 56821 - DNA, 20 bp, Artificial Sequence
  Description of Artificial Sequence: Synthetic oligonucleotide
  Target: SCN9A; (+) strand; PAM type: NRG; PAM sequence: TAG
catacttagtctttatggta

SEQ ID NO: 56822 - DNA, 20 bp, Artificial Sequence
  Description of Artificial Sequence: Synthetic oligonucleotide
  Target: SCN9A; (+) strand; PAM type: NRG; PAM sequence: TAG
atggtatagcctattgcttc

SEQ ID NO: 56823 - DNA, 20 bp, Artificial Sequence
  Description of Artificial Sequence: Synthetic oligonucleotide
  Target: SCN9A; (+) strand; PAM type: NRG; PAM sequence: AGG
tggtatagcctattgcttct

SEQ ID NO: 56824 - DNA, 20 bp, Artificial Sequence
  Description of Artificial Sequence: Synthetic oligonucleotide
  Target: SCN9A; (+) strand; PAM type: NRG; PAM sequence: GAG
gtacaacatgttactgtact

SEQ ID NO: 56825 - DNA, 20 bp, Artificial Sequence
  Description of Artificial Sequence: Synthetic oligonucleotide
  Target: SCN9A; (+) strand; PAM type: NRG; PAM sequence: CAG
gtactgagacaattgtaaca

SEQ ID NO: 56826 - DNA, 20 bp, Artificial Sequence
  Description of Artificial Sequence: Synthetic oligonucleotide
  Target: SCN9A; (+) strand; PAM type: NRG; PAM sequence: TGG
ctgagacaattgtaacacag

SEQ ID NO: 56827 - DNA, 20 bp, Artificial Sequence
  Description of Artificial Sequence: Synthetic oligonucleotide
  Target: SCN9A; (+) strand; PAM type: NRG; PAM sequence: TAG
tgtctaatcatacctaaaca

SEQ ID NO: 56828 - DNA, 20 bp, Artificial Sequence
  Description of Artificial Sequence: Synthetic oligonucleotide
  Target: SCN9A; (+) strand; PAM type: NRG; PAM sequence: AAG
aatcatacctaaacatagaa

SEQ ID NO: 56829 - DNA, 20 bp, Artificial Sequence
  Description of Artificial Sequence: Synthetic oligonucleotide
  Target: SCN9A; (+) strand; PAM type: NRG; PAM sequence: CAG
acctaaacatagaaaagtta

SEQ ID NO: 56830 - DNA, 20 bp, Artificial Sequence
  Description of Artificial Sequence: Synthetic oligonucleotide
  Target: SCN9A; (+) strand; PAM type: NRG; PAM sequence: CAG
gaaaagttacagtaaaaata

SEQ ID NO: 56831 - DNA, 20 bp, Artificial Sequence
  Description of Artificial Sequence: Synthetic oligonucleotide
  Target: SCN9A; (+) strand; PAM type: NRG; PAM sequence: TGG
aaatacagtattataatctg

SEQ ID NO: 56832 - DNA, 20 bp, Artificial Sequence
  Description of Artificial Sequence: Synthetic oligonucleotide
  Target: SCN9A; (+) strand; PAM type: NRG; PAM sequence: GGG
aatacagtattataatctgt

SEQ ID NO: 56833 - DNA, 20 bp, Artificial Sequence
  Description of Artificial Sequence: Synthetic oligonucleotide
  Target: SCN9A; (+) strand; PAM type: NRG; PAM sequence: CAG
tgggaccaccatcatatatg

SEQ ID NO: 56834 - DNA, 20 bp, Artificial Sequence
  Description of Artificial Sequence: Synthetic oligonucleotide
  Target: SCN9A; (+) strand; PAM type: NRG; PAM sequence: AAG
atgcagtctgtccttgactg

SEQ ID NO: 56835 - DNA, 20 bp, Artificial Sequence
  Description of Artificial Sequence: Synthetic oligonucleotide
  Target: SCN9A; (+) strand; PAM type: NRG; PAM sequence: TGG
tccttgactgaagtgttatc

SEQ ID NO: 56836 - DNA, 20 bp, Artificial Sequence
  Description of Artificial Sequence: Synthetic oligonucleotide
  Target: SCN9A; (+) strand; PAM type: NRG; PAM sequence: AAG
actgacatgactgtaatctt

SEQ ID NO: 56837 - DNA, 20 bp, Artificial Sequence
  Description of Artificial Sequence: Synthetic oligonucleotide
  Target: SCN9A; (+) strand; PAM type: NRG; PAM sequence: TAG
gacatgactgtaatcttaag

SEQ ID NO: 56838 - DNA, 20 bp, Artificial Sequence
  Description of Artificial Sequence: Synthetic oligonucleotide
  Target: SCN9A; (+) strand; PAM type: NRG; PAM sequence: CAG
atgactgtaatcttaagtag

SEQ ID NO: 56839 - DNA, 20 bp, Artificial Sequence
  Description of Artificial Sequence: Synthetic oligonucleotide
  Target: SCN9A; (+) strand; PAM type: NRG; PAM sequence: AGG
tgactgtaatcttaagtagc

SEQ ID NO: 56840 - DNA, 20 bp, Artificial Sequence
  Description of Artificial Sequence: Synthetic oligonucleotide
  Target: SCN9A; (+) strand; PAM type: NRG; PAM sequence: TGG
agtagcaggttaaaaattct

SEQ ID NO: 56841 - DNA, 20 bp, Artificial Sequence
  Description of Artificial Sequence: Synthetic oligonucleotide
  Target: SCN9A; (+) strand; PAM type: NRG; PAM sequence: CAG
aaaaattcttggacctcaca

SEQ ID NO: 56842 - DNA, 20 bp, Artificial Sequence
  Description of Artificial Sequence: Synthetic oligonucleotide
  Target: SCN9A; (+) strand; PAM type: NRG; PAM sequence: AGG
aaaattcttggacctcacac

SEQ ID NO: 56843 - DNA, 20 bp, Artificial Sequence
  Description of Artificial Sequence: Synthetic oligonucleotide
  Target: SCN9A; (+) strand; PAM type: NRG; PAM sequence: GGG
aaattcttggacctcacaca

SEQ ID NO: 56844 - DNA, 20 bp, Artificial Sequence
  Description of Artificial Sequence: Synthetic oligonucleotide
  Target: SCN9A; (+) strand; PAM type: NRG; PAM sequence: TAG
tcttggacctcacacaggga

SEQ ID NO: 56845 - DNA, 20 bp, Artificial Sequence
  Description of Artificial Sequence: Synthetic oligonucleotide
  Target: SCN9A; (+) strand; PAM type: NRG; PAM sequence: CAG
tagtaatattttatcctccc

SEQ ID NO: 56846 - DNA, 20 bp, Artificial Sequence
  Description of Artificial Sequence: Synthetic oligonucleotide
  Target: SCN9A; (+) strand; PAM type: NRG; PAM sequence: AAG
tattttatcctccccagtca

SEQ ID NO: 56847 - DNA, 20 bp, Artificial Sequence
  Description of Artificial Sequence: Synthetic oligonucleotide
  Target: SCN9A; (+) strand; PAM type: NRG; PAM sequence: AAG
tcctccccagtcaaagtgaa

SEQ ID NO: 56848 - DNA, 20 bp, Artificial Sequence
  Description of Artificial Sequence: Synthetic oligonucleotide
  Target: SCN9A; (+) strand; PAM type: NRG; PAM sequence: CAG
agtgaaaagacctcaaaaca

SEQ ID NO: 56849 - DNA, 20 bp, Artificial Sequence
  Description of Artificial Sequence: Synthetic oligonucleotide
  Target: SCN9A; (+) strand; PAM type: NRG; PAM sequence: AGG
gtgaaaagacctcaaaacac

SEQ ID NO: 56850 - DNA, 20 bp, Artificial Sequence
  Description of Artificial Sequence: Synthetic oligonucleotide
  Target: SCN9A; (+) strand; PAM type: NRG; PAM sequence: GAG
gaaaagacctcaaaacacag

SEQ ID NO: 56851 - DNA, 20 bp, Artificial Sequence
  Description of Artificial Sequence: Synthetic oligonucleotide
  Target: SCN9A; (+) strand; PAM type: NRG; PAM sequence: TGG
cctcaaaacacaggagatat

SEQ ID NO: 56852 - DNA, 20 bp, Artificial Sequence
  Description of Artificial Sequence: Synthetic oligonucleotide
  Target: SCN9A; (+) strand; PAM type: NRG; PAM sequence: GGG
ctcaaaacacaggagatatt

SEQ ID NO: 56853 - DNA, 20 bp, Artificial Sequence
  Description of Artificial Sequence: Synthetic oligonucleotide
  Target: SCN9A; (+) strand; PAM type: NRG; PAM sequence: TAG
aaaacacaggagatattggg

SEQ ID NO: 56854 - DNA, 20 bp, Artificial Sequence
  Description of Artificial Sequence: Synthetic oligonucleotide
  Target: SCN9A; (+) strand; PAM type: NRG; PAM sequence: CAG
gagatattgggtagactctg

SEQ ID NO: 56855 - DNA, 20 bp, Artificial Sequence
  Description of Artificial Sequence: Synthetic oligonucleotide
  Target: SCN9A; (+) strand; PAM type: NRG; PAM sequence: AAG
atattgggtagactctgcag

SEQ ID NO: 56856 - DNA, 20 bp, Artificial Sequence
  Description of Artificial Sequence: Synthetic oligonucleotide
  Target: SCN9A; (+) strand; PAM type: NRG; PAM sequence: AGG
tattgggtagactctgcaga

SEQ ID NO: 56857 - DNA, 20 bp, Artificial Sequence
  Description of Artificial Sequence: Synthetic oligonucleotide
  Target: SCN9A; (+) strand; PAM type: NRG; PAM sequence: GGG
attgggtagactctgcagaa

SEQ ID NO: 56858 - DNA, 20 bp, Artificial Sequence
  Description of Artificial Sequence: Synthetic oligonucleotide
  Target: SCN9A; (+) strand; PAM type: NRG; PAM sequence: TAG
tctgcagaagggtcttatct

SEQ ID NO: 56859 - DNA, 20 bp, Artificial Sequence
  Description of Artificial Sequence: Synthetic oligonucleotide
  Target: SCN9A; (+) strand; PAM type: NRG; PAM sequence: CAG
gcagaagggtcttatcttag

SEQ ID NO: 56860 - DNA, 20 bp, Artificial Sequence
  Description of Artificial Sequence: Synthetic oligonucleotide
  Target: SCN9A; (+) strand; PAM type: NRG; PAM sequence: TGG
gaagggtcttatcttagcag

SEQ ID NO: 56861 - DNA, 20 bp, Artificial Sequence
  Description of Artificial Sequence: Synthetic oligonucleotide
  Target: SCN9A; (+) strand; PAM type: NRG; PAM sequence: GGG
aagggtcttatcttagcagt

SEQ ID NO: 56862 - DNA, 20 bp, Artificial Sequence
  Description of Artificial Sequence: Synthetic oligonucleotide
  Target: SCN9A; (+) strand; PAM type: NRG; PAM sequence: GGG
agggtcttatcttagcagtg

SEQ ID NO: 56863 - DNA, 20 bp, Artificial Sequence
  Description of Artificial Sequence: Synthetic oligonucleotide
  Target: SCN9A; (+) strand; PAM type: NRG; PAM sequence: TGG
aactttaactaacgttgctc

SEQ ID NO: 56864 - DNA, 20 bp, Artificial Sequence
  Description of Artificial Sequence: Synthetic oligonucleotide
  Target: SCN9A; (-) strand; PAM type: YTN; PAM sequence: CTA
taaaagtatgaatcatggat

SEQ ID NO: 56865 - DNA, 20 bp, Artificial Sequence
  Description of Artificial Sequence: Synthetic oligonucleotide
  Target: SCN9A; (-) strand; PAM type: YTN; PAM sequence: CTG
acaatgtctataaaagtatg

SEQ ID NO: 56866 - DNA, 20 bp, Artificial Sequence
  Description of Artificial Sequence: Synthetic oligonucleotide
  Target: SCN9A; (-) strand; PAM type: YTN; PAM sequence: CTC
tgacaatgtctataaaagta

SEQ ID NO: 56867 - DNA, 20 bp, Artificial Sequence
  Description of Artificial Sequence: Synthetic oligonucleotide
  Target: SCN9A; (-) strand; PAM type: YTN; PAM sequence: CTG
atctctgacaatgtctataa

SEQ ID NO: 56868 - DNA, 20 bp, Artificial Sequence
  Description of Artificial Sequence: Synthetic oligonucleotide
  Target: SCN9A; (-) strand; PAM type: YTN; PAM sequence: TTG
acaacgactgatctctgaca

SEQ ID NO: 56869 - DNA, 20 bp, Artificial Sequence
  Description of Artificial Sequence: Synthetic oligonucleotide
  Target: SCN9A; (-) strand; PAM type: YTN; PAM sequence: TTC
cccagttgacaacgactgat

SEQ ID NO: 56870 - DNA, 20 bp, Artificial Sequence
  Description of Artificial Sequence: Synthetic oligonucleotide
  Target: SCN9A; (-) strand; PAM type: YTN; PAM sequence: CTT
ccccagttgacaacgactga

SEQ ID NO: 56871 - DNA, 20 bp, Artificial Sequence
  Description of Artificial Sequence: Synthetic oligonucleotide
  Target: SCN9A; (-) strand; PAM type: YTN; PAM sequence: CTC
agggggacaaaatcttcccc

SEQ ID NO: 56872 - DNA, 20 bp, Artificial Sequence
  Description of Artificial Sequence: Synthetic oligonucleotide
  Target: SCN9A; (-) strand; PAM type: YTN; PAM sequence: TTC
tcagggggacaaaatcttcc

SEQ ID NO: 56873 - DNA, 20 bp, Artificial Sequence
  Description of Artificial Sequence: Synthetic oligonucleotide
  Target: SCN9A; (-) strand; PAM type: YTN; PAM sequence: CTA
aatgttctcagggggacaaa

SEQ ID NO: 56874 - DNA, 20 bp, Artificial Sequence
  Description of Artificial Sequence: Synthetic oligonucleotide
  Target: SCN9A; (-) strand; PAM type: YTN; PAM sequence: TTG
ctaaatgttctcagggggac

SEQ ID NO: 56875 - DNA, 20 bp, Artificial Sequence
  Description of Artificial Sequence: Synthetic oligonucleotide
  Target: SCN9A; (-) strand; PAM type: YTN; PAM sequence: TTT
gctaaatgttctcaggggga

SEQ ID NO: 56876 - DNA, 20 bp, Artificial Sequence
  Description of Artificial Sequence: Synthetic oligonucleotide
  Target: SCN9A; (-) strand; PAM type: YTN; PAM sequence: CTT
tgctaaatgttctcaggggg

SEQ ID NO: 56877 - DNA, 20 bp, Artificial Sequence
  Description of Artificial Sequence: Synthetic oligonucleotide
  Target: SCN9A; (-) strand; PAM type: YTN; PAM sequence: TTA
tgacaaataaaaatgtcccc

SEQ ID NO: 56878 - DNA, 20 bp, Artificial Sequence
  Description of Artificial Sequence: Synthetic oligonucleotide
  Target: SCN9A; (-) strand; PAM type: YTN; PAM sequence: TTC
cacagttatgacaaataaaa

SEQ ID NO: 56879 - DNA, 20 bp, Artificial Sequence
  Description of Artificial Sequence: Synthetic oligonucleotide
  Target: SCN9A; (-) strand; PAM type: YTN; PAM sequence: CTA
attccacagttatgacaaat

SEQ ID NO: 56880 - DNA, 20 bp, Artificial Sequence
  Description of Artificial Sequence: Synthetic oligonucleotide
  Target: SCN9A; (-) strand; PAM type: YTN; PAM sequence: TTC
ctaattccacagttatgaca

SEQ ID NO: 56881 - DNA, 20 bp, Artificial Sequence
  Description of Artificial Sequence: Synthetic oligonucleotide
  Target: SCN9A; (-) strand; PAM type: YTN; PAM sequence: CTA
gatatcaataaacattccta

SEQ ID NO: 56882 - DNA, 20 bp, Artificial Sequence
  Description of Artificial Sequence: Synthetic oligonucleotide
  Target: SCN9A; (-) strand; PAM type: YTN; PAM sequence: CTC
tagatatcaataaacattcc

SEQ ID NO: 56883 - DNA, 20 bp, Artificial Sequence
  Description of Artificial Sequence: Synthetic oligonucleotide
  Target: SCN9A; (-) strand; PAM type: YTN; PAM sequence: CTA
acctctagatatcaataaac

SEQ ID NO: 56884 - DNA, 20 bp, Artificial Sequence
  Description of Artificial Sequence: Synthetic oligonucleotide
  Target: SCN9A; (-) strand; PAM type: YTN; PAM sequence: CTC
taacctctagatatcaataa

SEQ ID NO: 56885 - DNA, 20 bp, Artificial Sequence
  Description of Artificial Sequence: Synthetic oligonucleotide
  Target: SCN9A; (-) strand; PAM type: YTN; PAM sequence: CTG
gtctctaacctctagatatc

SEQ ID NO: 56886 - DNA, 20 bp, Artificial Sequence
  Description of Artificial Sequence: Synthetic oligonucleotide
  Target: SCN9A; (-) strand; PAM type: YTN; PAM sequence: TTA
gcacgatcactggtctctaa

SEQ ID NO: 56887 - DNA, 20 bp, Artificial Sequence
  Description of Artificial Sequence: Synthetic oligonucleotide
  Target: SCN9A; (-) strand; PAM type: YTN; PAM sequence: TTT
agcacgatcactggtctcta

SEQ ID NO: 56888 - DNA, 20 bp, Artificial Sequence
  Description of Artificial Sequence: Synthetic oligonucleotide
  Target: SCN9A; (-) strand; PAM type: YTN; PAM sequence: CTG
tgcatggtgggatgtttagc

SEQ ID NO: 56889 - DNA, 20 bp, Artificial Sequence
  Description of Artificial Sequence: Synthetic oligonucleotide
  Target: SCN9A; (-) strand; PAM type: YTN; PAM sequence: CTG
tcctgtgcatggtgggatgt

SEQ ID NO: 56890 - DNA, 20 bp, Artificial Sequence
  Description of Artificial Sequence: Synthetic oligonucleotide
  Target: SCN9A; (-) strand; PAM type: YTN; PAM sequence: TTG
tgagtggctgtcctgtgcat

SEQ ID NO: 56891 - DNA, 20 bp, Artificial Sequence
  Description of Artificial Sequence: Synthetic oligonucleotide
  Target: SCN9A; (-) strand; PAM type: YTN; PAM sequence: TTG
ttgtgagtggctgtcctgtg

SEQ ID NO: 56892 - DNA, 20 bp, Artificial Sequence
  Description of Artificial Sequence: Synthetic oligonucleotide
  Target: SCN9A; (-) strand; PAM type: YTN; PAM sequence: TTT
gttgtgagtggctgtcctgt

SEQ ID NO: 56893 - DNA, 20 bp, Artificial Sequence
  Description of Artificial Sequence: Synthetic oligonucleotide
  Target: SCN9A; (-) strand; PAM type: YTN; PAM sequence: CTT
tgttgtgagtggctgtcctg

SEQ ID NO: 56894 - DNA, 20 bp, Artificial Sequence
  Description of Artificial Sequence: Synthetic oligonucleotide
  Target: SCN9A; (-) strand; PAM type: YTN; PAM sequence: TTC
tttgttgtgagtggctgtcc

SEQ ID NO: 56895 - DNA, 20 bp, Artificial Sequence
  Description of Artificial Sequence: Synthetic oligonucleotide
  Target: SCN9A; (-) strand; PAM type: YTN; PAM sequence: CTG
gataattctttgttgtgagt

SEQ ID NO: 56896 - DNA, 20 bp, Artificial Sequence
  Description of Artificial Sequence: Synthetic oligonucleotide
  Target: SCN9A; (-) strand; PAM type: YTN; PAM sequence: TTG
agctggataattctttgttg

SEQ ID NO: 56897 - DNA, 20 bp, Artificial Sequence
  Description of Artificial Sequence: Synthetic oligonucleotide
  Target: SCN9A; (-) strand; PAM type: YTN; PAM sequence: TTT
gagctggataattctttgtt

SEQ ID NO: 56898 - DNA, 20 bp, Artificial Sequence
  Description of Artificial Sequence: Synthetic oligonucleotide
  Target: SCN9A; (-) strand; PAM type: YTN; PAM sequence: TTG
atatttgagctggataattc

SEQ ID NO: 56899 - DNA, 20 bp, Artificial Sequence
  Description of Artificial Sequence: Synthetic oligonucleotide
  Target: SCN9A; (-) strand; PAM type: YTN; PAM sequence: CTT
gatatttgagctggataatt

SEQ ID NO: 56900 - DNA, 20 bp, Artificial Sequence
  Description of Artificial Sequence: Synthetic oligonucleotide
  Target: SCN9A; (-) strand; PAM type: YTN; PAM sequence: TTG
gcaatcttgatatttgagct

SEQ ID NO: 56901 - DNA, 20 bp, Artificial Sequence
  Description of Artificial Sequence: Synthetic oligonucleotide
  Target: SCN9A; (-) strand; PAM type: YTN; PAM sequence: CTC
aatattggcaatcttgatat

SEQ ID NO: 56902 - DNA, 20 bp, Artificial Sequence
  Description of Artificial Sequence: Synthetic oligonucleotide
  Target: SCN9A; (-) strand; PAM type: YTN; PAM sequence: TTC
tcaatattggcaatcttgat

SEQ ID NO: 56903 - DNA, 20 bp, Artificial Sequence
  Description of Artificial Sequence: Synthetic oligonucleotide
  Target: SCN9A; (-) strand; PAM type: YTN; PAM sequence: TTT
ctcaatattggcaatcttga

SEQ ID NO: 56904 - DNA, 20 bp, Artificial Sequence
  Description of Artificial Sequence: Synthetic oligonucleotide
  Target: SCN9A; (-) strand; PAM type: YTN; PAM sequence: CTG
agtttctcaatattggcaat

SEQ ID NO: 56905 - DNA, 20 bp, Artificial Sequence
  Description of Artificial Sequence: Synthetic oligonucleotide
  Target: SCN9A; (-) strand; PAM type: YTN; PAM sequence: CTA
aggcctgagtttctcaatat

SEQ ID NO: 56906 - DNA, 20 bp, Artificial Sequence
  Description of Artificial Sequence: Synthetic oligonucleotide
  Target: SCN9A; (-) strand; PAM type: YTN; PAM sequence: CTC
taaggcctgagtttctcaat

SEQ ID NO: 56907 - DNA, 20 bp, Artificial Sequence
  Description of Artificial Sequence: Synthetic oligonucleotide
  Target: SCN9A; (-) strand; PAM type: YTN; PAM sequence: TTC
tctaaggcctgagtttctca

SEQ ID NO: 56908 - DNA, 20 bp, Artificial Sequence
  Description of Artificial Sequence: Synthetic oligonucleotide
  Target: SCN9A; (-) strand; PAM type: YTN; PAM sequence: TTT
ctctaaggcctgagtttctc

SEQ ID NO: 56909 - DNA, 20 bp, Artificial Sequence
  Description of Artificial Sequence: Synthetic oligonucleotide
  Target: SCN9A; (-) strand; PAM type: YTN; PAM sequence: TTA
tttctctaaggcctgagttt

SEQ ID NO: 56910 - DNA, 20 bp, Artificial Sequence
  Description of Artificial Sequence: Synthetic oligonucleotide
  Target: SCN9A; (-) strand; PAM type: YTN; PAM sequence: TTT
atttctctaaggcctgagtt

SEQ ID NO: 56911 - DNA, 20 bp, Artificial Sequence
  Description of Artificial Sequence: Synthetic oligonucleotide
  Target: SCN9A; (-) strand; PAM type: YTN; PAM sequence: TTA
aaatcagacatttatttctc

SEQ ID NO: 56912 - DNA, 20 bp, Artificial Sequence
  Description of Artificial Sequence: Synthetic oligonucleotide
  Target: SCN9A; (-) strand; PAM type: YTN; PAM sequence: CTA
cattaaaatcagacatttat

SEQ ID NO: 56913 - DNA, 20 bp, Artificial Sequence
  Description of Artificial Sequence: Synthetic oligonucleotide
  Target: SCN9A; (-) strand; PAM type: YTN; PAM sequence: TTC
tacattaaaatcagacattt

SEQ ID NO: 56914 - DNA, 20 bp, Artificial Sequence
  Description of Artificial Sequence: Synthetic oligonucleotide
  Target: SCN9A; (-) strand; PAM type: YTN; PAM sequence: TTC
atatacattctacattaaaa

SEQ ID NO: 56915 - DNA, 20 bp, Artificial Sequence
  Description of Artificial Sequence: Synthetic oligonucleotide
  Target: SCN9A; (-) strand; PAM type: YTN; PAM sequence: TTT
catatacattctacattaaa

SEQ ID NO: 56916 - DNA, 20 bp, Artificial Sequence
  Description of Artificial Sequence: Synthetic oligonucleotide
  Target: SCN9A; (-) strand; PAM type: YTN; PAM sequence: CTT
tcatatacattctacattaa

SEQ ID NO: 56917 - DNA, 20 bp, Artificial Sequence
  Description of Artificial Sequence: Synthetic oligonucleotide
  Target: SCN9A; (-) strand; PAM type: YTN; PAM sequence: CTG
aaaaatgaaaactttcatat

SEQ ID NO: 56918 - DNA, 20 bp, Artificial Sequence
  Description of Artificial Sequence: Synthetic oligonucleotide
  Target: SCN9A; (-) strand; PAM type: YTN; PAM sequence: TTA
acaaagtagaaaaaaaacag

SEQ ID NO: 56919 - DNA, 20 bp, Artificial Sequence
  Description of Artificial Sequence: Synthetic oligonucleotide
  Target: SCN9A; (-) strand; PAM type: YTN; PAM sequence: TTT
aacaaagtagaaaaaaaaca

SEQ ID NO: 56920 - DNA, 20 bp, Artificial Sequence
  Description of Artificial Sequence: Synthetic oligonucleotide
  Target: SCN9A; (-) strand; PAM type: YTN; PAM sequence: CTT
taacaaagtagaaaaaaaac

SEQ ID NO: 56921 - DNA, 20 bp, Artificial Sequence
  Description of Artificial Sequence: Synthetic oligonucleotide
  Target: SCN9A; (-) strand; PAM type: YTN; PAM sequence: CTA
tagctttaacaaagtagaaa

SEQ ID NO: 56922 - DNA, 20 bp, Artificial Sequence
  Description of Artificial Sequence: Synthetic oligonucleotide
  Target: SCN9A; (-) strand; PAM type: YTN; PAM sequence: CTC
tatagctttaacaaagtaga

SEQ ID NO: 56923 - DNA, 20 bp, Artificial Sequence
  Description of Artificial Sequence: Synthetic oligonucleotide
  Target: SCN9A; (-) strand; PAM type: YTN; PAM sequence: TTC
ctctatagctttaacaaagt

SEQ ID NO: 56924 - DNA, 20 bp, Artificial Sequence
  Description of Artificial Sequence: Synthetic oligonucleotide
  Target: SCN9A; (-) strand; PAM type: YTN; PAM sequence: TTT
cctctatagctttaacaaag

SEQ ID NO: 56925 - DNA, 20 bp, Artificial Sequence
  Description of Artificial Sequence: Synthetic oligonucleotide
  Target: SCN9A; (-) strand; PAM type: YTN; PAM sequence: TTT
tcctctatagctttaacaaa

SEQ ID NO: 56926 - DNA, 20 bp, Artificial Sequence
  Description of Artificial Sequence: Synthetic oligonucleotide
  Target: SCN9A; (-) strand; PAM type: YTN; PAM sequence: TTT
ttcctctatagctttaacaa

SEQ ID NO: 56927 - DNA, 20 bp, Artificial Sequence
  Description of Artificial Sequence: Synthetic oligonucleotide
  Target: SCN9A; (-) strand; PAM type: YTN; PAM sequence: TTA
aaagtgtttttcctctatag

SEQ ID NO: 56928 - DNA, 20 bp, Artificial Sequence
  Description of Artificial Sequence: Synthetic oligonucleotide
  Target: SCN9A; (-) strand; PAM type: YTN; PAM sequence: CTA
agttaaaagtgtttttcctc

SEQ ID NO: 56929 - DNA, 20 bp, Artificial Sequence
  Description of Artificial Sequence: Synthetic oligonucleotide
  Target: SCN9A; (-) strand; PAM type: YTN; PAM sequence: TTG
aaggactaagttaaaagtgt

SEQ ID NO: 56930 - DNA, 20 bp, Artificial Sequence
  Description of Artificial Sequence: Synthetic oligonucleotide
  Target: SCN9A; (-) strand; PAM type: YTN; PAM sequence: TTT
gaaggactaagttaaaagtg

SEQ ID NO: 56931 - DNA, 20 bp, Artificial Sequence
  Description of Artificial Sequence: Synthetic oligonucleotide
  Target: SCN9A; (-) strand; PAM type: YTN; PAM sequence: TTT
tgaaggactaagttaaaagt

SEQ ID NO: 56932 - DNA, 20 bp, Artificial Sequence
  Description of Artificial Sequence: Synthetic oligonucleotide
  Target: SCN9A; (-) strand; PAM type: YTN; PAM sequence: TTT
ttgaaggactaagttaaaag

SEQ ID NO: 56933 - DNA, 20 bp, Artificial Sequence
  Description of Artificial Sequence: Synthetic oligonucleotide
  Target: SCN9A; (-) strand; PAM type: YTN; PAM sequence: CTG
gcatttttgaaggactaagt

SEQ ID NO: 56934 - DNA, 20 bp, Artificial Sequence
  Description of Artificial Sequence: Synthetic oligonucleotide
  Target: SCN9A; (-) strand; PAM type: YTN; PAM sequence: TTA
gtatagaaaactggcatttt

SEQ ID NO: 56935 - DNA, 20 bp, Artificial Sequence
  Description of Artificial Sequence: Synthetic oligonucleotide
  Target: SCN9A; (-) strand; PAM type: YTN; PAM sequence: CTC
acaaaataaaattagtatag

SEQ ID NO: 56936 - DNA, 20 bp, Artificial Sequence
  Description of Artificial Sequence: Synthetic oligonucleotide
  Target: SCN9A; (-) strand; PAM type: YTN; PAM sequence: CTG
ctcacaaaataaaattagta

SEQ ID NO: 56937 - DNA, 20 bp, Artificial Sequence
  Description of Artificial Sequence: Synthetic oligonucleotide
  Target: SCN9A; (-) strand; PAM type: YTN; PAM sequence: CTG
tcccactgctcacaaaataa

SEQ ID NO: 56938 - DNA, 20 bp, Artificial Sequence
  Description of Artificial Sequence: Synthetic oligonucleotide
  Target: SCN9A; (-) strand; PAM type: YTN; PAM sequence: TTG
aaactgtcccactgctcaca

SEQ ID NO: 56939 - DNA, 20 bp, Artificial Sequence
  Description of Artificial Sequence: Synthetic oligonucleotide
  Target: SCN9A; (-) strand; PAM type: YTN; PAM sequence: TTT
gaaactgtcccactgctcac

SEQ ID NO: 56940 - DNA, 20 bp, Artificial Sequence
  Description of Artificial Sequence: Synthetic oligonucleotide
  Target: SCN9A; (-) strand; PAM type: YTN; PAM sequence: TTG
agtggatgtttgaaactgtc

SEQ ID NO: 56941 - DNA, 20 bp, Artificial Sequence
  Description of Artificial Sequence: Synthetic oligonucleotide
  Target: SCN9A; (-) strand; PAM type: YTN; PAM sequence: TTC
acatggtaagttgagtggat

SEQ ID NO: 56942 - DNA, 20 bp, Artificial Sequence
  Description of Artificial Sequence: Synthetic oligonucleotide
  Target: SCN9A; (-) strand; PAM type: YTN; PAM sequence: TTT
cacatggtaagttgagtgga

SEQ ID NO: 56943 - DNA, 20 bp, Artificial Sequence
  Description of Artificial Sequence: Synthetic oligonucleotide
  Target: SCN9A; (-) strand; PAM type: YTN; PAM sequence: CTT
tcacatggtaagttgagtgg

SEQ ID NO: 56944 - DNA, 20 bp, Artificial Sequence
  Description of Artificial Sequence: Synthetic oligonucleotide
  Target: SCN9A; (-) strand; PAM type: YTN; PAM sequence: CTA
tacatgtctttcacatggta

SEQ ID NO: 56945 - DNA, 20 bp, Artificial Sequence
  Description of Artificial Sequence: Synthetic oligonucleotide
  Target: SCN9A; (-) strand; PAM type: YTN; PAM sequence: CTG
agagagactatacatgtctt

SEQ ID NO: 56946 - DNA, 20 bp, Artificial Sequence
  Description of Artificial Sequence: Synthetic oligonucleotide
  Target: SCN9A; (-) strand; PAM type: YTN; PAM sequence: CTG
gcctgagagagactatacat

SEQ ID NO: 56947 - DNA, 20 bp, Artificial Sequence
  Description of Artificial Sequence: Synthetic oligonucleotide
  Target: SCN9A; (-) strand; PAM type: YTN; PAM sequence: TTC
tggcctgagagagactatac

SEQ ID NO: 56948 - DNA, 20 bp, Artificial Sequence
  Description of Artificial Sequence: Synthetic oligonucleotide
  Target: SCN9A; (-) strand; PAM type: YTN; PAM sequence: TTT
ctggcctgagagagactata

SEQ ID NO: 56949 - DNA, 20 bp, Artificial Sequence
  Description of Artificial Sequence: Synthetic oligonucleotide
  Target: SCN9A; (-) strand; PAM type: YTN; PAM sequence: CTT
tctggcctgagagagactat

SEQ ID NO: 56950 - DNA, 20 bp, Artificial Sequence
  Description of Artificial Sequence: Synthetic oligonucleotide
  Target: SCN9A; (-) strand; PAM type: YTN; PAM sequence: TTA
tacagtgccagtgctttctg

SEQ ID NO: 56951 - DNA, 20 bp, Artificial Sequence
  Description of Artificial Sequence: Synthetic oligonucleotide
  Target: SCN9A; (-) strand; PAM type: YTN; PAM sequence: CTT
atacagtgccagtgctttct

SEQ ID NO: 56952 - DNA, 20 bp, Artificial Sequence
  Description of Artificial Sequence: Synthetic oligonucleotide
  Target: SCN9A; (-) strand; PAM type: YTN; PAM sequence: TTC
ttatacagtgccagtgcttt

SEQ ID NO: 56953 - DNA, 20 bp, Artificial Sequence
  Description of Artificial Sequence: Synthetic oligonucleotide
  Target: SCN9A; (-) strand; PAM type: YTN; PAM sequence: TTA
cattcttatacagtgccagt

SEQ ID NO: 56954 - DNA, 20 bp, Artificial Sequence
  Description of Artificial Sequence: Synthetic oligonucleotide
  Target: SCN9A; (-) strand; PAM type: YTN; PAM sequence: CTT
acattcttatacagtgccag

SEQ ID NO: 56955 - DNA, 20 bp, Artificial Sequence
  Description of Artificial Sequence: Synthetic oligonucleotide
  Target: SCN9A; (-) strand; PAM type: YTN; PAM sequence: TTC
ttacattcttatacagtgcc

SEQ ID NO: 56956 - DNA, 20 bp, Artificial Sequence
  Description of Artificial Sequence: Synthetic oligonucleotide
  Target: SCN9A; (-) strand; PAM type: YTN; PAM sequence: CTC
aacaaaagtatagtgtattc

SEQ ID NO: 56957 - DNA, 20 bp, Artificial Sequence
  Description of Artificial Sequence: Synthetic oligonucleotide
  Target: SCN9A; (-) strand; PAM type: YTN; PAM sequence: TTC
tcaacaaaagtatagtgtat

SEQ ID NO: 56958 - DNA, 20 bp, Artificial Sequence
  Description of Artificial Sequence: Synthetic oligonucleotide
  Target: SCN9A; (-) strand; PAM type: YTN; PAM sequence: CTT
ctcaacaaaagtatagtgta

SEQ ID NO: 56959 - DNA, 20 bp, Artificial Sequence
  Description of Artificial Sequence: Synthetic oligonucleotide
  Target: SCN9A; (-) strand; PAM type: YTN; PAM sequence: TTG
caggatcttctcaacaaaag

SEQ ID NO: 56960 - DNA, 20 bp, Artificial Sequence
  Description of Artificial Sequence: Synthetic oligonucleotide
  Target: SCN9A; (-) strand; PAM type: YTN; PAM sequence: TTT
gcaggatcttctcaacaaaa

SEQ ID NO: 56961 - DNA, 20 bp, Artificial Sequence
  Description of Artificial Sequence: Synthetic oligonucleotide
  Target: SCN9A; (-) strand; PAM type: YTN; PAM sequence: CTG
tttgcaggatcttctcaaca

SEQ ID NO: 56962 - DNA, 20 bp, Artificial Sequence
  Description of Artificial Sequence: Synthetic oligonucleotide
  Target: SCN9A; (-) strand; PAM type: YTN; PAM sequence: TTC
tgtttgcaggatcttctcaa

SEQ ID NO: 56963 - DNA, 20 bp, Artificial Sequence
  Description of Artificial Sequence: Synthetic oligonucleotide
  Target: SCN9A; (-) strand; PAM type: YTN; PAM sequence: TTT
ctgtttgcaggatcttctca

SEQ ID NO: 56964 - DNA, 20 bp, Artificial Sequence
  Description of Artificial Sequence: Synthetic oligonucleotide
  Target: SCN9A; (-) strand; PAM type: YTN; PAM sequence: CTT
tctgtttgcaggatcttctc

SEQ ID NO: 56965 - DNA, 20 bp, Artificial Sequence
  Description of Artificial Sequence: Synthetic oligonucleotide
  Target: SCN9A; (-) strand; PAM type: YTN; PAM sequence: TTC
tttctgtttgcaggatcttc

SEQ ID NO: 56966 - DNA, 20 bp, Artificial Sequence
  Description of Artificial Sequence: Synthetic oligonucleotide
  Target: SCN9A; (-) strand; PAM type: YTN; PAM sequence: TTT
ctttctgtttgcaggatctt

SEQ ID NO: 56967 - DNA, 20 bp, Artificial Sequence
  Description of Artificial Sequence: Synthetic oligonucleotide
  Target: SCN9A; (-) strand; PAM type: YTN; PAM sequence: TTT
tctttctgtttgcaggatct

SEQ ID NO: 56968 - DNA, 20 bp, Artificial Sequence
  Description of Artificial Sequence: Synthetic oligonucleotide
  Target: SCN9A; (-) strand; PAM type: YTN; PAM sequence: CTC
aatagttttctttctgtttg

SEQ ID NO: 56969 - DNA, 20 bp, Artificial Sequence
  Description of Artificial Sequence: Synthetic oligonucleotide
  Target: SCN9A; (-) strand; PAM type: YTN; PAM sequence: TTC
agcctcaatagttttctttc

SEQ ID NO: 56970 - DNA, 20 bp, Artificial Sequence
  Description of Artificial Sequence: Synthetic oligonucleotide
  Target: SCN9A; (-) strand; PAM type: YTN; PAM sequence: CTT
cagcctcaatagttttcttt

SEQ ID NO: 56971 - DNA, 20 bp, Artificial Sequence
  Description of Artificial Sequence: Synthetic oligonucleotide
  Target: SCN9A; (-) strand; PAM type: YTN; PAM sequence: CTG
tgtgcttcagcctcaatagt

SEQ ID NO: 56972 - DNA, 20 bp, Artificial Sequence
  Description of Artificial Sequence: Synthetic oligonucleotide
  Target: SCN9A; (-) strand; PAM type: YTN; PAM sequence: TTA
atctgtgtgcttcagcctca

SEQ ID NO: 56973 - DNA, 20 bp, Artificial Sequence
  Description of Artificial Sequence: Synthetic oligonucleotide
  Target: SCN9A; (-) strand; PAM type: YTN; PAM sequence: CTT
aatctgtgtgcttcagcctc

SEQ ID NO: 56974 - DNA, 20 bp, Artificial Sequence
  Description of Artificial Sequence: Synthetic oligonucleotide
  Target: SCN9A; (-) strand; PAM type: YTN; PAM sequence: CTA
tcttaatctgtgtgcttcag

SEQ ID NO: 56975 - DNA, 20 bp, Artificial Sequence
  Description of Artificial Sequence: Synthetic oligonucleotide
  Target: SCN9A; (-) strand; PAM type: YTN; PAM sequence: TTC
cctatcttaatctgtgtgct

SEQ ID NO: 56976 - DNA, 20 bp, Artificial Sequence
  Description of Artificial Sequence: Synthetic oligonucleotide
  Target: SCN9A; (-) strand; PAM type: YTN; PAM sequence: TTT
ccctatcttaatctgtgtgc

SEQ ID NO: 56977 - DNA, 20 bp, Artificial Sequence
  Description of Artificial Sequence: Synthetic oligonucleotide
  Target: SCN9A; (-) strand; PAM type: YTN; PAM sequence: CTT
tccctatcttaatctgtgtg

SEQ ID NO: 56978 - DNA, 20 bp, Artificial Sequence
  Description of Artificial Sequence: Synthetic oligonucleotide
  Target: SCN9A; (-) strand; PAM type: YTN; PAM sequence: CTC
tttccctatcttaatctgtg

SEQ ID NO: 56979 - DNA, 20 bp, Artificial Sequence
  Description of Artificial Sequence: Synthetic oligonucleotide
  Target: SCN9A; (-) strand; PAM type: YTN; PAM sequence: TTC
cctctttccctatcttaatc

SEQ ID NO: 56980 - DNA, 20 bp, Artificial Sequence
  Description of Artificial Sequence: Synthetic oligonucleotide
  Target: SCN9A; (-) strand; PAM type: YTN; PAM sequence: CTT
ccctctttccctatcttaat

SEQ ID NO: 56981 - DNA, 20 bp, Artificial Sequence
  Description of Artificial Sequence: Synthetic oligonucleotide
  Target: SCN9A; (-) strand; PAM type: YTN; PAM sequence: TTA
tcttccctctttccctatct

SEQ ID NO: 56982 - DNA, 20 bp, Artificial Sequence
  Description of Artificial Sequence: Synthetic oligonucleotide
  Target: SCN9A; (-) strand; PAM type: YTN; PAM sequence: CTT
atcttccctctttccctatc

SEQ ID NO: 56983 - DNA, 20 bp, Artificial Sequence
  Description of Artificial Sequence: Synthetic oligonucleotide
  Target: SCN9A; (-) strand; PAM type: YTN; PAM sequence: CTC
ttatcttccctctttcccta

SEQ ID NO: 56984 - DNA, 20 bp, Artificial Sequence
  Description of Artificial Sequence: Synthetic oligonucleotide
  Target: SCN9A; (-) strand; PAM type: YTN; PAM sequence: CTG
ctcttatcttccctctttcc

SEQ ID NO: 56985 - DNA, 20 bp, Artificial Sequence
  Description of Artificial Sequence: Synthetic oligonucleotide
  Target: SCN9A; (-) strand; PAM type: YTN; PAM sequence: CTC
actgctcttatcttccctct

SEQ ID NO: 56986 - DNA, 20 bp, Artificial Sequence
  Description of Artificial Sequence: Synthetic oligonucleotide
  Target: SCN9A; (-) strand; PAM type: YTN; PAM sequence: CTA
caccatgtcagcctcactgc

SEQ ID NO: 56987 - DNA, 20 bp, Artificial Sequence
  Description of Artificial Sequence: Synthetic oligonucleotide
  Target: SCN9A; (-) strand; PAM type: YTN; PAM sequence: TTC
cagccctacaccatgtcagc

SEQ ID NO: 56988 - DNA, 20 bp, Artificial Sequence
  Description of Artificial Sequence: Synthetic oligonucleotide
  Target: SCN9A; (-) strand; PAM type: YTN; PAM sequence: TTT
ccagccctacaccatgtcag

SEQ ID NO: 56989 - DNA, 20 bp, Artificial Sequence
  Description of Artificial Sequence: Synthetic oligonucleotide
  Target: SCN9A; (-) strand; PAM type: YTN; PAM sequence: CTT
tccagccctacaccatgtca

SEQ ID NO: 56990 - DNA, 20 bp, Artificial Sequence
  Description of Artificial Sequence: Synthetic oligonucleotide
  Target: SCN9A; (-) strand; PAM type: YTN; PAM sequence: CTA
caagctttccagccctacac

SEQ ID NO: 56991 - DNA, 20 bp, Artificial Sequence
  Description of Artificial Sequence: Synthetic oligonucleotide
  Target: SCN9A; (-) strand; PAM type: YTN; PAM sequence: TTC
tacaagctttccagccctac

SEQ ID NO: 56992 - DNA, 20 bp, Artificial Sequence
  Description of Artificial Sequence: Synthetic oligonucleotide
  Target: SCN9A; (-) strand; PAM type: YTN; PAM sequence: CTA
caagttctacaagctttcca

SEQ ID NO: 56993 - DNA, 20 bp, Artificial Sequence
  Description of Artificial Sequence: Synthetic oligonucleotide
  Target: SCN9A; (-) strand; PAM type: YTN; PAM sequence: CTG
tctacaagttctacaagctt

SEQ ID NO: 56994 - DNA, 20 bp, Artificial Sequence
  Description of Artificial Sequence: Synthetic oligonucleotide
  Target: SCN9A; (-) strand; PAM type: YTN; PAM sequence: TTA
ctgtctacaagttctacaag

SEQ ID NO: 56995 - DNA, 20 bp, Artificial Sequence
  Description of Artificial Sequence: Synthetic oligonucleotide
  Target: SCN9A; (-) strand; PAM type: YTN; PAM sequence: CTA
ttactgtctacaagttctac

SEQ ID NO: 56996 - DNA, 20 bp, Artificial Sequence
  Description of Artificial Sequence: Synthetic oligonucleotide
  Target: SCN9A; (-) strand; PAM type: YTN; PAM sequence: CTA
tactattactgtctacaagt

SEQ ID NO: 56997 - DNA, 20 bp, Artificial Sequence
  Description of Artificial Sequence: Synthetic oligonucleotide
  Target: SCN9A; (-) strand; PAM type: YTN; PAM sequence: CTC
tatactattactgtctacaa

SEQ ID NO: 56998 - DNA, 20 bp, Artificial Sequence
  Description of Artificial Sequence: Synthetic oligonucleotide
  Target: SCN9A; (-) strand; PAM type: YTN; PAM sequence: TTA
caaactctatactattactg

SEQ ID NO: 56999 - DNA, 20 bp, Artificial Sequence
  Description of Artificial Sequence: Synthetic oligonucleotide
  Target: SCN9A; (-) strand; PAM type: YTN; PAM sequence: TTT
acaaactctatactattact

SEQ ID NO: 57000 - DNA, 20 bp, Artificial Sequence
  Description of Artificial Sequence: Synthetic oligonucleotide
  Target: SCN9A; (-) strand; PAM type: YTN; PAM sequence: TTT
tacaaactctatactattac

SEQ ID NO: 57001 - DNA, 20 bp, Artificial Sequence
  Description of Artificial Sequence: Synthetic oligonucleotide
  Target: SCN9A; (-) strand; PAM type: YTN; PAM sequence: CTC
agcaaagattttacaaactc

SEQ ID NO: 57002 - DNA, 20 bp, Artificial Sequence
  Description of Artificial Sequence: Synthetic oligonucleotide
  Target: SCN9A; (-) strand; PAM type: YTN; PAM sequence: CTA
aaatcctcagcaaagatttt

SEQ ID NO: 57003 - DNA, 20 bp, Artificial Sequence
  Description of Artificial Sequence: Synthetic oligonucleotide
  Target: SCN9A; (-) strand; PAM type: YTN; PAM sequence: TTC
taaaatcctcagcaaagatt

SEQ ID NO: 57004 - DNA, 20 bp, Artificial Sequence
  Description of Artificial Sequence: Synthetic oligonucleotide
  Target: SCN9A; (-) strand; PAM type: YTN; PAM sequence: TTA
tgatgataaattctaaaatc

SEQ ID NO: 57005 - DNA, 20 bp, Artificial Sequence
  Description of Artificial Sequence: Synthetic oligonucleotide
  Target: SCN9A; (-) strand; PAM type: YTN; PAM sequence: TTA
ttatgatgataaattctaaa

SEQ ID NO: 57006 - DNA, 20 bp, Artificial Sequence
  Description of Artificial Sequence: Synthetic oligonucleotide
  Target: SCN9A; (-) strand; PAM type: YTN; PAM sequence: CTC
cattattatgatgataaatt

SEQ ID NO: 57007 - DNA, 20 bp, Artificial Sequence
  Description of Artificial Sequence: Synthetic oligonucleotide
  Target: SCN9A; (-) strand; PAM type: YTN; PAM sequence: TTC
tccattattatgatgataaa

SEQ ID NO: 57008 - DNA, 20 bp, Artificial Sequence
  Description of Artificial Sequence: Synthetic oligonucleotide
  Target: SCN9A; (-) strand; PAM type: YTN; PAM sequence: TTT
ctccattattatgatgataa

SEQ ID NO: 57009 - DNA, 20 bp, Artificial Sequence
  Description of Artificial Sequence: Synthetic oligonucleotide
  Target: SCN9A; (-) strand; PAM type: YTN; PAM sequence: CTG
taatatttctccattattat

SEQ ID NO: 57010 - DNA, 20 bp, Artificial Sequence
  Description of Artificial Sequence: Synthetic oligonucleotide
  Target: SCN9A; (-) strand; PAM type: YTN; PAM sequence: TTC
tgtaatatttctccattatt

SEQ ID NO: 57011 - DNA, 20 bp, Artificial Sequence
  Description of Artificial Sequence: Synthetic oligonucleotide
  Target: SCN9A; (-) strand; PAM type: YTN; PAM sequence: TTC
cggcataaaattctgtaata

SEQ ID NO: 57012 - DNA, 20 bp, Artificial Sequence
  Description of Artificial Sequence: Synthetic oligonucleotide
  Target: SCN9A; (-) strand; PAM type: YTN; PAM sequence: TTT
ccggcataaaattctgtaat

SEQ ID NO: 57013 - DNA, 20 bp, Artificial Sequence
  Description of Artificial Sequence: Synthetic oligonucleotide
  Target: SCN9A; (-) strand; PAM type: YTN; PAM sequence: TTT
tccggcataaaattctgtaa

SEQ ID NO: 57014 - DNA, 20 bp, Artificial Sequence
  Description of Artificial Sequence: Synthetic oligonucleotide
  Target: SCN9A; (-) strand; PAM type: YTN; PAM sequence: TTG
ggtcattttccggcataaaa

SEQ ID NO: 57015 - DNA, 20 bp, Artificial Sequence
  Description of Artificial Sequence: Synthetic oligonucleotide
  Target: SCN9A; (-) strand; PAM type: YTN; PAM sequence: TTT
gggtcattttccggcataaa

SEQ ID NO: 57016 - DNA, 20 bp, Artificial Sequence
  Description of Artificial Sequence: Synthetic oligonucleotide
  Target: SCN9A; (-) strand; PAM type: YTN; PAM sequence: TTT
tgggtcattttccggcataa

SEQ ID NO: 57017 - DNA, 20 bp, Artificial Sequence
  Description of Artificial Sequence: Synthetic oligonucleotide
  Target: SCN9A; (-) strand; PAM type: YTN; PAM sequence: TTA
aaattttgggtcattttccg

SEQ ID NO: 57018 - DNA, 20 bp, Artificial Sequence
  Description of Artificial Sequence: Synthetic oligonucleotide
  Target: SCN9A; (-) strand; PAM type: YTN; PAM sequence: CTT
aaaattttgggtcattttcc

SEQ ID NO: 57019 - DNA, 20 bp, Artificial Sequence
  Description of Artificial Sequence: Synthetic oligonucleotide
  Target: SCN9A; (-) strand; PAM type: YTN; PAM sequence: CTG
cttaaaattttgggtcattt

SEQ ID NO: 57020 - DNA, 20 bp, Artificial Sequence
  Description of Artificial Sequence: Synthetic oligonucleotide
  Target: SCN9A; (-) strand; PAM type: YTN; PAM sequence: TTC
cctgcttaaaattttgggtc

SEQ ID NO: 57021 - DNA, 20 bp, Artificial Sequence
  Description of Artificial Sequence: Synthetic oligonucleotide
  Target: SCN9A; (-) strand; PAM type: YTN; PAM sequence: TTT
ccctgcttaaaattttgggt

SEQ ID NO: 57022 - DNA, 20 bp, Artificial Sequence
  Description of Artificial Sequence: Synthetic oligonucleotide
  Target: SCN9A; (-) strand; PAM type: YTN; PAM sequence: TTG
tgacatttccctgcttaaaa

SEQ ID NO: 57023 - DNA, 20 bp, Artificial Sequence
  Description of Artificial Sequence: Synthetic oligonucleotide
  Target: SCN9A; (-) strand; PAM type: YTN; PAM sequence: TTA
tgaggttgtgacatttccct

SEQ ID NO: 57024 - DNA, 20 bp, Artificial Sequence
  Description of Artificial Sequence: Synthetic oligonucleotide
  Target: SCN9A; (-) strand; PAM type: YTN; PAM sequence: TTT
atgaggttgtgacatttccc

SEQ ID NO: 57025 - DNA, 20 bp, Artificial Sequence
  Description of Artificial Sequence: Synthetic oligonucleotide
  Target: SCN9A; (-) strand; PAM type: YTN; PAM sequence: TTT
tatgaggttgtgacatttcc

SEQ ID NO: 57026 - DNA, 20 bp, Artificial Sequence
  Description of Artificial Sequence: Synthetic oligonucleotide
  Target: SCN9A; (-) strand; PAM type: YTN; PAM sequence: CTC
agtacagtagccagagtgga

SEQ ID NO: 57027 - DNA, 20 bp, Artificial Sequence
  Description of Artificial Sequence: Synthetic oligonucleotide
  Target: SCN9A; (-) strand; PAM type: YTN; PAM sequence: TTC
tcagtacagtagccagagtg

SEQ ID NO: 57028 - DNA, 20 bp, Artificial Sequence
  Description of Artificial Sequence: Synthetic oligonucleotide
  Target: SCN9A; (-) strand; PAM type: YTN; PAM sequence: CTA
ttctcagtacagtagccaga

SEQ ID NO: 57029 - DNA, 20 bp, Artificial Sequence
  Description of Artificial Sequence: Synthetic oligonucleotide
  Target: SCN9A; (-) strand; PAM type: YTN; PAM sequence: TTC
caaatctattctcagtacag

SEQ ID NO: 57030 - DNA, 20 bp, Artificial Sequence
  Description of Artificial Sequence: Synthetic oligonucleotide
  Target: SCN9A; (-) strand; PAM type: YTN; PAM sequence: CTT
ccaaatctattctcagtaca

SEQ ID NO: 57031 - DNA, 20 bp, Artificial Sequence
  Description of Artificial Sequence: Synthetic oligonucleotide
  Target: SCN9A; (-) strand; PAM type: YTN; PAM sequence: CTC
acttccaaatctattctcag

SEQ ID NO: 57032 - DNA, 20 bp, Artificial Sequence
  Description of Artificial Sequence: Synthetic oligonucleotide
  Target: SCN9A; (-) strand; PAM type: YTN; PAM sequence: TTG
cctcacttccaaatctattc

SEQ ID NO: 57033 - DNA, 20 bp, Artificial Sequence
  Description of Artificial Sequence: Synthetic oligonucleotide
  Target: SCN9A; (-) strand; PAM type: YTN; PAM sequence: CTT
gcctcacttccaaatctatt

SEQ ID NO: 57034 - DNA, 20 bp, Artificial Sequence
  Description of Artificial Sequence: Synthetic oligonucleotide
  Target: SCN9A; (-) strand; PAM type: YTN; PAM sequence: TTC
ttgcctcacttccaaatcta

SEQ ID NO: 57035 - DNA, 20 bp, Artificial Sequence
  Description of Artificial Sequence: Synthetic oligonucleotide
  Target: SCN9A; (-) strand; PAM type: YTN; PAM sequence: CTA
aatccattcttgcctcactt

SEQ ID NO: 57036 - DNA, 20 bp, Artificial Sequence
  Description of Artificial Sequence: Synthetic oligonucleotide
  Target: SCN9A; (-) strand; PAM type: YTN; PAM sequence: TTA
ctaaatccattcttgcctca

SEQ ID NO: 57037 - DNA, 20 bp, Artificial Sequence
  Description of Artificial Sequence: Synthetic oligonucleotide
  Target: SCN9A; (-) strand; PAM type: YTN; PAM sequence: CTT
actaaatccattcttgcctc

SEQ ID NO: 57038 - DNA, 20 bp, Artificial Sequence
  Description of Artificial Sequence: Synthetic oligonucleotide
  Target: SCN9A; (-) strand; PAM type: YTN; PAM sequence: TTA
tcttactaaatccattcttg

SEQ ID NO: 57039 - DNA, 20 bp, Artificial Sequence
  Description of Artificial Sequence: Synthetic oligonucleotide
  Target: SCN9A; (-) strand; PAM type: YTN; PAM sequence: TTT
atcttactaaatccattctt

SEQ ID NO: 57040 - DNA, 20 bp, Artificial Sequence
  Description of Artificial Sequence: Synthetic oligonucleotide
  Target: SCN9A; (-) strand; PAM type: YTN; PAM sequence: TTT
tatcttactaaatccattct

SEQ ID NO: 57041 - DNA, 20 bp, Artificial Sequence
  Description of Artificial Sequence: Synthetic oligonucleotide
  Target: SCN9A; (-) strand; PAM type: YTN; PAM sequence: TTG
ttttatcttactaaatccat

SEQ ID NO: 57042 - DNA, 20 bp, Artificial Sequence
  Description of Artificial Sequence: Synthetic oligonucleotide
  Target: SCN9A; (-) strand; PAM type: YTN; PAM sequence: CTT
gttttatcttactaaatcca

SEQ ID NO: 57043 - DNA, 20 bp, Artificial Sequence
  Description of Artificial Sequence: Synthetic oligonucleotide
  Target: SCN9A; (-) strand; PAM type: YTN; PAM sequence: CTA
cttgttttatcttactaaat

SEQ ID NO: 57044 - DNA, 20 bp, Artificial Sequence
  Description of Artificial Sequence: Synthetic oligonucleotide
  Target: SCN9A; (-) strand; PAM type: YTN; PAM sequence: TTA
taagacaatgtaataaccta

SEQ ID NO: 57045 - DNA, 20 bp, Artificial Sequence
  Description of Artificial Sequence: Synthetic oligonucleotide
  Target: SCN9A; (-) strand; PAM type: YTN; PAM sequence: TTT
ataagacaatgtaataacct

SEQ ID NO: 57046 - DNA, 20 bp, Artificial Sequence
  Description of Artificial Sequence: Synthetic oligonucleotide
  Target: SCN9A; (-) strand; PAM type: YTN; PAM sequence: CTT
tataagacaatgtaataacc

SEQ ID NO: 57047 - DNA, 20 bp, Artificial Sequence
  Description of Artificial Sequence: Synthetic oligonucleotide
  Target: SCN9A; (-) strand; PAM type: YTN; PAM sequence: CTC
tttataagacaatgtaataa

SEQ ID NO: 57048 - DNA, 20 bp, Artificial Sequence
  Description of Artificial Sequence: Synthetic oligonucleotide
  Target: SCN9A; (-) strand; PAM type: YTN; PAM sequence: TTA
acctctttataagacaatgt

SEQ ID NO: 57049 - DNA, 20 bp, Artificial Sequence
  Description of Artificial Sequence: Synthetic oligonucleotide
  Target: SCN9A; (-) strand; PAM type: YTN; PAM sequence: TTT
aacctctttataagacaatg

SEQ ID NO: 57050 - DNA, 20 bp, Artificial Sequence
  Description of Artificial Sequence: Synthetic oligonucleotide
  Target: SCN9A; (-) strand; PAM type: YTN; PAM sequence: CTT
taacctctttataagacaat

SEQ ID NO: 57051 - DNA, 20 bp, Artificial Sequence
  Description of Artificial Sequence: Synthetic oligonucleotide
  Target: SCN9A; (-) strand; PAM type: YTN; PAM sequence: TTA
ccacctttaacctctttata

SEQ ID NO: 57052 - DNA, 20 bp, Artificial Sequence
  Description of Artificial Sequence: Synthetic oligonucleotide
  Target: SCN9A; (-) strand; PAM type: YTN; PAM sequence: CTA
atccaatccattaccacctt

SEQ ID NO: 57053 - DNA, 20 bp, Artificial Sequence
  Description of Artificial Sequence: Synthetic oligonucleotide
  Target: SCN9A; (-) strand; PAM type: YTN; PAM sequence: CTG
tcaacacctaatccaatcca

SEQ ID NO: 57054 - DNA, 20 bp, Artificial Sequence
  Description of Artificial Sequence: Synthetic oligonucleotide
  Target: SCN9A; (-) strand; PAM type: YTN; PAM sequence: TTC
cactgtcaacacctaatcca

SEQ ID NO: 57055 - DNA, 20 bp, Artificial Sequence
  Description of Artificial Sequence: Synthetic oligonucleotide
  Target: SCN9A; (-) strand; PAM type: YTN; PAM sequence: TTT
ccactgtcaacacctaatcc

SEQ ID NO: 57056 - DNA, 20 bp, Artificial Sequence
  Description of Artificial Sequence: Synthetic oligonucleotide
  Target: SCN9A; (-) strand; PAM type: YTN; PAM sequence: TTA
atttccactgtcaacaccta

SEQ ID NO: 57057 - DNA, 20 bp, Artificial Sequence
  Description of Artificial Sequence: Synthetic oligonucleotide
  Target: SCN9A; (-) strand; PAM type: YTN; PAM sequence: CTT
aatttccactgtcaacacct

SEQ ID NO: 57058 - DNA, 20 bp, Artificial Sequence
  Description of Artificial Sequence: Synthetic oligonucleotide
  Target: SCN9A; (-) strand; PAM type: YTN; PAM sequence: CTC
ttaatttccactgtcaacac

SEQ ID NO: 57059 - DNA, 20 bp, Artificial Sequence
  Description of Artificial Sequence: Synthetic oligonucleotide
  Target: SCN9A; (-) strand; PAM type: YTN; PAM sequence: TTC
tcttaatttccactgtcaac

SEQ ID NO: 57060 - DNA, 20 bp, Artificial Sequence
  Description of Artificial Sequence: Synthetic oligonucleotide
  Target: SCN9A; (-) strand; PAM type: YTN; PAM sequence: CTT
ctcttaatttccactgtcaa

SEQ ID NO: 57061 - DNA, 20 bp, Artificial Sequence
  Description of Artificial Sequence: Synthetic oligonucleotide
  Target: SCN9A; (-) strand; PAM type: YTN; PAM sequence: CTA
atgtaatgtaaatacatcaa

SEQ ID NO: 57062 - DNA, 20 bp, Artificial Sequence
  Description of Artificial Sequence: Synthetic oligonucleotide
  Target: SCN9A; (-) strand; PAM type: YTN; PAM sequence: CTA
ccacctaatgtaatgtaaat

SEQ ID NO: 57063 - DNA, 20 bp, Artificial Sequence
  Description of Artificial Sequence: Synthetic oligonucleotide
  Target: SCN9A; (-) strand; PAM type: YTN; PAM sequence: TTC
taccacctaatgtaatgtaa

SEQ ID NO: 57064 - DNA, 20 bp, Artificial Sequence
  Description of Artificial Sequence: Synthetic oligonucleotide
  Target: SCN9A; (-) strand; PAM type: YTN; PAM sequence: TTC
attctaccacctaatgtaat

SEQ ID NO: 57065 - DNA, 20 bp, Artificial Sequence
  Description of Artificial Sequence: Synthetic oligonucleotide
  Target: SCN9A; (-) strand; PAM type: YTN; PAM sequence: TTC
accaagaccagttcattcta

SEQ ID NO: 57066 - DNA, 20 bp, Artificial Sequence
  Description of Artificial Sequence: Synthetic oligonucleotide
  Target: SCN9A; (-) strand; PAM type: YTN; PAM sequence: TTA
ttcaccaagaccagttcatt

SEQ ID NO: 57067 - DNA, 20 bp, Artificial Sequence
  Description of Artificial Sequence: Synthetic oligonucleotide
  Target: SCN9A; (-) strand; PAM type: YTN; PAM sequence: TTT
attcaccaagaccagttcat

SEQ ID NO: 57068 - DNA, 20 bp, Artificial Sequence
  Description of Artificial Sequence: Synthetic oligonucleotide
  Target: SCN9A; (-) strand; PAM type: YTN; PAM sequence: CTC
cgcatttattcaccaagacc

SEQ ID NO: 57069 - DNA, 20 bp, Artificial Sequence
  Description of Artificial Sequence: Synthetic oligonucleotide
  Target: SCN9A; (-) strand; PAM type: YTN; PAM sequence: TTA
accctccgcatttattcacc

SEQ ID NO: 57070 - DNA, 20 bp, Artificial Sequence
  Description of Artificial Sequence: Synthetic oligonucleotide
  Target: SCN9A; (-) strand; PAM type: YTN; PAM sequence: TTC
attaaccctccgcatttatt

SEQ ID NO: 57071 - DNA, 20 bp, Artificial Sequence
  Description of Artificial Sequence: Synthetic oligonucleotide
  Target: SCN9A; (-) strand; PAM type: YTN; PAM sequence: CTT
cattaaccctccgcatttat

SEQ ID NO: 57072 - DNA, 20 bp, Artificial Sequence
  Description of Artificial Sequence: Synthetic oligonucleotide
  Target: SCN9A; (-) strand; PAM type: YTN; PAM sequence: CTC
ttcattaaccctccgcattt

SEQ ID NO: 57073 - DNA, 20 bp, Artificial Sequence
  Description of Artificial Sequence: Synthetic oligonucleotide
  Target: SCN9A; (-) strand; PAM type: YTN; PAM sequence: CTA
atcctcttcattaaccctcc

SEQ ID NO: 57074 - DNA, 20 bp, Artificial Sequence
  Description of Artificial Sequence: Synthetic oligonucleotide
  Target: SCN9A; (-) strand; PAM type: YTN; PAM sequence: TTC
caaactaatcctcttcatta

SEQ ID NO: 57075 - DNA, 20 bp, Artificial Sequence
  Description of Artificial Sequence: Synthetic oligonucleotide
  Target: SCN9A; (-) strand; PAM type: YTN; PAM sequence: TTT
ccaaactaatcctcttcatt

SEQ ID NO: 57076 - DNA, 20 bp, Artificial Sequence
  Description of Artificial Sequence: Synthetic oligonucleotide
  Target: SCN9A; (-) strand; PAM type: YTN; PAM sequence: TTT
tccaaactaatcctcttcat

SEQ ID NO: 57077 - DNA, 20 bp, Artificial Sequence
  Description of Artificial Sequence: Synthetic oligonucleotide
  Target: SCN9A; (-) strand; PAM type: YTN; PAM sequence: TTC
atccagttttccaaactaat

SEQ ID NO: 57078 - DNA, 20 bp, Artificial Sequence
  Description of Artificial Sequence: Synthetic oligonucleotide
  Target: SCN9A; (-) strand; PAM type: YTN; PAM sequence: TTA
gtaccaccattcatccagtt

SEQ ID NO: 57079 - DNA, 20 bp, Artificial Sequence
  Description of Artificial Sequence: Synthetic oligonucleotide
  Target: SCN9A; (-) strand; PAM type: YTN; PAM sequence: TTG
attagtaccaccattcatcc

SEQ ID NO: 57080 - DNA, 20 bp, Artificial Sequence
  Description of Artificial Sequence: Synthetic oligonucleotide
  Target: SCN9A; (-) strand; PAM type: YTN; PAM sequence: CTC
attgattagtaccaccattc

SEQ ID NO: 57081 - DNA, 20 bp, Artificial Sequence
  Description of Artificial Sequence: Synthetic oligonucleotide
  Target: SCN9A; (-) strand; PAM type: YTN; PAM sequence: TTC
tcattgattagtaccaccat

SEQ ID NO: 57082 - DNA, 20 bp, Artificial Sequence
  Description of Artificial Sequence: Synthetic oligonucleotide
  Target: SCN9A; (-) strand; PAM type: YTN; PAM sequence: CTT
ctcattgattagtaccacca

SEQ ID NO: 57083 - DNA, 20 bp, Artificial Sequence
  Description of Artificial Sequence: Synthetic oligonucleotide
  Target: SCN9A; (-) strand; PAM type: YTN; PAM sequence: TTC
cttctcattgattagtacca

SEQ ID NO: 57084 - DNA, 20 bp, Artificial Sequence
  Description of Artificial Sequence: Synthetic oligonucleotide
  Target: SCN9A; (-) strand; PAM type: YTN; PAM sequence: CTT
ccttctcattgattagtacc

SEQ ID NO: 57085 - DNA, 20 bp, Artificial Sequence
  Description of Artificial Sequence: Synthetic oligonucleotide
  Target: SCN9A; (-) strand; PAM type: YTN; PAM sequence: TTA
catcttccttctcattgatt

SEQ ID NO: 57086 - DNA, 20 bp, Artificial Sequence
  Description of Artificial Sequence: Synthetic oligonucleotide
  Target: SCN9A; (-) strand; PAM type: YTN; PAM sequence: CTG
tatatcatggtaaataaatt

SEQ ID NO: 57087 - DNA, 20 bp, Artificial Sequence
  Description of Artificial Sequence: Synthetic oligonucleotide
  Target: SCN9A; (-) strand; PAM type: YTN; PAM sequence: CTA
agggacaactgtatatcatg

SEQ ID NO: 57088 - DNA, 20 bp, Artificial Sequence
  Description of Artificial Sequence: Synthetic oligonucleotide
  Target: SCN9A; (-) strand; PAM type: YTN; PAM sequence: CTC
agggagtccagaagccaatc

SEQ ID NO: 57089 - DNA, 20 bp, Artificial Sequence
  Description of Artificial Sequence: Synthetic oligonucleotide
  Target: SCN9A; (-) strand; PAM type: YTN; PAM sequence: TTC
tcagggagtccagaagccaa

SEQ ID NO: 57090 - DNA, 20 bp, Artificial Sequence
  Description of Artificial Sequence: Synthetic oligonucleotide
  Target: SCN9A; (-) strand; PAM type: YTN; PAM sequence: TTG
gtattctcagggagtccaga

SEQ ID NO: 57091 - DNA, 20 bp, Artificial Sequence
  Description of Artificial Sequence: Synthetic oligonucleotide
  Target: SCN9A; (-) strand; PAM type: YTN; PAM sequence: TTT
ggtattctcagggagtccag

SEQ ID NO: 57092 - DNA, 20 bp, Artificial Sequence
  Description of Artificial Sequence: Synthetic oligonucleotide
  Target: SCN9A; (-) strand; PAM type: YTN; PAM sequence: TTT
tggtattctcagggagtcca

SEQ ID NO: 57093 - DNA, 20 bp, Artificial Sequence
  Description of Artificial Sequence: Synthetic oligonucleotide
  Target: SCN9A; (-) strand; PAM type: YTN; PAM sequence: CTG
tggattttggtattctcagg

SEQ ID NO: 57094 - DNA, 20 bp, Artificial Sequence
  Description of Artificial Sequence: Synthetic oligonucleotide
  Target: SCN9A; (-) strand; PAM type: YTN; PAM sequence: TTG
agcatctgtggattttggta

SEQ ID NO: 57095 - DNA, 20 bp, Artificial Sequence
  Description of Artificial Sequence: Synthetic oligonucleotide
  Target: SCN9A; (-) strand; PAM type: YTN; PAM sequence: TTT
gagcatctgtggattttggt

SEQ ID NO: 57096 - DNA, 20 bp, Artificial Sequence
  Description of Artificial Sequence: Synthetic oligonucleotide
  Target: SCN9A; (-) strand; PAM type: YTN; PAM sequence: TTG
tataagagatttgagcatct

SEQ ID NO: 57097 - DNA, 20 bp, Artificial Sequence
  Description of Artificial Sequence: Synthetic oligonucleotide
  Target: SCN9A; (-) strand; PAM type: YTN; PAM sequence: TTT
gtataagagatttgagcatc

SEQ ID NO: 57098 - DNA, 20 bp, Artificial Sequence
  Description of Artificial Sequence: Synthetic oligonucleotide
  Target: SCN9A; (-) strand; PAM type: YTN; PAM sequence: CTA
tgccatttgtataagagatt

SEQ ID NO: 57099 - DNA, 20 bp, Artificial Sequence
  Description of Artificial Sequence: Synthetic oligonucleotide
  Target: SCN9A; (-) strand; PAM type: YTN; PAM sequence: TTA
taagcaaacactatgccatt

SEQ ID NO: 57100 - DNA, 20 bp, Artificial Sequence
  Description of Artificial Sequence: Synthetic oligonucleotide
  Target: SCN9A; (-) strand; PAM type: YTN; PAM sequence: CTA
tataggaggatgtgtgtagg

SEQ ID NO: 57101 - DNA, 20 bp, Artificial Sequence
  Description of Artificial Sequence: Synthetic oligonucleotide
  Target: SCN9A; (-) strand; PAM type: YTN; PAM sequence: TTA
aactatataggaggatgtgt

SEQ ID NO: 57102 - DNA, 20 bp, Artificial Sequence
  Description of Artificial Sequence: Synthetic oligonucleotide
  Target: SCN9A; (-) strand; PAM type: YTN; PAM sequence: TTT
aaactatataggaggatgtg

SEQ ID NO: 57103 - DNA, 20 bp, Artificial Sequence
  Description of Artificial Sequence: Synthetic oligonucleotide
  Target: SCN9A; (-) strand; PAM type: YTN; PAM sequence: TTT
taaactatataggaggatgt

SEQ ID NO: 57104 - DNA, 20 bp, Artificial Sequence
  Description of Artificial Sequence: Synthetic oligonucleotide
  Target: SCN9A; (-) strand; PAM type: YTN; PAM sequence: TTG
aatccatacaaatgaagtga

SEQ ID NO: 57105 - DNA, 20 bp, Artificial Sequence
  Description of Artificial Sequence: Synthetic oligonucleotide
  Target: SCN9A; (-) strand; PAM type: YTN; PAM sequence: CTA
cattgaatccatacaaatga

SEQ ID NO: 57106 - DNA, 20 bp, Artificial Sequence
  Description of Artificial Sequence: Synthetic oligonucleotide
  Target: SCN9A; (-) strand; PAM type: YTN; PAM sequence: CTG
agtactacattgaatccata

SEQ ID NO: 57107 - DNA, 20 bp, Artificial Sequence
  Description of Artificial Sequence: Synthetic oligonucleotide
  Target: SCN9A; (-) strand; PAM type: YTN; PAM sequence: TTC
catatgctgagtactacatt

SEQ ID NO: 57108 - DNA, 20 bp, Artificial Sequence
  Description of Artificial Sequence: Synthetic oligonucleotide
  Target: SCN9A; (-) strand; PAM type: YTN; PAM sequence: TTT
ccatatgctgagtactacat

SEQ ID NO: 57109 - DNA, 20 bp, Artificial Sequence
  Description of Artificial Sequence: Synthetic oligonucleotide
  Target: SCN9A; (-) strand; PAM type: YTN; PAM sequence: TTT
tccatatgctgagtactaca

SEQ ID NO: 57110 - DNA, 20 bp, Artificial Sequence
  Description of Artificial Sequence: Synthetic oligonucleotide
  Target: SCN9A; (-) strand; PAM type: YTN; PAM sequence: TTG
aattttccatatgctgagta

SEQ ID NO: 57111 - DNA, 20 bp, Artificial Sequence
  Description of Artificial Sequence: Synthetic oligonucleotide
  Target: SCN9A; (-) strand; PAM type: YTN; PAM sequence: CTT
gaattttccatatgctgagt

SEQ ID NO: 57112 - DNA, 20 bp, Artificial Sequence
  Description of Artificial Sequence: Synthetic oligonucleotide
  Target: SCN9A; (-) strand; PAM type: YTN; PAM sequence: TTG
gggaaaaaatccacaaagcc

SEQ ID NO: 57113 - DNA, 20 bp, Artificial Sequence
  Description of Artificial Sequence: Synthetic oligonucleotide
  Target: SCN9A; (-) strand; PAM type: YTN; PAM sequence: CTG
gatcagaaatagttggggaa

SEQ ID NO: 57114 - DNA, 20 bp, Artificial Sequence
  Description of Artificial Sequence: Synthetic oligonucleotide
  Target: SCN9A; (-) strand; PAM type: YTN; PAM sequence: TTC
tggatcagaaatagttgggg

SEQ ID NO: 57115 - DNA, 20 bp, Artificial Sequence
  Description of Artificial Sequence: Synthetic oligonucleotide
  Target: SCN9A; (-) strand; PAM type: YTN; PAM sequence: TTC
aaccaattctggatcagaaa

SEQ ID NO: 57116 - DNA, 20 bp, Artificial Sequence
  Description of Artificial Sequence: Synthetic oligonucleotide
  Target: SCN9A; (-) strand; PAM type: YTN; PAM sequence: CTG
tggattcaaccaattctgga

SEQ ID NO: 57117 - DNA, 20 bp, Artificial Sequence
  Description of Artificial Sequence: Synthetic oligonucleotide
  Target: SCN9A; (-) strand; PAM type: YTN; PAM sequence: CTG
atctgtggattcaaccaatt

SEQ ID NO: 57118 - DNA, 20 bp, Artificial Sequence
  Description of Artificial Sequence: Synthetic oligonucleotide
  Target: SCN9A; (-) strand; PAM type: YTN; PAM sequence: TTC
tgatctgtggattcaaccaa

SEQ ID NO: 57119 - DNA, 20 bp, Artificial Sequence
  Description of Artificial Sequence: Synthetic oligonucleotide
  Target: SCN9A; (-) strand; PAM type: YTN; PAM sequence: TTT
ctgatctgtggattcaacca

SEQ ID NO: 57120 - DNA, 20 bp, Artificial Sequence
  Description of Artificial Sequence: Synthetic oligonucleotide
  Target: SCN9A; (-) strand; PAM type: YTN; PAM sequence: CTC
catatccatggtttctgatc

SEQ ID NO: 57121 - DNA, 20 bp, Artificial Sequence
  Description of Artificial Sequence: Synthetic oligonucleotide
  Target: SCN9A; (-) strand; PAM type: YTN; PAM sequence: TTC
agtcctccatatccatggtt

SEQ ID NO: 57122 - DNA, 20 bp, Artificial Sequence
  Description of Artificial Sequence: Synthetic oligonucleotide
  Target: SCN9A; (-) strand; PAM type: YTN; PAM sequence: CTC
atggtggaagatatatatat

SEQ ID NO: 57123 - DNA, 20 bp, Artificial Sequence
  Description of Artificial Sequence: Synthetic oligonucleotide
  Target: SCN9A; (-) strand; PAM type: YTN; PAM sequence: CTA
atctcatggtggaagatata

SEQ ID NO: 57124 - DNA, 20 bp, Artificial Sequence
  Description of Artificial Sequence: Synthetic oligonucleotide
  Target: SCN9A; (-) strand; PAM type: YTN; PAM sequence: CTA
taggaatactaatctcatgg

SEQ ID NO: 57125 - DNA, 20 bp, Artificial Sequence
  Description of Artificial Sequence: Synthetic oligonucleotide
  Target: SCN9A; (-) strand; PAM type: YTN; PAM sequence: TTC
tataggaatactaatctcat

SEQ ID NO: 57126 - DNA, 20 bp, Artificial Sequence
  Description of Artificial Sequence: Synthetic oligonucleotide
  Target: SCN9A; (-) strand; PAM type: YTN; PAM sequence: TTT
ctataggaatactaatctca

SEQ ID NO: 57127 - DNA, 20 bp, Artificial Sequence
  Description of Artificial Sequence: Synthetic oligonucleotide
  Target: SCN9A; (-) strand; PAM type: YTN; PAM sequence: TTT
tctataggaatactaatctc

SEQ ID NO: 57128 - DNA, 20 bp, Artificial Sequence
  Description of Artificial Sequence: Synthetic oligonucleotide
  Target: SCN9A; (-) strand; PAM type: YTN; PAM sequence: TTT
ttctataggaatactaatct

SEQ ID NO: 57129 - DNA, 20 bp, Artificial Sequence
  Description of Artificial Sequence: Synthetic oligonucleotide
  Target: SCN9A; (-) strand; PAM type: YTN; PAM sequence: TTT
tttctataggaatactaatc

SEQ ID NO: 57130 - DNA, 20 bp, Artificial Sequence
  Description of Artificial Sequence: Synthetic oligonucleotide
  Target: SCN9A; (-) strand; PAM type: YTN; PAM sequence: CTT
ttttctataggaatactaat

SEQ ID NO: 57131 - DNA, 20 bp, Artificial Sequence
  Description of Artificial Sequence: Synthetic oligonucleotide
  Target: SCN9A; (-) strand; PAM type: YTN; PAM sequence: TTC
ttttttctataggaatacta

SEQ ID NO: 57132 - DNA, 20 bp, Artificial Sequence
  Description of Artificial Sequence: Synthetic oligonucleotide
  Target: SCN9A; (-) strand; PAM type: YTN; PAM sequence: CTT
cttttttctataggaatact

SEQ ID NO: 57133 - DNA, 20 bp, Artificial Sequence
  Description of Artificial Sequence: Synthetic oligonucleotide
  Target: SCN9A; (-) strand; PAM type: YTN; PAM sequence: CTC
ttcttttttctataggaata

SEQ ID NO: 57134 - DNA, 20 bp, Artificial Sequence
  Description of Artificial Sequence: Synthetic oligonucleotide
  Target: SCN9A; (-) strand; PAM type: YTN; PAM sequence: CTC
tcttcttttttctataggaa

SEQ ID NO: 57135 - DNA, 20 bp, Artificial Sequence
  Description of Artificial Sequence: Synthetic oligonucleotide
  Target: SCN9A; (-) strand; PAM type: YTN; PAM sequence: CTG
gtctctcttcttttttctat

SEQ ID NO: 57136 - DNA, 20 bp, Artificial Sequence
  Description of Artificial Sequence: Synthetic oligonucleotide
  Target: SCN9A; (-) strand; PAM type: YTN; PAM sequence: CTC
tggtctctcttcttttttct

SEQ ID NO: 57137 - DNA, 20 bp, Artificial Sequence
  Description of Artificial Sequence: Synthetic oligonucleotide
  Target: SCN9A; (-) strand; PAM type: YTN; PAM sequence: TTC
aaatggaggaggcagtgagc

SEQ ID NO: 57138 - DNA, 20 bp, Artificial Sequence
  Description of Artificial Sequence: Synthetic oligonucleotide
  Target: SCN9A; (-) strand; PAM type: YTN; PAM sequence: CTT
caaatggaggaggcagtgag

SEQ ID NO: 57139 - DNA, 20 bp, Artificial Sequence
  Description of Artificial Sequence: Synthetic oligonucleotide
  Target: SCN9A; (-) strand; PAM type: YTN; PAM sequence: CTG
tgtcttcaaatggaggaggc

SEQ ID NO: 57140 - DNA, 20 bp, Artificial Sequence
  Description of Artificial Sequence: Synthetic oligonucleotide
  Target: SCN9A; (-) strand; PAM type: YTN; PAM sequence: CTC
actgtgtcttcaaatggagg

SEQ ID NO: 57141 - DNA, 20 bp, Artificial Sequence
  Description of Artificial Sequence: Synthetic oligonucleotide
  Target: SCN9A; (-) strand; PAM type: YTN; PAM sequence: TTC
tcactgtgtcttcaaatgga

SEQ ID NO: 57142 - DNA, 20 bp, Artificial Sequence
  Description of Artificial Sequence: Synthetic oligonucleotide
  Target: SCN9A; (-) strand; PAM type: YTN; PAM sequence: CTG
gcagagggcagcattctcac

SEQ ID NO: 57143 - DNA, 20 bp, Artificial Sequence
  Description of Artificial Sequence: Synthetic oligonucleotide
  Target: SCN9A; (-) strand; PAM type: YTN; PAM sequence: CTG
gctggcagagggcagcattc

SEQ ID NO: 57144 - DNA, 20 bp, Artificial Sequence
  Description of Artificial Sequence: Synthetic oligonucleotide
  Target: SCN9A; (-) strand; PAM type: YTN; PAM sequence: TTC
ctggctggcagagggcagca

SEQ ID NO: 57145 - DNA, 20 bp, Artificial Sequence
  Description of Artificial Sequence: Synthetic oligonucleotide
  Target: SCN9A; (-) strand; PAM type: YTN; PAM sequence: TTT
cctggctggcagagggcagc

SEQ ID NO: 57146 - DNA, 20 bp, Artificial Sequence
  Description of Artificial Sequence: Synthetic oligonucleotide
  Target: SCN9A; (-) strand; PAM type: YTN; PAM sequence: CTC
atttcctggctggcagaggg

SEQ ID NO: 57147 - DNA, 20 bp, Artificial Sequence
  Description of Artificial Sequence: Synthetic oligonucleotide
  Target: SCN9A; (-) strand; PAM type: YTN; PAM sequence: TTC
cccagtgagggctcatttcc

SEQ ID NO: 57148 - DNA, 20 bp, Artificial Sequence
  Description of Artificial Sequence: Synthetic oligonucleotide
  Target: SCN9A; (-) strand; PAM type: YTN; PAM sequence: TTC
gttccccagtgagggctcat

SEQ ID NO: 57149 - DNA, 20 bp, Artificial Sequence
  Description of Artificial Sequence: Synthetic oligonucleotide
  Target: SCN9A; (-) strand; PAM type: YTN; PAM sequence: TTT
cgttccccagtgagggctca

SEQ ID NO: 57150 - DNA, 20 bp, Artificial Sequence
  Description of Artificial Sequence: Synthetic oligonucleotide
  Target: SCN9A; (-) strand; PAM type: YTN; PAM sequence: TTA
aggcgccagccaatttcgtt

SEQ ID NO: 57151 - DNA, 20 bp, Artificial Sequence
  Description of Artificial Sequence: Synthetic oligonucleotide
  Target: SCN9A; (-) strand; PAM type: YTN; PAM sequence: CTG
aggagtccaagattaaggcg

SEQ ID NO: 57152 - DNA, 20 bp, Artificial Sequence
  Description of Artificial Sequence: Synthetic oligonucleotide
  Target: SCN9A; (-) strand; PAM type: YTN; PAM sequence: TTC
ccgaggctgaggagtccaag

SEQ ID NO: 57153 - DNA, 20 bp, Artificial Sequence
  Description of Artificial Sequence: Synthetic oligonucleotide
  Target: SCN9A; (-) strand; PAM type: YTN; PAM sequence: CTA
acagttcccgaggctgagga

SEQ ID NO: 57154 - DNA, 20 bp, Artificial Sequence
  Description of Artificial Sequence: Synthetic oligonucleotide
  Target: SCN9A; (-) strand; PAM type: YTN; PAM sequence: TTC
taacagttcccgaggctgag

SEQ ID NO: 57155 - DNA, 20 bp, Artificial Sequence
  Description of Artificial Sequence: Synthetic oligonucleotide
  Target: SCN9A; (-) strand; PAM type: YTN; PAM sequence: TTT
ctaacagttcccgaggctga

SEQ ID NO: 57156 - DNA, 20 bp, Artificial Sequence
  Description of Artificial Sequence: Synthetic oligonucleotide
  Target: SCN9A; (-) strand; PAM type: YTN; PAM sequence: TTA
tttctaacagttcccgaggc

SEQ ID NO: 57157 - DNA, 20 bp, Artificial Sequence
  Description of Artificial Sequence: Synthetic oligonucleotide
  Target: SCN9A; (-) strand; PAM type: YTN; PAM sequence: TTT
atttctaacagttcccgagg

SEQ ID NO: 57158 - DNA, 20 bp, Artificial Sequence
  Description of Artificial Sequence: Synthetic oligonucleotide
  Target: SCN9A; (-) strand; PAM type: YTN; PAM sequence: CTA
gaacaacagaaatttatttc

SEQ ID NO: 57159 - DNA, 20 bp, Artificial Sequence
  Description of Artificial Sequence: Synthetic oligonucleotide
  Target: SCN9A; (-) strand; PAM type: YTN; PAM sequence: CTG
ggtggctagaacaacagaaa

SEQ ID NO: 57160 - DNA, 20 bp, Artificial Sequence
  Description of Artificial Sequence: Synthetic oligonucleotide
  Target: SCN9A; (-) strand; PAM type: YTN; PAM sequence: CTG
tcataataatataccataga

SEQ ID NO: 57161 - DNA, 20 bp, Artificial Sequence
  Description of Artificial Sequence: Synthetic oligonucleotide
  Target: SCN9A; (-) strand; PAM type: YTN; PAM sequence: CTG
gggctgtcataataatatac

SEQ ID NO: 57162 - DNA, 20 bp, Artificial Sequence
  Description of Artificial Sequence: Synthetic oligonucleotide
  Target: SCN9A; (-) strand; PAM type: YTN; PAM sequence: TTA
gaaagctggggctgtcataa

SEQ ID NO: 57163 - DNA, 20 bp, Artificial Sequence
  Description of Artificial Sequence: Synthetic oligonucleotide
  Target: SCN9A; (-) strand; PAM type: YTN; PAM sequence: CTT
agaaagctggggctgtcata

SEQ ID NO: 57164 - DNA, 20 bp, Artificial Sequence
  Description of Artificial Sequence: Synthetic oligonucleotide
  Target: SCN9A; (-) strand; PAM type: YTN; PAM sequence: TTG
gtcttagaaagctggggctg

SEQ ID NO: 57165 - DNA, 20 bp, Artificial Sequence
  Description of Artificial Sequence: Synthetic oligonucleotide
  Target: SCN9A; (-) strand; PAM type: YTN; PAM sequence: TTG
tgttggtcttagaaagctgg

SEQ ID NO: 57166 - DNA, 20 bp, Artificial Sequence
  Description of Artificial Sequence: Synthetic oligonucleotide
  Target: SCN9A; (-) strand; PAM type: YTN; PAM sequence: TTT
gtgttggtcttagaaagctg

SEQ ID NO: 57167 - DNA, 20 bp, Artificial Sequence
  Description of Artificial Sequence: Synthetic oligonucleotide
  Target: SCN9A; (-) strand; PAM type: YTN; PAM sequence: TTT
tgtgttggtcttagaaagct

SEQ ID NO: 57168 - DNA, 20 bp, Artificial Sequence
  Description of Artificial Sequence: Synthetic oligonucleotide
  Target: SCN9A; (-) strand; PAM type: YTN; PAM sequence: TTT
ttgtgttggtcttagaaagc

SEQ ID NO: 57169 - DNA, 20 bp, Artificial Sequence
  Description of Artificial Sequence: Synthetic oligonucleotide
  Target: SCN9A; (-) strand; PAM type: YTN; PAM sequence: TTA
tcatttttgtgttggtctta

SEQ ID NO: 57170 - DNA, 20 bp, Artificial Sequence
  Description of Artificial Sequence: Synthetic oligonucleotide
  Target: SCN9A; (-) strand; PAM type: YTN; PAM sequence: TTA
aagcaatagcaggagccaga

SEQ ID NO: 57171 - DNA, 20 bp, Artificial Sequence
  Description of Artificial Sequence: Synthetic oligonucleotide
  Target: SCN9A; (-) strand; PAM type: YTN; PAM sequence: CTT
aaagcaatagcaggagccag

SEQ ID NO: 57172 - DNA, 20 bp, Artificial Sequence
  Description of Artificial Sequence: Synthetic oligonucleotide
  Target: SCN9A; (-) strand; PAM type: YTN; PAM sequence: TTA
cttaaagcaatagcaggagc

SEQ ID NO: 57173 - DNA, 20 bp, Artificial Sequence
  Description of Artificial Sequence: Synthetic oligonucleotide
  Target: SCN9A; (-) strand; PAM type: YTN; PAM sequence: TTA
ttacttaaagcaatagcagg

SEQ ID NO: 57174 - DNA, 20 bp, Artificial Sequence
  Description of Artificial Sequence: Synthetic oligonucleotide
  Target: SCN9A; (-) strand; PAM type: YTN; PAM sequence: CTC
aggagtcagagataataata

SEQ ID NO: 57175 - DNA, 20 bp, Artificial Sequence
  Description of Artificial Sequence: Synthetic oligonucleotide
  Target: SCN9A; (-) strand; PAM type: YTN; PAM sequence: TTG
cagaagacatgagactcagg

SEQ ID NO: 57176 - DNA, 20 bp, Artificial Sequence
  Description of Artificial Sequence: Synthetic oligonucleotide
  Target: SCN9A; (-) strand; PAM type: YTN; PAM sequence: CTT
gcagaagacatgagactcag

SEQ ID NO: 57177 - DNA, 20 bp, Artificial Sequence
  Description of Artificial Sequence: Synthetic oligonucleotide
  Target: SCN9A; (-) strand; PAM type: YTN; PAM sequence: TTA
catgcttgcagaagacatga

SEQ ID NO: 57178 - DNA, 20 bp, Artificial Sequence
  Description of Artificial Sequence: Synthetic oligonucleotide
  Target: SCN9A; (-) strand; PAM type: YTN; PAM sequence: TTA
gcatgttacatgcttgcaga

SEQ ID NO: 57179 - DNA, 20 bp, Artificial Sequence
  Description of Artificial Sequence: Synthetic oligonucleotide
  Target: SCN9A; (-) strand; PAM type: YTN; PAM sequence: TTT
agcatgttacatgcttgcag

SEQ ID NO: 57180 - DNA, 20 bp, Artificial Sequence
  Description of Artificial Sequence: Synthetic oligonucleotide
  Target: SCN9A; (-) strand; PAM type: YTN; PAM sequence: CTT
tagcatgttacatgcttgca

SEQ ID NO: 57181 - DNA, 20 bp, Artificial Sequence
  Description of Artificial Sequence: Synthetic oligonucleotide
  Target: SCN9A; (-) strand; PAM type: YTN; PAM sequence: TTC
actttagcatgttacatgct

SEQ ID NO: 57182 - DNA, 20 bp, Artificial Sequence
  Description of Artificial Sequence: Synthetic oligonucleotide
  Target: SCN9A; (-) strand; PAM type: YTN; PAM sequence: TTA
gagtaacataattcacttta

SEQ ID NO: 57183 - DNA, 20 bp, Artificial Sequence
  Description of Artificial Sequence: Synthetic oligonucleotide
  Target: SCN9A; (-) strand; PAM type: YTN; PAM sequence: CTT
agagtaacataattcacttt

SEQ ID NO: 57184 - DNA, 20 bp, Artificial Sequence
  Description of Artificial Sequence: Synthetic oligonucleotide
  Target: SCN9A; (-) strand; PAM type: YTN; PAM sequence: CTC
ttagagtaacataattcact

SEQ ID NO: 57185 - DNA, 20 bp, Artificial Sequence
  Description of Artificial Sequence: Synthetic oligonucleotide
  Target: SCN9A; (-) strand; PAM type: YTN; PAM sequence: TTC
actcttagagtaacataatt

SEQ ID NO: 57186 - DNA, 20 bp, Artificial Sequence
  Description of Artificial Sequence: Synthetic oligonucleotide
  Target: SCN9A; (-) strand; PAM type: YTN; PAM sequence: TTT
cactcttagagtaacataat

SEQ ID NO: 57187 - DNA, 20 bp, Artificial Sequence
  Description of Artificial Sequence: Synthetic oligonucleotide
  Target: SCN9A; (-) strand; PAM type: YTN; PAM sequence: TTA
tatatttcactcttagagta

SEQ ID NO: 57188 - DNA, 20 bp, Artificial Sequence
  Description of Artificial Sequence: Synthetic oligonucleotide
  Target: SCN9A; (-) strand; PAM type: YTN; PAM sequence: TTA
aggaagggtgcattatatat

SEQ ID NO: 57189 - DNA, 20 bp, Artificial Sequence
  Description of Artificial Sequence: Synthetic oligonucleotide
  Target: SCN9A; (-) strand; PAM type: YTN; PAM sequence: TTT
aaggaagggtgcattatata

SEQ ID NO: 57190 - DNA, 20 bp, Artificial Sequence
  Description of Artificial Sequence: Synthetic oligonucleotide
  Target: SCN9A; (-) strand; PAM type: YTN; PAM sequence: CTA
tgtcaatacatttaaggaag

SEQ ID NO: 57191 - DNA, 20 bp, Artificial Sequence
  Description of Artificial Sequence: Synthetic oligonucleotide
  Target: SCN9A; (-) strand; PAM type: YTN; PAM sequence: TTC
tatgtcaatacatttaagga

SEQ ID NO: 57192 - DNA, 20 bp, Artificial Sequence
  Description of Artificial Sequence: Synthetic oligonucleotide
  Target: SCN9A; (-) strand; PAM type: YTN; PAM sequence: TTT
ctatgtcaatacatttaagg

SEQ ID NO: 57193 - DNA, 20 bp, Artificial Sequence
  Description of Artificial Sequence: Synthetic oligonucleotide
  Target: SCN9A; (-) strand; PAM type: YTN; PAM sequence: TTG
gaacataaaaagtttctatg

SEQ ID NO: 57194 - DNA, 20 bp, Artificial Sequence
  Description of Artificial Sequence: Synthetic oligonucleotide
  Target: SCN9A; (-) strand; PAM type: YTN; PAM sequence: TTT
ggaacataaaaagtttctat

SEQ ID NO: 57195 - DNA, 20 bp, Artificial Sequence
  Description of Artificial Sequence: Synthetic oligonucleotide
  Target: SCN9A; (-) strand; PAM type: YTN; PAM sequence: TTC
atttggaacataaaaagttt

SEQ ID NO: 57196 - DNA, 20 bp, Artificial Sequence
  Description of Artificial Sequence: Synthetic oligonucleotide
  Target: SCN9A; (-) strand; PAM type: YTN; PAM sequence: TTT
catttggaacataaaaagtt

SEQ ID NO: 57197 - DNA, 20 bp, Artificial Sequence
  Description of Artificial Sequence: Synthetic oligonucleotide
  Target: SCN9A; (-) strand; PAM type: YTN; PAM sequence: CTA
aaacgtttcatttggaacat

SEQ ID NO: 57198 - DNA, 20 bp, Artificial Sequence
  Description of Artificial Sequence: Synthetic oligonucleotide
  Target: SCN9A; (-) strand; PAM type: YTN; PAM sequence: TTC
taaaacgtttcatttggaac

SEQ ID NO: 57199 - DNA, 20 bp, Artificial Sequence
  Description of Artificial Sequence: Synthetic oligonucleotide
  Target: SCN9A; (-) strand; PAM type: YTN; PAM sequence: CTT
ctaaaacgtttcatttggaa

SEQ ID NO: 57200 - DNA, 20 bp, Artificial Sequence
  Description of Artificial Sequence: Synthetic oligonucleotide
  Target: SCN9A; (-) strand; PAM type: YTN; PAM sequence: CTA
cagcaaatgtcttctaaaac

SEQ ID NO: 57201 - DNA, 20 bp, Artificial Sequence
  Description of Artificial Sequence: Synthetic oligonucleotide
  Target: SCN9A; (-) strand; PAM type: YTN; PAM sequence: TTA
aaatgtaggccaagagaatc

SEQ ID NO: 57202 - DNA, 20 bp, Artificial Sequence
  Description of Artificial Sequence: Synthetic oligonucleotide
  Target: SCN9A; (-) strand; PAM type: YTN; PAM sequence: TTT
aaaatgtaggccaagagaat

SEQ ID NO: 57203 - DNA, 20 bp, Artificial Sequence
  Description of Artificial Sequence: Synthetic oligonucleotide
  Target: SCN9A; (-) strand; PAM type: YTN; PAM sequence: CTT
taaaatgtaggccaagagaa

SEQ ID NO: 57204 - DNA, 20 bp, Artificial Sequence
  Description of Artificial Sequence: Synthetic oligonucleotide
  Target: SCN9A; (-) strand; PAM type: YTN; PAM sequence: CTC
atgcctttaaaatgtaggcc

SEQ ID NO: 57205 - DNA, 20 bp, Artificial Sequence
  Description of Artificial Sequence: Synthetic oligonucleotide
  Target: SCN9A; (-) strand; PAM type: YTN; PAM sequence: TTG
tcccactcatgcctttaaaa

SEQ ID NO: 57206 - DNA, 20 bp, Artificial Sequence
  Description of Artificial Sequence: Synthetic oligonucleotide
  Target: SCN9A; (-) strand; PAM type: YTN; PAM sequence: CTT
gtcccactcatgcctttaaa

SEQ ID NO: 57207 - DNA, 20 bp, Artificial Sequence
  Description of Artificial Sequence: Synthetic oligonucleotide
  Target: SCN9A; (-) strand; PAM type: YTN; PAM sequence: CTG
aagtatacttgtcccactca

SEQ ID NO: 57208 - DNA, 20 bp, Artificial Sequence
  Description of Artificial Sequence: Synthetic oligonucleotide
  Target: SCN9A; (-) strand; PAM type: YTN; PAM sequence: CTC
aaagtcaaagagaatctgaa

SEQ ID NO: 57209 - DNA, 20 bp, Artificial Sequence
  Description of Artificial Sequence: Synthetic oligonucleotide
  Target: SCN9A; (-) strand; PAM type: YTN; PAM sequence: TTC
tcaaagtcaaagagaatctg

SEQ ID NO: 57210 - DNA, 20 bp, Artificial Sequence
  Description of Artificial Sequence: Synthetic oligonucleotide
  Target: SCN9A; (-) strand; PAM type: YTN; PAM sequence: TTT
ctcaaagtcaaagagaatct

SEQ ID NO: 57211 - DNA, 20 bp, Artificial Sequence
  Description of Artificial Sequence: Synthetic oligonucleotide
  Target: SCN9A; (-) strand; PAM type: YTN; PAM sequence: TTT
tctcaaagtcaaagagaatc

SEQ ID NO: 57212 - DNA, 20 bp, Artificial Sequence
  Description of Artificial Sequence: Synthetic oligonucleotide
  Target: SCN9A; (-) strand; PAM type: YTN; PAM sequence: TTA
agtaattttctcaaagtcaa

SEQ ID NO: 57213 - DNA, 20 bp, Artificial Sequence
  Description of Artificial Sequence: Synthetic oligonucleotide
  Target: SCN9A; (-) strand; PAM type: YTN; PAM sequence: CTT
aagtaattttctcaaagtca

SEQ ID NO: 57214 - DNA, 20 bp, Artificial Sequence
  Description of Artificial Sequence: Synthetic oligonucleotide
  Target: SCN9A; (-) strand; PAM type: YTN; PAM sequence: TTA
cccagaagccaaagaaaatg

SEQ ID NO: 57215 - DNA, 20 bp, Artificial Sequence
  Description of Artificial Sequence: Synthetic oligonucleotide
  Target: SCN9A; (-) strand; PAM type: YTN; PAM sequence: TTT
acccagaagccaaagaaaat

SEQ ID NO: 57216 - DNA, 20 bp, Artificial Sequence
  Description of Artificial Sequence: Synthetic oligonucleotide
  Target: SCN9A; (-) strand; PAM type: YTN; PAM sequence: TTT
tacccagaagccaaagaaaa

SEQ ID NO: 57217 - DNA, 20 bp, Artificial Sequence
  Description of Artificial Sequence: Synthetic oligonucleotide
  Target: SCN9A; (-) strand; PAM type: YTN; PAM sequence: TTT
ttacccagaagccaaagaaa

SEQ ID NO: 57218 - DNA, 20 bp, Artificial Sequence
  Description of Artificial Sequence: Synthetic oligonucleotide
  Target: SCN9A; (-) strand; PAM type: YTN; PAM sequence: TTA
caaatttttacccagaagcc

SEQ ID NO: 57219 - DNA, 20 bp, Artificial Sequence
  Description of Artificial Sequence: Synthetic oligonucleotide
  Target: SCN9A; (-) strand; PAM type: YTN; PAM sequence: CTT
acaaatttttacccagaagc

SEQ ID NO: 57220 - DNA, 20 bp, Artificial Sequence
  Description of Artificial Sequence: Synthetic oligonucleotide
  Target: SCN9A; (-) strand; PAM type: YTN; PAM sequence: TTG
gcaaagcaccttacaaattt

SEQ ID NO: 57221 - DNA, 20 bp, Artificial Sequence
  Description of Artificial Sequence: Synthetic oligonucleotide
  Target: SCN9A; (-) strand; PAM type: YTN; PAM sequence: CTT
ggcaaagcaccttacaaatt

SEQ ID NO: 57222 - DNA, 20 bp, Artificial Sequence
  Description of Artificial Sequence: Synthetic oligonucleotide
  Target: SCN9A; (-) strand; PAM type: YTN; PAM sequence: TTC
ttggcaaagcaccttacaaa

SEQ ID NO: 57223 - DNA, 20 bp, Artificial Sequence
  Description of Artificial Sequence: Synthetic oligonucleotide
  Target: SCN9A; (-) strand; PAM type: YTN; PAM sequence: TTA
ttcttggcaaagcaccttac

SEQ ID NO: 57224 - DNA, 20 bp, Artificial Sequence
  Description of Artificial Sequence: Synthetic oligonucleotide
  Target: SCN9A; (-) strand; PAM type: YTN; PAM sequence: CTT
attcttggcaaagcacctta

SEQ ID NO: 57225 - DNA, 20 bp, Artificial Sequence
  Description of Artificial Sequence: Synthetic oligonucleotide
  Target: SCN9A; (-) strand; PAM type: YTN; PAM sequence: TTC
agtgcaccttattcttggca

SEQ ID NO: 57226 - DNA, 20 bp, Artificial Sequence
  Description of Artificial Sequence: Synthetic oligonucleotide
  Target: SCN9A; (-) strand; PAM type: YTN; PAM sequence: TTA
ccattcagtgcaccttattc

SEQ ID NO: 57227 - DNA, 20 bp, Artificial Sequence
  Description of Artificial Sequence: Synthetic oligonucleotide
  Target: SCN9A; (-) strand; PAM type: YTN; PAM sequence: TTT
accattcagtgcaccttatt

SEQ ID NO: 57228 - DNA, 20 bp, Artificial Sequence
  Description of Artificial Sequence: Synthetic oligonucleotide
  Target: SCN9A; (-) strand; PAM type: YTN; PAM sequence: CTA
atcgtgtttaccattcagtg

SEQ ID NO: 57229 - DNA, 20 bp, Artificial Sequence
  Description of Artificial Sequence: Synthetic oligonucleotide
  Target: SCN9A; (-) strand; PAM type: YTN; PAM sequence: CTA
tcctaatcgtgtttaccatt

SEQ ID NO: 57230 - DNA, 20 bp, Artificial Sequence
  Description of Artificial Sequence: Synthetic oligonucleotide
  Target: SCN9A; (-) strand; PAM type: YTN; PAM sequence: TTG
actatcctaatcgtgtttac

SEQ ID NO: 57231 - DNA, 20 bp, Artificial Sequence
  Description of Artificial Sequence: Synthetic oligonucleotide
  Target: SCN9A; (-) strand; PAM type: YTN; PAM sequence: CTG
ttgactatcctaatcgtgtt

SEQ ID NO: 57232 - DNA, 20 bp, Artificial Sequence
  Description of Artificial Sequence: Synthetic oligonucleotide
  Target: SCN9A; (-) strand; PAM type: YTN; PAM sequence: CTC
cctgttgactatcctaatcg

SEQ ID NO: 57233 - DNA, 20 bp, Artificial Sequence
  Description of Artificial Sequence: Synthetic oligonucleotide
  Target: SCN9A; (-) strand; PAM type: YTN; PAM sequence: TTC
ctccctgttgactatcctaa

SEQ ID NO: 57234 - DNA, 20 bp, Artificial Sequence
  Description of Artificial Sequence: Synthetic oligonucleotide
  Target: SCN9A; (-) strand; PAM type: YTN; PAM sequence: TTT
cctccctgttgactatccta

SEQ ID NO: 57235 - DNA, 20 bp, Artificial Sequence
  Description of Artificial Sequence: Synthetic oligonucleotide
  Target: SCN9A; (-) strand; PAM type: YTN; PAM sequence: TTT
tcctccctgttgactatcct

SEQ ID NO: 57236 - DNA, 20 bp, Artificial Sequence
  Description of Artificial Sequence: Synthetic oligonucleotide
  Target: SCN9A; (-) strand; PAM type: YTN; PAM sequence: TTA
aaggaggagattttcctccc

SEQ ID NO: 57237 - DNA, 20 bp, Artificial Sequence
  Description of Artificial Sequence: Synthetic oligonucleotide
  Target: SCN9A; (-) strand; PAM type: YTN; PAM sequence: TTT
aaaggaggagattttcctcc

SEQ ID NO: 57238 - DNA, 20 bp, Artificial Sequence
  Description of Artificial Sequence: Synthetic oligonucleotide
  Target: SCN9A; (-) strand; PAM type: YTN; PAM sequence: TTA
tcaaaaatttaaaggaggag

SEQ ID NO: 57239 - DNA, 20 bp, Artificial Sequence
  Description of Artificial Sequence: Synthetic oligonucleotide
  Target: SCN9A; (-) strand; PAM type: YTN; PAM sequence: CTT
atcaaaaatttaaaggagga

SEQ ID NO: 57240 - DNA, 20 bp, Artificial Sequence
  Description of Artificial Sequence: Synthetic oligonucleotide
  Target: SCN9A; (-) strand; PAM type: YTN; PAM sequence: TTA
tcttatcaaaaatttaaagg

SEQ ID NO: 57241 - DNA, 20 bp, Artificial Sequence
  Description of Artificial Sequence: Synthetic oligonucleotide
  Target: SCN9A; (-) strand; PAM type: YTN; PAM sequence: TTG
ttatcttatcaaaaatttaa

SEQ ID NO: 57242 - DNA, 20 bp, Artificial Sequence
  Description of Artificial Sequence: Synthetic oligonucleotide
  Target: SCN9A; (-) strand; PAM type: YTN; PAM sequence: TTA
attgttatcttatcaaaaat

SEQ ID NO: 57243 - DNA, 20 bp, Artificial Sequence
  Description of Artificial Sequence: Synthetic oligonucleotide
  Target: SCN9A; (-) strand; PAM type: YTN; PAM sequence: CTG
atgtagaaagcaaatgttaa

SEQ ID NO: 57244 - DNA, 20 bp, Artificial Sequence
  Description of Artificial Sequence: Synthetic oligonucleotide
  Target: SCN9A; (-) strand; PAM type: YTN; PAM sequence: CTC
gcccgcaaaagactgatgta

SEQ ID NO: 57245 - DNA, 20 bp, Artificial Sequence
  Description of Artificial Sequence: Synthetic oligonucleotide
  Target: SCN9A; (-) strand; PAM type: YTN; PAM sequence: CTG
atctcgcccgcaaaagactg

SEQ ID NO: 57246 - DNA, 20 bp, Artificial Sequence
  Description of Artificial Sequence: Synthetic oligonucleotide
  Target: SCN9A; (-) strand; PAM type: YTN; PAM sequence: TTG
gcacactgatctcgcccgca

SEQ ID NO: 57247 - DNA, 20 bp, Artificial Sequence
  Description of Artificial Sequence: Synthetic oligonucleotide
  Target: SCN9A; (-) strand; PAM type: YTN; PAM sequence: TTT
ggcacactgatctcgcccgc

SEQ ID NO: 57248 - DNA, 20 bp, Artificial Sequence
  Description of Artificial Sequence: Synthetic oligonucleotide
  Target: SCN9A; (-) strand; PAM type: YTN; PAM sequence: CTG
gtgagacagtttggcacact

SEQ ID NO: 57249 - DNA, 20 bp, Artificial Sequence
  Description of Artificial Sequence: Synthetic oligonucleotide
  Target: SCN9A; (-) strand; PAM type: YTN; PAM sequence: CTG
tggaggtaaaaagagaggga

SEQ ID NO: 57250 - DNA, 20 bp, Artificial Sequence
  Description of Artificial Sequence: Synthetic oligonucleotide
  Target: SCN9A; (-) strand; PAM type: YTN; PAM sequence: CTC
atacagactgtggaggtaaa

SEQ ID NO: 57251 - DNA, 20 bp, Artificial Sequence
  Description of Artificial Sequence: Synthetic oligonucleotide
  Target: SCN9A; (-) strand; PAM type: YTN; PAM sequence: TTA
tcaaaccacaatggctcata

SEQ ID NO: 57252 - DNA, 20 bp, Artificial Sequence
  Description of Artificial Sequence: Synthetic oligonucleotide
  Target: SCN9A; (-) strand; PAM type: YTN; PAM sequence: TTT
atcaaaccacaatggctcat

SEQ ID NO: 57253 - DNA, 20 bp, Artificial Sequence
  Description of Artificial Sequence: Synthetic oligonucleotide
  Target: SCN9A; (-) strand; PAM type: YTN; PAM sequence: TTT
tatcaaaccacaatggctca

SEQ ID NO: 57254 - DNA, 20 bp, Artificial Sequence
  Description of Artificial Sequence: Synthetic oligonucleotide
  Target: SCN9A; (-) strand; PAM type: YTN; PAM sequence: TTA
ttttatcaaaccacaatggc

SEQ ID NO: 57255 - DNA, 20 bp, Artificial Sequence
  Description of Artificial Sequence: Synthetic oligonucleotide
  Target: SCN9A; (-) strand; PAM type: YTN; PAM sequence: CTA
gaaaggttattttatcaaac

SEQ ID NO: 57256 - DNA, 20 bp, Artificial Sequence
  Description of Artificial Sequence: Synthetic oligonucleotide
  Target: SCN9A; (-) strand; PAM type: YTN; PAM sequence: CTA
ctagaaaggttattttatca

SEQ ID NO: 57257 - DNA, 20 bp, Artificial Sequence
  Description of Artificial Sequence: Synthetic oligonucleotide
  Target: SCN9A; (-) strand; PAM type: YTN; PAM sequence: TTA
aggtagaaatacagatgagc

SEQ ID NO: 57258 - DNA, 20 bp, Artificial Sequence
  Description of Artificial Sequence: Synthetic oligonucleotide
  Target: SCN9A; (-) strand; PAM type: YTN; PAM sequence: TTC
caatgtaccatgttaaggta

SEQ ID NO: 57259 - DNA, 20 bp, Artificial Sequence
  Description of Artificial Sequence: Synthetic oligonucleotide
  Target: SCN9A; (-) strand; PAM type: YTN; PAM sequence: TTT
ccaatgtaccatgttaaggt

SEQ ID NO: 57260 - DNA, 20 bp, Artificial Sequence
  Description of Artificial Sequence: Synthetic oligonucleotide
  Target: SCN9A; (-) strand; PAM type: YTN; PAM sequence: TTT
tccaatgtaccatgttaagg

SEQ ID NO: 57261 - DNA, 20 bp, Artificial Sequence
  Description of Artificial Sequence: Synthetic oligonucleotide
  Target: SCN9A; (-) strand; PAM type: YTN; PAM sequence: CTG
ttttccaatgtaccatgtta

SEQ ID NO: 57262 - DNA, 20 bp, Artificial Sequence
  Description of Artificial Sequence: Synthetic oligonucleotide
  Target: SCN9A; (-) strand; PAM type: YTN; PAM sequence: CTC
ctgttttccaatgtaccatg

SEQ ID NO: 57263 - DNA, 20 bp, Artificial Sequence
  Description of Artificial Sequence: Synthetic oligonucleotide
  Target: SCN9A; (-) strand; PAM type: YTN; PAM sequence: TTA
caaaggatcaaacacaaatg

SEQ ID NO: 57264 - DNA, 20 bp, Artificial Sequence
  Description of Artificial Sequence: Synthetic oligonucleotide
  Target: SCN9A; (-) strand; PAM type: YTN; PAM sequence: TTG
ttacaaaggatcaaacacaa

SEQ ID NO: 57265 - DNA, 20 bp, Artificial Sequence
  Description of Artificial Sequence: Synthetic oligonucleotide
  Target: SCN9A; (-) strand; PAM type: YTN; PAM sequence: TTT
gttacaaaggatcaaacaca

SEQ ID NO: 57266 - DNA, 20 bp, Artificial Sequence
  Description of Artificial Sequence: Synthetic oligonucleotide
  Target: SCN9A; (-) strand; PAM type: YTN; PAM sequence: TTG
tgatcatttgttacaaagga

SEQ ID NO: 57267 - DNA, 20 bp, Artificial Sequence
  Description of Artificial Sequence: Synthetic oligonucleotide
  Target: SCN9A; (-) strand; PAM type: YTN; PAM sequence: TTT
gtgatcatttgttacaaagg

SEQ ID NO: 57268 - DNA, 20 bp, Artificial Sequence
  Description of Artificial Sequence: Synthetic oligonucleotide
  Target: SCN9A; (-) strand; PAM type: YTN; PAM sequence: CTA
aatttgtgatcatttgttac

SEQ ID NO: 57269 - DNA, 20 bp, Artificial Sequence
  Description of Artificial Sequence: Synthetic oligonucleotide
  Target: SCN9A; (-) strand; PAM type: YTN; PAM sequence: CTG
ctaaatttgtgatcatttgt

SEQ ID NO: 57270 - DNA, 20 bp, Artificial Sequence
  Description of Artificial Sequence: Synthetic oligonucleotide
  Target: SCN9A; (-) strand; PAM type: YTN; PAM sequence: TTA
agctgctaaatttgtgatca

SEQ ID NO: 57271 - DNA, 20 bp, Artificial Sequence
  Description of Artificial Sequence: Synthetic oligonucleotide
  Target: SCN9A; (-) strand; PAM type: YTN; PAM sequence: TTT
aagctgctaaatttgtgatc

SEQ ID NO: 57272 - DNA, 20 bp, Artificial Sequence
  Description of Artificial Sequence: Synthetic oligonucleotide
  Target: SCN9A; (-) strand; PAM type: YTN; PAM sequence: TTT
taagctgctaaatttgtgat

SEQ ID NO: 57273 - DNA, 20 bp, Artificial Sequence
  Description of Artificial Sequence: Synthetic oligonucleotide
  Target: SCN9A; (-) strand; PAM type: YTN; PAM sequence: TTA
ttttaagctgctaaatttgt

SEQ ID NO: 57274 - DNA, 20 bp, Artificial Sequence
  Description of Artificial Sequence: Synthetic oligonucleotide
  Target: SCN9A; (-) strand; PAM type: YTN; PAM sequence: TTG
tattattttaagctgctaaa

SEQ ID NO: 57275 - DNA, 20 bp, Artificial Sequence
  Description of Artificial Sequence: Synthetic oligonucleotide
  Target: SCN9A; (-) strand; PAM type: YTN; PAM sequence: TTT
gtattattttaagctgctaa

SEQ ID NO: 57276 - DNA, 20 bp, Artificial Sequence
  Description of Artificial Sequence: Synthetic oligonucleotide
  Target: SCN9A; (-) strand; PAM type: YTN; PAM sequence: TTG
tgagataatacatttgtatt

SEQ ID NO: 57277 - DNA, 20 bp, Artificial Sequence
  Description of Artificial Sequence: Synthetic oligonucleotide
  Target: SCN9A; (-) strand; PAM type: YTN; PAM sequence: CTC
acaaaaattgtgagataata

SEQ ID NO: 57278 - DNA, 20 bp, Artificial Sequence
  Description of Artificial Sequence: Synthetic oligonucleotide
  Target: SCN9A; (-) strand; PAM type: YTN; PAM sequence: CTG
cctcacaaaaattgtgagat

SEQ ID NO: 57279 - DNA, 20 bp, Artificial Sequence
  Description of Artificial Sequence: Synthetic oligonucleotide
  Target: SCN9A; (-) strand; PAM type: YTN; PAM sequence: CTC
ctgcctcacaaaaattgtga

SEQ ID NO: 57280 - DNA, 20 bp, Artificial Sequence
  Description of Artificial Sequence: Synthetic oligonucleotide
  Target: SCN9A; (-) strand; PAM type: YTN; PAM sequence: CTA
tacccaggctcctgcctcac

SEQ ID NO: 57281 - DNA, 20 bp, Artificial Sequence
  Description of Artificial Sequence: Synthetic oligonucleotide
  Target: SCN9A; (-) strand; PAM type: YTN; PAM sequence: TTA
tacaaaacacagataactat

SEQ ID NO: 57282 - DNA, 20 bp, Artificial Sequence
  Description of Artificial Sequence: Synthetic oligonucleotide
  Target: SCN9A; (-) strand; PAM type: YTN; PAM sequence: TTT
atacaaaacacagataacta

SEQ ID NO: 57283 - DNA, 20 bp, Artificial Sequence
  Description of Artificial Sequence: Synthetic oligonucleotide
  Target: SCN9A; (-) strand; PAM type: YTN; PAM sequence: CTT
tatacaaaacacagataact

SEQ ID NO: 57284 - DNA, 20 bp, Artificial Sequence
  Description of Artificial Sequence: Synthetic oligonucleotide
  Target: SCN9A; (-) strand; PAM type: YTN; PAM sequence: TTA
catgtgtctttatacaaaac

SEQ ID NO: 57285 - DNA, 20 bp, Artificial Sequence
  Description of Artificial Sequence: Synthetic oligonucleotide
  Target: SCN9A; (-) strand; PAM type: YTN; PAM sequence: CTA
acagaacagaaaaaataagt

SEQ ID NO: 57286 - DNA, 20 bp, Artificial Sequence
  Description of Artificial Sequence: Synthetic oligonucleotide
  Target: SCN9A; (-) strand; PAM type: YTN; PAM sequence: TTC
taacagaacagaaaaaataa

SEQ ID NO: 57287 - DNA, 20 bp, Artificial Sequence
  Description of Artificial Sequence: Synthetic oligonucleotide
  Target: SCN9A; (-) strand; PAM type: YTN; PAM sequence: CTT
ctaacagaacagaaaaaata

SEQ ID NO: 57288 - DNA, 20 bp, Artificial Sequence
  Description of Artificial Sequence: Synthetic oligonucleotide
  Target: SCN9A; (-) strand; PAM type: YTN; PAM sequence: TTC
cttctaacagaacagaaaaa

SEQ ID NO: 57289 - DNA, 20 bp, Artificial Sequence
  Description of Artificial Sequence: Synthetic oligonucleotide
  Target: SCN9A; (-) strand; PAM type: YTN; PAM sequence: CTA
attccttctaacagaacaga

SEQ ID NO: 57290 - DNA, 20 bp, Artificial Sequence
  Description of Artificial Sequence: Synthetic oligonucleotide
  Target: SCN9A; (-) strand; PAM type: YTN; PAM sequence: CTG
tgatacactaattccttcta

SEQ ID NO: 57291 - DNA, 20 bp, Artificial Sequence
  Description of Artificial Sequence: Synthetic oligonucleotide
  Target: SCN9A; (-) strand; PAM type: YTN; PAM sequence: CTC
atataagaaaaggatataaa

SEQ ID NO: 57292 - DNA, 20 bp, Artificial Sequence
  Description of Artificial Sequence: Synthetic oligonucleotide
  Target: SCN9A; (-) strand; PAM type: YTN; PAM sequence: TTG
ctcatataagaaaaggatat

SEQ ID NO: 57293 - DNA, 20 bp, Artificial Sequence
  Description of Artificial Sequence: Synthetic oligonucleotide
  Target: SCN9A; (-) strand; PAM type: YTN; PAM sequence: CTT
gctcatataagaaaaggata

SEQ ID NO: 57294 - DNA, 20 bp, Artificial Sequence
  Description of Artificial Sequence: Synthetic oligonucleotide
  Target: SCN9A; (-) strand; PAM type: YTN; PAM sequence: TTA
tatgagaaagaatgatatct

SEQ ID NO: 57295 - DNA, 20 bp, Artificial Sequence
  Description of Artificial Sequence: Synthetic oligonucleotide
  Target: SCN9A; (-) strand; PAM type: YTN; PAM sequence: TTT
atatgagaaagaatgatatc

SEQ ID NO: 57296 - DNA, 20 bp, Artificial Sequence
  Description of Artificial Sequence: Synthetic oligonucleotide
  Target: SCN9A; (-) strand; PAM type: YTN; PAM sequence: TTT
tatatgagaaagaatgatat

SEQ ID NO: 57297 - DNA, 20 bp, Artificial Sequence
  Description of Artificial Sequence: Synthetic oligonucleotide
  Target: SCN9A; (-) strand; PAM type: YTN; PAM sequence: TTT
ttatatgagaaagaatgata

SEQ ID NO: 57298 - DNA, 20 bp, Artificial Sequence
  Description of Artificial Sequence: Synthetic oligonucleotide
  Target: SCN9A; (-) strand; PAM type: YTN; PAM sequence: CTC
atttttatatgagaaagaat

SEQ ID NO: 57299 - DNA, 20 bp, Artificial Sequence
  Description of Artificial Sequence: Synthetic oligonucleotide
  Target: SCN9A; (-) strand; PAM type: YTN; PAM sequence: CTG
ctcatttttatatgagaaag

SEQ ID NO: 57300 - DNA, 20 bp, Artificial Sequence
  Description of Artificial Sequence: Synthetic oligonucleotide
  Target: SCN9A; (-) strand; PAM type: YTN; PAM sequence: TTG
agaactgctcatttttatat

SEQ ID NO: 57301 - DNA, 20 bp, Artificial Sequence
  Description of Artificial Sequence: Synthetic oligonucleotide
  Target: SCN9A; (-) strand; PAM type: YTN; PAM sequence: CTT
gagaactgctcatttttata

SEQ ID NO: 57302 - DNA, 20 bp, Artificial Sequence
  Description of Artificial Sequence: Synthetic oligonucleotide
  Target: SCN9A; (-) strand; PAM type: YTN; PAM sequence: CTC
ttgagaactgctcattttta

SEQ ID NO: 57303 - DNA, 20 bp, Artificial Sequence
  Description of Artificial Sequence: Synthetic oligonucleotide
  Target: SCN9A; (-) strand; PAM type: YTN; PAM sequence: CTA
ctcttgagaactgctcattt

SEQ ID NO: 57304 - DNA, 20 bp, Artificial Sequence
  Description of Artificial Sequence: Synthetic oligonucleotide
  Target: SCN9A; (-) strand; PAM type: YTN; PAM sequence: TTA
ggctactcttgagaactgct

SEQ ID NO: 57305 - DNA, 20 bp, Artificial Sequence
  Description of Artificial Sequence: Synthetic oligonucleotide
  Target: SCN9A; (-) strand; PAM type: YTN; PAM sequence: CTT
aggctactcttgagaactgc

SEQ ID NO: 57306 - DNA, 20 bp, Artificial Sequence
  Description of Artificial Sequence: Synthetic oligonucleotide
  Target: SCN9A; (-) strand; PAM type: YTN; PAM sequence: TTC
ttaggctactcttgagaact

SEQ ID NO: 57307 - DNA, 20 bp, Artificial Sequence
  Description of Artificial Sequence: Synthetic oligonucleotide
  Target: SCN9A; (-) strand; PAM type: YTN; PAM sequence: CTG
ttcttaggctactcttgaga

SEQ ID NO: 57308 - DNA, 20 bp, Artificial Sequence
  Description of Artificial Sequence: Synthetic oligonucleotide
  Target: SCN9A; (-) strand; PAM type: YTN; PAM sequence: CTC
ctgttcttaggctactcttg

SEQ ID NO: 57309 - DNA, 20 bp, Artificial Sequence
  Description of Artificial Sequence: Synthetic oligonucleotide
  Target: SCN9A; (-) strand; PAM type: YTN; PAM sequence: TTC
tcctgttcttaggctactct

SEQ ID NO: 57310 - DNA, 20 bp, Artificial Sequence
  Description of Artificial Sequence: Synthetic oligonucleotide
  Target: SCN9A; (-) strand; PAM type: YTN; PAM sequence: TTT
ctcctgttcttaggctactc

SEQ ID NO: 57311 - DNA, 20 bp, Artificial Sequence
  Description of Artificial Sequence: Synthetic oligonucleotide
  Target: SCN9A; (-) strand; PAM type: YTN; PAM sequence: CTT
tctcctgttcttaggctact

SEQ ID NO: 57312 - DNA, 20 bp, Artificial Sequence
  Description of Artificial Sequence: Synthetic oligonucleotide
  Target: SCN9A; (-) strand; PAM type: YTN; PAM sequence: TTA
aaatgtgctttctcctgttc

SEQ ID NO: 57313 - DNA, 20 bp, Artificial Sequence
  Description of Artificial Sequence: Synthetic oligonucleotide
  Target: SCN9A; (-) strand; PAM type: YTN; PAM sequence: TTG
acaatatgttaaaatgtgct

SEQ ID NO: 57314 - DNA, 20 bp, Artificial Sequence
  Description of Artificial Sequence: Synthetic oligonucleotide
  Target: SCN9A; (-) strand; PAM type: YTN; PAM sequence: CTG
tacattgacaatatgttaaa

SEQ ID NO: 57315 - DNA, 20 bp, Artificial Sequence
  Description of Artificial Sequence: Synthetic oligonucleotide
  Target: SCN9A; (-) strand; PAM type: YTN; PAM sequence: CTC
tgtacattgacaatatgtta

SEQ ID NO: 57316 - DNA, 20 bp, Artificial Sequence
  Description of Artificial Sequence: Synthetic oligonucleotide
  Target: SCN9A; (-) strand; PAM type: YTN; PAM sequence: CTA
ctctgtacattgacaatatg

SEQ ID NO: 57317 - DNA, 20 bp, Artificial Sequence
  Description of Artificial Sequence: Synthetic oligonucleotide
  Target: SCN9A; (-) strand; PAM type: YTN; PAM sequence: TTC
tactctgtacattgacaata

SEQ ID NO: 57318 - DNA, 20 bp, Artificial Sequence
  Description of Artificial Sequence: Synthetic oligonucleotide
  Target: SCN9A; (-) strand; PAM type: YTN; PAM sequence: CTT
ctactctgtacattgacaat

SEQ ID NO: 57319 - DNA, 20 bp, Artificial Sequence
  Description of Artificial Sequence: Synthetic oligonucleotide
  Target: SCN9A; (-) strand; PAM type: YTN; PAM sequence: TTG
tgtcttctactctgtacatt

SEQ ID NO: 57320 - DNA, 20 bp, Artificial Sequence
  Description of Artificial Sequence: Synthetic oligonucleotide
  Target: SCN9A; (-) strand; PAM type: YTN; PAM sequence: CTT
gtgtcttctactctgtacat

SEQ ID NO: 57321 - DNA, 20 bp, Artificial Sequence
  Description of Artificial Sequence: Synthetic oligonucleotide
  Target: SCN9A; (-) strand; PAM type: YTN; PAM sequence: TTA
aatatcttgtgtcttctact

SEQ ID NO: 57322 - DNA, 20 bp, Artificial Sequence
  Description of Artificial Sequence: Synthetic oligonucleotide
  Target: SCN9A; (-) strand; PAM type: YTN; PAM sequence: TTT
aaatatcttgtgtcttctac

SEQ ID NO: 57323 - DNA, 20 bp, Artificial Sequence
  Description of Artificial Sequence: Synthetic oligonucleotide
  Target: SCN9A; (-) strand; PAM type: YTN; PAM sequence: CTT
taaatatcttgtgtcttcta

SEQ ID NO: 57324 - DNA, 20 bp, Artificial Sequence
  Description of Artificial Sequence: Synthetic oligonucleotide
  Target: SCN9A; (-) strand; PAM type: YTN; PAM sequence: CTC
tttaaatatcttgtgtcttc

SEQ ID NO: 57325 - DNA, 20 bp, Artificial Sequence
  Description of Artificial Sequence: Synthetic oligonucleotide
  Target: SCN9A; (-) strand; PAM type: YTN; PAM sequence: CTC
tctttaaatatcttgtgtct

SEQ ID NO: 57326 - DNA, 20 bp, Artificial Sequence
  Description of Artificial Sequence: Synthetic oligonucleotide
  Target: SCN9A; (-) strand; PAM type: YTN; PAM sequence: TTA
ctctctttaaatatcttgtg

SEQ ID NO: 57327 - DNA, 20 bp, Artificial Sequence
  Description of Artificial Sequence: Synthetic oligonucleotide
  Target: SCN9A; (-) strand; PAM type: YTN; PAM sequence: TTT
actctctttaaatatcttgt

SEQ ID NO: 57328 - DNA, 20 bp, Artificial Sequence
  Description of Artificial Sequence: Synthetic oligonucleotide
  Target: SCN9A; (-) strand; PAM type: YTN; PAM sequence: CTC
cagatttactctctttaaat

SEQ ID NO: 57329 - DNA, 20 bp, Artificial Sequence
  Description of Artificial Sequence: Synthetic oligonucleotide
  Target: SCN9A; (-) strand; PAM type: YTN; PAM sequence: CTG
aggagcctccagatttactc

SEQ ID NO: 57330 - DNA, 20 bp, Artificial Sequence
  Description of Artificial Sequence: Synthetic oligonucleotide
  Target: SCN9A; (-) strand; PAM type: YTN; PAM sequence: TTC
atctgaggagcctccagatt

SEQ ID NO: 57331 - DNA, 20 bp, Artificial Sequence
  Description of Artificial Sequence: Synthetic oligonucleotide
  Target: SCN9A; (-) strand; PAM type: YTN; PAM sequence: CTT
catctgaggagcctccagat

SEQ ID NO: 57332 - DNA, 20 bp, Artificial Sequence
  Description of Artificial Sequence: Synthetic oligonucleotide
  Target: SCN9A; (-) strand; PAM type: YTN; PAM sequence: CTG
gcccttcatctgaggagcct

SEQ ID NO: 57333 - DNA, 20 bp, Artificial Sequence
  Description of Artificial Sequence: Synthetic oligonucleotide
  Target: SCN9A; (-) strand; PAM type: YTN; PAM sequence: TTA
tggctggcccttcatctgag

SEQ ID NO: 57334 - DNA, 20 bp, Artificial Sequence
  Description of Artificial Sequence: Synthetic oligonucleotide
  Target: SCN9A; (-) strand; PAM type: YTN; PAM sequence: CTT
atggctggcccttcatctga

SEQ ID NO: 57335 - DNA, 20 bp, Artificial Sequence
  Description of Artificial Sequence: Synthetic oligonucleotide
  Target: SCN9A; (-) strand; PAM type: YTN; PAM sequence: TTA
cttatggctggcccttcatc

SEQ ID NO: 57336 - DNA, 20 bp, Artificial Sequence
  Description of Artificial Sequence: Synthetic oligonucleotide
  Target: SCN9A; (-) strand; PAM type: YTN; PAM sequence: TTT
acttatggctggcccttcat

SEQ ID NO: 57337 - DNA, 20 bp, Artificial Sequence
  Description of Artificial Sequence: Synthetic oligonucleotide
  Target: SCN9A; (-) strand; PAM type: YTN; PAM sequence: TTT
tacttatggctggcccttca

SEQ ID NO: 57338 - DNA, 20 bp, Artificial Sequence
  Description of Artificial Sequence: Synthetic oligonucleotide
  Target: SCN9A; (-) strand; PAM type: YTN; PAM sequence: CTT
ttacttatggctggcccttc

SEQ ID NO: 57339 - DNA, 20 bp, Artificial Sequence
  Description of Artificial Sequence: Synthetic oligonucleotide
  Target: SCN9A; (-) strand; PAM type: YTN; PAM sequence: TTC
ttttacttatggctggccct

SEQ ID NO: 57340 - DNA, 20 bp, Artificial Sequence
  Description of Artificial Sequence: Synthetic oligonucleotide
  Target: SCN9A; (-) strand; PAM type: YTN; PAM sequence: TTA
aacaaatacattcttttact

SEQ ID NO: 57341 - DNA, 20 bp, Artificial Sequence
  Description of Artificial Sequence: Synthetic oligonucleotide
  Target: SCN9A; (-) strand; PAM type: YTN; PAM sequence: TTT
aaacaaatacattcttttac

SEQ ID NO: 57342 - DNA, 20 bp, Artificial Sequence
  Description of Artificial Sequence: Synthetic oligonucleotide
  Target: SCN9A; (-) strand; PAM type: YTN; PAM sequence: CTT
taaacaaatacattctttta

SEQ ID NO: 57343 - DNA, 20 bp, Artificial Sequence
  Description of Artificial Sequence: Synthetic oligonucleotide
  Target: SCN9A; (-) strand; PAM type: YTN; PAM sequence: CTG
ctttaaacaaatacattctt

SEQ ID NO: 57344 - DNA, 20 bp, Artificial Sequence
  Description of Artificial Sequence: Synthetic oligonucleotide
  Target: SCN9A; (-) strand; PAM type: YTN; PAM sequence: TTG
catgtgctgctttaaacaaa

SEQ ID NO: 57345 - DNA, 20 bp, Artificial Sequence
  Description of Artificial Sequence: Synthetic oligonucleotide
  Target: SCN9A; (-) strand; PAM type: YTN; PAM sequence: TTT
gcatgtgctgctttaaacaa

SEQ ID NO: 57346 - DNA, 20 bp, Artificial Sequence
  Description of Artificial Sequence: Synthetic oligonucleotide
  Target: SCN9A; (-) strand; PAM type: YTN; PAM sequence: CTG
gatttgcatgtgctgcttta

SEQ ID NO: 57347 - DNA, 20 bp, Artificial Sequence
  Description of Artificial Sequence: Synthetic oligonucleotide
  Target: SCN9A; (-) strand; PAM type: YTN; PAM sequence: CTA
aatatgtgagaacataatct

SEQ ID NO: 57348 - DNA, 20 bp, Artificial Sequence
  Description of Artificial Sequence: Synthetic oligonucleotide
  Target: SCN9A; (-) strand; PAM type: YTN; PAM sequence: TTC
taaatatgtgagaacataat

SEQ ID NO: 57349 - DNA, 20 bp, Artificial Sequence
  Description of Artificial Sequence: Synthetic oligonucleotide
  Target: SCN9A; (-) strand; PAM type: YTN; PAM sequence: TTT
ctaaatatgtgagaacataa

SEQ ID NO: 57350 - DNA, 20 bp, Artificial Sequence
  Description of Artificial Sequence: Synthetic oligonucleotide
  Target: SCN9A; (-) strand; PAM type: YTN; PAM sequence: CTA
tttctaaatatgtgagaaca

SEQ ID NO: 57351 - DNA, 20 bp, Artificial Sequence
  Description of Artificial Sequence: Synthetic oligonucleotide
  Target: SCN9A; (-) strand; PAM type: YTN; PAM sequence: TTA
ctatttctaaatatgtgaga

SEQ ID NO: 57352 - DNA, 20 bp, Artificial Sequence
  Description of Artificial Sequence: Synthetic oligonucleotide
  Target: SCN9A; (-) strand; PAM type: YTN; PAM sequence: TTA
aattactatttctaaatatg

SEQ ID NO: 57353 - DNA, 20 bp, Artificial Sequence
  Description of Artificial Sequence: Synthetic oligonucleotide
  Target: SCN9A; (-) strand; PAM type: YTN; PAM sequence: CTC
ccattaaattactatttcta

SEQ ID NO: 57354 - DNA, 20 bp, Artificial Sequence
  Description of Artificial Sequence: Synthetic oligonucleotide
  Target: SCN9A; (-) strand; PAM type: YTN; PAM sequence: TTA
agaatacactcccattaaat

SEQ ID NO: 57355 - DNA, 20 bp, Artificial Sequence
  Description of Artificial Sequence: Synthetic oligonucleotide
  Target: SCN9A; (-) strand; PAM type: YTN; PAM sequence: TTA
tatccagtgaatattaagaa

SEQ ID NO: 57356 - DNA, 20 bp, Artificial Sequence
  Description of Artificial Sequence: Synthetic oligonucleotide
  Target: SCN9A; (-) strand; PAM type: YTN; PAM sequence: TTA
tgggaaaattatatccagtg

SEQ ID NO: 57357 - DNA, 20 bp, Artificial Sequence
  Description of Artificial Sequence: Synthetic oligonucleotide
  Target: SCN9A; (-) strand; PAM type: YTN; PAM sequence: TTT
atgggaaaattatatccagt

SEQ ID NO: 57358 - DNA, 20 bp, Artificial Sequence
  Description of Artificial Sequence: Synthetic oligonucleotide
  Target: SCN9A; (-) strand; PAM type: YTN; PAM sequence: TTA
gaatttatgggaaaattata

SEQ ID NO: 57359 - DNA, 20 bp, Artificial Sequence
  Description of Artificial Sequence: Synthetic oligonucleotide
  Target: SCN9A; (-) strand; PAM type: YTN; PAM sequence: TTT
agaatttatgggaaaattat

SEQ ID NO: 57360 - DNA, 20 bp, Artificial Sequence
  Description of Artificial Sequence: Synthetic oligonucleotide
  Target: SCN9A; (-) strand; PAM type: YTN; PAM sequence: TTA
gtgatgtgtaaaatttagaa

SEQ ID NO: 57361 - DNA, 20 bp, Artificial Sequence
  Description of Artificial Sequence: Synthetic oligonucleotide
  Target: SCN9A; (-) strand; PAM type: YTN; PAM sequence: TTT
agtgatgtgtaaaatttaga

SEQ ID NO: 57362 - DNA, 20 bp, Artificial Sequence
  Description of Artificial Sequence: Synthetic oligonucleotide
  Target: SCN9A; (-) strand; PAM type: YTN; PAM sequence: TTT
tagtgatgtgtaaaatttag

SEQ ID NO: 57363 - DNA, 20 bp, Artificial Sequence
  Description of Artificial Sequence: Synthetic oligonucleotide
  Target: SCN9A; (-) strand; PAM type: YTN; PAM sequence: TTT
ttagtgatgtgtaaaattta

SEQ ID NO: 57364 - DNA, 20 bp, Artificial Sequence
  Description of Artificial Sequence: Synthetic oligonucleotide
  Target: SCN9A; (-) strand; PAM type: YTN; PAM sequence: TTA
tttttagtgatgtgtaaaat

SEQ ID NO: 57365 - DNA, 20 bp, Artificial Sequence
  Description of Artificial Sequence: Synthetic oligonucleotide
  Target: SCN9A; (-) strand; PAM type: YTN; PAM sequence: TTT
atttttagtgatgtgtaaaa

SEQ ID NO: 57366 - DNA, 20 bp, Artificial Sequence
  Description of Artificial Sequence: Synthetic oligonucleotide
  Target: SCN9A; (-) strand; PAM type: YTN; PAM sequence: TTT
tatttttagtgatgtgtaaa

SEQ ID NO: 57367 - DNA, 20 bp, Artificial Sequence
  Description of Artificial Sequence: Synthetic oligonucleotide
  Target: SCN9A; (-) strand; PAM type: YTN; PAM sequence: TTT
ttatttttagtgatgtgtaa

SEQ ID NO: 57368 - DNA, 20 bp, Artificial Sequence
  Description of Artificial Sequence: Synthetic oligonucleotide
  Target: SCN9A; (-) strand; PAM type: YTN; PAM sequence: TTC
atttttatttttagtgatgt

SEQ ID NO: 57369 - DNA, 20 bp, Artificial Sequence
  Description of Artificial Sequence: Synthetic oligonucleotide
  Target: SCN9A; (-) strand; PAM type: YTN; PAM sequence: CTA
atataccatcataattcatt

SEQ ID NO: 57370 - DNA, 20 bp, Artificial Sequence
  Description of Artificial Sequence: Synthetic oligonucleotide
  Target: SCN9A; (-) strand; PAM type: YTN; PAM sequence: CTC
taatataccatcataattca

SEQ ID NO: 57371 - DNA, 20 bp, Artificial Sequence
  Description of Artificial Sequence: Synthetic oligonucleotide
  Target: SCN9A; (-) strand; PAM type: YTN; PAM sequence: TTC
tctaatataccatcataatt

SEQ ID NO: 57372 - DNA, 20 bp, Artificial Sequence
  Description of Artificial Sequence: Synthetic oligonucleotide
  Target: SCN9A; (-) strand; PAM type: YTN; PAM sequence: CTT
ctctaatataccatcataat

SEQ ID NO: 57373 - DNA, 20 bp, Artificial Sequence
  Description of Artificial Sequence: Synthetic oligonucleotide
  Target: SCN9A; (-) strand; PAM type: YTN; PAM sequence: TTC
ttctctaatataccatcata

SEQ ID NO: 57374 - DNA, 20 bp, Artificial Sequence
  Description of Artificial Sequence: Synthetic oligonucleotide
  Target: SCN9A; (-) strand; PAM type: YTN; PAM sequence: CTA
taaaaatataattcttctct

SEQ ID NO: 57375 - DNA, 20 bp, Artificial Sequence
  Description of Artificial Sequence: Synthetic oligonucleotide
  Target: SCN9A; (-) strand; PAM type: YTN; PAM sequence: TTC
tataaaaatataattcttct

SEQ ID NO: 57376 - DNA, 20 bp, Artificial Sequence
  Description of Artificial Sequence: Synthetic oligonucleotide
  Target: SCN9A; (-) strand; PAM type: YTN; PAM sequence: TTT
ctataaaaatataattcttc

SEQ ID NO: 57377 - DNA, 20 bp, Artificial Sequence
  Description of Artificial Sequence: Synthetic oligonucleotide
  Target: SCN9A; (-) strand; PAM type: YTN; PAM sequence: CTT
tctataaaaatataattctt

SEQ ID NO: 57378 - DNA, 20 bp, Artificial Sequence
  Description of Artificial Sequence: Synthetic oligonucleotide
  Target: SCN9A; (-) strand; PAM type: YTN; PAM sequence: TTC
tttctataaaaatataattc

SEQ ID NO: 57379 - DNA, 20 bp, Artificial Sequence
  Description of Artificial Sequence: Synthetic oligonucleotide
  Target: SCN9A; (-) strand; PAM type: YTN; PAM sequence: TTC
agtcatattctttctataaa

SEQ ID NO: 57380 - DNA, 20 bp, Artificial Sequence
  Description of Artificial Sequence: Synthetic oligonucleotide
  Target: SCN9A; (-) strand; PAM type: YTN; PAM sequence: TTA
gttcagtcatattctttcta

SEQ ID NO: 57381 - DNA, 20 bp, Artificial Sequence
  Description of Artificial Sequence: Synthetic oligonucleotide
  Target: SCN9A; (-) strand; PAM type: YTN; PAM sequence: TTC
aagttagttcagtcatattc

SEQ ID NO: 57382 - DNA, 20 bp, Artificial Sequence
  Description of Artificial Sequence: Synthetic oligonucleotide
  Target: SCN9A; (-) strand; PAM type: YTN; PAM sequence: CTT
caagttagttcagtcatatt

SEQ ID NO: 57383 - DNA, 20 bp, Artificial Sequence
  Description of Artificial Sequence: Synthetic oligonucleotide
  Target: SCN9A; (-) strand; PAM type: YTN; PAM sequence: CTA
caaaacaatatgtcttcaag

SEQ ID NO: 57384 - DNA, 20 bp, Artificial Sequence
  Description of Artificial Sequence: Synthetic oligonucleotide
  Target: SCN9A; (-) strand; PAM type: YTN; PAM sequence: TTC
ctacaaaacaatatgtcttc

SEQ ID NO: 57385 - DNA, 20 bp, Artificial Sequence
  Description of Artificial Sequence: Synthetic oligonucleotide
  Target: SCN9A; (-) strand; PAM type: YTN; PAM sequence: TTT
cctacaaaacaatatgtctt

SEQ ID NO: 57386 - DNA, 20 bp, Artificial Sequence
  Description of Artificial Sequence: Synthetic oligonucleotide
  Target: SCN9A; (-) strand; PAM type: YTN; PAM sequence: TTA
tttcctacaaaacaatatgt

SEQ ID NO: 57387 - DNA, 20 bp, Artificial Sequence
  Description of Artificial Sequence: Synthetic oligonucleotide
  Target: SCN9A; (-) strand; PAM type: YTN; PAM sequence: TTT
atttcctacaaaacaatatg

SEQ ID NO: 57388 - DNA, 20 bp, Artificial Sequence
  Description of Artificial Sequence: Synthetic oligonucleotide
  Target: SCN9A; (-) strand; PAM type: YTN; PAM sequence: TTT
tatttcctacaaaacaatat

SEQ ID NO: 57389 - DNA, 20 bp, Artificial Sequence
  Description of Artificial Sequence: Synthetic oligonucleotide
  Target: SCN9A; (-) strand; PAM type: YTN; PAM sequence: TTA
ttttatttcctacaaaacaa

SEQ ID NO: 57390 - DNA, 20 bp, Artificial Sequence
  Description of Artificial Sequence: Synthetic oligonucleotide
  Target: SCN9A; (-) strand; PAM type: YTN; PAM sequence: TTT
attttatttcctacaaaaca

SEQ ID NO: 57391 - DNA, 20 bp, Artificial Sequence
  Description of Artificial Sequence: Synthetic oligonucleotide
  Target: SCN9A; (-) strand; PAM type: YTN; PAM sequence: TTT
tattttatttcctacaaaac

SEQ ID NO: 57392 - DNA, 20 bp, Artificial Sequence
  Description of Artificial Sequence: Synthetic oligonucleotide
  Target: SCN9A; (-) strand; PAM type: YTN; PAM sequence: TTT
ttattttatttcctacaaaa

SEQ ID NO: 57393 - DNA, 20 bp, Artificial Sequence
  Description of Artificial Sequence: Synthetic oligonucleotide
  Target: SCN9A; (-) strand; PAM type: YTN; PAM sequence: CTA
gtttttattttatttcctac

SEQ ID NO: 57394 - DNA, 20 bp, Artificial Sequence
  Description of Artificial Sequence: Synthetic oligonucleotide
  Target: SCN9A; (-) strand; PAM type: YTN; PAM sequence: CTG
gcatgacctagtttttattt

SEQ ID NO: 57395 - DNA, 20 bp, Artificial Sequence
  Description of Artificial Sequence: Synthetic oligonucleotide
  Target: SCN9A; (-) strand; PAM type: YTN; PAM sequence: TTG
ctggcatgacctagttttta

SEQ ID NO: 57396 - DNA, 20 bp, Artificial Sequence
  Description of Artificial Sequence: Synthetic oligonucleotide
  Target: SCN9A; (-) strand; PAM type: YTN; PAM sequence: TTT
gctggcatgacctagttttt

SEQ ID NO: 57397 - DNA, 20 bp, Artificial Sequence
  Description of Artificial Sequence: Synthetic oligonucleotide
  Target: SCN9A; (-) strand; PAM type: YTN; PAM sequence: TTG
taatatttgctggcatgacc

SEQ ID NO: 57398 - DNA, 20 bp, Artificial Sequence
  Description of Artificial Sequence: Synthetic oligonucleotide
  Target: SCN9A; (-) strand; PAM type: YTN; PAM sequence: TTC
gtaagttgtaatatttgctg

SEQ ID NO: 57399 - DNA, 20 bp, Artificial Sequence
  Description of Artificial Sequence: Synthetic oligonucleotide
  Target: SCN9A; (-) strand; PAM type: YTN; PAM sequence: TTA
ttcgtaagttgtaatatttg

SEQ ID NO: 57400 - DNA, 20 bp, Artificial Sequence
  Description of Artificial Sequence: Synthetic oligonucleotide
  Target: SCN9A; (-) strand; PAM type: YTN; PAM sequence: CTG
agcaaaagttattcgtaagt

SEQ ID NO: 57401 - DNA, 20 bp, Artificial Sequence
  Description of Artificial Sequence: Synthetic oligonucleotide
  Target: SCN9A; (-) strand; PAM type: YTN; PAM sequence: CTA
gtagaactgagcaaaagtta

SEQ ID NO: 57402 - DNA, 20 bp, Artificial Sequence
  Description of Artificial Sequence: Synthetic oligonucleotide
  Target: SCN9A; (-) strand; PAM type: YTN; PAM sequence: TTG
caaatctagtagaactgagc

SEQ ID NO: 57403 - DNA, 20 bp, Artificial Sequence
  Description of Artificial Sequence: Synthetic oligonucleotide
  Target: SCN9A; (-) strand; PAM type: YTN; PAM sequence: TTT
gcaaatctagtagaactgag

SEQ ID NO: 57404 - DNA, 20 bp, Artificial Sequence
  Description of Artificial Sequence: Synthetic oligonucleotide
  Target: SCN9A; (-) strand; PAM type: YTN; PAM sequence: TTT
tgcaaatctagtagaactga

SEQ ID NO: 57405 - DNA, 20 bp, Artificial Sequence
  Description of Artificial Sequence: Synthetic oligonucleotide
  Target: SCN9A; (-) strand; PAM type: YTN; PAM sequence: TTA
aaaattttgcaaatctagta

SEQ ID NO: 57406 - DNA, 20 bp, Artificial Sequence
  Description of Artificial Sequence: Synthetic oligonucleotide
  Target: SCN9A; (-) strand; PAM type: YTN; PAM sequence: TTG
ttaaaaattttgcaaatcta

SEQ ID NO: 57407 - DNA, 20 bp, Artificial Sequence
  Description of Artificial Sequence: Synthetic oligonucleotide
  Target: SCN9A; (-) strand; PAM type: YTN; PAM sequence: CTT
gttaaaaattttgcaaatct

SEQ ID NO: 57408 - DNA, 20 bp, Artificial Sequence
  Description of Artificial Sequence: Synthetic oligonucleotide
  Target: SCN9A; (-) strand; PAM type: YTN; PAM sequence: TTC
agagcttgttaaaaattttg

SEQ ID NO: 57409 - DNA, 20 bp, Artificial Sequence
  Description of Artificial Sequence: Synthetic oligonucleotide
  Target: SCN9A; (-) strand; PAM type: YTN; PAM sequence: TTA
gaaacaaaagataaaagcaa

SEQ ID NO: 57410 - DNA, 20 bp, Artificial Sequence
  Description of Artificial Sequence: Synthetic oligonucleotide
  Target: SCN9A; (-) strand; PAM type: YTN; PAM sequence: TTT
agaaacaaaagataaaagca

SEQ ID NO: 57411 - DNA, 20 bp, Artificial Sequence
  Description of Artificial Sequence: Synthetic oligonucleotide
  Target: SCN9A; (-) strand; PAM type: YTN; PAM sequence: CTT
tagaaacaaaagataaaagc

SEQ ID NO: 57412 - DNA, 20 bp, Artificial Sequence
  Description of Artificial Sequence: Synthetic oligonucleotide
  Target: SCN9A; (-) strand; PAM type: YTN; PAM sequence: TTA
aatatatctttagaaacaaa

SEQ ID NO: 57413 - DNA, 20 bp, Artificial Sequence
  Description of Artificial Sequence: Synthetic oligonucleotide
  Target: SCN9A; (-) strand; PAM type: YTN; PAM sequence: TTT
aaatatatctttagaaacaa

SEQ ID NO: 57414 - DNA, 20 bp, Artificial Sequence
  Description of Artificial Sequence: Synthetic oligonucleotide
  Target: SCN9A; (-) strand; PAM type: YTN; PAM sequence: TTT
taaatatatctttagaaaca

SEQ ID NO: 57415 - DNA, 20 bp, Artificial Sequence
  Description of Artificial Sequence: Synthetic oligonucleotide
  Target: SCN9A; (-) strand; PAM type: YTN; PAM sequence: TTT
ttaaatatatctttagaaac

SEQ ID NO: 57416 - DNA, 20 bp, Artificial Sequence
  Description of Artificial Sequence: Synthetic oligonucleotide
  Target: SCN9A; (-) strand; PAM type: YTN; PAM sequence: CTT
tttaaatatatctttagaaa

SEQ ID NO: 57417 - DNA, 20 bp, Artificial Sequence
  Description of Artificial Sequence: Synthetic oligonucleotide
  Target: SCN9A; (-) strand; PAM type: YTN; PAM sequence: TTG
aatctttttaaatatatctt

SEQ ID NO: 57418 - DNA, 20 bp, Artificial Sequence
  Description of Artificial Sequence: Synthetic oligonucleotide
  Target: SCN9A; (-) strand; PAM type: YTN; PAM sequence: CTT
gaatctttttaaatatatct

SEQ ID NO: 57419 - DNA, 20 bp, Artificial Sequence
  Description of Artificial Sequence: Synthetic oligonucleotide
  Target: SCN9A; (-) strand; PAM type: YTN; PAM sequence: TTA
gcttgaatctttttaaatat

SEQ ID NO: 57420 - DNA, 20 bp, Artificial Sequence
  Description of Artificial Sequence: Synthetic oligonucleotide
  Target: SCN9A; (-) strand; PAM type: YTN; PAM sequence: TTT
agcttgaatctttttaaata

SEQ ID NO: 57421 - DNA, 20 bp, Artificial Sequence
  Description of Artificial Sequence: Synthetic oligonucleotide
  Target: SCN9A; (-) strand; PAM type: YTN; PAM sequence: CTT
tagcttgaatctttttaaat

SEQ ID NO: 57422 - DNA, 20 bp, Artificial Sequence
  Description of Artificial Sequence: Synthetic oligonucleotide
  Target: SCN9A; (-) strand; PAM type: YTN; PAM sequence: TTG
cactttagcttgaatctttt

SEQ ID NO: 57423 - DNA, 20 bp, Artificial Sequence
  Description of Artificial Sequence: Synthetic oligonucleotide
  Target: SCN9A; (-) strand; PAM type: YTN; PAM sequence: CTG
catcattgcactttagcttg

SEQ ID NO: 57424 - DNA, 20 bp, Artificial Sequence
  Description of Artificial Sequence: Synthetic oligonucleotide
  Target: SCN9A; (-) strand; PAM type: YTN; PAM sequence: TTG
gtaataactgcatcattgca

SEQ ID NO: 57425 - DNA, 20 bp, Artificial Sequence
  Description of Artificial Sequence: Synthetic oligonucleotide
  Target: SCN9A; (-) strand; PAM type: YTN; PAM sequence: TTA
tgagacattggtaataactg

SEQ ID NO: 57426 - DNA, 20 bp, Artificial Sequence
  Description of Artificial Sequence: Synthetic oligonucleotide
  Target: SCN9A; (-) strand; PAM type: YTN; PAM sequence: TTT
atgagacattggtaataact

SEQ ID NO: 57427 - DNA, 20 bp, Artificial Sequence
  Description of Artificial Sequence: Synthetic oligonucleotide
  Target: SCN9A; (-) strand; PAM type: YTN; PAM sequence: TTG
aagagatttatgagacattg

SEQ ID NO: 57428 - DNA, 20 bp, Artificial Sequence
  Description of Artificial Sequence: Synthetic oligonucleotide
  Target: SCN9A; (-) strand; PAM type: YTN; PAM sequence: TTT
gaagagatttatgagacatt

SEQ ID NO: 57429 - DNA, 20 bp, Artificial Sequence
  Description of Artificial Sequence: Synthetic oligonucleotide
  Target: SCN9A; (-) strand; PAM type: YTN; PAM sequence: CTG
cgaaaaggtaatttgaagag

SEQ ID NO: 57430 - DNA, 20 bp, Artificial Sequence
  Description of Artificial Sequence: Synthetic oligonucleotide
  Target: SCN9A; (-) strand; PAM type: YTN; PAM sequence: CTG
tctgcgaaaaggtaatttga

SEQ ID NO: 57431 - DNA, 20 bp, Artificial Sequence
  Description of Artificial Sequence: Synthetic oligonucleotide
  Target: SCN9A; (-) strand; PAM type: YTN; PAM sequence: TTG
atctgtctgcgaaaaggtaa

SEQ ID NO: 57432 - DNA, 20 bp, Artificial Sequence
  Description of Artificial Sequence: Synthetic oligonucleotide
  Target: SCN9A; (-) strand; PAM type: YTN; PAM sequence: TTA
ataattgatctgtctgcgaa

SEQ ID NO: 57433 - DNA, 20 bp, Artificial Sequence
  Description of Artificial Sequence: Synthetic oligonucleotide
  Target: SCN9A; (-) strand; PAM type: YTN; PAM sequence: CTA
cattaataattgatctgtct

SEQ ID NO: 57434 - DNA, 20 bp, Artificial Sequence
  Description of Artificial Sequence: Synthetic oligonucleotide
  Target: SCN9A; (-) strand; PAM type: YTN; PAM sequence: CTG
cgagccatacctacattaat

SEQ ID NO: 57435 - DNA, 20 bp, Artificial Sequence
  Description of Artificial Sequence: Synthetic oligonucleotide
  Target: SCN9A; (-) strand; PAM type: YTN; PAM sequence: CTC
tgcgagccatacctacatta

SEQ ID NO: 57436 - DNA, 20 bp, Artificial Sequence
  Description of Artificial Sequence: Synthetic oligonucleotide
  Target: SCN9A; (-) strand; PAM type: YTN; PAM sequence: TTA
ctctgcgagccatacctaca

SEQ ID NO: 57437 - DNA, 20 bp, Artificial Sequence
  Description of Artificial Sequence: Synthetic oligonucleotide
  Target: SCN9A; (-) strand; PAM type: YTN; PAM sequence: CTA
ttactctgcgagccatacct

SEQ ID NO: 57438 - DNA, 20 bp, Artificial Sequence
  Description of Artificial Sequence: Synthetic oligonucleotide
  Target: SCN9A; (-) strand; PAM type: YTN; PAM sequence: CTC
cctattactctgcgagccat

SEQ ID NO: 57439 - DNA, 20 bp, Artificial Sequence
  Description of Artificial Sequence: Synthetic oligonucleotide
  Target: SCN9A; (-) strand; PAM type: YTN; PAM sequence: TTG
actccctattactctgcgag

SEQ ID NO: 57440 - DNA, 20 bp, Artificial Sequence
  Description of Artificial Sequence: Synthetic oligonucleotide
  Target: SCN9A; (-) strand; PAM type: YTN; PAM sequence: CTT
gactccctattactctgcga

SEQ ID NO: 57441 - DNA, 20 bp, Artificial Sequence
  Description of Artificial Sequence: Synthetic oligonucleotide
  Target: SCN9A; (-) strand; PAM type: YTN; PAM sequence: TTA
gcttgactccctattactct

SEQ ID NO: 57442 - DNA, 20 bp, Artificial Sequence
  Description of Artificial Sequence: Synthetic oligonucleotide
  Target: SCN9A; (-) strand; PAM type: YTN; PAM sequence: CTT
agcttgactccctattactc

SEQ ID NO: 57443 - DNA, 20 bp, Artificial Sequence
  Description of Artificial Sequence: Synthetic oligonucleotide
  Target: SCN9A; (-) strand; PAM type: YTN; PAM sequence: CTA
cacttagcttgactccctat

SEQ ID NO: 57444 - DNA, 20 bp, Artificial Sequence
  Description of Artificial Sequence: Synthetic oligonucleotide
  Target: SCN9A; (-) strand; PAM type: YTN; PAM sequence: CTC
acatgctacacttagcttga

SEQ ID NO: 57445 - DNA, 20 bp, Artificial Sequence
  Description of Artificial Sequence: Synthetic oligonucleotide
  Target: SCN9A; (-) strand; PAM type: YTN; PAM sequence: TTA
taaacaagcaatagagctca

SEQ ID NO: 57446 - DNA, 20 bp, Artificial Sequence
  Description of Artificial Sequence: Synthetic oligonucleotide
  Target: SCN9A; (-) strand; PAM type: YTN; PAM sequence: TTG
atagttataaacaagcaata

SEQ ID NO: 57447 - DNA, 20 bp, Artificial Sequence
  Description of Artificial Sequence: Synthetic oligonucleotide
  Target: SCN9A; (-) strand; PAM type: YTN; PAM sequence: TTG
atgcacacaggaaatgaaac

SEQ ID NO: 57448 - DNA, 20 bp, Artificial Sequence
  Description of Artificial Sequence: Synthetic oligonucleotide
  Target: SCN9A; (-) strand; PAM type: YTN; PAM sequence: TTT
gatgcacacaggaaatgaaa

SEQ ID NO: 57449 - DNA, 20 bp, Artificial Sequence
  Description of Artificial Sequence: Synthetic oligonucleotide
  Target: SCN9A; (-) strand; PAM type: YTN; PAM sequence: CTG
caatagtatttgatgcacac

SEQ ID NO: 57450 - DNA, 20 bp, Artificial Sequence
  Description of Artificial Sequence: Synthetic oligonucleotide
  Target: SCN9A; (-) strand; PAM type: YTN; PAM sequence: TTG
ctgcaatagtatttgatgca

SEQ ID NO: 57451 - DNA, 20 bp, Artificial Sequence
  Description of Artificial Sequence: Synthetic oligonucleotide
  Target: SCN9A; (-) strand; PAM type: YTN; PAM sequence: TTT
gctgcaatagtatttgatgc

SEQ ID NO: 57452 - DNA, 20 bp, Artificial Sequence
  Description of Artificial Sequence: Synthetic oligonucleotide
  Target: SCN9A; (-) strand; PAM type: YTN; PAM sequence: TTT
tgctgcaatagtatttgatg

SEQ ID NO: 57453 - DNA, 20 bp, Artificial Sequence
  Description of Artificial Sequence: Synthetic oligonucleotide
  Target: SCN9A; (-) strand; PAM type: YTN; PAM sequence: CTA
gagcagaggggattttgctg

SEQ ID NO: 57454 - DNA, 20 bp, Artificial Sequence
  Description of Artificial Sequence: Synthetic oligonucleotide
  Target: SCN9A; (-) strand; PAM type: YTN; PAM sequence: CTA
gctagagcagaggggatttt

SEQ ID NO: 57455 - DNA, 20 bp, Artificial Sequence
  Description of Artificial Sequence: Synthetic oligonucleotide
  Target: SCN9A; (-) strand; PAM type: YTN; PAM sequence: TTA
catactagctagagcagagg

SEQ ID NO: 57456 - DNA, 20 bp, Artificial Sequence
  Description of Artificial Sequence: Synthetic oligonucleotide
  Target: SCN9A; (-) strand; PAM type: YTN; PAM sequence: CTC
aagggagggagaaattacat

SEQ ID NO: 57457 - DNA, 20 bp, Artificial Sequence
  Description of Artificial Sequence: Synthetic oligonucleotide
  Target: SCN9A; (-) strand; PAM type: YTN; PAM sequence: CTC
tcaagggagggagaaattac

SEQ ID NO: 57458 - DNA, 20 bp, Artificial Sequence
  Description of Artificial Sequence: Synthetic oligonucleotide
  Target: SCN9A; (-) strand; PAM type: YTN; PAM sequence: CTC
tctcaagggagggagaaatt

SEQ ID NO: 57459 - DNA, 20 bp, Artificial Sequence
  Description of Artificial Sequence: Synthetic oligonucleotide
  Target: SCN9A; (-) strand; PAM type: YTN; PAM sequence: CTG
caggatacatggtaatctct

SEQ ID NO: 57460 - DNA, 20 bp, Artificial Sequence
  Description of Artificial Sequence: Synthetic oligonucleotide
  Target: SCN9A; (-) strand; PAM type: YTN; PAM sequence: CTA
tgccataacccaagcaaaat

SEQ ID NO: 57461 - DNA, 20 bp, Artificial Sequence
  Description of Artificial Sequence: Synthetic oligonucleotide
  Target: SCN9A; (-) strand; PAM type: YTN; PAM sequence: TTG
tagataatgctatgccataa

SEQ ID NO: 57462 - DNA, 20 bp, Artificial Sequence
  Description of Artificial Sequence: Synthetic oligonucleotide
  Target: SCN9A; (-) strand; PAM type: YTN; PAM sequence: TTC
acattgtagataatgctatg

SEQ ID NO: 57463 - DNA, 20 bp, Artificial Sequence
  Description of Artificial Sequence: Synthetic oligonucleotide
  Target: SCN9A; (-) strand; PAM type: YTN; PAM sequence: TTT
cacattgtagataatgctat

SEQ ID NO: 57464 - DNA, 20 bp, Artificial Sequence
  Description of Artificial Sequence: Synthetic oligonucleotide
  Target: SCN9A; (-) strand; PAM type: YTN; PAM sequence: CTT
tcacattgtagataatgcta

SEQ ID NO: 57465 - DNA, 20 bp, Artificial Sequence
  Description of Artificial Sequence: Synthetic oligonucleotide
  Target: SCN9A; (-) strand; PAM type: YTN; PAM sequence: TTC
tttcacattgtagataatgc

SEQ ID NO: 57466 - DNA, 20 bp, Artificial Sequence
  Description of Artificial Sequence: Synthetic oligonucleotide
  Target: SCN9A; (-) strand; PAM type: YTN; PAM sequence: CTA
aattctttcacattgtagat

SEQ ID NO: 57467 - DNA, 20 bp, Artificial Sequence
  Description of Artificial Sequence: Synthetic oligonucleotide
  Target: SCN9A; (-) strand; PAM type: YTN; PAM sequence: TTA
caacaacaaagctaaattct

SEQ ID NO: 57468 - DNA, 20 bp, Artificial Sequence
  Description of Artificial Sequence: Synthetic oligonucleotide
  Target: SCN9A; (-) strand; PAM type: YTN; PAM sequence: TTT
acaacaacaaagctaaattc

SEQ ID NO: 57469 - DNA, 20 bp, Artificial Sequence
  Description of Artificial Sequence: Synthetic oligonucleotide
  Target: SCN9A; (-) strand; PAM type: YTN; PAM sequence: TTT
tacaacaacaaagctaaatt

SEQ ID NO: 57470 - DNA, 20 bp, Artificial Sequence
  Description of Artificial Sequence: Synthetic oligonucleotide
  Target: SCN9A; (-) strand; PAM type: YTN; PAM sequence: TTT
ttacaacaacaaagctaaat

SEQ ID NO: 57471 - DNA, 20 bp, Artificial Sequence
  Description of Artificial Sequence: Synthetic oligonucleotide
  Target: SCN9A; (-) strand; PAM type: YTN; PAM sequence: TTT
tttacaacaacaaagctaaa

SEQ ID NO: 57472 - DNA, 20 bp, Artificial Sequence
  Description of Artificial Sequence: Synthetic oligonucleotide
  Target: SCN9A; (-) strand; PAM type: YTN; PAM sequence: TTG
tgatacatgcaaatttttta

SEQ ID NO: 57473 - DNA, 20 bp, Artificial Sequence
  Description of Artificial Sequence: Synthetic oligonucleotide
  Target: SCN9A; (-) strand; PAM type: YTN; PAM sequence: TTC
aacataagtgattgtgatac

SEQ ID NO: 57474 - DNA, 20 bp, Artificial Sequence
  Description of Artificial Sequence: Synthetic oligonucleotide
  Target: SCN9A; (-) strand; PAM type: YTN; PAM sequence: TTT
caacataagtgattgtgata

SEQ ID NO: 57475 - DNA, 20 bp, Artificial Sequence
  Description of Artificial Sequence: Synthetic oligonucleotide
  Target: SCN9A; (-) strand; PAM type: YTN; PAM sequence: CTG
taatccatttcaacataagt

SEQ ID NO: 57476 - DNA, 20 bp, Artificial Sequence
  Description of Artificial Sequence: Synthetic oligonucleotide
  Target: SCN9A; (-) strand; PAM type: YTN; PAM sequence: CTG
aataatactgtaatccattt

SEQ ID NO: 57477 - DNA, 20 bp, Artificial Sequence
  Description of Artificial Sequence: Synthetic oligonucleotide
  Target: SCN9A; (-) strand; PAM type: YTN; PAM sequence: TTA
taatcactgaataatactgt

SEQ ID NO: 57478 - DNA, 20 bp, Artificial Sequence
  Description of Artificial Sequence: Synthetic oligonucleotide
  Target: SCN9A; (-) strand; PAM type: YTN; PAM sequence: CTG
caaaatagaattataatcac

SEQ ID NO: 57479 - DNA, 20 bp, Artificial Sequence
  Description of Artificial Sequence: Synthetic oligonucleotide
  Target: SCN9A; (-) strand; PAM type: YTN; PAM sequence: CTC
tgcaaaatagaattataatc

SEQ ID NO: 57480 - DNA, 20 bp, Artificial Sequence
  Description of Artificial Sequence: Synthetic oligonucleotide
  Target: SCN9A; (-) strand; PAM type: YTN; PAM sequence: TTG
caatagccactctgcaaaat

SEQ ID NO: 57481 - DNA, 20 bp, Artificial Sequence
  Description of Artificial Sequence: Synthetic oligonucleotide
  Target: SCN9A; (-) strand; PAM type: YTN; PAM sequence: CTG
atagttgcaatagccactct

SEQ ID NO: 57482 - DNA, 20 bp, Artificial Sequence
  Description of Artificial Sequence: Synthetic oligonucleotide
  Target: SCN9A; (-) strand; PAM type: YTN; PAM sequence: TTG
tactgatagttgcaatagcc

SEQ ID NO: 57483 - DNA, 20 bp, Artificial Sequence
  Description of Artificial Sequence: Synthetic oligonucleotide
  Target: SCN9A; (-) strand; PAM type: YTN; PAM sequence: TTT
gtactgatagttgcaatagc

SEQ ID NO: 57484 - DNA, 20 bp, Artificial Sequence
  Description of Artificial Sequence: Synthetic oligonucleotide
  Target: SCN9A; (-) strand; PAM type: YTN; PAM sequence: TTT
tgtactgatagttgcaatag

SEQ ID NO: 57485 - DNA, 20 bp, Artificial Sequence
  Description of Artificial Sequence: Synthetic oligonucleotide
  Target: SCN9A; (-) strand; PAM type: YTN; PAM sequence: CTT
ttgtactgatagttgcaata

SEQ ID NO: 57486 - DNA, 20 bp, Artificial Sequence
  Description of Artificial Sequence: Synthetic oligonucleotide
  Target: SCN9A; (-) strand; PAM type: YTN; PAM sequence: TTG
ggacttttgtactgatagtt

SEQ ID NO: 57487 - DNA, 20 bp, Artificial Sequence
  Description of Artificial Sequence: Synthetic oligonucleotide
  Target: SCN9A; (-) strand; PAM type: YTN; PAM sequence: CTT
gggacttttgtactgatagt

SEQ ID NO: 57488 - DNA, 20 bp, Artificial Sequence
  Description of Artificial Sequence: Synthetic oligonucleotide
  Target: SCN9A; (-) strand; PAM type: YTN; PAM sequence: TTA
atagcatgtaaaaggtgtaa

SEQ ID NO: 57489 - DNA, 20 bp, Artificial Sequence
  Description of Artificial Sequence: Synthetic oligonucleotide
  Target: SCN9A; (-) strand; PAM type: YTN; PAM sequence: CTT
aatagcatgtaaaaggtgta

SEQ ID NO: 57490 - DNA, 20 bp, Artificial Sequence
  Description of Artificial Sequence: Synthetic oligonucleotide
  Target: SCN9A; (-) strand; PAM type: YTN; PAM sequence: TTA
tcttaatagcatgtaaaagg

SEQ ID NO: 57491 - DNA, 20 bp, Artificial Sequence
  Description of Artificial Sequence: Synthetic oligonucleotide
  Target: SCN9A; (-) strand; PAM type: YTN; PAM sequence: TTA
tgttatcttaatagcatgta

SEQ ID NO: 57492 - DNA, 20 bp, Artificial Sequence
  Description of Artificial Sequence: Synthetic oligonucleotide
  Target: SCN9A; (-) strand; PAM type: YTN; PAM sequence: TTT
atgttatcttaatagcatgt

SEQ ID NO: 57493 - DNA, 20 bp, Artificial Sequence
  Description of Artificial Sequence: Synthetic oligonucleotide
  Target: SCN9A; (-) strand; PAM type: YTN; PAM sequence: TTT
tatgttatcttaatagcatg

SEQ ID NO: 57494 - DNA, 20 bp, Artificial Sequence
  Description of Artificial Sequence: Synthetic oligonucleotide
  Target: SCN9A; (-) strand; PAM type: YTN; PAM sequence: CTT
ttatgttatcttaatagcat

SEQ ID NO: 57495 - DNA, 20 bp, Artificial Sequence
  Description of Artificial Sequence: Synthetic oligonucleotide
  Target: SCN9A; (-) strand; PAM type: YTN; PAM sequence: TTC
aacttttatgttatcttaat

SEQ ID NO: 57496 - DNA, 20 bp, Artificial Sequence
  Description of Artificial Sequence: Synthetic oligonucleotide
  Target: SCN9A; (-) strand; PAM type: YTN; PAM sequence: TTT
caacttttatgttatcttaa

SEQ ID NO: 57497 - DNA, 20 bp, Artificial Sequence
  Description of Artificial Sequence: Synthetic oligonucleotide
  Target: SCN9A; (-) strand; PAM type: YTN; PAM sequence: TTA
tttcaacttttatgttatct

SEQ ID NO: 57498 - DNA, 20 bp, Artificial Sequence
  Description of Artificial Sequence: Synthetic oligonucleotide
  Target: SCN9A; (-) strand; PAM type: YTN; PAM sequence: CTA
ggccattatttcaactttta

SEQ ID NO: 57499 - DNA, 20 bp, Artificial Sequence
  Description of Artificial Sequence: Synthetic oligonucleotide
  Target: SCN9A; (-) strand; PAM type: YTN; PAM sequence: TTG
ccatactaggccattatttc

SEQ ID NO: 57500 - DNA, 20 bp, Artificial Sequence
  Description of Artificial Sequence: Synthetic oligonucleotide
  Target: SCN9A; (-) strand; PAM type: YTN; PAM sequence: CTA
aaaataattgccatactagg

SEQ ID NO: 57501 - DNA, 20 bp, Artificial Sequence
  Description of Artificial Sequence: Synthetic oligonucleotide
  Target: SCN9A; (-) strand; PAM type: YTN; PAM sequence: TTC
taaaaataattgccatacta

SEQ ID NO: 57502 - DNA, 20 bp, Artificial Sequence
  Description of Artificial Sequence: Synthetic oligonucleotide
  Target: SCN9A; (-) strand; PAM type: YTN; PAM sequence: TTA
ggtaagatattctaaaaata

SEQ ID NO: 57503 - DNA, 20 bp, Artificial Sequence
  Description of Artificial Sequence: Synthetic oligonucleotide
  Target: SCN9A; (-) strand; PAM type: YTN; PAM sequence: TTG
atggtcattaggtaagatat

SEQ ID NO: 57504 - DNA, 20 bp, Artificial Sequence
  Description of Artificial Sequence: Synthetic oligonucleotide
  Target: SCN9A; (-) strand; PAM type: YTN; PAM sequence: CTG
ttgatggtcattaggtaaga

SEQ ID NO: 57505 - DNA, 20 bp, Artificial Sequence
  Description of Artificial Sequence: Synthetic oligonucleotide
  Target: SCN9A; (-) strand; PAM type: YTN; PAM sequence: CTA
taagcatcaagtcctgttga

SEQ ID NO: 57506 - DNA, 20 bp, Artificial Sequence
  Description of Artificial Sequence: Synthetic oligonucleotide
  Target: SCN9A; (-) strand; PAM type: YTN; PAM sequence: TTA
gctataagcatcaagtcctg

SEQ ID NO: 57507 - DNA, 20 bp, Artificial Sequence
  Description of Artificial Sequence: Synthetic oligonucleotide
  Target: SCN9A; (-) strand; PAM type: YTN; PAM sequence: TTT
agctataagcatcaagtcct

SEQ ID NO: 57508 - DNA, 20 bp, Artificial Sequence
  Description of Artificial Sequence: Synthetic oligonucleotide
  Target: SCN9A; (-) strand; PAM type: YTN; PAM sequence: CTT
tagctataagcatcaagtcc

SEQ ID NO: 57509 - DNA, 20 bp, Artificial Sequence
  Description of Artificial Sequence: Synthetic oligonucleotide
  Target: SCN9A; (-) strand; PAM type: YTN; PAM sequence: CTA
ctttagctataagcatcaag

SEQ ID NO: 57510 - DNA, 20 bp, Artificial Sequence
  Description of Artificial Sequence: Synthetic oligonucleotide
  Target: SCN9A; (-) strand; PAM type: YTN; PAM sequence: CTC
tactttagctataagcatca

SEQ ID NO: 57511 - DNA, 20 bp, Artificial Sequence
  Description of Artificial Sequence: Synthetic oligonucleotide
  Target: SCN9A; (-) strand; PAM type: YTN; PAM sequence: TTA
atacaaccctctactttagc

SEQ ID NO: 57512 - DNA, 20 bp, Artificial Sequence
  Description of Artificial Sequence: Synthetic oligonucleotide
  Target: SCN9A; (-) strand; PAM type: YTN; PAM sequence: CTG
agtaattaatacaaccctct

SEQ ID NO: 57513 - DNA, 20 bp, Artificial Sequence
  Description of Artificial Sequence: Synthetic oligonucleotide
  Target: SCN9A; (-) strand; PAM type: YTN; PAM sequence: TTA
gctgagtaattaatacaacc

SEQ ID NO: 57514 - DNA, 20 bp, Artificial Sequence
  Description of Artificial Sequence: Synthetic oligonucleotide
  Target: SCN9A; (-) strand; PAM type: YTN; PAM sequence: TTT
agctgagtaattaatacaac

SEQ ID NO: 57515 - DNA, 20 bp, Artificial Sequence
  Description of Artificial Sequence: Synthetic oligonucleotide
  Target: SCN9A; (-) strand; PAM type: YTN; PAM sequence: TTT
tagctgagtaattaatacaa

SEQ ID NO: 57516 - DNA, 20 bp, Artificial Sequence
  Description of Artificial Sequence: Synthetic oligonucleotide
  Target: SCN9A; (-) strand; PAM type: YTN; PAM sequence: TTT
ttagctgagtaattaataca

SEQ ID NO: 57517 - DNA, 20 bp, Artificial Sequence
  Description of Artificial Sequence: Synthetic oligonucleotide
  Target: SCN9A; (-) strand; PAM type: YTN; PAM sequence: TTA
ccatttttagctgagtaatt

SEQ ID NO: 57518 - DNA, 20 bp, Artificial Sequence
  Description of Artificial Sequence: Synthetic oligonucleotide
  Target: SCN9A; (-) strand; PAM type: YTN; PAM sequence: CTT
accatttttagctgagtaat

SEQ ID NO: 57519 - DNA, 20 bp, Artificial Sequence
  Description of Artificial Sequence: Synthetic oligonucleotide
  Target: SCN9A; (-) strand; PAM type: YTN; PAM sequence: TTC
ttaccatttttagctgagta

SEQ ID NO: 57520 - DNA, 20 bp, Artificial Sequence
  Description of Artificial Sequence: Synthetic oligonucleotide
  Target: SCN9A; (-) strand; PAM type: YTN; PAM sequence: TTC
caaaaagtggaggtggttct

SEQ ID NO: 57521 - DNA, 20 bp, Artificial Sequence
  Description of Artificial Sequence: Synthetic oligonucleotide
  Target: SCN9A; (-) strand; PAM type: YTN; PAM sequence: TTT
ccaaaaagtggaggtggttc

SEQ ID NO: 57522 - DNA, 20 bp, Artificial Sequence
  Description of Artificial Sequence: Synthetic oligonucleotide
  Target: SCN9A; (-) strand; PAM type: YTN; PAM sequence: TTA
tttccaaaaagtggaggtgg

SEQ ID NO: 57523 - DNA, 20 bp, Artificial Sequence
  Description of Artificial Sequence: Synthetic oligonucleotide
  Target: SCN9A; (-) strand; PAM type: YTN; PAM sequence: CTT
atttccaaaaagtggaggtg

SEQ ID NO: 57524 - DNA, 20 bp, Artificial Sequence
  Description of Artificial Sequence: Synthetic oligonucleotide
  Target: SCN9A; (-) strand; PAM type: YTN; PAM sequence: CTA
gcttatttccaaaaagtgga

SEQ ID NO: 57525 - DNA, 20 bp, Artificial Sequence
  Description of Artificial Sequence: Synthetic oligonucleotide
  Target: SCN9A; (-) strand; PAM type: YTN; PAM sequence: TTA
taaaggtctagcttatttcc

SEQ ID NO: 57526 - DNA, 20 bp, Artificial Sequence
  Description of Artificial Sequence: Synthetic oligonucleotide
  Target: SCN9A; (-) strand; PAM type: YTN; PAM sequence: TTT
ataaaggtctagcttatttc

SEQ ID NO: 57527 - DNA, 20 bp, Artificial Sequence
  Description of Artificial Sequence: Synthetic oligonucleotide
  Target: SCN9A; (-) strand; PAM type: YTN; PAM sequence: TTA
aaatcaggaaatatgcacat

SEQ ID NO: 57528 - DNA, 20 bp, Artificial Sequence
  Description of Artificial Sequence: Synthetic oligonucleotide
  Target: SCN9A; (-) strand; PAM type: YTN; PAM sequence: TTC
aaacaacatattaaaatcag

SEQ ID NO: 57529 - DNA, 20 bp, Artificial Sequence
  Description of Artificial Sequence: Synthetic oligonucleotide
  Target: SCN9A; (-) strand; PAM type: YTN; PAM sequence: TTA
tgaattcaaacaacatatta

SEQ ID NO: 57530 - DNA, 20 bp, Artificial Sequence
  Description of Artificial Sequence: Synthetic oligonucleotide
  Target: SCN9A; (-) strand; PAM type: YTN; PAM sequence: TTT
atgaattcaaacaacatatt

SEQ ID NO: 57531 - DNA, 20 bp, Artificial Sequence
  Description of Artificial Sequence: Synthetic oligonucleotide
  Target: SCN9A; (-) strand; PAM type: YTN; PAM sequence: TTG
agatttatgaattcaaacaa

SEQ ID NO: 57532 - DNA, 20 bp, Artificial Sequence
  Description of Artificial Sequence: Synthetic oligonucleotide
  Target: SCN9A; (-) strand; PAM type: YTN; PAM sequence: TTT
gagatttatgaattcaaaca

SEQ ID NO: 57533 - DNA, 20 bp, Artificial Sequence
  Description of Artificial Sequence: Synthetic oligonucleotide
  Target: SCN9A; (-) strand; PAM type: YTN; PAM sequence: TTT
tgagatttatgaattcaaac

SEQ ID NO: 57534 - DNA, 20 bp, Artificial Sequence
  Description of Artificial Sequence: Synthetic oligonucleotide
  Target: SCN9A; (-) strand; PAM type: YTN; PAM sequence: CTT
ttgagatttatgaattcaaa

SEQ ID NO: 57535 - DNA, 20 bp, Artificial Sequence
  Description of Artificial Sequence: Synthetic oligonucleotide
  Target: SCN9A; (-) strand; PAM type: YTN; PAM sequence: CTA
cttttgagatttatgaattc

SEQ ID NO: 57536 - DNA, 20 bp, Artificial Sequence
  Description of Artificial Sequence: Synthetic oligonucleotide
  Target: SCN9A; (-) strand; PAM type: YTN; PAM sequence: TTA
gctacttttgagatttatga

SEQ ID NO: 57537 - DNA, 20 bp, Artificial Sequence
  Description of Artificial Sequence: Synthetic oligonucleotide
  Target: SCN9A; (-) strand; PAM type: YTN; PAM sequence: TTT
agctacttttgagatttatg

SEQ ID NO: 57538 - DNA, 20 bp, Artificial Sequence
  Description of Artificial Sequence: Synthetic oligonucleotide
  Target: SCN9A; (-) strand; PAM type: YTN; PAM sequence: TTC
aaaatttagctacttttgag

SEQ ID NO: 57539 - DNA, 20 bp, Artificial Sequence
  Description of Artificial Sequence: Synthetic oligonucleotide
  Target: SCN9A; (-) strand; PAM type: YTN; PAM sequence: TTT
caaaatttagctacttttga

SEQ ID NO: 57540 - DNA, 20 bp, Artificial Sequence
  Description of Artificial Sequence: Synthetic oligonucleotide
  Target: SCN9A; (-) strand; PAM type: YTN; PAM sequence: TTA
gtgatgtggcatatacacca

SEQ ID NO: 57541 - DNA, 20 bp, Artificial Sequence
  Description of Artificial Sequence: Synthetic oligonucleotide
  Target: SCN9A; (-) strand; PAM type: YTN; PAM sequence: TTT
agtgatgtggcatatacacc

SEQ ID NO: 57542 - DNA, 20 bp, Artificial Sequence
  Description of Artificial Sequence: Synthetic oligonucleotide
  Target: SCN9A; (-) strand; PAM type: YTN; PAM sequence: TTG
gtaggtagtaaatatttagt

SEQ ID NO: 57543 - DNA, 20 bp, Artificial Sequence
  Description of Artificial Sequence: Synthetic oligonucleotide
  Target: SCN9A; (-) strand; PAM type: YTN; PAM sequence: TTA
tgcacccattggtaggtagt

SEQ ID NO: 57544 - DNA, 20 bp, Artificial Sequence
  Description of Artificial Sequence: Synthetic oligonucleotide
  Target: SCN9A; (-) strand; PAM type: YTN; PAM sequence: TTT
atgcacccattggtaggtag

SEQ ID NO: 57545 - DNA, 20 bp, Artificial Sequence
  Description of Artificial Sequence: Synthetic oligonucleotide
  Target: SCN9A; (-) strand; PAM type: YTN; PAM sequence: TTT
tatgcacccattggtaggta

SEQ ID NO: 57546 - DNA, 20 bp, Artificial Sequence
  Description of Artificial Sequence: Synthetic oligonucleotide
  Target: SCN9A; (-) strand; PAM type: YTN; PAM sequence: CTA
tagtgcccaaaagagtttta

SEQ ID NO: 57547 - DNA, 20 bp, Artificial Sequence
  Description of Artificial Sequence: Synthetic oligonucleotide
  Target: SCN9A; (-) strand; PAM type: YTN; PAM sequence: TTA
tatgggtaagtataactata

SEQ ID NO: 57548 - DNA, 20 bp, Artificial Sequence
  Description of Artificial Sequence: Synthetic oligonucleotide
  Target: SCN9A; (-) strand; PAM type: YTN; PAM sequence: TTT
atatgggtaagtataactat

SEQ ID NO: 57549 - DNA, 20 bp, Artificial Sequence
  Description of Artificial Sequence: Synthetic oligonucleotide
  Target: SCN9A; (-) strand; PAM type: YTN; PAM sequence: TTT
tatatgggtaagtataacta

SEQ ID NO: 57550 - DNA, 20 bp, Artificial Sequence
  Description of Artificial Sequence: Synthetic oligonucleotide
  Target: SCN9A; (-) strand; PAM type: YTN; PAM sequence: CTA
ttttatatgggtaagtataa

SEQ ID NO: 57551 - DNA, 20 bp, Artificial Sequence
  Description of Artificial Sequence: Synthetic oligonucleotide
  Target: SCN9A; (-) strand; PAM type: YTN; PAM sequence: CTC
tattttatatgggtaagtat

SEQ ID NO: 57552 - DNA, 20 bp, Artificial Sequence
  Description of Artificial Sequence: Synthetic oligonucleotide
  Target: SCN9A; (-) strand; PAM type: YTN; PAM sequence: TTC
tctattttatatgggtaagt

SEQ ID NO: 57553 - DNA, 20 bp, Artificial Sequence
  Description of Artificial Sequence: Synthetic oligonucleotide
  Target: SCN9A; (-) strand; PAM type: YTN; PAM sequence: TTT
ctctattttatatgggtaag

SEQ ID NO: 57554 - DNA, 20 bp, Artificial Sequence
  Description of Artificial Sequence: Synthetic oligonucleotide
  Target: SCN9A; (-) strand; PAM type: YTN; PAM sequence: TTT
tctctattttatatgggtaa

SEQ ID NO: 57555 - DNA, 20 bp, Artificial Sequence
  Description of Artificial Sequence: Synthetic oligonucleotide
  Target: SCN9A; (-) strand; PAM type: YTN; PAM sequence: TTA
aataatgacaatattttctc

SEQ ID NO: 57556 - DNA, 20 bp, Artificial Sequence
  Description of Artificial Sequence: Synthetic oligonucleotide
  Target: SCN9A; (-) strand; PAM type: YTN; PAM sequence: TTC
atgaatgttaaataatgaca

SEQ ID NO: 57557 - DNA, 20 bp, Artificial Sequence
  Description of Artificial Sequence: Synthetic oligonucleotide
  Target: SCN9A; (-) strand; PAM type: YTN; PAM sequence: CTT
catgaatgttaaataatgac

SEQ ID NO: 57558 - DNA, 20 bp, Artificial Sequence
  Description of Artificial Sequence: Synthetic oligonucleotide
  Target: SCN9A; (-) strand; PAM type: YTN; PAM sequence: CTC
ttcatgaatgttaaataatg

SEQ ID NO: 57559 - DNA, 20 bp, Artificial Sequence
  Description of Artificial Sequence: Synthetic oligonucleotide
  Target: SCN9A; (-) strand; PAM type: YTN; PAM sequence: CTG
tatcatacaggaacaatgca

SEQ ID NO: 57560 - DNA, 20 bp, Artificial Sequence
  Description of Artificial Sequence: Synthetic oligonucleotide
  Target: SCN9A; (-) strand; PAM type: YTN; PAM sequence: CTC
tgtatcatacaggaacaatg

SEQ ID NO: 57561 - DNA, 20 bp, Artificial Sequence
  Description of Artificial Sequence: Synthetic oligonucleotide
  Target: SCN9A; (-) strand; PAM type: YTN; PAM sequence: CTA
cctctgtatcatacaggaac

SEQ ID NO: 57562 - DNA, 20 bp, Artificial Sequence
  Description of Artificial Sequence: Synthetic oligonucleotide
  Target: SCN9A; (-) strand; PAM type: YTN; PAM sequence: CTA
aaaatgtaagaacccaggct

SEQ ID NO: 57563 - DNA, 20 bp, Artificial Sequence
  Description of Artificial Sequence: Synthetic oligonucleotide
  Target: SCN9A; (-) strand; PAM type: YTN; PAM sequence: CTA
ctaaaaatgtaagaacccag

SEQ ID NO: 57564 - DNA, 20 bp, Artificial Sequence
  Description of Artificial Sequence: Synthetic oligonucleotide
  Target: SCN9A; (-) strand; PAM type: YTN; PAM sequence: TTG
ctactaaaaatgtaagaacc

SEQ ID NO: 57565 - DNA, 20 bp, Artificial Sequence
  Description of Artificial Sequence: Synthetic oligonucleotide
  Target: SCN9A; (-) strand; PAM type: YTN; PAM sequence: TTT
gctactaaaaatgtaagaac

SEQ ID NO: 57566 - DNA, 20 bp, Artificial Sequence
  Description of Artificial Sequence: Synthetic oligonucleotide
  Target: SCN9A; (-) strand; PAM type: YTN; PAM sequence: TTA
atttgctactaaaaatgtaa

SEQ ID NO: 57567 - DNA, 20 bp, Artificial Sequence
  Description of Artificial Sequence: Synthetic oligonucleotide
  Target: SCN9A; (-) strand; PAM type: YTN; PAM sequence: TTA
gtatggcaattaatttgcta

SEQ ID NO: 57568 - DNA, 20 bp, Artificial Sequence
  Description of Artificial Sequence: Synthetic oligonucleotide
  Target: SCN9A; (-) strand; PAM type: YTN; PAM sequence: TTA
gtagtaagagtagttagtat

SEQ ID NO: 57569 - DNA, 20 bp, Artificial Sequence
  Description of Artificial Sequence: Synthetic oligonucleotide
  Target: SCN9A; (-) strand; PAM type: YTN; PAM sequence: TTA
tattagtagtaagagtagtt

SEQ ID NO: 57570 - DNA, 20 bp, Artificial Sequence
  Description of Artificial Sequence: Synthetic oligonucleotide
  Target: SCN9A; (-) strand; PAM type: YTN; PAM sequence: TTT
atattagtagtaagagtagt

SEQ ID NO: 57571 - DNA, 20 bp, Artificial Sequence
  Description of Artificial Sequence: Synthetic oligonucleotide
  Target: SCN9A; (-) strand; PAM type: YTN; PAM sequence: TTG
aaaatttatattagtagtaa

SEQ ID NO: 57572 - DNA, 20 bp, Artificial Sequence
  Description of Artificial Sequence: Synthetic oligonucleotide
  Target: SCN9A; (-) strand; PAM type: YTN; PAM sequence: CTG
aaaacacattgaaaatttat

SEQ ID NO: 57573 - DNA, 20 bp, Artificial Sequence
  Description of Artificial Sequence: Synthetic oligonucleotide
  Target: SCN9A; (-) strand; PAM type: YTN; PAM sequence: TTA
aaacaatgactgaaaacaca

SEQ ID NO: 57574 - DNA, 20 bp, Artificial Sequence
  Description of Artificial Sequence: Synthetic oligonucleotide
  Target: SCN9A; (-) strand; PAM type: YTN; PAM sequence: TTC
atgaagaaattaaaacaatg

SEQ ID NO: 57575 - DNA, 20 bp, Artificial Sequence
  Description of Artificial Sequence: Synthetic oligonucleotide
  Target: SCN9A; (-) strand; PAM type: YTN; PAM sequence: CTT
catgaagaaattaaaacaat

SEQ ID NO: 57576 - DNA, 20 bp, Artificial Sequence
  Description of Artificial Sequence: Synthetic oligonucleotide
  Target: SCN9A; (-) strand; PAM type: YTN; PAM sequence: TTG
taatgatagaatgagacaag

SEQ ID NO: 57577 - DNA, 20 bp, Artificial Sequence
  Description of Artificial Sequence: Synthetic oligonucleotide
  Target: SCN9A; (-) strand; PAM type: YTN; PAM sequence: TTA
tgtggttgtaatgatagaat

SEQ ID NO: 57578 - DNA, 20 bp, Artificial Sequence
  Description of Artificial Sequence: Synthetic oligonucleotide
  Target: SCN9A; (-) strand; PAM type: YTN; PAM sequence: TTC
attatgtggttgtaatgata

SEQ ID NO: 57579 - DNA, 20 bp, Artificial Sequence
  Description of Artificial Sequence: Synthetic oligonucleotide
  Target: SCN9A; (-) strand; PAM type: YTN; PAM sequence: CTT
cattatgtggttgtaatgat

SEQ ID NO: 57580 - DNA, 20 bp, Artificial Sequence
  Description of Artificial Sequence: Synthetic oligonucleotide
  Target: SCN9A; (-) strand; PAM type: YTN; PAM sequence: CTA
cttcattatgtggttgtaat

SEQ ID NO: 57581 - DNA, 20 bp, Artificial Sequence
  Description of Artificial Sequence: Synthetic oligonucleotide
  Target: SCN9A; (-) strand; PAM type: YTN; PAM sequence: CTA
taaaatgaggagaagagtac

SEQ ID NO: 57582 - DNA, 20 bp, Artificial Sequence
  Description of Artificial Sequence: Synthetic oligonucleotide
  Target: SCN9A; (-) strand; PAM type: YTN; PAM sequence: TTA
tctataaaatgaggagaaga

SEQ ID NO: 57583 - DNA, 20 bp, Artificial Sequence
  Description of Artificial Sequence: Synthetic oligonucleotide
  Target: SCN9A; (-) strand; PAM type: YTN; PAM sequence: CTT
atctataaaatgaggagaag

SEQ ID NO: 57584 - DNA, 20 bp, Artificial Sequence
  Description of Artificial Sequence: Synthetic oligonucleotide
  Target: SCN9A; (-) strand; PAM type: YTN; PAM sequence: TTC
ttatctataaaatgaggaga

SEQ ID NO: 57585 - DNA, 20 bp, Artificial Sequence
  Description of Artificial Sequence: Synthetic oligonucleotide
  Target: SCN9A; (-) strand; PAM type: YTN; PAM sequence: TTT
cttatctataaaatgaggag

SEQ ID NO: 57586 - DNA, 20 bp, Artificial Sequence
  Description of Artificial Sequence: Synthetic oligonucleotide
  Target: SCN9A; (-) strand; PAM type: YTN; PAM sequence: CTT
tcttatctataaaatgagga

SEQ ID NO: 57587 - DNA, 20 bp, Artificial Sequence
  Description of Artificial Sequence: Synthetic oligonucleotide
  Target: SCN9A; (-) strand; PAM type: YTN; PAM sequence: CTC
aactttcttatctataaaat

SEQ ID NO: 57588 - DNA, 20 bp, Artificial Sequence
  Description of Artificial Sequence: Synthetic oligonucleotide
  Target: SCN9A; (-) strand; PAM type: YTN; PAM sequence: CTA
tatgggcctcaactttctta

SEQ ID NO: 57589 - DNA, 20 bp, Artificial Sequence
  Description of Artificial Sequence: Synthetic oligonucleotide
  Target: SCN9A; (-) strand; PAM type: YTN; PAM sequence: TTA
acctatatgggcctcaactt

SEQ ID NO: 57590 - DNA, 20 bp, Artificial Sequence
  Description of Artificial Sequence: Synthetic oligonucleotide
  Target: SCN9A; (-) strand; PAM type: YTN; PAM sequence: TTT
aacctatatgggcctcaact

SEQ ID NO: 57591 - DNA, 20 bp, Artificial Sequence
  Description of Artificial Sequence: Synthetic oligonucleotide
  Target: SCN9A; (-) strand; PAM type: YTN; PAM sequence: CTT
taacctatatgggcctcaac

SEQ ID NO: 57592 - DNA, 20 bp, Artificial Sequence
  Description of Artificial Sequence: Synthetic oligonucleotide
  Target: SCN9A; (-) strand; PAM type: YTN; PAM sequence: TTC
tttaacctatatgggcctca

SEQ ID NO: 57593 - DNA, 20 bp, Artificial Sequence
  Description of Artificial Sequence: Synthetic oligonucleotide
  Target: SCN9A; (-) strand; PAM type: YTN; PAM sequence: CTG
aatacattctttaacctata

SEQ ID NO: 57594 - DNA, 20 bp, Artificial Sequence
  Description of Artificial Sequence: Synthetic oligonucleotide
  Target: SCN9A; (-) strand; PAM type: YTN; PAM sequence: TTG
ctgaatacattctttaacct

SEQ ID NO: 57595 - DNA, 20 bp, Artificial Sequence
  Description of Artificial Sequence: Synthetic oligonucleotide
  Target: SCN9A; (-) strand; PAM type: YTN; PAM sequence: TTT
gctgaatacattctttaacc

SEQ ID NO: 57596 - DNA, 20 bp, Artificial Sequence
  Description of Artificial Sequence: Synthetic oligonucleotide
  Target: SCN9A; (-) strand; PAM type: YTN; PAM sequence: CTA
tgagtttgctgaatacattc

SEQ ID NO: 57597 - DNA, 20 bp, Artificial Sequence
  Description of Artificial Sequence: Synthetic oligonucleotide
  Target: SCN9A; (-) strand; PAM type: YTN; PAM sequence: TTA
agccatgaccctatgagttt

SEQ ID NO: 57598 - DNA, 20 bp, Artificial Sequence
  Description of Artificial Sequence: Synthetic oligonucleotide
  Target: SCN9A; (-) strand; PAM type: YTN; PAM sequence: TTG
tatcccagttaagccatgac

SEQ ID NO: 57599 - DNA, 20 bp, Artificial Sequence
  Description of Artificial Sequence: Synthetic oligonucleotide
  Target: SCN9A; (-) strand; PAM type: YTN; PAM sequence: TTT
gtatcccagttaagccatga

SEQ ID NO: 57600 - DNA, 20 bp, Artificial Sequence
  Description of Artificial Sequence: Synthetic oligonucleotide
  Target: SCN9A; (-) strand; PAM type: YTN; PAM sequence: CTA
tatttgtatcccagttaagc

SEQ ID NO: 57601 - DNA, 20 bp, Artificial Sequence
  Description of Artificial Sequence: Synthetic oligonucleotide
  Target: SCN9A; (-) strand; PAM type: YTN; PAM sequence: CTA
gaactatatttgtatcccag

SEQ ID NO: 57602 - DNA, 20 bp, Artificial Sequence
  Description of Artificial Sequence: Synthetic oligonucleotide
  Target: SCN9A; (-) strand; PAM type: YTN; PAM sequence: CTA
agactagaactatatttgta

SEQ ID NO: 57603 - DNA, 20 bp, Artificial Sequence
  Description of Artificial Sequence: Synthetic oligonucleotide
  Target: SCN9A; (-) strand; PAM type: YTN; PAM sequence: TTC
taagactagaactatatttg

SEQ ID NO: 57604 - DNA, 20 bp, Artificial Sequence
  Description of Artificial Sequence: Synthetic oligonucleotide
  Target: SCN9A; (-) strand; PAM type: YTN; PAM sequence: CTA
agagcatgggttctaagact

SEQ ID NO: 57605 - DNA, 20 bp, Artificial Sequence
  Description of Artificial Sequence: Synthetic oligonucleotide
  Target: SCN9A; (-) strand; PAM type: YTN; PAM sequence: TTA
agaggtgatatagcatacat

SEQ ID NO: 57606 - DNA, 20 bp, Artificial Sequence
  Description of Artificial Sequence: Synthetic oligonucleotide
  Target: SCN9A; (-) strand; PAM type: YTN; PAM sequence: CTT
aagaggtgatatagcataca

SEQ ID NO: 57607 - DNA, 20 bp, Artificial Sequence
  Description of Artificial Sequence: Synthetic oligonucleotide
  Target: SCN9A; (-) strand; PAM type: YTN; PAM sequence: CTC
ttaagaggtgatatagcata

SEQ ID NO: 57608 - DNA, 20 bp, Artificial Sequence
  Description of Artificial Sequence: Synthetic oligonucleotide
  Target: SCN9A; (-) strand; PAM type: YTN; PAM sequence: CTG
taccagctcttaagaggtga

SEQ ID NO: 57609 - DNA, 20 bp, Artificial Sequence
  Description of Artificial Sequence: Synthetic oligonucleotide
  Target: SCN9A; (-) strand; PAM type: YTN; PAM sequence: TTA
cagatgggaaagctgtacca

SEQ ID NO: 57610 - DNA, 20 bp, Artificial Sequence
  Description of Artificial Sequence: Synthetic oligonucleotide
  Target: SCN9A; (-) strand; PAM type: YTN; PAM sequence: TTT
acagatgggaaagctgtacc

SEQ ID NO: 57611 - DNA, 20 bp, Artificial Sequence
  Description of Artificial Sequence: Synthetic oligonucleotide
  Target: SCN9A; (-) strand; PAM type: YTN; PAM sequence: TTT
tacagatgggaaagctgtac

SEQ ID NO: 57612 - DNA, 20 bp, Artificial Sequence
  Description of Artificial Sequence: Synthetic oligonucleotide
  Target: SCN9A; (-) strand; PAM type: YTN; PAM sequence: CTC
attttacagatgggaaagct

SEQ ID NO: 57613 - DNA, 20 bp, Artificial Sequence
  Description of Artificial Sequence: Synthetic oligonucleotide
  Target: SCN9A; (-) strand; PAM type: YTN; PAM sequence: TTC
tcattttacagatgggaaag

SEQ ID NO: 57614 - DNA, 20 bp, Artificial Sequence
  Description of Artificial Sequence: Synthetic oligonucleotide
  Target: SCN9A; (-) strand; PAM type: YTN; PAM sequence: TTT
ctcattttacagatgggaaa

SEQ ID NO: 57615 - DNA, 20 bp, Artificial Sequence
  Description of Artificial Sequence: Synthetic oligonucleotide
  Target: SCN9A; (-) strand; PAM type: YTN; PAM sequence: TTT
tctcattttacagatgggaa

SEQ ID NO: 57616 - DNA, 20 bp, Artificial Sequence
  Description of Artificial Sequence: Synthetic oligonucleotide
  Target: SCN9A; (-) strand; PAM type: YTN; PAM sequence: TTT
ttctcattttacagatggga

SEQ ID NO: 57617 - DNA, 20 bp, Artificial Sequence
  Description of Artificial Sequence: Synthetic oligonucleotide
  Target: SCN9A; (-) strand; PAM type: YTN; PAM sequence: CTT
tttctcattttacagatggg

SEQ ID NO: 57618 - DNA, 20 bp, Artificial Sequence
  Description of Artificial Sequence: Synthetic oligonucleotide
  Target: SCN9A; (-) strand; PAM type: YTN; PAM sequence: CTC
tttttctcattttacagatg

SEQ ID NO: 57619 - DNA, 20 bp, Artificial Sequence
  Description of Artificial Sequence: Synthetic oligonucleotide
  Target: SCN9A; (-) strand; PAM type: YTN; PAM sequence: TTA
ctctttttctcattttacag

SEQ ID NO: 57620 - DNA, 20 bp, Artificial Sequence
  Description of Artificial Sequence: Synthetic oligonucleotide
  Target: SCN9A; (-) strand; PAM type: YTN; PAM sequence: TTA
caaccacatggagtattact

SEQ ID NO: 57621 - DNA, 20 bp, Artificial Sequence
  Description of Artificial Sequence: Synthetic oligonucleotide
  Target: SCN9A; (-) strand; PAM type: YTN; PAM sequence: CTT
acaaccacatggagtattac

SEQ ID NO: 57622 - DNA, 20 bp, Artificial Sequence
  Description of Artificial Sequence: Synthetic oligonucleotide
  Target: SCN9A; (-) strand; PAM type: YTN; PAM sequence: CTA
cccttacaaccacatggagt

SEQ ID NO: 57623 - DNA, 20 bp, Artificial Sequence
  Description of Artificial Sequence: Synthetic oligonucleotide
  Target: SCN9A; (-) strand; PAM type: YTN; PAM sequence: TTC
tacccttacaaccacatgga

SEQ ID NO: 57624 - DNA, 20 bp, Artificial Sequence
  Description of Artificial Sequence: Synthetic oligonucleotide
  Target: SCN9A; (-) strand; PAM type: YTN; PAM sequence: CTC
attctacccttacaaccaca

SEQ ID NO: 57625 - DNA, 20 bp, Artificial Sequence
  Description of Artificial Sequence: Synthetic oligonucleotide
  Target: SCN9A; (-) strand; PAM type: YTN; PAM sequence: TTG
tctcattctacccttacaac

SEQ ID NO: 57626 - DNA, 20 bp, Artificial Sequence
  Description of Artificial Sequence: Synthetic oligonucleotide
  Target: SCN9A; (-) strand; PAM type: YTN; PAM sequence: CTT
gtctcattctacccttacaa

SEQ ID NO: 57627 - DNA, 20 bp, Artificial Sequence
  Description of Artificial Sequence: Synthetic oligonucleotide
  Target: SCN9A; (-) strand; PAM type: YTN; PAM sequence: TTG
tgtagcttgtctcattctac

SEQ ID NO: 57628 - DNA, 20 bp, Artificial Sequence
  Description of Artificial Sequence: Synthetic oligonucleotide
  Target: SCN9A; (-) strand; PAM type: YTN; PAM sequence: TTT
gtgtagcttgtctcattcta

SEQ ID NO: 57629 - DNA, 20 bp, Artificial Sequence
  Description of Artificial Sequence: Synthetic oligonucleotide
  Target: SCN9A; (-) strand; PAM type: YTN; PAM sequence: CTT
tgtgtagcttgtctcattct

SEQ ID NO: 57630 - DNA, 20 bp, Artificial Sequence
  Description of Artificial Sequence: Synthetic oligonucleotide
  Target: SCN9A; (-) strand; PAM type: YTN; PAM sequence: TTC
tttgtgtagcttgtctcatt

SEQ ID NO: 57631 - DNA, 20 bp, Artificial Sequence
  Description of Artificial Sequence: Synthetic oligonucleotide
  Target: SCN9A; (-) strand; PAM type: YTN; PAM sequence: TTT
ctttgtgtagcttgtctcat

SEQ ID NO: 57632 - DNA, 20 bp, Artificial Sequence
  Description of Artificial Sequence: Synthetic oligonucleotide
  Target: SCN9A; (-) strand; PAM type: YTN; PAM sequence: CTA
atttctttgtgtagcttgtc

SEQ ID NO: 57633 - DNA, 20 bp, Artificial Sequence
  Description of Artificial Sequence: Synthetic oligonucleotide
  Target: SCN9A; (-) strand; PAM type: YTN; PAM sequence: TTC
taatttctttgtgtagcttg

SEQ ID NO: 57634 - DNA, 20 bp, Artificial Sequence
  Description of Artificial Sequence: Synthetic oligonucleotide
  Target: SCN9A; (-) strand; PAM type: YTN; PAM sequence: TTG
ttctaatttctttgtgtagc

SEQ ID NO: 57635 - DNA, 20 bp, Artificial Sequence
  Description of Artificial Sequence: Synthetic oligonucleotide
  Target: SCN9A; (-) strand; PAM type: YTN; PAM sequence: TTG
tcattgttctaatttctttg

SEQ ID NO: 57636 - DNA, 20 bp, Artificial Sequence
  Description of Artificial Sequence: Synthetic oligonucleotide
  Target: SCN9A; (-) strand; PAM type: YTN; PAM sequence: CTG
tattgtcattgttctaattt

SEQ ID NO: 57637 - DNA, 20 bp, Artificial Sequence
  Description of Artificial Sequence: Synthetic oligonucleotide
  Target: SCN9A; (-) strand; PAM type: YTN; PAM sequence: TTC
tgtattgtcattgttctaat

SEQ ID NO: 57638 - DNA, 20 bp, Artificial Sequence
  Description of Artificial Sequence: Synthetic oligonucleotide
  Target: SCN9A; (-) strand; PAM type: YTN; PAM sequence: TTG
attctgtattgtcattgttc

SEQ ID NO: 57639 - DNA, 20 bp, Artificial Sequence
  Description of Artificial Sequence: Synthetic oligonucleotide
  Target: SCN9A; (-) strand; PAM type: YTN; PAM sequence: CTT
gattctgtattgtcattgtt

SEQ ID NO: 57640 - DNA, 20 bp, Artificial Sequence
  Description of Artificial Sequence: Synthetic oligonucleotide
  Target: SCN9A; (-) strand; PAM type: YTN; PAM sequence: TTC
ttgattctgtattgtcattg

SEQ ID NO: 57641 - DNA, 20 bp, Artificial Sequence
  Description of Artificial Sequence: Synthetic oligonucleotide
  Target: SCN9A; (-) strand; PAM type: YTN; PAM sequence: CTA
atataaattcttgattctgt

SEQ ID NO: 57642 - DNA, 20 bp, Artificial Sequence
  Description of Artificial Sequence: Synthetic oligonucleotide
  Target: SCN9A; (-) strand; PAM type: YTN; PAM sequence: CTA
ctaatataaattcttgattc

SEQ ID NO: 57643 - DNA, 20 bp, Artificial Sequence
  Description of Artificial Sequence: Synthetic oligonucleotide
  Target: SCN9A; (-) strand; PAM type: YTN; PAM sequence: TTA
ctactaatataaattcttga

SEQ ID NO: 57644 - DNA, 20 bp, Artificial Sequence
  Description of Artificial Sequence: Synthetic oligonucleotide
  Target: SCN9A; (-) strand; PAM type: YTN; PAM sequence: CTA
ttactactaatataaattct

SEQ ID NO: 57645 - DNA, 20 bp, Artificial Sequence
  Description of Artificial Sequence: Synthetic oligonucleotide
  Target: SCN9A; (-) strand; PAM type: YTN; PAM sequence: CTA
ctattactactaatataaat

SEQ ID NO: 57646 - DNA, 20 bp, Artificial Sequence
  Description of Artificial Sequence: Synthetic oligonucleotide
  Target: SCN9A; (-) strand; PAM type: YTN; PAM sequence: CTA
actactattactactaatat

SEQ ID NO: 57647 - DNA, 20 bp, Artificial Sequence
  Description of Artificial Sequence: Synthetic oligonucleotide
  Target: SCN9A; (-) strand; PAM type: YTN; PAM sequence: TTG
tcatactaactactattact

SEQ ID NO: 57648 - DNA, 20 bp, Artificial Sequence
  Description of Artificial Sequence: Synthetic oligonucleotide
  Target: SCN9A; (-) strand; PAM type: YTN; PAM sequence: TTG
gttgtcatactaactactat

SEQ ID NO: 57649 - DNA, 20 bp, Artificial Sequence
  Description of Artificial Sequence: Synthetic oligonucleotide
  Target: SCN9A; (-) strand; PAM type: YTN; PAM sequence: TTA
gtagcaaattggttgtcata

SEQ ID NO: 57650 - DNA, 20 bp, Artificial Sequence
  Description of Artificial Sequence: Synthetic oligonucleotide
  Target: SCN9A; (-) strand; PAM type: YTN; PAM sequence: TTT
agtagcaaattggttgtcat

SEQ ID NO: 57651 - DNA, 20 bp, Artificial Sequence
  Description of Artificial Sequence: Synthetic oligonucleotide
  Target: SCN9A; (-) strand; PAM type: YTN; PAM sequence: TTT
tagtagcaaattggttgtca

SEQ ID NO: 57652 - DNA, 20 bp, Artificial Sequence
  Description of Artificial Sequence: Synthetic oligonucleotide
  Target: SCN9A; (-) strand; PAM type: YTN; PAM sequence: TTT
ttagtagcaaattggttgtc

SEQ ID NO: 57653 - DNA, 20 bp, Artificial Sequence
  Description of Artificial Sequence: Synthetic oligonucleotide
  Target: SCN9A; (-) strand; PAM type: YTN; PAM sequence: TTA
catttttagtagcaaattgg

SEQ ID NO: 57654 - DNA, 20 bp, Artificial Sequence
  Description of Artificial Sequence: Synthetic oligonucleotide
  Target: SCN9A; (-) strand; PAM type: YTN; PAM sequence: CTT
acatttttagtagcaaattg

SEQ ID NO: 57655 - DNA, 20 bp, Artificial Sequence
  Description of Artificial Sequence: Synthetic oligonucleotide
  Target: SCN9A; (-) strand; PAM type: YTN; PAM sequence: TTC
ttacatttttagtagcaaat

SEQ ID NO: 57656 - DNA, 20 bp, Artificial Sequence
  Description of Artificial Sequence: Synthetic oligonucleotide
  Target: SCN9A; (-) strand; PAM type: YTN; PAM sequence: CTG
gattcttacatttttagtag

SEQ ID NO: 57657 - DNA, 20 bp, Artificial Sequence
  Description of Artificial Sequence: Synthetic oligonucleotide
  Target: SCN9A; (-) strand; PAM type: YTN; PAM sequence: CTG
tatgacacagaagtagcctg

SEQ ID NO: 57658 - DNA, 20 bp, Artificial Sequence
  Description of Artificial Sequence: Synthetic oligonucleotide
  Target: SCN9A; (-) strand; PAM type: YTN; PAM sequence: TTC
ctgtatgacacagaagtagc

SEQ ID NO: 57659 - DNA, 20 bp, Artificial Sequence
  Description of Artificial Sequence: Synthetic oligonucleotide
  Target: SCN9A; (-) strand; PAM type: YTN; PAM sequence: TTG
ttcctgtatgacacagaagt

SEQ ID NO: 57660 - DNA, 20 bp, Artificial Sequence
  Description of Artificial Sequence: Synthetic oligonucleotide
  Target: SCN9A; (-) strand; PAM type: YTN; PAM sequence: CTG
cattgttcctgtatgacaca

SEQ ID NO: 57661 - DNA, 20 bp, Artificial Sequence
  Description of Artificial Sequence: Synthetic oligonucleotide
  Target: SCN9A; (-) strand; PAM type: YTN; PAM sequence: TTC
atggagactgcattgttcct

SEQ ID NO: 57662 - DNA, 20 bp, Artificial Sequence
  Description of Artificial Sequence: Synthetic oligonucleotide
  Target: SCN9A; (-) strand; PAM type: YTN; PAM sequence: TTG
gttcatggagactgcattgt

SEQ ID NO: 57663 - DNA, 20 bp, Artificial Sequence
  Description of Artificial Sequence: Synthetic oligonucleotide
  Target: SCN9A; (-) strand; PAM type: YTN; PAM sequence: TTT
ggttcatggagactgcattg

SEQ ID NO: 57664 - DNA, 20 bp, Artificial Sequence
  Description of Artificial Sequence: Synthetic oligonucleotide
  Target: SCN9A; (-) strand; PAM type: YTN; PAM sequence: CTT
tggttcatggagactgcatt

SEQ ID NO: 57665 - DNA, 20 bp, Artificial Sequence
  Description of Artificial Sequence: Synthetic oligonucleotide
  Target: SCN9A; (-) strand; PAM type: YTN; PAM sequence: CTA
agagctttggttcatggaga

SEQ ID NO: 57666 - DNA, 20 bp, Artificial Sequence
  Description of Artificial Sequence: Synthetic oligonucleotide
  Target: SCN9A; (-) strand; PAM type: YTN; PAM sequence: TTA
agaggtggtgtagcatacat

SEQ ID NO: 57667 - DNA, 20 bp, Artificial Sequence
  Description of Artificial Sequence: Synthetic oligonucleotide
  Target: SCN9A; (-) strand; PAM type: YTN; PAM sequence: TTG
tgtaatagcattaagaggtg

SEQ ID NO: 57668 - DNA, 20 bp, Artificial Sequence
  Description of Artificial Sequence: Synthetic oligonucleotide
  Target: SCN9A; (-) strand; PAM type: YTN; PAM sequence: TTT
gtgtaatagcattaagaggt

SEQ ID NO: 57669 - DNA, 20 bp, Artificial Sequence
  Description of Artificial Sequence: Synthetic oligonucleotide
  Target: SCN9A; (-) strand; PAM type: YTN; PAM sequence: TTT
tgtgtaatagcattaagagg

SEQ ID NO: 57670 - DNA, 20 bp, Artificial Sequence
  Description of Artificial Sequence: Synthetic oligonucleotide
  Target: SCN9A; (-) strand; PAM type: YTN; PAM sequence: TTT
ttgtgtaatagcattaagag

SEQ ID NO: 57671 - DNA, 20 bp, Artificial Sequence
  Description of Artificial Sequence: Synthetic oligonucleotide
  Target: SCN9A; (-) strand; PAM type: YTN; PAM sequence: CTA
catttttgtgtaatagcatt

SEQ ID NO: 57672 - DNA, 20 bp, Artificial Sequence
  Description of Artificial Sequence: Synthetic oligonucleotide
  Target: SCN9A; (-) strand; PAM type: YTN; PAM sequence: CTA
gccacacagcgatgtctaca

SEQ ID NO: 57673 - DNA, 20 bp, Artificial Sequence
  Description of Artificial Sequence: Synthetic oligonucleotide
  Target: SCN9A; (-) strand; PAM type: YTN; PAM sequence: TTG
agacaggaagcaaaaatatg

SEQ ID NO: 57674 - DNA, 20 bp, Artificial Sequence
  Description of Artificial Sequence: Synthetic oligonucleotide
  Target: SCN9A; (-) strand; PAM type: YTN; PAM sequence: TTG
tgcaaagggagaaaattgag

SEQ ID NO: 57675 - DNA, 20 bp, Artificial Sequence
  Description of Artificial Sequence: Synthetic oligonucleotide
  Target: SCN9A; (-) strand; PAM type: YTN; PAM sequence: TTT
gtgcaaagggagaaaattga

SEQ ID NO: 57676 - DNA, 20 bp, Artificial Sequence
  Description of Artificial Sequence: Synthetic oligonucleotide
  Target: SCN9A; (-) strand; PAM type: YTN; PAM sequence: TTG
aaatccacatcaaggtttgt

SEQ ID NO: 57677 - DNA, 20 bp, Artificial Sequence
  Description of Artificial Sequence: Synthetic oligonucleotide
  Target: SCN9A; (-) strand; PAM type: YTN; PAM sequence: CTT
gaaatccacatcaaggtttg

SEQ ID NO: 57678 - DNA, 20 bp, Artificial Sequence
  Description of Artificial Sequence: Synthetic oligonucleotide
  Target: SCN9A; (-) strand; PAM type: YTN; PAM sequence: TTC
ttgaaatccacatcaaggtt

SEQ ID NO: 57679 - DNA, 20 bp, Artificial Sequence
  Description of Artificial Sequence: Synthetic oligonucleotide
  Target: SCN9A; (-) strand; PAM type: YTN; PAM sequence: TTT
cttgaaatccacatcaaggt

SEQ ID NO: 57680 - DNA, 20 bp, Artificial Sequence
  Description of Artificial Sequence: Synthetic oligonucleotide
  Target: SCN9A; (-) strand; PAM type: YTN; PAM sequence: TTC
caaagtaatttcttgaaatc

SEQ ID NO: 57681 - DNA, 20 bp, Artificial Sequence
  Description of Artificial Sequence: Synthetic oligonucleotide
  Target: SCN9A; (-) strand; PAM type: YTN; PAM sequence: CTA
gagttccaaagtaatttctt

SEQ ID NO: 57682 - DNA, 20 bp, Artificial Sequence
  Description of Artificial Sequence: Synthetic oligonucleotide
  Target: SCN9A; (-) strand; PAM type: YTN; PAM sequence: TTC
ccgggaaacaaagacaagga

SEQ ID NO: 57683 - DNA, 20 bp, Artificial Sequence
  Description of Artificial Sequence: Synthetic oligonucleotide
  Target: SCN9A; (-) strand; PAM type: YTN; PAM sequence: CTC
cataagaagtgttcccggga

SEQ ID NO: 57684 - DNA, 20 bp, Artificial Sequence
  Description of Artificial Sequence: Synthetic oligonucleotide
  Target: SCN9A; (-) strand; PAM type: YTN; PAM sequence: TTC
aaatgtcctccataagaagt

SEQ ID NO: 57685 - DNA, 20 bp, Artificial Sequence
  Description of Artificial Sequence: Synthetic oligonucleotide
  Target: SCN9A; (-) strand; PAM type: YTN; PAM sequence: CTT
caaatgtcctccataagaag

SEQ ID NO: 57686 - DNA, 20 bp, Artificial Sequence
  Description of Artificial Sequence: Synthetic oligonucleotide
  Target: SCN9A; (-) strand; PAM type: YTN; PAM sequence: TTG
aaaggacagcttcaaatgtc

SEQ ID NO: 57687 - DNA, 20 bp, Artificial Sequence
  Description of Artificial Sequence: Synthetic oligonucleotide
  Target: SCN9A; (-) strand; PAM type: YTN; PAM sequence: TTC
attgaaaggacagcttcaaa

SEQ ID NO: 57688 - DNA, 20 bp, Artificial Sequence
  Description of Artificial Sequence: Synthetic oligonucleotide
  Target: SCN9A; (-) strand; PAM type: YTN; PAM sequence: TTT
cattgaaaggacagcttcaa

SEQ ID NO: 57689 - DNA, 20 bp, Artificial Sequence
  Description of Artificial Sequence: Synthetic oligonucleotide
  Target: SCN9A; (-) strand; PAM type: YTN; PAM sequence: TTT
tcattgaaaggacagcttca

SEQ ID NO: 57690 - DNA, 20 bp, Artificial Sequence
  Description of Artificial Sequence: Synthetic oligonucleotide
  Target: SCN9A; (-) strand; PAM type: YTN; PAM sequence: CTT
ttcattgaaaggacagcttc

SEQ ID NO: 57691 - DNA, 20 bp, Artificial Sequence
  Description of Artificial Sequence: Synthetic oligonucleotide
  Target: SCN9A; (-) strand; PAM type: YTN; PAM sequence: TTC
cttttcattgaaaggacagc

SEQ ID NO: 57692 - DNA, 20 bp, Artificial Sequence
  Description of Artificial Sequence: Synthetic oligonucleotide
  Target: SCN9A; (-) strand; PAM type: YTN; PAM sequence: TTT
ccttttcattgaaaggacag

SEQ ID NO: 57693 - DNA, 20 bp, Artificial Sequence
  Description of Artificial Sequence: Synthetic oligonucleotide
  Target: SCN9A; (-) strand; PAM type: YTN; PAM sequence: TTT
tccttttcattgaaaggaca

SEQ ID NO: 57694 - DNA, 20 bp, Artificial Sequence
  Description of Artificial Sequence: Synthetic oligonucleotide
  Target: SCN9A; (-) strand; PAM type: YTN; PAM sequence: TTT
ttccttttcattgaaaggac

SEQ ID NO: 57695 - DNA, 20 bp, Artificial Sequence
  Description of Artificial Sequence: Synthetic oligonucleotide
  Target: SCN9A; (-) strand; PAM type: YTN; PAM sequence: CTT
tttccttttcattgaaagga

SEQ ID NO: 57696 - DNA, 20 bp, Artificial Sequence
  Description of Artificial Sequence: Synthetic oligonucleotide
  Target: SCN9A; (-) strand; PAM type: YTN; PAM sequence: CTG
atagctttttccttttcatt

SEQ ID NO: 57697 - DNA, 20 bp, Artificial Sequence
  Description of Artificial Sequence: Synthetic oligonucleotide
  Target: SCN9A; (-) strand; PAM type: YTN; PAM sequence: TTG
caacaactgatagctttttc

SEQ ID NO: 57698 - DNA, 20 bp, Artificial Sequence
  Description of Artificial Sequence: Synthetic oligonucleotide
  Target: SCN9A; (-) strand; PAM type: YTN; PAM sequence: CTA
aataagttgcaacaactgat

SEQ ID NO: 57699 - DNA, 20 bp, Artificial Sequence
  Description of Artificial Sequence: Synthetic oligonucleotide
  Target: SCN9A; (-) strand; PAM type: YTN; PAM sequence: TTA
gaataaccataggtgggtaa
